United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 140

SEQ ID NO: 5939703 - DNA, 18 bp, Homo sapiens
tatttggtctctatttca

SEQ ID NO: 5939704 - DNA, 17 bp, Homo sapiens
tatttggtgattacatt

SEQ ID NO: 5939705 - DNA, 22 bp, Homo sapiens
tatttggtgattacattttaaa

SEQ ID NO: 5939706 - DNA, 21 bp, Homo sapiens
tatttggtttggccatctctg

SEQ ID NO: 5939707 - DNA, 14 bp, Homo sapiens
tatttgtaaaaata

SEQ ID NO: 5939708 - DNA, 23 bp, Homo sapiens
tatttgtaaaatgacaatcatgt

SEQ ID NO: 5939709 - DNA, 15 bp, Homo sapiens
tatttgtaaaccatt

SEQ ID NO: 5939710 - DNA, 19 bp, Homo sapiens
tatttgtaaaccattgtaa

SEQ ID NO: 5939711 - DNA, 13 bp, Homo sapiens
tatttgtaaagct

SEQ ID NO: 5939712 - DNA, 17 bp, Homo sapiens
tatttgtaaatctgcca

SEQ ID NO: 5939713 - DNA, 20 bp, Homo sapiens
tatttgtaaatttagtgttt

SEQ ID NO: 5939714 - DNA, 16 bp, Homo sapiens
tatttgtaaatttatg

SEQ ID NO: 5939715 - DNA, 20 bp, Homo sapiens
tatttgtaacattgtaaagt

SEQ ID NO: 5939716 - DNA, 22 bp, Homo sapiens
tatttgtaacattgtaaagtat

SEQ ID NO: 5939717 - DNA, 20 bp, Homo sapiens
tatttgtaactttgcatgtt

SEQ ID NO: 5939718 - DNA, 23 bp, Homo sapiens
tatttgtaaggcttgttccaatg

SEQ ID NO: 5939719 - DNA, 15 bp, Homo sapiens
tatttgtaattaaaa

SEQ ID NO: 5939720 - DNA, 16 bp, Homo sapiens
tatttgtacaaataaa

SEQ ID NO: 5939721 - DNA, 17 bp, Homo sapiens
tatttgtacaaataaac

SEQ ID NO: 5939722 - DNA, 16 bp, Homo sapiens
tatttgtacaaatact

SEQ ID NO: 5939723 - DNA, 14 bp, Homo sapiens
tatttgtacaattt

SEQ ID NO: 5939724 - DNA, 16 bp, Homo sapiens
tatttgtactttctgt

SEQ ID NO: 5939725 - DNA, 22 bp, Homo sapiens
tatttgtagctagaatatccta

SEQ ID NO: 5939726 - DNA, 22 bp, Homo sapiens
tatttgtaggggaactcatttg

SEQ ID NO: 5939727 - DNA, 18 bp, Homo sapiens
tatttgtataaaagtgtg

SEQ ID NO: 5939728 - DNA, 15 bp, Homo sapiens
tatttgtatctctga

SEQ ID NO: 5939729 - DNA, 20 bp, Homo sapiens
tatttgtatgatattttaaa

SEQ ID NO: 5939730 - DNA, 11 bp, Homo sapiens
tatttgtatta

SEQ ID NO: 5939731 - DNA, 15 bp, Homo sapiens
tatttgtattagtaa

SEQ ID NO: 5939732 - DNA, 13 bp, Homo sapiens
tatttgtattccc

SEQ ID NO: 5939733 - DNA, 24 bp, Homo sapiens
tatttgtcatgacagtgcttgcat

SEQ ID NO: 5939734 - DNA, 13 bp, Homo sapiens
tatttgtctgtgt

SEQ ID NO: 5939735 - DNA, 15 bp, Homo sapiens
tatttgtctgtgtgc

SEQ ID NO: 5939736 - DNA, 16 bp, Homo sapiens
tatttgtctgtgtgct

SEQ ID NO: 5939737 - DNA, 23 bp, Homo sapiens
tatttgtctgtgtgctactaaca

SEQ ID NO: 5939738 - DNA, 23 bp, Homo sapiens
tatttgtcttaaaaaatgtgaaa

SEQ ID NO: 5939739 - DNA, 13 bp, Homo sapiens
tatttgtcttccg

SEQ ID NO: 5939740 - DNA, 17 bp, Homo sapiens
tatttgtctttaaacag

SEQ ID NO: 5939741 - DNA, 15 bp, Homo sapiens
tatttgtctttcagg

SEQ ID NO: 5939742 - DNA, 15 bp, Homo sapiens
tatttgtctttgaat

SEQ ID NO: 5939743 - DNA, 23 bp, Homo sapiens
tatttgtgaaactttaatgagga

SEQ ID NO: 5939744 - DNA, 20 bp, Homo sapiens
tatttgtgaattctgggatt

SEQ ID NO: 5939745 - DNA, 17 bp, Homo sapiens
tatttgtgactaattgt

SEQ ID NO: 5939746 - DNA, 21 bp, Homo sapiens
tatttgtgacttttaaaaata

SEQ ID NO: 5939747 - DNA, 18 bp, Homo sapiens
tatttgtgatagcacttt

SEQ ID NO: 5939748 - DNA, 18 bp, Homo sapiens
tatttgtgatgacaactg

SEQ ID NO: 5939749 - DNA, 21 bp, Homo sapiens
tatttgtgcacatgtacatat

SEQ ID NO: 5939750 - DNA, 18 bp, Homo sapiens
tatttgtgccgtaattat

SEQ ID NO: 5939751 - DNA, 21 bp, Homo sapiens
tatttgtgctatagtatttga

SEQ ID NO: 5939752 - DNA, 17 bp, Homo sapiens
tatttgtgtaactgaaa

SEQ ID NO: 5939753 - DNA, 17 bp, Homo sapiens
tatttgtgtaatagaaa

SEQ ID NO: 5939754 - DNA, 15 bp, Homo sapiens
tatttgtgtatttaa

SEQ ID NO: 5939755 - DNA, 19 bp, Homo sapiens
tatttgtgtattttcctgg

SEQ ID NO: 5939756 - DNA, 14 bp, Homo sapiens
tatttgtgttcagt

SEQ ID NO: 5939757 - DNA, 16 bp, Homo sapiens
tatttgtgttcagttc

SEQ ID NO: 5939758 - DNA, 22 bp, Homo sapiens
tatttgtgttgggggaaatgtt

SEQ ID NO: 5939759 - DNA, 19 bp, Homo sapiens
tatttgtgttttaatttaa

SEQ ID NO: 5939760 - DNA, 21 bp, Homo sapiens
tatttgtgttttaatttaaac

SEQ ID NO: 5939761 - DNA, 17 bp, Homo sapiens
tatttgttaaatattta

SEQ ID NO: 5939762 - DNA, 19 bp, Homo sapiens
tatttgttaatagttcctg

SEQ ID NO: 5939763 - DNA, 22 bp, Homo sapiens
tatttgttaatggtttgaatat

SEQ ID NO: 5939764 - DNA, 13 bp, Homo sapiens
tatttgttaattt

SEQ ID NO: 5939765 - DNA, 14 bp, Homo sapiens
tatttgttaatttc

SEQ ID NO: 5939766 - DNA, 24 bp, Homo sapiens
tatttgttatatataataaatact

SEQ ID NO: 5939767 - DNA, 14 bp, Homo sapiens
tatttgttcatgtt

SEQ ID NO: 5939768 - DNA, 16 bp, Homo sapiens
tatttgttcttataaa

SEQ ID NO: 5939769 - DNA, 19 bp, Homo sapiens
tatttgttgtttttaacaa

SEQ ID NO: 5939770 - DNA, 21 bp, Homo sapiens
tatttgtttatggtaaaaaat

SEQ ID NO: 5939771 - DNA, 13 bp, Homo sapiens
tatttgtttccct

SEQ ID NO: 5939772 - DNA, 14 bp, Homo sapiens
tatttgttttcatg

SEQ ID NO: 5939773 - DNA, 17 bp, Homo sapiens
tatttgtttttcattca

SEQ ID NO: 5939774 - DNA, 20 bp, Homo sapiens
tattttaaaaaaattcatca

SEQ ID NO: 5939775 - DNA, 13 bp, Homo sapiens
tattttaaaaaat

SEQ ID NO: 5939776 - DNA, 19 bp, Homo sapiens
tattttaaaaccatgcagc

SEQ ID NO: 5939777 - DNA, 14 bp, Homo sapiens
tattttaaaagcca

SEQ ID NO: 5939778 - DNA, 16 bp, Homo sapiens
tattttaaaataaact

SEQ ID NO: 5939779 - DNA, 20 bp, Homo sapiens
tattttaaaatagaggcttt

SEQ ID NO: 5939780 - DNA, 22 bp, Homo sapiens
tattttaaaatagcgttcttgt

SEQ ID NO: 5939781 - DNA, 19 bp, Homo sapiens
tattttaaaatatatgaag

SEQ ID NO: 5939782 - DNA, 22 bp, Homo sapiens
tattttaaaatatttaaacctt

SEQ ID NO: 5939783 - DNA, 19 bp, Homo sapiens
tattttaaaatctcctaaa

SEQ ID NO: 5939784 - DNA, 15 bp, Homo sapiens
tattttaaaattcat

SEQ ID NO: 5939785 - DNA, 14 bp, Homo sapiens
tattttaaaatttg

SEQ ID NO: 5939786 - DNA, 14 bp, Homo sapiens
tattttaaacaaaa

SEQ ID NO: 5939787 - DNA, 19 bp, Homo sapiens
tattttaaacaaaatagaa

SEQ ID NO: 5939788 - DNA, 22 bp, Homo sapiens
tattttaaagctgactttgttg

SEQ ID NO: 5939789 - DNA, 13 bp, Homo sapiens
tatttttgtaaac

SEQ ID NO: 5939790 - DNA, 16 bp, Homo sapiens
tatttttgtaatgtga

SEQ ID NO: 5939791 - DNA, 13 bp, Homo sapiens
tatttttgtagca

SEQ ID NO: 5939792 - DNA, 14 bp, Homo sapiens
tatttttgtagtga

SEQ ID NO: 5939793 - DNA, 23 bp, Homo sapiens
tatttttgtagtgacctgtttat

SEQ ID NO: 5939794 - DNA, 13 bp, Homo sapiens
tatttttgtataa

SEQ ID NO: 5939795 - DNA, 18 bp, Homo sapiens
tatttttgtatttctcta

SEQ ID NO: 5939796 - DNA, 13 bp, Homo sapiens
tatttttgtgtag

SEQ ID NO: 5939797 - DNA, 22 bp, Homo sapiens
tatttttgtgttttcttgtaaa

SEQ ID NO: 5939798 - DNA, 13 bp, Homo sapiens
tatttttgttaat

SEQ ID NO: 5939799 - DNA, 23 bp, Homo sapiens
tatttttgttaatcatcttctct

SEQ ID NO: 5939800 - DNA, 13 bp, Homo sapiens
tatttttgttgtt

SEQ ID NO: 5939801 - DNA, 21 bp, Homo sapiens
tattttttaaaaaatttgcgc

SEQ ID NO: 5939802 - DNA, 16 bp, Homo sapiens
tattttttaaaaatga

SEQ ID NO: 5939803 - DNA, 12 bp, Homo sapiens
tattttttaaag

SEQ ID NO: 5939804 - DNA, 16 bp, Homo sapiens
tattttttaaatcttg

SEQ ID NO: 5939805 - DNA, 17 bp, Homo sapiens
tattttttaacatgaaa

SEQ ID NO: 5939806 - DNA, 20 bp, Homo sapiens
tattttttaactcccaagca

SEQ ID NO: 5939807 - DNA, 12 bp, Homo sapiens
tattttttaaga

SEQ ID NO: 5939808 - DNA, 13 bp, Homo sapiens
tattttttaagtt

SEQ ID NO: 5939809 - DNA, 12 bp, Homo sapiens
tattttttaatt

SEQ ID NO: 5939810 - DNA, 20 bp, Homo sapiens
tattttttacaaacagatga

SEQ ID NO: 5939811 - DNA, 14 bp, Homo sapiens
tattttttactaca

SEQ ID NO: 5939812 - DNA, 14 bp, Homo sapiens
tattttttataaat

SEQ ID NO: 5939813 - DNA, 19 bp, Homo sapiens
tattttttatatctggaat

SEQ ID NO: 5939814 - DNA, 16 bp, Homo sapiens
tattttttatgttgta

SEQ ID NO: 5939815 - DNA, 16 bp, Homo sapiens
tattttttattaatat

SEQ ID NO: 5939816 - DNA, 21 bp, Homo sapiens
tattttttatttctaagtatt

SEQ ID NO: 5939817 - DNA, 13 bp, Homo sapiens
tattttttcccaa

SEQ ID NO: 5939818 - DNA, 14 bp, Homo sapiens
tattttttccttaa

SEQ ID NO: 5939819 - DNA, 16 bp, Homo sapiens
tattttttccttttgt

SEQ ID NO: 5939820 - DNA, 15 bp, Homo sapiens
tattttttctacaca

SEQ ID NO: 5939821 - DNA, 14 bp, Homo sapiens
tattttttctatga

SEQ ID NO: 5939822 - DNA, 19 bp, Homo sapiens
tattttttcttttctttac

SEQ ID NO: 5939823 - DNA, 22 bp, Homo sapiens
tattttttgaggctatgaatat

SEQ ID NO: 5939824 - DNA, 15 bp, Homo sapiens
tattttttggacttc

SEQ ID NO: 5939825 - DNA, 21 bp, Homo sapiens
tattttttggacttcaaagca

SEQ ID NO: 5939826 - DNA, 12 bp, Homo sapiens
tattttttgggc

SEQ ID NO: 5939827 - DNA, 13 bp, Homo sapiens
tattttttgggcc

SEQ ID NO: 5939828 - DNA, 22 bp, Homo sapiens
tattttttgggccattacccca

SEQ ID NO: 5939829 - DNA, 16 bp, Homo sapiens
tattttttgtaactct

SEQ ID NO: 5939830 - DNA, 14 bp, Homo sapiens
tattttttgtataa

SEQ ID NO: 5939831 - DNA, 17 bp, Homo sapiens
tattttttgtataattg

SEQ ID NO: 5939832 - DNA, 21 bp, Homo sapiens
tattttttgtatagtattgga

SEQ ID NO: 5939833 - DNA, 17 bp, Homo sapiens
tattttttgttgaaagt

SEQ ID NO: 5939834 - DNA, 15 bp, Homo sapiens
tatttttttaaaatt

SEQ ID NO: 5939835 - DNA, 21 bp, Homo sapiens
tatttttttaaatcaaggaaa

SEQ ID NO: 5939836 - DNA, 19 bp, Homo sapiens
tatttttttaactgtgata

SEQ ID NO: 5939837 - DNA, 17 bp, Homo sapiens
tatttttttaactttac

SEQ ID NO: 5939838 - DNA, 20 bp, Homo sapiens
tatttttttaccaattccaa

SEQ ID NO: 5939839 - DNA, 18 bp, Homo sapiens
tatttttttacttgagca

SEQ ID NO: 5939840 - DNA, 20 bp, Homo sapiens
tatttttttacttgagcaaa

SEQ ID NO: 5939841 - DNA, 14 bp, Homo sapiens
tatttttttattct

SEQ ID NO: 5939842 - DNA, 16 bp, Homo sapiens
tatttttttattcttc

SEQ ID NO: 5939843 - DNA, 14 bp, Homo sapiens
tatttttttctacc

SEQ ID NO: 5939844 - DNA, 23 bp, Homo sapiens
tatttttttctaccttgaggtct

SEQ ID NO: 5939845 - DNA, 14 bp, Homo sapiens
tatttttttctccc

SEQ ID NO: 5939846 - DNA, 16 bp, Homo sapiens
tatttttttctgaaat

SEQ ID NO: 5939847 - DNA, 17 bp, Homo sapiens
tatttttttctgaaatt

SEQ ID NO: 5939848 - DNA, 22 bp, Homo sapiens
tatttttttctgaattattttc

SEQ ID NO: 5939849 - DNA, 15 bp, Homo sapiens
tatttttttctgtaa

SEQ ID NO: 5939850 - DNA, 20 bp, Homo sapiens
tatttttttctttttaaaat

SEQ ID NO: 5939851 - DNA, 18 bp, Homo sapiens
tatttttttgatggctaa

SEQ ID NO: 5939852 - DNA, 13 bp, Homo sapiens
tatttttttgcaa

SEQ ID NO: 5939853 - DNA, 13 bp, Homo sapiens
tatttttttgtac

SEQ ID NO: 5939854 - DNA, 15 bp, Homo sapiens
tattttttttaaaga

SEQ ID NO: 5939855 - DNA, 18 bp, Homo sapiens
tattttttttaaatcaaa

SEQ ID NO: 5939856 - DNA, 14 bp, Homo sapiens
tattttttttcaaa

SEQ ID NO: 5939857 - DNA, 22 bp, Homo sapiens
tattttttttcaaaatgaagat

SEQ ID NO: 5939858 - DNA, 23 bp, Homo sapiens
tattttttttcaaaatgaagata

SEQ ID NO: 5939859 - DNA, 20 bp, Homo sapiens
tattttttttggcctgtttg

SEQ ID NO: 5939860 - DNA, 21 bp, Homo sapiens
tattttttttggcctgtttga

SEQ ID NO: 5939861 - DNA, 19 bp, Homo sapiens
tatttttttttctaagaga

SEQ ID NO: 5939862 - DNA, 20 bp, Homo sapiens
tattttttttttccattagt

SEQ ID NO: 5939863 - DNA, 19 bp, Homo sapiens
tattttttttttcttcttg

SEQ ID NO: 5939864 - DNA, 22 bp, Homo sapiens
tcaaaaaaaaaaaaaaaagcct

SEQ ID NO: 5939865 - DNA, 22 bp, Homo sapiens
tcaaaaaaaaaaaaaaagactg

SEQ ID NO: 5939866 - DNA, 19 bp, Homo sapiens
tcaaaaaaaaaaaaatgca

SEQ ID NO: 5939867 - DNA, 20 bp, Homo sapiens
tcaaaaaaaaaaaaatgcac

SEQ ID NO: 5939868 - DNA, 16 bp, Homo sapiens
tcaaaaaaaaaaaagt

SEQ ID NO: 5939869 - DNA, 14 bp, Homo sapiens
tcaaaaaaagaaaa

SEQ ID NO: 5939870 - DNA, 12 bp, Homo sapiens
tcaaaaaaatgt

SEQ ID NO: 5939871 - DNA, 14 bp, Homo sapiens
tcaaaaaacaaaaa

SEQ ID NO: 5939872 - DNA, 17 bp, Homo sapiens
tcaaaaaacagaaaaac

SEQ ID NO: 5939873 - DNA, 20 bp, Homo sapiens
tcaaaaaacagaaaaacaaa

SEQ ID NO: 5939874 - DNA, 14 bp, Homo sapiens
tcaaaaaacttgta

SEQ ID NO: 5939875 - DNA, 15 bp, Homo sapiens
tcaaaaaacttgtaa

SEQ ID NO: 5939876 - DNA, 18 bp, Homo sapiens
tcaaaaaatcatgtttat

SEQ ID NO: 5939877 - DNA, 16 bp, Homo sapiens
tcaaaaacaaactagg

SEQ ID NO: 5939878 - DNA, 23 bp, Homo sapiens
tcaaaaacacagtgtttttgtaa

SEQ ID NO: 5939879 - DNA, 23 bp, Homo sapiens
tcaaaaacactctcactatgctg

SEQ ID NO: 5939880 - DNA, 15 bp, Homo sapiens
tcaaaaacattctta

SEQ ID NO: 5939881 - DNA, 21 bp, Homo sapiens
tcaaaaaccattacaaaatct

SEQ ID NO: 5939882 - DNA, 17 bp, Homo sapiens
tcaaaaactaaaatcat

SEQ ID NO: 5939883 - DNA, 23 bp, Homo sapiens
tcaaaaactaaaatcattgtcaa

SEQ ID NO: 5939884 - DNA, 14 bp, Homo sapiens
tcaaaaacttttgc

SEQ ID NO: 5939885 - DNA, 12 bp, Homo sapiens
tcaaaaagaacc

SEQ ID NO: 5939886 - DNA, 16 bp, Homo sapiens
tcaaaaagcagagtgg

SEQ ID NO: 5939887 - DNA, 12 bp, Homo sapiens
tcaaaaagccac

SEQ ID NO: 5939888 - DNA, 19 bp, Homo sapiens
tcaaaaagctaatgtgcag

SEQ ID NO: 5939889 - DNA, 14 bp, Homo sapiens
tcaaaaagctgcta

SEQ ID NO: 5939890 - DNA, 21 bp, Homo sapiens
tcaaaaaggcttataaaacag

SEQ ID NO: 5939891 - DNA, 20 bp, Homo sapiens
tcaaaaagggaagtaagcaa

SEQ ID NO: 5939892 - DNA, 18 bp, Homo sapiens
tcaaaaaggtgtgtcaaa

SEQ ID NO: 5939893 - DNA, 19 bp, Homo sapiens
tcaaaaagtgtttattttt

SEQ ID NO: 5939894 - DNA, 23 bp, Homo sapiens
tcaaaaagtgtttatttttcata

SEQ ID NO: 5939895 - DNA, 20 bp, Homo sapiens
tcaaaaataaaaaatctgaa

SEQ ID NO: 5939896 - DNA, 13 bp, Homo sapiens
tcaaaaataaact

SEQ ID NO: 5939897 - DNA, 15 bp, Homo sapiens
tcaaaaataaactag

SEQ ID NO: 5939898 - DNA, 18 bp, Homo sapiens
tcaaaaataaactagttt

SEQ ID NO: 5939899 - DNA, 19 bp, Homo sapiens
tcaaaaataaactagtttc

SEQ ID NO: 5939900 - DNA, 14 bp, Homo sapiens
tcaaaaatacaaaa

SEQ ID NO: 5939901 - DNA, 15 bp, Homo sapiens
tcaaaaatacaaaat

SEQ ID NO: 5939902 - DNA, 12 bp, Homo sapiens
tcaaaaatattt

SEQ ID NO: 5939903 - DNA, 14 bp, Homo sapiens
tcaaaaatattttt

SEQ ID NO: 5939904 - DNA, 14 bp, Homo sapiens
tcaaaaatcatcaa

SEQ ID NO: 5939905 - DNA, 15 bp, Homo sapiens
tcaaaaatcatcaaa

SEQ ID NO: 5939906 - DNA, 20 bp, Homo sapiens
tcaaaaatcattaacacttt

SEQ ID NO: 5939907 - DNA, 13 bp, Homo sapiens
tcaaaaatctgaa

SEQ ID NO: 5939908 - DNA, 15 bp, Homo sapiens
tcaaaaatctgaaga

SEQ ID NO: 5939909 - DNA, 17 bp, Homo sapiens
tcaaaaatctgaagatt

SEQ ID NO: 5939910 - DNA, 18 bp, Homo sapiens
tcaaaaatctgaagattg

SEQ ID NO: 5939911 - DNA, 12 bp, Homo sapiens
tcaaaaatgctg

SEQ ID NO: 5939912 - DNA, 12 bp, Homo sapiens
tcaaaaattaaa

SEQ ID NO: 5939913 - DNA, 13 bp, Homo sapiens
tcaaaaatttctg

SEQ ID NO: 5939914 - DNA, 18 bp, Homo sapiens
tcaaaaattttgaatgta

SEQ ID NO: 5939915 - DNA, 12 bp, Homo sapiens
tcaaaacaaaac

SEQ ID NO: 5939916 - DNA, 22 bp, Homo sapiens
tcaaaacaaccactttctcagg

SEQ ID NO: 5939917 - DNA, 20 bp, Homo sapiens
tcaaaacaaccatcctgctc

SEQ ID NO: 5939918 - DNA, 20 bp, Homo sapiens
tcaaaacaatattactttgt

SEQ ID NO: 5939919 - DNA, 13 bp, Homo sapiens
tcaaaacactgtg

SEQ ID NO: 5939920 - DNA, 15 bp, Homo sapiens
tcaaaacactgtgga

SEQ ID NO: 5939921 - DNA, 16 bp, Homo sapiens
tcaaaacactgtggaa

SEQ ID NO: 5939922 - DNA, 17 bp, Homo sapiens
tcaaaacactgtggaac

SEQ ID NO: 5939923 - DNA, 19 bp, Homo sapiens
tcaaaacacttccagtctg

SEQ ID NO: 5939924 - DNA, 21 bp, Homo sapiens
tcaaaacagaagcagcttctt

SEQ ID NO: 5939925 - DNA, 16 bp, Homo sapiens
tcaaaacagagggctg

SEQ ID NO: 5939926 - DNA, 13 bp, Homo sapiens
tcaaaacatatca

SEQ ID NO: 5939927 - DNA, 15 bp, Homo sapiens
tcaaaacatatcaat

SEQ ID NO: 5939928 - DNA, 19 bp, Homo sapiens
tcaaaacatatcaattcaa

SEQ ID NO: 5939929 - DNA, 15 bp, Homo sapiens
tcaaaacattccaag

SEQ ID NO: 5939930 - DNA, 17 bp, Homo sapiens
tcaaaaccaagtatcac

SEQ ID NO: 5939931 - DNA, 15 bp, Homo sapiens
tcaaaacctgcagtt

SEQ ID NO: 5939932 - DNA, 18 bp, Homo sapiens
tcaaaacctgcagttaac

SEQ ID NO: 5939933 - DNA, 21 bp, Homo sapiens
tcaaaacctggagatgcagct

SEQ ID NO: 5939934 - DNA, 16 bp, Homo sapiens
tcaaaacctgtgccag

SEQ ID NO: 5939935 - DNA, 14 bp, Homo sapiens
tcaaaaccttcctt

SEQ ID NO: 5939936 - DNA, 15 bp, Homo sapiens
tcaaaaccttttgaa

SEQ ID NO: 5939937 - DNA, 18 bp, Homo sapiens
tcaaaacggggcagccaa

SEQ ID NO: 5939938 - DNA, 14 bp, Homo sapiens
tcaaaactcaaatg

SEQ ID NO: 5939939 - DNA, 18 bp, Homo sapiens
tcaaaactccactcagca

SEQ ID NO: 5939940 - DNA, 13 bp, Homo sapiens
tcaaaactgcact

SEQ ID NO: 5939941 - DNA, 13 bp, Homo sapiens
tcaaaacttaaga

SEQ ID NO: 5939942 - DNA, 21 bp, Homo sapiens
tcaaaacttggacccttggaa

SEQ ID NO: 5939943 - DNA, 22 bp, Homo sapiens
tcaaaacttggacccttggaaa

SEQ ID NO: 5939944 - DNA, 16 bp, Homo sapiens
tcaaaactttcagctg

SEQ ID NO: 5939945 - DNA, 13 bp, Homo sapiens
tcaaaagaaaatg

SEQ ID NO: 5939946 - DNA, 18 bp, Homo sapiens
tcaaaagaaagaaaatca

SEQ ID NO: 5939947 - DNA, 14 bp, Homo sapiens
tcaaaagaaagaga

SEQ ID NO: 5939948 - DNA, 21 bp, Homo sapiens
tcaaaagaaatagaaaaggaa

SEQ ID NO: 5939949 - DNA, 20 bp, Homo sapiens
tcaaaagaagggtaagtgct

SEQ ID NO: 5939950 - DNA, 21 bp, Homo sapiens
tcaaaagaatctattagattt

SEQ ID NO: 5939951 - DNA, 16 bp, Homo sapiens
tcaaaagacaaacatg

SEQ ID NO: 5939952 - DNA, 18 bp, Homo sapiens
tcaaaagacaattcttta

SEQ ID NO: 5939953 - DNA, 19 bp, Homo sapiens
tcaaaagacaattctttat

SEQ ID NO: 5939954 - DNA, 17 bp, Homo sapiens
tcaaaagacatgttgta

SEQ ID NO: 5939955 - DNA, 16 bp, Homo sapiens
tcaaaagagatgaaag

SEQ ID NO: 5939956 - DNA, 20 bp, Homo sapiens
tcaaaagagcactttaataa

SEQ ID NO: 5939957 - DNA, 16 bp, Homo sapiens
tcaaaagagccctggc

SEQ ID NO: 5939958 - DNA, 18 bp, Homo sapiens
tcaaaagagccctggctc

SEQ ID NO: 5939959 - DNA, 19 bp, Homo sapiens
tcaaaagagccctggctct

SEQ ID NO: 5939960 - DNA, 17 bp, Homo sapiens
tcaaaagaggttacttt

SEQ ID NO: 5939961 - DNA, 19 bp, Homo sapiens
tcaaaagatccttcatttt

SEQ ID NO: 5939962 - DNA, 17 bp, Homo sapiens
tcaaaagattgttttat

SEQ ID NO: 5939963 - DNA, 21 bp, Homo sapiens
tcaaaagcacaaaccctgggg

SEQ ID NO: 5939964 - DNA, 23 bp, Homo sapiens
tcaaaagcacttgttccttctgc

SEQ ID NO: 5939965 - DNA, 13 bp, Homo sapiens
tcaaaagcattta

SEQ ID NO: 5939966 - DNA, 11 bp, Homo sapiens
tcaaaagccaa

SEQ ID NO: 5939967 - DNA, 13 bp, Homo sapiens
tcaaaagccaaaa

SEQ ID NO: 5939968 - DNA, 18 bp, Homo sapiens
tcaaaagccataacttga

SEQ ID NO: 5939969 - DNA, 16 bp, Homo sapiens
tcaaatacacatttgc

SEQ ID NO: 5939970 - DNA, 20 bp, Homo sapiens
tcaaatacagcatttctttg

SEQ ID NO: 5939971 - DNA, 19 bp, Homo sapiens
tcaaatacagtagtataat

SEQ ID NO: 5939972 - DNA, 13 bp, Homo sapiens
tcaaatacatgca

SEQ ID NO: 5939973 - DNA, 15 bp, Homo sapiens
tcaaatacatgcaca

SEQ ID NO: 5939974 - DNA, 22 bp, Homo sapiens
tcaaatacgtgggcattcaaat

SEQ ID NO: 5939975 - DNA, 23 bp, Homo sapiens
tcaaatacgtgggcattcaaatg

SEQ ID NO: 5939976 - DNA, 18 bp, Homo sapiens
tcaaatacttcaaatcat

SEQ ID NO: 5939977 - DNA, 12 bp, Homo sapiens
tcaaatagattt

SEQ ID NO: 5939978 - DNA, 16 bp, Homo sapiens
tcaaatagcaaggcca

SEQ ID NO: 5939979 - DNA, 23 bp, Homo sapiens
tcaaataggctattaaaaaagtc

SEQ ID NO: 5939980 - DNA, 14 bp, Homo sapiens
tcaaatagtataga

SEQ ID NO: 5939981 - DNA, 15 bp, Homo sapiens
tcaaatagttgcata

SEQ ID NO: 5939982 - DNA, 13 bp, Homo sapiens
tcaaatatagaaa

SEQ ID NO: 5939983 - DNA, 14 bp, Homo sapiens
tcaaatatatttaa

SEQ ID NO: 5939984 - DNA, 17 bp, Homo sapiens
tcaaatatatttaacta

SEQ ID NO: 5939985 - DNA, 18 bp, Homo sapiens
tcaaatatatttaactat

SEQ ID NO: 5939986 - DNA, 20 bp, Homo sapiens
tcaaatatcatttactcttc

SEQ ID NO: 5939987 - DNA, 15 bp, Homo sapiens
tcaaatatctcagag

SEQ ID NO: 5939988 - DNA, 21 bp, Homo sapiens
tcaaatatgagtacaaatgcc

SEQ ID NO: 5939989 - DNA, 14 bp, Homo sapiens
tcaaatatgcaaag

SEQ ID NO: 5939990 - DNA, 16 bp, Homo sapiens
tcaaatatgcaaagca

SEQ ID NO: 5939991 - DNA, 18 bp, Homo sapiens
tcaaatatgcaaagcact

SEQ ID NO: 5939992 - DNA, 13 bp, Homo sapiens
tcaaatatgtaaa

SEQ ID NO: 5939993 - DNA, 17 bp, Homo sapiens
tcaaatatgtaaacttt

SEQ ID NO: 5939994 - DNA, 14 bp, Homo sapiens
tcaaatattagatg

SEQ ID NO: 5939995 - DNA, 15 bp, Homo sapiens
tcaaatattagatgt

SEQ ID NO: 5939996 - DNA, 19 bp, Homo sapiens
tcaaatattagatgtgatt

SEQ ID NO: 5939997 - DNA, 13 bp, Homo sapiens
tcaaatattgaat

SEQ ID NO: 5939998 - DNA, 17 bp, Homo sapiens
tcaaatattgaatgcct

SEQ ID NO: 5939999 - DNA, 17 bp, Homo sapiens
tcaaatatttattggat

SEQ ID NO: 5940000 - DNA, 17 bp, Homo sapiens
tcaaatcaaaaacaggc

SEQ ID NO: 5940001 - DNA, 14 bp, Homo sapiens
tcaaatcaactgaa

SEQ ID NO: 5940002 - DNA, 14 bp, Homo sapiens
tcaaatcagagcag

SEQ ID NO: 5940003 - DNA, 23 bp, Homo sapiens
tcaaatcaggctactagaattct

SEQ ID NO: 5940004 - DNA, 16 bp, Homo sapiens
tcaaatcaggttttct

SEQ ID NO: 5940005 - DNA, 15 bp, Homo sapiens
tcaaatcagtcagtg

SEQ ID NO: 5940006 - DNA, 18 bp, Homo sapiens
tcaaatcagtgatctatg

SEQ ID NO: 5940007 - DNA, 19 bp, Homo sapiens
tcaaatcagtgatctatgt

SEQ ID NO: 5940008 - DNA, 13 bp, Homo sapiens
tcaaatcatcatt

SEQ ID NO: 5940009 - DNA, 14 bp, Homo sapiens
tcaaatcatcatta

SEQ ID NO: 5940010 - DNA, 18 bp, Homo sapiens
tcaaatcattcaaaactt

SEQ ID NO: 5940011 - DNA, 14 bp, Homo sapiens
tcaaatcattcctt

SEQ ID NO: 5940012 - DNA, 17 bp, Homo sapiens
tcaaatccaaaatggtt

SEQ ID NO: 5940013 - DNA, 22 bp, Homo sapiens
tcaaatccacccatatgttaaa

SEQ ID NO: 5940014 - DNA, 18 bp, Homo sapiens
tcaaatccactagtattt

SEQ ID NO: 5940015 - DNA, 19 bp, Homo sapiens
tcaaatccaggaccctgcc

SEQ ID NO: 5940016 - DNA, 13 bp, Homo sapiens
tcaaatccagtgg

SEQ ID NO: 5940017 - DNA, 14 bp, Homo sapiens
tcaaatccagtggt

SEQ ID NO: 5940018 - DNA, 15 bp, Homo sapiens
tcaaatccagtggtg

SEQ ID NO: 5940019 - DNA, 20 bp, Homo sapiens
tcaaatccagtggtgggtaa

SEQ ID NO: 5940020 - DNA, 22 bp, Homo sapiens
tcaaatccagtggtgggtaatt

SEQ ID NO: 5940021 - DNA, 15 bp, Homo sapiens
tcaaatccatgtgtc

SEQ ID NO: 5940022 - DNA, 20 bp, Homo sapiens
tcaaatcccaaaccattact

SEQ ID NO: 5940023 - DNA, 14 bp, Homo sapiens
tcaaatcctctttt

SEQ ID NO: 5940024 - DNA, 19 bp, Homo sapiens
tcaaatcctgccactgttt

SEQ ID NO: 5940025 - DNA, 16 bp, Homo sapiens
tcaaatccttccaaaa

SEQ ID NO: 5940026 - DNA, 19 bp, Homo sapiens
tcaaatccttccaaaaatt

SEQ ID NO: 5940027 - DNA, 22 bp, Homo sapiens
tcaaatccttccaaaaattatt

SEQ ID NO: 5940028 - DNA, 17 bp, Homo sapiens
tcaaatccttgagcact

SEQ ID NO: 5940029 - DNA, 20 bp, Homo sapiens
tcaaatctaccactgtatga

SEQ ID NO: 5940030 - DNA, 16 bp, Homo sapiens
tcaaatctattcagac

SEQ ID NO: 5940031 - DNA, 16 bp, Homo sapiens
tcaaatctccagtatt

SEQ ID NO: 5940032 - DNA, 18 bp, Homo sapiens
tcaaatctcccacaagta

SEQ ID NO: 5940033 - DNA, 20 bp, Homo sapiens
tcaaatctcccacaagtata

SEQ ID NO: 5940034 - DNA, 23 bp, Homo sapiens
tcaaatctctccacctctagtca

SEQ ID NO: 5940035 - DNA, 13 bp, Homo sapiens
tcaaatctgagcc

SEQ ID NO: 5940036 - DNA, 15 bp, Homo sapiens
tcaaatctgctttca

SEQ ID NO: 5940037 - DNA, 17 bp, Homo sapiens
tcaaatctggtccatat

SEQ ID NO: 5940038 - DNA, 14 bp, Homo sapiens
tcaaatcttaagag

SEQ ID NO: 5940039 - DNA, 22 bp, Homo sapiens
tcaaatgaaaggattctctaat

SEQ ID NO: 5940040 - DNA, 12 bp, Homo sapiens
tcaaatgaacac

SEQ ID NO: 5940041 - DNA, 14 bp, Homo sapiens
tcaaatgaactttt

SEQ ID NO: 5940042 - DNA, 16 bp, Homo sapiens
tcaaatgaaggtggtt

SEQ ID NO: 5940043 - DNA, 19 bp, Homo sapiens
tcaaatgaataatgccttt

SEQ ID NO: 5940044 - DNA, 15 bp, Homo sapiens
tcaaatgacccaaag

SEQ ID NO: 5940045 - DNA, 16 bp, Homo sapiens
tcaaatgacccaaaga

SEQ ID NO: 5940046 - DNA, 16 bp, Homo sapiens
tcaaatgagtaacatt

SEQ ID NO: 5940047 - DNA, 17 bp, Homo sapiens
tcaaatgagtttaaaaa

SEQ ID NO: 5940048 - DNA, 22 bp, Homo sapiens
tcaaatgagtttaaaaaaataa

SEQ ID NO: 5940049 - DNA, 16 bp, Homo sapiens
tcaaatgatcctccca

SEQ ID NO: 5940050 - DNA, 16 bp, Homo sapiens
tcaaatgatccttcct

SEQ ID NO: 5940051 - DNA, 15 bp, Homo sapiens
tcaaatgatgtgcaa

SEQ ID NO: 5940052 - DNA, 19 bp, Homo sapiens
tcaaatgatttcatattga

SEQ ID NO: 5940053 - DNA, 10 bp, Homo sapiens
tcaaatgcat

SEQ ID NO: 5940054 - DNA, 12 bp, Homo sapiens
tcaaatgccaaa

SEQ ID NO: 5940055 - DNA, 23 bp, Homo sapiens
tcaaatgcgcgtgtgcacgtgtg

SEQ ID NO: 5940056 - DNA, 13 bp, Homo sapiens
tcaaatgctaaat

SEQ ID NO: 5940057 - DNA, 15 bp, Homo sapiens
tcaaatgctgttagt

SEQ ID NO: 5940058 - DNA, 14 bp, Homo sapiens
tcaaatgggaaaaa

SEQ ID NO: 5940059 - DNA, 18 bp, Homo sapiens
tcaaatgggctgctgctt

SEQ ID NO: 5940060 - DNA, 15 bp, Homo sapiens
tcaaatgggtgatat

SEQ ID NO: 5940061 - DNA, 15 bp, Homo sapiens
tcaaatggtattttt

SEQ ID NO: 5940062 - DNA, 20 bp, Homo sapiens
tcaaatggtattttttgtga

SEQ ID NO: 5940063 - DNA, 15 bp, Homo sapiens
tcaaatggtgtcatg

SEQ ID NO: 5940064 - DNA, 15 bp, Homo sapiens
tcaaatgtaaagttt

SEQ ID NO: 5940065 - DNA, 16 bp, Homo sapiens
tcaaatgtaaatttac

SEQ ID NO: 5940066 - DNA, 13 bp, Homo sapiens
tcaaatgtatatt

SEQ ID NO: 5940067 - DNA, 19 bp, Homo sapiens
tcaaatgtatatttaactt

SEQ ID NO: 5940068 - DNA, 18 bp, Homo sapiens
tcaaatgtgcaatttgta

SEQ ID NO: 5940069 - DNA, 21 bp, Homo sapiens
tcaaatgtgcaatttgtaaat

SEQ ID NO: 5940070 - DNA, 12 bp, Homo sapiens
tcaaatgtgtaa

SEQ ID NO: 5940071 - DNA, 12 bp, Homo sapiens
tcaaatgtgtac

SEQ ID NO: 5940072 - DNA, 15 bp, Homo sapiens
tcaaatgttacaaaa

SEQ ID NO: 5940073 - DNA, 18 bp, Homo sapiens
tcaaatgttacagtttat

SEQ ID NO: 5940074 - DNA, 20 bp, Homo sapiens
tcaaatgttagagtttaatt

SEQ ID NO: 5940075 - DNA, 19 bp, Homo sapiens
tcaaatgttagatattgct

SEQ ID NO: 5940076 - DNA, 19 bp, Homo sapiens
tcaaatgttctaagtttct

SEQ ID NO: 5940077 - DNA, 20 bp, Homo sapiens
tcaaatgttctaagtttcta

SEQ ID NO: 5940078 - DNA, 22 bp, Homo sapiens
tcaaatgttctaagtttctaag

SEQ ID NO: 5940079 - DNA, 20 bp, Homo sapiens
tcaaatgtttaatcatataa

SEQ ID NO: 5940080 - DNA, 17 bp, Homo sapiens
tcaaatgtttccttaaa

SEQ ID NO: 5940081 - DNA, 22 bp, Homo sapiens
tcaaatgtttccttaaacatga

SEQ ID NO: 5940082 - DNA, 23 bp, Homo sapiens
tcaaatgtttccttaaacatgaa

SEQ ID NO: 5940083 - DNA, 16 bp, Homo sapiens
tcaaatgttttctgca

SEQ ID NO: 5940084 - DNA, 12 bp, Homo sapiens
tcaaattaaaaa

SEQ ID NO: 5940085 - DNA, 20 bp, Homo sapiens
tcaaattaaaaaagctgctg

SEQ ID NO: 5940086 - DNA, 20 bp, Homo sapiens
tcaaattaaaacagctgcat

SEQ ID NO: 5940087 - DNA, 18 bp, Homo sapiens
tcaaattaaagtgctgtt

SEQ ID NO: 5940088 - DNA, 20 bp, Homo sapiens
tcaaattaagattctctgcc

SEQ ID NO: 5940089 - DNA, 22 bp, Homo sapiens
tcaaattaagattctctgccca

SEQ ID NO: 5940090 - DNA, 23 bp, Homo sapiens
tcaaattaatctttctttacctg

SEQ ID NO: 5940091 - DNA, 15 bp, Homo sapiens
tcaaattaattgtgt

SEQ ID NO: 5940092 - DNA, 16 bp, Homo sapiens
tcaaattaattgtgtg

SEQ ID NO: 5940093 - DNA, 12 bp, Homo sapiens
tcaaattactaa

SEQ ID NO: 5940094 - DNA, 15 bp, Homo sapiens
tcaaattactaatga

SEQ ID NO: 5940095 - DNA, 15 bp, Homo sapiens
tcaaattagaagaca

SEQ ID NO: 5940096 - DNA, 16 bp, Homo sapiens
tcaaattagaagacat

SEQ ID NO: 5940097 - DNA, 10 bp, Homo sapiens
tcaaattatt

SEQ ID NO: 5940098 - DNA, 13 bp, Homo sapiens
tcaaattcaaata

SEQ ID NO: 5940099 - DNA, 19 bp, Homo sapiens
tcaaattcaaggccttcca

SEQ ID NO: 5940100 - DNA, 22 bp, Homo sapiens
tcaaattcacgttctagtgaaa

SEQ ID NO: 5940101 - DNA, 14 bp, Homo sapiens
tcaaattcagctct

SEQ ID NO: 5940102 - DNA, 15 bp, Homo sapiens
tcaaattcagctctg

SEQ ID NO: 5940103 - DNA, 16 bp, Homo sapiens
tcaaattcctgcaaaa

SEQ ID NO: 5940104 - DNA, 22 bp, Homo sapiens
tcaaattcctgcaaaattacct

SEQ ID NO: 5940105 - DNA, 16 bp, Homo sapiens
tcaaattctcaaccta

SEQ ID NO: 5940106 - DNA, 23 bp, Homo sapiens
tcaaattctctatgtacagatga

SEQ ID NO: 5940107 - DNA, 14 bp, Homo sapiens
tcaaattctcttct

SEQ ID NO: 5940108 - DNA, 22 bp, Homo sapiens
tcaaattctgattattacaaca

SEQ ID NO: 5940109 - DNA, 14 bp, Homo sapiens
tcaaattctgtctg

SEQ ID NO: 5940110 - DNA, 15 bp, Homo sapiens
tcaaattctgtctgg

SEQ ID NO: 5940111 - DNA, 16 bp, Homo sapiens
tcaaattcttctgaac

SEQ ID NO: 5940112 - DNA, 23 bp, Homo sapiens
tcaaattctttttttattattat

SEQ ID NO: 5940113 - DNA, 23 bp, Homo sapiens
tcaaattgaatttgcacggtttg

SEQ ID NO: 5940114 - DNA, 13 bp, Homo sapiens
tcaaattgcttaa

SEQ ID NO: 5940115 - DNA, 20 bp, Homo sapiens
tcaaattggactttcaaaat

SEQ ID NO: 5940116 - DNA, 23 bp, Homo sapiens
tcaaattggctacaatcttggag

SEQ ID NO: 5940117 - DNA, 20 bp, Homo sapiens
tcaaattgtaagcatgcaca

SEQ ID NO: 5940118 - DNA, 14 bp, Homo sapiens
tcaaattgtatcta

SEQ ID NO: 5940119 - DNA, 18 bp, Homo sapiens
tcaaattgtgcaaaatat

SEQ ID NO: 5940120 - DNA, 22 bp, Homo sapiens
tcaaattgtgcagtactttgtg

SEQ ID NO: 5940121 - DNA, 15 bp, Homo sapiens
tcaaattgtgtgaaa

SEQ ID NO: 5940122 - DNA, 19 bp, Homo sapiens
tcaaatttactgtcttaaa

SEQ ID NO: 5940123 - DNA, 15 bp, Homo sapiens
tcaaatttactttaa

SEQ ID NO: 5940124 - DNA, 18 bp, Homo sapiens
tcaaatttatttccaatg

SEQ ID NO: 5940125 - DNA, 23 bp, Homo sapiens
tcaaatttattttaatgtaaaga

SEQ ID NO: 5940126 - DNA, 14 bp, Homo sapiens
tcaaatttctaaat

SEQ ID NO: 5940127 - DNA, 15 bp, Homo sapiens
tcaaatttgccacca

SEQ ID NO: 5940128 - DNA, 22 bp, Homo sapiens
tcaaatttgtctggttaaaaaa

SEQ ID NO: 5940129 - DNA, 14 bp, Homo sapiens
tcaaatttgtgtca

SEQ ID NO: 5940130 - DNA, 13 bp, Homo sapiens
tcaaattttaagt

SEQ ID NO: 5940131 - DNA, 14 bp, Homo sapiens
tcaaattttatctg

SEQ ID NO: 5940132 - DNA, 22 bp, Homo sapiens
tcaaattttatctgcctctctt

SEQ ID NO: 5940133 - DNA, 13 bp, Homo sapiens
tcaaattttgtac

SEQ ID NO: 5940134 - DNA, 23 bp, Homo sapiens
tcaaatttttaagtaatttcatg

SEQ ID NO: 5940135 - DNA, 13 bp, Homo sapiens
tcaaatttttcat

SEQ ID NO: 5940136 - DNA, 15 bp, Homo sapiens
tcaaatttttcatct

SEQ ID NO: 5940137 - DNA, 21 bp, Homo sapiens
tcaaattttttaaaagagaca

SEQ ID NO: 5940138 - DNA, 16 bp, Homo sapiens
tcaaattttttgactt

SEQ ID NO: 5940139 - DNA, 17 bp, Homo sapiens
tcaaatttttttttaac

SEQ ID NO: 5940140 - DNA, 20 bp, Homo sapiens
tcaaatttttttttaacgtg

SEQ ID NO: 5940141 - DNA, 13 bp, Homo sapiens
tcaacaaaaagac

SEQ ID NO: 5940142 - DNA, 15 bp, Homo sapiens
tcaacaaaaagacat

SEQ ID NO: 5940143 - DNA, 16 bp, Homo sapiens
tcaacaaaaagacatg

SEQ ID NO: 5940144 - DNA, 15 bp, Homo sapiens
tcaacaaacagtgta

SEQ ID NO: 5940145 - DNA, 12 bp, Homo sapiens
tcaacaaacatt

SEQ ID NO: 5940146 - DNA, 14 bp, Homo sapiens
tcaacaaactgcaa

SEQ ID NO: 5940147 - DNA, 20 bp, Homo sapiens
tcaacaaagaaacaaagatg

SEQ ID NO: 5940148 - DNA, 12 bp, Homo sapiens
tcaagcaacaag

SEQ ID NO: 5940149 - DNA, 16 bp, Homo sapiens
tcaagcaacagcactt

SEQ ID NO: 5940150 - DNA, 23 bp, Homo sapiens
tcaagcaagatgagctgtgcgct

SEQ ID NO: 5940151 - DNA, 20 bp, Homo sapiens
tcaagcaatccacctgcctt

SEQ ID NO: 5940152 - DNA, 22 bp, Homo sapiens
tcaagcaatccacctgccttgg

SEQ ID NO: 5940153 - DNA, 19 bp, Homo sapiens
tcaagcaatcctcctacct

SEQ ID NO: 5940154 - DNA, 17 bp, Homo sapiens
tcaagcaatcctcctgc

SEQ ID NO: 5940155 - DNA, 18 bp, Homo sapiens
tcaagcaatcctcctgcc

SEQ ID NO: 5940156 - DNA, 19 bp, Homo sapiens
tcaagcaatcctcctgcct

SEQ ID NO: 5940157 - DNA, 20 bp, Homo sapiens
tcaagcaatcctctcacctc

SEQ ID NO: 5940158 - DNA, 18 bp, Homo sapiens
tcaagcacactggaatat

SEQ ID NO: 5940159 - DNA, 19 bp, Homo sapiens
tcaagcaccaggaagtgtt

SEQ ID NO: 5940160 - DNA, 14 bp, Homo sapiens
tcaagcaccaggga

SEQ ID NO: 5940161 - DNA, 13 bp, Homo sapiens
tcaagcactgata

SEQ ID NO: 5940162 - DNA, 17 bp, Homo sapiens
tcaagcacttcccagga

SEQ ID NO: 5940163 - DNA, 16 bp, Homo sapiens
tcaagcagcaaaatcc

SEQ ID NO: 5940164 - DNA, 12 bp, Homo sapiens
tcaagcagccaa

SEQ ID NO: 5940165 - DNA, 22 bp, Homo sapiens
tcaagcagcgaccgccccctcc

SEQ ID NO: 5940166 - DNA, 17 bp, Homo sapiens
tcaagcaggttagagaa

SEQ ID NO: 5940167 - DNA, 18 bp, Homo sapiens
tcaagcagtcgtgcctgt

SEQ ID NO: 5940168 - DNA, 19 bp, Homo sapiens
tcaagcagtctacccacct

SEQ ID NO: 5940169 - DNA, 17 bp, Homo sapiens
tcaagcatattggaaag

SEQ ID NO: 5940170 - DNA, 12 bp, Homo sapiens
tcaagcatcatt

SEQ ID NO: 5940171 - DNA, 22 bp, Homo sapiens
tcaagcatctcctgaggatcag

SEQ ID NO: 5940172 - DNA, 12 bp, Homo sapiens
tcaagcatgaag

SEQ ID NO: 5940173 - DNA, 14 bp, Homo sapiens
tcaagccaaaaaag

SEQ ID NO: 5940174 - DNA, 15 bp, Homo sapiens
tcaagccaagcagcc

SEQ ID NO: 5940175 - DNA, 16 bp, Homo sapiens
tcaagccaagcagcca

SEQ ID NO: 5940176 - DNA, 21 bp, Homo sapiens
tcaagccagcaacacagagca

SEQ ID NO: 5940177 - DNA, 21 bp, Homo sapiens
tcaagccagccccctccagct

SEQ ID NO: 5940178 - DNA, 13 bp, Homo sapiens
tcaagccagcctg

SEQ ID NO: 5940179 - DNA, 14 bp, Homo sapiens
tcaagccaggagac

SEQ ID NO: 5940180 - DNA, 16 bp, Homo sapiens
tcaagccatgtataaa

SEQ ID NO: 5940181 - DNA, 22 bp, Homo sapiens
tcaagccatgtataaatgtgat

SEQ ID NO: 5940182 - DNA, 18 bp, Homo sapiens
tcaagccattctgcctca

SEQ ID NO: 5940183 - DNA, 22 bp, Homo sapiens
tcaagcccagccacgtggagcc

SEQ ID NO: 5940184 - DNA, 13 bp, Homo sapiens
tcaagcccaggag

SEQ ID NO: 5940185 - DNA, 18 bp, Homo sapiens
tcaagcccaggcttcctg

SEQ ID NO: 5940186 - DNA, 16 bp, Homo sapiens
tcaagccccagcagcc

SEQ ID NO: 5940187 - DNA, 20 bp, Homo sapiens
tcaagccccagcagccctca

SEQ ID NO: 5940188 - DNA, 20 bp, Homo sapiens
tcaagccccattccctctct

SEQ ID NO: 5940189 - DNA, 15 bp, Homo sapiens
tcaagcccctgtcta

SEQ ID NO: 5940190 - DNA, 16 bp, Homo sapiens
tcaagcccctgtctaa

SEQ ID NO: 5940191 - DNA, 16 bp, Homo sapiens
tcaagccccttctctc

SEQ ID NO: 5940192 - DNA, 20 bp, Homo sapiens
tcaagccctcctccccagag

SEQ ID NO: 5940193 - DNA, 21 bp, Homo sapiens
tcaagccctcctccccagagc

SEQ ID NO: 5940194 - DNA, 20 bp, Homo sapiens
tcaagccgcaagctctcagc

SEQ ID NO: 5940195 - DNA, 15 bp, Homo sapiens
tcaagccgtggccgg

SEQ ID NO: 5940196 - DNA, 15 bp, Homo sapiens
tcaagcctgcagcga

SEQ ID NO: 5940197 - DNA, 11 bp, Homo sapiens
tcaagcctggc

SEQ ID NO: 5940198 - DNA, 15 bp, Homo sapiens
tcaagcctggcccag

SEQ ID NO: 5940199 - DNA, 14 bp, Homo sapiens
tcaagcctgtgggc

SEQ ID NO: 5940200 - DNA, 16 bp, Homo sapiens
tcaagccttccaggga

SEQ ID NO: 5940201 - DNA, 16 bp, Homo sapiens
tcaagcgattctcctg

SEQ ID NO: 5940202 - DNA, 22 bp, Homo sapiens
tcaagcgattctcctgcctcag

SEQ ID NO: 5940203 - DNA, 23 bp, Homo sapiens
tcaagcgattctcctgcctcagc

SEQ ID NO: 5940204 - DNA, 16 bp, Homo sapiens
tcaagcgattcttctg

SEQ ID NO: 5940205 - DNA, 18 bp, Homo sapiens
tcaagcgattcttctgct

SEQ ID NO: 5940206 - DNA, 21 bp, Homo sapiens
tcaagcgattcttctgcttca

SEQ ID NO: 5940207 - DNA, 18 bp, Homo sapiens
tcaagctaagtaaaaata

SEQ ID NO: 5940208 - DNA, 13 bp, Homo sapiens
tcaagctaataaa

SEQ ID NO: 5940209 - DNA, 19 bp, Homo sapiens
tcaagctaataaaatatca

SEQ ID NO: 5940210 - DNA, 22 bp, Homo sapiens
tcaagctaataaaatatcattc

SEQ ID NO: 5940211 - DNA, 15 bp, Homo sapiens
tcaagctaattttct

SEQ ID NO: 5940212 - DNA, 17 bp, Homo sapiens
tcaagctactttatgta

SEQ ID NO: 5940213 - DNA, 18 bp, Homo sapiens
tcaagctagaaggccaca

SEQ ID NO: 5940214 - DNA, 20 bp, Homo sapiens
tcaagctagaaggccacatg

SEQ ID NO: 5940215 - DNA, 15 bp, Homo sapiens
tcaagctcatgtcat

SEQ ID NO: 5940216 - DNA, 21 bp, Homo sapiens
tcaagctcctagtatgccctg

SEQ ID NO: 5940217 - DNA, 13 bp, Homo sapiens
tcaagctctgagg

SEQ ID NO: 5940218 - DNA, 15 bp, Homo sapiens
tcaagctgagaaaag

SEQ ID NO: 5940219 - DNA, 17 bp, Homo sapiens
tcaagctgagaaaagta

SEQ ID NO: 5940220 - DNA, 12 bp, Homo sapiens
tcaagctgagct

SEQ ID NO: 5940221 - DNA, 18 bp, Homo sapiens
tcaagctgagctggcttc

SEQ ID NO: 5940222 - DNA, 20 bp, Homo sapiens
tcaagctgagtattaaaatg

SEQ ID NO: 5940223 - DNA, 23 bp, Homo sapiens
tcaagctgagtattaaaatgtat

SEQ ID NO: 5940224 - DNA, 21 bp, Homo sapiens
tcaagctggaagaagtgagca

SEQ ID NO: 5940225 - DNA, 12 bp, Homo sapiens
tcaagctgtccc

SEQ ID NO: 5940226 - DNA, 16 bp, Homo sapiens
tcaagcttaatatgtg

SEQ ID NO: 5940227 - DNA, 21 bp, Homo sapiens
tcaagcttagtgagcagtgag

SEQ ID NO: 5940228 - DNA, 14 bp, Homo sapiens
tcaagcttgtgtac

SEQ ID NO: 5940229 - DNA, 18 bp, Homo sapiens
tcaagcttgtgtacttga

SEQ ID NO: 5940230 - DNA, 13 bp, Homo sapiens
tcaagctttcccg

SEQ ID NO: 5940231 - DNA, 14 bp, Homo sapiens
tcaagctttccgag

SEQ ID NO: 5940232 - DNA, 13 bp, Homo sapiens
tcaagctttcctg

SEQ ID NO: 5940233 - DNA, 21 bp, Homo sapiens
tcaaggaaaaatgctgcttct

SEQ ID NO: 5940234 - DNA, 17 bp, Homo sapiens
tcaaggaaaagttcttt

SEQ ID NO: 5940235 - DNA, 20 bp, Homo sapiens
tcaaggaaaagttctttcaa

SEQ ID NO: 5940236 - DNA, 14 bp, Homo sapiens
tcaaggaaaataag

SEQ ID NO: 5940237 - DNA, 17 bp, Homo sapiens
tcaaggaaaataagtga

SEQ ID NO: 5940238 - DNA, 20 bp, Homo sapiens
tcaaggaaagggggtcccag

SEQ ID NO: 5940239 - DNA, 20 bp, Homo sapiens
tcaaggaacagccacaaaat

SEQ ID NO: 5940240 - DNA, 17 bp, Homo sapiens
tcaaggaacttgaaaaa

SEQ ID NO: 5940241 - DNA, 12 bp, Homo sapiens
tcaaggaagaaa

SEQ ID NO: 5940242 - DNA, 13 bp, Homo sapiens
tcaaggaagaaaa

SEQ ID NO: 5940243 - DNA, 15 bp, Homo sapiens
tcaaggaagaaaacg

SEQ ID NO: 5940244 - DNA, 17 bp, Homo sapiens
tcaaggaagaaaacgga

SEQ ID NO: 5940245 - DNA, 16 bp, Homo sapiens
tcaaggaagaagaaat

SEQ ID NO: 5940246 - DNA, 17 bp, Homo sapiens
tcaaggaagagccagcc

SEQ ID NO: 5940247 - DNA, 18 bp, Homo sapiens
tcaaggaagagccagccg

SEQ ID NO: 5940248 - DNA, 14 bp, Homo sapiens
tcaaggaaggatgc

SEQ ID NO: 5940249 - DNA, 19 bp, Homo sapiens
tcaaggaagggacaagaca

SEQ ID NO: 5940250 - DNA, 20 bp, Homo sapiens
tcaaggaagtagaaacaaaa

SEQ ID NO: 5940251 - DNA, 18 bp, Homo sapiens
tcaaggaataatgggctt

SEQ ID NO: 5940252 - DNA, 19 bp, Homo sapiens
tcaaggaatttcttaactt

SEQ ID NO: 5940253 - DNA, 23 bp, Homo sapiens
tcaaggaatttcttaacttcttg

SEQ ID NO: 5940254 - DNA, 19 bp, Homo sapiens
tcaaggacaaagtctccag

SEQ ID NO: 5940255 - DNA, 21 bp, Homo sapiens
tcaaggacaaagtctccagcc

SEQ ID NO: 5940256 - DNA, 16 bp, Homo sapiens
tcaaggacaggagcct

SEQ ID NO: 5940257 - DNA, 15 bp, Homo sapiens
tcaaggacagggctg

SEQ ID NO: 5940258 - DNA, 18 bp, Homo sapiens
tcaaggacagggctgagc

SEQ ID NO: 5940259 - DNA, 19 bp, Homo sapiens
tcaaggactgaattgtttt

SEQ ID NO: 5940260 - DNA, 12 bp, Homo sapiens
tcaaggactggt

SEQ ID NO: 5940261 - DNA, 21 bp, Homo sapiens
tcaaggactggtaaaatacat

SEQ ID NO: 5940262 - DNA, 21 bp, Homo sapiens
tcaaggactgtttcagtgtga

SEQ ID NO: 5940263 - DNA, 18 bp, Homo sapiens
tcaaggacttgaaagcat

SEQ ID NO: 5940264 - DNA, 19 bp, Homo sapiens
tcaaggacttgaaagcatc

SEQ ID NO: 5940265 - DNA, 19 bp, Homo sapiens
tcaaggagaccatgtatgt

SEQ ID NO: 5940266 - DNA, 18 bp, Homo sapiens
tcaaggagaggcaaagaa

SEQ ID NO: 5940267 - DNA, 20 bp, Homo sapiens
tcaaggagggagaaaggcaa

SEQ ID NO: 5940268 - DNA, 13 bp, Homo sapiens
tcaaggagggcac

SEQ ID NO: 5940269 - DNA, 17 bp, Homo sapiens
tcaaggagtcttctaat

SEQ ID NO: 5940270 - DNA, 23 bp, Homo sapiens
tcaaggagtcttctaatgtaaat

SEQ ID NO: 5940271 - DNA, 15 bp, Homo sapiens
tcaaggagtgaagta

SEQ ID NO: 5940272 - DNA, 16 bp, Homo sapiens
tcaaggagtgaagtaa

SEQ ID NO: 5940273 - DNA, 17 bp, Homo sapiens
tcaaggagtgaagtaat

SEQ ID NO: 5940274 - DNA, 16 bp, Homo sapiens
tcaaggataaatatct

SEQ ID NO: 5940275 - DNA, 18 bp, Homo sapiens
tcaaggatcctgagccag

SEQ ID NO: 5940276 - DNA, 20 bp, Homo sapiens
tcaaggattcttctgattct

SEQ ID NO: 5940277 - DNA, 22 bp, Homo sapiens
tcaaggcaaaaatatcaggagc

SEQ ID NO: 5940278 - DNA, 19 bp, Homo sapiens
tcaaggcacattgaaatac

SEQ ID NO: 5940279 - DNA, 17 bp, Homo sapiens
tcaaggcaccagcaaat

SEQ ID NO: 5940280 - DNA, 14 bp, Homo sapiens
tcaaggcactctag

SEQ ID NO: 5940281 - DNA, 13 bp, Homo sapiens
tcaaggcactgcc

SEQ ID NO: 5940282 - DNA, 23 bp, Homo sapiens
tcaaggcagggaaggggccatga

SEQ ID NO: 5940283 - DNA, 17 bp, Homo sapiens
tcaaggcatcatgcaga

SEQ ID NO: 5940284 - DNA, 13 bp, Homo sapiens
tcaaggccacctc

SEQ ID NO: 5940285 - DNA, 18 bp, Homo sapiens
tcaaggccacctctgcct

SEQ ID NO: 5940286 - DNA, 18 bp, Homo sapiens
tcaaggccaccttggagg

SEQ ID NO: 5940287 - DNA, 22 bp, Homo sapiens
tcaaggccatattttaaaaaat

SEQ ID NO: 5940288 - DNA, 22 bp, Homo sapiens
tcaaggccgagggccaggcaga

SEQ ID NO: 5940289 - DNA, 23 bp, Homo sapiens
tcaaggccgagggccaggcagaa

SEQ ID NO: 5940290 - DNA, 21 bp, Homo sapiens
tcaaggccgtgtccccttgtt

SEQ ID NO: 5940291 - DNA, 18 bp, Homo sapiens
tcaaggcctgtccctggc

SEQ ID NO: 5940292 - DNA, 13 bp, Homo sapiens
tcaaggccttcag

SEQ ID NO: 5940293 - DNA, 18 bp, Homo sapiens
tcaaggctaattggaaaa

SEQ ID NO: 5940294 - DNA, 17 bp, Homo sapiens
tcaaggctcagaaggaa

SEQ ID NO: 5940295 - DNA, 14 bp, Homo sapiens
tcaaggctgcctgg

SEQ ID NO: 5940296 - DNA, 14 bp, Homo sapiens
tcaaggcttggaga

SEQ ID NO: 5940297 - DNA, 22 bp, Homo sapiens
tcaagggaaaggcaagcttgag

SEQ ID NO: 5940298 - DNA, 20 bp, Homo sapiens
tcaagggaccctgggtggga

SEQ ID NO: 5940299 - DNA, 17 bp, Homo sapiens
tcaagggactgggggtg

SEQ ID NO: 5940300 - DNA, 17 bp, Homo sapiens
tcaagggagaatataga

SEQ ID NO: 5940301 - DNA, 20 bp, Homo sapiens
tcaagggcactgtgatacag

SEQ ID NO: 5940302 - DNA, 19 bp, Homo sapiens
tcaagggcagctttgctca

SEQ ID NO: 5940303 - DNA, 14 bp, Homo sapiens
tcaagggctggggc

SEQ ID NO: 5940304 - DNA, 20 bp, Homo sapiens
tcaagggctggggctgagct

SEQ ID NO: 5940305 - DNA, 19 bp, Homo sapiens
tcaagggctttcctgtgcc

SEQ ID NO: 5940306 - DNA, 21 bp, Homo sapiens
tcaaggggactggtgatggga

SEQ ID NO: 5940307 - DNA, 13 bp, Homo sapiens
tcaaggggcaggg

SEQ ID NO: 5940308 - DNA, 14 bp, Homo sapiens
tcaagggggtgaca

SEQ ID NO: 5940309 - DNA, 23 bp, Homo sapiens
tcaagggtaccaatcctggcagg

SEQ ID NO: 5940310 - DNA, 16 bp, Homo sapiens
tcaagggtgcgtctgg

SEQ ID NO: 5940311 - DNA, 14 bp, Homo sapiens
tcaagggtggcagg

SEQ ID NO: 5940312 - DNA, 18 bp, Homo sapiens
tcaagggtggcaggtcac

SEQ ID NO: 5940313 - DNA, 21 bp, Homo sapiens
tcaagggtggcaggtcactgt

SEQ ID NO: 5940314 - DNA, 20 bp, Homo sapiens
tcaaggtaaaattctaaata

SEQ ID NO: 5940315 - DNA, 17 bp, Homo sapiens
tcaaggtcaacggctta

SEQ ID NO: 5940316 - DNA, 18 bp, Homo sapiens
tcaaggtcactgtttcct

SEQ ID NO: 5940317 - DNA, 15 bp, Homo sapiens
tcaaggtcagaacag

SEQ ID NO: 5940318 - DNA, 18 bp, Homo sapiens
tcaaggtcatcaaacatt

SEQ ID NO: 5940319 - DNA, 16 bp, Homo sapiens
tcaaggtccagtggaa

SEQ ID NO: 5940320 - DNA, 21 bp, Homo sapiens
tcaaggtcgtttttttcattc

SEQ ID NO: 5940321 - DNA, 22 bp, Homo sapiens
tcaaggtgaaggatctgtccga

SEQ ID NO: 5940322 - DNA, 18 bp, Homo sapiens
tcaaggtgagaattaagt

SEQ ID NO: 5940323 - DNA, 19 bp, Homo sapiens
tcaaggtgctcttctcatt

SEQ ID NO: 5940324 - DNA, 16 bp, Homo sapiens
tcaaggtgctgttgtc

SEQ ID NO: 5940325 - DNA, 22 bp, Homo sapiens
tcaatagccccatctctcctgc

SEQ ID NO: 5940326 - DNA, 17 bp, Homo sapiens
tcaatagctaagcatct

SEQ ID NO: 5940327 - DNA, 17 bp, Homo sapiens
tcaatagctccaagctg

SEQ ID NO: 5940328 - DNA, 21 bp, Homo sapiens
tcaatagctccaagctgttaa

SEQ ID NO: 5940329 - DNA, 22 bp, Homo sapiens
tcaatagctccaagctgttaaa

SEQ ID NO: 5940330 - DNA, 17 bp, Homo sapiens
tcaatagctttgtagtt

SEQ ID NO: 5940331 - DNA, 14 bp, Homo sapiens
tcaataggaaaaac

SEQ ID NO: 5940332 - DNA, 22 bp, Homo sapiens
tcaataggaaaaactgattttt

SEQ ID NO: 5940333 - DNA, 17 bp, Homo sapiens
tcaataggaattgcatt

SEQ ID NO: 5940334 - DNA, 19 bp, Homo sapiens
tcaataggagggatgttcc

SEQ ID NO: 5940335 - DNA, 15 bp, Homo sapiens
tcaatagtattaact

SEQ ID NO: 5940336 - DNA, 16 bp, Homo sapiens
tcaatagtattaacta

SEQ ID NO: 5940337 - DNA, 17 bp, Homo sapiens
tcaatagtcaagaaaaa

SEQ ID NO: 5940338 - DNA, 20 bp, Homo sapiens
tcaatagtgtcctatgcaat

SEQ ID NO: 5940339 - DNA, 13 bp, Homo sapiens
tcaatagttctta

SEQ ID NO: 5940340 - DNA, 12 bp, Homo sapiens
tcaatagttgaa

SEQ ID NO: 5940341 - DNA, 13 bp, Homo sapiens
tcaatagttgaat

SEQ ID NO: 5940342 - DNA, 14 bp, Homo sapiens
tcaatataaaaaca

SEQ ID NO: 5940343 - DNA, 15 bp, Homo sapiens
tcaatataagaagca

SEQ ID NO: 5940344 - DNA, 20 bp, Homo sapiens
tcaatataagaagcaatctt

SEQ ID NO: 5940345 - DNA, 19 bp, Homo sapiens
tcaatatataataaatggg

SEQ ID NO: 5940346 - DNA, 16 bp, Homo sapiens
tcaatatattgaactt

SEQ ID NO: 5940347 - DNA, 22 bp, Homo sapiens
tcaatatattgaacttttgtac

SEQ ID NO: 5940348 - DNA, 11 bp, Homo sapiens
tcaatatcaag

SEQ ID NO: 5940349 - DNA, 20 bp, Homo sapiens
tcaatatcaagactgactgg

SEQ ID NO: 5940350 - DNA, 15 bp, Homo sapiens
tcaatatcagctttg

SEQ ID NO: 5940351 - DNA, 18 bp, Homo sapiens
tcaatatccaaaccaaat

SEQ ID NO: 5940352 - DNA, 14 bp, Homo sapiens
tcaatatcctttgc

SEQ ID NO: 5940353 - DNA, 23 bp, Homo sapiens
tcaatatcgtacctgtccctcca

SEQ ID NO: 5940354 - DNA, 12 bp, Homo sapiens
tcaatatgcaag

SEQ ID NO: 5940355 - DNA, 15 bp, Homo sapiens
tcaatatgcaagcag

SEQ ID NO: 5940356 - DNA, 18 bp, Homo sapiens
tcaatatggggcattaat

SEQ ID NO: 5940357 - DNA, 23 bp, Homo sapiens
tcaatatggggcattaatattct

SEQ ID NO: 5940358 - DNA, 17 bp, Homo sapiens
tcaatatgtatatatgt

SEQ ID NO: 5940359 - DNA, 19 bp, Homo sapiens
tcaatattaaatacagaca

SEQ ID NO: 5940360 - DNA, 13 bp, Homo sapiens
tcaatattatgaa

SEQ ID NO: 5940361 - DNA, 17 bp, Homo sapiens
tcaatattcaataaagc

SEQ ID NO: 5940362 - DNA, 21 bp, Homo sapiens
tcaatattcctgaatgaaata

SEQ ID NO: 5940363 - DNA, 22 bp, Homo sapiens
tcaatattgaatttttcctatg

SEQ ID NO: 5940364 - DNA, 13 bp, Homo sapiens
tcaatattgacat

SEQ ID NO: 5940365 - DNA, 19 bp, Homo sapiens
tcaatattgcctttgcctc

SEQ ID NO: 5940366 - DNA, 13 bp, Homo sapiens
tcaatattggtgt

SEQ ID NO: 5940367 - DNA, 19 bp, Homo sapiens
tcaatattggtgtactgta

SEQ ID NO: 5940368 - DNA, 14 bp, Homo sapiens
tcaatatttaagag

SEQ ID NO: 5940369 - DNA, 13 bp, Homo sapiens
tcaatatttaagt

SEQ ID NO: 5940370 - DNA, 17 bp, Homo sapiens
tcaatatttagaaaatt

SEQ ID NO: 5940371 - DNA, 21 bp, Homo sapiens
tcaatatttagaaaattttgt

SEQ ID NO: 5940372 - DNA, 13 bp, Homo sapiens
tcaatatttatta

SEQ ID NO: 5940373 - DNA, 20 bp, Homo sapiens
tcaatatttattattttcac

SEQ ID NO: 5940374 - DNA, 23 bp, Homo sapiens
tcaatatttcagataatcacaat

SEQ ID NO: 5940375 - DNA, 15 bp, Homo sapiens
tcaatattttccatg

SEQ ID NO: 5940376 - DNA, 14 bp, Homo sapiens
tcaatcaaactttc

SEQ ID NO: 5940377 - DNA, 13 bp, Homo sapiens
tcaatcaaagcta

SEQ ID NO: 5940378 - DNA, 15 bp, Homo sapiens
tcaatcaacatctct

SEQ ID NO: 5940379 - DNA, 14 bp, Homo sapiens
tcaatcaaccaaag

SEQ ID NO: 5940380 - DNA, 16 bp, Homo sapiens
tcaatcaactttactg

SEQ ID NO: 5940381 - DNA, 21 bp, Homo sapiens
tcaatcaagcaaaatttctgt

SEQ ID NO: 5940382 - DNA, 22 bp, Homo sapiens
tcaatcacaaaagtatattcaa

SEQ ID NO: 5940383 - DNA, 14 bp, Homo sapiens
tcaatcacactaca

SEQ ID NO: 5940384 - DNA, 12 bp, Homo sapiens
tcaatcacagct

SEQ ID NO: 5940385 - DNA, 15 bp, Homo sapiens
tcaatcacagtctca

SEQ ID NO: 5940386 - DNA, 15 bp, Homo sapiens
tcaatcactgctccc

SEQ ID NO: 5940387 - DNA, 13 bp, Homo sapiens
tcaatcagccttt

SEQ ID NO: 5940388 - DNA, 22 bp, Homo sapiens
tcaatcagtctcagaatgtcat

SEQ ID NO: 5940389 - DNA, 14 bp, Homo sapiens
tcaatcagtgcagt

SEQ ID NO: 5940390 - DNA, 14 bp, Homo sapiens
tcaatcatcaaaaa

SEQ ID NO: 5940391 - DNA, 14 bp, Homo sapiens
tcaatcatgtcagt

SEQ ID NO: 5940392 - DNA, 13 bp, Homo sapiens
tcaatcattgaag

SEQ ID NO: 5940393 - DNA, 22 bp, Homo sapiens
tcaatcattgaagtatattctt

SEQ ID NO: 5940394 - DNA, 18 bp, Homo sapiens
tcaatcattgtcagagat

SEQ ID NO: 5940395 - DNA, 16 bp, Homo sapiens
tcaatcatttattcat

SEQ ID NO: 5940396 - DNA, 13 bp, Homo sapiens
tcaatcatttctc

SEQ ID NO: 5940397 - DNA, 20 bp, Homo sapiens
tcaatccaaattccctctgg

SEQ ID NO: 5940398 - DNA, 21 bp, Homo sapiens
tcaatccacagtattgttctt

SEQ ID NO: 5940399 - DNA, 20 bp, Homo sapiens
tcaatccaccttcaggcccc

SEQ ID NO: 5940400 - DNA, 15 bp, Homo sapiens
tcaatccagctatgt

SEQ ID NO: 5940401 - DNA, 17 bp, Homo sapiens
tcaatccaggctacaat

SEQ ID NO: 5940402 - DNA, 22 bp, Homo sapiens
tcaatccatcagcaatgcttct

SEQ ID NO: 5940403 - DNA, 13 bp, Homo sapiens
tcaatcccagcct

SEQ ID NO: 5940404 - DNA, 22 bp, Homo sapiens
tcaatcccctcattcaggaaaa

SEQ ID NO: 5940405 - DNA, 14 bp, Homo sapiens
tcaatccctttgca

SEQ ID NO: 5940406 - DNA, 22 bp, Homo sapiens
tcaatcctaatttctcctccct

SEQ ID NO: 5940407 - DNA, 15 bp, Homo sapiens
tcaatcctacctgtt

SEQ ID NO: 5940408 - DNA, 21 bp, Homo sapiens
tcaatcctgattcctctctaa

SEQ ID NO: 5940409 - DNA, 15 bp, Homo sapiens
tcaatcctgccccca

SEQ ID NO: 5940410 - DNA, 22 bp, Homo sapiens
tcaatcctgggcaatcagacac

SEQ ID NO: 5940411 - DNA, 12 bp, Homo sapiens
tcaatcctggta

SEQ ID NO: 5940412 - DNA, 18 bp, Homo sapiens
tcaatcctggtaaccaaa

SEQ ID NO: 5940413 - DNA, 18 bp, Homo sapiens
tcaatctaaggccttccc

SEQ ID NO: 5940414 - DNA, 20 bp, Homo sapiens
tcaatctcccgctgctgctg

SEQ ID NO: 5940415 - DNA, 21 bp, Homo sapiens
tcaatctcctctctctttcct

SEQ ID NO: 5940416 - DNA, 21 bp, Homo sapiens
tcaatctcgtatagaagtctt

SEQ ID NO: 5940417 - DNA, 22 bp, Homo sapiens
tcaatctcgtatagaagtcttc

SEQ ID NO: 5940418 - DNA, 19 bp, Homo sapiens
tcaatctcgtttagtgcca

SEQ ID NO: 5940419 - DNA, 14 bp, Homo sapiens
tcaatctctgacta

SEQ ID NO: 5940420 - DNA, 12 bp, Homo sapiens
tcaatctctgtt

SEQ ID NO: 5940421 - DNA, 20 bp, Homo sapiens
tcaatctctgttgcacctga

SEQ ID NO: 5940422 - DNA, 22 bp, Homo sapiens
tcaatctgcagtttgtgaactt

SEQ ID NO: 5940423 - DNA, 23 bp, Homo sapiens
tcaatctgcagtttgtgaacttc

SEQ ID NO: 5940424 - DNA, 20 bp, Homo sapiens
tcaatctggcttctgcatta

SEQ ID NO: 5940425 - DNA, 17 bp, Homo sapiens
tcaatctgtaaactgtg

SEQ ID NO: 5940426 - DNA, 16 bp, Homo sapiens
tcaatcttattactga

SEQ ID NO: 5940427 - DNA, 17 bp, Homo sapiens
tcaatcttcaatccttg

SEQ ID NO: 5940428 - DNA, 20 bp, Homo sapiens
tcaatcttcggggtgtgatg

SEQ ID NO: 5940429 - DNA, 16 bp, Homo sapiens
tcaatcttgcatgtaa

SEQ ID NO: 5940430 - DNA, 17 bp, Homo sapiens
tcaatcttgcatgtaac

SEQ ID NO: 5940431 - DNA, 18 bp, Homo sapiens
tcaatcttgcatgtaacg

SEQ ID NO: 5940432 - DNA, 19 bp, Homo sapiens
tcaatcttggtttgtcagt

SEQ ID NO: 5940433 - DNA, 14 bp, Homo sapiens
tcaatcttgttact

SEQ ID NO: 5940434 - DNA, 19 bp, Homo sapiens
tcaatcttgttactgctga

SEQ ID NO: 5940435 - DNA, 18 bp, Homo sapiens
tcaatgaaaaatgtaatt

SEQ ID NO: 5940436 - DNA, 21 bp, Homo sapiens
tcaatgaaacaaagaaagaga

SEQ ID NO: 5940437 - DNA, 12 bp, Homo sapiens
tcaatgaaatat

SEQ ID NO: 5940438 - DNA, 16 bp, Homo sapiens
tcaatgaaatatttgc

SEQ ID NO: 5940439 - DNA, 17 bp, Homo sapiens
tcaatgaaatatttgct

SEQ ID NO: 5940440 - DNA, 18 bp, Homo sapiens
tcaatgaaatatttgctt

SEQ ID NO: 5940441 - DNA, 21 bp, Homo sapiens
tcaatgaaatatttgcttatt

SEQ ID NO: 5940442 - DNA, 18 bp, Homo sapiens
tcaatgaaatggattggt

SEQ ID NO: 5940443 - DNA, 21 bp, Homo sapiens
tcaatgaacttccatttgtat

SEQ ID NO: 5940444 - DNA, 22 bp, Homo sapiens
tcaatgaacttccatttgtatt

SEQ ID NO: 5940445 - DNA, 15 bp, Homo sapiens
tcaatgaatattgaa

SEQ ID NO: 5940446 - DNA, 14 bp, Homo sapiens
tcaatgaatattgt

SEQ ID NO: 5940447 - DNA, 17 bp, Homo sapiens
tcaatgaatccccgacc

SEQ ID NO: 5940448 - DNA, 15 bp, Homo sapiens
tcaatgaattatatt

SEQ ID NO: 5940449 - DNA, 21 bp, Homo sapiens
tcaatgaattttataatctgc

SEQ ID NO: 5940450 - DNA, 18 bp, Homo sapiens
tcaatgacagagccttct

SEQ ID NO: 5940451 - DNA, 14 bp, Homo sapiens
tcaatgagagcata

SEQ ID NO: 5940452 - DNA, 17 bp, Homo sapiens
tcaatgagcatgtttag

SEQ ID NO: 5940453 - DNA, 21 bp, Homo sapiens
tcaatgagcatgtttagactt

SEQ ID NO: 5940454 - DNA, 17 bp, Homo sapiens
tcaatgaggtgtccaac

SEQ ID NO: 5940455 - DNA, 14 bp, Homo sapiens
tcaatgagttcttc

SEQ ID NO: 5940456 - DNA, 14 bp, Homo sapiens
tcaatgataaattt

SEQ ID NO: 5940457 - DNA, 20 bp, Homo sapiens
tcaatgatagcacctaaact

SEQ ID NO: 5940458 - DNA, 10 bp, Homo sapiens
tcaatgatct

SEQ ID NO: 5940459 - DNA, 13 bp, Homo sapiens
tcaatgatctagg

SEQ ID NO: 5940460 - DNA, 21 bp, Homo sapiens
tcaatgatctaggtttaactc

SEQ ID NO: 5940461 - DNA, 21 bp, Homo sapiens
tcaatgcaaatagtagacatt

SEQ ID NO: 5940462 - DNA, 22 bp, Homo sapiens
tcaatgcaaatagtagacattt

SEQ ID NO: 5940463 - DNA, 18 bp, Homo sapiens
tcaatgcaacctctgccc

SEQ ID NO: 5940464 - DNA, 21 bp, Homo sapiens
tcaatgcaagccccaactttc

SEQ ID NO: 5940465 - DNA, 15 bp, Homo sapiens
tcaatgcaatgaaaa

SEQ ID NO: 5940466 - DNA, 16 bp, Homo sapiens
tcaatgcaatgaaaac

SEQ ID NO: 5940467 - DNA, 19 bp, Homo sapiens
tcaatgcaatgaaaacaaa

SEQ ID NO: 5940468 - DNA, 23 bp, Homo sapiens
tcaatgcaatgcaattcaatgca

SEQ ID NO: 5940469 - DNA, 15 bp, Homo sapiens
tcaatgcaatgcatc

SEQ ID NO: 5940470 - DNA, 16 bp, Homo sapiens
tcaatgcaatgcatct

SEQ ID NO: 5940471 - DNA, 22 bp, Homo sapiens
tcaatgcagcacccttgccatc

SEQ ID NO: 5940472 - DNA, 13 bp, Homo sapiens
tcaatgcagccag

SEQ ID NO: 5940473 - DNA, 15 bp, Homo sapiens
tcaatgcagttgtct

SEQ ID NO: 5940474 - DNA, 22 bp, Homo sapiens
tcaatgcatacaataaaagagc

SEQ ID NO: 5940475 - DNA, 19 bp, Homo sapiens
tcaatgcatgatgactctt

SEQ ID NO: 5940476 - DNA, 23 bp, Homo sapiens
tcaatgcatgatgactcttctta

SEQ ID NO: 5940477 - DNA, 18 bp, Homo sapiens
tcaatgcatttaaaatac

SEQ ID NO: 5940478 - DNA, 14 bp, Homo sapiens
tcaatgcattttta

SEQ ID NO: 5940479 - DNA, 21 bp, Homo sapiens
tcaatgccaatgagtctgtaa

SEQ ID NO: 5940480 - DNA, 22 bp, Homo sapiens
tcaatgccaatgagtctgtaat

SEQ ID NO: 5940481 - DNA, 12 bp, Homo sapiens
tcaatgccattg

SEQ ID NO: 5940482 - DNA, 14 bp, Homo sapiens
tcaatgcccagtaa

SEQ ID NO: 5940483 - DNA, 15 bp, Homo sapiens
tcaatgcccagtaaa

SEQ ID NO: 5940484 - DNA, 17 bp, Homo sapiens
tcaatgcccagtaaaat

SEQ ID NO: 5940485 - DNA, 21 bp, Homo sapiens
tcaatgcccagtaaaatttca

SEQ ID NO: 5940486 - DNA, 23 bp, Homo sapiens
tcaatgcccagtaaaatttcagg

SEQ ID NO: 5940487 - DNA, 12 bp, Homo sapiens
tcaatgccctgc

SEQ ID NO: 5940488 - DNA, 13 bp, Homo sapiens
tcaatgccctgcc

SEQ ID NO: 5940489 - DNA, 16 bp, Homo sapiens
tcaatgctacaaaatg

SEQ ID NO: 5940490 - DNA, 16 bp, Homo sapiens
tcaatgctagaaaatc

SEQ ID NO: 5940491 - DNA, 17 bp, Homo sapiens
tcaatgctatggactgc

SEQ ID NO: 5940492 - DNA, 20 bp, Homo sapiens
tcaatgctatggactgcaca

SEQ ID NO: 5940493 - DNA, 13 bp, Homo sapiens
tcaatgctcataa

SEQ ID NO: 5940494 - DNA, 14 bp, Homo sapiens
tcaatgctcataac

SEQ ID NO: 5940495 - DNA, 16 bp, Homo sapiens
tcaatgctctaacaaa

SEQ ID NO: 5940496 - DNA, 14 bp, Homo sapiens
tcaatgcttctttt

SEQ ID NO: 5940497 - DNA, 18 bp, Homo sapiens
tcaatgctttatttgtaa

SEQ ID NO: 5940498 - DNA, 19 bp, Homo sapiens
tcaatgcttttctagcaac

SEQ ID NO: 5940499 - DNA, 15 bp, Homo sapiens
tcaatggaaacaggg

SEQ ID NO: 5940500 - DNA, 14 bp, Homo sapiens
tcaatggaagaaat

SEQ ID NO: 5940501 - DNA, 19 bp, Homo sapiens
tcaatggactgcaccttgt

SEQ ID NO: 5940502 - DNA, 20 bp, Homo sapiens
tcaatggatttgatgctgtt

SEQ ID NO: 5940503 - DNA, 18 bp, Homo sapiens
tcacactctctgcagccc

SEQ ID NO: 5940504 - DNA, 16 bp, Homo sapiens
tcacactctcttctta

SEQ ID NO: 5940505 - DNA, 14 bp, Homo sapiens
tcacactctgtgtt

SEQ ID NO: 5940506 - DNA, 19 bp, Homo sapiens
tcacactgagaatgtaaga

SEQ ID NO: 5940507 - DNA, 23 bp, Homo sapiens
tcacactgagaatgtaagaacta

SEQ ID NO: 5940508 - DNA, 15 bp, Homo sapiens
tcacactgagctggg

SEQ ID NO: 5940509 - DNA, 17 bp, Homo sapiens
tcacactgatgggctgg

SEQ ID NO: 5940510 - DNA, 23 bp, Homo sapiens
tcacactgatgggctggggcagg

SEQ ID NO: 5940511 - DNA, 20 bp, Homo sapiens
tcacactgcaagagccttgg

SEQ ID NO: 5940512 - DNA, 24 bp, Homo sapiens
tcacactggatccatcttgagcca

SEQ ID NO: 5940513 - DNA, 16 bp, Homo sapiens
tcacactggctatcaa

SEQ ID NO: 5940514 - DNA, 16 bp, Homo sapiens
tcacactgggtggtgg

SEQ ID NO: 5940515 - DNA, 16 bp, Homo sapiens
tcacactggtaaatgt

SEQ ID NO: 5940516 - DNA, 11 bp, Homo sapiens
tcacactgtct

SEQ ID NO: 5940517 - DNA, 17 bp, Homo sapiens
tcacactgtcttcccga

SEQ ID NO: 5940518 - DNA, 16 bp, Homo sapiens
tcacactgtcttctga

SEQ ID NO: 5940519 - DNA, 23 bp, Homo sapiens
tcacactgtggcctgatcagcag

SEQ ID NO: 5940520 - DNA, 20 bp, Homo sapiens
tcacacttactgtaagacat

SEQ ID NO: 5940521 - DNA, 21 bp, Homo sapiens
tcacacttactgtaagacatt

SEQ ID NO: 5940522 - DNA, 17 bp, Homo sapiens
tcacacttcattgtaaa

SEQ ID NO: 5940523 - DNA, 18 bp, Homo sapiens
tcacacttccaccagcct

SEQ ID NO: 5940524 - DNA, 22 bp, Homo sapiens
tcacacttctgtgagaccccca

SEQ ID NO: 5940525 - DNA, 13 bp, Homo sapiens
tcacacttggagc

SEQ ID NO: 5940526 - DNA, 14 bp, Homo sapiens
tcacacttgggctg

SEQ ID NO: 5940527 - DNA, 15 bp, Homo sapiens
tcacacttgggctgg

SEQ ID NO: 5940528 - DNA, 22 bp, Homo sapiens
tcacactttttatttaattaaa

SEQ ID NO: 5940529 - DNA, 16 bp, Homo sapiens
tcacagaaaatttaac

SEQ ID NO: 5940530 - DNA, 22 bp, Homo sapiens
tcacagaaacggtctttatgaa

SEQ ID NO: 5940531 - DNA, 21 bp, Homo sapiens
tcacagaaatcagaggagaga

SEQ ID NO: 5940532 - DNA, 12 bp, Homo sapiens
tcacagaaatga

SEQ ID NO: 5940533 - DNA, 16 bp, Homo sapiens
tcacagaaatgagatc

SEQ ID NO: 5940534 - DNA, 12 bp, Homo sapiens
tcacagaagaat

SEQ ID NO: 5940535 - DNA, 14 bp, Homo sapiens
tcacagaagatgaa

SEQ ID NO: 5940536 - DNA, 15 bp, Homo sapiens
tcacagaatctccat

SEQ ID NO: 5940537 - DNA, 15 bp, Homo sapiens
tcacagacatataga

SEQ ID NO: 5940538 - DNA, 16 bp, Homo sapiens
tcacagacccctgggg

SEQ ID NO: 5940539 - DNA, 16 bp, Homo sapiens
tcacagacctcagcag

SEQ ID NO: 5940540 - DNA, 20 bp, Homo sapiens
tcacagacctctgcttggag

SEQ ID NO: 5940541 - DNA, 22 bp, Homo sapiens
tcacagacgctcctgaagttag

SEQ ID NO: 5940542 - DNA, 14 bp, Homo sapiens
tcacagactcttcc

SEQ ID NO: 5940543 - DNA, 17 bp, Homo sapiens
tcacagactcttccacc

SEQ ID NO: 5940544 - DNA, 21 bp, Homo sapiens
tcacagacttctggcctagga

SEQ ID NO: 5940545 - DNA, 12 bp, Homo sapiens
tcacagagaagc

SEQ ID NO: 5940546 - DNA, 13 bp, Homo sapiens
tcacagagaagct

SEQ ID NO: 5940547 - DNA, 15 bp, Homo sapiens
tcacagagaagctcc

SEQ ID NO: 5940548 - DNA, 21 bp, Homo sapiens
tcacagagacattcctccgag

SEQ ID NO: 5940549 - DNA, 16 bp, Homo sapiens
tcacagagcacgcctg

SEQ ID NO: 5940550 - DNA, 22 bp, Homo sapiens
tcacagagcacgcctgccatct

SEQ ID NO: 5940551 - DNA, 12 bp, Homo sapiens
tcacagagcagc

SEQ ID NO: 5940552 - DNA, 14 bp, Homo sapiens
tcacagagccactc

SEQ ID NO: 5940553 - DNA, 23 bp, Homo sapiens
tcacagagccactcttcaagtag

SEQ ID NO: 5940554 - DNA, 13 bp, Homo sapiens
tcacagaggcagt

SEQ ID NO: 5940555 - DNA, 13 bp, Homo sapiens
tcacagaggcata

SEQ ID NO: 5940556 - DNA, 20 bp, Homo sapiens
tcacagaggtctttcagctc

SEQ ID NO: 5940557 - DNA, 16 bp, Homo sapiens
tcacagagtcaaggcc

SEQ ID NO: 5940558 - DNA, 18 bp, Homo sapiens
tcacagagtcaaggcctg

SEQ ID NO: 5940559 - DNA, 21 bp, Homo sapiens
tcacagagtgagactccatct

SEQ ID NO: 5940560 - DNA, 23 bp, Homo sapiens
tcacagagtgagactccatctca

SEQ ID NO: 5940561 - DNA, 14 bp, Homo sapiens
tcacagagtgtgct

SEQ ID NO: 5940562 - DNA, 18 bp, Homo sapiens
tcacagatgcatatagac

SEQ ID NO: 5940563 - DNA, 21 bp, Homo sapiens
tcacagatgcatatagacaca

SEQ ID NO: 5940564 - DNA, 23 bp, Homo sapiens
tcacagatggaagaagttttaac

SEQ ID NO: 5940565 - DNA, 20 bp, Homo sapiens
tcacagatgggtattaaact

SEQ ID NO: 5940566 - DNA, 17 bp, Homo sapiens
tcacagatgtgcccaga

SEQ ID NO: 5940567 - DNA, 18 bp, Homo sapiens
tcacagatgtgcccagag

SEQ ID NO: 5940568 - DNA, 21 bp, Homo sapiens
tcacagatgtgtgattcacag

SEQ ID NO: 5940569 - DNA, 22 bp, Homo sapiens
tcacagattgaggtaataatga

SEQ ID NO: 5940570 - DNA, 21 bp, Homo sapiens
tcacagatttccaaaagtact

SEQ ID NO: 5940571 - DNA, 21 bp, Homo sapiens
tcacagattttttctttaaat

SEQ ID NO: 5940572 - DNA, 16 bp, Homo sapiens
tcacagcaaacctctc

SEQ ID NO: 5940573 - DNA, 19 bp, Homo sapiens
tcacagcacatttgttaat

SEQ ID NO: 5940574 - DNA, 17 bp, Homo sapiens
tcacagcaccaaaataa

SEQ ID NO: 5940575 - DNA, 18 bp, Homo sapiens
tcacagcacttacaattt

SEQ ID NO: 5940576 - DNA, 20 bp, Homo sapiens
tcacagcacttacaattttc

SEQ ID NO: 5940577 - DNA, 14 bp, Homo sapiens
tcacagcagaatga

SEQ ID NO: 5940578 - DNA, 16 bp, Homo sapiens
tcacagcagaatgaag

SEQ ID NO: 5940579 - DNA, 14 bp, Homo sapiens
tcacagcagccact

SEQ ID NO: 5940580 - DNA, 13 bp, Homo sapiens
tcacagcagcctc

SEQ ID NO: 5940581 - DNA, 19 bp, Homo sapiens
tcacagcagtcacaggccc

SEQ ID NO: 5940582 - DNA, 23 bp, Homo sapiens
tcacagcagtcacaggcccagga

SEQ ID NO: 5940583 - DNA, 16 bp, Homo sapiens
tcacagcatgtgcaat

SEQ ID NO: 5940584 - DNA, 13 bp, Homo sapiens
tcacagcatttgc

SEQ ID NO: 5940585 - DNA, 16 bp, Homo sapiens
tcacagccacttggga

SEQ ID NO: 5940586 - DNA, 17 bp, Homo sapiens
tcacagccagactggca

SEQ ID NO: 5940587 - DNA, 17 bp, Homo sapiens
tcacagccagcccagct

SEQ ID NO: 5940588 - DNA, 19 bp, Homo sapiens
tcacagccagcccagctcc

SEQ ID NO: 5940589 - DNA, 14 bp, Homo sapiens
tcacagccatttca

SEQ ID NO: 5940590 - DNA, 12 bp, Homo sapiens
tcacagcccaga

SEQ ID NO: 5940591 - DNA, 22 bp, Homo sapiens
tcacagccccacccttgtccct

SEQ ID NO: 5940592 - DNA, 19 bp, Homo sapiens
tcacagcctaggaccagtt

SEQ ID NO: 5940593 - DNA, 15 bp, Homo sapiens
tcacagcctccaggg

SEQ ID NO: 5940594 - DNA, 15 bp, Homo sapiens
tcacagcctccgcgg

SEQ ID NO: 5940595 - DNA, 20 bp, Homo sapiens
tcacagcctcctctgtctgc

SEQ ID NO: 5940596 - DNA, 16 bp, Homo sapiens
tcacagcctctgaccc

SEQ ID NO: 5940597 - DNA, 17 bp, Homo sapiens
tcacagcctctgacccc

SEQ ID NO: 5940598 - DNA, 19 bp, Homo sapiens
tcacagcctctgacccctc

SEQ ID NO: 5940599 - DNA, 20 bp, Homo sapiens
tcacagcctctgacccctcc

SEQ ID NO: 5940600 - DNA, 22 bp, Homo sapiens
tcacagcctttgcgctctgggt

SEQ ID NO: 5940601 - DNA, 15 bp, Homo sapiens
tcacagcgtctgctc

SEQ ID NO: 5940602 - DNA, 15 bp, Homo sapiens
tcacagcgtttcagg

SEQ ID NO: 5940603 - DNA, 16 bp, Homo sapiens
tcacagctcacggcag

SEQ ID NO: 5940604 - DNA, 21 bp, Homo sapiens
tcacagctcacggcagcctca

SEQ ID NO: 5940605 - DNA, 18 bp, Homo sapiens
tcacagctgaagaaaatg

SEQ ID NO: 5940606 - DNA, 16 bp, Homo sapiens
tcacagctgcagctgg

SEQ ID NO: 5940607 - DNA, 19 bp, Homo sapiens
tcacagctgcagctgggcc

SEQ ID NO: 5940608 - DNA, 20 bp, Homo sapiens
tcacagctgcagctgggccc

SEQ ID NO: 5940609 - DNA, 15 bp, Homo sapiens
tcacagctggatctg

SEQ ID NO: 5940610 - DNA, 18 bp, Homo sapiens
tcacagctggatctgctt

SEQ ID NO: 5940611 - DNA, 19 bp, Homo sapiens
tcacagcttattatccaat

SEQ ID NO: 5940612 - DNA, 15 bp, Homo sapiens
tcacagcttcagcca

SEQ ID NO: 5940613 - DNA, 19 bp, Homo sapiens
tcacagcttcagccaggag

SEQ ID NO: 5940614 - DNA, 14 bp, Homo sapiens
tcacagcttctcca

SEQ ID NO: 5940615 - DNA, 20 bp, Homo sapiens
tcacagcttctccaagcatc

SEQ ID NO: 5940616 - DNA, 13 bp, Homo sapiens
tcacagcttcttt

SEQ ID NO: 5940617 - DNA, 17 bp, Homo sapiens
tcacagctttcccaggt

SEQ ID NO: 5940618 - DNA, 23 bp, Homo sapiens
tcacaggaaaatgtatccagagg

SEQ ID NO: 5940619 - DNA, 19 bp, Homo sapiens
tcacaggaagtagaggagg

SEQ ID NO: 5940620 - DNA, 23 bp, Homo sapiens
tcacaggactctgcctcctcttc

SEQ ID NO: 5940621 - DNA, 13 bp, Homo sapiens
tcacaggagcaga

SEQ ID NO: 5940622 - DNA, 14 bp, Homo sapiens
tcacaggagcagac

SEQ ID NO: 5940623 - DNA, 18 bp, Homo sapiens
tcacaggagcagacagag

SEQ ID NO: 5940624 - DNA, 21 bp, Homo sapiens
tcacaggatgccagcccctgc

SEQ ID NO: 5940625 - DNA, 23 bp, Homo sapiens
tcacaggatgccagcccctgcct

SEQ ID NO: 5940626 - DNA, 19 bp, Homo sapiens
tcacaggcaaagtccagct

SEQ ID NO: 5940627 - DNA, 22 bp, Homo sapiens
tcacaggcagccagtgccctga

SEQ ID NO: 5940628 - DNA, 18 bp, Homo sapiens
tcacaggcagctctgagc

SEQ ID NO: 5940629 - DNA, 11 bp, Homo sapiens
tcacaggcagg

SEQ ID NO: 5940630 - DNA, 12 bp, Homo sapiens
tcacaggcaggt

SEQ ID NO: 5940631 - DNA, 19 bp, Homo sapiens
tcacaggcaggtccagggt

SEQ ID NO: 5940632 - DNA, 20 bp, Homo sapiens
tcacaggcagtgcatgtgaa

SEQ ID NO: 5940633 - DNA, 17 bp, Homo sapiens
tcacaggcatagagtga

SEQ ID NO: 5940634 - DNA, 13 bp, Homo sapiens
tcacaggcccagg

SEQ ID NO: 5940635 - DNA, 13 bp, Homo sapiens
tcacaggcctctc

SEQ ID NO: 5940636 - DNA, 15 bp, Homo sapiens
tcacaggcctctctt

SEQ ID NO: 5940637 - DNA, 20 bp, Homo sapiens
tcacaggcgaggcctggagt

SEQ ID NO: 5940638 - DNA, 18 bp, Homo sapiens
tcacaggctgggctgggc

SEQ ID NO: 5940639 - DNA, 19 bp, Homo sapiens
tcacaggctgggctgggca

SEQ ID NO: 5940640 - DNA, 14 bp, Homo sapiens
tcacaggctgggtc

SEQ ID NO: 5940641 - DNA, 20 bp, Homo sapiens
tcacaggctgggtcaaaaga

SEQ ID NO: 5940642 - DNA, 23 bp, Homo sapiens
tcacaggctgggtcaaaagagcc

SEQ ID NO: 5940643 - DNA, 19 bp, Homo sapiens
tcacaggctgtaaattgaa

SEQ ID NO: 5940644 - DNA, 19 bp, Homo sapiens
tcacagggaatggccacaa

SEQ ID NO: 5940645 - DNA, 23 bp, Homo sapiens
tcacagggactgaaaacctctcc

SEQ ID NO: 5940646 - DNA, 20 bp, Homo sapiens
tcacagggaggattgaaaaa

SEQ ID NO: 5940647 - DNA, 15 bp, Homo sapiens
tcacagggcagagcc

SEQ ID NO: 5940648 - DNA, 19 bp, Homo sapiens
tcacagggcagagccggga

SEQ ID NO: 5940649 - DNA, 23 bp, Homo sapiens
tcacagggcaggccttgctgggg

SEQ ID NO: 5940650 - DNA, 16 bp, Homo sapiens
tcacagggcagtacct

SEQ ID NO: 5940651 - DNA, 14 bp, Homo sapiens
tcacagggccaact

SEQ ID NO: 5940652 - DNA, 13 bp, Homo sapiens
tcacagggcctca

SEQ ID NO: 5940653 - DNA, 14 bp, Homo sapiens
tcacagggcctcag

SEQ ID NO: 5940654 - DNA, 16 bp, Homo sapiens
tcacagggcctcagtt

SEQ ID NO: 5940655 - DNA, 17 bp, Homo sapiens
tcacagggcctcagttt

SEQ ID NO: 5940656 - DNA, 17 bp, Homo sapiens
tcacaggggcggggcag

SEQ ID NO: 5940657 - DNA, 14 bp, Homo sapiens
tcacaggggtacag

SEQ ID NO: 5940658 - DNA, 22 bp, Homo sapiens
tcacagggtgagggccacctcc

SEQ ID NO: 5940659 - DNA, 19 bp, Homo sapiens
tcacagggtgggcctcggc

SEQ ID NO: 5940660 - DNA, 24 bp, Homo sapiens
tcacagggttgggcccagatctgg

SEQ ID NO: 5940661 - DNA, 23 bp, Homo sapiens
tcacaggtagacagtatataact

SEQ ID NO: 5940662 - DNA, 19 bp, Homo sapiens
tcacaggtcttgcccaaag

SEQ ID NO: 5940663 - DNA, 22 bp, Homo sapiens
tcacaggttggaagagaatcac

SEQ ID NO: 5940664 - DNA, 17 bp, Homo sapiens
tcacaggttttcagaga

SEQ ID NO: 5940665 - DNA, 20 bp, Homo sapiens
tcacaggttttcagagaatt

SEQ ID NO: 5940666 - DNA, 21 bp, Homo sapiens
tcacaggttttcagagaatta

SEQ ID NO: 5940667 - DNA, 18 bp, Homo sapiens
tcacagtaaagagtacac

SEQ ID NO: 5940668 - DNA, 19 bp, Homo sapiens
tcacagtaaagagtacact

SEQ ID NO: 5940669 - DNA, 18 bp, Homo sapiens
tcacagtacagcatgtgc

SEQ ID NO: 5940670 - DNA, 20 bp, Homo sapiens
tcacagtacagcatgtgcct

SEQ ID NO: 5940671 - DNA, 12 bp, Homo sapiens
tcacagtacttt

SEQ ID NO: 5940672 - DNA, 18 bp, Homo sapiens
tcacagtagagccagctt

SEQ ID NO: 5940673 - DNA, 21 bp, Homo sapiens
tcacagtagagccagcttggg

SEQ ID NO: 5940674 - DNA, 22 bp, Homo sapiens
tcacagtatcagtattttcaca

SEQ ID NO: 5940675 - DNA, 15 bp, Homo sapiens
tcacagtattgctca

SEQ ID NO: 5940676 - DNA, 17 bp, Homo sapiens
tcacagtcaccaagtgt

SEQ ID NO: 5940677 - DNA, 15 bp, Homo sapiens
tcacagtccaaccag

SEQ ID NO: 5940678 - DNA, 20 bp, Homo sapiens
tcacagtccaaccagaaaca

SEQ ID NO: 5940679 - DNA, 15 bp, Homo sapiens
tcacagtcccactgt

SEQ ID NO: 5940680 - DNA, 18 bp, Homo sapiens
tcacagtcccactgtgca

SEQ ID NO: 5940681 - DNA, 22 bp, Homo sapiens
tcacagtcccaggtttagtgaa

SEQ ID NO: 5940682 - DNA, 19 bp, Homo sapiens
tcacagtcctatgtacaga

SEQ ID NO: 5940683 - DNA, 22 bp, Homo sapiens
tcacagtcctatgtacagagct

SEQ ID NO: 5940684 - DNA, 19 bp, Homo sapiens
tcacagtccttaccagcag

SEQ ID NO: 5940685 - DNA, 16 bp, Homo sapiens
tcacagtctaattttt

SEQ ID NO: 5940686 - DNA, 21 bp, Homo sapiens
tcacagtctaatttttattca

SEQ ID NO: 5940687 - DNA, 13 bp, Homo sapiens
tcacagtctcaca

SEQ ID NO: 5940688 - DNA, 18 bp, Homo sapiens
tcacagtctcagttctct

SEQ ID NO: 5940689 - DNA, 21 bp, Homo sapiens
tcacagtctctttaatcttca

SEQ ID NO: 5940690 - DNA, 16 bp, Homo sapiens
tcacagtcttgtgaac

SEQ ID NO: 5940691 - DNA, 18 bp, Homo sapiens
tcacagtgacccttccca

SEQ ID NO: 5940692 - DNA, 18 bp, Homo sapiens
tcacagtgctcttttctc

SEQ ID NO: 5940693 - DNA, 20 bp, Homo sapiens
tcacagtgctcttttctcct

SEQ ID NO: 5940694 - DNA, 14 bp, Homo sapiens
tcacagtgctgtgt

SEQ ID NO: 5940695 - DNA, 15 bp, Homo sapiens
tcacagtggcgagag

SEQ ID NO: 5940696 - DNA, 17 bp, Homo sapiens
tcacagtggcgagagga

SEQ ID NO: 5940697 - DNA, 17 bp, Homo sapiens
tcacagtgggagccagg

SEQ ID NO: 5940698 - DNA, 22 bp, Homo sapiens
tcacagtgggcggcttccctgc

SEQ ID NO: 5940699 - DNA, 23 bp, Homo sapiens
tcacagtggggtttttttgtctt

SEQ ID NO: 5940700 - DNA, 20 bp, Homo sapiens
tcacagtgtctgtaaatcaa

SEQ ID NO: 5940701 - DNA, 17 bp, Homo sapiens
tcacagtgtgtggtcaa

SEQ ID NO: 5940702 - DNA, 13 bp, Homo sapiens
tcacagtgtgttt

SEQ ID NO: 5940703 - DNA, 13 bp, Homo sapiens
tcacagtgtttct

SEQ ID NO: 5940704 - DNA, 21 bp, Homo sapiens
tcacagtgtttcttattcccc

SEQ ID NO: 5940705 - DNA, 19 bp, Homo sapiens
tcacagtgtttttattgct

SEQ ID NO: 5940706 - DNA, 17 bp, Homo sapiens
tcacagttattacatac

SEQ ID NO: 5940707 - DNA, 20 bp, Homo sapiens
tcacagttattattcttcta

SEQ ID NO: 5940708 - DNA, 16 bp, Homo sapiens
tcacagttcaaaattc

SEQ ID NO: 5940709 - DNA, 19 bp, Homo sapiens
tcacagttcaaaattctaa

SEQ ID NO: 5940710 - DNA, 23 bp, Homo sapiens
tcacagttccctttatttcacat

SEQ ID NO: 5940711 - DNA, 13 bp, Homo sapiens
tcacagttcctcg

SEQ ID NO: 5940712 - DNA, 19 bp, Homo sapiens
tcacagttcctcgccctgg

SEQ ID NO: 5940713 - DNA, 20 bp, Homo sapiens
tcacagttcctcgccctggg

SEQ ID NO: 5940714 - DNA, 16 bp, Homo sapiens
tcacagttctctcctt

SEQ ID NO: 5940715 - DNA, 14 bp, Homo sapiens
tcacagttctgtaa

SEQ ID NO: 5940716 - DNA, 22 bp, Homo sapiens
tcacagttgccatgtagacccc

SEQ ID NO: 5940717 - DNA, 19 bp, Homo sapiens
tcacagttggcacttctgc

SEQ ID NO: 5940718 - DNA, 19 bp, Homo sapiens
tcacataaactttataaat

SEQ ID NO: 5940719 - DNA, 22 bp, Homo sapiens
tcacataaagaaattcaagaag

SEQ ID NO: 5940720 - DNA, 24 bp, Homo sapiens
tcacataaagaaattcaagaagta

SEQ ID NO: 5940721 - DNA, 23 bp, Homo sapiens
tcacataaatggattaattacta

SEQ ID NO: 5940722 - DNA, 16 bp, Homo sapiens
tcacataacagaatgc

SEQ ID NO: 5940723 - DNA, 19 bp, Homo sapiens
tcacataacagagtagttt

SEQ ID NO: 5940724 - DNA, 17 bp, Homo sapiens
tcacataagctcagaat

SEQ ID NO: 5940725 - DNA, 20 bp, Homo sapiens
tcacataagctcagaatcca

SEQ ID NO: 5940726 - DNA, 17 bp, Homo sapiens
tcacataatgaatgcta

SEQ ID NO: 5940727 - DNA, 20 bp, Homo sapiens
tcacataattccagtcacag

SEQ ID NO: 5940728 - DNA, 18 bp, Homo sapiens
tcacatacaattattttt

SEQ ID NO: 5940729 - DNA, 14 bp, Homo sapiens
tcacatacaatttg

SEQ ID NO: 5940730 - DNA, 18 bp, Homo sapiens
tcacatacaatttgcact

SEQ ID NO: 5940731 - DNA, 16 bp, Homo sapiens
tcacataccagagtct

SEQ ID NO: 5940732 - DNA, 23 bp, Homo sapiens
tcacataccagagtctggagctg

SEQ ID NO: 5940733 - DNA, 17 bp, Homo sapiens
tcacatagatgtccctt

SEQ ID NO: 5940734 - DNA, 20 bp, Homo sapiens
tcacataggaagggatctga

SEQ ID NO: 5940735 - DNA, 14 bp, Homo sapiens
tcacataggctctc

SEQ ID NO: 5940736 - DNA, 23 bp, Homo sapiens
tcacataggtaggtatctttata

SEQ ID NO: 5940737 - DNA, 22 bp, Homo sapiens
tcacataggttagattctcatt

SEQ ID NO: 5940738 - DNA, 21 bp, Homo sapiens
tcacatataaaagttaaacta

SEQ ID NO: 5940739 - DNA, 22 bp, Homo sapiens
tcacatataaatagatgatttc

SEQ ID NO: 5940740 - DNA, 14 bp, Homo sapiens
tcacatataacatg

SEQ ID NO: 5940741 - DNA, 14 bp, Homo sapiens
tcacatatctagta

SEQ ID NO: 5940742 - DNA, 17 bp, Homo sapiens
tcacatatctagtatga

SEQ ID NO: 5940743 - DNA, 21 bp, Homo sapiens
tcacatatctagtatgaaatt

SEQ ID NO: 5940744 - DNA, 15 bp, Homo sapiens
tcacatatctgtcat

SEQ ID NO: 5940745 - DNA, 17 bp, Homo sapiens
tcacatatgtctgtatc

SEQ ID NO: 5940746 - DNA, 18 bp, Homo sapiens
tcacatattgatttccgt

SEQ ID NO: 5940747 - DNA, 14 bp, Homo sapiens
tcacatattttaaa

SEQ ID NO: 5940748 - DNA, 23 bp, Homo sapiens
tcacatattttattaagaactca

SEQ ID NO: 5940749 - DNA, 13 bp, Homo sapiens
tcacatcaagcat

SEQ ID NO: 5940750 - DNA, 15 bp, Homo sapiens
tcacatcaagcatca

SEQ ID NO: 5940751 - DNA, 18 bp, Homo sapiens
tcacatcacaatattcag

SEQ ID NO: 5940752 - DNA, 13 bp, Homo sapiens
tcacatcacagga

SEQ ID NO: 5940753 - DNA, 20 bp, Homo sapiens
tcacatcacccatgttgaga

SEQ ID NO: 5940754 - DNA, 13 bp, Homo sapiens
tcacatcagataa

SEQ ID NO: 5940755 - DNA, 16 bp, Homo sapiens
tcacatccaactggaa

SEQ ID NO: 5940756 - DNA, 23 bp, Homo sapiens
tcacatccaatgcatagtttgtt

SEQ ID NO: 5940757 - DNA, 13 bp, Homo sapiens
tcacatccatccc

SEQ ID NO: 5940758 - DNA, 12 bp, Homo sapiens
tcacatccctct

SEQ ID NO: 5940759 - DNA, 22 bp, Homo sapiens
tcacatccctgtaaattgcaga

SEQ ID NO: 5940760 - DNA, 17 bp, Homo sapiens
tcacatcctaatagaaa

SEQ ID NO: 5940761 - DNA, 21 bp, Homo sapiens
tcacatcctaatagaaagaaa

SEQ ID NO: 5940762 - DNA, 13 bp, Homo sapiens
tcacatcctcaga

SEQ ID NO: 5940763 - DNA, 17 bp, Homo sapiens
tcacatcctcctgccca

SEQ ID NO: 5940764 - DNA, 19 bp, Homo sapiens
tcacatcctcctgcccagc

SEQ ID NO: 5940765 - DNA, 23 bp, Homo sapiens
tcacatcctcctgcccagctcct

SEQ ID NO: 5940766 - DNA, 15 bp, Homo sapiens
tcacatcctctccag

SEQ ID NO: 5940767 - DNA, 11 bp, Homo sapiens
tcacatcctgg

SEQ ID NO: 5940768 - DNA, 18 bp, Homo sapiens
tcacatcctggcctggca

SEQ ID NO: 5940769 - DNA, 19 bp, Homo sapiens
tcacatcctggcctggcac

SEQ ID NO: 5940770 - DNA, 17 bp, Homo sapiens
tcacatcctgtgtttct

SEQ ID NO: 5940771 - DNA, 15 bp, Homo sapiens
tcacatctaaagctt

SEQ ID NO: 5940772 - DNA, 16 bp, Homo sapiens
tcacatctaaagcttt

SEQ ID NO: 5940773 - DNA, 20 bp, Homo sapiens
tcacatctaaagctttatct

SEQ ID NO: 5940774 - DNA, 15 bp, Homo sapiens
tcacatctcacctcc

SEQ ID NO: 5940775 - DNA, 20 bp, Homo sapiens
tcacatctgcacactctctt

SEQ ID NO: 5940776 - DNA, 12 bp, Homo sapiens
tcacatctgtat

SEQ ID NO: 5940777 - DNA, 23 bp, Homo sapiens
tcacatcttatttattttagcaa

SEQ ID NO: 5940778 - DNA, 15 bp, Homo sapiens
tcacatcttggcaca

SEQ ID NO: 5940779 - DNA, 14 bp, Homo sapiens
tcacatctttcaca

SEQ ID NO: 5940780 - DNA, 20 bp, Homo sapiens
tcacatgaaggagacagcag

SEQ ID NO: 5940781 - DNA, 17 bp, Homo sapiens
tcacatgaattattaca

SEQ ID NO: 5940782 - DNA, 21 bp, Homo sapiens
tcacatgaattattacagtgt

SEQ ID NO: 5940783 - DNA, 22 bp, Homo sapiens
tcacatgaattattacagtgtt

SEQ ID NO: 5940784 - DNA, 23 bp, Homo sapiens
tcacatgacatccacatgcacat

SEQ ID NO: 5940785 - DNA, 14 bp, Homo sapiens
tcacatgaccacat

SEQ ID NO: 5940786 - DNA, 13 bp, Homo sapiens
tcacatgacctga

SEQ ID NO: 5940787 - DNA, 20 bp, Homo sapiens
tcacatgacctgatcactag

SEQ ID NO: 5940788 - DNA, 18 bp, Homo sapiens
tcacatgactgaagggac

SEQ ID NO: 5940789 - DNA, 19 bp, Homo sapiens
tcacatgagtcaaaacaaa

SEQ ID NO: 5940790 - DNA, 13 bp, Homo sapiens
tcacatgatgaaa

SEQ ID NO: 5940791 - DNA, 21 bp, Homo sapiens
tcacatgatgcacttcaaatt

SEQ ID NO: 5940792 - DNA, 23 bp, Homo sapiens
tcacatgattatagaaggctgtc

SEQ ID NO: 5940793 - DNA, 20 bp, Homo sapiens
tcacatgattccagccatca

SEQ ID NO: 5940794 - DNA, 21 bp, Homo sapiens
tcacatgcccgctgtcccagg

SEQ ID NO: 5940795 - DNA, 22 bp, Homo sapiens
tcacatgcccgctgtcccaggg

SEQ ID NO: 5940796 - DNA, 13 bp, Homo sapiens
tcacatgccttgc

SEQ ID NO: 5940797 - DNA, 15 bp, Homo sapiens
tcacatgccttgcaa

SEQ ID NO: 5940798 - DNA, 18 bp, Homo sapiens
tcacatgctaaagccagg

SEQ ID NO: 5940799 - DNA, 17 bp, Homo sapiens
tcacatgctccttgcct

SEQ ID NO: 5940800 - DNA, 18 bp, Homo sapiens
tcacatgctccttgcctc

SEQ ID NO: 5940801 - DNA, 13 bp, Homo sapiens
tcacatgctggct

SEQ ID NO: 5940802 - DNA, 14 bp, Homo sapiens
tcacatgctggctc

SEQ ID NO: 5940803 - DNA, 21 bp, Homo sapiens
tcacatggaatctacatgtgt

SEQ ID NO: 5940804 - DNA, 19 bp, Homo sapiens
tcacatggaatgagggttt

SEQ ID NO: 5940805 - DNA, 16 bp, Homo sapiens
tcacatggagctcttc

SEQ ID NO: 5940806 - DNA, 21 bp, Homo sapiens
tcacatggcctatgcacatat

SEQ ID NO: 5940807 - DNA, 23 bp, Homo sapiens
tcacatggcgtcctgcccttgct

SEQ ID NO: 5940808 - DNA, 18 bp, Homo sapiens
tcacatggtgcccctagc

SEQ ID NO: 5940809 - DNA, 21 bp, Homo sapiens
tcacatggtgctacgcctgca

SEQ ID NO: 5940810 - DNA, 15 bp, Homo sapiens
tcacatgtatgtttt

SEQ ID NO: 5940811 - DNA, 18 bp, Homo sapiens
tcacatgtcagccactgt

SEQ ID NO: 5940812 - DNA, 21 bp, Homo sapiens
tcacatgtcagtaccttcaaa

SEQ ID NO: 5940813 - DNA, 19 bp, Homo sapiens
tcacatgtcctattactga

SEQ ID NO: 5940814 - DNA, 19 bp, Homo sapiens
tcacatgtgccctctgcca

SEQ ID NO: 5940815 - DNA, 16 bp, Homo sapiens
tcacatgtgccctgcc

SEQ ID NO: 5940816 - DNA, 13 bp, Homo sapiens
tcacatgtggcac

SEQ ID NO: 5940817 - DNA, 17 bp, Homo sapiens
tcacatgtggctccccc

SEQ ID NO: 5940818 - DNA, 14 bp, Homo sapiens
tcacatgttttcaa

SEQ ID NO: 5940819 - DNA, 17 bp, Homo sapiens
tcacatgttttcaaatg

SEQ ID NO: 5940820 - DNA, 18 bp, Homo sapiens
tcacatgttttcaaatgg

SEQ ID NO: 5940821 - DNA, 20 bp, Homo sapiens
tcacatgttttcaaatggag

SEQ ID NO: 5940822 - DNA, 12 bp, Homo sapiens
tcacattaacat

SEQ ID NO: 5940823 - DNA, 15 bp, Homo sapiens
tcacattaacatttt

SEQ ID NO: 5940824 - DNA, 19 bp, Homo sapiens
tcacattaactcaggcatt

SEQ ID NO: 5940825 - DNA, 20 bp, Homo sapiens
tcacattaatatttgctgac

SEQ ID NO: 5940826 - DNA, 18 bp, Homo sapiens
tcacattaatctcaaaga

SEQ ID NO: 5940827 - DNA, 19 bp, Homo sapiens
tcacattaatggtctaaaa

SEQ ID NO: 5940828 - DNA, 22 bp, Homo sapiens
tcacattaatggtctaaaaata

SEQ ID NO: 5940829 - DNA, 21 bp, Homo sapiens
tcacattacatcatcctcctt

SEQ ID NO: 5940830 - DNA, 15 bp, Homo sapiens
tcacattagaagaca

SEQ ID NO: 5940831 - DNA, 13 bp, Homo sapiens
tcacattagaatt

SEQ ID NO: 5940832 - DNA, 20 bp, Homo sapiens
tcacattaggggaaccattg

SEQ ID NO: 5940833 - DNA, 18 bp, Homo sapiens
tcacattatttattaaaa

SEQ ID NO: 5940834 - DNA, 20 bp, Homo sapiens
tcacattatttattaaaaat

SEQ ID NO: 5940835 - DNA, 16 bp, Homo sapiens
tcacattatttgcatg

SEQ ID NO: 5940836 - DNA, 13 bp, Homo sapiens
tcacattccctct

SEQ ID NO: 5940837 - DNA, 22 bp, Homo sapiens
tcacattcctctgcccttcctg

SEQ ID NO: 5940838 - DNA, 16 bp, Homo sapiens
tcacattcctgaccct

SEQ ID NO: 5940839 - DNA, 12 bp, Homo sapiens
tcacattctgct

SEQ ID NO: 5940840 - DNA, 14 bp, Homo sapiens
tcacattctgctta

SEQ ID NO: 5940841 - DNA, 15 bp, Homo sapiens
tcacattcttataaa

SEQ ID NO: 5940842 - DNA, 18 bp, Homo sapiens
tcacattcttataaatat

SEQ ID NO: 5940843 - DNA, 21 bp, Homo sapiens
tcacattcttggcttaatcat

SEQ ID NO: 5940844 - DNA, 14 bp, Homo sapiens
tcacattgaatcat

SEQ ID NO: 5940845 - DNA, 20 bp, Homo sapiens
tcacattgagctgatataaa

SEQ ID NO: 5940846 - DNA, 23 bp, Homo sapiens
tcacattgagctgatataaattc

SEQ ID NO: 5940847 - DNA, 13 bp, Homo sapiens
tcacattgatcat

SEQ ID NO: 5940848 - DNA, 12 bp, Homo sapiens
tcacattgcatt

SEQ ID NO: 5940849 - DNA, 15 bp, Homo sapiens
tcacattgcattcta

SEQ ID NO: 5940850 - DNA, 17 bp, Homo sapiens
tcacattgcattctatt

SEQ ID NO: 5940851 - DNA, 21 bp, Homo sapiens
tcacattgcattctattgcct

SEQ ID NO: 5940852 - DNA, 21 bp, Homo sapiens
tcacattgctgtattttagaa

SEQ ID NO: 5940853 - DNA, 14 bp, Homo sapiens
tcacattggaaaca

SEQ ID NO: 5940854 - DNA, 17 bp, Homo sapiens
tcacattggaaacaagt

SEQ ID NO: 5940855 - DNA, 20 bp, Homo sapiens
tcaccgatattagtcctaca

SEQ ID NO: 5940856 - DNA, 19 bp, Homo sapiens
tcaccgattcttccttgcc

SEQ ID NO: 5940857 - DNA, 21 bp, Homo sapiens
tcaccgattcttccttgccac

SEQ ID NO: 5940858 - DNA, 20 bp, Homo sapiens
tcaccgcaggtgctcatgct

SEQ ID NO: 5940859 - DNA, 20 bp, Homo sapiens
tcaccgcagtcgtcgcacag

SEQ ID NO: 5940860 - DNA, 15 bp, Homo sapiens
tcaccgcattccagg

SEQ ID NO: 5940861 - DNA, 14 bp, Homo sapiens
tcaccgccatgcaa

SEQ ID NO: 5940862 - DNA, 15 bp, Homo sapiens
tcaccgcccatcagg

SEQ ID NO: 5940863 - DNA, 20 bp, Homo sapiens
tcaccgcccatcagggttct

SEQ ID NO: 5940864 - DNA, 18 bp, Homo sapiens
tcaccgcggctggatggg

SEQ ID NO: 5940865 - DNA, 20 bp, Homo sapiens
tcaccgctggcccttagaga

SEQ ID NO: 5940866 - DNA, 15 bp, Homo sapiens
tcaccgctgggtggt

SEQ ID NO: 5940867 - DNA, 19 bp, Homo sapiens
tcaccgcttccctcctgcc

SEQ ID NO: 5940868 - DNA, 13 bp, Homo sapiens
tcaccggcatgct

SEQ ID NO: 5940869 - DNA, 15 bp, Homo sapiens
tcaccggcatgctgg

SEQ ID NO: 5940870 - DNA, 15 bp, Homo sapiens
tcaccggctctcacc

SEQ ID NO: 5940871 - DNA, 19 bp, Homo sapiens
tcaccgtatctcaggaagt

SEQ ID NO: 5940872 - DNA, 17 bp, Homo sapiens
tcaccgtcacaataaaa

SEQ ID NO: 5940873 - DNA, 17 bp, Homo sapiens
tcaccgtgctgtcttct

SEQ ID NO: 5940874 - DNA, 22 bp, Homo sapiens
tcaccgtgctgtcttctggtct

SEQ ID NO: 5940875 - DNA, 18 bp, Homo sapiens
tcaccgtggaccttcctg

SEQ ID NO: 5940876 - DNA, 20 bp, Homo sapiens
tcaccgtggaccttcctgcc

SEQ ID NO: 5940877 - DNA, 21 bp, Homo sapiens
tcaccgtggattcgcttgagt

SEQ ID NO: 5940878 - DNA, 21 bp, Homo sapiens
tcaccgtggctaccattgtca

SEQ ID NO: 5940879 - DNA, 17 bp, Homo sapiens
tcacctaaaccctctgt

SEQ ID NO: 5940880 - DNA, 19 bp, Homo sapiens
tcacctaaaccctctgtga

SEQ ID NO: 5940881 - DNA, 21 bp, Homo sapiens
tcacctaaaccctctgtgaaa

SEQ ID NO: 5940882 - DNA, 16 bp, Homo sapiens
tcacctaacagaatat

SEQ ID NO: 5940883 - DNA, 20 bp, Homo sapiens
tcacctaagcaatcactggg

SEQ ID NO: 5940884 - DNA, 23 bp, Homo sapiens
tcacctaagcaatcactgggccc

SEQ ID NO: 5940885 - DNA, 16 bp, Homo sapiens
tcacctaagcacttct

SEQ ID NO: 5940886 - DNA, 19 bp, Homo sapiens
tcacctaagcacttctaga

SEQ ID NO: 5940887 - DNA, 17 bp, Homo sapiens
tcacctaagtctctgtg

SEQ ID NO: 5940888 - DNA, 14 bp, Homo sapiens
tcacctaatgttta

SEQ ID NO: 5940889 - DNA, 16 bp, Homo sapiens
tcacctacaggactgg

SEQ ID NO: 5940890 - DNA, 18 bp, Homo sapiens
tcacctacaggactgggc

SEQ ID NO: 5940891 - DNA, 19 bp, Homo sapiens
tcacctacaggactgggcc

SEQ ID NO: 5940892 - DNA, 19 bp, Homo sapiens
tcacctactcacacaggca

SEQ ID NO: 5940893 - DNA, 18 bp, Homo sapiens
tcacctacttcctcctcc

SEQ ID NO: 5940894 - DNA, 16 bp, Homo sapiens
tcacctagaacgtgca

SEQ ID NO: 5940895 - DNA, 20 bp, Homo sapiens
tcacctagaccttgcctccc

SEQ ID NO: 5940896 - DNA, 14 bp, Homo sapiens
tcacctagagccag

SEQ ID NO: 5940897 - DNA, 23 bp, Homo sapiens
tcacctagcaacatatctctgcc

SEQ ID NO: 5940898 - DNA, 16 bp, Homo sapiens
tcacctagcagcctca

SEQ ID NO: 5940899 - DNA, 17 bp, Homo sapiens
tcacctagcatgtgtaa

SEQ ID NO: 5940900 - DNA, 14 bp, Homo sapiens
tcacctagctgctc

SEQ ID NO: 5940901 - DNA, 20 bp, Homo sapiens
tcacctaggaagcctcagat

SEQ ID NO: 5940902 - DNA, 17 bp, Homo sapiens
tcacctaggggaggagg

SEQ ID NO: 5940903 - DNA, 19 bp, Homo sapiens
tcacctatccagagagtat

SEQ ID NO: 5940904 - DNA, 14 bp, Homo sapiens
tcacctatttaatg

SEQ ID NO: 5940905 - DNA, 16 bp, Homo sapiens
tcacctatttaatgtt

SEQ ID NO: 5940906 - DNA, 20 bp, Homo sapiens
tcacctatttccattcaaca

SEQ ID NO: 5940907 - DNA, 15 bp, Homo sapiens
tcacctcactcagca

SEQ ID NO: 5940908 - DNA, 19 bp, Homo sapiens
tcacctcactcagcaccac

SEQ ID NO: 5940909 - DNA, 20 bp, Homo sapiens
tcacctcactcagcaccact

SEQ ID NO: 5940910 - DNA, 23 bp, Homo sapiens
tcacctcactcagcaccactcaa

SEQ ID NO: 5940911 - DNA, 12 bp, Homo sapiens
tcacctcagagt

SEQ ID NO: 5940912 - DNA, 16 bp, Homo sapiens
tcacctcagagtggag

SEQ ID NO: 5940913 - DNA, 13 bp, Homo sapiens
tcacctcagcctg

SEQ ID NO: 5940914 - DNA, 18 bp, Homo sapiens
tcacctcagcctggagag

SEQ ID NO: 5940915 - DNA, 23 bp, Homo sapiens
tcacctcagcctggagaggcctg

SEQ ID NO: 5940916 - DNA, 13 bp, Homo sapiens
tcacctcagctga

SEQ ID NO: 5940917 - DNA, 16 bp, Homo sapiens
tcacctcagtagaaaa

SEQ ID NO: 5940918 - DNA, 14 bp, Homo sapiens
tcacctcatggaat

SEQ ID NO: 5940919 - DNA, 14 bp, Homo sapiens
tcacctcattctga

SEQ ID NO: 5940920 - DNA, 19 bp, Homo sapiens
tcacctccaagcatttcat

SEQ ID NO: 5940921 - DNA, 15 bp, Homo sapiens
tcacctccatccccc

SEQ ID NO: 5940922 - DNA, 16 bp, Homo sapiens
tcacctccatccccct

SEQ ID NO: 5940923 - DNA, 12 bp, Homo sapiens
tcacctccatgt

SEQ ID NO: 5940924 - DNA, 13 bp, Homo sapiens
tcacctcccaggg

SEQ ID NO: 5940925 - DNA, 24 bp, Homo sapiens
tcacctccccacatcgcacactgg

SEQ ID NO: 5940926 - DNA, 15 bp, Homo sapiens
tcacctcccccatct

SEQ ID NO: 5940927 - DNA, 17 bp, Homo sapiens
tcacctcccctccttgc

SEQ ID NO: 5940928 - DNA, 18 bp, Homo sapiens
tcacctcccgaagccacc

SEQ ID NO: 5940929 - DNA, 16 bp, Homo sapiens
tcacctccctgctcag

SEQ ID NO: 5940930 - DNA, 20 bp, Homo sapiens
tcacctccctgctcagtgct

SEQ ID NO: 5940931 - DNA, 21 bp, Homo sapiens
tcacctccggcctccacatga

SEQ ID NO: 5940932 - DNA, 23 bp, Homo sapiens
tcacctccggtcgtgtctctggt

SEQ ID NO: 5940933 - DNA, 11 bp, Homo sapiens
tcacctcctaa

SEQ ID NO: 5940934 - DNA, 12 bp, Homo sapiens
tcacctcctaat

SEQ ID NO: 5940935 - DNA, 11 bp, Homo sapiens
tcacctcctcc

SEQ ID NO: 5940936 - DNA, 16 bp, Homo sapiens
tcacctcctccactca

SEQ ID NO: 5940937 - DNA, 12 bp, Homo sapiens
tcacctcctcta

SEQ ID NO: 5940938 - DNA, 22 bp, Homo sapiens
tcacctcctctaaggttgggca

SEQ ID NO: 5940939 - DNA, 17 bp, Homo sapiens
tcacctccttctgcagt

SEQ ID NO: 5940940 - DNA, 24 bp, Homo sapiens
tcacctcgagaagtaattatcagt

SEQ ID NO: 5940941 - DNA, 13 bp, Homo sapiens
tcacctcgctggg

SEQ ID NO: 5940942 - DNA, 16 bp, Homo sapiens
tcacctcgtctccctg

SEQ ID NO: 5940943 - DNA, 17 bp, Homo sapiens
tcacctcgtctccctgg

SEQ ID NO: 5940944 - DNA, 22 bp, Homo sapiens
tcacctcgtctccctggtgcct

SEQ ID NO: 5940945 - DNA, 20 bp, Homo sapiens
tcacctcgttactctcacct

SEQ ID NO: 5940946 - DNA, 20 bp, Homo sapiens
tcacctctaaaacagtcctt

SEQ ID NO: 5940947 - DNA, 23 bp, Homo sapiens
tcacctctacccaaaccctaggt

SEQ ID NO: 5940948 - DNA, 17 bp, Homo sapiens
tcacctctactgtctcc

SEQ ID NO: 5940949 - DNA, 17 bp, Homo sapiens
tcacctctaggcctcag

SEQ ID NO: 5940950 - DNA, 18 bp, Homo sapiens
tcacctctaggcctcagt

SEQ ID NO: 5940951 - DNA, 22 bp, Homo sapiens
tcacctctaggtccccatactc

SEQ ID NO: 5940952 - DNA, 16 bp, Homo sapiens
tcacctctcagctgct

SEQ ID NO: 5940953 - DNA, 16 bp, Homo sapiens
tcacctctccaggtgc

SEQ ID NO: 5940954 - DNA, 18 bp, Homo sapiens
tcacctctccaggtgctc

SEQ ID NO: 5940955 - DNA, 16 bp, Homo sapiens
tcacctctctcactga

SEQ ID NO: 5940956 - DNA, 14 bp, Homo sapiens
tcacctctctcaga

SEQ ID NO: 5940957 - DNA, 16 bp, Homo sapiens
tcacctctcttcagcc

SEQ ID NO: 5940958 - DNA, 15 bp, Homo sapiens
tcacctctgcctcaa

SEQ ID NO: 5940959 - DNA, 18 bp, Homo sapiens
tcacctctgggaccccag

SEQ ID NO: 5940960 - DNA, 19 bp, Homo sapiens
tcacctctgggaccccagc

SEQ ID NO: 5940961 - DNA, 21 bp, Homo sapiens
tcacctctgggaccccagctg

SEQ ID NO: 5940962 - DNA, 22 bp, Homo sapiens
tcacctctgggaccccagctgc

SEQ ID NO: 5940963 - DNA, 23 bp, Homo sapiens
tcacctctgggaccccagctgct

SEQ ID NO: 5940964 - DNA, 14 bp, Homo sapiens
tcacctctgttaag

SEQ ID NO: 5940965 - DNA, 20 bp, Homo sapiens
tcacctcttccactccttct

SEQ ID NO: 5940966 - DNA, 19 bp, Homo sapiens
tcacctctttaaccactcc

SEQ ID NO: 5940967 - DNA, 14 bp, Homo sapiens
tcacctgaaacact

SEQ ID NO: 5940968 - DNA, 16 bp, Homo sapiens
tcacctgaaacactgg

SEQ ID NO: 5940969 - DNA, 19 bp, Homo sapiens
tcacctgaaacactggacc

SEQ ID NO: 5940970 - DNA, 17 bp, Homo sapiens
tcacctgaaccccagag

SEQ ID NO: 5940971 - DNA, 19 bp, Homo sapiens
tcacctgaaccccagaggc

SEQ ID NO: 5940972 - DNA, 15 bp, Homo sapiens
tcacctgacctctga

SEQ ID NO: 5940973 - DNA, 15 bp, Homo sapiens
tcacctgagacctcc

SEQ ID NO: 5940974 - DNA, 22 bp, Homo sapiens
tcacctgagcaggacctctgaa

SEQ ID NO: 5940975 - DNA, 23 bp, Homo sapiens
tcacctgagcccggatgcttctc

SEQ ID NO: 5940976 - DNA, 17 bp, Homo sapiens
tcacctgaggtcgggag

SEQ ID NO: 5940977 - DNA, 18 bp, Homo sapiens
tcacctgattcaactaaa

SEQ ID NO: 5940978 - DNA, 19 bp, Homo sapiens
tcacctgattcaactaaaa

SEQ ID NO: 5940979 - DNA, 23 bp, Homo sapiens
tcacctgcaagccccagggcctg

SEQ ID NO: 5940980 - DNA, 21 bp, Homo sapiens
tcacctgcacagggccctctg

SEQ ID NO: 5940981 - DNA, 23 bp, Homo sapiens
tcacctgcacagggccctctgag

SEQ ID NO: 5940982 - DNA, 13 bp, Homo sapiens
tcacctgcactaa

SEQ ID NO: 5940983 - DNA, 13 bp, Homo sapiens
tcacctgcagaga

SEQ ID NO: 5940984 - DNA, 13 bp, Homo sapiens
tcacctgccacca

SEQ ID NO: 5940985 - DNA, 14 bp, Homo sapiens
tcacctgccccagc

SEQ ID NO: 5940986 - DNA, 15 bp, Homo sapiens
tcacctgcccctcaa

SEQ ID NO: 5940987 - DNA, 18 bp, Homo sapiens
tcacctgcccctctgttc

SEQ ID NO: 5940988 - DNA, 14 bp, Homo sapiens
tcacctgccggctc

SEQ ID NO: 5940989 - DNA, 12 bp, Homo sapiens
tcacctgcctgt

SEQ ID NO: 5940990 - DNA, 16 bp, Homo sapiens
tcacctgcgcaagtgc

SEQ ID NO: 5940991 - DNA, 21 bp, Homo sapiens
tcacctgcgcaagtgcctggg

SEQ ID NO: 5940992 - DNA, 22 bp, Homo sapiens
tcacctgcgcaagtgcctggga

SEQ ID NO: 5940993 - DNA, 18 bp, Homo sapiens
tcacctgcgcagggccct

SEQ ID NO: 5940994 - DNA, 20 bp, Homo sapiens
tcacctgcgcagggccctct

SEQ ID NO: 5940995 - DNA, 14 bp, Homo sapiens
tcacctgctccaga

SEQ ID NO: 5940996 - DNA, 16 bp, Homo sapiens
tcacctgctccagaag

SEQ ID NO: 5940997 - DNA, 16 bp, Homo sapiens
tcacctgctcccagtc

SEQ ID NO: 5940998 - DNA, 15 bp, Homo sapiens
tcacctgctggcccc

SEQ ID NO: 5940999 - DNA, 13 bp, Homo sapiens
tcacctgctggtt

SEQ ID NO: 5941000 - DNA, 18 bp, Homo sapiens
tcacctggaggcaagagg

SEQ ID NO: 5941001 - DNA, 13 bp, Homo sapiens
tcacctggccctg

SEQ ID NO: 5941002 - DNA, 14 bp, Homo sapiens
tcacctggccctgc

SEQ ID NO: 5941003 - DNA, 16 bp, Homo sapiens
tcacctggccctgctt

SEQ ID NO: 5941004 - DNA, 19 bp, Homo sapiens
tcacctggccctgcttcct

SEQ ID NO: 5941005 - DNA, 23 bp, Homo sapiens
tcacctggccctgcttcctgctt

SEQ ID NO: 5941006 - DNA, 12 bp, Homo sapiens
tcacctggctga

SEQ ID NO: 5941007 - DNA, 19 bp, Homo sapiens
tcacctggctgagcagttc

SEQ ID NO: 5941008 - DNA, 19 bp, Homo sapiens
tcacctggctgctaggcca

SEQ ID NO: 5941009 - DNA, 13 bp, Homo sapiens
tcacctggcttcc

SEQ ID NO: 5941010 - DNA, 22 bp, Homo sapiens
tcacctgggcctttcctgtgcc

SEQ ID NO: 5941011 - DNA, 12 bp, Homo sapiens
tcacctgggcgg

SEQ ID NO: 5941012 - DNA, 17 bp, Homo sapiens
tcacctggggctgctgg

SEQ ID NO: 5941013 - DNA, 18 bp, Homo sapiens
tcacctggggctgctggc

SEQ ID NO: 5941014 - DNA, 18 bp, Homo sapiens
tcacctgggtttgcaaga

SEQ ID NO: 5941015 - DNA, 17 bp, Homo sapiens
tcacctggtatccatta

SEQ ID NO: 5941016 - DNA, 13 bp, Homo sapiens
tcacctggtcctc

SEQ ID NO: 5941017 - DNA, 14 bp, Homo sapiens
tcacctggtcctcc

SEQ ID NO: 5941018 - DNA, 15 bp, Homo sapiens
tcacctggttgaccc

SEQ ID NO: 5941019 - DNA, 16 bp, Homo sapiens
tcacctgtaaaacttt

SEQ ID NO: 5941020 - DNA, 18 bp, Homo sapiens
tcacctgtaaaactttat

SEQ ID NO: 5941021 - DNA, 16 bp, Homo sapiens
tcacctgtaaacctga

SEQ ID NO: 5941022 - DNA, 22 bp, Homo sapiens
tcacctgtaagatgaagataag

SEQ ID NO: 5941023 - DNA, 15 bp, Homo sapiens
tcacctgtactattg

SEQ ID NO: 5941024 - DNA, 20 bp, Homo sapiens
tcacctgtatatttctttta

SEQ ID NO: 5941025 - DNA, 20 bp, Homo sapiens
tcacctgtgcagggccctct

SEQ ID NO: 5941026 - DNA, 12 bp, Homo sapiens
tcacctgtgcta

SEQ ID NO: 5941027 - DNA, 16 bp, Homo sapiens
tcacctgtgctacctc

SEQ ID NO: 5941028 - DNA, 17 bp, Homo sapiens
tcacctgtgtgcccagc

SEQ ID NO: 5941029 - DNA, 23 bp, Homo sapiens
tcacctgttactgaaagtggttt

SEQ ID NO: 5941030 - DNA, 20 bp, Homo sapiens
tcacctgttcatttgaagaa

SEQ ID NO: 5941031 - DNA, 22 bp, Homo sapiens
tcacctgttcatttgaagaaaa

SEQ ID NO: 5941032 - DNA, 20 bp, Homo sapiens
tcacctgttgcttacaattt

SEQ ID NO: 5941033 - DNA, 17 bp, Homo sapiens
tcactcttggagcctgc

SEQ ID NO: 5941034 - DNA, 21 bp, Homo sapiens
tcactcttgtcacccaggctg

SEQ ID NO: 5941035 - DNA, 13 bp, Homo sapiens
tcactcttttgat

SEQ ID NO: 5941036 - DNA, 23 bp, Homo sapiens
tcactcttttgggatctaactgt

SEQ ID NO: 5941037 - DNA, 17 bp, Homo sapiens
tcactgaaaattggaca

SEQ ID NO: 5941038 - DNA, 22 bp, Homo sapiens
tcactgaaaattggacagattg

SEQ ID NO: 5941039 - DNA, 14 bp, Homo sapiens
tcactgaaacatgg

SEQ ID NO: 5941040 - DNA, 16 bp, Homo sapiens
tcactgaaacctctgc

SEQ ID NO: 5941041 - DNA, 18 bp, Homo sapiens
tcactgaaataaaagcta

SEQ ID NO: 5941042 - DNA, 15 bp, Homo sapiens
tcactgaaatgtttg

SEQ ID NO: 5941043 - DNA, 13 bp, Homo sapiens
tcactgaacaaaa

SEQ ID NO: 5941044 - DNA, 23 bp, Homo sapiens
tcactgaacaaactaaaggtgca

SEQ ID NO: 5941045 - DNA, 16 bp, Homo sapiens
tcactgaactccaccg

SEQ ID NO: 5941046 - DNA, 21 bp, Homo sapiens
tcactgaactttgctgagcct

SEQ ID NO: 5941047 - DNA, 17 bp, Homo sapiens
tcactgaacttttcaaa

SEQ ID NO: 5941048 - DNA, 16 bp, Homo sapiens
tcactgaaggcctggc

SEQ ID NO: 5941049 - DNA, 15 bp, Homo sapiens
tcactgaagtgaata

SEQ ID NO: 5941050 - DNA, 21 bp, Homo sapiens
tcactgaagtgaatacatggt

SEQ ID NO: 5941051 - DNA, 19 bp, Homo sapiens
tcactgaagtgattgaaag

SEQ ID NO: 5941052 - DNA, 22 bp, Homo sapiens
tcactgaatgcctcaatgtgac

SEQ ID NO: 5941053 - DNA, 19 bp, Homo sapiens
tcactgacacaaaaagtag

SEQ ID NO: 5941054 - DNA, 16 bp, Homo sapiens
tcactgacacaaagga

SEQ ID NO: 5941055 - DNA, 19 bp, Homo sapiens
tcactgacacaaaggaagt

SEQ ID NO: 5941056 - DNA, 14 bp, Homo sapiens
tcactgacacagga

SEQ ID NO: 5941057 - DNA, 22 bp, Homo sapiens
tcactgacacatcagcatgttt

SEQ ID NO: 5941058 - DNA, 22 bp, Homo sapiens
tcactgacactgcgaactctca

SEQ ID NO: 5941059 - DNA, 20 bp, Homo sapiens
tcactgaccctaactgcaga

SEQ ID NO: 5941060 - DNA, 18 bp, Homo sapiens
tcactgaccctggagcgg

SEQ ID NO: 5941061 - DNA, 17 bp, Homo sapiens
tcactgacctttgtttc

SEQ ID NO: 5941062 - DNA, 22 bp, Homo sapiens
tcactgactcaggctgctcctt

SEQ ID NO: 5941063 - DNA, 13 bp, Homo sapiens
tcactgagaaagg

SEQ ID NO: 5941064 - DNA, 23 bp, Homo sapiens
tcactgagaagatggcactgtcc

SEQ ID NO: 5941065 - DNA, 18 bp, Homo sapiens
tcactgagaaggccccag

SEQ ID NO: 5941066 - DNA, 24 bp, Homo sapiens
tcactgagaaggccccagggcagc

SEQ ID NO: 5941067 - DNA, 18 bp, Homo sapiens
tcactgagaccaaggctt

SEQ ID NO: 5941068 - DNA, 19 bp, Homo sapiens
tcactgagcacagtcaggg

SEQ ID NO: 5941069 - DNA, 16 bp, Homo sapiens
tcactgagcactgttt

SEQ ID NO: 5941070 - DNA, 22 bp, Homo sapiens
tcactgagcatcactagtgaca

SEQ ID NO: 5941071 - DNA, 18 bp, Homo sapiens
tcactgagccatcatttc

SEQ ID NO: 5941072 - DNA, 20 bp, Homo sapiens
tcactgagccatcatttcct

SEQ ID NO: 5941073 - DNA, 22 bp, Homo sapiens
tcactgaggcctgagacccagg

SEQ ID NO: 5941074 - DNA, 23 bp, Homo sapiens
tcactgagggggagctgtcttgt

SEQ ID NO: 5941075 - DNA, 17 bp, Homo sapiens
tcactgatgggaataaa

SEQ ID NO: 5941076 - DNA, 19 bp, Homo sapiens
tcactgattccctctccca

SEQ ID NO: 5941077 - DNA, 18 bp, Homo sapiens
tcactgattgggtgccat

SEQ ID NO: 5941078 - DNA, 17 bp, Homo sapiens
tcactgcaaacacacct

SEQ ID NO: 5941079 - DNA, 23 bp, Homo sapiens
tcactgcaaacacaccttggaga

SEQ ID NO: 5941080 - DNA, 14 bp, Homo sapiens
tcactgcaacctcc

SEQ ID NO: 5941081 - DNA, 16 bp, Homo sapiens
tcactgcaacctccac

SEQ ID NO: 5941082 - DNA, 18 bp, Homo sapiens
tcactgcaacctccacct

SEQ ID NO: 5941083 - DNA, 20 bp, Homo sapiens
tcactgcaacctccacctcc

SEQ ID NO: 5941084 - DNA, 22 bp, Homo sapiens
tcactgcaacctccgcatcccg

SEQ ID NO: 5941085 - DNA, 19 bp, Homo sapiens
tcactgcaacctctgcctc

SEQ ID NO: 5941086 - DNA, 21 bp, Homo sapiens
tcactgcaacctctgcctcct

SEQ ID NO: 5941087 - DNA, 22 bp, Homo sapiens
tcactgcaacctctgcctcctg

SEQ ID NO: 5941088 - DNA, 18 bp, Homo sapiens
tcactgcaagctccgcct

SEQ ID NO: 5941089 - DNA, 20 bp, Homo sapiens
tcactgcaatctctgcctcc

SEQ ID NO: 5941090 - DNA, 16 bp, Homo sapiens
tcactgcaatgtcaaa

SEQ ID NO: 5941091 - DNA, 18 bp, Homo sapiens
tcactgcaattttgtgta

SEQ ID NO: 5941092 - DNA, 14 bp, Homo sapiens
tcactgcagcccag

SEQ ID NO: 5941093 - DNA, 22 bp, Homo sapiens
tcactgcagcctcaacctcctg

SEQ ID NO: 5941094 - DNA, 18 bp, Homo sapiens
tcactgcagcctccgcct

SEQ ID NO: 5941095 - DNA, 22 bp, Homo sapiens
tcactgcagcctccgcttccct

SEQ ID NO: 5941096 - DNA, 22 bp, Homo sapiens
tcactgcagcctccttctcctg

SEQ ID NO: 5941097 - DNA, 23 bp, Homo sapiens
tcactgcagcctcgacctccctg

SEQ ID NO: 5941098 - DNA, 13 bp, Homo sapiens
tcactgcaggcac

SEQ ID NO: 5941099 - DNA, 21 bp, Homo sapiens
tcactgcatggcttctgaaag

SEQ ID NO: 5941100 - DNA, 19 bp, Homo sapiens
tcactgcattcattctgag

SEQ ID NO: 5941101 - DNA, 18 bp, Homo sapiens
tcactgcatttgcctgct

SEQ ID NO: 5941102 - DNA, 23 bp, Homo sapiens
tcactgcattttgtttgaaactt

SEQ ID NO: 5941103 - DNA, 20 bp, Homo sapiens
tcactgccagagataaacta

SEQ ID NO: 5941104 - DNA, 15 bp, Homo sapiens
tcactgccagagcta

SEQ ID NO: 5941105 - DNA, 18 bp, Homo sapiens
tcactgccaggccagcct

SEQ ID NO: 5941106 - DNA, 16 bp, Homo sapiens
tcactgccatgatagc

SEQ ID NO: 5941107 - DNA, 23 bp, Homo sapiens
tcactgccatggaattccctcct

SEQ ID NO: 5941108 - DNA, 17 bp, Homo sapiens
tcactgcccacctgcca

SEQ ID NO: 5941109 - DNA, 18 bp, Homo sapiens
tcactgcccacctgccag

SEQ ID NO: 5941110 - DNA, 19 bp, Homo sapiens
tcactgcccacctgccagg

SEQ ID NO: 5941111 - DNA, 21 bp, Homo sapiens
tcactgcccacctgccaggct

SEQ ID NO: 5941112 - DNA, 18 bp, Homo sapiens
tcactgccccaccagcca

SEQ ID NO: 5941113 - DNA, 20 bp, Homo sapiens
tcactgccccaccagccacc

SEQ ID NO: 5941114 - DNA, 21 bp, Homo sapiens
tcactgccccaccagccacct

SEQ ID NO: 5941115 - DNA, 16 bp, Homo sapiens
tcactgccccacttct

SEQ ID NO: 5941116 - DNA, 21 bp, Homo sapiens
tcactgccccacttctggcat

SEQ ID NO: 5941117 - DNA, 23 bp, Homo sapiens
tcactgccccacttctggcatgg

SEQ ID NO: 5941118 - DNA, 14 bp, Homo sapiens
tcactgccccctcc

SEQ ID NO: 5941119 - DNA, 21 bp, Homo sapiens
tcactgccccctccgtcccac

SEQ ID NO: 5941120 - DNA, 18 bp, Homo sapiens
tcactgcccgcacaccct

SEQ ID NO: 5941121 - DNA, 17 bp, Homo sapiens
tcactgccctccctcgg

SEQ ID NO: 5941122 - DNA, 19 bp, Homo sapiens
tcactgcctaaaattttag

SEQ ID NO: 5941123 - DNA, 23 bp, Homo sapiens
tcactgcctaggaggctggccaa

SEQ ID NO: 5941124 - DNA, 16 bp, Homo sapiens
tcactgcctctttgca

SEQ ID NO: 5941125 - DNA, 13 bp, Homo sapiens
tcactgcctgaca

SEQ ID NO: 5941126 - DNA, 15 bp, Homo sapiens
tcactgcctgcagag

SEQ ID NO: 5941127 - DNA, 14 bp, Homo sapiens
tcactgcctgcagc

SEQ ID NO: 5941128 - DNA, 16 bp, Homo sapiens
tcactgcctgcagctg

SEQ ID NO: 5941129 - DNA, 17 bp, Homo sapiens
tcactgcctgcagctga

SEQ ID NO: 5941130 - DNA, 14 bp, Homo sapiens
tcactgcctggagt

SEQ ID NO: 5941131 - DNA, 20 bp, Homo sapiens
tcactgcctggtaaaattaa

SEQ ID NO: 5941132 - DNA, 14 bp, Homo sapiens
tcactgccttcgtt

SEQ ID NO: 5941133 - DNA, 19 bp, Homo sapiens
tcactgccttcgtttatat

SEQ ID NO: 5941134 - DNA, 18 bp, Homo sapiens
tcactgcgaagaccctct

SEQ ID NO: 5941135 - DNA, 23 bp, Homo sapiens
tcactgcgccactgctccgtgga

SEQ ID NO: 5941136 - DNA, 22 bp, Homo sapiens
tcactgctacaccttagcagct

SEQ ID NO: 5941137 - DNA, 13 bp, Homo sapiens
tcactgctcacac

SEQ ID NO: 5941138 - DNA, 15 bp, Homo sapiens
tcactgctccaggcc

SEQ ID NO: 5941139 - DNA, 19 bp, Homo sapiens
tcactgctccctgaagcca

SEQ ID NO: 5941140 - DNA, 20 bp, Homo sapiens
tcactgctccctgaagccag

SEQ ID NO: 5941141 - DNA, 23 bp, Homo sapiens
tcactgctccctgaagccagcct

SEQ ID NO: 5941142 - DNA, 19 bp, Homo sapiens
tcactgctgatcgtagaaa

SEQ ID NO: 5941143 - DNA, 14 bp, Homo sapiens
tcactgctgatttt

SEQ ID NO: 5941144 - DNA, 22 bp, Homo sapiens
tcactgctgcaaggcctttctg

SEQ ID NO: 5941145 - DNA, 22 bp, Homo sapiens
tcactgctgctactgcccctct

SEQ ID NO: 5941146 - DNA, 12 bp, Homo sapiens
tcactgctgctc

SEQ ID NO: 5941147 - DNA, 15 bp, Homo sapiens
tcactgctgctggga

SEQ ID NO: 5941148 - DNA, 16 bp, Homo sapiens
tcactgctggctgcct

SEQ ID NO: 5941149 - DNA, 18 bp, Homo sapiens
tcactgctggctgcctta

SEQ ID NO: 5941150 - DNA, 22 bp, Homo sapiens
tcactgctggctgccttagaac

SEQ ID NO: 5941151 - DNA, 22 bp, Homo sapiens
tcactgctgtaaagcaaaatat

SEQ ID NO: 5941152 - DNA, 12 bp, Homo sapiens
tcactgctgtca

SEQ ID NO: 5941153 - DNA, 18 bp, Homo sapiens
tcactgctgtcagccaag

SEQ ID NO: 5941154 - DNA, 16 bp, Homo sapiens
tcactgctgtccctcc

SEQ ID NO: 5941155 - DNA, 18 bp, Homo sapiens
tcactgctgtccctcctg

SEQ ID NO: 5941156 - DNA, 23 bp, Homo sapiens
tcactgctgttatatttcatcat

SEQ ID NO: 5941157 - DNA, 17 bp, Homo sapiens
tcactgcttaacttcac

SEQ ID NO: 5941158 - DNA, 15 bp, Homo sapiens
tcactgcttgatgaa

SEQ ID NO: 5941159 - DNA, 17 bp, Homo sapiens
tcactgcttttggcctg

SEQ ID NO: 5941160 - DNA, 23 bp, Homo sapiens
tcactgcttttggcctggagttt

SEQ ID NO: 5941161 - DNA, 21 bp, Homo sapiens
tcactggaaaggaaagatgat

SEQ ID NO: 5941162 - DNA, 17 bp, Homo sapiens
tcactggaacctccctg

SEQ ID NO: 5941163 - DNA, 22 bp, Homo sapiens
tcactggaacctccctgggcct

SEQ ID NO: 5941164 - DNA, 23 bp, Homo sapiens
tcactggaacctccctgggcctg

SEQ ID NO: 5941165 - DNA, 18 bp, Homo sapiens
tcactggaccactgggca

SEQ ID NO: 5941166 - DNA, 11 bp, Homo sapiens
tcactggagca

SEQ ID NO: 5941167 - DNA, 12 bp, Homo sapiens
tcactggagccc

SEQ ID NO: 5941168 - DNA, 13 bp, Homo sapiens
tcactggagccca

SEQ ID NO: 5941169 - DNA, 21 bp, Homo sapiens
tcactggaggagcagcttcct

SEQ ID NO: 5941170 - DNA, 21 bp, Homo sapiens
tcactggattataagttctat

SEQ ID NO: 5941171 - DNA, 15 bp, Homo sapiens
tcactggcaatattt

SEQ ID NO: 5941172 - DNA, 14 bp, Homo sapiens
tcactggcagagca

SEQ ID NO: 5941173 - DNA, 16 bp, Homo sapiens
tcactggcagagcaca

SEQ ID NO: 5941174 - DNA, 17 bp, Homo sapiens
tcactggcagagcacag

SEQ ID NO: 5941175 - DNA, 22 bp, Homo sapiens
tcactggcagagcacagcccac

SEQ ID NO: 5941176 - DNA, 18 bp, Homo sapiens
tcactggcagccccagca

SEQ ID NO: 5941177 - DNA, 19 bp, Homo sapiens
tcactggcagccccagcac

SEQ ID NO: 5941178 - DNA, 14 bp, Homo sapiens
tcactggcctctcc

SEQ ID NO: 5941179 - DNA, 18 bp, Homo sapiens
tcactggcctctccccag

SEQ ID NO: 5941180 - DNA, 18 bp, Homo sapiens
tcactggcctgccatgcc

SEQ ID NO: 5941181 - DNA, 20 bp, Homo sapiens
tcactggcgacacgtagcag

SEQ ID NO: 5941182 - DNA, 22 bp, Homo sapiens
tcactggcgacacgtagcagct

SEQ ID NO: 5941183 - DNA, 22 bp, Homo sapiens
tcactggcgaggtgcggccacc

SEQ ID NO: 5941184 - DNA, 15 bp, Homo sapiens
tcactggcgccttct

SEQ ID NO: 5941185 - DNA, 16 bp, Homo sapiens
tcactggctcatgccc

SEQ ID NO: 5941186 - DNA, 18 bp, Homo sapiens
tcactggctcatgcccct

SEQ ID NO: 5941187 - DNA, 11 bp, Homo sapiens
tcactggctct

SEQ ID NO: 5941188 - DNA, 12 bp, Homo sapiens
tcactggctctc

SEQ ID NO: 5941189 - DNA, 13 bp, Homo sapiens
tcactggctctcc

SEQ ID NO: 5941190 - DNA, 15 bp, Homo sapiens
tcactggctctccaa

SEQ ID NO: 5941191 - DNA, 17 bp, Homo sapiens
tcactggctctccaagt

SEQ ID NO: 5941192 - DNA, 11 bp, Homo sapiens
tcactggctgg

SEQ ID NO: 5941193 - DNA, 19 bp, Homo sapiens
tcactggctggcctgagca

SEQ ID NO: 5941194 - DNA, 15 bp, Homo sapiens
tcactggctggctcc

SEQ ID NO: 5941195 - DNA, 18 bp, Homo sapiens
tcactgggactttgtaaa

SEQ ID NO: 5941196 - DNA, 16 bp, Homo sapiens
tcactgggatgcctct

SEQ ID NO: 5941197 - DNA, 13 bp, Homo sapiens
tcactgggcccag

SEQ ID NO: 5941198 - DNA, 21 bp, Homo sapiens
tcactgggcccagaggagagg

SEQ ID NO: 5941199 - DNA, 22 bp, Homo sapiens
tcactgggcccagaggagagga

SEQ ID NO: 5941200 - DNA, 19 bp, Homo sapiens
tcactgggcctttccagag

SEQ ID NO: 5941201 - DNA, 17 bp, Homo sapiens
tcactgggctcactgca

SEQ ID NO: 5941202 - DNA, 22 bp, Homo sapiens
tcactggggatcccgtgctgga

SEQ ID NO: 5941203 - DNA, 17 bp, Homo sapiens
tcactggggatggtggc

SEQ ID NO: 5941204 - DNA, 18 bp, Homo sapiens
tcactggggatggtggca

SEQ ID NO: 5941205 - DNA, 19 bp, Homo sapiens
tcactggggatggtggcac

SEQ ID NO: 5941206 - DNA, 14 bp, Homo sapiens
tcactggggcagac

SEQ ID NO: 5941207 - DNA, 20 bp, Homo sapiens
tcactggggcatgagatttt

SEQ ID NO: 5941208 - DNA, 17 bp, Homo sapiens
tcactggggctgcgcag

SEQ ID NO: 5941209 - DNA, 18 bp, Homo sapiens
tcactgggggctttgggc

SEQ ID NO: 5941210 - DNA, 18 bp, Homo sapiens
tcactggtagaccaaaat

SEQ ID NO: 5941211 - DNA, 14 bp, Homo sapiens
tcactggtcagggc

SEQ ID NO: 5941212 - DNA, 15 bp, Homo sapiens
tcactggtcagggca

SEQ ID NO: 5941213 - DNA, 16 bp, Homo sapiens
tcactggtcagggcag

SEQ ID NO: 5941214 - DNA, 16 bp, Homo sapiens
tcactggtctctaagt

SEQ ID NO: 5941215 - DNA, 14 bp, Homo sapiens
tcactggtgcattt

SEQ ID NO: 5941216 - DNA, 23 bp, Homo sapiens
tcactggtggatctaagaagggc

SEQ ID NO: 5941217 - DNA, 16 bp, Homo sapiens
tcactggtttacaaat

SEQ ID NO: 5941218 - DNA, 14 bp, Homo sapiens
tcactgtaaagaca

SEQ ID NO: 5941219 - DNA, 15 bp, Homo sapiens
tcactgtaacctgat

SEQ ID NO: 5941220 - DNA, 23 bp, Homo sapiens
tcactgtaagactcattccctag

SEQ ID NO: 5941221 - DNA, 20 bp, Homo sapiens
tcactgtacagttttgtgga

SEQ ID NO: 5941222 - DNA, 17 bp, Homo sapiens
tcactgtactctgtggg

SEQ ID NO: 5941223 - DNA, 22 bp, Homo sapiens
tcactgtagtttagttctgttg

SEQ ID NO: 5941224 - DNA, 17 bp, Homo sapiens
tcactgtagttttgagt

SEQ ID NO: 5941225 - DNA, 21 bp, Homo sapiens
tcactgtagttttgagtgtat

SEQ ID NO: 5941226 - DNA, 18 bp, Homo sapiens
tcactgtataaacttttt

SEQ ID NO: 5941227 - DNA, 19 bp, Homo sapiens
tcactgtataaataggaga

SEQ ID NO: 5941228 - DNA, 23 bp, Homo sapiens
tcactgtataaataggagaggat

SEQ ID NO: 5941229 - DNA, 21 bp, Homo sapiens
tcactgtataccgatcaggaa

SEQ ID NO: 5941230 - DNA, 18 bp, Homo sapiens
tcactgtatagtaatcat

SEQ ID NO: 5941231 - DNA, 14 bp, Homo sapiens
tcactgtatataaa

SEQ ID NO: 5941232 - DNA, 15 bp, Homo sapiens
tcactgtatataaac

SEQ ID NO: 5941233 - DNA, 17 bp, Homo sapiens
tcactgtatataaacat

SEQ ID NO: 5941234 - DNA, 20 bp, Homo sapiens
tcactgtattagagcgccag

SEQ ID NO: 5941235 - DNA, 14 bp, Homo sapiens
tcactgtcaatgat

SEQ ID NO: 5941236 - DNA, 11 bp, Homo sapiens
tcactgtcact

SEQ ID NO: 5941237 - DNA, 17 bp, Homo sapiens
tcactgtcactgccgac

SEQ ID NO: 5941238 - DNA, 18 bp, Homo sapiens
tcactgtcaggaagaaat

SEQ ID NO: 5941239 - DNA, 16 bp, Homo sapiens
tcactgtcagtcccac

SEQ ID NO: 5941240 - DNA, 21 bp, Homo sapiens
tcactgtcagtcccactgcac

SEQ ID NO: 5941241 - DNA, 16 bp, Homo sapiens
tcactgtcatctgcca

SEQ ID NO: 5941242 - DNA, 14 bp, Homo sapiens
tcactgtccctcct

SEQ ID NO: 5941243 - DNA, 17 bp, Homo sapiens
tcactgtcgcccaggct

SEQ ID NO: 5941244 - DNA, 20 bp, Homo sapiens
tcactgtcgcccaggctgga

SEQ ID NO: 5941245 - DNA, 14 bp, Homo sapiens
tcactgtctaggct

SEQ ID NO: 5941246 - DNA, 17 bp, Homo sapiens
tcactgtctatttaagt

SEQ ID NO: 5941247 - DNA, 20 bp, Homo sapiens
tcactgtctgagagtttagt

SEQ ID NO: 5941248 - DNA, 14 bp, Homo sapiens
tcactgtctgtctg

SEQ ID NO: 5941249 - DNA, 14 bp, Homo sapiens
tcactgtctttcct

SEQ ID NO: 5941250 - DNA, 16 bp, Homo sapiens
tcactgtctttcctag

SEQ ID NO: 5941251 - DNA, 16 bp, Homo sapiens
tcactgtctttgactg

SEQ ID NO: 5941252 - DNA, 20 bp, Homo sapiens
tcactgtgaaccaaccccca

SEQ ID NO: 5941253 - DNA, 23 bp, Homo sapiens
tcactgtgaaccaacccccatct

SEQ ID NO: 5941254 - DNA, 16 bp, Homo sapiens
tcactgtgagttctga

SEQ ID NO: 5941255 - DNA, 12 bp, Homo sapiens
tcactgtgatca

SEQ ID NO: 5941256 - DNA, 14 bp, Homo sapiens
tcactgtgcactgc

SEQ ID NO: 5941257 - DNA, 15 bp, Homo sapiens
tcactgtgcactgcc

SEQ ID NO: 5941258 - DNA, 16 bp, Homo sapiens
tcactgtgcactgccc

SEQ ID NO: 5941259 - DNA, 11 bp, Homo sapiens
tcactgtgctc

SEQ ID NO: 5941260 - DNA, 12 bp, Homo sapiens
tcactgtgctcc

SEQ ID NO: 5941261 - DNA, 16 bp, Homo sapiens
tcactgtgctgttgtt

SEQ ID NO: 5941262 - DNA, 23 bp, Homo sapiens
tcactgtgctgttgttatgatgt

SEQ ID NO: 5941263 - DNA, 20 bp, Homo sapiens
tcactgtgcttaatttaaat

SEQ ID NO: 5941264 - DNA, 22 bp, Homo sapiens
tcactgtgcttattttgtttca

SEQ ID NO: 5941265 - DNA, 19 bp, Homo sapiens
tcactgtgcttcgagccaa

SEQ ID NO: 5941266 - DNA, 22 bp, Homo sapiens
tcactgtgcttcgagccaactc

SEQ ID NO: 5941267 - DNA, 17 bp, Homo sapiens
tcactgtggccacagcc

SEQ ID NO: 5941268 - DNA, 12 bp, Homo sapiens
tcactgtggctg

SEQ ID NO: 5941269 - DNA, 16 bp, Homo sapiens
tcactgtgtacataat

SEQ ID NO: 5941270 - DNA, 17 bp, Homo sapiens
tcactgtgtacataatg

SEQ ID NO: 5941271 - DNA, 15 bp, Homo sapiens
tcactgtgtatagga

SEQ ID NO: 5941272 - DNA, 18 bp, Homo sapiens
tcactgtgtataggaatt

SEQ ID NO: 5941273 - DNA, 23 bp, Homo sapiens
tcactgtgtataggaatttgtat

SEQ ID NO: 5941274 - DNA, 15 bp, Homo sapiens
tcactgtgtatattt

SEQ ID NO: 5941275 - DNA, 11 bp, Homo sapiens
tcactgtgtta

SEQ ID NO: 5941276 - DNA, 17 bp, Homo sapiens
tcactgtgttgcccagg

SEQ ID NO: 5941277 - DNA, 21 bp, Homo sapiens
tcactgtgttgcccaggctgg

SEQ ID NO: 5941278 - DNA, 13 bp, Homo sapiens
tcactgttataaa

SEQ ID NO: 5941279 - DNA, 14 bp, Homo sapiens
tcactgttataaat

SEQ ID NO: 5941280 - DNA, 23 bp, Homo sapiens
tcactgttataaattttgtacat

SEQ ID NO: 5941281 - DNA, 14 bp, Homo sapiens
tcactgttcatgaa

SEQ ID NO: 5941282 - DNA, 16 bp, Homo sapiens
tcactgttccctctgc

SEQ ID NO: 5941283 - DNA, 22 bp, Homo sapiens
tcactgttctattcatctcaag

SEQ ID NO: 5941284 - DNA, 14 bp, Homo sapiens
tcactgttctgcaa

SEQ ID NO: 5941285 - DNA, 19 bp, Homo sapiens
tcactgttgaaaattattt

SEQ ID NO: 5941286 - DNA, 22 bp, Homo sapiens
tcactgttgagttctgattgtg

SEQ ID NO: 5941287 - DNA, 22 bp, Homo sapiens
tcactgttgcagtggcctggcc

SEQ ID NO: 5941288 - DNA, 19 bp, Homo sapiens
tcactgttgcccaggctgg

SEQ ID NO: 5941289 - DNA, 17 bp, Homo sapiens
tcactgttgctttgaaa

SEQ ID NO: 5941290 - DNA, 21 bp, Homo sapiens
tcactgttgtgaatcaccaaa

SEQ ID NO: 5941291 - DNA, 21 bp, Homo sapiens
tcactgtttcactactcagca

SEQ ID NO: 5941292 - DNA, 23 bp, Homo sapiens
tcactgtttcatctaagtgcctc

SEQ ID NO: 5941293 - DNA, 22 bp, Homo sapiens
tcactgtttcctattaatcttc

SEQ ID NO: 5941294 - DNA, 14 bp, Homo sapiens
tcactgtttcctgg

SEQ ID NO: 5941295 - DNA, 14 bp, Homo sapiens
tcactgtttctctg

SEQ ID NO: 5941296 - DNA, 17 bp, Homo sapiens
tcactgtttctctgctg

SEQ ID NO: 5941297 - DNA, 20 bp, Homo sapiens
tcactgtttctctgctgttg

SEQ ID NO: 5941298 - DNA, 22 bp, Homo sapiens
tcactgtttgtttttaaaaagc

SEQ ID NO: 5941299 - DNA, 22 bp, Homo sapiens
tcactgtttttagacaccttca

SEQ ID NO: 5941300 - DNA, 17 bp, Homo sapiens
tcactgtttttattcct

SEQ ID NO: 5941301 - DNA, 23 bp, Homo sapiens
tcactgtttttattccttccatc

SEQ ID NO: 5941302 - DNA, 13 bp, Homo sapiens
tcacttaaaacac

SEQ ID NO: 5941303 - DNA, 19 bp, Homo sapiens
tcacttaaacaatgtcctc

SEQ ID NO: 5941304 - DNA, 21 bp, Homo sapiens
tcacttaaacaatgtcctctt

SEQ ID NO: 5941305 - DNA, 21 bp, Homo sapiens
tcacttaaactttgtcacttc

SEQ ID NO: 5941306 - DNA, 18 bp, Homo sapiens
tcacttaaaggcacaaat

SEQ ID NO: 5941307 - DNA, 15 bp, Homo sapiens
tcacttaaagggtct

SEQ ID NO: 5941308 - DNA, 17 bp, Homo sapiens
tcacttaaatgttacca

SEQ ID NO: 5941309 - DNA, 17 bp, Homo sapiens
tcacttaaattcttttg

SEQ ID NO: 5941310 - DNA, 18 bp, Homo sapiens
tcacttaaatttgttctt

SEQ ID NO: 5941311 - DNA, 15 bp, Homo sapiens
tcacttaacaaacaa

SEQ ID NO: 5941312 - DNA, 23 bp, Homo sapiens
tcacttaacttacatgactttct

SEQ ID NO: 5941313 - DNA, 16 bp, Homo sapiens
tcacttaagcccagga

SEQ ID NO: 5941314 - DNA, 13 bp, Homo sapiens
tcacttaagtatt

SEQ ID NO: 5941315 - DNA, 13 bp, Homo sapiens
tcacttaatcttt

SEQ ID NO: 5941316 - DNA, 14 bp, Homo sapiens
tcacttaatgtttc

SEQ ID NO: 5941317 - DNA, 17 bp, Homo sapiens
tcacttaatgtttctta

SEQ ID NO: 5941318 - DNA, 15 bp, Homo sapiens
tcacttaattctcat

SEQ ID NO: 5941319 - DNA, 21 bp, Homo sapiens
tcacttacataaagctccctt

SEQ ID NO: 5941320 - DNA, 17 bp, Homo sapiens
tcacttacctagattta

SEQ ID NO: 5941321 - DNA, 16 bp, Homo sapiens
tcacttacctgaaaag

SEQ ID NO: 5941322 - DNA, 22 bp, Homo sapiens
tcacttactatccatttcttca

SEQ ID NO: 5941323 - DNA, 15 bp, Homo sapiens
tcacttactgtttct

SEQ ID NO: 5941324 - DNA, 16 bp, Homo sapiens
tcacttactgtttctg

SEQ ID NO: 5941325 - DNA, 19 bp, Homo sapiens
tcacttaggggcagcatgt

SEQ ID NO: 5941326 - DNA, 13 bp, Homo sapiens
tcacttataccaa

SEQ ID NO: 5941327 - DNA, 13 bp, Homo sapiens
tcacttatcctga

SEQ ID NO: 5941328 - DNA, 20 bp, Homo sapiens
tcacttatttccttatgtgt

SEQ ID NO: 5941329 - DNA, 18 bp, Homo sapiens
tcacttcaagctgttatt

SEQ ID NO: 5941330 - DNA, 14 bp, Homo sapiens
tcacttcaccatca

SEQ ID NO: 5941331 - DNA, 13 bp, Homo sapiens
tcacttcagatct

SEQ ID NO: 5941332 - DNA, 18 bp, Homo sapiens
tcacttcatacttctaaa

SEQ ID NO: 5941333 - DNA, 19 bp, Homo sapiens
tcacttcatcttctcagct

SEQ ID NO: 5941334 - DNA, 16 bp, Homo sapiens
tcacttcattgaccaa

SEQ ID NO: 5941335 - DNA, 15 bp, Homo sapiens
tcacttcattgtttt

SEQ ID NO: 5941336 - DNA, 16 bp, Homo sapiens
tcacttccagagagga

SEQ ID NO: 5941337 - DNA, 19 bp, Homo sapiens
tcacttccagcttgcctgt

SEQ ID NO: 5941338 - DNA, 22 bp, Homo sapiens
tcacttccagtgttggctgtgt

SEQ ID NO: 5941339 - DNA, 22 bp, Homo sapiens
tcacttccatacagctctacgt

SEQ ID NO: 5941340 - DNA, 15 bp, Homo sapiens
tcacttccccaactc

SEQ ID NO: 5941341 - DNA, 22 bp, Homo sapiens
tcacttccccaagatctgccag

SEQ ID NO: 5941342 - DNA, 23 bp, Homo sapiens
tcacttccccaagatctgccaga

SEQ ID NO: 5941343 - DNA, 11 bp, Homo sapiens
tcacttcccct

SEQ ID NO: 5941344 - DNA, 16 bp, Homo sapiens
tcacttccccttccaa

SEQ ID NO: 5941345 - DNA, 18 bp, Homo sapiens
tcacttcccgagcgctgg

SEQ ID NO: 5941346 - DNA, 17 bp, Homo sapiens
tcacttcccgtagctgc

SEQ ID NO: 5941347 - DNA, 20 bp, Homo sapiens
tcacttcccgtagctgccag

SEQ ID NO: 5941348 - DNA, 13 bp, Homo sapiens
tcacttccctggg

SEQ ID NO: 5941349 - DNA, 14 bp, Homo sapiens
tcacttccctggga

SEQ ID NO: 5941350 - DNA, 17 bp, Homo sapiens
tcacttcctacaagagc

SEQ ID NO: 5941351 - DNA, 23 bp, Homo sapiens
tcacttcctagagcatctgtccc

SEQ ID NO: 5941352 - DNA, 19 bp, Homo sapiens
tcacttcctctccacagga

SEQ ID NO: 5941353 - DNA, 15 bp, Homo sapiens
tcacttcgaaattct

SEQ ID NO: 5941354 - DNA, 23 bp, Homo sapiens
tcacttcgcgtgccctcgctgct

SEQ ID NO: 5941355 - DNA, 23 bp, Homo sapiens
tcacttcgggctgtgtaaacaca

SEQ ID NO: 5941356 - DNA, 13 bp, Homo sapiens
tcacttctaaatg

SEQ ID NO: 5941357 - DNA, 16 bp, Homo sapiens
tcacttctaaatgcat

SEQ ID NO: 5941358 - DNA, 21 bp, Homo sapiens
tcacttctacctacatatttg

SEQ ID NO: 5941359 - DNA, 22 bp, Homo sapiens
tcacttctacgcataaactaga

SEQ ID NO: 5941360 - DNA, 18 bp, Homo sapiens
tcacttctagatctcagc

SEQ ID NO: 5941361 - DNA, 22 bp, Homo sapiens
tcacttctcctgctgctcctgt

SEQ ID NO: 5941362 - DNA, 23 bp, Homo sapiens
tcacttctcctgctgctcctgtt

SEQ ID NO: 5941363 - DNA, 22 bp, Homo sapiens
tcacttctcttaaacttgtgaa

SEQ ID NO: 5941364 - DNA, 17 bp, Homo sapiens
tcacttctgaccacact

SEQ ID NO: 5941365 - DNA, 17 bp, Homo sapiens
tcacttctgagaactca

SEQ ID NO: 5941366 - DNA, 22 bp, Homo sapiens
tcacttctggcactgtgactac

SEQ ID NO: 5941367 - DNA, 20 bp, Homo sapiens
tcacttcttaaggacagtgt

SEQ ID NO: 5941368 - DNA, 12 bp, Homo sapiens
tcacttcttcac

SEQ ID NO: 5941369 - DNA, 18 bp, Homo sapiens
tcacttcttccactgtgt

SEQ ID NO: 5941370 - DNA, 17 bp, Homo sapiens
tcacttcttcctattgt

SEQ ID NO: 5941371 - DNA, 15 bp, Homo sapiens
tcacttcttctgtcc

SEQ ID NO: 5941372 - DNA, 19 bp, Homo sapiens
tcacttctttgcagagcct

SEQ ID NO: 5941373 - DNA, 23 bp, Homo sapiens
tcacttgaaagattttattgtat

SEQ ID NO: 5941374 - DNA, 22 bp, Homo sapiens
tcacttgaacccgggaggcaga

SEQ ID NO: 5941375 - DNA, 16 bp, Homo sapiens
tcacttgactcttgaa

SEQ ID NO: 5941376 - DNA, 18 bp, Homo sapiens
tcacttgactcttgaata

SEQ ID NO: 5941377 - DNA, 14 bp, Homo sapiens
tcacttgagacaaa

SEQ ID NO: 5941378 - DNA, 14 bp, Homo sapiens
tcacttgagcccag

SEQ ID NO: 5941379 - DNA, 15 bp, Homo sapiens
tcacttgagcccagg

SEQ ID NO: 5941380 - DNA, 23 bp, Homo sapiens
tcacttgaggaggagctggcctg

SEQ ID NO: 5941381 - DNA, 22 bp, Homo sapiens
tcacttgaggtcaggagttcct

SEQ ID NO: 5941382 - DNA, 20 bp, Homo sapiens
tcacttgatgtgccatttta

SEQ ID NO: 5941383 - DNA, 18 bp, Homo sapiens
tcacttgatgtttcctgg

SEQ ID NO: 5941384 - DNA, 20 bp, Homo sapiens
tcacttgattcatctctggt

SEQ ID NO: 5941385 - DNA, 13 bp, Homo sapiens
tcagacccatctc

SEQ ID NO: 5941386 - DNA, 18 bp, Homo sapiens
tcagacccatctctccct

SEQ ID NO: 5941387 - DNA, 17 bp, Homo sapiens
tcagaccccagcggctg

SEQ ID NO: 5941388 - DNA, 15 bp, Homo sapiens
tcagaccccagttct

SEQ ID NO: 5941389 - DNA, 12 bp, Homo sapiens
tcagacccccac

SEQ ID NO: 5941390 - DNA, 14 bp, Homo sapiens
tcagacccccactc

SEQ ID NO: 5941391 - DNA, 17 bp, Homo sapiens
tcagaccccctcagcct

SEQ ID NO: 5941392 - DNA, 19 bp, Homo sapiens
tcagacccctcagccccag

SEQ ID NO: 5941393 - DNA, 14 bp, Homo sapiens
tcagacccctgcct

SEQ ID NO: 5941394 - DNA, 15 bp, Homo sapiens
tcagacccctgcctg

SEQ ID NO: 5941395 - DNA, 13 bp, Homo sapiens
tcagaccctaccc

SEQ ID NO: 5941396 - DNA, 18 bp, Homo sapiens
tcagaccgtcttcctcca

SEQ ID NO: 5941397 - DNA, 18 bp, Homo sapiens
tcagacctagcagggaag

SEQ ID NO: 5941398 - DNA, 13 bp, Homo sapiens
tcagacctctgat

SEQ ID NO: 5941399 - DNA, 16 bp, Homo sapiens
tcagacctctgatccc

SEQ ID NO: 5941400 - DNA, 17 bp, Homo sapiens
tcagacctgtcttccaa

SEQ ID NO: 5941401 - DNA, 22 bp, Homo sapiens
tcagacctgtcttccaaggaga

SEQ ID NO: 5941402 - DNA, 23 bp, Homo sapiens
tcagacctgtcttccaaggagac

SEQ ID NO: 5941403 - DNA, 15 bp, Homo sapiens
tcagaccttcttcca

SEQ ID NO: 5941404 - DNA, 20 bp, Homo sapiens
tcagaccttggatcagatga

SEQ ID NO: 5941405 - DNA, 21 bp, Homo sapiens
tcagacctttgtctgaaggat

SEQ ID NO: 5941406 - DNA, 16 bp, Homo sapiens
tcagacgagacaccct

SEQ ID NO: 5941407 - DNA, 17 bp, Homo sapiens
tcagacgagacacccta

SEQ ID NO: 5941408 - DNA, 18 bp, Homo sapiens
tcagacgagacaccctaa

SEQ ID NO: 5941409 - DNA, 20 bp, Homo sapiens
tcagacgagacaccctaact

SEQ ID NO: 5941410 - DNA, 22 bp, Homo sapiens
tcagacgccaggcaccacagcc

SEQ ID NO: 5941411 - DNA, 16 bp, Homo sapiens
tcagacgcctgaggaa

SEQ ID NO: 5941412 - DNA, 17 bp, Homo sapiens
tcagacgcctgaggaac

SEQ ID NO: 5941413 - DNA, 19 bp, Homo sapiens
tcagacggcggccaggcac

SEQ ID NO: 5941414 - DNA, 23 bp, Homo sapiens
tcagacggcggccaggcacaggg

SEQ ID NO: 5941415 - DNA, 21 bp, Homo sapiens
tcagacgtctagatgggttct

SEQ ID NO: 5941416 - DNA, 19 bp, Homo sapiens
tcagacgtgtgacctccat

SEQ ID NO: 5941417 - DNA, 22 bp, Homo sapiens
tcagacgtgtgacctccatact

SEQ ID NO: 5941418 - DNA, 19 bp, Homo sapiens
tcagacgttggtcccaagt

SEQ ID NO: 5941419 - DNA, 21 bp, Homo sapiens
tcagactaagaaatattccaa

SEQ ID NO: 5941420 - DNA, 17 bp, Homo sapiens
tcagactaagccagcac

SEQ ID NO: 5941421 - DNA, 21 bp, Homo sapiens
tcagactcaagtacccattct

SEQ ID NO: 5941422 - DNA, 21 bp, Homo sapiens
tcagactcagttttttgtaac

SEQ ID NO: 5941423 - DNA, 15 bp, Homo sapiens
tcagactccgccctc

SEQ ID NO: 5941424 - DNA, 13 bp, Homo sapiens
tcagactcctggc

SEQ ID NO: 5941425 - DNA, 16 bp, Homo sapiens
tcagactctaaacaca

SEQ ID NO: 5941426 - DNA, 18 bp, Homo sapiens
tcagactctaagaaagaa

SEQ ID NO: 5941427 - DNA, 19 bp, Homo sapiens
tcagactctaagaaagaac

SEQ ID NO: 5941428 - DNA, 14 bp, Homo sapiens
tcagactctagaaa

SEQ ID NO: 5941429 - DNA, 17 bp, Homo sapiens
tcagactctagaaaaaa

SEQ ID NO: 5941430 - DNA, 17 bp, Homo sapiens
tcagactctcagcccag

SEQ ID NO: 5941431 - DNA, 14 bp, Homo sapiens
tcagactctctcct

SEQ ID NO: 5941432 - DNA, 11 bp, Homo sapiens
tcagactctgg

SEQ ID NO: 5941433 - DNA, 19 bp, Homo sapiens
tcagactcttggggaagcg

SEQ ID NO: 5941434 - DNA, 20 bp, Homo sapiens
tcagactctttagttgattt

SEQ ID NO: 5941435 - DNA, 18 bp, Homo sapiens
tcagactgacagtttaca

SEQ ID NO: 5941436 - DNA, 14 bp, Homo sapiens
tcagactgcaatat

SEQ ID NO: 5941437 - DNA, 14 bp, Homo sapiens
tcagactgcaccca

SEQ ID NO: 5941438 - DNA, 17 bp, Homo sapiens
tcagactgcacccagga

SEQ ID NO: 5941439 - DNA, 18 bp, Homo sapiens
tcagactgcacccaggag

SEQ ID NO: 5941440 - DNA, 15 bp, Homo sapiens
tcagactgcagaggg

SEQ ID NO: 5941441 - DNA, 14 bp, Homo sapiens
tcagactgcatgta

SEQ ID NO: 5941442 - DNA, 13 bp, Homo sapiens
tcagactgccaaa

SEQ ID NO: 5941443 - DNA, 20 bp, Homo sapiens
tcagactgcctgtctgcttg

SEQ ID NO: 5941444 - DNA, 14 bp, Homo sapiens
tcagactgctggga

SEQ ID NO: 5941445 - DNA, 15 bp, Homo sapiens
tcagactgctgggac

SEQ ID NO: 5941446 - DNA, 15 bp, Homo sapiens
tcagactgcttcatt

SEQ ID NO: 5941447 - DNA, 17 bp, Homo sapiens
tcagactgcttcattgg

SEQ ID NO: 5941448 - DNA, 16 bp, Homo sapiens
tcagactgctttgaga

SEQ ID NO: 5941449 - DNA, 12 bp, Homo sapiens
tcagactggagg

SEQ ID NO: 5941450 - DNA, 13 bp, Homo sapiens
tcagactggaggt

SEQ ID NO: 5941451 - DNA, 18 bp, Homo sapiens
tcagactggaggtcgaag

SEQ ID NO: 5941452 - DNA, 14 bp, Homo sapiens
tcagactggctggc

SEQ ID NO: 5941453 - DNA, 21 bp, Homo sapiens
tcagactggctggctgcagtg

SEQ ID NO: 5941454 - DNA, 16 bp, Homo sapiens
tcagactggtctcgaa

SEQ ID NO: 5941455 - DNA, 12 bp, Homo sapiens
tcagactgtata

SEQ ID NO: 5941456 - DNA, 21 bp, Homo sapiens
tcagactgtgcaatacttaga

SEQ ID NO: 5941457 - DNA, 14 bp, Homo sapiens
tcagactgtttagt

SEQ ID NO: 5941458 - DNA, 15 bp, Homo sapiens
tcagacttaacagac

SEQ ID NO: 5941459 - DNA, 16 bp, Homo sapiens
tcagacttccaaatcc

SEQ ID NO: 5941460 - DNA, 19 bp, Homo sapiens
tcagacttccaaatcctgg

SEQ ID NO: 5941461 - DNA, 18 bp, Homo sapiens
tcagacttgatttacaag

SEQ ID NO: 5941462 - DNA, 21 bp, Homo sapiens
tcagacttgatttacaagcat

SEQ ID NO: 5941463 - DNA, 16 bp, Homo sapiens
tcagacttgcggccac

SEQ ID NO: 5941464 - DNA, 20 bp, Homo sapiens
tcagacttgcggccacagca

SEQ ID NO: 5941465 - DNA, 14 bp, Homo sapiens
tcagacttgtcaag

SEQ ID NO: 5941466 - DNA, 23 bp, Homo sapiens
tcagactttaaagaataatatgc

SEQ ID NO: 5941467 - DNA, 15 bp, Homo sapiens
tcagactttgctgca

SEQ ID NO: 5941468 - DNA, 19 bp, Homo sapiens
tcagactttgctgcatttt

SEQ ID NO: 5941469 - DNA, 22 bp, Homo sapiens
tcagactttgtgttcatttcat

SEQ ID NO: 5941470 - DNA, 19 bp, Homo sapiens
tcagacttttatcaaaatc

SEQ ID NO: 5941471 - DNA, 16 bp, Homo sapiens
tcagacttttgtacat

SEQ ID NO: 5941472 - DNA, 14 bp, Homo sapiens
tcagagaaaacact

SEQ ID NO: 5941473 - DNA, 15 bp, Homo sapiens
tcagagaaaacttca

SEQ ID NO: 5941474 - DNA, 20 bp, Homo sapiens
tcagagaaaatgagaaagga

SEQ ID NO: 5941475 - DNA, 14 bp, Homo sapiens
tcagagaaaggact

SEQ ID NO: 5941476 - DNA, 16 bp, Homo sapiens
tcagagaaatgtctgt

SEQ ID NO: 5941477 - DNA, 17 bp, Homo sapiens
tcagagaaatgtctgtc

SEQ ID NO: 5941478 - DNA, 11 bp, Homo sapiens
tcagagaagtc

SEQ ID NO: 5941479 - DNA, 13 bp, Homo sapiens
tcagagaagtcag

SEQ ID NO: 5941480 - DNA, 20 bp, Homo sapiens
tcagagaatgatcaccctga

SEQ ID NO: 5941481 - DNA, 16 bp, Homo sapiens
tcagagaattactatt

SEQ ID NO: 5941482 - DNA, 22 bp, Homo sapiens
tcagagaattatctcaagtaaa

SEQ ID NO: 5941483 - DNA, 12 bp, Homo sapiens
tcagagaatttc

SEQ ID NO: 5941484 - DNA, 13 bp, Homo sapiens
tcagagaatttct

SEQ ID NO: 5941485 - DNA, 14 bp, Homo sapiens
tcagagacaaaata

SEQ ID NO: 5941486 - DNA, 21 bp, Homo sapiens
tcagagacaaaatatttccca

SEQ ID NO: 5941487 - DNA, 15 bp, Homo sapiens
tcagagacaccaaac

SEQ ID NO: 5941488 - DNA, 12 bp, Homo sapiens
tcagagacactg

SEQ ID NO: 5941489 - DNA, 21 bp, Homo sapiens
tcagagacagaccccttggct

SEQ ID NO: 5941490 - DNA, 12 bp, Homo sapiens
tcagagacagat

SEQ ID NO: 5941491 - DNA, 15 bp, Homo sapiens
tcagagacagctgat

SEQ ID NO: 5941492 - DNA, 20 bp, Homo sapiens
tcagagacaggtggcctagc

SEQ ID NO: 5941493 - DNA, 19 bp, Homo sapiens
tcagagacatcagcccttg

SEQ ID NO: 5941494 - DNA, 20 bp, Homo sapiens
tcagagaccagcactcagcc

SEQ ID NO: 5941495 - DNA, 16 bp, Homo sapiens
tcagagaccaggccct

SEQ ID NO: 5941496 - DNA, 14 bp, Homo sapiens
tcagagaccagggc

SEQ ID NO: 5941497 - DNA, 20 bp, Homo sapiens
tcagagactcagggccccag

SEQ ID NO: 5941498 - DNA, 15 bp, Homo sapiens
tcagagactcccagg

SEQ ID NO: 5941499 - DNA, 20 bp, Homo sapiens
tcagagactcctgcaggcag

SEQ ID NO: 5941500 - DNA, 19 bp, Homo sapiens
tcagagactgcccttctca

SEQ ID NO: 5941501 - DNA, 17 bp, Homo sapiens
tcagagactggcagcca

SEQ ID NO: 5941502 - DNA, 18 bp, Homo sapiens
tcagagactggcagccag

SEQ ID NO: 5941503 - DNA, 14 bp, Homo sapiens
tcagagagagtgtt

SEQ ID NO: 5941504 - DNA, 15 bp, Homo sapiens
tcagagagcaaggca

SEQ ID NO: 5941505 - DNA, 12 bp, Homo sapiens
tcagagagcagt

SEQ ID NO: 5941506 - DNA, 22 bp, Homo sapiens
tcagagaggacaaaataaagtg

SEQ ID NO: 5941507 - DNA, 17 bp, Homo sapiens
tcagagagtacactgtg

SEQ ID NO: 5941508 - DNA, 19 bp, Homo sapiens
tcagagagtacactgtgtc

SEQ ID NO: 5941509 - DNA, 22 bp, Homo sapiens
tcagagagtacactgtgtctct

SEQ ID NO: 5941510 - DNA, 13 bp, Homo sapiens
tcagagataaagc

SEQ ID NO: 5941511 - DNA, 17 bp, Homo sapiens
tcagagatataataagc

SEQ ID NO: 5941512 - DNA, 19 bp, Homo sapiens
tcagagatcaggatcagct

SEQ ID NO: 5941513 - DNA, 17 bp, Homo sapiens
tcagagatctcccttct

SEQ ID NO: 5941514 - DNA, 15 bp, Homo sapiens
tcagagatgaaacta

SEQ ID NO: 5941515 - DNA, 22 bp, Homo sapiens
tcagagatgatcagtccaactg

SEQ ID NO: 5941516 - DNA, 15 bp, Homo sapiens
tcagagatggacaga

SEQ ID NO: 5941517 - DNA, 15 bp, Homo sapiens
tcagagatgggctga

SEQ ID NO: 5941518 - DNA, 22 bp, Homo sapiens
tcagagatggtaatctacagct

SEQ ID NO: 5941519 - DNA, 23 bp, Homo sapiens
tcagagatggtaatctacagctc

SEQ ID NO: 5941520 - DNA, 23 bp, Homo sapiens
tcagagatgtccatttttacaag

SEQ ID NO: 5941521 - DNA, 17 bp, Homo sapiens
tcagagatgttttcaag

SEQ ID NO: 5941522 - DNA, 15 bp, Homo sapiens
tcagagattattcaa

SEQ ID NO: 5941523 - DNA, 17 bp, Homo sapiens
tcagagatttatataaa

SEQ ID NO: 5941524 - DNA, 19 bp, Homo sapiens
tcagagatttatataaatg

SEQ ID NO: 5941525 - DNA, 16 bp, Homo sapiens
tcagagcaaatttggg

SEQ ID NO: 5941526 - DNA, 17 bp, Homo sapiens
tcagagcaagcctttga

SEQ ID NO: 5941527 - DNA, 20 bp, Homo sapiens
tcagagcaagcctttgacct

SEQ ID NO: 5941528 - DNA, 14 bp, Homo sapiens
tcagagcacagcca

SEQ ID NO: 5941529 - DNA, 13 bp, Homo sapiens
tcagagcactccc

SEQ ID NO: 5941530 - DNA, 22 bp, Homo sapiens
tcagagcactttaaaaacaggc

SEQ ID NO: 5941531 - DNA, 14 bp, Homo sapiens
tcagagcagcagaa

SEQ ID NO: 5941532 - DNA, 13 bp, Homo sapiens
tcagagcaggacc

SEQ ID NO: 5941533 - DNA, 13 bp, Homo sapiens
tcagagcaggagg

SEQ ID NO: 5941534 - DNA, 14 bp, Homo sapiens
tcagagcaggaggc

SEQ ID NO: 5941535 - DNA, 12 bp, Homo sapiens
tcagagcattta

SEQ ID NO: 5941536 - DNA, 13 bp, Homo sapiens
tcagagccaagtc

SEQ ID NO: 5941537 - DNA, 23 bp, Homo sapiens
tcagagccacagggtctgcctcc

SEQ ID NO: 5941538 - DNA, 21 bp, Homo sapiens
tcagagccacccctaaagaga

SEQ ID NO: 5941539 - DNA, 12 bp, Homo sapiens
tcagagccactc

SEQ ID NO: 5941540 - DNA, 23 bp, Homo sapiens
tcagagccagcctggctctgccc

SEQ ID NO: 5941541 - DNA, 18 bp, Homo sapiens
tcagagccagtgaaggag

SEQ ID NO: 5941542 - DNA, 22 bp, Homo sapiens
tcagagccatgtcttctccctg

SEQ ID NO: 5941543 - DNA, 13 bp, Homo sapiens
tcagagcccagcc

SEQ ID NO: 5941544 - DNA, 17 bp, Homo sapiens
tcagagcccagcccagg

SEQ ID NO: 5941545 - DNA, 12 bp, Homo sapiens
tcagagcccagg

SEQ ID NO: 5941546 - DNA, 13 bp, Homo sapiens
tcagagcccaggg

SEQ ID NO: 5941547 - DNA, 14 bp, Homo sapiens
tcagagcccagggg

SEQ ID NO: 5941548 - DNA, 15 bp, Homo sapiens
tcagagcccagggga

SEQ ID NO: 5941549 - DNA, 17 bp, Homo sapiens
tcagagcccaggggaga

SEQ ID NO: 5941550 - DNA, 12 bp, Homo sapiens
tcagagcccatg

SEQ ID NO: 5941551 - DNA, 21 bp, Homo sapiens
tcagagcccatggcttccctg

SEQ ID NO: 5941552 - DNA, 14 bp, Homo sapiens
tcagagcccatggt

SEQ ID NO: 5941553 - DNA, 17 bp, Homo sapiens
tcagagcccccagccct

SEQ ID NO: 5941554 - DNA, 19 bp, Homo sapiens
tcagagcccccagccctgg

SEQ ID NO: 5941555 - DNA, 20 bp, Homo sapiens
tcagagcccccagccctggg

SEQ ID NO: 5941556 - DNA, 18 bp, Homo sapiens
tcagagccccgccccacc

SEQ ID NO: 5941557 - DNA, 11 bp, Homo sapiens
tcagagccctg

SEQ ID NO: 5941558 - DNA, 19 bp, Homo sapiens
tcagagccctggctgggtt

SEQ ID NO: 5941559 - DNA, 19 bp, Homo sapiens
tcagagcccttttgctata

SEQ ID NO: 5941560 - DNA, 16 bp, Homo sapiens
tcagagccgtggtcct

SEQ ID NO: 5941561 - DNA, 13 bp, Homo sapiens
tcagagcctagcc

SEQ ID NO: 5941562 - DNA, 14 bp, Homo sapiens
tcagagcctagcca

SEQ ID NO: 5941563 - DNA, 18 bp, Homo sapiens
tcagagcctagccacctc

SEQ ID NO: 5941564 - DNA, 14 bp, Homo sapiens
tcagagcctcagct

SEQ ID NO: 5941565 - DNA, 18 bp, Homo sapiens
tcagcagccctcctcacc

SEQ ID NO: 5941566 - DNA, 21 bp, Homo sapiens
tcagcagccgccttaagctga

SEQ ID NO: 5941567 - DNA, 22 bp, Homo sapiens
tcagcagccgccttaagctgat

SEQ ID NO: 5941568 - DNA, 19 bp, Homo sapiens
tcagcagcctcactgcatc

SEQ ID NO: 5941569 - DNA, 17 bp, Homo sapiens
tcagcagcctccctgaa

SEQ ID NO: 5941570 - DNA, 20 bp, Homo sapiens
tcagcagcgaccacccctgc

SEQ ID NO: 5941571 - DNA, 17 bp, Homo sapiens
tcagcagcggcagcagc

SEQ ID NO: 5941572 - DNA, 17 bp, Homo sapiens
tcagcagctagaaaaca

SEQ ID NO: 5941573 - DNA, 17 bp, Homo sapiens
tcagcaggagccaatat

SEQ ID NO: 5941574 - DNA, 15 bp, Homo sapiens
tcagcaggaggaaag

SEQ ID NO: 5941575 - DNA, 12 bp, Homo sapiens
tcagcaggcagc

SEQ ID NO: 5941576 - DNA, 16 bp, Homo sapiens
tcagcaggcaggctgg

SEQ ID NO: 5941577 - DNA, 11 bp, Homo sapiens
tcagcaggccc

SEQ ID NO: 5941578 - DNA, 18 bp, Homo sapiens
tcagcagggactgtaaac

SEQ ID NO: 5941579 - DNA, 22 bp, Homo sapiens
tcagcagggactgtaaacacag

SEQ ID NO: 5941580 - DNA, 18 bp, Homo sapiens
tcagcagtaagcaggcct

SEQ ID NO: 5941581 - DNA, 20 bp, Homo sapiens
tcagcagtacctataaagta

SEQ ID NO: 5941582 - DNA, 18 bp, Homo sapiens
tcagcagtcaatacaaat

SEQ ID NO: 5941583 - DNA, 18 bp, Homo sapiens
tcagcagtcctagcccca

SEQ ID NO: 5941584 - DNA, 16 bp, Homo sapiens
tcagcagtctaaattt

SEQ ID NO: 5941585 - DNA, 12 bp, Homo sapiens
tcagcagtgatt

SEQ ID NO: 5941586 - DNA, 21 bp, Homo sapiens
tcagcagtgtctgttcttcat

SEQ ID NO: 5941587 - DNA, 20 bp, Homo sapiens
tcagcagttgacatccaaat

SEQ ID NO: 5941588 - DNA, 14 bp, Homo sapiens
tcagcagttgctgg

SEQ ID NO: 5941589 - DNA, 16 bp, Homo sapiens
tcagcagttgctggta

SEQ ID NO: 5941590 - DNA, 19 bp, Homo sapiens
tcagcagttgctggtaaaa

SEQ ID NO: 5941591 - DNA, 20 bp, Homo sapiens
tcagcagttgctggtaaaat

SEQ ID NO: 5941592 - DNA, 23 bp, Homo sapiens
tcagcagttgctggtaaaatgaa

SEQ ID NO: 5941593 - DNA, 17 bp, Homo sapiens
tcagcataagtaaacaa

SEQ ID NO: 5941594 - DNA, 17 bp, Homo sapiens
tcagcatacctttattg

SEQ ID NO: 5941595 - DNA, 16 bp, Homo sapiens
tcagcatagagctata

SEQ ID NO: 5941596 - DNA, 19 bp, Homo sapiens
tcagcatatatataaaata

SEQ ID NO: 5941597 - DNA, 23 bp, Homo sapiens
tcagcatatttgtatagttgctt

SEQ ID NO: 5941598 - DNA, 16 bp, Homo sapiens
tcagcatcaaacatga

SEQ ID NO: 5941599 - DNA, 23 bp, Homo sapiens
tcagcatcaaacatgaaaacatt

SEQ ID NO: 5941600 - DNA, 16 bp, Homo sapiens
tcagcatcaagcccca

SEQ ID NO: 5941601 - DNA, 15 bp, Homo sapiens
tcagcatcactaaac

SEQ ID NO: 5941602 - DNA, 19 bp, Homo sapiens
tcagcatcactgatgggaa

SEQ ID NO: 5941603 - DNA, 20 bp, Homo sapiens
tcagcatcactgatgggaat

SEQ ID NO: 5941604 - DNA, 14 bp, Homo sapiens
tcagcatccaaaag

SEQ ID NO: 5941605 - DNA, 15 bp, Homo sapiens
tcagcatcctggaaa

SEQ ID NO: 5941606 - DNA, 20 bp, Homo sapiens
tcagcatcctggaaatttgt

SEQ ID NO: 5941607 - DNA, 16 bp, Homo sapiens
tcagcatcctggcacc

SEQ ID NO: 5941608 - DNA, 15 bp, Homo sapiens
tcagcatctcacttc

SEQ ID NO: 5941609 - DNA, 19 bp, Homo sapiens
tcagcatctcacttcttct

SEQ ID NO: 5941610 - DNA, 16 bp, Homo sapiens
tcagcatctgaccatc

SEQ ID NO: 5941611 - DNA, 19 bp, Homo sapiens
tcagcatctgaccatctgt

SEQ ID NO: 5941612 - DNA, 15 bp, Homo sapiens
tcagcatctgtgatg

SEQ ID NO: 5941613 - DNA, 17 bp, Homo sapiens
tcagcatctttgccctt

SEQ ID NO: 5941614 - DNA, 20 bp, Homo sapiens
tcagcatgaaaatgtgtgtt

SEQ ID NO: 5941615 - DNA, 14 bp, Homo sapiens
tcagcatgaatttg

SEQ ID NO: 5941616 - DNA, 16 bp, Homo sapiens
tcagcatgacaaaaat

SEQ ID NO: 5941617 - DNA, 20 bp, Homo sapiens
tcagcatgacaaaaataaca

SEQ ID NO: 5941618 - DNA, 15 bp, Homo sapiens
tcagcatgcaataca

SEQ ID NO: 5941619 - DNA, 20 bp, Homo sapiens
tcagcatgcatagtgctaag

SEQ ID NO: 5941620 - DNA, 20 bp, Homo sapiens
tcagcatgcttcccagaggg

SEQ ID NO: 5941621 - DNA, 23 bp, Homo sapiens
tcagcatggactgttcatttgaa

SEQ ID NO: 5941622 - DNA, 18 bp, Homo sapiens
tcagcatgtagggcttct

SEQ ID NO: 5941623 - DNA, 16 bp, Homo sapiens
tcagcatgtctattca

SEQ ID NO: 5941624 - DNA, 18 bp, Homo sapiens
tcagcatgtctcagattg

SEQ ID NO: 5941625 - DNA, 13 bp, Homo sapiens
tcagcatgttttc

SEQ ID NO: 5941626 - DNA, 17 bp, Homo sapiens
tcagcatgttttctgct

SEQ ID NO: 5941627 - DNA, 18 bp, Homo sapiens
tcagcatgttttctgctt

SEQ ID NO: 5941628 - DNA, 16 bp, Homo sapiens
tcagcattcaaaatag

SEQ ID NO: 5941629 - DNA, 23 bp, Homo sapiens
tcagcattcaaaatagttctatt

SEQ ID NO: 5941630 - DNA, 21 bp, Homo sapiens
tcagcattcagtccgcctggc

SEQ ID NO: 5941631 - DNA, 15 bp, Homo sapiens
tcagcattcccaatt

SEQ ID NO: 5941632 - DNA, 17 bp, Homo sapiens
tcagcattctcactcct

SEQ ID NO: 5941633 - DNA, 18 bp, Homo sapiens
tcagcattcttagcctgt

SEQ ID NO: 5941634 - DNA, 14 bp, Homo sapiens
tcagcattgtttca

SEQ ID NO: 5941635 - DNA, 21 bp, Homo sapiens
tcagcatttactttgtttctt

SEQ ID NO: 5941636 - DNA, 19 bp, Homo sapiens
tcagcatttccttgtcccg

SEQ ID NO: 5941637 - DNA, 11 bp, Homo sapiens
tcagcatttga

SEQ ID NO: 5941638 - DNA, 19 bp, Homo sapiens
tcagcatttgatttccatg

SEQ ID NO: 5941639 - DNA, 19 bp, Homo sapiens
tcagcatttgttctttgcc

SEQ ID NO: 5941640 - DNA, 16 bp, Homo sapiens
tcagcattttcttaga

SEQ ID NO: 5941641 - DNA, 21 bp, Homo sapiens
tcagcattttttatcaggcag

SEQ ID NO: 5941642 - DNA, 16 bp, Homo sapiens
tcagccaaatgcaggg

SEQ ID NO: 5941643 - DNA, 22 bp, Homo sapiens
tcagccaaatttcctgtttgaa

SEQ ID NO: 5941644 - DNA, 23 bp, Homo sapiens
tcagccaacattgccttgcattt

SEQ ID NO: 5941645 - DNA, 17 bp, Homo sapiens
tcagccaaccttactta

SEQ ID NO: 5941646 - DNA, 22 bp, Homo sapiens
tcagccaaccttacttacagca

SEQ ID NO: 5941647 - DNA, 23 bp, Homo sapiens
tcagccaagacaaggaggtagag

SEQ ID NO: 5941648 - DNA, 19 bp, Homo sapiens
tcagccaaggggctgcgct

SEQ ID NO: 5941649 - DNA, 20 bp, Homo sapiens
tcagccaaggggctgcgcta

SEQ ID NO: 5941650 - DNA, 17 bp, Homo sapiens
tcagccaagtgcagagt

SEQ ID NO: 5941651 - DNA, 16 bp, Homo sapiens
tcagccaagttttata

SEQ ID NO: 5941652 - DNA, 15 bp, Homo sapiens
tcagccaatctggac

SEQ ID NO: 5941653 - DNA, 23 bp, Homo sapiens
tcagccaatctggacacttcttt

SEQ ID NO: 5941654 - DNA, 16 bp, Homo sapiens
tcagccaatttgtctc

SEQ ID NO: 5941655 - DNA, 17 bp, Homo sapiens
tcagccaatttgtctcc

SEQ ID NO: 5941656 - DNA, 18 bp, Homo sapiens
tcagccacaaagcccccc

SEQ ID NO: 5941657 - DNA, 16 bp, Homo sapiens
tcagccacacctgtca

SEQ ID NO: 5941658 - DNA, 13 bp, Homo sapiens
tcagccacactgg

SEQ ID NO: 5941659 - DNA, 13 bp, Homo sapiens
tcagccacagcct

SEQ ID NO: 5941660 - DNA, 17 bp, Homo sapiens
tcagccacatgccccag

SEQ ID NO: 5941661 - DNA, 18 bp, Homo sapiens
tcagccacatgccccagg

SEQ ID NO: 5941662 - DNA, 20 bp, Homo sapiens
tcagccaccactcagtgctt

SEQ ID NO: 5941663 - DNA, 11 bp, Homo sapiens
tcagccaccct

SEQ ID NO: 5941664 - DNA, 16 bp, Homo sapiens
tcagccaccctgagtt

SEQ ID NO: 5941665 - DNA, 15 bp, Homo sapiens
tcagccacctccctc

SEQ ID NO: 5941666 - DNA, 22 bp, Homo sapiens
tcagccacctccctctgccagt

SEQ ID NO: 5941667 - DNA, 12 bp, Homo sapiens
tcagccacctgg

SEQ ID NO: 5941668 - DNA, 16 bp, Homo sapiens
tcagccacctgggaac

SEQ ID NO: 5941669 - DNA, 16 bp, Homo sapiens
tcagccacgaccagcc

SEQ ID NO: 5941670 - DNA, 23 bp, Homo sapiens
tcagccacgaccagccccttcct

SEQ ID NO: 5941671 - DNA, 12 bp, Homo sapiens
tcagccacgcct

SEQ ID NO: 5941672 - DNA, 15 bp, Homo sapiens
tcagccactgaggga

SEQ ID NO: 5941673 - DNA, 14 bp, Homo sapiens
tcagccactgtcac

SEQ ID NO: 5941674 - DNA, 13 bp, Homo sapiens
tcagccactgtga

SEQ ID NO: 5941675 - DNA, 14 bp, Homo sapiens
tcagccagagaagc

SEQ ID NO: 5941676 - DNA, 23 bp, Homo sapiens
tcagccagcacttgtccagctga

SEQ ID NO: 5941677 - DNA, 15 bp, Homo sapiens
tcagccagccctgga

SEQ ID NO: 5941678 - DNA, 17 bp, Homo sapiens
tcagccagccctggagg

SEQ ID NO: 5941679 - DNA, 17 bp, Homo sapiens
tcagccagccgccctgg

SEQ ID NO: 5941680 - DNA, 18 bp, Homo sapiens
tcagccagccgccctggg

SEQ ID NO: 5941681 - DNA, 12 bp, Homo sapiens
tcagccagcctc

SEQ ID NO: 5941682 - DNA, 13 bp, Homo sapiens
tcagccagcctcc

SEQ ID NO: 5941683 - DNA, 21 bp, Homo sapiens
tcagccagcctcgcccatccc

SEQ ID NO: 5941684 - DNA, 13 bp, Homo sapiens
tcagccagccttc

SEQ ID NO: 5941685 - DNA, 14 bp, Homo sapiens
tcagccagccttcc

SEQ ID NO: 5941686 - DNA, 14 bp, Homo sapiens
tcagccagctgccc

SEQ ID NO: 5941687 - DNA, 17 bp, Homo sapiens
tcagccagctgcccaca

SEQ ID NO: 5941688 - DNA, 16 bp, Homo sapiens
tcagccagctgtttaa

SEQ ID NO: 5941689 - DNA, 13 bp, Homo sapiens
tcagccagcttgg

SEQ ID NO: 5941690 - DNA, 13 bp, Homo sapiens
tcagccaggagct

SEQ ID NO: 5941691 - DNA, 19 bp, Homo sapiens
tcagccaggagctgggcag

SEQ ID NO: 5941692 - DNA, 22 bp, Homo sapiens
tcagccaggcaagaaagcttcc

SEQ ID NO: 5941693 - DNA, 18 bp, Homo sapiens
tcagccaggcgtggttac

SEQ ID NO: 5941694 - DNA, 16 bp, Homo sapiens
tcagccaggtctgact

SEQ ID NO: 5941695 - DNA, 18 bp, Homo sapiens
tcagccagtctcagatgc

SEQ ID NO: 5941696 - DNA, 16 bp, Homo sapiens
tcagccagtggggatg

SEQ ID NO: 5941697 - DNA, 22 bp, Homo sapiens
tcagccataaagtgccagtttg

SEQ ID NO: 5941698 - DNA, 15 bp, Homo sapiens
tcagccatcagccat

SEQ ID NO: 5941699 - DNA, 20 bp, Homo sapiens
tcagccatccgcagactgct

SEQ ID NO: 5941700 - DNA, 16 bp, Homo sapiens
tcagccatcgtcctgg

SEQ ID NO: 5941701 - DNA, 19 bp, Homo sapiens
tcagccatgataagaacag

SEQ ID NO: 5941702 - DNA, 23 bp, Homo sapiens
tcagccatgcgcgcgctctctct

SEQ ID NO: 5941703 - DNA, 21 bp, Homo sapiens
tcagccatgggaaatgagcca

SEQ ID NO: 5941704 - DNA, 14 bp, Homo sapiens
tcagccatgtacag

SEQ ID NO: 5941705 - DNA, 12 bp, Homo sapiens
tcagccattaaa

SEQ ID NO: 5941706 - DNA, 19 bp, Homo sapiens
tcagccattaaaataaaac

SEQ ID NO: 5941707 - DNA, 20 bp, Homo sapiens
tcagccattaaaataaaaca

SEQ ID NO: 5941708 - DNA, 16 bp, Homo sapiens
tcagccatttccccct

SEQ ID NO: 5941709 - DNA, 17 bp, Homo sapiens
tcagccatttccccctc

SEQ ID NO: 5941710 - DNA, 19 bp, Homo sapiens
tcagccatttccccctcct

SEQ ID NO: 5941711 - DNA, 23 bp, Homo sapiens
tcagccatttccccctcctcaga

SEQ ID NO: 5941712 - DNA, 18 bp, Homo sapiens
tcagccatttgccatcac

SEQ ID NO: 5941713 - DNA, 13 bp, Homo sapiens
tcagccattttta

SEQ ID NO: 5941714 - DNA, 15 bp, Homo sapiens
tcagcccaagattct

SEQ ID NO: 5941715 - DNA, 21 bp, Homo sapiens
tcagcccaccagccacctcat

SEQ ID NO: 5941716 - DNA, 14 bp, Homo sapiens
tcagcccaccctcc

SEQ ID NO: 5941717 - DNA, 12 bp, Homo sapiens
tcagcccagcac

SEQ ID NO: 5941718 - DNA, 14 bp, Homo sapiens
tcagcccagcacct

SEQ ID NO: 5941719 - DNA, 19 bp, Homo sapiens
tcagcccagcacctgctcc

SEQ ID NO: 5941720 - DNA, 15 bp, Homo sapiens
tcagcccagctggcc

SEQ ID NO: 5941721 - DNA, 20 bp, Homo sapiens
tcagcccaggtcagctgtta

SEQ ID NO: 5941722 - DNA, 17 bp, Homo sapiens
tcagcccaggtctcctg

SEQ ID NO: 5941723 - DNA, 16 bp, Homo sapiens
tcagcccatatttcat

SEQ ID NO: 5941724 - DNA, 14 bp, Homo sapiens
tcagcccatggagg

SEQ ID NO: 5941725 - DNA, 15 bp, Homo sapiens
tcagcccatggaggc

SEQ ID NO: 5941726 - DNA, 16 bp, Homo sapiens
tcagcccatggaggca

SEQ ID NO: 5941727 - DNA, 18 bp, Homo sapiens
tcagccccaagggctggg

SEQ ID NO: 5941728 - DNA, 17 bp, Homo sapiens
tcagccccacaggactt

SEQ ID NO: 5941729 - DNA, 19 bp, Homo sapiens
tcagccccaccccagggca

SEQ ID NO: 5941730 - DNA, 18 bp, Homo sapiens
tcagccccaccctggcct

SEQ ID NO: 5941731 - DNA, 18 bp, Homo sapiens
tcagccccagacctgccg

SEQ ID NO: 5941732 - DNA, 15 bp, Homo sapiens
tcagccccagcccag

SEQ ID NO: 5941733 - DNA, 17 bp, Homo sapiens
tcagccccagcccagcc

SEQ ID NO: 5941734 - DNA, 13 bp, Homo sapiens
tcagccccaggag

SEQ ID NO: 5941735 - DNA, 18 bp, Homo sapiens
tcagccccaggagaaggg

SEQ ID NO: 5941736 - DNA, 12 bp, Homo sapiens
tcagccccaggc

SEQ ID NO: 5941737 - DNA, 20 bp, Homo sapiens
tcagccccaggccagctgcg

SEQ ID NO: 5941738 - DNA, 17 bp, Homo sapiens
tcagccccagggccctg

SEQ ID NO: 5941739 - DNA, 21 bp, Homo sapiens
tcagccccagggccctgctca

SEQ ID NO: 5941740 - DNA, 15 bp, Homo sapiens
tcagccccatcgccc

SEQ ID NO: 5941741 - DNA, 16 bp, Homo sapiens
tcagcccccaccaggg

SEQ ID NO: 5941742 - DNA, 13 bp, Homo sapiens
tcagcccccagcc

SEQ ID NO: 5941743 - DNA, 13 bp, Homo sapiens
tcagcccccagga

SEQ ID NO: 5941744 - DNA, 16 bp, Homo sapiens
tcagcccccaggccag

SEQ ID NO: 5941745 - DNA, 19 bp, Homo sapiens
tcagcccccatcacccaag

SEQ ID NO: 5941746 - DNA, 23 bp, Homo sapiens
tcagcccccatcacccaagccac

SEQ ID NO: 5941747 - DNA, 19 bp, Homo sapiens
tcagccccgagctgtcccc

SEQ ID NO: 5941748 - DNA, 21 bp, Homo sapiens
tcagccccgcctgtcacaata

SEQ ID NO: 5941749 - DNA, 22 bp, Homo sapiens
tcagccccgcctgtcacaataa

SEQ ID NO: 5941750 - DNA, 22 bp, Homo sapiens
tcagccccggccactccctgcc

SEQ ID NO: 5941751 - DNA, 12 bp, Homo sapiens
tcagcccctacc

SEQ ID NO: 5941752 - DNA, 13 bp, Homo sapiens
tcagcccctagga

SEQ ID NO: 5941753 - DNA, 22 bp, Homo sapiens
tcagcccctaggagtatatttc

SEQ ID NO: 5941754 - DNA, 16 bp, Homo sapiens
tcagcccctagtgcta

SEQ ID NO: 5941755 - DNA, 18 bp, Homo sapiens
tcagcccctcatcagcct

SEQ ID NO: 5941756 - DNA, 12 bp, Homo sapiens
tcagcccctcct

SEQ ID NO: 5941757 - DNA, 14 bp, Homo sapiens
tcagcccctcctct

SEQ ID NO: 5941758 - DNA, 17 bp, Homo sapiens
tcagcccctcctctgcc

SEQ ID NO: 5941759 - DNA, 21 bp, Homo sapiens
tcagcccctcctctgccacct

SEQ ID NO: 5941760 - DNA, 22 bp, Homo sapiens
tcagcccctcctctgccacctc

SEQ ID NO: 5941761 - DNA, 23 bp, Homo sapiens
tcagcccctcctctgccacctcc

SEQ ID NO: 5941762 - DNA, 16 bp, Homo sapiens
tcagcccctcttccct

SEQ ID NO: 5941763 - DNA, 22 bp, Homo sapiens
tcagcccctcttgccccccacc

SEQ ID NO: 5941764 - DNA, 14 bp, Homo sapiens
tcagcccctgatcc

SEQ ID NO: 5941765 - DNA, 18 bp, Homo sapiens
tcagcccctgatctctga

SEQ ID NO: 5941766 - DNA, 15 bp, Homo sapiens
tcagcccctggcaat

SEQ ID NO: 5941767 - DNA, 14 bp, Homo sapiens
tcagcccctgggaa

SEQ ID NO: 5941768 - DNA, 18 bp, Homo sapiens
tcagccccttctcccctc

SEQ ID NO: 5941769 - DNA, 17 bp, Homo sapiens
tcagcccgaatgcctgt

SEQ ID NO: 5941770 - DNA, 20 bp, Homo sapiens
tcagcccgctggagcatgag

SEQ ID NO: 5941771 - DNA, 15 bp, Homo sapiens
tcagcccgggacagg

SEQ ID NO: 5941772 - DNA, 20 bp, Homo sapiens
tcagcccggtgtgaggaggg

SEQ ID NO: 5941773 - DNA, 19 bp, Homo sapiens
tcagccctagggtggagag

SEQ ID NO: 5941774 - DNA, 18 bp, Homo sapiens
tcagccctcacacaccct

SEQ ID NO: 5941775 - DNA, 13 bp, Homo sapiens
tcagccctcagaa

SEQ ID NO: 5941776 - DNA, 18 bp, Homo sapiens
tcagccctcagaagaaaa

SEQ ID NO: 5941777 - DNA, 14 bp, Homo sapiens
tcagccctcagaat

SEQ ID NO: 5941778 - DNA, 14 bp, Homo sapiens
tcagccctccatgg

SEQ ID NO: 5941779 - DNA, 18 bp, Homo sapiens
tcagccctccatggcctg

SEQ ID NO: 5941780 - DNA, 14 bp, Homo sapiens
tcagccctccctgc

SEQ ID NO: 5941781 - DNA, 18 bp, Homo sapiens
tcagccctccctgcccct

SEQ ID NO: 5941782 - DNA, 19 bp, Homo sapiens
tcagccctccctgcccctc

SEQ ID NO: 5941783 - DNA, 13 bp, Homo sapiens
tcagccctctctt

SEQ ID NO: 5941784 - DNA, 17 bp, Homo sapiens
tcagccctctcttgcca

SEQ ID NO: 5941785 - DNA, 13 bp, Homo sapiens
tcagccctgaccc

SEQ ID NO: 5941786 - DNA, 23 bp, Homo sapiens
tcagccctgaggtgaaagggagc

SEQ ID NO: 5941787 - DNA, 14 bp, Homo sapiens
tcagccctgccctt

SEQ ID NO: 5941788 - DNA, 23 bp, Homo sapiens
tcagccctgcccttcagcatcct

SEQ ID NO: 5941789 - DNA, 14 bp, Homo sapiens
tcagccctgctccc

SEQ ID NO: 5941790 - DNA, 15 bp, Homo sapiens
tcagccctgctccct

SEQ ID NO: 5941791 - DNA, 16 bp, Homo sapiens
tcagccctgctccctg

SEQ ID NO: 5941792 - DNA, 17 bp, Homo sapiens
tcagccctgctccctgc

SEQ ID NO: 5941793 - DNA, 23 bp, Homo sapiens
tcagccctgctccctgcctcctg

SEQ ID NO: 5941794 - DNA, 17 bp, Homo sapiens
tcagccctggaggtgcc

SEQ ID NO: 5941795 - DNA, 21 bp, Homo sapiens
tcagccctggaggtgccagca

SEQ ID NO: 5941796 - DNA, 14 bp, Homo sapiens
tcagccctggcccc

SEQ ID NO: 5941797 - DNA, 17 bp, Homo sapiens
tcagccctggccctgcc

SEQ ID NO: 5941798 - DNA, 18 bp, Homo sapiens
tcagccctggccctgccc

SEQ ID NO: 5941799 - DNA, 15 bp, Homo sapiens
tcagccctggccttt

SEQ ID NO: 5941800 - DNA, 21 bp, Homo sapiens
tcagccctgggccccaccacc

SEQ ID NO: 5941801 - DNA, 20 bp, Homo sapiens
tcagccctgtgtctgtcaca

SEQ ID NO: 5941802 - DNA, 21 bp, Homo sapiens
tcagccctgtgtctgtcacag

SEQ ID NO: 5941803 - DNA, 21 bp, Homo sapiens
tcagcccttgcccccatccct

SEQ ID NO: 5941804 - DNA, 20 bp, Homo sapiens
tcagcccttggcttctgctt

SEQ ID NO: 5941805 - DNA, 23 bp, Homo sapiens
tcagccctttgctctgatttcct

SEQ ID NO: 5941806 - DNA, 23 bp, Homo sapiens
tcagccgaattgtggtgtcttac

SEQ ID NO: 5941807 - DNA, 16 bp, Homo sapiens
tcagccgagcccaggg

SEQ ID NO: 5941808 - DNA, 19 bp, Homo sapiens
tcagccgagccgggcctgg

SEQ ID NO: 5941809 - DNA, 22 bp, Homo sapiens
tcagccggcgtggcaaatataa

SEQ ID NO: 5941810 - DNA, 22 bp, Homo sapiens
tcagccgtagggtggcactggg

SEQ ID NO: 5941811 - DNA, 16 bp, Homo sapiens
tcagccgtcagccatc

SEQ ID NO: 5941812 - DNA, 16 bp, Homo sapiens
tcagccgtgcactccc

SEQ ID NO: 5941813 - DNA, 15 bp, Homo sapiens
tcagccgtgggcccg

SEQ ID NO: 5941814 - DNA, 22 bp, Homo sapiens
tcagcctaccgctggccctgcc

SEQ ID NO: 5941815 - DNA, 23 bp, Homo sapiens
tcagcctaccgctggccctgccg

SEQ ID NO: 5941816 - DNA, 23 bp, Homo sapiens
tcagcctagccgacctcagcctt

SEQ ID NO: 5941817 - DNA, 20 bp, Homo sapiens
tcagcctagtggcttgtcct

SEQ ID NO: 5941818 - DNA, 12 bp, Homo sapiens
tcagcctcagag

SEQ ID NO: 5941819 - DNA, 14 bp, Homo sapiens
tcagcctcagagga

SEQ ID NO: 5941820 - DNA, 15 bp, Homo sapiens
tcagcctcatcctga

SEQ ID NO: 5941821 - DNA, 21 bp, Homo sapiens
tcagcctcatgccccaggcct

SEQ ID NO: 5941822 - DNA, 19 bp, Homo sapiens
tcagcctcattcagcatgg

SEQ ID NO: 5941823 - DNA, 20 bp, Homo sapiens
tcagcctccagagtagctgg

SEQ ID NO: 5941824 - DNA, 19 bp, Homo sapiens
tcagcctccagcctctgtt

SEQ ID NO: 5941825 - DNA, 23 bp, Homo sapiens
tcagcctccatcctaccccctgt

SEQ ID NO: 5941826 - DNA, 16 bp, Homo sapiens
tcagcctcccaaagtg

SEQ ID NO: 5941827 - DNA, 19 bp, Homo sapiens
tcagcctcccaaagtgctg

SEQ ID NO: 5941828 - DNA, 22 bp, Homo sapiens
tcagcctcccaaccccagggcc

SEQ ID NO: 5941829 - DNA, 21 bp, Homo sapiens
tcagcctcccacagtgctggg

SEQ ID NO: 5941830 - DNA, 21 bp, Homo sapiens
tcagcctcccagagtgctagg

SEQ ID NO: 5941831 - DNA, 20 bp, Homo sapiens
tcagcctccccagtagctgg

SEQ ID NO: 5941832 - DNA, 12 bp, Homo sapiens
tcagcctccccc

SEQ ID NO: 5941833 - DNA, 13 bp, Homo sapiens
tcagcctcccccc

SEQ ID NO: 5941834 - DNA, 13 bp, Homo sapiens
tcagcctcccctt

SEQ ID NO: 5941835 - DNA, 15 bp, Homo sapiens
tcagcctccccttct

SEQ ID NO: 5941836 - DNA, 20 bp, Homo sapiens
tcagcctccccttcttcccg

SEQ ID NO: 5941837 - DNA, 23 bp, Homo sapiens
tcagcctccccttcttcccgccc

SEQ ID NO: 5941838 - DNA, 20 bp, Homo sapiens
tcagcctcccgaatagctgg

SEQ ID NO: 5941839 - DNA, 21 bp, Homo sapiens
tcagcctcccgaatagctggg

SEQ ID NO: 5941840 - DNA, 22 bp, Homo sapiens
tcagcctcccgagtagctggca

SEQ ID NO: 5941841 - DNA, 22 bp, Homo sapiens
tcagcctcccgagtagctggga

SEQ ID NO: 5941842 - DNA, 23 bp, Homo sapiens
tcagcctcccgagtagctgggat

SEQ ID NO: 5941843 - DNA, 16 bp, Homo sapiens
tcagcctccctcagcc

SEQ ID NO: 5941844 - DNA, 12 bp, Homo sapiens
tcagcctccctg

SEQ ID NO: 5941845 - DNA, 20 bp, Homo sapiens
tcagcctccctttgccagcc

SEQ ID NO: 5941846 - DNA, 23 bp, Homo sapiens
tcagcctccctttgccagccacc

SEQ ID NO: 5941847 - DNA, 20 bp, Homo sapiens
tcagcctccggagtagctgg

SEQ ID NO: 5941848 - DNA, 22 bp, Homo sapiens
tcagcctccggatgacacaaat

SEQ ID NO: 5941849 - DNA, 13 bp, Homo sapiens
tcagcctcctgaa

SEQ ID NO: 5941850 - DNA, 20 bp, Homo sapiens
tcagcctcctgaacagctgg

SEQ ID NO: 5941851 - DNA, 15 bp, Homo sapiens
tcagcctcctgagcc

SEQ ID NO: 5941852 - DNA, 14 bp, Homo sapiens
tcagcctcctgagt

SEQ ID NO: 5941853 - DNA, 23 bp, Homo sapiens
tcagcctcctgagtagctgggat

SEQ ID NO: 5941854 - DNA, 16 bp, Homo sapiens
tcagcctcctgtgtag

SEQ ID NO: 5941855 - DNA, 20 bp, Homo sapiens
tcagcctcctgtgtagctgg

SEQ ID NO: 5941856 - DNA, 23 bp, Homo sapiens
tcagcctcgcaggcctccctgcc

SEQ ID NO: 5941857 - DNA, 16 bp, Homo sapiens
tcagcctctctcccag

SEQ ID NO: 5941858 - DNA, 17 bp, Homo sapiens
tcagcctctctcccagt

SEQ ID NO: 5941859 - DNA, 20 bp, Homo sapiens
tcagcctctctcccagtcta

SEQ ID NO: 5941860 - DNA, 21 bp, Homo sapiens
tcagcctctctcccagtctac

SEQ ID NO: 5941861 - DNA, 14 bp, Homo sapiens
tcagcctctgctgg

SEQ ID NO: 5941862 - DNA, 15 bp, Homo sapiens
tcagcctctgctgga

SEQ ID NO: 5941863 - DNA, 14 bp, Homo sapiens
tcagcctctggcca

SEQ ID NO: 5941864 - DNA, 12 bp, Homo sapiens
tcagcctcttaa

SEQ ID NO: 5941865 - DNA, 14 bp, Homo sapiens
tcagcctcttctct

SEQ ID NO: 5941866 - DNA, 20 bp, Homo sapiens
tcagcctcttgagtagctgg

SEQ ID NO: 5941867 - DNA, 20 bp, Homo sapiens
tcagcctgaggctgagactg

SEQ ID NO: 5941868 - DNA, 14 bp, Homo sapiens
tcagcctgcaccct

SEQ ID NO: 5941869 - DNA, 15 bp, Homo sapiens
tcagcctgcccacct

SEQ ID NO: 5941870 - DNA, 20 bp, Homo sapiens
tcagcctgcccacctctccc

SEQ ID NO: 5941871 - DNA, 14 bp, Homo sapiens
tcagcctgcctgaa

SEQ ID NO: 5941872 - DNA, 21 bp, Homo sapiens
tcagcctgcctgaagagagga

SEQ ID NO: 5941873 - DNA, 14 bp, Homo sapiens
tcagcctgcttctt

SEQ ID NO: 5941874 - DNA, 13 bp, Homo sapiens
tcagcctggagag

SEQ ID NO: 5941875 - DNA, 14 bp, Homo sapiens
tcagcctggagagg

SEQ ID NO: 5941876 - DNA, 20 bp, Homo sapiens
tcagcctggagaggcctggg

SEQ ID NO: 5941877 - DNA, 11 bp, Homo sapiens
tcagcctggcc

SEQ ID NO: 5941878 - DNA, 17 bp, Homo sapiens
tcagcctggccagacac

SEQ ID NO: 5941879 - DNA, 18 bp, Homo sapiens
tcagcctggccagacaca

SEQ ID NO: 5941880 - DNA, 20 bp, Homo sapiens
tcagcctggccagacacagg

SEQ ID NO: 5941881 - DNA, 13 bp, Homo sapiens
tcagcctggcctg

SEQ ID NO: 5941882 - DNA, 14 bp, Homo sapiens
tcagcctggcctgc

SEQ ID NO: 5941883 - DNA, 18 bp, Homo sapiens
tcagcctggcctgcccgt

SEQ ID NO: 5941884 - DNA, 23 bp, Homo sapiens
tcagcctggcctgcccgtgccct

SEQ ID NO: 5941885 - DNA, 13 bp, Homo sapiens
tcagcctggctgg

SEQ ID NO: 5941886 - DNA, 15 bp, Homo sapiens
tcagcctggctgggc

SEQ ID NO: 5941887 - DNA, 16 bp, Homo sapiens
tcagcctggctgggct

SEQ ID NO: 5941888 - DNA, 12 bp, Homo sapiens
tcagcctgggcc

SEQ ID NO: 5941889 - DNA, 18 bp, Homo sapiens
tcagcctgggcccctcag

SEQ ID NO: 5941890 - DNA, 19 bp, Homo sapiens
tcagcctgggcccctcagc

SEQ ID NO: 5941891 - DNA, 16 bp, Homo sapiens
tcagcctggggctctc

SEQ ID NO: 5941892 - DNA, 14 bp, Homo sapiens
tcagcctggtgggc

SEQ ID NO: 5941893 - DNA, 12 bp, Homo sapiens
tcagcctggttt

SEQ ID NO: 5941894 - DNA, 14 bp, Homo sapiens
tcagcctgtaccgg

SEQ ID NO: 5941895 - DNA, 14 bp, Homo sapiens
tcagcctgtctcgg

SEQ ID NO: 5941896 - DNA, 17 bp, Homo sapiens
tcagcctgtctcttcca

SEQ ID NO: 5941897 - DNA, 18 bp, Homo sapiens
tcagcctgtctcttccat

SEQ ID NO: 5941898 - DNA, 12 bp, Homo sapiens
tcagcctgtgct

SEQ ID NO: 5941899 - DNA, 18 bp, Homo sapiens
tcagcctgtgctgtggca

SEQ ID NO: 5941900 - DNA, 19 bp, Homo sapiens
tcagcctgttccagaagga

SEQ ID NO: 5941901 - DNA, 18 bp, Homo sapiens
tcagcctgttccttcctg

SEQ ID NO: 5941902 - DNA, 20 bp, Homo sapiens
tcagcctgttccttcctgca

SEQ ID NO: 5941903 - DNA, 21 bp, Homo sapiens
tcagcctgttccttcctgcag

SEQ ID NO: 5941904 - DNA, 17 bp, Homo sapiens
tcagccttaagaaccat

SEQ ID NO: 5941905 - DNA, 15 bp, Homo sapiens
tcagccttacatttg

SEQ ID NO: 5941906 - DNA, 18 bp, Homo sapiens
tcagccttcaagaatcag

SEQ ID NO: 5941907 - DNA, 22 bp, Homo sapiens
tcagccttccaactagctggga

SEQ ID NO: 5941908 - DNA, 21 bp, Homo sapiens
tcagccttccccttgcccagg

SEQ ID NO: 5941909 - DNA, 16 bp, Homo sapiens
tcagccttcctcctca

SEQ ID NO: 5941910 - DNA, 14 bp, Homo sapiens
tcagccttctcctc

SEQ ID NO: 5941911 - DNA, 14 bp, Homo sapiens
tcagccttctgagt

SEQ ID NO: 5941912 - DNA, 15 bp, Homo sapiens
tcagccttgaaaaac

SEQ ID NO: 5941913 - DNA, 21 bp, Homo sapiens
tcagccttgaaaaacaagtct

SEQ ID NO: 5941914 - DNA, 15 bp, Homo sapiens
tcagccttgctgacc

SEQ ID NO: 5941915 - DNA, 17 bp, Homo sapiens
tcagccttgctgacctc

SEQ ID NO: 5941916 - DNA, 19 bp, Homo sapiens
tcagccttgctgctctgcg

SEQ ID NO: 5941917 - DNA, 22 bp, Homo sapiens
tcagccttgctgctctgcgtgg

SEQ ID NO: 5941918 - DNA, 16 bp, Homo sapiens
tcagccttggttcctg

SEQ ID NO: 5941919 - DNA, 17 bp, Homo sapiens
tcagccttggttcctga

SEQ ID NO: 5941920 - DNA, 15 bp, Homo sapiens
tcaggagattgttaa

SEQ ID NO: 5941921 - DNA, 15 bp, Homo sapiens
tcaggagcacagcca

SEQ ID NO: 5941922 - DNA, 18 bp, Homo sapiens
tcaggagcacagccatag

SEQ ID NO: 5941923 - DNA, 22 bp, Homo sapiens
tcaggagcacagccatagcaga

SEQ ID NO: 5941924 - DNA, 10 bp, Homo sapiens
tcaggagcag

SEQ ID NO: 5941925 - DNA, 13 bp, Homo sapiens
tcaggagcagcat

SEQ ID NO: 5941926 - DNA, 15 bp, Homo sapiens
tcaggagcagcatca

SEQ ID NO: 5941927 - DNA, 22 bp, Homo sapiens
tcaggagcagcctcagaacaaa

SEQ ID NO: 5941928 - DNA, 14 bp, Homo sapiens
tcaggagccagcag

SEQ ID NO: 5941929 - DNA, 13 bp, Homo sapiens
tcaggagccccca

SEQ ID NO: 5941930 - DNA, 12 bp, Homo sapiens
tcaggagcctcc

SEQ ID NO: 5941931 - DNA, 11 bp, Homo sapiens
tcaggagcctg

SEQ ID NO: 5941932 - DNA, 12 bp, Homo sapiens
tcaggagcctgc

SEQ ID NO: 5941933 - DNA, 18 bp, Homo sapiens
tcaggagcctgctaagga

SEQ ID NO: 5941934 - DNA, 19 bp, Homo sapiens
tcaggagcctgctaaggaa

SEQ ID NO: 5941935 - DNA, 22 bp, Homo sapiens
tcaggagcctgctaaggaacaa

SEQ ID NO: 5941936 - DNA, 13 bp, Homo sapiens
tcaggagcctggc

SEQ ID NO: 5941937 - DNA, 16 bp, Homo sapiens
tcaggagcctggccag

SEQ ID NO: 5941938 - DNA, 21 bp, Homo sapiens
tcaggagcctggccaggcagg

SEQ ID NO: 5941939 - DNA, 21 bp, Homo sapiens
tcaggagcgatcgctcccctg

SEQ ID NO: 5941940 - DNA, 13 bp, Homo sapiens
tcaggagctcagt

SEQ ID NO: 5941941 - DNA, 15 bp, Homo sapiens
tcaggagcttcaatg

SEQ ID NO: 5941942 - DNA, 12 bp, Homo sapiens
tcaggagcttgc

SEQ ID NO: 5941943 - DNA, 14 bp, Homo sapiens
tcaggagcttgggc

SEQ ID NO: 5941944 - DNA, 23 bp, Homo sapiens
tcaggagcttgggcagtgcccca

SEQ ID NO: 5941945 - DNA, 16 bp, Homo sapiens
tcaggaggaaggctta

SEQ ID NO: 5941946 - DNA, 15 bp, Homo sapiens
tcaggaggaggctgc

SEQ ID NO: 5941947 - DNA, 18 bp, Homo sapiens
tcaggaggaggctgccct

SEQ ID NO: 5941948 - DNA, 20 bp, Homo sapiens
tcaggaggcagtggcttgga

SEQ ID NO: 5941949 - DNA, 18 bp, Homo sapiens
tcaggaggccaaggtggg

SEQ ID NO: 5941950 - DNA, 22 bp, Homo sapiens
tcaggaggccgaggcaggagaa

SEQ ID NO: 5941951 - DNA, 18 bp, Homo sapiens
tcaggaggccgttgcaga

SEQ ID NO: 5941952 - DNA, 19 bp, Homo sapiens
tcaggaggcgaataaatgt

SEQ ID NO: 5941953 - DNA, 16 bp, Homo sapiens
tcaggaggcgcagccc

SEQ ID NO: 5941954 - DNA, 19 bp, Homo sapiens
tcaggaggcgcagcccgaa

SEQ ID NO: 5941955 - DNA, 23 bp, Homo sapiens
tcaggaggcgcagcccgaagccc

SEQ ID NO: 5941956 - DNA, 12 bp, Homo sapiens
tcaggaggcgcc

SEQ ID NO: 5941957 - DNA, 12 bp, Homo sapiens
tcaggaggctga

SEQ ID NO: 5941958 - DNA, 14 bp, Homo sapiens
tcaggaggctgagg

SEQ ID NO: 5941959 - DNA, 17 bp, Homo sapiens
tcaggaggctgaggcac

SEQ ID NO: 5941960 - DNA, 19 bp, Homo sapiens
tcaggaggctgaggcagga

SEQ ID NO: 5941961 - DNA, 22 bp, Homo sapiens
tcaggaggctgaggcaggagaa

SEQ ID NO: 5941962 - DNA, 13 bp, Homo sapiens
tcaggaggctgga

SEQ ID NO: 5941963 - DNA, 21 bp, Homo sapiens
tcaggaggctggaggaagggg

SEQ ID NO: 5941964 - DNA, 16 bp, Homo sapiens
tcaggagggcaggctg

SEQ ID NO: 5941965 - DNA, 23 bp, Homo sapiens
tcaggagggcaggctgaggtggg

SEQ ID NO: 5941966 - DNA, 20 bp, Homo sapiens
tcaggagggtgacgcccagc

SEQ ID NO: 5941967 - DNA, 18 bp, Homo sapiens
tcaggaggtactgtgagg

SEQ ID NO: 5941968 - DNA, 18 bp, Homo sapiens
tcaggagtccaagaccag

SEQ ID NO: 5941969 - DNA, 14 bp, Homo sapiens
tcaggagtccactg

SEQ ID NO: 5941970 - DNA, 20 bp, Homo sapiens
tcaggagtccactgcctcca

SEQ ID NO: 5941971 - DNA, 19 bp, Homo sapiens
tcaggagtcccaaggaaag

SEQ ID NO: 5941972 - DNA, 16 bp, Homo sapiens
tcaggagtgtgtgtga

SEQ ID NO: 5941973 - DNA, 22 bp, Homo sapiens
tcaggagttagaggccagcctg

SEQ ID NO: 5941974 - DNA, 17 bp, Homo sapiens
tcaggagttcaagacta

SEQ ID NO: 5941975 - DNA, 12 bp, Homo sapiens
tcaggagttcct

SEQ ID NO: 5941976 - DNA, 22 bp, Homo sapiens
tcaggagttcgagaccagcctc

SEQ ID NO: 5941977 - DNA, 23 bp, Homo sapiens
tcaggagttcgagagcagcctgg

SEQ ID NO: 5941978 - DNA, 20 bp, Homo sapiens
tcaggagttcgaggcgagcc

SEQ ID NO: 5941979 - DNA, 18 bp, Homo sapiens
tcaggatactcaaagtgg

SEQ ID NO: 5941980 - DNA, 20 bp, Homo sapiens
tcaggatattcactctgtgg

SEQ ID NO: 5941981 - DNA, 20 bp, Homo sapiens
tcaggatcaaaccccgacca

SEQ ID NO: 5941982 - DNA, 16 bp, Homo sapiens
tcaggatcaagaaagt

SEQ ID NO: 5941983 - DNA, 15 bp, Homo sapiens
tcaggatccagtctg

SEQ ID NO: 5941984 - DNA, 14 bp, Homo sapiens
tcaggatctatttt

SEQ ID NO: 5941985 - DNA, 23 bp, Homo sapiens
tcaggatctcttagcattttaat

SEQ ID NO: 5941986 - DNA, 15 bp, Homo sapiens
tcaggatgaacccag

SEQ ID NO: 5941987 - DNA, 17 bp, Homo sapiens
tcaggatgaacccagga

SEQ ID NO: 5941988 - DNA, 15 bp, Homo sapiens
tcaggatgaggcccc

SEQ ID NO: 5941989 - DNA, 19 bp, Homo sapiens
tcaggatgagggaaaagaa

SEQ ID NO: 5941990 - DNA, 13 bp, Homo sapiens
tcaggatgcacat

SEQ ID NO: 5941991 - DNA, 17 bp, Homo sapiens
tcaggatgcacatttct

SEQ ID NO: 5941992 - DNA, 19 bp, Homo sapiens
tcaggatgcacggtttctg

SEQ ID NO: 5941993 - DNA, 16 bp, Homo sapiens
tcaggatgcccagggc

SEQ ID NO: 5941994 - DNA, 17 bp, Homo sapiens
tcaggatgggaagaaaa

SEQ ID NO: 5941995 - DNA, 18 bp, Homo sapiens
tcaggatggtttctttaa

SEQ ID NO: 5941996 - DNA, 21 bp, Homo sapiens
tcaggatgtaggggttaactt

SEQ ID NO: 5941997 - DNA, 19 bp, Homo sapiens
tcaggattaactaaagaag

SEQ ID NO: 5941998 - DNA, 15 bp, Homo sapiens
tcaggattgcgagag

SEQ ID NO: 5941999 - DNA, 18 bp, Homo sapiens
tcaggattgcgagagatg

SEQ ID NO: 5942000 - DNA, 23 bp, Homo sapiens
tcaggattgcgagagatgtgtgt

SEQ ID NO: 5942001 - DNA, 20 bp, Homo sapiens
tcaggatttaaaaactggaa

SEQ ID NO: 5942002 - DNA, 13 bp, Homo sapiens
tcaggatttcatt

SEQ ID NO: 5942003 - DNA, 15 bp, Homo sapiens
tcaggcaaagtgctt

SEQ ID NO: 5942004 - DNA, 17 bp, Homo sapiens
tcaggcaaattggggag

SEQ ID NO: 5942005 - DNA, 20 bp, Homo sapiens
tcaggcaagcccctcagccc

SEQ ID NO: 5942006 - DNA, 21 bp, Homo sapiens
tcaggcaatgccctgcggctc

SEQ ID NO: 5942007 - DNA, 19 bp, Homo sapiens
tcaggcaattctcctgcct

SEQ ID NO: 5942008 - DNA, 17 bp, Homo sapiens
tcaggcacaccttgcag

SEQ ID NO: 5942009 - DNA, 15 bp, Homo sapiens
tcaggcacaggcagg

SEQ ID NO: 5942010 - DNA, 16 bp, Homo sapiens
tcaggcacaggcagga

SEQ ID NO: 5942011 - DNA, 19 bp, Homo sapiens
tcaggcacaggcaggaaga

SEQ ID NO: 5942012 - DNA, 16 bp, Homo sapiens
tcaggcacatcattgg

SEQ ID NO: 5942013 - DNA, 12 bp, Homo sapiens
tcaggcaccagc

SEQ ID NO: 5942014 - DNA, 16 bp, Homo sapiens
tcaggcaccagcatcc

SEQ ID NO: 5942015 - DNA, 20 bp, Homo sapiens
tcaggcacgtctcctgctgc

SEQ ID NO: 5942016 - DNA, 18 bp, Homo sapiens
tcaggcactgggcatgag

SEQ ID NO: 5942017 - DNA, 19 bp, Homo sapiens
tcaggcactgggcatgagg

SEQ ID NO: 5942018 - DNA, 14 bp, Homo sapiens
tcaggcactggtgg

SEQ ID NO: 5942019 - DNA, 16 bp, Homo sapiens
tcaggcactggtggca

SEQ ID NO: 5942020 - DNA, 17 bp, Homo sapiens
tcaggcagaaatattta

SEQ ID NO: 5942021 - DNA, 21 bp, Homo sapiens
tcaggcagacaagagctgctg

SEQ ID NO: 5942022 - DNA, 24 bp, Homo sapiens
tcaggcagaggatgttctggacct

SEQ ID NO: 5942023 - DNA, 19 bp, Homo sapiens
tcaggcagataactgctgt

SEQ ID NO: 5942024 - DNA, 20 bp, Homo sapiens
tcaggcagataactgctgta

SEQ ID NO: 5942025 - DNA, 20 bp, Homo sapiens
tcaggcagcaccacactggg

SEQ ID NO: 5942026 - DNA, 22 bp, Homo sapiens
tcaggcagcaccacactgggtg

SEQ ID NO: 5942027 - DNA, 12 bp, Homo sapiens
tcaggcagccag

SEQ ID NO: 5942028 - DNA, 15 bp, Homo sapiens
tcaggcagccttcat

SEQ ID NO: 5942029 - DNA, 16 bp, Homo sapiens
tcaggcagccttcata

SEQ ID NO: 5942030 - DNA, 21 bp, Homo sapiens
tcaggcagcgttagggctgct

SEQ ID NO: 5942031 - DNA, 18 bp, Homo sapiens
tcaggcaggtgggatgga

SEQ ID NO: 5942032 - DNA, 20 bp, Homo sapiens
tcaggcagtaggcattcttt

SEQ ID NO: 5942033 - DNA, 12 bp, Homo sapiens
tcaggcagtggc

SEQ ID NO: 5942034 - DNA, 18 bp, Homo sapiens
tcaggcagttactatttt

SEQ ID NO: 5942035 - DNA, 18 bp, Homo sapiens
tcaggcagttccctgttg

SEQ ID NO: 5942036 - DNA, 16 bp, Homo sapiens
tcaggcataggcctgg

SEQ ID NO: 5942037 - DNA, 17 bp, Homo sapiens
tcaggcataggcctggg

SEQ ID NO: 5942038 - DNA, 18 bp, Homo sapiens
tcaggcataggcctgggt

SEQ ID NO: 5942039 - DNA, 19 bp, Homo sapiens
tcaggcataggcctgggtg

SEQ ID NO: 5942040 - DNA, 17 bp, Homo sapiens
tcaggcatgaacatgta

SEQ ID NO: 5942041 - DNA, 14 bp, Homo sapiens
tcaggcatgcctgt

SEQ ID NO: 5942042 - DNA, 15 bp, Homo sapiens
tcaggcatgcctgtg

SEQ ID NO: 5942043 - DNA, 16 bp, Homo sapiens
tcaggcatgcctgtgt

SEQ ID NO: 5942044 - DNA, 17 bp, Homo sapiens
tcaggcatggctcagag

SEQ ID NO: 5942045 - DNA, 20 bp, Homo sapiens
tcaggcattggatatttttt

SEQ ID NO: 5942046 - DNA, 23 bp, Homo sapiens
tcaggcatttcatttattttttc

SEQ ID NO: 5942047 - DNA, 20 bp, Homo sapiens
tcaggccaaagacctcccaa

SEQ ID NO: 5942048 - DNA, 17 bp, Homo sapiens
tcaggccacagcccctg

SEQ ID NO: 5942049 - DNA, 23 bp, Homo sapiens
tcaggccacataattggactctg

SEQ ID NO: 5942050 - DNA, 14 bp, Homo sapiens
tcaggccacggcag

SEQ ID NO: 5942051 - DNA, 17 bp, Homo sapiens
tcaggccagagccaagg

SEQ ID NO: 5942052 - DNA, 12 bp, Homo sapiens
tcaggccagccc

SEQ ID NO: 5942053 - DNA, 16 bp, Homo sapiens
tcaggccagcccagcc

SEQ ID NO: 5942054 - DNA, 13 bp, Homo sapiens
tcaggccagctgc

SEQ ID NO: 5942055 - DNA, 14 bp, Homo sapiens
tcaggccaggccct

SEQ ID NO: 5942056 - DNA, 16 bp, Homo sapiens
tcaggccaggccctct

SEQ ID NO: 5942057 - DNA, 17 bp, Homo sapiens
tcaggccaggccctctg

SEQ ID NO: 5942058 - DNA, 20 bp, Homo sapiens
tcaggccaggccctctgccc

SEQ ID NO: 5942059 - DNA, 17 bp, Homo sapiens
tcaggccaggtgcagtg

SEQ ID NO: 5942060 - DNA, 13 bp, Homo sapiens
tcaggccaggtgg

SEQ ID NO: 5942061 - DNA, 21 bp, Homo sapiens
tcaggccagtaatcccagtga

SEQ ID NO: 5942062 - DNA, 17 bp, Homo sapiens
tcaggccagtgccagga

SEQ ID NO: 5942063 - DNA, 21 bp, Homo sapiens
tcaggccatattatcaatgtt

SEQ ID NO: 5942064 - DNA, 21 bp, Homo sapiens
tcaggccatcatcagtggagc

SEQ ID NO: 5942065 - DNA, 23 bp, Homo sapiens
tcaggccatcatcagtggagcca

SEQ ID NO: 5942066 - DNA, 15 bp, Homo sapiens
tcaggcccagcctct

SEQ ID NO: 5942067 - DNA, 15 bp, Homo sapiens
tcaggcccaggcact

SEQ ID NO: 5942068 - DNA, 19 bp, Homo sapiens
tcaggcccagttctcgtgc

SEQ ID NO: 5942069 - DNA, 22 bp, Homo sapiens
tcaggcccagttctcgtgccct

SEQ ID NO: 5942070 - DNA, 17 bp, Homo sapiens
tcaggcccatcagctac

SEQ ID NO: 5942071 - DNA, 14 bp, Homo sapiens
tcaggccccaggac

SEQ ID NO: 5942072 - DNA, 20 bp, Homo sapiens
tcaggcccccacctggctca

SEQ ID NO: 5942073 - DNA, 12 bp, Homo sapiens
tcaggcccccag

SEQ ID NO: 5942074 - DNA, 16 bp, Homo sapiens
tcaggccccgggcttc

SEQ ID NO: 5942075 - DNA, 19 bp, Homo sapiens
tcaggccccgggcttccct

SEQ ID NO: 5942076 - DNA, 21 bp, Homo sapiens
tcaggccccgggcttcccttc

SEQ ID NO: 5942077 - DNA, 20 bp, Homo sapiens
tcaggcccggcatgcgggcc

SEQ ID NO: 5942078 - DNA, 17 bp, Homo sapiens
tcaggcccgtcggagct

SEQ ID NO: 5942079 - DNA, 18 bp, Homo sapiens
tcaggcccgtcggagctg

SEQ ID NO: 5942080 - DNA, 17 bp, Homo sapiens
tcaggccctcagctgtc

SEQ ID NO: 5942081 - DNA, 15 bp, Homo sapiens
tcaggccctctgcct

SEQ ID NO: 5942082 - DNA, 17 bp, Homo sapiens
tcaggccctctgcctgc

SEQ ID NO: 5942083 - DNA, 16 bp, Homo sapiens
tcaggcctaggaggcc

SEQ ID NO: 5942084 - DNA, 23 bp, Homo sapiens
tcaggcctcacccctcccctggg

SEQ ID NO: 5942085 - DNA, 13 bp, Homo sapiens
tcaggcctcacct

SEQ ID NO: 5942086 - DNA, 21 bp, Homo sapiens
tcaggcctcacctcccagggc

SEQ ID NO: 5942087 - DNA, 22 bp, Homo sapiens
tcaggcctcacctcccagggct

SEQ ID NO: 5942088 - DNA, 16 bp, Homo sapiens
tcaggcctctgcagaa

SEQ ID NO: 5942089 - DNA, 19 bp, Homo sapiens
tcaggcctctgcagaagcc

SEQ ID NO: 5942090 - DNA, 21 bp, Homo sapiens
tcaggcctctgcagaagccaa

SEQ ID NO: 5942091 - DNA, 23 bp, Homo sapiens
tcaggcctgaacccgtccattca

SEQ ID NO: 5942092 - DNA, 16 bp, Homo sapiens
tcaggcctgatgaggg

SEQ ID NO: 5942093 - DNA, 20 bp, Homo sapiens
tcaggcctgatgagggggaa

SEQ ID NO: 5942094 - DNA, 14 bp, Homo sapiens
tcaggcctgccaat

SEQ ID NO: 5942095 - DNA, 15 bp, Homo sapiens
tcaggcctggcctca

SEQ ID NO: 5942096 - DNA, 14 bp, Homo sapiens
tcaggcctgggcag

SEQ ID NO: 5942097 - DNA, 21 bp, Homo sapiens
tcaggcctgggcaggaccctg

SEQ ID NO: 5942098 - DNA, 18 bp, Homo sapiens
tcagtaatttgtttaaaa

SEQ ID NO: 5942099 - DNA, 19 bp, Homo sapiens
tcagtaatttttagaagca

SEQ ID NO: 5942100 - DNA, 22 bp, Homo sapiens
tcagtacaacccataatcatgt

SEQ ID NO: 5942101 - DNA, 15 bp, Homo sapiens
tcagtacagggcagg

SEQ ID NO: 5942102 - DNA, 12 bp, Homo sapiens
tcagtaccaaag

SEQ ID NO: 5942103 - DNA, 21 bp, Homo sapiens
tcagtacccctggtaaaccaa

SEQ ID NO: 5942104 - DNA, 17 bp, Homo sapiens
tcagtaccctctcagct

SEQ ID NO: 5942105 - DNA, 16 bp, Homo sapiens
tcagtacgatcaagtt

SEQ ID NO: 5942106 - DNA, 20 bp, Homo sapiens
tcagtacgatcaagttgttg

SEQ ID NO: 5942107 - DNA, 19 bp, Homo sapiens
tcagtacttcagcaagaga

SEQ ID NO: 5942108 - DNA, 20 bp, Homo sapiens
tcagtacttgtgaaacacag

SEQ ID NO: 5942109 - DNA, 22 bp, Homo sapiens
tcagtacttgtgaaacacagct

SEQ ID NO: 5942110 - DNA, 15 bp, Homo sapiens
tcagtacttgtttct

SEQ ID NO: 5942111 - DNA, 13 bp, Homo sapiens
tcagtacttttat

SEQ ID NO: 5942112 - DNA, 16 bp, Homo sapiens
tcagtacttttattaa

SEQ ID NO: 5942113 - DNA, 14 bp, Homo sapiens
tcagtactttttta

SEQ ID NO: 5942114 - DNA, 23 bp, Homo sapiens
tcagtacttttttaaatattttc

SEQ ID NO: 5942115 - DNA, 18 bp, Homo sapiens
tcagtagaaaaggatcta

SEQ ID NO: 5942116 - DNA, 16 bp, Homo sapiens
tcagtagaaagctaaa

SEQ ID NO: 5942117 - DNA, 22 bp, Homo sapiens
tcagtagaaagctaaagtgatc

SEQ ID NO: 5942118 - DNA, 17 bp, Homo sapiens
tcagtagaattaccatt

SEQ ID NO: 5942119 - DNA, 14 bp, Homo sapiens
tcagtagaatttta

SEQ ID NO: 5942120 - DNA, 14 bp, Homo sapiens
tcagtagcatttta

SEQ ID NO: 5942121 - DNA, 20 bp, Homo sapiens
tcagtagccatatcttccaa

SEQ ID NO: 5942122 - DNA, 14 bp, Homo sapiens
tcagtagctgagtg

SEQ ID NO: 5942123 - DNA, 14 bp, Homo sapiens
tcagtagcttaagg

SEQ ID NO: 5942124 - DNA, 14 bp, Homo sapiens
tcagtagcttatct

SEQ ID NO: 5942125 - DNA, 18 bp, Homo sapiens
tcagtaggactccttatt

SEQ ID NO: 5942126 - DNA, 13 bp, Homo sapiens
tcagtaggctaat

SEQ ID NO: 5942127 - DNA, 21 bp, Homo sapiens
tcagtaggtctgaaggcctcc

SEQ ID NO: 5942128 - DNA, 22 bp, Homo sapiens
tcagtaggtctgaaggcctcca

SEQ ID NO: 5942129 - DNA, 13 bp, Homo sapiens
tcagtagtcagac

SEQ ID NO: 5942130 - DNA, 17 bp, Homo sapiens
tcagtagtgagcagcat

SEQ ID NO: 5942131 - DNA, 15 bp, Homo sapiens
tcagtagtgctaatg

SEQ ID NO: 5942132 - DNA, 14 bp, Homo sapiens
tcagtagtgtacat

SEQ ID NO: 5942133 - DNA, 16 bp, Homo sapiens
tcagtagtgtacatta

SEQ ID NO: 5942134 - DNA, 14 bp, Homo sapiens
tcagtagttccagg

SEQ ID NO: 5942135 - DNA, 15 bp, Homo sapiens
tcagtagtttcatgt

SEQ ID NO: 5942136 - DNA, 18 bp, Homo sapiens
tcagtagtttctaagtct

SEQ ID NO: 5942137 - DNA, 18 bp, Homo sapiens
tcagtagtttgagaccag

SEQ ID NO: 5942138 - DNA, 20 bp, Homo sapiens
tcagtagtttgcatttcaga

SEQ ID NO: 5942139 - DNA, 16 bp, Homo sapiens
tcagtataaattgtcg

SEQ ID NO: 5942140 - DNA, 16 bp, Homo sapiens
tcagtataattctgta

SEQ ID NO: 5942141 - DNA, 20 bp, Homo sapiens
tcagtataattctgtactga

SEQ ID NO: 5942142 - DNA, 14 bp, Homo sapiens
tcagtatactgtgt

SEQ ID NO: 5942143 - DNA, 14 bp, Homo sapiens
tcagtatatttggt

SEQ ID NO: 5942144 - DNA, 15 bp, Homo sapiens
tcagtatatttggtt

SEQ ID NO: 5942145 - DNA, 22 bp, Homo sapiens
tcagtatatttggtttctagat

SEQ ID NO: 5942146 - DNA, 14 bp, Homo sapiens
tcagtatattttct

SEQ ID NO: 5942147 - DNA, 18 bp, Homo sapiens
tcagtatcaaggctgcct

SEQ ID NO: 5942148 - DNA, 19 bp, Homo sapiens
tcagtatcaaggctgcctg

SEQ ID NO: 5942149 - DNA, 21 bp, Homo sapiens
tcagtatcaaggctgcctgga

SEQ ID NO: 5942150 - DNA, 17 bp, Homo sapiens
tcagtatccaggctttg

SEQ ID NO: 5942151 - DNA, 17 bp, Homo sapiens
tcagtatccatgctctt

SEQ ID NO: 5942152 - DNA, 20 bp, Homo sapiens
tcagtatctgtatctctctc

SEQ ID NO: 5942153 - DNA, 24 bp, Homo sapiens
tcagtatctgtatctctctctctt

SEQ ID NO: 5942154 - DNA, 16 bp, Homo sapiens
tcagtatcttaaaatt

SEQ ID NO: 5942155 - DNA, 21 bp, Homo sapiens
tcagtatcttagagtttacag

SEQ ID NO: 5942156 - DNA, 16 bp, Homo sapiens
tcagtatgaagacact

SEQ ID NO: 5942157 - DNA, 19 bp, Homo sapiens
tcagtatgaagacactgtc

SEQ ID NO: 5942158 - DNA, 21 bp, Homo sapiens
tcagtatgatttatcctcaca

SEQ ID NO: 5942159 - DNA, 16 bp, Homo sapiens
tcagtatgctgtttta

SEQ ID NO: 5942160 - DNA, 20 bp, Homo sapiens
tcagtatgctgttttaataa

SEQ ID NO: 5942161 - DNA, 20 bp, Homo sapiens
tcagtatgctttccctgagg

SEQ ID NO: 5942162 - DNA, 15 bp, Homo sapiens
tcagtatgtattctt

SEQ ID NO: 5942163 - DNA, 23 bp, Homo sapiens
tcagtatgtccccataagacaaa

SEQ ID NO: 5942164 - DNA, 16 bp, Homo sapiens
tcagtatgtggaagtg

SEQ ID NO: 5942165 - DNA, 15 bp, Homo sapiens
tcagtatgttgtcaa

SEQ ID NO: 5942166 - DNA, 16 bp, Homo sapiens
tcagtatgttgtcaaa

SEQ ID NO: 5942167 - DNA, 17 bp, Homo sapiens
tcagtatgttttacact

SEQ ID NO: 5942168 - DNA, 19 bp, Homo sapiens
tcagtatgttttacactgt

SEQ ID NO: 5942169 - DNA, 17 bp, Homo sapiens
tcagtattaaactctcc

SEQ ID NO: 5942170 - DNA, 21 bp, Homo sapiens
tcagtattaatactaaaatat

SEQ ID NO: 5942171 - DNA, 19 bp, Homo sapiens
tcagtattactttctgccg

SEQ ID NO: 5942172 - DNA, 20 bp, Homo sapiens
tcagtattactttctgccgc

SEQ ID NO: 5942173 - DNA, 20 bp, Homo sapiens
tcagtattagatgcacttaa

SEQ ID NO: 5942174 - DNA, 16 bp, Homo sapiens
tcagtattatatgtac

SEQ ID NO: 5942175 - DNA, 22 bp, Homo sapiens
tcagtattatctaaatgaatga

SEQ ID NO: 5942176 - DNA, 20 bp, Homo sapiens
tcagtattcccagccttgag

SEQ ID NO: 5942177 - DNA, 19 bp, Homo sapiens
tcagtattctgacatgtaa

SEQ ID NO: 5942178 - DNA, 18 bp, Homo sapiens
tcagtattgaagcatttt

SEQ ID NO: 5942179 - DNA, 22 bp, Homo sapiens
tcagtattgaagcattttataa

SEQ ID NO: 5942180 - DNA, 20 bp, Homo sapiens
tcagtattgagacactgtca

SEQ ID NO: 5942181 - DNA, 22 bp, Homo sapiens
tcagtattgagacactgtcaag

SEQ ID NO: 5942182 - DNA, 16 bp, Homo sapiens
tcagtattgtgtaaag

SEQ ID NO: 5942183 - DNA, 24 bp, Homo sapiens
tcagtattgttttggtttgctact

SEQ ID NO: 5942184 - DNA, 13 bp, Homo sapiens
tcagtatttaact

SEQ ID NO: 5942185 - DNA, 20 bp, Homo sapiens
tcagtatttaactaattata

SEQ ID NO: 5942186 - DNA, 16 bp, Homo sapiens
tcagtatttaatgaaa

SEQ ID NO: 5942187 - DNA, 14 bp, Homo sapiens
tcagtatttatgta

SEQ ID NO: 5942188 - DNA, 17 bp, Homo sapiens
tcagtatttatgtaatt

SEQ ID NO: 5942189 - DNA, 22 bp, Homo sapiens
tcagtatttatgtaatttgtac

SEQ ID NO: 5942190 - DNA, 13 bp, Homo sapiens
tcagtatttcaac

SEQ ID NO: 5942191 - DNA, 14 bp, Homo sapiens
tcagtatttcaact

SEQ ID NO: 5942192 - DNA, 16 bp, Homo sapiens
tcagtatttccttcca

SEQ ID NO: 5942193 - DNA, 17 bp, Homo sapiens
tcagtatttccttccac

SEQ ID NO: 5942194 - DNA, 19 bp, Homo sapiens
tcagtatttccttccactg

SEQ ID NO: 5942195 - DNA, 15 bp, Homo sapiens
tcagtattttcacac

SEQ ID NO: 5942196 - DNA, 18 bp, Homo sapiens
tcagtattttccctgcta

SEQ ID NO: 5942197 - DNA, 22 bp, Homo sapiens
tcagtattttggagaaattatt

SEQ ID NO: 5942198 - DNA, 13 bp, Homo sapiens
tcagtcaaaactt

SEQ ID NO: 5942199 - DNA, 15 bp, Homo sapiens
tcagtcaaaacttta

SEQ ID NO: 5942200 - DNA, 16 bp, Homo sapiens
tcagtcaatattttta

SEQ ID NO: 5942201 - DNA, 20 bp, Homo sapiens
tcagtcacaaaccagcctgg

SEQ ID NO: 5942202 - DNA, 21 bp, Homo sapiens
tcagtcacaaaccagcctggg

SEQ ID NO: 5942203 - DNA, 13 bp, Homo sapiens
tcagtcacagcca

SEQ ID NO: 5942204 - DNA, 18 bp, Homo sapiens
tcagtcacccccacttcc

SEQ ID NO: 5942205 - DNA, 20 bp, Homo sapiens
tcagtcactaaaaggaagac

SEQ ID NO: 5942206 - DNA, 23 bp, Homo sapiens
tcagtcagaaaactttaaaaaat

SEQ ID NO: 5942207 - DNA, 16 bp, Homo sapiens
tcagtcagggtttgtc

SEQ ID NO: 5942208 - DNA, 22 bp, Homo sapiens
tcagtcagttcccggagcacag

SEQ ID NO: 5942209 - DNA, 18 bp, Homo sapiens
tcagtcatcaaagcagaa

SEQ ID NO: 5942210 - DNA, 21 bp, Homo sapiens
tcagtcatcaaagcagaagtc

SEQ ID NO: 5942211 - DNA, 20 bp, Homo sapiens
tcagtcatgcataaatatgc

SEQ ID NO: 5942212 - DNA, 23 bp, Homo sapiens
tcagtccaaggggtcccctccag

SEQ ID NO: 5942213 - DNA, 22 bp, Homo sapiens
tcagtccacccccattgtgaat

SEQ ID NO: 5942214 - DNA, 23 bp, Homo sapiens
tcagtccacccccattgtgaatg

SEQ ID NO: 5942215 - DNA, 17 bp, Homo sapiens
tcagtccagaagaattg

SEQ ID NO: 5942216 - DNA, 14 bp, Homo sapiens
tcagtccagatgcc

SEQ ID NO: 5942217 - DNA, 20 bp, Homo sapiens
tcagtccagatgccttcctg

SEQ ID NO: 5942218 - DNA, 21 bp, Homo sapiens
tcagtccagcagtttccagtc

SEQ ID NO: 5942219 - DNA, 15 bp, Homo sapiens
tcagtccatttatat

SEQ ID NO: 5942220 - DNA, 22 bp, Homo sapiens
tcagtcccaaagcggccgatgg

SEQ ID NO: 5942221 - DNA, 15 bp, Homo sapiens
tcagtcccacagccc

SEQ ID NO: 5942222 - DNA, 17 bp, Homo sapiens
tcagtcccactgcaccc

SEQ ID NO: 5942223 - DNA, 21 bp, Homo sapiens
tcagtcccccaccacactgaa

SEQ ID NO: 5942224 - DNA, 13 bp, Homo sapiens
tcagtcccctccc

SEQ ID NO: 5942225 - DNA, 14 bp, Homo sapiens
tcagtcccctccca

SEQ ID NO: 5942226 - DNA, 22 bp, Homo sapiens
tcagtcccctctctctgggtca

SEQ ID NO: 5942227 - DNA, 16 bp, Homo sapiens
tcagtccctactgagt

SEQ ID NO: 5942228 - DNA, 17 bp, Homo sapiens
tcagtccctatgtattt

SEQ ID NO: 5942229 - DNA, 13 bp, Homo sapiens
tcagtccctgagc

SEQ ID NO: 5942230 - DNA, 20 bp, Homo sapiens
tcagtccctgagcagtctac

SEQ ID NO: 5942231 - DNA, 19 bp, Homo sapiens
tcagtcctcaaagcttttt

SEQ ID NO: 5942232 - DNA, 18 bp, Homo sapiens
tcagtcctcccctcacag

SEQ ID NO: 5942233 - DNA, 21 bp, Homo sapiens
tcagtcctcccctcacagcct

SEQ ID NO: 5942234 - DNA, 13 bp, Homo sapiens
tcagtcctctgca

SEQ ID NO: 5942235 - DNA, 18 bp, Homo sapiens
tcagtcctgtagttttat

SEQ ID NO: 5942236 - DNA, 20 bp, Homo sapiens
tcagtccttattatcccagc

SEQ ID NO: 5942237 - DNA, 13 bp, Homo sapiens
tcagtcctttgtc

SEQ ID NO: 5942238 - DNA, 19 bp, Homo sapiens
tcagtcctttgtctttctt

SEQ ID NO: 5942239 - DNA, 18 bp, Homo sapiens
tcagtcgatattcccagg

SEQ ID NO: 5942240 - DNA, 19 bp, Homo sapiens
tcagtcgatattcccaggg

SEQ ID NO: 5942241 - DNA, 19 bp, Homo sapiens
tcagtcggggcaggccagg

SEQ ID NO: 5942242 - DNA, 17 bp, Homo sapiens
tcagtcgttttagtgtc

SEQ ID NO: 5942243 - DNA, 20 bp, Homo sapiens
tcagtcgttttagtgtctga

SEQ ID NO: 5942244 - DNA, 19 bp, Homo sapiens
tcagtctaacagtttgcct

SEQ ID NO: 5942245 - DNA, 14 bp, Homo sapiens
tcagtctaaggtct

SEQ ID NO: 5942246 - DNA, 15 bp, Homo sapiens
tcagtctatccacag

SEQ ID NO: 5942247 - DNA, 19 bp, Homo sapiens
tcagtctcacagagaagct

SEQ ID NO: 5942248 - DNA, 22 bp, Homo sapiens
tcagtctcacagagaagctcct

SEQ ID NO: 5942249 - DNA, 15 bp, Homo sapiens
tcagtctcacctgcc

SEQ ID NO: 5942250 - DNA, 20 bp, Homo sapiens
tcagtctcacctgccggctc

SEQ ID NO: 5942251 - DNA, 17 bp, Homo sapiens
tcagtctcagctgctga

SEQ ID NO: 5942252 - DNA, 23 bp, Homo sapiens
tcagtctcccttctcccatgagg

SEQ ID NO: 5942253 - DNA, 20 bp, Homo sapiens
tcagtctccctttcccttct

SEQ ID NO: 5942254 - DNA, 22 bp, Homo sapiens
tcagtctctataccaataaagt

SEQ ID NO: 5942255 - DNA, 17 bp, Homo sapiens
tcagtctctgagcagtg

SEQ ID NO: 5942256 - DNA, 13 bp, Homo sapiens
tcagtctgctcca

SEQ ID NO: 5942257 - DNA, 22 bp, Homo sapiens
tcagtctgctctcccttgtgga

SEQ ID NO: 5942258 - DNA, 16 bp, Homo sapiens
tcagtctgcttagaaa

SEQ ID NO: 5942259 - DNA, 17 bp, Homo sapiens
tcagtctgctttctcta

SEQ ID NO: 5942260 - DNA, 17 bp, Homo sapiens
tcagtctggtgggagga

SEQ ID NO: 5942261 - DNA, 12 bp, Homo sapiens
tcagtctgtcca

SEQ ID NO: 5942262 - DNA, 23 bp, Homo sapiens
tcagtctgtgggagctcagctcg

SEQ ID NO: 5942263 - DNA, 12 bp, Homo sapiens
tcagtctgttca

SEQ ID NO: 5942264 - DNA, 18 bp, Homo sapiens
tcagtcttaatactttat

SEQ ID NO: 5942265 - DNA, 14 bp, Homo sapiens
tcagtcttcatacc

SEQ ID NO: 5942266 - DNA, 13 bp, Homo sapiens
tcagtcttgcctt

SEQ ID NO: 5942267 - DNA, 16 bp, Homo sapiens
tcagtctttgctcagt

SEQ ID NO: 5942268 - DNA, 15 bp, Homo sapiens
tcagtctttggggga

SEQ ID NO: 5942269 - DNA, 21 bp, Homo sapiens
tcagtctttgggggattcaaa

SEQ ID NO: 5942270 - DNA, 18 bp, Homo sapiens
tcagtcttttctctgaaa

SEQ ID NO: 5942271 - DNA, 12 bp, Homo sapiens
tcagtctttttc

SEQ ID NO: 5942272 - DNA, 15 bp, Homo sapiens
tcagtctttttctgt

SEQ ID NO: 5942273 - DNA, 14 bp, Homo sapiens
tcagtgaaatcata

SEQ ID NO: 5942274 - DNA, 13 bp, Homo sapiens
tcagtgaactgtt

SEQ ID NO: 5942275 - DNA, 21 bp, Homo sapiens
tcataaagcattggagtttca

SEQ ID NO: 5942276 - DNA, 18 bp, Homo sapiens
tcataaaggagcatataa

SEQ ID NO: 5942277 - DNA, 23 bp, Homo sapiens
tcataaaggatatttcaaatgat

SEQ ID NO: 5942278 - DNA, 17 bp, Homo sapiens
tcataaagggttgaaaa

SEQ ID NO: 5942279 - DNA, 23 bp, Homo sapiens
tcataaagttagaatctattttc

SEQ ID NO: 5942280 - DNA, 18 bp, Homo sapiens
tcataaataaagtttgtt

SEQ ID NO: 5942281 - DNA, 22 bp, Homo sapiens
tcataaatactgtcaaacaata

SEQ ID NO: 5942282 - DNA, 23 bp, Homo sapiens
tcataaatactgtcaaacaataa

SEQ ID NO: 5942283 - DNA, 16 bp, Homo sapiens
tcataaatagtaaata

SEQ ID NO: 5942284 - DNA, 14 bp, Homo sapiens
tcataaatgaattt

SEQ ID NO: 5942285 - DNA, 18 bp, Homo sapiens
tcataaattaatgattct

SEQ ID NO: 5942286 - DNA, 15 bp, Homo sapiens
tcataaattactgtt

SEQ ID NO: 5942287 - DNA, 13 bp, Homo sapiens
tcataaattcaaa

SEQ ID NO: 5942288 - DNA, 12 bp, Homo sapiens
tcataacaatgt

SEQ ID NO: 5942289 - DNA, 14 bp, Homo sapiens
tcataacaatgtct

SEQ ID NO: 5942290 - DNA, 15 bp, Homo sapiens
tcataacatctttga

SEQ ID NO: 5942291 - DNA, 21 bp, Homo sapiens
tcataacatctttgaaaagaa

SEQ ID NO: 5942292 - DNA, 16 bp, Homo sapiens
tcataacatttaaaga

SEQ ID NO: 5942293 - DNA, 11 bp, Homo sapiens
tcataaccaac

SEQ ID NO: 5942294 - DNA, 14 bp, Homo sapiens
tcataacctagcct

SEQ ID NO: 5942295 - DNA, 23 bp, Homo sapiens
tcataacggatcagaaatacaga

SEQ ID NO: 5942296 - DNA, 19 bp, Homo sapiens
tcataacggttaagaaagc

SEQ ID NO: 5942297 - DNA, 20 bp, Homo sapiens
tcataacggttaagaaagca

SEQ ID NO: 5942298 - DNA, 13 bp, Homo sapiens
tcataactagaac

SEQ ID NO: 5942299 - DNA, 20 bp, Homo sapiens
tcataactagagtatgtgta

SEQ ID NO: 5942300 - DNA, 16 bp, Homo sapiens
tcataacttaataaat

SEQ ID NO: 5942301 - DNA, 11 bp, Homo sapiens
tcataacttat

SEQ ID NO: 5942302 - DNA, 17 bp, Homo sapiens
tcataacttcctgtact

SEQ ID NO: 5942303 - DNA, 15 bp, Homo sapiens
tcataagaatttttc

SEQ ID NO: 5942304 - DNA, 22 bp, Homo sapiens
tcataagaatttttcagcactt

SEQ ID NO: 5942305 - DNA, 18 bp, Homo sapiens
tcataagaggttctaact

SEQ ID NO: 5942306 - DNA, 20 bp, Homo sapiens
tcataagaggttctaacttc

SEQ ID NO: 5942307 - DNA, 19 bp, Homo sapiens
tcataagatagttacattt

SEQ ID NO: 5942308 - DNA, 15 bp, Homo sapiens
tcataagatattctt

SEQ ID NO: 5942309 - DNA, 19 bp, Homo sapiens
tcataagatattctttaca

SEQ ID NO: 5942310 - DNA, 18 bp, Homo sapiens
tcataagcattactttat

SEQ ID NO: 5942311 - DNA, 21 bp, Homo sapiens
tcataagccaatttttctgca

SEQ ID NO: 5942312 - DNA, 14 bp, Homo sapiens
tcataagctttgta

SEQ ID NO: 5942313 - DNA, 21 bp, Homo sapiens
tcataaggagacttctgtctt

SEQ ID NO: 5942314 - DNA, 17 bp, Homo sapiens
tcataaggagttggtgt

SEQ ID NO: 5942315 - DNA, 23 bp, Homo sapiens
tcataaggcatatacaaataaac

SEQ ID NO: 5942316 - DNA, 20 bp, Homo sapiens
tcataaggcttcaaaatgtt

SEQ ID NO: 5942317 - DNA, 15 bp, Homo sapiens
tcataagtatttcaa

SEQ ID NO: 5942318 - DNA, 15 bp, Homo sapiens
tcataagtggggaga

SEQ ID NO: 5942319 - DNA, 18 bp, Homo sapiens
tcataataaactacacaa

SEQ ID NO: 5942320 - DNA, 20 bp, Homo sapiens
tcataataaagttgttttat

SEQ ID NO: 5942321 - DNA, 13 bp, Homo sapiens
tcataataaattt

SEQ ID NO: 5942322 - DNA, 14 bp, Homo sapiens
tcataataaatttt

SEQ ID NO: 5942323 - DNA, 16 bp, Homo sapiens
tcataatatattgtgt

SEQ ID NO: 5942324 - DNA, 13 bp, Homo sapiens
tcataatccttct

SEQ ID NO: 5942325 - DNA, 18 bp, Homo sapiens
tcataatctctttccatc

SEQ ID NO: 5942326 - DNA, 14 bp, Homo sapiens
tcataatctttgct

SEQ ID NO: 5942327 - DNA, 18 bp, Homo sapiens
tcataatgaattataaca

SEQ ID NO: 5942328 - DNA, 19 bp, Homo sapiens
tcataatgaattataacag

SEQ ID NO: 5942329 - DNA, 13 bp, Homo sapiens
tcataatgactta

SEQ ID NO: 5942330 - DNA, 17 bp, Homo sapiens
tcataatgcagaagtat

SEQ ID NO: 5942331 - DNA, 13 bp, Homo sapiens
tcataatgtgaag

SEQ ID NO: 5942332 - DNA, 17 bp, Homo sapiens
tcataatgtgaagtgtt

SEQ ID NO: 5942333 - DNA, 14 bp, Homo sapiens
tcataatgtgagat

SEQ ID NO: 5942334 - DNA, 21 bp, Homo sapiens
tcataattaaaatttatctta

SEQ ID NO: 5942335 - DNA, 13 bp, Homo sapiens
tcataattacatt

SEQ ID NO: 5942336 - DNA, 12 bp, Homo sapiens
tcataattacca

SEQ ID NO: 5942337 - DNA, 15 bp, Homo sapiens
tcataattagaacaa

SEQ ID NO: 5942338 - DNA, 18 bp, Homo sapiens
tcataattagaacaatag

SEQ ID NO: 5942339 - DNA, 19 bp, Homo sapiens
tcataattagaacaatagc

SEQ ID NO: 5942340 - DNA, 15 bp, Homo sapiens
tcataattattattt

SEQ ID NO: 5942341 - DNA, 12 bp, Homo sapiens
tcataattcacc

SEQ ID NO: 5942342 - DNA, 13 bp, Homo sapiens
tcataattcacca

SEQ ID NO: 5942343 - DNA, 15 bp, Homo sapiens
tcataattcaccaaa

SEQ ID NO: 5942344 - DNA, 12 bp, Homo sapiens
tcataattcaga

SEQ ID NO: 5942345 - DNA, 15 bp, Homo sapiens
tcataattcatttaa

SEQ ID NO: 5942346 - DNA, 23 bp, Homo sapiens
tcataattcatttaagaacaaga

SEQ ID NO: 5942347 - DNA, 20 bp, Homo sapiens
tcataattcctacagcacta

SEQ ID NO: 5942348 - DNA, 12 bp, Homo sapiens
tcataattctaa

SEQ ID NO: 5942349 - DNA, 14 bp, Homo sapiens
tcataattctgaaa

SEQ ID NO: 5942350 - DNA, 15 bp, Homo sapiens
tcataattctgaaac

SEQ ID NO: 5942351 - DNA, 19 bp, Homo sapiens
tcataattgcctacattta

SEQ ID NO: 5942352 - DNA, 13 bp, Homo sapiens
tcataattgtcaa

SEQ ID NO: 5942353 - DNA, 22 bp, Homo sapiens
tcataattgttgtggtttaaat

SEQ ID NO: 5942354 - DNA, 23 bp, Homo sapiens
tcataatttaaaaatctccatta

SEQ ID NO: 5942355 - DNA, 15 bp, Homo sapiens
tcataatttatacag

SEQ ID NO: 5942356 - DNA, 12 bp, Homo sapiens
tcataattttca

SEQ ID NO: 5942357 - DNA, 19 bp, Homo sapiens
tcataatttttgcagaaaa

SEQ ID NO: 5942358 - DNA, 13 bp, Homo sapiens
tcatacaaaactg

SEQ ID NO: 5942359 - DNA, 18 bp, Homo sapiens
tcatacaaactctcacca

SEQ ID NO: 5942360 - DNA, 14 bp, Homo sapiens
tcatacaacaaaga

SEQ ID NO: 5942361 - DNA, 17 bp, Homo sapiens
tcatacaacaaagagga

SEQ ID NO: 5942362 - DNA, 14 bp, Homo sapiens
tcatacacagaaat

SEQ ID NO: 5942363 - DNA, 14 bp, Homo sapiens
tcatacacttcctt

SEQ ID NO: 5942364 - DNA, 13 bp, Homo sapiens
tcatacagaaggc

SEQ ID NO: 5942365 - DNA, 12 bp, Homo sapiens
tcatacagagaa

SEQ ID NO: 5942366 - DNA, 15 bp, Homo sapiens
tcatacagagaagtc

SEQ ID NO: 5942367 - DNA, 19 bp, Homo sapiens
tcatacagcactacttact

SEQ ID NO: 5942368 - DNA, 12 bp, Homo sapiens
tcatacagtttt

SEQ ID NO: 5942369 - DNA, 14 bp, Homo sapiens
tcatacagttttat

SEQ ID NO: 5942370 - DNA, 12 bp, Homo sapiens
tcatacatatat

SEQ ID NO: 5942371 - DNA, 13 bp, Homo sapiens
tcatacattgtac

SEQ ID NO: 5942372 - DNA, 15 bp, Homo sapiens
tcatacattgtacga

SEQ ID NO: 5942373 - DNA, 15 bp, Homo sapiens
tcataccaatgaaaa

SEQ ID NO: 5942374 - DNA, 14 bp, Homo sapiens
tcataccagtcagt

SEQ ID NO: 5942375 - DNA, 14 bp, Homo sapiens
tcataccatctgct

SEQ ID NO: 5942376 - DNA, 15 bp, Homo sapiens
tcatacccaccccca

SEQ ID NO: 5942377 - DNA, 18 bp, Homo sapiens
tcatacccatgcacagta

SEQ ID NO: 5942378 - DNA, 19 bp, Homo sapiens
tcatacccatgcacagtac

SEQ ID NO: 5942379 - DNA, 20 bp, Homo sapiens
tcataccctctacctggatg

SEQ ID NO: 5942380 - DNA, 20 bp, Homo sapiens
tcataccgcctcgtgccagc

SEQ ID NO: 5942381 - DNA, 15 bp, Homo sapiens
tcatacctaagtact

SEQ ID NO: 5942382 - DNA, 17 bp, Homo sapiens
tcatacctaagtactgt

SEQ ID NO: 5942383 - DNA, 18 bp, Homo sapiens
tcatacctaagtactgta

SEQ ID NO: 5942384 - DNA, 20 bp, Homo sapiens
tcatacctaagtactgtaat

SEQ ID NO: 5942385 - DNA, 16 bp, Homo sapiens
tcatacctacatgtat

SEQ ID NO: 5942386 - DNA, 15 bp, Homo sapiens
tcatacctgctcctc

SEQ ID NO: 5942387 - DNA, 19 bp, Homo sapiens
tcatacctgttgtacactt

SEQ ID NO: 5942388 - DNA, 19 bp, Homo sapiens
tcatacgcatcccatctct

SEQ ID NO: 5942389 - DNA, 23 bp, Homo sapiens
tcatacgcatcccatctctccca

SEQ ID NO: 5942390 - DNA, 15 bp, Homo sapiens
tcatacgtccaccat

SEQ ID NO: 5942391 - DNA, 20 bp, Homo sapiens
tcatacgtctttagatgcta

SEQ ID NO: 5942392 - DNA, 23 bp, Homo sapiens
tcatacgtgtgtgtgtgtgtatg

SEQ ID NO: 5942393 - DNA, 19 bp, Homo sapiens
tcatacgttgatagtttac

SEQ ID NO: 5942394 - DNA, 12 bp, Homo sapiens
tcatactacatt

SEQ ID NO: 5942395 - DNA, 21 bp, Homo sapiens
tcatactacattgagtagaca

SEQ ID NO: 5942396 - DNA, 21 bp, Homo sapiens
tcatactactgaaacagattt

SEQ ID NO: 5942397 - DNA, 20 bp, Homo sapiens
tcatactatctactctcctc

SEQ ID NO: 5942398 - DNA, 14 bp, Homo sapiens
tcatactatttaag

SEQ ID NO: 5942399 - DNA, 14 bp, Homo sapiens
tcatactctagatt

SEQ ID NO: 5942400 - DNA, 23 bp, Homo sapiens
tcatactctagattttgttttgc

SEQ ID NO: 5942401 - DNA, 16 bp, Homo sapiens
tcatactctgttgcct

SEQ ID NO: 5942402 - DNA, 18 bp, Homo sapiens
tcatactctgttgcctcc

SEQ ID NO: 5942403 - DNA, 21 bp, Homo sapiens
tcatactctgttgcctcctct

SEQ ID NO: 5942404 - DNA, 21 bp, Homo sapiens
tcatactcttaagtgtaaata

SEQ ID NO: 5942405 - DNA, 23 bp, Homo sapiens
tcatactgaaaaaaaaagcttgt

SEQ ID NO: 5942406 - DNA, 16 bp, Homo sapiens
tcatactgaaattatt

SEQ ID NO: 5942407 - DNA, 14 bp, Homo sapiens
tcatactgattttt

SEQ ID NO: 5942408 - DNA, 21 bp, Homo sapiens
tcatactgatttttaagtcaa

SEQ ID NO: 5942409 - DNA, 14 bp, Homo sapiens
tcatactgcctact

SEQ ID NO: 5942410 - DNA, 12 bp, Homo sapiens
tcatactgtaca

SEQ ID NO: 5942411 - DNA, 14 bp, Homo sapiens
tcatactgtacaca

SEQ ID NO: 5942412 - DNA, 15 bp, Homo sapiens
tcatactgtacacat

SEQ ID NO: 5942413 - DNA, 21 bp, Homo sapiens
tcatactgtacacatttctta

SEQ ID NO: 5942414 - DNA, 22 bp, Homo sapiens
tcatactgtacacatttcttaa

SEQ ID NO: 5942415 - DNA, 18 bp, Homo sapiens
tcatactgtcatataatg

SEQ ID NO: 5942416 - DNA, 20 bp, Homo sapiens
tcatactgtcatataatgca

SEQ ID NO: 5942417 - DNA, 18 bp, Homo sapiens
tcatactgtctgggatta

SEQ ID NO: 5942418 - DNA, 18 bp, Homo sapiens
tcatactgtgcaggcctg

SEQ ID NO: 5942419 - DNA, 19 bp, Homo sapiens
tcatactgtgctggagcca

SEQ ID NO: 5942420 - DNA, 20 bp, Homo sapiens
tcatactgttttgaataaat

SEQ ID NO: 5942421 - DNA, 22 bp, Homo sapiens
tcatactgttttgaataaattt

SEQ ID NO: 5942422 - DNA, 19 bp, Homo sapiens
tcatacttaaaaatttatt

SEQ ID NO: 5942423 - DNA, 22 bp, Homo sapiens
tcatacttctaaatcagaaata

SEQ ID NO: 5942424 - DNA, 23 bp, Homo sapiens
tcatacttctaaatcagaaatag

SEQ ID NO: 5942425 - DNA, 12 bp, Homo sapiens
tcatacttgaac

SEQ ID NO: 5942426 - DNA, 12 bp, Homo sapiens
tcatactttgcc

SEQ ID NO: 5942427 - DNA, 12 bp, Homo sapiens
tcatacttttct

SEQ ID NO: 5942428 - DNA, 19 bp, Homo sapiens
tcatacttttcttactata

SEQ ID NO: 5942429 - DNA, 17 bp, Homo sapiens
tcatagaaaattgaaac

SEQ ID NO: 5942430 - DNA, 20 bp, Homo sapiens
tcatagaaacttcatggttt

SEQ ID NO: 5942431 - DNA, 15 bp, Homo sapiens
tcatagaaatacatc

SEQ ID NO: 5942432 - DNA, 14 bp, Homo sapiens
tcatagaacattga

SEQ ID NO: 5942433 - DNA, 19 bp, Homo sapiens
tcatagaacattgatctgt

SEQ ID NO: 5942434 - DNA, 12 bp, Homo sapiens
tcatagaagaac

SEQ ID NO: 5942435 - DNA, 16 bp, Homo sapiens
tcatagaatagcatgt

SEQ ID NO: 5942436 - DNA, 21 bp, Homo sapiens
tcatagaatagcatgttgtag

SEQ ID NO: 5942437 - DNA, 14 bp, Homo sapiens
tcatagacccatct

SEQ ID NO: 5942438 - DNA, 14 bp, Homo sapiens
tcatagataccatt

SEQ ID NO: 5942439 - DNA, 16 bp, Homo sapiens
tcatagatattggaag

SEQ ID NO: 5942440 - DNA, 14 bp, Homo sapiens
tcatagatgaactt

SEQ ID NO: 5942441 - DNA, 15 bp, Homo sapiens
tcatagatgtttcct

SEQ ID NO: 5942442 - DNA, 16 bp, Homo sapiens
tcatagattattataa

SEQ ID NO: 5942443 - DNA, 23 bp, Homo sapiens
tcatagattattataaactataa

SEQ ID NO: 5942444 - DNA, 14 bp, Homo sapiens
tcatagattcttga

SEQ ID NO: 5942445 - DNA, 16 bp, Homo sapiens
tcatagatttctgatt

SEQ ID NO: 5942446 - DNA, 16 bp, Homo sapiens
tcatagcacatgtttt

SEQ ID NO: 5942447 - DNA, 21 bp, Homo sapiens
tcatagcacatgttttacaaa

SEQ ID NO: 5942448 - DNA, 18 bp, Homo sapiens
tcatagcagattttaatt

SEQ ID NO: 5942449 - DNA, 11 bp, Homo sapiens
tcatagcagct

SEQ ID NO: 5942450 - DNA, 12 bp, Homo sapiens
tcatagcagctt

SEQ ID NO: 5942451 - DNA, 14 bp, Homo sapiens
tcatagcatgatat

SEQ ID NO: 5942452 - DNA, 19 bp, Homo sapiens
tcatagcattaactaatct

SEQ ID NO: 5942453 - DNA, 16 bp, Homo sapiens
tcatagccaaacagga

SEQ ID NO: 5942454 - DNA, 17 bp, Homo sapiens
tcatagccataaatgat

SEQ ID NO: 5942455 - DNA, 19 bp, Homo sapiens
tcatcaatgtgacatttac

SEQ ID NO: 5942456 - DNA, 20 bp, Homo sapiens
tcatcaatttgtaattttag

SEQ ID NO: 5942457 - DNA, 13 bp, Homo sapiens
tcatcaattttta

SEQ ID NO: 5942458 - DNA, 15 bp, Homo sapiens
tcatcaatttttata

SEQ ID NO: 5942459 - DNA, 18 bp, Homo sapiens
tcatcaatttttatacat

SEQ ID NO: 5942460 - DNA, 21 bp, Homo sapiens
tcatcaatttttatacatatc

SEQ ID NO: 5942461 - DNA, 15 bp, Homo sapiens
tcatcacaaatggct

SEQ ID NO: 5942462 - DNA, 14 bp, Homo sapiens
tcatcacacacatg

SEQ ID NO: 5942463 - DNA, 16 bp, Homo sapiens
tcatcacacacatgga

SEQ ID NO: 5942464 - DNA, 19 bp, Homo sapiens
tcatcacagcatgtgcaat

SEQ ID NO: 5942465 - DNA, 17 bp, Homo sapiens
tcatcacataaagaaat

SEQ ID NO: 5942466 - DNA, 17 bp, Homo sapiens
tcatcaccacccttcca

SEQ ID NO: 5942467 - DNA, 12 bp, Homo sapiens
tcatcaccactg

SEQ ID NO: 5942468 - DNA, 15 bp, Homo sapiens
tcatcacccagtcct

SEQ ID NO: 5942469 - DNA, 16 bp, Homo sapiens
tcatcaccccagaggc

SEQ ID NO: 5942470 - DNA, 19 bp, Homo sapiens
tcatcaccgattcttcctt

SEQ ID NO: 5942471 - DNA, 20 bp, Homo sapiens
tcatcaccgattcttccttg

SEQ ID NO: 5942472 - DNA, 23 bp, Homo sapiens
tcatcaccgattcttccttgcca

SEQ ID NO: 5942473 - DNA, 20 bp, Homo sapiens
tcatcactgaaatccctcta

SEQ ID NO: 5942474 - DNA, 12 bp, Homo sapiens
tcatcactggac

SEQ ID NO: 5942475 - DNA, 13 bp, Homo sapiens
tcatcactgtaaa

SEQ ID NO: 5942476 - DNA, 19 bp, Homo sapiens
tcatcactgtaaagacaaa

SEQ ID NO: 5942477 - DNA, 17 bp, Homo sapiens
tcatcactgtggctgtc

SEQ ID NO: 5942478 - DNA, 21 bp, Homo sapiens
tcatcactttgacctaaatta

SEQ ID NO: 5942479 - DNA, 16 bp, Homo sapiens
tcatcagaaaggaaaa

SEQ ID NO: 5942480 - DNA, 19 bp, Homo sapiens
tcatcagaaaggaaaaaca

SEQ ID NO: 5942481 - DNA, 21 bp, Homo sapiens
tcatcagaacagctgttgact

SEQ ID NO: 5942482 - DNA, 22 bp, Homo sapiens
tcatcagactagtatcaagtgt

SEQ ID NO: 5942483 - DNA, 15 bp, Homo sapiens
tcatcagagcagcta

SEQ ID NO: 5942484 - DNA, 15 bp, Homo sapiens
tcatcagagcctttc

SEQ ID NO: 5942485 - DNA, 17 bp, Homo sapiens
tcatcagagctcctctg

SEQ ID NO: 5942486 - DNA, 13 bp, Homo sapiens
tcatcagatgcct

SEQ ID NO: 5942487 - DNA, 20 bp, Homo sapiens
tcatcagatgcctgcttgat

SEQ ID NO: 5942488 - DNA, 13 bp, Homo sapiens
tcatcagcaggag

SEQ ID NO: 5942489 - DNA, 12 bp, Homo sapiens
tcatcagcattt

SEQ ID NO: 5942490 - DNA, 21 bp, Homo sapiens
tcatcagcatttaataaatgt

SEQ ID NO: 5942491 - DNA, 16 bp, Homo sapiens
tcatcagccaccatcc

SEQ ID NO: 5942492 - DNA, 13 bp, Homo sapiens
tcatcagcccagg

SEQ ID NO: 5942493 - DNA, 13 bp, Homo sapiens
tcatcagcctttt

SEQ ID NO: 5942494 - DNA, 15 bp, Homo sapiens
tcatcaggaagcctg

SEQ ID NO: 5942495 - DNA, 19 bp, Homo sapiens
tcatcaggaccctggacct

SEQ ID NO: 5942496 - DNA, 22 bp, Homo sapiens
tcatcaggatgaacccaggacg

SEQ ID NO: 5942497 - DNA, 22 bp, Homo sapiens
tcatcaggccgggtgcagtggc

SEQ ID NO: 5942498 - DNA, 12 bp, Homo sapiens
tcatcaggctct

SEQ ID NO: 5942499 - DNA, 16 bp, Homo sapiens
tcatcaggctctgttc

SEQ ID NO: 5942500 - DNA, 15 bp, Homo sapiens
tcatcaggcttggaa

SEQ ID NO: 5942501 - DNA, 13 bp, Homo sapiens
tcatcagggaggg

SEQ ID NO: 5942502 - DNA, 13 bp, Homo sapiens
tcatcagggcctg

SEQ ID NO: 5942503 - DNA, 16 bp, Homo sapiens
tcatcagggcctgggg

SEQ ID NO: 5942504 - DNA, 21 bp, Homo sapiens
tcatcagggcctggggcctga

SEQ ID NO: 5942505 - DNA, 23 bp, Homo sapiens
tcatcagggcctggggcctgaga

SEQ ID NO: 5942506 - DNA, 20 bp, Homo sapiens
tcatcagtaagtataacaaa

SEQ ID NO: 5942507 - DNA, 14 bp, Homo sapiens
tcatcagtattgaa

SEQ ID NO: 5942508 - DNA, 20 bp, Homo sapiens
tcatcagtattgaagcattt

SEQ ID NO: 5942509 - DNA, 15 bp, Homo sapiens
tcatcagtattgtgt

SEQ ID NO: 5942510 - DNA, 19 bp, Homo sapiens
tcatcagtattgtgtaaag

SEQ ID NO: 5942511 - DNA, 19 bp, Homo sapiens
tcatcagtgcctctttgaa

SEQ ID NO: 5942512 - DNA, 12 bp, Homo sapiens
tcatcagtgtta

SEQ ID NO: 5942513 - DNA, 14 bp, Homo sapiens
tcatcataaaaggt

SEQ ID NO: 5942514 - DNA, 13 bp, Homo sapiens
tcatcataaaata

SEQ ID NO: 5942515 - DNA, 15 bp, Homo sapiens
tcatcatacatgact

SEQ ID NO: 5942516 - DNA, 23 bp, Homo sapiens
tcatcatagaaggagagcccagg

SEQ ID NO: 5942517 - DNA, 13 bp, Homo sapiens
tcatcatattcca

SEQ ID NO: 5942518 - DNA, 23 bp, Homo sapiens
tcatcatcagacttgcggccaca

SEQ ID NO: 5942519 - DNA, 14 bp, Homo sapiens
tcatcatcagagcc

SEQ ID NO: 5942520 - DNA, 14 bp, Homo sapiens
tcatcatcagggcc

SEQ ID NO: 5942521 - DNA, 16 bp, Homo sapiens
tcatcatcagggcctg

SEQ ID NO: 5942522 - DNA, 17 bp, Homo sapiens
tcatcatcatggccagc

SEQ ID NO: 5942523 - DNA, 16 bp, Homo sapiens
tcatcatccacccgct

SEQ ID NO: 5942524 - DNA, 17 bp, Homo sapiens
tcatcatccagatgtgg

SEQ ID NO: 5942525 - DNA, 18 bp, Homo sapiens
tcatcatccctccctgcc

SEQ ID NO: 5942526 - DNA, 23 bp, Homo sapiens
tcatcatcgtcatcatcataggt

SEQ ID NO: 5942527 - DNA, 17 bp, Homo sapiens
tcatcatctcttgataa

SEQ ID NO: 5942528 - DNA, 21 bp, Homo sapiens
tcatcatctcttgataaagga

SEQ ID NO: 5942529 - DNA, 12 bp, Homo sapiens
tcatcatcttgt

SEQ ID NO: 5942530 - DNA, 17 bp, Homo sapiens
tcatcatctttttgtgt

SEQ ID NO: 5942531 - DNA, 13 bp, Homo sapiens
tcatcatgcagct

SEQ ID NO: 5942532 - DNA, 20 bp, Homo sapiens
tcatcatggaggtcatacat

SEQ ID NO: 5942533 - DNA, 15 bp, Homo sapiens
tcatcatgtagaata

SEQ ID NO: 5942534 - DNA, 16 bp, Homo sapiens
tcatcatgtctattgt

SEQ ID NO: 5942535 - DNA, 15 bp, Homo sapiens
tcatcatgttttgat

SEQ ID NO: 5942536 - DNA, 19 bp, Homo sapiens
tcatcattaataagtgaag

SEQ ID NO: 5942537 - DNA, 17 bp, Homo sapiens
tcatcattcacttcact

SEQ ID NO: 5942538 - DNA, 15 bp, Homo sapiens
tcatcattccctctc

SEQ ID NO: 5942539 - DNA, 13 bp, Homo sapiens
tcatcattctctg

SEQ ID NO: 5942540 - DNA, 22 bp, Homo sapiens
tcatcattctctgtctcatcca

SEQ ID NO: 5942541 - DNA, 17 bp, Homo sapiens
tcatcattcttgtggga

SEQ ID NO: 5942542 - DNA, 19 bp, Homo sapiens
tcatcattcttgtgggaga

SEQ ID NO: 5942543 - DNA, 23 bp, Homo sapiens
tcatcattcttgtgggagacagc

SEQ ID NO: 5942544 - DNA, 22 bp, Homo sapiens
tcatcattgggctcacttctaa

SEQ ID NO: 5942545 - DNA, 18 bp, Homo sapiens
tcatcattttctccacct

SEQ ID NO: 5942546 - DNA, 14 bp, Homo sapiens
tcatcatttttcct

SEQ ID NO: 5942547 - DNA, 22 bp, Homo sapiens
tcatccaaaagtgaccagcata

SEQ ID NO: 5942548 - DNA, 19 bp, Homo sapiens
tcatccaaaatattttttg

SEQ ID NO: 5942549 - DNA, 19 bp, Homo sapiens
tcatccaaacaatttaaaa

SEQ ID NO: 5942550 - DNA, 21 bp, Homo sapiens
tcatccaaactgtatcttcct

SEQ ID NO: 5942551 - DNA, 18 bp, Homo sapiens
tcatccaacaagaagaaa

SEQ ID NO: 5942552 - DNA, 19 bp, Homo sapiens
tcatccaactggaaggctt

SEQ ID NO: 5942553 - DNA, 23 bp, Homo sapiens
tcatccaaggaacctaattgaaa

SEQ ID NO: 5942554 - DNA, 19 bp, Homo sapiens
tcatccaagttaaatgtag

SEQ ID NO: 5942555 - DNA, 15 bp, Homo sapiens
tcatccaatcctcac

SEQ ID NO: 5942556 - DNA, 22 bp, Homo sapiens
tcatccaatctaaccacatcaa

SEQ ID NO: 5942557 - DNA, 18 bp, Homo sapiens
tcatccacagaggccagg

SEQ ID NO: 5942558 - DNA, 15 bp, Homo sapiens
tcatccacattgttt

SEQ ID NO: 5942559 - DNA, 13 bp, Homo sapiens
tcatccacccgct

SEQ ID NO: 5942560 - DNA, 22 bp, Homo sapiens
tcatccacccgctgcccctccc

SEQ ID NO: 5942561 - DNA, 20 bp, Homo sapiens
tcatccacctgtcttggcct

SEQ ID NO: 5942562 - DNA, 22 bp, Homo sapiens
tcatccactagtgcaaatcata

SEQ ID NO: 5942563 - DNA, 16 bp, Homo sapiens
tcatccagaactgtct

SEQ ID NO: 5942564 - DNA, 19 bp, Homo sapiens
tcatccagaactgtcttag

SEQ ID NO: 5942565 - DNA, 19 bp, Homo sapiens
tcatccagactcagagctc

SEQ ID NO: 5942566 - DNA, 21 bp, Homo sapiens
tcatccagactcctcatggat

SEQ ID NO: 5942567 - DNA, 20 bp, Homo sapiens
tcatccagatgtggctactg

SEQ ID NO: 5942568 - DNA, 16 bp, Homo sapiens
tcatccagcagtgttg

SEQ ID NO: 5942569 - DNA, 22 bp, Homo sapiens
tcatccagctacttagctggcc

SEQ ID NO: 5942570 - DNA, 20 bp, Homo sapiens
tcatccaggcccaactgtga

SEQ ID NO: 5942571 - DNA, 11 bp, Homo sapiens
tcatccaggga

SEQ ID NO: 5942572 - DNA, 19 bp, Homo sapiens
tcatccaggtcctttcctt

SEQ ID NO: 5942573 - DNA, 14 bp, Homo sapiens
tcatccagttgcaa

SEQ ID NO: 5942574 - DNA, 20 bp, Homo sapiens
tcatccagttgcaataaaat

SEQ ID NO: 5942575 - DNA, 21 bp, Homo sapiens
tcatccagtttgttctccggg

SEQ ID NO: 5942576 - DNA, 20 bp, Homo sapiens
tcatccataaagcaagctca

SEQ ID NO: 5942577 - DNA, 15 bp, Homo sapiens
tcatccataactgaa

SEQ ID NO: 5942578 - DNA, 16 bp, Homo sapiens
tcatccatagacacag

SEQ ID NO: 5942579 - DNA, 19 bp, Homo sapiens
tcatccatagacacagtat

SEQ ID NO: 5942580 - DNA, 12 bp, Homo sapiens
tcatccatcatc

SEQ ID NO: 5942581 - DNA, 16 bp, Homo sapiens
tcatccatcatcatgt

SEQ ID NO: 5942582 - DNA, 17 bp, Homo sapiens
tcatccatcatctgctg

SEQ ID NO: 5942583 - DNA, 22 bp, Homo sapiens
tcatccatcatctgctgcacat

SEQ ID NO: 5942584 - DNA, 15 bp, Homo sapiens
tcatccatcctgagc

SEQ ID NO: 5942585 - DNA, 15 bp, Homo sapiens
tcatccatgcacttt

SEQ ID NO: 5942586 - DNA, 18 bp, Homo sapiens
tcatccatgccctcccag

SEQ ID NO: 5942587 - DNA, 18 bp, Homo sapiens
tcatccattctctctgcc

SEQ ID NO: 5942588 - DNA, 20 bp, Homo sapiens
tcatccattctctctgccca

SEQ ID NO: 5942589 - DNA, 13 bp, Homo sapiens
tcatccatttctt

SEQ ID NO: 5942590 - DNA, 19 bp, Homo sapiens
tcatcccaacagcccagca

SEQ ID NO: 5942591 - DNA, 12 bp, Homo sapiens
tcatcccaacct

SEQ ID NO: 5942592 - DNA, 19 bp, Homo sapiens
tcatcccaatgggggaagt

SEQ ID NO: 5942593 - DNA, 18 bp, Homo sapiens
tcatcccacgcactccat

SEQ ID NO: 5942594 - DNA, 13 bp, Homo sapiens
tcatcccagcccc

SEQ ID NO: 5942595 - DNA, 14 bp, Homo sapiens
tcatcccagcccca

SEQ ID NO: 5942596 - DNA, 14 bp, Homo sapiens
tcatcccagctgct

SEQ ID NO: 5942597 - DNA, 17 bp, Homo sapiens
tcatcccagctgctgag

SEQ ID NO: 5942598 - DNA, 22 bp, Homo sapiens
tcatcccatctaagctgcagct

SEQ ID NO: 5942599 - DNA, 17 bp, Homo sapiens
tcatcccatgagaccct

SEQ ID NO: 5942600 - DNA, 14 bp, Homo sapiens
tcatcccatgtaca

SEQ ID NO: 5942601 - DNA, 20 bp, Homo sapiens
tcatcccattaatcatttcc

SEQ ID NO: 5942602 - DNA, 20 bp, Homo sapiens
tcatcccattccaggcagcc

SEQ ID NO: 5942603 - DNA, 18 bp, Homo sapiens
tcatcccattctgcgtca

SEQ ID NO: 5942604 - DNA, 21 bp, Homo sapiens
tcatccccacaatctggctta

SEQ ID NO: 5942605 - DNA, 20 bp, Homo sapiens
tcatccccacctgtcttcaa

SEQ ID NO: 5942606 - DNA, 14 bp, Homo sapiens
tcatccccaccttg

SEQ ID NO: 5942607 - DNA, 14 bp, Homo sapiens
tcatccccagtccc

SEQ ID NO: 5942608 - DNA, 15 bp, Homo sapiens
tcatccccagtccca

SEQ ID NO: 5942609 - DNA, 15 bp, Homo sapiens
tcatccccatcctcc

SEQ ID NO: 5942610 - DNA, 18 bp, Homo sapiens
tcatccccatcctccaga

SEQ ID NO: 5942611 - DNA, 13 bp, Homo sapiens
tcatccccccacc

SEQ ID NO: 5942612 - DNA, 16 bp, Homo sapiens
tcatccccccacccga

SEQ ID NO: 5942613 - DNA, 17 bp, Homo sapiens
tcatcccccctgctgcc

SEQ ID NO: 5942614 - DNA, 19 bp, Homo sapiens
tcatcccccctgctgccca

SEQ ID NO: 5942615 - DNA, 20 bp, Homo sapiens
tcatcccctcagaaggtctg

SEQ ID NO: 5942616 - DNA, 20 bp, Homo sapiens
tcatcccctcgtcctgtccc

SEQ ID NO: 5942617 - DNA, 14 bp, Homo sapiens
tcatcccctctcag

SEQ ID NO: 5942618 - DNA, 14 bp, Homo sapiens
tcatccccttgtgt

SEQ ID NO: 5942619 - DNA, 23 bp, Homo sapiens
tcatcccgagcacctccacatcc

SEQ ID NO: 5942620 - DNA, 14 bp, Homo sapiens
tcatcccgctcctg

SEQ ID NO: 5942621 - DNA, 17 bp, Homo sapiens
tcatcccgctcctgctg

SEQ ID NO: 5942622 - DNA, 20 bp, Homo sapiens
tcatcccggagcgcacctgc

SEQ ID NO: 5942623 - DNA, 21 bp, Homo sapiens
tcatcccggagcgcacctgct

SEQ ID NO: 5942624 - DNA, 18 bp, Homo sapiens
tcatcccggggccatgga

SEQ ID NO: 5942625 - DNA, 14 bp, Homo sapiens
tcatcccgtatcac

SEQ ID NO: 5942626 - DNA, 19 bp, Homo sapiens
tcatcccgtatcacagtgt

SEQ ID NO: 5942627 - DNA, 21 bp, Homo sapiens
tcatccctatgggattcagtg

SEQ ID NO: 5942628 - DNA, 22 bp, Homo sapiens
tcatccctatttatagttttta

SEQ ID NO: 5942629 - DNA, 23 bp, Homo sapiens
tcatccctgccaagaactctggg

SEQ ID NO: 5942630 - DNA, 21 bp, Homo sapiens
tcatcccttctcttccaggca

SEQ ID NO: 5942631 - DNA, 13 bp, Homo sapiens
tcatccctttcca

SEQ ID NO: 5942632 - DNA, 14 bp, Homo sapiens
tcatccctttccag

SEQ ID NO: 5942633 - DNA, 16 bp, Homo sapiens
tcatgccattttattt

SEQ ID NO: 5942634 - DNA, 20 bp, Homo sapiens
tcatgccattttatttcttt

SEQ ID NO: 5942635 - DNA, 18 bp, Homo sapiens
tcatgcccaccccctgcc

SEQ ID NO: 5942636 - DNA, 21 bp, Homo sapiens
tcatgcccaccccctgccctg

SEQ ID NO: 5942637 - DNA, 21 bp, Homo sapiens
tcatgcccactcccccaggag

SEQ ID NO: 5942638 - DNA, 15 bp, Homo sapiens
tcatgccccagtatt

SEQ ID NO: 5942639 - DNA, 13 bp, Homo sapiens
tcatgcccccctc

SEQ ID NO: 5942640 - DNA, 21 bp, Homo sapiens
tcatgccccctttcagatgtc

SEQ ID NO: 5942641 - DNA, 14 bp, Homo sapiens
tcatgccccggctg

SEQ ID NO: 5942642 - DNA, 13 bp, Homo sapiens
tcatgcccgccag

SEQ ID NO: 5942643 - DNA, 13 bp, Homo sapiens
tcatgccctcctc

SEQ ID NO: 5942644 - DNA, 15 bp, Homo sapiens
tcatgccctcctctc

SEQ ID NO: 5942645 - DNA, 21 bp, Homo sapiens
tcatgccctgccaagcagcag

SEQ ID NO: 5942646 - DNA, 15 bp, Homo sapiens
tcatgcccttctgat

SEQ ID NO: 5942647 - DNA, 21 bp, Homo sapiens
tcatgccgctgtgtctatgaa

SEQ ID NO: 5942648 - DNA, 12 bp, Homo sapiens
tcatgcctcagt

SEQ ID NO: 5942649 - DNA, 13 bp, Homo sapiens
tcatgcctcagtt

SEQ ID NO: 5942650 - DNA, 14 bp, Homo sapiens
tcatgcctctgagg

SEQ ID NO: 5942651 - DNA, 18 bp, Homo sapiens
tcatgcctgagaatgcct

SEQ ID NO: 5942652 - DNA, 23 bp, Homo sapiens
tcatgcctgagaatgcctaggcc

SEQ ID NO: 5942653 - DNA, 15 bp, Homo sapiens
tcatgcctgatgaaa

SEQ ID NO: 5942654 - DNA, 23 bp, Homo sapiens
tcatgcctgcctgataccctgct

SEQ ID NO: 5942655 - DNA, 15 bp, Homo sapiens
tcatgcctgctgaga

SEQ ID NO: 5942656 - DNA, 17 bp, Homo sapiens
tcatgcctgctgagaga

SEQ ID NO: 5942657 - DNA, 14 bp, Homo sapiens
tcatgcctggcccc

SEQ ID NO: 5942658 - DNA, 19 bp, Homo sapiens
tcatgcctggcccccctcc

SEQ ID NO: 5942659 - DNA, 18 bp, Homo sapiens
tcatgcctggcttcgcaa

SEQ ID NO: 5942660 - DNA, 12 bp, Homo sapiens
tcatgcctgggg

SEQ ID NO: 5942661 - DNA, 14 bp, Homo sapiens
tcatgcctgtaatc

SEQ ID NO: 5942662 - DNA, 15 bp, Homo sapiens
tcatgcctgtaatcc

SEQ ID NO: 5942663 - DNA, 21 bp, Homo sapiens
tcatgcctttcatagtttatt

SEQ ID NO: 5942664 - DNA, 17 bp, Homo sapiens
tcatgcctttgtaagtt

SEQ ID NO: 5942665 - DNA, 21 bp, Homo sapiens
tcatgcgaattcttgcttgag

SEQ ID NO: 5942666 - DNA, 22 bp, Homo sapiens
tcatgcgaattcttgcttgagg

SEQ ID NO: 5942667 - DNA, 17 bp, Homo sapiens
tcatgcgcagtccccag

SEQ ID NO: 5942668 - DNA, 18 bp, Homo sapiens
tcatgcgtgttttacctt

SEQ ID NO: 5942669 - DNA, 21 bp, Homo sapiens
tcatgcgttttatatcttcct

SEQ ID NO: 5942670 - DNA, 22 bp, Homo sapiens
tcatgctaattatataatattt

SEQ ID NO: 5942671 - DNA, 18 bp, Homo sapiens
tcatgctacccagccatt

SEQ ID NO: 5942672 - DNA, 22 bp, Homo sapiens
tcatgctatatatcttttgtaa

SEQ ID NO: 5942673 - DNA, 13 bp, Homo sapiens
tcatgctatttct

SEQ ID NO: 5942674 - DNA, 14 bp, Homo sapiens
tcatgctatttcta

SEQ ID NO: 5942675 - DNA, 20 bp, Homo sapiens
tcatgctcacttttgtgaaa

SEQ ID NO: 5942676 - DNA, 13 bp, Homo sapiens
tcatgctcagcct

SEQ ID NO: 5942677 - DNA, 20 bp, Homo sapiens
tcatgctcagccttgctgct

SEQ ID NO: 5942678 - DNA, 24 bp, Homo sapiens
tcatgctcccctgtgccagcccag

SEQ ID NO: 5942679 - DNA, 13 bp, Homo sapiens
tcatgctgaatcc

SEQ ID NO: 5942680 - DNA, 13 bp, Homo sapiens
tcatgctgccaat

SEQ ID NO: 5942681 - DNA, 20 bp, Homo sapiens
tcatgctgccaatatcctaa

SEQ ID NO: 5942682 - DNA, 23 bp, Homo sapiens
tcatgctgccaatatcctaataa

SEQ ID NO: 5942683 - DNA, 13 bp, Homo sapiens
tcatgctgcccct

SEQ ID NO: 5942684 - DNA, 17 bp, Homo sapiens
tcatgctgcctgccatg

SEQ ID NO: 5942685 - DNA, 22 bp, Homo sapiens
tcatgctgcctgccatgtgtga

SEQ ID NO: 5942686 - DNA, 14 bp, Homo sapiens
tcatgctgctcccc

SEQ ID NO: 5942687 - DNA, 20 bp, Homo sapiens
tcatgctggaacctgcaaaa

SEQ ID NO: 5942688 - DNA, 14 bp, Homo sapiens
tcatgctgggattt

SEQ ID NO: 5942689 - DNA, 17 bp, Homo sapiens
tcatgctgtgcattttt

SEQ ID NO: 5942690 - DNA, 23 bp, Homo sapiens
tcatgctgttgctgctactgtct

SEQ ID NO: 5942691 - DNA, 14 bp, Homo sapiens
tcatgcttaataaa

SEQ ID NO: 5942692 - DNA, 15 bp, Homo sapiens
tcatgcttactattt

SEQ ID NO: 5942693 - DNA, 13 bp, Homo sapiens
tcatgcttcagtt

SEQ ID NO: 5942694 - DNA, 17 bp, Homo sapiens
tcatgcttctactccat

SEQ ID NO: 5942695 - DNA, 19 bp, Homo sapiens
tcatgcttctactgtgaca

SEQ ID NO: 5942696 - DNA, 15 bp, Homo sapiens
tcatgcttcttctca

SEQ ID NO: 5942697 - DNA, 14 bp, Homo sapiens
tcatgcttgacata

SEQ ID NO: 5942698 - DNA, 20 bp, Homo sapiens
tcatgctttaaagtgtaata

SEQ ID NO: 5942699 - DNA, 15 bp, Homo sapiens
tcatgctttctcctt

SEQ ID NO: 5942700 - DNA, 14 bp, Homo sapiens
tcatgcttttctca

SEQ ID NO: 5942701 - DNA, 21 bp, Homo sapiens
tcatggaaagactgggacagc

SEQ ID NO: 5942702 - DNA, 19 bp, Homo sapiens
tcatggaacacaaacacat

SEQ ID NO: 5942703 - DNA, 20 bp, Homo sapiens
tcatggaagtggcagtgaaa

SEQ ID NO: 5942704 - DNA, 16 bp, Homo sapiens
tcatggaatcttgctg

SEQ ID NO: 5942705 - DNA, 20 bp, Homo sapiens
tcatggaatggacatcctgt

SEQ ID NO: 5942706 - DNA, 19 bp, Homo sapiens
tcatggaattggagctcgt

SEQ ID NO: 5942707 - DNA, 20 bp, Homo sapiens
tcatggaattggtttaaact

SEQ ID NO: 5942708 - DNA, 20 bp, Homo sapiens
tcatggacaaagttctgtat

SEQ ID NO: 5942709 - DNA, 14 bp, Homo sapiens
tcatggacactttg

SEQ ID NO: 5942710 - DNA, 13 bp, Homo sapiens
tcatggacagctg

SEQ ID NO: 5942711 - DNA, 14 bp, Homo sapiens
tcatggacagctga

SEQ ID NO: 5942712 - DNA, 16 bp, Homo sapiens
tcatggacagctgagc

SEQ ID NO: 5942713 - DNA, 21 bp, Homo sapiens
tcatggaccaagaatgagctg

SEQ ID NO: 5942714 - DNA, 16 bp, Homo sapiens
tcatggaccactgttt

SEQ ID NO: 5942715 - DNA, 18 bp, Homo sapiens
tcatggaccagtggctgg

SEQ ID NO: 5942716 - DNA, 16 bp, Homo sapiens
tcatggactgttgcca

SEQ ID NO: 5942717 - DNA, 11 bp, Homo sapiens
tcatggagaaa

SEQ ID NO: 5942718 - DNA, 17 bp, Homo sapiens
tcatggagaaccaccta

SEQ ID NO: 5942719 - DNA, 18 bp, Homo sapiens
tcatggagtagcctggac

SEQ ID NO: 5942720 - DNA, 20 bp, Homo sapiens
tcatggagtcatcttgcaca

SEQ ID NO: 5942721 - DNA, 14 bp, Homo sapiens
tcatggatcaacca

SEQ ID NO: 5942722 - DNA, 13 bp, Homo sapiens
tcatggattactt

SEQ ID NO: 5942723 - DNA, 19 bp, Homo sapiens
tcatggattgccacagctc

SEQ ID NO: 5942724 - DNA, 14 bp, Homo sapiens
tcatggatttggtt

SEQ ID NO: 5942725 - DNA, 22 bp, Homo sapiens
tcatggcagaaggcaaacccat

SEQ ID NO: 5942726 - DNA, 11 bp, Homo sapiens
tcatggcagct

SEQ ID NO: 5942727 - DNA, 14 bp, Homo sapiens
tcatggccacactg

SEQ ID NO: 5942728 - DNA, 17 bp, Homo sapiens
tcatggccacactgtga

SEQ ID NO: 5942729 - DNA, 19 bp, Homo sapiens
tcatggccacactgtgaca

SEQ ID NO: 5942730 - DNA, 16 bp, Homo sapiens
tcatggccagctggag

SEQ ID NO: 5942731 - DNA, 18 bp, Homo sapiens
tcatggcccaaatccagt

SEQ ID NO: 5942732 - DNA, 23 bp, Homo sapiens
tcatggccctgtagttaggcctg

SEQ ID NO: 5942733 - DNA, 19 bp, Homo sapiens
tcatggccttgaaacagtt

SEQ ID NO: 5942734 - DNA, 15 bp, Homo sapiens
tcatggccttgtcta

SEQ ID NO: 5942735 - DNA, 16 bp, Homo sapiens
tcatggcgggactgga

SEQ ID NO: 5942736 - DNA, 22 bp, Homo sapiens
tcatggcgtaatgggcctgccc

SEQ ID NO: 5942737 - DNA, 13 bp, Homo sapiens
tcatggctcaagg

SEQ ID NO: 5942738 - DNA, 18 bp, Homo sapiens
tcatggctcttagaaact

SEQ ID NO: 5942739 - DNA, 16 bp, Homo sapiens
tcatggctgctgttgc

SEQ ID NO: 5942740 - DNA, 19 bp, Homo sapiens
tcatggctgttatctgtct

SEQ ID NO: 5942741 - DNA, 18 bp, Homo sapiens
tcatggcttaatgtttat

SEQ ID NO: 5942742 - DNA, 14 bp, Homo sapiens
tcatggcttaggat

SEQ ID NO: 5942743 - DNA, 14 bp, Homo sapiens
tcatggctttttct

SEQ ID NO: 5942744 - DNA, 17 bp, Homo sapiens
tcatgggaacgcagcct

SEQ ID NO: 5942745 - DNA, 21 bp, Homo sapiens
tcatgggaacgcagcctccag

SEQ ID NO: 5942746 - DNA, 22 bp, Homo sapiens
tcatgggaacgcagcctccagt

SEQ ID NO: 5942747 - DNA, 20 bp, Homo sapiens
tcatgggagtaagttcttca

SEQ ID NO: 5942748 - DNA, 19 bp, Homo sapiens
tcatgggagtcagggagcc

SEQ ID NO: 5942749 - DNA, 18 bp, Homo sapiens
tcatgggcattgctggac

SEQ ID NO: 5942750 - DNA, 20 bp, Homo sapiens
tcatgggcattgctggactg

SEQ ID NO: 5942751 - DNA, 24 bp, Homo sapiens
tcatgggccacaaggcacagtctt

SEQ ID NO: 5942752 - DNA, 14 bp, Homo sapiens
tcatggggagtaat

SEQ ID NO: 5942753 - DNA, 20 bp, Homo sapiens
tcatggggggagcaccctga

SEQ ID NO: 5942754 - DNA, 22 bp, Homo sapiens
tcatggggggagcaccctgagg

SEQ ID NO: 5942755 - DNA, 16 bp, Homo sapiens
tcatggggtggggttg

SEQ ID NO: 5942756 - DNA, 22 bp, Homo sapiens
tcatggggtttttgccctggag

SEQ ID NO: 5942757 - DNA, 21 bp, Homo sapiens
tcatgggtcccttgaaggaag

SEQ ID NO: 5942758 - DNA, 22 bp, Homo sapiens
tcatgggtcccttgaaggaaga

SEQ ID NO: 5942759 - DNA, 13 bp, Homo sapiens
tcatgggttcctc

SEQ ID NO: 5942760 - DNA, 16 bp, Homo sapiens
tcatggtaatgacaga

SEQ ID NO: 5942761 - DNA, 20 bp, Homo sapiens
tcatggtaatgacagatgca

SEQ ID NO: 5942762 - DNA, 16 bp, Homo sapiens
tcatggtacttcctct

SEQ ID NO: 5942763 - DNA, 18 bp, Homo sapiens
tcatggtacttcctctgt

SEQ ID NO: 5942764 - DNA, 20 bp, Homo sapiens
tcatggtacttcctctgtga

SEQ ID NO: 5942765 - DNA, 22 bp, Homo sapiens
tcatggtagagaccgagcctct

SEQ ID NO: 5942766 - DNA, 14 bp, Homo sapiens
tcatggtagatttt

SEQ ID NO: 5942767 - DNA, 14 bp, Homo sapiens
tcatggtatttgac

SEQ ID NO: 5942768 - DNA, 18 bp, Homo sapiens
tcatggtccccatggcat

SEQ ID NO: 5942769 - DNA, 14 bp, Homo sapiens
tcatggtcctgaat

SEQ ID NO: 5942770 - DNA, 17 bp, Homo sapiens
tcatggtcctgaatgta

SEQ ID NO: 5942771 - DNA, 15 bp, Homo sapiens
tcatggtcctggctg

SEQ ID NO: 5942772 - DNA, 18 bp, Homo sapiens
tcatggtcctttctggaa

SEQ ID NO: 5942773 - DNA, 13 bp, Homo sapiens
tcatggtgaaatt

SEQ ID NO: 5942774 - DNA, 15 bp, Homo sapiens
tcatggtgaggctta

SEQ ID NO: 5942775 - DNA, 15 bp, Homo sapiens
tcatggtgatgcaag

SEQ ID NO: 5942776 - DNA, 20 bp, Homo sapiens
tcatggtgatgcaagtcact

SEQ ID NO: 5942777 - DNA, 14 bp, Homo sapiens
tcatggtgctcaga

SEQ ID NO: 5942778 - DNA, 18 bp, Homo sapiens
tcatggtggccacggcca

SEQ ID NO: 5942779 - DNA, 16 bp, Homo sapiens
tcatggtgtaataaga

SEQ ID NO: 5942780 - DNA, 16 bp, Homo sapiens
tcatggtgtgttacac

SEQ ID NO: 5942781 - DNA, 14 bp, Homo sapiens
tcatggttcaagta

SEQ ID NO: 5942782 - DNA, 15 bp, Homo sapiens
tcatggttcaagtat

SEQ ID NO: 5942783 - DNA, 19 bp, Homo sapiens
tcatggttttaaagctaaa

SEQ ID NO: 5942784 - DNA, 18 bp, Homo sapiens
tcatgtaaaacagaaaaa

SEQ ID NO: 5942785 - DNA, 13 bp, Homo sapiens
tcatgtaaaataa

SEQ ID NO: 5942786 - DNA, 14 bp, Homo sapiens
tcatgtaaacatac

SEQ ID NO: 5942787 - DNA, 19 bp, Homo sapiens
tcatgtaaacctaagcacg

SEQ ID NO: 5942788 - DNA, 13 bp, Homo sapiens
tcatgtaaactgt

SEQ ID NO: 5942789 - DNA, 18 bp, Homo sapiens
tcatgtaaatactgttgg

SEQ ID NO: 5942790 - DNA, 16 bp, Homo sapiens
tcatgtaaatgctcat

SEQ ID NO: 5942791 - DNA, 11 bp, Homo sapiens
tcatgtaacat

SEQ ID NO: 5942792 - DNA, 21 bp, Homo sapiens
tcatgtaacttttttatttta

SEQ ID NO: 5942793 - DNA, 16 bp, Homo sapiens
tcatgtaagatggcaa

SEQ ID NO: 5942794 - DNA, 18 bp, Homo sapiens
tcatgtaagctgaaaata

SEQ ID NO: 5942795 - DNA, 12 bp, Homo sapiens
tcatgtaagttt

SEQ ID NO: 5942796 - DNA, 21 bp, Homo sapiens
tcatgtaatagtggctttcat

SEQ ID NO: 5942797 - DNA, 12 bp, Homo sapiens
tcatgtaattat

SEQ ID NO: 5942798 - DNA, 17 bp, Homo sapiens
tcatgtacaagatgaag

SEQ ID NO: 5942799 - DNA, 16 bp, Homo sapiens
tcatgtacagcatgca

SEQ ID NO: 5942800 - DNA, 21 bp, Homo sapiens
tcatgtactacacttctgaaa

SEQ ID NO: 5942801 - DNA, 16 bp, Homo sapiens
tcatgtactgcattat

SEQ ID NO: 5942802 - DNA, 19 bp, Homo sapiens
tcatgtactgcattatttg

SEQ ID NO: 5942803 - DNA, 12 bp, Homo sapiens
tcatgtacttaa

SEQ ID NO: 5942804 - DNA, 11 bp, Homo sapiens
tcatgtacttc

SEQ ID NO: 5942805 - DNA, 18 bp, Homo sapiens
tcatgtacttcctgtgta

SEQ ID NO: 5942806 - DNA, 13 bp, Homo sapiens
tcatgtacttttt

SEQ ID NO: 5942807 - DNA, 15 bp, Homo sapiens
tcatgtactttttag

SEQ ID NO: 5942808 - DNA, 14 bp, Homo sapiens
tcatgtagaacaag

SEQ ID NO: 5942809 - DNA, 20 bp, Homo sapiens
tcatgtagagaaaagcacac

SEQ ID NO: 5942810 - DNA, 11 bp, Homo sapiens
tcatgtagatt

SEQ ID NO: 5942811 - DNA, 19 bp, Homo sapiens
tcatgtatgttcagaagaa

SEQ ID NO: 5942812 - DNA, 15 bp, Homo sapiens
tcattacttgggaaa

SEQ ID NO: 5942813 - DNA, 14 bp, Homo sapiens
tcattacttttaaa

SEQ ID NO: 5942814 - DNA, 12 bp, Homo sapiens
tcattagaaagg

SEQ ID NO: 5942815 - DNA, 18 bp, Homo sapiens
tcattagaagttaccaaa

SEQ ID NO: 5942816 - DNA, 14 bp, Homo sapiens
tcattagaattgaa

SEQ ID NO: 5942817 - DNA, 15 bp, Homo sapiens
tcattagaattgaat

SEQ ID NO: 5942818 - DNA, 22 bp, Homo sapiens
tcattagaattgaattattggg

SEQ ID NO: 5942819 - DNA, 12 bp, Homo sapiens
tcattagagcag

SEQ ID NO: 5942820 - DNA, 15 bp, Homo sapiens
tcattagagcaggcg

SEQ ID NO: 5942821 - DNA, 13 bp, Homo sapiens
tcattagagctta

SEQ ID NO: 5942822 - DNA, 17 bp, Homo sapiens
tcattagcaaaaaaagt

SEQ ID NO: 5942823 - DNA, 18 bp, Homo sapiens
tcattagcctgagtagaa

SEQ ID NO: 5942824 - DNA, 15 bp, Homo sapiens
tcattagctgctctg

SEQ ID NO: 5942825 - DNA, 18 bp, Homo sapiens
tcattagctgtgattttt

SEQ ID NO: 5942826 - DNA, 15 bp, Homo sapiens
tcattaggaaaacat

SEQ ID NO: 5942827 - DNA, 16 bp, Homo sapiens
tcattaggatggctag

SEQ ID NO: 5942828 - DNA, 15 bp, Homo sapiens
tcattaggcaaagta

SEQ ID NO: 5942829 - DNA, 21 bp, Homo sapiens
tcattaggtgtgactgaattt

SEQ ID NO: 5942830 - DNA, 16 bp, Homo sapiens
tcattaggttttgctt

SEQ ID NO: 5942831 - DNA, 22 bp, Homo sapiens
tcattagtcatgtttatctgct

SEQ ID NO: 5942832 - DNA, 14 bp, Homo sapiens
tcattagttttgaa

SEQ ID NO: 5942833 - DNA, 12 bp, Homo sapiens
tcattataaaat

SEQ ID NO: 5942834 - DNA, 13 bp, Homo sapiens
tcattataaacgt

SEQ ID NO: 5942835 - DNA, 15 bp, Homo sapiens
tcattatagcatgta

SEQ ID NO: 5942836 - DNA, 20 bp, Homo sapiens
tcattatattctaattaaaa

SEQ ID NO: 5942837 - DNA, 17 bp, Homo sapiens
tcattatcaaaagtgat

SEQ ID NO: 5942838 - DNA, 13 bp, Homo sapiens
tcattatctcaaa

SEQ ID NO: 5942839 - DNA, 17 bp, Homo sapiens
tcattatctgagttgca

SEQ ID NO: 5942840 - DNA, 16 bp, Homo sapiens
tcattatcttcatgtt

SEQ ID NO: 5942841 - DNA, 15 bp, Homo sapiens
tcattatctttgctg

SEQ ID NO: 5942842 - DNA, 13 bp, Homo sapiens
tcattatgaagat

SEQ ID NO: 5942843 - DNA, 16 bp, Homo sapiens
tcattatgaagatgtt

SEQ ID NO: 5942844 - DNA, 17 bp, Homo sapiens
tcattatgaagatgttt

SEQ ID NO: 5942845 - DNA, 12 bp, Homo sapiens
tcattatgacat

SEQ ID NO: 5942846 - DNA, 13 bp, Homo sapiens
tcattatgacatt

SEQ ID NO: 5942847 - DNA, 16 bp, Homo sapiens
tcattatgatttcatt

SEQ ID NO: 5942848 - DNA, 20 bp, Homo sapiens
tcattatgcaacgtttaaca

SEQ ID NO: 5942849 - DNA, 21 bp, Homo sapiens
tcattatgcaacgtttaacat

SEQ ID NO: 5942850 - DNA, 22 bp, Homo sapiens
tcattatgcacttgggagaaaa

SEQ ID NO: 5942851 - DNA, 13 bp, Homo sapiens
tcattatgctttg

SEQ ID NO: 5942852 - DNA, 14 bp, Homo sapiens
tcattatgctttga

SEQ ID NO: 5942853 - DNA, 18 bp, Homo sapiens
tcattatgctttgaactt

SEQ ID NO: 5942854 - DNA, 19 bp, Homo sapiens
tcattatggtagaatcatt

SEQ ID NO: 5942855 - DNA, 13 bp, Homo sapiens
tcattatgtcaat

SEQ ID NO: 5942856 - DNA, 16 bp, Homo sapiens
tcattatgtcaattca

SEQ ID NO: 5942857 - DNA, 17 bp, Homo sapiens
tcattatgttcatgtaa

SEQ ID NO: 5942858 - DNA, 15 bp, Homo sapiens
tcattattaccactt

SEQ ID NO: 5942859 - DNA, 13 bp, Homo sapiens
tcattattcaaga

SEQ ID NO: 5942860 - DNA, 17 bp, Homo sapiens
tcattattggaattaac

SEQ ID NO: 5942861 - DNA, 19 bp, Homo sapiens
tcattattggaattaacct

SEQ ID NO: 5942862 - DNA, 14 bp, Homo sapiens
tcattattggaggg

SEQ ID NO: 5942863 - DNA, 14 bp, Homo sapiens
tcattatttattaa

SEQ ID NO: 5942864 - DNA, 23 bp, Homo sapiens
tcattatttattgttaaattaca

SEQ ID NO: 5942865 - DNA, 13 bp, Homo sapiens
tcattatttcaaa

SEQ ID NO: 5942866 - DNA, 16 bp, Homo sapiens
tcattatttcaaggaa

SEQ ID NO: 5942867 - DNA, 14 bp, Homo sapiens
tcattatttcatca

SEQ ID NO: 5942868 - DNA, 13 bp, Homo sapiens
tcattatttctgg

SEQ ID NO: 5942869 - DNA, 14 bp, Homo sapiens
tcattatttgagac

SEQ ID NO: 5942870 - DNA, 18 bp, Homo sapiens
tcattattttattatgaa

SEQ ID NO: 5942871 - DNA, 22 bp, Homo sapiens
tcattattttattatgaaactt

SEQ ID NO: 5942872 - DNA, 23 bp, Homo sapiens
tcattattttgtggttctatttt

SEQ ID NO: 5942873 - DNA, 13 bp, Homo sapiens
tcattatttttca

SEQ ID NO: 5942874 - DNA, 14 bp, Homo sapiens
tcattatttttcaa

SEQ ID NO: 5942875 - DNA, 11 bp, Homo sapiens
tcattcaaaac

SEQ ID NO: 5942876 - DNA, 15 bp, Homo sapiens
tcattcaaaactttc

SEQ ID NO: 5942877 - DNA, 17 bp, Homo sapiens
tcattcaaaatgtccag

SEQ ID NO: 5942878 - DNA, 14 bp, Homo sapiens
tcattcaaactgca

SEQ ID NO: 5942879 - DNA, 21 bp, Homo sapiens
tcattcaaatcagtgatctat

SEQ ID NO: 5942880 - DNA, 20 bp, Homo sapiens
tcattcaaatgaactttaaa

SEQ ID NO: 5942881 - DNA, 17 bp, Homo sapiens
tcattcaagcctgtgaa

SEQ ID NO: 5942882 - DNA, 15 bp, Homo sapiens
tcattcaagcttcat

SEQ ID NO: 5942883 - DNA, 22 bp, Homo sapiens
tcattcaagtgtaaaatatttt

SEQ ID NO: 5942884 - DNA, 21 bp, Homo sapiens
tcattcaatattgacatttgt

SEQ ID NO: 5942885 - DNA, 21 bp, Homo sapiens
tcattcaatttaagtatattt

SEQ ID NO: 5942886 - DNA, 23 bp, Homo sapiens
tcattcaatttaagtatatttgt

SEQ ID NO: 5942887 - DNA, 20 bp, Homo sapiens
tcattcacaaagtataacaa

SEQ ID NO: 5942888 - DNA, 22 bp, Homo sapiens
tcattcacaaagtataacaatt

SEQ ID NO: 5942889 - DNA, 22 bp, Homo sapiens
tcattcacatcgcagattctcc

SEQ ID NO: 5942890 - DNA, 14 bp, Homo sapiens
tcattcacatttca

SEQ ID NO: 5942891 - DNA, 17 bp, Homo sapiens
tcattcacttcactgtg

SEQ ID NO: 5942892 - DNA, 19 bp, Homo sapiens
tcattcacttcactgtgct

SEQ ID NO: 5942893 - DNA, 20 bp, Homo sapiens
tcattcacttcactgtgctg

SEQ ID NO: 5942894 - DNA, 13 bp, Homo sapiens
tcattcagaaatg

SEQ ID NO: 5942895 - DNA, 14 bp, Homo sapiens
tcattcagaaatgt

SEQ ID NO: 5942896 - DNA, 20 bp, Homo sapiens
tcattcagagactgcccttc

SEQ ID NO: 5942897 - DNA, 22 bp, Homo sapiens
tcattcagagtcagccaggacc

SEQ ID NO: 5942898 - DNA, 18 bp, Homo sapiens
tcattcagatataagatt

SEQ ID NO: 5942899 - DNA, 22 bp, Homo sapiens
tcattcagatatgattcaaatg

SEQ ID NO: 5942900 - DNA, 12 bp, Homo sapiens
tcattcagcaga

SEQ ID NO: 5942901 - DNA, 19 bp, Homo sapiens
tcattcagcagcaaatttt

SEQ ID NO: 5942902 - DNA, 19 bp, Homo sapiens
tcattcagccttgctgacc

SEQ ID NO: 5942903 - DNA, 18 bp, Homo sapiens
tcattcagcctttagaaa

SEQ ID NO: 5942904 - DNA, 13 bp, Homo sapiens
tcattcaggaaaa

SEQ ID NO: 5942905 - DNA, 19 bp, Homo sapiens
tcattcaggtgttctcttc

SEQ ID NO: 5942906 - DNA, 12 bp, Homo sapiens
tcattcagttct

SEQ ID NO: 5942907 - DNA, 19 bp, Homo sapiens
tcattcagttctaggcctt

SEQ ID NO: 5942908 - DNA, 20 bp, Homo sapiens
tcattcagttctaggccttt

SEQ ID NO: 5942909 - DNA, 22 bp, Homo sapiens
tcattcataaaagtttgcatgt

SEQ ID NO: 5942910 - DNA, 15 bp, Homo sapiens
tcattcatacttaaa

SEQ ID NO: 5942911 - DNA, 10 bp, Homo sapiens
tcattcatat

SEQ ID NO: 5942912 - DNA, 18 bp, Homo sapiens
tcattcatatgagttcct

SEQ ID NO: 5942913 - DNA, 11 bp, Homo sapiens
tcattcatatt

SEQ ID NO: 5942914 - DNA, 12 bp, Homo sapiens
tcattcatatta

SEQ ID NO: 5942915 - DNA, 20 bp, Homo sapiens
tcattcatccaggactgaga

SEQ ID NO: 5942916 - DNA, 12 bp, Homo sapiens
tcattcatcctg

SEQ ID NO: 5942917 - DNA, 12 bp, Homo sapiens
tcattcatgaat

SEQ ID NO: 5942918 - DNA, 23 bp, Homo sapiens
tcattcatgaatattttcaagtt

SEQ ID NO: 5942919 - DNA, 18 bp, Homo sapiens
tcattcattagtcatgtt

SEQ ID NO: 5942920 - DNA, 15 bp, Homo sapiens
tcattcattcactgt

SEQ ID NO: 5942921 - DNA, 16 bp, Homo sapiens
tcattcatttattcat

SEQ ID NO: 5942922 - DNA, 15 bp, Homo sapiens
tcattcattttgtgt

SEQ ID NO: 5942923 - DNA, 11 bp, Homo sapiens
tcattccaaac

SEQ ID NO: 5942924 - DNA, 17 bp, Homo sapiens
tcattccaacagtgagt

SEQ ID NO: 5942925 - DNA, 16 bp, Homo sapiens
tcattccaagcacttt

SEQ ID NO: 5942926 - DNA, 23 bp, Homo sapiens
tcattccaccttcccatgccctg

SEQ ID NO: 5942927 - DNA, 13 bp, Homo sapiens
tcattccagcagc

SEQ ID NO: 5942928 - DNA, 14 bp, Homo sapiens
tcattccagcagct

SEQ ID NO: 5942929 - DNA, 13 bp, Homo sapiens
tcattccagtgct

SEQ ID NO: 5942930 - DNA, 18 bp, Homo sapiens
tcattccagtgctagaaa

SEQ ID NO: 5942931 - DNA, 18 bp, Homo sapiens
tcattccatgactctgcc

SEQ ID NO: 5942932 - DNA, 18 bp, Homo sapiens
tcattccatgtgcccagt

SEQ ID NO: 5942933 - DNA, 15 bp, Homo sapiens
tcattccattgccta

SEQ ID NO: 5942934 - DNA, 16 bp, Homo sapiens
tcattccatttgctga

SEQ ID NO: 5942935 - DNA, 14 bp, Homo sapiens
tcattcccactgca

SEQ ID NO: 5942936 - DNA, 17 bp, Homo sapiens
tcattcccactgcactt

SEQ ID NO: 5942937 - DNA, 15 bp, Homo sapiens
tcattcccatgtgga

SEQ ID NO: 5942938 - DNA, 15 bp, Homo sapiens
tcattcccccttcct

SEQ ID NO: 5942939 - DNA, 21 bp, Homo sapiens
tcattcccccttcctagtgaa

SEQ ID NO: 5942940 - DNA, 12 bp, Homo sapiens
tcattcccctcg

SEQ ID NO: 5942941 - DNA, 16 bp, Homo sapiens
tcattcccctttgcac

SEQ ID NO: 5942942 - DNA, 18 bp, Homo sapiens
tcattcccctttgcactg

SEQ ID NO: 5942943 - DNA, 19 bp, Homo sapiens
tcattcccctttgcactgt

SEQ ID NO: 5942944 - DNA, 20 bp, Homo sapiens
tcattcccttcgacagcatt

SEQ ID NO: 5942945 - DNA, 21 bp, Homo sapiens
tcattcccttcgacagcattt

SEQ ID NO: 5942946 - DNA, 22 bp, Homo sapiens
tcattccggactggcagaagca

SEQ ID NO: 5942947 - DNA, 12 bp, Homo sapiens
tcattcctccag

SEQ ID NO: 5942948 - DNA, 12 bp, Homo sapiens
tcattcctctgt

SEQ ID NO: 5942949 - DNA, 16 bp, Homo sapiens
tcattcctgaaagaaa

SEQ ID NO: 5942950 - DNA, 22 bp, Homo sapiens
tcattcctgaaagaaacagtta

SEQ ID NO: 5942951 - DNA, 13 bp, Homo sapiens
tcattcctgcctg

SEQ ID NO: 5942952 - DNA, 11 bp, Homo sapiens
tcattcctgtc

SEQ ID NO: 5942953 - DNA, 15 bp, Homo sapiens
tcattcctgttcttt

SEQ ID NO: 5942954 - DNA, 20 bp, Homo sapiens
tcattccttcactcatccag

SEQ ID NO: 5942955 - DNA, 17 bp, Homo sapiens
tcattcgcctgtgggaa

SEQ ID NO: 5942956 - DNA, 18 bp, Homo sapiens
tcattcgcctttgtcttg

SEQ ID NO: 5942957 - DNA, 22 bp, Homo sapiens
tcattcgcctttgtcttgtact

SEQ ID NO: 5942958 - DNA, 21 bp, Homo sapiens
tcattcgctcccacattctga

SEQ ID NO: 5942959 - DNA, 22 bp, Homo sapiens
tcattcggtgtgaacttttctc

SEQ ID NO: 5942960 - DNA, 18 bp, Homo sapiens
tcattcgtggttgatttc

SEQ ID NO: 5942961 - DNA, 20 bp, Homo sapiens
tcattcgtggttgatttcaa

SEQ ID NO: 5942962 - DNA, 21 bp, Homo sapiens
tcattcgtggttgatttcaat

SEQ ID NO: 5942963 - DNA, 15 bp, Homo sapiens
tcattcgttctgtgg

SEQ ID NO: 5942964 - DNA, 16 bp, Homo sapiens
tcattctaaaatcaga

SEQ ID NO: 5942965 - DNA, 19 bp, Homo sapiens
tcattctaaaccaaaacag

SEQ ID NO: 5942966 - DNA, 12 bp, Homo sapiens
tcattctaaaga

SEQ ID NO: 5942967 - DNA, 16 bp, Homo sapiens
tcattctacagaataa

SEQ ID NO: 5942968 - DNA, 18 bp, Homo sapiens
tcattctaccaagctgtc

SEQ ID NO: 5942969 - DNA, 20 bp, Homo sapiens
tcattctagaccctatacat

SEQ ID NO: 5942970 - DNA, 18 bp, Homo sapiens
tcattctatgacaataaa

SEQ ID NO: 5942971 - DNA, 22 bp, Homo sapiens
tcattctcacctaaaccctctg

SEQ ID NO: 5942972 - DNA, 23 bp, Homo sapiens
tcattctcataattcctacagca

SEQ ID NO: 5942973 - DNA, 13 bp, Homo sapiens
tcattctcatcca

SEQ ID NO: 5942974 - DNA, 15 bp, Homo sapiens
tcattctcatccaaa

SEQ ID NO: 5942975 - DNA, 16 bp, Homo sapiens
tcattctcatccaaaa

SEQ ID NO: 5942976 - DNA, 23 bp, Homo sapiens
tcattctcatccaaaagtgacca

SEQ ID NO: 5942977 - DNA, 10 bp, Homo sapiens
tcattctccc

SEQ ID NO: 5942978 - DNA, 22 bp, Homo sapiens
tcattctcccgcttcctggcct

SEQ ID NO: 5942979 - DNA, 13 bp, Homo sapiens
tcattctcctcct

SEQ ID NO: 5942980 - DNA, 14 bp, Homo sapiens
tcattctcctcctc

SEQ ID NO: 5942981 - DNA, 12 bp, Homo sapiens
tcattctcctgc

SEQ ID NO: 5942982 - DNA, 18 bp, Homo sapiens
tcattctccttgctctgt

SEQ ID NO: 5942983 - DNA, 16 bp, Homo sapiens
tcattctccttgtaaa

SEQ ID NO: 5942984 - DNA, 21 bp, Homo sapiens
tcattctccttgtgttactaa

SEQ ID NO: 5942985 - DNA, 14 bp, Homo sapiens
tcattctctgtctc

SEQ ID NO: 5942986 - DNA, 16 bp, Homo sapiens
tcattctctgtctcat

SEQ ID NO: 5942987 - DNA, 22 bp, Homo sapiens
tcattctcttgaaggtgctgcc

SEQ ID NO: 5942988 - DNA, 13 bp, Homo sapiens
tcattctctttct

SEQ ID NO: 5942989 - DNA, 23 bp, Homo sapiens
tcattctgaaccctccaaaggaa

SEQ ID NO: 5942990 - DNA, 16 bp, Homo sapiens
tcattctgaatctgaa

SEQ ID NO: 5942991 - DNA, 14 bp, Homo sapiens
tcattctgcacctt

SEQ ID NO: 5942992 - DNA, 14 bp, Homo sapiens
tcattctgcattaa

SEQ ID NO: 5942993 - DNA, 21 bp, Homo sapiens
tcatttagataatttgaaaaa

SEQ ID NO: 5942994 - DNA, 12 bp, Homo sapiens
tcatttagatgc

SEQ ID NO: 5942995 - DNA, 17 bp, Homo sapiens
tcatttagatgcacttt

SEQ ID NO: 5942996 - DNA, 18 bp, Homo sapiens
tcatttagtcatgtgacc

SEQ ID NO: 5942997 - DNA, 17 bp, Homo sapiens
tcatttagtgagttatt

SEQ ID NO: 5942998 - DNA, 19 bp, Homo sapiens
tcatttagtttgattattc

SEQ ID NO: 5942999 - DNA, 22 bp, Homo sapiens
tcatttataaagctaaaataac

SEQ ID NO: 5943000 - DNA, 18 bp, Homo sapiens
tcatttatagcacgtctc

SEQ ID NO: 5943001 - DNA, 17 bp, Homo sapiens
tcatttatatagattat

SEQ ID NO: 5943002 - DNA, 14 bp, Homo sapiens
tcatttatattgca

SEQ ID NO: 5943003 - DNA, 15 bp, Homo sapiens
tcatttatcaagcag

SEQ ID NO: 5943004 - DNA, 15 bp, Homo sapiens
tcatttatcactctg

SEQ ID NO: 5943005 - DNA, 15 bp, Homo sapiens
tcatttatccctcaa

SEQ ID NO: 5943006 - DNA, 18 bp, Homo sapiens
tcatttatctataattta

SEQ ID NO: 5943007 - DNA, 11 bp, Homo sapiens
tcatttatgat

SEQ ID NO: 5943008 - DNA, 17 bp, Homo sapiens
tcatttatgatacaaaa

SEQ ID NO: 5943009 - DNA, 14 bp, Homo sapiens
tcatttattaagta

SEQ ID NO: 5943010 - DNA, 15 bp, Homo sapiens
tcatttattaagtat

SEQ ID NO: 5943011 - DNA, 17 bp, Homo sapiens
tcatttattaagtatat

SEQ ID NO: 5943012 - DNA, 23 bp, Homo sapiens
tcatttattaagtatatttgtaa

SEQ ID NO: 5943013 - DNA, 20 bp, Homo sapiens
tcatttattttaaaaaatga

SEQ ID NO: 5943014 - DNA, 19 bp, Homo sapiens
tcatttcaaatacatcttt

SEQ ID NO: 5943015 - DNA, 17 bp, Homo sapiens
tcatttcaatcattgaa

SEQ ID NO: 5943016 - DNA, 14 bp, Homo sapiens
tcatttcacacagt

SEQ ID NO: 5943017 - DNA, 14 bp, Homo sapiens
tcatttcacattaa

SEQ ID NO: 5943018 - DNA, 14 bp, Homo sapiens
tcatttcacccctc

SEQ ID NO: 5943019 - DNA, 23 bp, Homo sapiens
tcatttcacccctccctttctcc

SEQ ID NO: 5943020 - DNA, 20 bp, Homo sapiens
tcatttcactaagctcctcc

SEQ ID NO: 5943021 - DNA, 13 bp, Homo sapiens
tcatttcagaagt

SEQ ID NO: 5943022 - DNA, 21 bp, Homo sapiens
tcatttcagaagttagtttgt

SEQ ID NO: 5943023 - DNA, 13 bp, Homo sapiens
tcatttcagattt

SEQ ID NO: 5943024 - DNA, 13 bp, Homo sapiens
tcatttcagccaa

SEQ ID NO: 5943025 - DNA, 12 bp, Homo sapiens
tcatttcaggat

SEQ ID NO: 5943026 - DNA, 16 bp, Homo sapiens
tcatttcagtttctat

SEQ ID NO: 5943027 - DNA, 21 bp, Homo sapiens
tcatttcatagccaaacagga

SEQ ID NO: 5943028 - DNA, 14 bp, Homo sapiens
tcatttcatatatc

SEQ ID NO: 5943029 - DNA, 18 bp, Homo sapiens
tcatttcatcctttcact

SEQ ID NO: 5943030 - DNA, 12 bp, Homo sapiens
tcatttcatcta

SEQ ID NO: 5943031 - DNA, 14 bp, Homo sapiens
tcatttcatctcat

SEQ ID NO: 5943032 - DNA, 18 bp, Homo sapiens
tcatttcatctcatttaa

SEQ ID NO: 5943033 - DNA, 15 bp, Homo sapiens
tcatttcatgctctg

SEQ ID NO: 5943034 - DNA, 14 bp, Homo sapiens
tcatttcatgcttt

SEQ ID NO: 5943035 - DNA, 13 bp, Homo sapiens
tcatttcattcca

SEQ ID NO: 5943036 - DNA, 19 bp, Homo sapiens
tcatttcattgtatgatgt

SEQ ID NO: 5943037 - DNA, 13 bp, Homo sapiens
tcatttccaagca

SEQ ID NO: 5943038 - DNA, 22 bp, Homo sapiens
tcatttccaccaagggtatctg

SEQ ID NO: 5943039 - DNA, 13 bp, Homo sapiens
tcatttccagctt

SEQ ID NO: 5943040 - DNA, 15 bp, Homo sapiens
tcatttccagcttct

SEQ ID NO: 5943041 - DNA, 20 bp, Homo sapiens
tcatttccagcttctcagtt

SEQ ID NO: 5943042 - DNA, 23 bp, Homo sapiens
tcatttcccctcccaatcctctc

SEQ ID NO: 5943043 - DNA, 12 bp, Homo sapiens
tcatttccgtga

SEQ ID NO: 5943044 - DNA, 20 bp, Homo sapiens
tcatttccgttttgcctgtg

SEQ ID NO: 5943045 - DNA, 22 bp, Homo sapiens
tcatttcctatgtaactgcatt

SEQ ID NO: 5943046 - DNA, 24 bp, Homo sapiens
tcatttcctctgagctgttatctt

SEQ ID NO: 5943047 - DNA, 12 bp, Homo sapiens
tcatttcctgcc

SEQ ID NO: 5943048 - DNA, 13 bp, Homo sapiens
tcatttcctgccc

SEQ ID NO: 5943049 - DNA, 15 bp, Homo sapiens
tcatttcctgccctt

SEQ ID NO: 5943050 - DNA, 22 bp, Homo sapiens
tcatttcctttgttgtctacat

SEQ ID NO: 5943051 - DNA, 19 bp, Homo sapiens
tcatttcgtatttctcata

SEQ ID NO: 5943052 - DNA, 10 bp, Homo sapiens
tcatttctaa

SEQ ID NO: 5943053 - DNA, 16 bp, Homo sapiens
tcatttctagagaaaa

SEQ ID NO: 5943054 - DNA, 17 bp, Homo sapiens
tcatttctatttctcct

SEQ ID NO: 5943055 - DNA, 21 bp, Homo sapiens
tcatttctatttctcctccat

SEQ ID NO: 5943056 - DNA, 18 bp, Homo sapiens
tcatttctcataattttg

SEQ ID NO: 5943057 - DNA, 19 bp, Homo sapiens
tcatttctccagattatct

SEQ ID NO: 5943058 - DNA, 14 bp, Homo sapiens
tcatttctgccagc

SEQ ID NO: 5943059 - DNA, 15 bp, Homo sapiens
tcatttcttatcaca

SEQ ID NO: 5943060 - DNA, 15 bp, Homo sapiens
tcatttcttcctcag

SEQ ID NO: 5943061 - DNA, 20 bp, Homo sapiens
tcatttcttcctcagctggt

SEQ ID NO: 5943062 - DNA, 13 bp, Homo sapiens
tcatttcttgggc

SEQ ID NO: 5943063 - DNA, 22 bp, Homo sapiens
tcatttctttcaagacagccta

SEQ ID NO: 5943064 - DNA, 14 bp, Homo sapiens
tcatttctttgtct

SEQ ID NO: 5943065 - DNA, 22 bp, Homo sapiens
tcatttctttttgggagagact

SEQ ID NO: 5943066 - DNA, 22 bp, Homo sapiens
tcatttgaataaaaaggaactt

SEQ ID NO: 5943067 - DNA, 14 bp, Homo sapiens
tcatttgagataaa

SEQ ID NO: 5943068 - DNA, 16 bp, Homo sapiens
tcatttgcatcctatc

SEQ ID NO: 5943069 - DNA, 20 bp, Homo sapiens
tcatttgccaactaatttta

SEQ ID NO: 5943070 - DNA, 17 bp, Homo sapiens
tcatttgccaggaagat

SEQ ID NO: 5943071 - DNA, 21 bp, Homo sapiens
tcatttgcccttaaggacaaa

SEQ ID NO: 5943072 - DNA, 14 bp, Homo sapiens
tcatttgctgtgaa

SEQ ID NO: 5943073 - DNA, 21 bp, Homo sapiens
tcatttggaggaatcacccca

SEQ ID NO: 5943074 - DNA, 21 bp, Homo sapiens
tcatttggcagcccctgtttt

SEQ ID NO: 5943075 - DNA, 21 bp, Homo sapiens
tcatttggggcatttgtaaaa

SEQ ID NO: 5943076 - DNA, 16 bp, Homo sapiens
tcatttgggggcgttc

SEQ ID NO: 5943077 - DNA, 16 bp, Homo sapiens
tcatttggttaaatca

SEQ ID NO: 5943078 - DNA, 18 bp, Homo sapiens
tcatttggttcattaatt

SEQ ID NO: 5943079 - DNA, 20 bp, Homo sapiens
tcatttggttcattaattct

SEQ ID NO: 5943080 - DNA, 18 bp, Homo sapiens
tcatttgtacaaggtaat

SEQ ID NO: 5943081 - DNA, 17 bp, Homo sapiens
tcatttgtatgtcaaag

SEQ ID NO: 5943082 - DNA, 16 bp, Homo sapiens
tcatttgtattgctta

SEQ ID NO: 5943083 - DNA, 14 bp, Homo sapiens
tcatttgtcacaca

SEQ ID NO: 5943084 - DNA, 16 bp, Homo sapiens
tcatttgtcctgttct

SEQ ID NO: 5943085 - DNA, 15 bp, Homo sapiens
tcatttgtgaagaat

SEQ ID NO: 5943086 - DNA, 17 bp, Homo sapiens
tcatttgtggctttctg

SEQ ID NO: 5943087 - DNA, 22 bp, Homo sapiens
tcatttgtgggtttttatttcc

SEQ ID NO: 5943088 - DNA, 23 bp, Homo sapiens
tcatttgttaatatttcttcgtg

SEQ ID NO: 5943089 - DNA, 16 bp, Homo sapiens
tcatttgttcattaaa

SEQ ID NO: 5943090 - DNA, 16 bp, Homo sapiens
tcatttgttgtgatgt

SEQ ID NO: 5943091 - DNA, 17 bp, Homo sapiens
tcatttgtttaaaaagg

SEQ ID NO: 5943092 - DNA, 14 bp, Homo sapiens
tcatttgtttaaac

SEQ ID NO: 5943093 - DNA, 15 bp, Homo sapiens
tcatttgtttaaaca

SEQ ID NO: 5943094 - DNA, 18 bp, Homo sapiens
tcatttgtttaaacaatc

SEQ ID NO: 5943095 - DNA, 18 bp, Homo sapiens
tcatttgtttacatttga

SEQ ID NO: 5943096 - DNA, 19 bp, Homo sapiens
tcattttaaaaactttatt

SEQ ID NO: 5943097 - DNA, 19 bp, Homo sapiens
tcattttaaaatctgattt

SEQ ID NO: 5943098 - DNA, 21 bp, Homo sapiens
tcattttaacatgatttcaaa

SEQ ID NO: 5943099 - DNA, 17 bp, Homo sapiens
tcattttaactggcatg

SEQ ID NO: 5943100 - DNA, 13 bp, Homo sapiens
tcattttaatata

SEQ ID NO: 5943101 - DNA, 17 bp, Homo sapiens
tcattttaatatataat

SEQ ID NO: 5943102 - DNA, 13 bp, Homo sapiens
tcattttaatgta

SEQ ID NO: 5943103 - DNA, 15 bp, Homo sapiens
tcattttaatgtaaa

SEQ ID NO: 5943104 - DNA, 13 bp, Homo sapiens
tcattttaattta

SEQ ID NO: 5943105 - DNA, 14 bp, Homo sapiens
tcattttaatttat

SEQ ID NO: 5943106 - DNA, 16 bp, Homo sapiens
tcattttacagtatct

SEQ ID NO: 5943107 - DNA, 18 bp, Homo sapiens
tcattttacccttggctc

SEQ ID NO: 5943108 - DNA, 12 bp, Homo sapiens
tcattttactaa

SEQ ID NO: 5943109 - DNA, 20 bp, Homo sapiens
tcattttagacactgggaga

SEQ ID NO: 5943110 - DNA, 18 bp, Homo sapiens
tcattttagctggtgtca

SEQ ID NO: 5943111 - DNA, 15 bp, Homo sapiens
tcattttagtgactg

SEQ ID NO: 5943112 - DNA, 18 bp, Homo sapiens
tcattttatataaagaaa

SEQ ID NO: 5943113 - DNA, 16 bp, Homo sapiens
tcattttatatgtcaa

SEQ ID NO: 5943114 - DNA, 18 bp, Homo sapiens
tcattttatatgtcaaag

SEQ ID NO: 5943115 - DNA, 21 bp, Homo sapiens
tcattttatatgtcaaagcag

SEQ ID NO: 5943116 - DNA, 18 bp, Homo sapiens
tcattttatattgaaaaa

SEQ ID NO: 5943117 - DNA, 22 bp, Homo sapiens
tcattttatggcacctatttct

SEQ ID NO: 5943118 - DNA, 13 bp, Homo sapiens
tcattttattctt

SEQ ID NO: 5943119 - DNA, 13 bp, Homo sapiens
tcattttcagatc

SEQ ID NO: 5943120 - DNA, 15 bp, Homo sapiens
tcattttcatcactg

SEQ ID NO: 5943121 - DNA, 13 bp, Homo sapiens
tcattttcatgtg

SEQ ID NO: 5943122 - DNA, 13 bp, Homo sapiens
tcattttcattaa

SEQ ID NO: 5943123 - DNA, 17 bp, Homo sapiens
tcattttcattaccagg

SEQ ID NO: 5943124 - DNA, 22 bp, Homo sapiens
tcattttcattatttcaaggaa

SEQ ID NO: 5943125 - DNA, 13 bp, Homo sapiens
tcattttccaata

SEQ ID NO: 5943126 - DNA, 14 bp, Homo sapiens
tcattttcctggga

SEQ ID NO: 5943127 - DNA, 12 bp, Homo sapiens
tcattttcctgt

SEQ ID NO: 5943128 - DNA, 16 bp, Homo sapiens
tcattttcctgttcag

SEQ ID NO: 5943129 - DNA, 21 bp, Homo sapiens
tcattttcctgttcagtgaga

SEQ ID NO: 5943130 - DNA, 14 bp, Homo sapiens
tcattttcctttct

SEQ ID NO: 5943131 - DNA, 16 bp, Homo sapiens
tcattttcctttctgt

SEQ ID NO: 5943132 - DNA, 12 bp, Homo sapiens
tcattttctaga

SEQ ID NO: 5943133 - DNA, 21 bp, Homo sapiens
tcattttctagatacaataaa

SEQ ID NO: 5943134 - DNA, 20 bp, Homo sapiens
tcattttctagccctctccc

SEQ ID NO: 5943135 - DNA, 21 bp, Homo sapiens
tcattttctagccctctccct

SEQ ID NO: 5943136 - DNA, 20 bp, Homo sapiens
tcattttctataacagatat

SEQ ID NO: 5943137 - DNA, 13 bp, Homo sapiens
tcattttctctaa

SEQ ID NO: 5943138 - DNA, 15 bp, Homo sapiens
tcattttctctcctc

SEQ ID NO: 5943139 - DNA, 13 bp, Homo sapiens
tcattttctcttt

SEQ ID NO: 5943140 - DNA, 12 bp, Homo sapiens
tcattttctgac

SEQ ID NO: 5943141 - DNA, 17 bp, Homo sapiens
tcattttctgacatgca

SEQ ID NO: 5943142 - DNA, 19 bp, Homo sapiens
tcattttctgacatgcatt

SEQ ID NO: 5943143 - DNA, 21 bp, Homo sapiens
tcattttctgacatgcattgt

SEQ ID NO: 5943144 - DNA, 13 bp, Homo sapiens
tcattttctgcaa

SEQ ID NO: 5943145 - DNA, 15 bp, Homo sapiens
tcattttctgcattt

SEQ ID NO: 5943146 - DNA, 18 bp, Homo sapiens
tcattttcttgatgtcac

SEQ ID NO: 5943147 - DNA, 21 bp, Homo sapiens
tcattttgaattatgtgcact

SEQ ID NO: 5943148 - DNA, 15 bp, Homo sapiens
tcattttgactggct

SEQ ID NO: 5943149 - DNA, 14 bp, Homo sapiens
tcattttgagaaca

SEQ ID NO: 5943150 - DNA, 15 bp, Homo sapiens
tcattttgagctgaa

SEQ ID NO: 5943151 - DNA, 22 bp, Homo sapiens
tcattttgagtctcaggccctg

SEQ ID NO: 5943152 - DNA, 12 bp, Homo sapiens
tcattttgatgt

SEQ ID NO: 5943153 - DNA, 13 bp, Homo sapiens
tcattttgatgta

SEQ ID NO: 5943154 - DNA, 12 bp, Homo sapiens
tcattttgcact

SEQ ID NO: 5943155 - DNA, 16 bp, Homo sapiens
tcattttgcattcaaa

SEQ ID NO: 5943156 - DNA, 17 bp, Homo sapiens
tcattttgcattcaaat

SEQ ID NO: 5943157 - DNA, 17 bp, Homo sapiens
tcattttgccattaaaa

SEQ ID NO: 5943158 - DNA, 14 bp, Homo sapiens
tcattttgcttccc

SEQ ID NO: 5943159 - DNA, 13 bp, Homo sapiens
tcattttgcttta

SEQ ID NO: 5943160 - DNA, 14 bp, Homo sapiens
tcattttggagctt

SEQ ID NO: 5943161 - DNA, 21 bp, Homo sapiens
tcattttggcaagaagactgt

SEQ ID NO: 5943162 - DNA, 20 bp, Homo sapiens
tcattttgggaaattcttgc

SEQ ID NO: 5943163 - DNA, 16 bp, Homo sapiens
tcattttggtctgttt

SEQ ID NO: 5943164 - DNA, 16 bp, Homo sapiens
tcattttggtttgttt

SEQ ID NO: 5943165 - DNA, 18 bp, Homo sapiens
tcattttggttttgtgtt

SEQ ID NO: 5943166 - DNA, 17 bp, Homo sapiens
tcattttgtaacaaatg

SEQ ID NO: 5943167 - DNA, 16 bp, Homo sapiens
tcattttgtaatattt

SEQ ID NO: 5943168 - DNA, 14 bp, Homo sapiens
tcattttgtatgta

SEQ ID NO: 5943169 - DNA, 17 bp, Homo sapiens
tcattttgtatgtatgt

SEQ ID NO: 5943170 - DNA, 17 bp, Homo sapiens
tcattttgtccatgtcc

SEQ ID NO: 5943171 - DNA, 13 bp, Homo sapiens
tcattttgtgtaa

SEQ ID NO: 5943172 - DNA, 17 bp, Homo sapiens
tcatttttaaagcctgg

SEQ ID NO: 5943173 - DNA, 15 bp, Homo sapiens
tcatttttaaatgtg

SEQ ID NO: 5943174 - DNA, 20 bp, Homo sapiens
tccaagcctctgtcttttct

SEQ ID NO: 5943175 - DNA, 11 bp, Homo sapiens
tccaagcctgc

SEQ ID NO: 5943176 - DNA, 13 bp, Homo sapiens
tccaagcctgcct

SEQ ID NO: 5943177 - DNA, 15 bp, Homo sapiens
tccaagcctggcacc

SEQ ID NO: 5943178 - DNA, 16 bp, Homo sapiens
tccaagcctggcaccc

SEQ ID NO: 5943179 - DNA, 17 bp, Homo sapiens
tccaagcctggcaccca

SEQ ID NO: 5943180 - DNA, 15 bp, Homo sapiens
tccaagcctgggcca

SEQ ID NO: 5943181 - DNA, 19 bp, Homo sapiens
tccaagcctgggccactgg

SEQ ID NO: 5943182 - DNA, 21 bp, Homo sapiens
tccaagccttcaccctgtgga

SEQ ID NO: 5943183 - DNA, 21 bp, Homo sapiens
tccaagcgaggtcaacagaga

SEQ ID NO: 5943184 - DNA, 22 bp, Homo sapiens
tccaagcgaggtcaacagagaa

SEQ ID NO: 5943185 - DNA, 15 bp, Homo sapiens
tccaagcgcctggct

SEQ ID NO: 5943186 - DNA, 23 bp, Homo sapiens
tccaagcggatgctccatttcaa

SEQ ID NO: 5943187 - DNA, 13 bp, Homo sapiens
tccaagctcccag

SEQ ID NO: 5943188 - DNA, 14 bp, Homo sapiens
tccaagctcccagg

SEQ ID NO: 5943189 - DNA, 16 bp, Homo sapiens
tccaagctcccaggca

SEQ ID NO: 5943190 - DNA, 12 bp, Homo sapiens
tccaagctccct

SEQ ID NO: 5943191 - DNA, 17 bp, Homo sapiens
tccaagctgagagtcta

SEQ ID NO: 5943192 - DNA, 23 bp, Homo sapiens
tccaagctgcgggctccctggca

SEQ ID NO: 5943193 - DNA, 12 bp, Homo sapiens
tccaagctggga

SEQ ID NO: 5943194 - DNA, 22 bp, Homo sapiens
tccaagctgggagattcaaggg

SEQ ID NO: 5943195 - DNA, 17 bp, Homo sapiens
tccaagctgttaaagat

SEQ ID NO: 5943196 - DNA, 22 bp, Homo sapiens
tccaagcttccatagctgctgc

SEQ ID NO: 5943197 - DNA, 16 bp, Homo sapiens
tccaaggaaaagcaga

SEQ ID NO: 5943198 - DNA, 14 bp, Homo sapiens
tccaaggaaaattg

SEQ ID NO: 5943199 - DNA, 16 bp, Homo sapiens
tccaaggaaaattgaa

SEQ ID NO: 5943200 - DNA, 14 bp, Homo sapiens
tccaaggaaacatg

SEQ ID NO: 5943201 - DNA, 21 bp, Homo sapiens
tccaaggaaaccacagctgct

SEQ ID NO: 5943202 - DNA, 20 bp, Homo sapiens
tccaaggaacctaattgaaa

SEQ ID NO: 5943203 - DNA, 20 bp, Homo sapiens
tccaaggaacttcatgcttg

SEQ ID NO: 5943204 - DNA, 19 bp, Homo sapiens
tccaaggagaaacagagac

SEQ ID NO: 5943205 - DNA, 23 bp, Homo sapiens
tccaaggagaaacagagacaggc

SEQ ID NO: 5943206 - DNA, 14 bp, Homo sapiens
tccaaggagaccaa

SEQ ID NO: 5943207 - DNA, 23 bp, Homo sapiens
tccaaggagaccaagtcctggct

SEQ ID NO: 5943208 - DNA, 19 bp, Homo sapiens
tccaaggagctgagaatag

SEQ ID NO: 5943209 - DNA, 23 bp, Homo sapiens
tccaaggagctgagaatagaagg

SEQ ID NO: 5943210 - DNA, 12 bp, Homo sapiens
tccaaggagttc

SEQ ID NO: 5943211 - DNA, 15 bp, Homo sapiens
tccaaggcaaacaat

SEQ ID NO: 5943212 - DNA, 14 bp, Homo sapiens
tccaaggcaaatgt

SEQ ID NO: 5943213 - DNA, 15 bp, Homo sapiens
tccaaggcaaatgtc

SEQ ID NO: 5943214 - DNA, 18 bp, Homo sapiens
tccaaggcaaatgtccaa

SEQ ID NO: 5943215 - DNA, 23 bp, Homo sapiens
tccaaggcagaagcagcagggga

SEQ ID NO: 5943216 - DNA, 14 bp, Homo sapiens
tccaaggcagtgga

SEQ ID NO: 5943217 - DNA, 17 bp, Homo sapiens
tccaaggcagttctgtg

SEQ ID NO: 5943218 - DNA, 21 bp, Homo sapiens
tccaaggcagttctgtgtcct

SEQ ID NO: 5943219 - DNA, 17 bp, Homo sapiens
tccaaggccagaaggag

SEQ ID NO: 5943220 - DNA, 19 bp, Homo sapiens
tccaaggccagaaggaggg

SEQ ID NO: 5943221 - DNA, 20 bp, Homo sapiens
tccaaggccagaaggagggg

SEQ ID NO: 5943222 - DNA, 12 bp, Homo sapiens
tccaaggccagt

SEQ ID NO: 5943223 - DNA, 12 bp, Homo sapiens
tccaaggccctg

SEQ ID NO: 5943224 - DNA, 23 bp, Homo sapiens
tccaaggccctgctttttttctt

SEQ ID NO: 5943225 - DNA, 18 bp, Homo sapiens
tccaaggccgcggcccag

SEQ ID NO: 5943226 - DNA, 15 bp, Homo sapiens
tccaaggctggtccc

SEQ ID NO: 5943227 - DNA, 13 bp, Homo sapiens
tccaaggctgtct

SEQ ID NO: 5943228 - DNA, 21 bp, Homo sapiens
tccaaggctttaaagctgaga

SEQ ID NO: 5943229 - DNA, 17 bp, Homo sapiens
tccaagggacagcccac

SEQ ID NO: 5943230 - DNA, 23 bp, Homo sapiens
tccaagggacaggtgggcctggc

SEQ ID NO: 5943231 - DNA, 17 bp, Homo sapiens
tccaagggcccagaggg

SEQ ID NO: 5943232 - DNA, 22 bp, Homo sapiens
tccaagggcccggtttcccggc

SEQ ID NO: 5943233 - DNA, 15 bp, Homo sapiens
tccaagggccgtgcc

SEQ ID NO: 5943234 - DNA, 18 bp, Homo sapiens
tccaagggccgtgccctt

SEQ ID NO: 5943235 - DNA, 21 bp, Homo sapiens
tccaagggccgtgcccttgcc

SEQ ID NO: 5943236 - DNA, 22 bp, Homo sapiens
tccaagggcttctgcaccctcc

SEQ ID NO: 5943237 - DNA, 21 bp, Homo sapiens
tccaaggggaatcagaactca

SEQ ID NO: 5943238 - DNA, 21 bp, Homo sapiens
tccaagggtatgggaagccat

SEQ ID NO: 5943239 - DNA, 22 bp, Homo sapiens
tccaagggtatgggaagccata

SEQ ID NO: 5943240 - DNA, 14 bp, Homo sapiens
tccaagggtttcga

SEQ ID NO: 5943241 - DNA, 21 bp, Homo sapiens
tccaagggtttcgactggtcc

SEQ ID NO: 5943242 - DNA, 22 bp, Homo sapiens
tccaagggtttcgactggtcca

SEQ ID NO: 5943243 - DNA, 14 bp, Homo sapiens
tccaaggtggcaga

SEQ ID NO: 5943244 - DNA, 15 bp, Homo sapiens
tccaaggtggtctgc

SEQ ID NO: 5943245 - DNA, 21 bp, Homo sapiens
tccaaggtttataaagcagat

SEQ ID NO: 5943246 - DNA, 19 bp, Homo sapiens
tccaagtaaagatgtcaat

SEQ ID NO: 5943247 - DNA, 16 bp, Homo sapiens
tccaagtaccaatgct

SEQ ID NO: 5943248 - DNA, 22 bp, Homo sapiens
tccaagtatatcagctactgta

SEQ ID NO: 5943249 - DNA, 13 bp, Homo sapiens
tccaagtatttta

SEQ ID NO: 5943250 - DNA, 14 bp, Homo sapiens
tccaagtcaacact

SEQ ID NO: 5943251 - DNA, 16 bp, Homo sapiens
tccaagtcacaaagag

SEQ ID NO: 5943252 - DNA, 18 bp, Homo sapiens
tccaagtccaacctgcct

SEQ ID NO: 5943253 - DNA, 20 bp, Homo sapiens
tccaagtccaacctgcctgt

SEQ ID NO: 5943254 - DNA, 12 bp, Homo sapiens
tccaagtccttt

SEQ ID NO: 5943255 - DNA, 22 bp, Homo sapiens
tccaagtcctttaactcgttgc

SEQ ID NO: 5943256 - DNA, 14 bp, Homo sapiens
tccaagtcctttat

SEQ ID NO: 5943257 - DNA, 13 bp, Homo sapiens
tccaagtctagct

SEQ ID NO: 5943258 - DNA, 18 bp, Homo sapiens
tccaagtctctctgtgaa

SEQ ID NO: 5943259 - DNA, 19 bp, Homo sapiens
tccaagtctgtacctcaaa

SEQ ID NO: 5943260 - DNA, 23 bp, Homo sapiens
tccaagtctttcttcttttttaa

SEQ ID NO: 5943261 - DNA, 21 bp, Homo sapiens
tccaagtgatcctcccacctc

SEQ ID NO: 5943262 - DNA, 15 bp, Homo sapiens
tccaagtgccaatat

SEQ ID NO: 5943263 - DNA, 18 bp, Homo sapiens
tccaagtgccagaggtgg

SEQ ID NO: 5943264 - DNA, 13 bp, Homo sapiens
tccaagtgcccca

SEQ ID NO: 5943265 - DNA, 15 bp, Homo sapiens
tccaagtgccccacc

SEQ ID NO: 5943266 - DNA, 21 bp, Homo sapiens
tccaagtgccccaccactccc

SEQ ID NO: 5943267 - DNA, 22 bp, Homo sapiens
tccaagtgccccctcacctctc

SEQ ID NO: 5943268 - DNA, 19 bp, Homo sapiens
tccaagtggacggcagacc

SEQ ID NO: 5943269 - DNA, 16 bp, Homo sapiens
tccaagtgtataatgt

SEQ ID NO: 5943270 - DNA, 20 bp, Homo sapiens
tccaagtgtataatgttggt

SEQ ID NO: 5943271 - DNA, 11 bp, Homo sapiens
tccaagtgtgc

SEQ ID NO: 5943272 - DNA, 13 bp, Homo sapiens
tccaagtgtgcat

SEQ ID NO: 5943273 - DNA, 18 bp, Homo sapiens
tccaagtgtgtgtgcaat

SEQ ID NO: 5943274 - DNA, 20 bp, Homo sapiens
tccaagtgttataccaacta

SEQ ID NO: 5943275 - DNA, 15 bp, Homo sapiens
tccaagtgtttcttg

SEQ ID NO: 5943276 - DNA, 13 bp, Homo sapiens
tccaagttcaaaa

SEQ ID NO: 5943277 - DNA, 18 bp, Homo sapiens
tccaagttcattcatact

SEQ ID NO: 5943278 - DNA, 14 bp, Homo sapiens
tccaagttcctgca

SEQ ID NO: 5943279 - DNA, 19 bp, Homo sapiens
tccaagttcctgcactcca

SEQ ID NO: 5943280 - DNA, 22 bp, Homo sapiens
tccaagttcctgcactccagaa

SEQ ID NO: 5943281 - DNA, 23 bp, Homo sapiens
tccaagttcctgcactccagaat

SEQ ID NO: 5943282 - DNA, 16 bp, Homo sapiens
tccaagttggactggg

SEQ ID NO: 5943283 - DNA, 17 bp, Homo sapiens
tccaagttgttcgggcc

SEQ ID NO: 5943284 - DNA, 18 bp, Homo sapiens
tccaagtttgacttgtat

SEQ ID NO: 5943285 - DNA, 23 bp, Homo sapiens
tccaataaaaatcaggagcctgc

SEQ ID NO: 5943286 - DNA, 14 bp, Homo sapiens
tccaataaaccagg

SEQ ID NO: 5943287 - DNA, 19 bp, Homo sapiens
tccaataaagtgccttctg

SEQ ID NO: 5943288 - DNA, 20 bp, Homo sapiens
tccaataaagtgccttctgg

SEQ ID NO: 5943289 - DNA, 23 bp, Homo sapiens
tccaataaagtgccttctgggct

SEQ ID NO: 5943290 - DNA, 23 bp, Homo sapiens
tccaataaatgtgaaattctgtc

SEQ ID NO: 5943291 - DNA, 14 bp, Homo sapiens
tccaataactagtg

SEQ ID NO: 5943292 - DNA, 21 bp, Homo sapiens
tccaataattttcctgtgaca

SEQ ID NO: 5943293 - DNA, 15 bp, Homo sapiens
tccaataccctagaa

SEQ ID NO: 5943294 - DNA, 13 bp, Homo sapiens
tccaatagaaaga

SEQ ID NO: 5943295 - DNA, 19 bp, Homo sapiens
tccaataggaatgctaaca

SEQ ID NO: 5943296 - DNA, 19 bp, Homo sapiens
tccaatagttagatctacc

SEQ ID NO: 5943297 - DNA, 15 bp, Homo sapiens
tccaatatcatgtct

SEQ ID NO: 5943298 - DNA, 23 bp, Homo sapiens
tccaatatcatgtcttgtgcata

SEQ ID NO: 5943299 - DNA, 15 bp, Homo sapiens
tccaatatgaaaacc

SEQ ID NO: 5943300 - DNA, 17 bp, Homo sapiens
tccaatatgtgattttt

SEQ ID NO: 5943301 - DNA, 14 bp, Homo sapiens
tccaatatttataa

SEQ ID NO: 5943302 - DNA, 20 bp, Homo sapiens
tccaatatttataattaaag

SEQ ID NO: 5943303 - DNA, 21 bp, Homo sapiens
tccaatatttataattaaaga

SEQ ID NO: 5943304 - DNA, 23 bp, Homo sapiens
tccaatatttataattaaagaaa

SEQ ID NO: 5943305 - DNA, 11 bp, Homo sapiens
tccaatatttg

SEQ ID NO: 5943306 - DNA, 16 bp, Homo sapiens
tccaatattttgcctt

SEQ ID NO: 5943307 - DNA, 19 bp, Homo sapiens
tccaatcaatcttgcatgt

SEQ ID NO: 5943308 - DNA, 20 bp, Homo sapiens
tccaatcaatttaaatgttt

SEQ ID NO: 5943309 - DNA, 22 bp, Homo sapiens
tccaatcaatttaaatgtttac

SEQ ID NO: 5943310 - DNA, 22 bp, Homo sapiens
tccaatcactgtgcttaattta

SEQ ID NO: 5943311 - DNA, 14 bp, Homo sapiens
tccaatcagagaat

SEQ ID NO: 5943312 - DNA, 20 bp, Homo sapiens
tccaatcagagaccaggccc

SEQ ID NO: 5943313 - DNA, 23 bp, Homo sapiens
tccaatcccatctattctctgcc

SEQ ID NO: 5943314 - DNA, 14 bp, Homo sapiens
tccaatccccactc

SEQ ID NO: 5943315 - DNA, 22 bp, Homo sapiens
tccaatcctggctctgtggctt

SEQ ID NO: 5943316 - DNA, 15 bp, Homo sapiens
tccaatctcaaggaa

SEQ ID NO: 5943317 - DNA, 13 bp, Homo sapiens
tccaatctctggt

SEQ ID NO: 5943318 - DNA, 14 bp, Homo sapiens
tccaatctgtaatt

SEQ ID NO: 5943319 - DNA, 13 bp, Homo sapiens
tccaatcttgctt

SEQ ID NO: 5943320 - DNA, 14 bp, Homo sapiens
tccaatcttgcttt

SEQ ID NO: 5943321 - DNA, 17 bp, Homo sapiens
tccaatcttgctttgtg

SEQ ID NO: 5943322 - DNA, 18 bp, Homo sapiens
tccaatcttgtttccaaa

SEQ ID NO: 5943323 - DNA, 11 bp, Homo sapiens
tccaatgaaat

SEQ ID NO: 5943324 - DNA, 13 bp, Homo sapiens
tccaatgaagata

SEQ ID NO: 5943325 - DNA, 14 bp, Homo sapiens
tccaatgagctttc

SEQ ID NO: 5943326 - DNA, 15 bp, Homo sapiens
tccaatgagctttct

SEQ ID NO: 5943327 - DNA, 18 bp, Homo sapiens
tccaatgagctttctgaa

SEQ ID NO: 5943328 - DNA, 14 bp, Homo sapiens
tccaatgcacagtt

SEQ ID NO: 5943329 - DNA, 17 bp, Homo sapiens
tccaatgcactgatgtg

SEQ ID NO: 5943330 - DNA, 15 bp, Homo sapiens
tccaatgcattggcc

SEQ ID NO: 5943331 - DNA, 17 bp, Homo sapiens
tccaatgccacctagac

SEQ ID NO: 5943332 - DNA, 19 bp, Homo sapiens
tccaatgcttctgcatact

SEQ ID NO: 5943333 - DNA, 20 bp, Homo sapiens
tccaatggaaagcttttcag

SEQ ID NO: 5943334 - DNA, 16 bp, Homo sapiens
tccaatggctgtaaac

SEQ ID NO: 5943335 - DNA, 19 bp, Homo sapiens
tccaatggctgtaaactat

SEQ ID NO: 5943336 - DNA, 20 bp, Homo sapiens
tccaatggctgtaaactata

SEQ ID NO: 5943337 - DNA, 15 bp, Homo sapiens
tccaatggggcgggg

SEQ ID NO: 5943338 - DNA, 17 bp, Homo sapiens
tccaatgtcctgaaaca

SEQ ID NO: 5943339 - DNA, 16 bp, Homo sapiens
tccaatgtctggagac

SEQ ID NO: 5943340 - DNA, 17 bp, Homo sapiens
tccaatgtctggagacc

SEQ ID NO: 5943341 - DNA, 23 bp, Homo sapiens
tccaatgtctggagaccaccagg

SEQ ID NO: 5943342 - DNA, 11 bp, Homo sapiens
tccaatgtgaa

SEQ ID NO: 5943343 - DNA, 21 bp, Homo sapiens
tccaatgtgaaagattattta

SEQ ID NO: 5943344 - DNA, 17 bp, Homo sapiens
tccaatgtgcccagtca

SEQ ID NO: 5943345 - DNA, 20 bp, Homo sapiens
tccaatgtggtggcaataaa

SEQ ID NO: 5943346 - DNA, 22 bp, Homo sapiens
tccaatgtggttggtcaaatca

SEQ ID NO: 5943347 - DNA, 11 bp, Homo sapiens
tccaatgtgtt

SEQ ID NO: 5943348 - DNA, 14 bp, Homo sapiens
tccaatgttgttca

SEQ ID NO: 5943349 - DNA, 16 bp, Homo sapiens
tccaattaaaattaag

SEQ ID NO: 5943350 - DNA, 21 bp, Homo sapiens
tccaattaaatttattttact

SEQ ID NO: 5943351 - DNA, 15 bp, Homo sapiens
tccaattaaggattt

SEQ ID NO: 5943352 - DNA, 16 bp, Homo sapiens
tccaattaatgattca

SEQ ID NO: 5943353 - DNA, 21 bp, Homo sapiens
tccaattaattagtaaggatt

SEQ ID NO: 5943354 - DNA, 23 bp, Homo sapiens
tccaattagtttcctttttaata

SEQ ID NO: 5943355 - DNA, 14 bp, Homo sapiens
tccaattatgaaac

SEQ ID NO: 5943356 - DNA, 20 bp, Homo sapiens
tccaattatgcactggccac

SEQ ID NO: 5943357 - DNA, 16 bp, Homo sapiens
tccaattatgtgacaa

SEQ ID NO: 5943358 - DNA, 19 bp, Homo sapiens
tccaattatgtgacaacct

SEQ ID NO: 5943359 - DNA, 21 bp, Homo sapiens
tccaattcaaaaataaattag

SEQ ID NO: 5943360 - DNA, 19 bp, Homo sapiens
tccaattcattatgtcaat

SEQ ID NO: 5943361 - DNA, 11 bp, Homo sapiens
tccaattccaa

SEQ ID NO: 5943362 - DNA, 22 bp, Homo sapiens
tccaattcccaccactaaaaaa

SEQ ID NO: 5943363 - DNA, 13 bp, Homo sapiens
tccaattccccct

SEQ ID NO: 5943364 - DNA, 22 bp, Homo sapiens
tccaattctaaatccgacttga

SEQ ID NO: 5943365 - DNA, 13 bp, Homo sapiens
tccaattgatgta

SEQ ID NO: 5943366 - DNA, 16 bp, Homo sapiens
tccaattgatgtatat

SEQ ID NO: 5943367 - DNA, 18 bp, Homo sapiens
tccaatttctattaaagg

SEQ ID NO: 5943368 - DNA, 18 bp, Homo sapiens
tccaatttgtaagtaaca

SEQ ID NO: 5943369 - DNA, 17 bp, Homo sapiens
tccaattttaaaatgaa

SEQ ID NO: 5943370 - DNA, 17 bp, Homo sapiens
tccaattttaatttagt

SEQ ID NO: 5943371 - DNA, 18 bp, Homo sapiens
tccaattttctggaatac

SEQ ID NO: 5943372 - DNA, 15 bp, Homo sapiens
tccacaaaagaagtg

SEQ ID NO: 5943373 - DNA, 20 bp, Homo sapiens
tccacaaaataaccaatcct

SEQ ID NO: 5943374 - DNA, 13 bp, Homo sapiens
tccacaaacacat

SEQ ID NO: 5943375 - DNA, 20 bp, Homo sapiens
tccacaaagaaaattcctat

SEQ ID NO: 5943376 - DNA, 16 bp, Homo sapiens
tccacaaagccgtgcc

SEQ ID NO: 5943377 - DNA, 20 bp, Homo sapiens
tccacaaagccgtgcctttc

SEQ ID NO: 5943378 - DNA, 15 bp, Homo sapiens
tccacaaatatgagt

SEQ ID NO: 5943379 - DNA, 12 bp, Homo sapiens
tccacaaatgtc

SEQ ID NO: 5943380 - DNA, 14 bp, Homo sapiens
tccacaaattatta

SEQ ID NO: 5943381 - DNA, 21 bp, Homo sapiens
tccacaacactgtgtcacatc

SEQ ID NO: 5943382 - DNA, 16 bp, Homo sapiens
tccacaacagcctggg

SEQ ID NO: 5943383 - DNA, 18 bp, Homo sapiens
tccacaactcagtttcat

SEQ ID NO: 5943384 - DNA, 16 bp, Homo sapiens
tccacaagagcccagg

SEQ ID NO: 5943385 - DNA, 17 bp, Homo sapiens
tccacaagagcccaggc

SEQ ID NO: 5943386 - DNA, 18 bp, Homo sapiens
tccacaagagcccaggcc

SEQ ID NO: 5943387 - DNA, 23 bp, Homo sapiens
tccacaagattcccagagacagg

SEQ ID NO: 5943388 - DNA, 23 bp, Homo sapiens
tccacaagcaatggacctttggg

SEQ ID NO: 5943389 - DNA, 21 bp, Homo sapiens
tccacaagtgccgcaaattgt

SEQ ID NO: 5943390 - DNA, 16 bp, Homo sapiens
tccacaatgactgctt

SEQ ID NO: 5943391 - DNA, 14 bp, Homo sapiens
tccacaattcttct

SEQ ID NO: 5943392 - DNA, 15 bp, Homo sapiens
tccacaattcttctg

SEQ ID NO: 5943393 - DNA, 14 bp, Homo sapiens
tccacacaaaatgt

SEQ ID NO: 5943394 - DNA, 15 bp, Homo sapiens
tccacacaaaatgtc

SEQ ID NO: 5943395 - DNA, 20 bp, Homo sapiens
tccacacaaagattttctaa

SEQ ID NO: 5943396 - DNA, 22 bp, Homo sapiens
tccacacaagacagcagagcca

SEQ ID NO: 5943397 - DNA, 15 bp, Homo sapiens
tccacacaagggaag

SEQ ID NO: 5943398 - DNA, 18 bp, Homo sapiens
tccacacaagggaaggac

SEQ ID NO: 5943399 - DNA, 18 bp, Homo sapiens
tccacacacagcagctcc

SEQ ID NO: 5943400 - DNA, 20 bp, Homo sapiens
tccacacacagctgggctgt

SEQ ID NO: 5943401 - DNA, 15 bp, Homo sapiens
tccacacacgcagga

SEQ ID NO: 5943402 - DNA, 14 bp, Homo sapiens
tccacacagaactg

SEQ ID NO: 5943403 - DNA, 19 bp, Homo sapiens
tccacacagcagtgtcccc

SEQ ID NO: 5943404 - DNA, 19 bp, Homo sapiens
tccacacagtgctcaaggc

SEQ ID NO: 5943405 - DNA, 17 bp, Homo sapiens
tccacacatgaatctgc

SEQ ID NO: 5943406 - DNA, 14 bp, Homo sapiens
tccacacatttaaa

SEQ ID NO: 5943407 - DNA, 15 bp, Homo sapiens
tccacacatttaaaa

SEQ ID NO: 5943408 - DNA, 17 bp, Homo sapiens
tccacaccaagcagcaa

SEQ ID NO: 5943409 - DNA, 18 bp, Homo sapiens
tccacaccactgttgcct

SEQ ID NO: 5943410 - DNA, 20 bp, Homo sapiens
tccacaccactgttgccttt

SEQ ID NO: 5943411 - DNA, 21 bp, Homo sapiens
tccacaccagctgctgctgga

SEQ ID NO: 5943412 - DNA, 18 bp, Homo sapiens
tccacacccaatgctgct

SEQ ID NO: 5943413 - DNA, 21 bp, Homo sapiens
tccacacccaatgctgctcca

SEQ ID NO: 5943414 - DNA, 23 bp, Homo sapiens
tccacacccaccccctctggaga

SEQ ID NO: 5943415 - DNA, 14 bp, Homo sapiens
tccacacccagcct

SEQ ID NO: 5943416 - DNA, 21 bp, Homo sapiens
tccacacccagcctgtcccac

SEQ ID NO: 5943417 - DNA, 13 bp, Homo sapiens
tccacacccccac

SEQ ID NO: 5943418 - DNA, 16 bp, Homo sapiens
tccacacccgtgagaa

SEQ ID NO: 5943419 - DNA, 12 bp, Homo sapiens
tccacaccctct

SEQ ID NO: 5943420 - DNA, 17 bp, Homo sapiens
tccacaccctctccttg

SEQ ID NO: 5943421 - DNA, 19 bp, Homo sapiens
tccacacctccacccgtcc

SEQ ID NO: 5943422 - DNA, 21 bp, Homo sapiens
tccacacctccacccgtcctg

SEQ ID NO: 5943423 - DNA, 14 bp, Homo sapiens
tccacacctgcggc

SEQ ID NO: 5943424 - DNA, 14 bp, Homo sapiens
tccacactagaaag

SEQ ID NO: 5943425 - DNA, 15 bp, Homo sapiens
tccacactagaaaga

SEQ ID NO: 5943426 - DNA, 16 bp, Homo sapiens
tccacactatgtgtgt

SEQ ID NO: 5943427 - DNA, 17 bp, Homo sapiens
tccacactatgtgtgtt

SEQ ID NO: 5943428 - DNA, 23 bp, Homo sapiens
tccacactatgtgtgttgtttcc

SEQ ID NO: 5943429 - DNA, 23 bp, Homo sapiens
tccacactcagaaaattccctgg

SEQ ID NO: 5943430 - DNA, 13 bp, Homo sapiens
tccacactccact

SEQ ID NO: 5943431 - DNA, 15 bp, Homo sapiens
tccacactccactga

SEQ ID NO: 5943432 - DNA, 13 bp, Homo sapiens
tccacactgacca

SEQ ID NO: 5943433 - DNA, 14 bp, Homo sapiens
tccacactgtcaaa

SEQ ID NO: 5943434 - DNA, 18 bp, Homo sapiens
tccacagaaaccctgttt

SEQ ID NO: 5943435 - DNA, 19 bp, Homo sapiens
tccacagaaaccctgtttt

SEQ ID NO: 5943436 - DNA, 20 bp, Homo sapiens
tccacagaaaccctgtttta

SEQ ID NO: 5943437 - DNA, 17 bp, Homo sapiens
tccacagaacctttgtc

SEQ ID NO: 5943438 - DNA, 10 bp, Homo sapiens
tccacagacg

SEQ ID NO: 5943439 - DNA, 22 bp, Homo sapiens
tccacagacggaagggtaaaca

SEQ ID NO: 5943440 - DNA, 19 bp, Homo sapiens
tccacagaggacacagaga

SEQ ID NO: 5943441 - DNA, 17 bp, Homo sapiens
tccacagagtaagacat

SEQ ID NO: 5943442 - DNA, 20 bp, Homo sapiens
tccacagagtgagccagtga

SEQ ID NO: 5943443 - DNA, 15 bp, Homo sapiens
tccacagattgtttc

SEQ ID NO: 5943444 - DNA, 17 bp, Homo sapiens
tccacagattgtttcta

SEQ ID NO: 5943445 - DNA, 22 bp, Homo sapiens
tccacagattgtttctatacaa

SEQ ID NO: 5943446 - DNA, 19 bp, Homo sapiens
tccacagcaaccccaggct

SEQ ID NO: 5943447 - DNA, 14 bp, Homo sapiens
tccacagccatccc

SEQ ID NO: 5943448 - DNA, 22 bp, Homo sapiens
tccacagccatcccagccttgg

SEQ ID NO: 5943449 - DNA, 14 bp, Homo sapiens
tccacagccgcagc

SEQ ID NO: 5943450 - DNA, 16 bp, Homo sapiens
tccacagccgcagcct

SEQ ID NO: 5943451 - DNA, 17 bp, Homo sapiens
tccacagccgcagcctc

SEQ ID NO: 5943452 - DNA, 14 bp, Homo sapiens
tccacagccttgca

SEQ ID NO: 5943453 - DNA, 20 bp, Homo sapiens
tccacagccttgcagcggct

SEQ ID NO: 5943454 - DNA, 18 bp, Homo sapiens
tccacagcgagggcagct

SEQ ID NO: 5943455 - DNA, 20 bp, Homo sapiens
tccacagcgagggcagctgc

SEQ ID NO: 5943456 - DNA, 21 bp, Homo sapiens
tccacagcgagggcagctgct

SEQ ID NO: 5943457 - DNA, 19 bp, Homo sapiens
tccacagcggaggagacca

SEQ ID NO: 5943458 - DNA, 22 bp, Homo sapiens
tccacagcggaggagaccagct

SEQ ID NO: 5943459 - DNA, 12 bp, Homo sapiens
tccacagctgca

SEQ ID NO: 5943460 - DNA, 13 bp, Homo sapiens
tccacagctgcag

SEQ ID NO: 5943461 - DNA, 14 bp, Homo sapiens
tccacagctgcagc

SEQ ID NO: 5943462 - DNA, 18 bp, Homo sapiens
tccacagctgcagcccat

SEQ ID NO: 5943463 - DNA, 14 bp, Homo sapiens
tccacagctgccct

SEQ ID NO: 5943464 - DNA, 15 bp, Homo sapiens
tccacagctggaaag

SEQ ID NO: 5943465 - DNA, 13 bp, Homo sapiens
tccacagcttcct

SEQ ID NO: 5943466 - DNA, 12 bp, Homo sapiens
tccacaggacac

SEQ ID NO: 5943467 - DNA, 20 bp, Homo sapiens
tccacaggagggcatccctg

SEQ ID NO: 5943468 - DNA, 12 bp, Homo sapiens
tccacaggatat

SEQ ID NO: 5943469 - DNA, 18 bp, Homo sapiens
tccacaggcaaaactcag

SEQ ID NO: 5943470 - DNA, 19 bp, Homo sapiens
tccacagggctcctgaagg

SEQ ID NO: 5943471 - DNA, 20 bp, Homo sapiens
tccacagggctcctgaagga

SEQ ID NO: 5943472 - DNA, 21 bp, Homo sapiens
tccacagggctcctgaaggaa

SEQ ID NO: 5943473 - DNA, 21 bp, Homo sapiens
tccacagggcttgttttccaa

SEQ ID NO: 5943474 - DNA, 16 bp, Homo sapiens
tccacaggggcaggcc

SEQ ID NO: 5943475 - DNA, 19 bp, Homo sapiens
tccacaggggcaggcctgg

SEQ ID NO: 5943476 - DNA, 22 bp, Homo sapiens
tccacaggggctatcccttctc

SEQ ID NO: 5943477 - DNA, 18 bp, Homo sapiens
tccacagggtcccacagc

SEQ ID NO: 5943478 - DNA, 21 bp, Homo sapiens
tccacagggtgggatgagcct

SEQ ID NO: 5943479 - DNA, 14 bp, Homo sapiens
tccacaggtctaga

SEQ ID NO: 5943480 - DNA, 15 bp, Homo sapiens
tccacaggtctagac

SEQ ID NO: 5943481 - DNA, 17 bp, Homo sapiens
tccacaggtctagacta

SEQ ID NO: 5943482 - DNA, 18 bp, Homo sapiens
tccacagtaatctttcgg

SEQ ID NO: 5943483 - DNA, 13 bp, Homo sapiens
tccacagtattgt

SEQ ID NO: 5943484 - DNA, 16 bp, Homo sapiens
tccacagtattgttct

SEQ ID NO: 5943485 - DNA, 17 bp, Homo sapiens
tccacagtattgttctt

SEQ ID NO: 5943486 - DNA, 22 bp, Homo sapiens
tccacagtattgttcttgtaaa

SEQ ID NO: 5943487 - DNA, 20 bp, Homo sapiens
tccacagtcccccacccacc

SEQ ID NO: 5943488 - DNA, 17 bp, Homo sapiens
tccacagtctcccattc

SEQ ID NO: 5943489 - DNA, 13 bp, Homo sapiens
tccacagtctctg

SEQ ID NO: 5943490 - DNA, 14 bp, Homo sapiens
tccacagtgactcc

SEQ ID NO: 5943491 - DNA, 18 bp, Homo sapiens
tccacagtgactgggccc

SEQ ID NO: 5943492 - DNA, 20 bp, Homo sapiens
tccacagtgcccagctaatt

SEQ ID NO: 5943493 - DNA, 12 bp, Homo sapiens
tccacagtggcg

SEQ ID NO: 5943494 - DNA, 18 bp, Homo sapiens
tccacagtggcgggccca

SEQ ID NO: 5943495 - DNA, 21 bp, Homo sapiens
tccacagtgttgtgccccttc

SEQ ID NO: 5943496 - DNA, 15 bp, Homo sapiens
tccacagttcagtgg

SEQ ID NO: 5943497 - DNA, 16 bp, Homo sapiens
tccacagttcagtggc

SEQ ID NO: 5943498 - DNA, 19 bp, Homo sapiens
tccacagttgccaccacct

SEQ ID NO: 5943499 - DNA, 20 bp, Homo sapiens
tccacagttgccaccacctc

SEQ ID NO: 5943500 - DNA, 12 bp, Homo sapiens
tccacataaagg

SEQ ID NO: 5943501 - DNA, 14 bp, Homo sapiens
tccacataaatgct

SEQ ID NO: 5943502 - DNA, 16 bp, Homo sapiens
tccacataaatgctcc

SEQ ID NO: 5943503 - DNA, 13 bp, Homo sapiens
tccacataaattt

SEQ ID NO: 5943504 - DNA, 14 bp, Homo sapiens
tccacataaatttt

SEQ ID NO: 5943505 - DNA, 21 bp, Homo sapiens
tccacataaattttaattcaa

SEQ ID NO: 5943506 - DNA, 12 bp, Homo sapiens
tccacatacact

SEQ ID NO: 5943507 - DNA, 16 bp, Homo sapiens
tccacatacactgcat

SEQ ID NO: 5943508 - DNA, 16 bp, Homo sapiens
tccacataggtttaga

SEQ ID NO: 5943509 - DNA, 17 bp, Homo sapiens
tccacatcccagcagcc

SEQ ID NO: 5943510 - DNA, 18 bp, Homo sapiens
tccacatcccatgttgaa

SEQ ID NO: 5943511 - DNA, 17 bp, Homo sapiens
tccacatccccaccttc

SEQ ID NO: 5943512 - DNA, 15 bp, Homo sapiens
tccacatccccagag

SEQ ID NO: 5943513 - DNA, 16 bp, Homo sapiens
tccacatccccagagc

SEQ ID NO: 5943514 - DNA, 17 bp, Homo sapiens
tccacatccccagagcc

SEQ ID NO: 5943515 - DNA, 16 bp, Homo sapiens
tccacatccccagctg

SEQ ID NO: 5943516 - DNA, 17 bp, Homo sapiens
tccacatccccagctgt

SEQ ID NO: 5943517 - DNA, 12 bp, Homo sapiens
tccacatcctct

SEQ ID NO: 5943518 - DNA, 17 bp, Homo sapiens
tccacatcctgtgggac

SEQ ID NO: 5943519 - DNA, 15 bp, Homo sapiens
tccacatcctgtgtc

SEQ ID NO: 5943520 - DNA, 15 bp, Homo sapiens
tccacatctgcatca

SEQ ID NO: 5943521 - DNA, 13 bp, Homo sapiens
tccacatctgcct

SEQ ID NO: 5943522 - DNA, 18 bp, Homo sapiens
tccacatctgccttaaaa

SEQ ID NO: 5943523 - DNA, 14 bp, Homo sapiens
tccacatcttctca

SEQ ID NO: 5943524 - DNA, 15 bp, Homo sapiens
tccacatcttctcag

SEQ ID NO: 5943525 - DNA, 13 bp, Homo sapiens
tccacatgacctc

SEQ ID NO: 5943526 - DNA, 15 bp, Homo sapiens
tccacatgacctcca

SEQ ID NO: 5943527 - DNA, 22 bp, Homo sapiens
tccacatgcacatgtattctgt

SEQ ID NO: 5943528 - DNA, 14 bp, Homo sapiens
tccacatgctctga

SEQ ID NO: 5943529 - DNA, 18 bp, Homo sapiens
tccacatgctgcctggca

SEQ ID NO: 5943530 - DNA, 16 bp, Homo sapiens
tccacttaaaatacat

SEQ ID NO: 5943531 - DNA, 19 bp, Homo sapiens
tccacttagagaacaaagg

SEQ ID NO: 5943532 - DNA, 20 bp, Homo sapiens
tccacttatagcctctgtct

SEQ ID NO: 5943533 - DNA, 23 bp, Homo sapiens
tccacttatagcctctgtctggc

SEQ ID NO: 5943534 - DNA, 14 bp, Homo sapiens
tccacttatgtaga

SEQ ID NO: 5943535 - DNA, 18 bp, Homo sapiens
tccacttatgtagacaaa

SEQ ID NO: 5943536 - DNA, 16 bp, Homo sapiens
tccacttcattttgta

SEQ ID NO: 5943537 - DNA, 23 bp, Homo sapiens
tccacttcatttttaagaaagga

SEQ ID NO: 5943538 - DNA, 15 bp, Homo sapiens
tccacttccagaggg

SEQ ID NO: 5943539 - DNA, 11 bp, Homo sapiens
tccacttccct

SEQ ID NO: 5943540 - DNA, 12 bp, Homo sapiens
tccacttccctc

SEQ ID NO: 5943541 - DNA, 16 bp, Homo sapiens
tccacttcccttagaa

SEQ ID NO: 5943542 - DNA, 17 bp, Homo sapiens
tccacttctaactccac

SEQ ID NO: 5943543 - DNA, 18 bp, Homo sapiens
tccacttctaactccact

SEQ ID NO: 5943544 - DNA, 20 bp, Homo sapiens
tccacttctctagagaacat

SEQ ID NO: 5943545 - DNA, 17 bp, Homo sapiens
tccacttctgacagcct

SEQ ID NO: 5943546 - DNA, 19 bp, Homo sapiens
tccacttctgacagcctca

SEQ ID NO: 5943547 - DNA, 16 bp, Homo sapiens
tccacttctggtataa

SEQ ID NO: 5943548 - DNA, 15 bp, Homo sapiens
tccacttctggtccc

SEQ ID NO: 5943549 - DNA, 21 bp, Homo sapiens
tccacttctggtcccctgtgg

SEQ ID NO: 5943550 - DNA, 18 bp, Homo sapiens
tccacttcttaatgcttt

SEQ ID NO: 5943551 - DNA, 18 bp, Homo sapiens
tccacttcttggttcctg

SEQ ID NO: 5943552 - DNA, 19 bp, Homo sapiens
tccacttcttggttcctgg

SEQ ID NO: 5943553 - DNA, 14 bp, Homo sapiens
tccacttgccaggg

SEQ ID NO: 5943554 - DNA, 17 bp, Homo sapiens
tccacttgccctgttct

SEQ ID NO: 5943555 - DNA, 20 bp, Homo sapiens
tccacttgcttgaagaccca

SEQ ID NO: 5943556 - DNA, 17 bp, Homo sapiens
tccacttggtctgtgag

SEQ ID NO: 5943557 - DNA, 21 bp, Homo sapiens
tccacttgttcattctgtgac

SEQ ID NO: 5943558 - DNA, 14 bp, Homo sapiens
tccacttgtttgca

SEQ ID NO: 5943559 - DNA, 16 bp, Homo sapiens
tccacttgtttgcact

SEQ ID NO: 5943560 - DNA, 17 bp, Homo sapiens
tccactttatcttgaat

SEQ ID NO: 5943561 - DNA, 14 bp, Homo sapiens
tccactttcagctg

SEQ ID NO: 5943562 - DNA, 15 bp, Homo sapiens
tccactttcagctgt

SEQ ID NO: 5943563 - DNA, 16 bp, Homo sapiens
tccactttcagctgtc

SEQ ID NO: 5943564 - DNA, 12 bp, Homo sapiens
tccactttcctc

SEQ ID NO: 5943565 - DNA, 13 bp, Homo sapiens
tccactttcctct

SEQ ID NO: 5943566 - DNA, 15 bp, Homo sapiens
tccactttcctctct

SEQ ID NO: 5943567 - DNA, 17 bp, Homo sapiens
tccactttcctctctct

SEQ ID NO: 5943568 - DNA, 18 bp, Homo sapiens
tccactttcctctctctc

SEQ ID NO: 5943569 - DNA, 17 bp, Homo sapiens
tccactttgtataaatt

SEQ ID NO: 5943570 - DNA, 18 bp, Homo sapiens
tccactttgtataaattt

SEQ ID NO: 5943571 - DNA, 12 bp, Homo sapiens
tccacttttgtt

SEQ ID NO: 5943572 - DNA, 20 bp, Homo sapiens
tccagaaaaatgaaaagcaa

SEQ ID NO: 5943573 - DNA, 13 bp, Homo sapiens
tccagaaaacaaa

SEQ ID NO: 5943574 - DNA, 14 bp, Homo sapiens
tccagaaaacaaaa

SEQ ID NO: 5943575 - DNA, 15 bp, Homo sapiens
tccagaaaactgtga

SEQ ID NO: 5943576 - DNA, 22 bp, Homo sapiens
tccagaaaatagggtggacaga

SEQ ID NO: 5943577 - DNA, 14 bp, Homo sapiens
tccagaaaatataa

SEQ ID NO: 5943578 - DNA, 16 bp, Homo sapiens
tccagaaaatataaat

SEQ ID NO: 5943579 - DNA, 18 bp, Homo sapiens
tccagaaaatataaatgc

SEQ ID NO: 5943580 - DNA, 23 bp, Homo sapiens
tccagaaaatataaatgcatgat

SEQ ID NO: 5943581 - DNA, 22 bp, Homo sapiens
tccagaaaatgtgtcagcatgc

SEQ ID NO: 5943582 - DNA, 15 bp, Homo sapiens
tccagaaacagctgc

SEQ ID NO: 5943583 - DNA, 14 bp, Homo sapiens
tccagaaaccaaac

SEQ ID NO: 5943584 - DNA, 18 bp, Homo sapiens
tccagaaactcctgtttc

SEQ ID NO: 5943585 - DNA, 20 bp, Homo sapiens
tccagaaacttgttcttcca

SEQ ID NO: 5943586 - DNA, 23 bp, Homo sapiens
tccagaaagaaaacttgtattat

SEQ ID NO: 5943587 - DNA, 18 bp, Homo sapiens
tccagaaagcaaggactg

SEQ ID NO: 5943588 - DNA, 18 bp, Homo sapiens
tccagaaagcaggagcag

SEQ ID NO: 5943589 - DNA, 20 bp, Homo sapiens
tccagaaagcaggagcagct

SEQ ID NO: 5943590 - DNA, 22 bp, Homo sapiens
tccagaaagcaggagcagctgt

SEQ ID NO: 5943591 - DNA, 20 bp, Homo sapiens
tccagaaagccccacccagg

SEQ ID NO: 5943592 - DNA, 23 bp, Homo sapiens
tccagaaaggatatttaagaaaa

SEQ ID NO: 5943593 - DNA, 16 bp, Homo sapiens
tccagaaatgtccctt

SEQ ID NO: 5943594 - DNA, 23 bp, Homo sapiens
tccagaaatgtctaaatgctgaa

SEQ ID NO: 5943595 - DNA, 18 bp, Homo sapiens
tccagaaattgtgtgtgc

SEQ ID NO: 5943596 - DNA, 16 bp, Homo sapiens
tccagaacacaacctt

SEQ ID NO: 5943597 - DNA, 15 bp, Homo sapiens
tccagaaccttactg

SEQ ID NO: 5943598 - DNA, 21 bp, Homo sapiens
tccagaaccttactggcactg

SEQ ID NO: 5943599 - DNA, 16 bp, Homo sapiens
tccagaacgtctctca

SEQ ID NO: 5943600 - DNA, 20 bp, Homo sapiens
tccagaacgtctctcaccta

SEQ ID NO: 5943601 - DNA, 22 bp, Homo sapiens
tccagaacgtctctcacctaga

SEQ ID NO: 5943602 - DNA, 22 bp, Homo sapiens
tccagaactcactggggcctac

SEQ ID NO: 5943603 - DNA, 16 bp, Homo sapiens
tccagaactcttcctc

SEQ ID NO: 5943604 - DNA, 16 bp, Homo sapiens
tccagaactgtcttag

SEQ ID NO: 5943605 - DNA, 20 bp, Homo sapiens
tccagaagaaattatttaat

SEQ ID NO: 5943606 - DNA, 23 bp, Homo sapiens
tccagaagaaattatttaatatg

SEQ ID NO: 5943607 - DNA, 15 bp, Homo sapiens
tccagaagaagagaa

SEQ ID NO: 5943608 - DNA, 17 bp, Homo sapiens
tccagaagaagagaagc

SEQ ID NO: 5943609 - DNA, 21 bp, Homo sapiens
tccagaagaagagaagctgct

SEQ ID NO: 5943610 - DNA, 18 bp, Homo sapiens
tccagaagaatattcagg

SEQ ID NO: 5943611 - DNA, 19 bp, Homo sapiens
tccagaagaatattcagga

SEQ ID NO: 5943612 - DNA, 16 bp, Homo sapiens
tccagaagaccccact

SEQ ID NO: 5943613 - DNA, 16 bp, Homo sapiens
tccagaagatgccagc

SEQ ID NO: 5943614 - DNA, 21 bp, Homo sapiens
tccagaagatgccagcttctc

SEQ ID NO: 5943615 - DNA, 11 bp, Homo sapiens
tccagaagcct

SEQ ID NO: 5943616 - DNA, 13 bp, Homo sapiens
tccagaagcctcc

SEQ ID NO: 5943617 - DNA, 20 bp, Homo sapiens
tccagaagcctccttacatt

SEQ ID NO: 5943618 - DNA, 18 bp, Homo sapiens
tccagaagcctctggcta

SEQ ID NO: 5943619 - DNA, 19 bp, Homo sapiens
tccagaagcctctggctag

SEQ ID NO: 5943620 - DNA, 17 bp, Homo sapiens
tccagaaggatttcttg

SEQ ID NO: 5943621 - DNA, 19 bp, Homo sapiens
tccagaaggatttcttgta

SEQ ID NO: 5943622 - DNA, 14 bp, Homo sapiens
tccagaaggcagca

SEQ ID NO: 5943623 - DNA, 16 bp, Homo sapiens
tccagaaggggagctt

SEQ ID NO: 5943624 - DNA, 21 bp, Homo sapiens
tccagaaggggtttggtctgg

SEQ ID NO: 5943625 - DNA, 19 bp, Homo sapiens
tccagaagtggggctctgg

SEQ ID NO: 5943626 - DNA, 17 bp, Homo sapiens
tccagaagtgtattcat

SEQ ID NO: 5943627 - DNA, 20 bp, Homo sapiens
tccagaagtgtgactggcta

SEQ ID NO: 5943628 - DNA, 18 bp, Homo sapiens
tccagaagttcaaaatca

SEQ ID NO: 5943629 - DNA, 12 bp, Homo sapiens
tccagaatatct

SEQ ID NO: 5943630 - DNA, 24 bp, Homo sapiens
tccagaatccacaaagccgtgcct

SEQ ID NO: 5943631 - DNA, 18 bp, Homo sapiens
tccagaatctaaagccag

SEQ ID NO: 5943632 - DNA, 16 bp, Homo sapiens
tccagaatctgctgtt

SEQ ID NO: 5943633 - DNA, 19 bp, Homo sapiens
tccagaatctgctgttgcc

SEQ ID NO: 5943634 - DNA, 17 bp, Homo sapiens
tccagaatcttgacttt

SEQ ID NO: 5943635 - DNA, 19 bp, Homo sapiens
tccagaatcttgactttct

SEQ ID NO: 5943636 - DNA, 17 bp, Homo sapiens
tccagaatgaccttgag

SEQ ID NO: 5943637 - DNA, 23 bp, Homo sapiens
tccagaatgctgaactccttgtt

SEQ ID NO: 5943638 - DNA, 21 bp, Homo sapiens
tccagaatgctgtacatctat

SEQ ID NO: 5943639 - DNA, 16 bp, Homo sapiens
tccagaatggggctta

SEQ ID NO: 5943640 - DNA, 12 bp, Homo sapiens
tccagaatgtaa

SEQ ID NO: 5943641 - DNA, 13 bp, Homo sapiens
tccagaatgtaag

SEQ ID NO: 5943642 - DNA, 18 bp, Homo sapiens
tccagaatgtaagaaaac

SEQ ID NO: 5943643 - DNA, 23 bp, Homo sapiens
tccagaatgtaagaaaacaaaat

SEQ ID NO: 5943644 - DNA, 15 bp, Homo sapiens
tccagaatgtgctgc

SEQ ID NO: 5943645 - DNA, 22 bp, Homo sapiens
tccagaattatgaggcattgag

SEQ ID NO: 5943646 - DNA, 18 bp, Homo sapiens
tccagaatttgaatatta

SEQ ID NO: 5943647 - DNA, 18 bp, Homo sapiens
tccagaatttggaaatcc

SEQ ID NO: 5943648 - DNA, 22 bp, Homo sapiens
tccagaatttggaaatcctagt

SEQ ID NO: 5943649 - DNA, 23 bp, Homo sapiens
tccagacaagccctgcttgctgg

SEQ ID NO: 5943650 - DNA, 13 bp, Homo sapiens
tccagacactttt

SEQ ID NO: 5943651 - DNA, 20 bp, Homo sapiens
tccagacagagtggatctgg

SEQ ID NO: 5943652 - DNA, 22 bp, Homo sapiens
tccagacagtcgctcagtctgt

SEQ ID NO: 5943653 - DNA, 20 bp, Homo sapiens
tccagacatacgaaacacaa

SEQ ID NO: 5943654 - DNA, 13 bp, Homo sapiens
tccagacatcatg

SEQ ID NO: 5943655 - DNA, 16 bp, Homo sapiens
tccagacattgtattt

SEQ ID NO: 5943656 - DNA, 16 bp, Homo sapiens
tccagaccaaaataat

SEQ ID NO: 5943657 - DNA, 14 bp, Homo sapiens
tccagaccacctgc

SEQ ID NO: 5943658 - DNA, 17 bp, Homo sapiens
tccagaccacctgccag

SEQ ID NO: 5943659 - DNA, 23 bp, Homo sapiens
tccagaccacctgccagccatca

SEQ ID NO: 5943660 - DNA, 16 bp, Homo sapiens
tccagaccattgtctt

SEQ ID NO: 5943661 - DNA, 18 bp, Homo sapiens
tccagaccattgtcttcc

SEQ ID NO: 5943662 - DNA, 13 bp, Homo sapiens
tccagacccaagt

SEQ ID NO: 5943663 - DNA, 17 bp, Homo sapiens
tccagacccccacccct

SEQ ID NO: 5943664 - DNA, 20 bp, Homo sapiens
tccagacccccaccccttcc

SEQ ID NO: 5943665 - DNA, 16 bp, Homo sapiens
tccagaccccccagcc

SEQ ID NO: 5943666 - DNA, 17 bp, Homo sapiens
tccagaccccccagccc

SEQ ID NO: 5943667 - DNA, 20 bp, Homo sapiens
tccagacccctaccctttcc

SEQ ID NO: 5943668 - DNA, 17 bp, Homo sapiens
tccagacccctggcttt

SEQ ID NO: 5943669 - DNA, 18 bp, Homo sapiens
tccagacccctggctttt

SEQ ID NO: 5943670 - DNA, 14 bp, Homo sapiens
tccagaccctgcct

SEQ ID NO: 5943671 - DNA, 17 bp, Homo sapiens
tccagaccctgcctgag

SEQ ID NO: 5943672 - DNA, 19 bp, Homo sapiens
tccagaccctgcctgagcc

SEQ ID NO: 5943673 - DNA, 20 bp, Homo sapiens
tccagaccctgcctgagccc

SEQ ID NO: 5943674 - DNA, 22 bp, Homo sapiens
tccagacctatatctggagtga

SEQ ID NO: 5943675 - DNA, 14 bp, Homo sapiens
tccagacctgagct

SEQ ID NO: 5943676 - DNA, 13 bp, Homo sapiens
tccagacctgatc

SEQ ID NO: 5943677 - DNA, 18 bp, Homo sapiens
tccagacctgatcctgga

SEQ ID NO: 5943678 - DNA, 22 bp, Homo sapiens
tccagacctgatcctggaggcc

SEQ ID NO: 5943679 - DNA, 20 bp, Homo sapiens
tccagacctgcttcctgaaa

SEQ ID NO: 5943680 - DNA, 21 bp, Homo sapiens
tccagacctgcttcctgaaat

SEQ ID NO: 5943681 - DNA, 22 bp, Homo sapiens
tccagacctgcttcctgaaata

SEQ ID NO: 5943682 - DNA, 21 bp, Homo sapiens
tccagacctggctccactctt

SEQ ID NO: 5943683 - DNA, 13 bp, Homo sapiens
tccagacctgggc

SEQ ID NO: 5943684 - DNA, 22 bp, Homo sapiens
tccagacgcactgatctttgca

SEQ ID NO: 5943685 - DNA, 18 bp, Homo sapiens
tccagacgtaggggaggg

SEQ ID NO: 5943686 - DNA, 18 bp, Homo sapiens
tccagactcagagctctc

SEQ ID NO: 5943687 - DNA, 19 bp, Homo sapiens
tccagactcaggttccaga

SEQ ID NO: 5943688 - DNA, 15 bp, Homo sapiens
tccagactgcggagc

SEQ ID NO: 5943689 - DNA, 16 bp, Homo sapiens
tccagactgcggagca

SEQ ID NO: 5943690 - DNA, 22 bp, Homo sapiens
tccagactgcttccaattttct

SEQ ID NO: 5943691 - DNA, 19 bp, Homo sapiens
tccagactgtaagatgttg

SEQ ID NO: 5943692 - DNA, 14 bp, Homo sapiens
tccagacttcgcta

SEQ ID NO: 5943693 - DNA, 23 bp, Homo sapiens
tccagacttcgctattcccaggc

SEQ ID NO: 5943694 - DNA, 14 bp, Homo sapiens
tccagactttctat

SEQ ID NO: 5943695 - DNA, 21 bp, Homo sapiens
tccagactttctattaatatt

SEQ ID NO: 5943696 - DNA, 17 bp, Homo sapiens
tccagagaaagcacaat

SEQ ID NO: 5943697 - DNA, 19 bp, Homo sapiens
tccagagaaagcacaattt

SEQ ID NO: 5943698 - DNA, 16 bp, Homo sapiens
tccagagaacacaggg

SEQ ID NO: 5943699 - DNA, 21 bp, Homo sapiens
tccagagaactgcagacctca

SEQ ID NO: 5943700 - DNA, 22 bp, Homo sapiens
tccagagaagccccgcacgggc

SEQ ID NO: 5943701 - DNA, 18 bp, Homo sapiens
tccagagaagcgctgttg

SEQ ID NO: 5943702 - DNA, 13 bp, Homo sapiens
tccagagacactg

SEQ ID NO: 5943703 - DNA, 20 bp, Homo sapiens
tccagagacactgagccagt

SEQ ID NO: 5943704 - DNA, 20 bp, Homo sapiens
tccagagacagggaaaggtc

SEQ ID NO: 5943705 - DNA, 14 bp, Homo sapiens
tccagagaccaaat

SEQ ID NO: 5943706 - DNA, 14 bp, Homo sapiens
tccagagaccacac

SEQ ID NO: 5943707 - DNA, 14 bp, Homo sapiens
tccagagacccctc

SEQ ID NO: 5943708 - DNA, 22 bp, Homo sapiens
tccagagagaagcaccccacca

SEQ ID NO: 5943709 - DNA, 22 bp, Homo sapiens
tccagagagaggatgcagaggg

SEQ ID NO: 5943710 - DNA, 17 bp, Homo sapiens
tccagagagcagctccc

SEQ ID NO: 5943711 - DNA, 18 bp, Homo sapiens
tccagagagcagctccct

SEQ ID NO: 5943712 - DNA, 24 bp, Homo sapiens
tccagagaggctggatgacttgct

SEQ ID NO: 5943713 - DNA, 18 bp, Homo sapiens
tccagagagtcctctgga

SEQ ID NO: 5943714 - DNA, 21 bp, Homo sapiens
tccagagagtggagagagcag

SEQ ID NO: 5943715 - DNA, 17 bp, Homo sapiens
tccagagagtggctcct

SEQ ID NO: 5943716 - DNA, 19 bp, Homo sapiens
tccagagataaaaatcata

SEQ ID NO: 5943717 - DNA, 18 bp, Homo sapiens
tccagagattcattttct

SEQ ID NO: 5943718 - DNA, 20 bp, Homo sapiens
tccagagcagagcctacaga

SEQ ID NO: 5943719 - DNA, 23 bp, Homo sapiens
tccagagcagagtttacgggtct

SEQ ID NO: 5943720 - DNA, 14 bp, Homo sapiens
tccagagccagcct

SEQ ID NO: 5943721 - DNA, 18 bp, Homo sapiens
tccagagccagcctggga

SEQ ID NO: 5943722 - DNA, 19 bp, Homo sapiens
tccagagccagcctgggac

SEQ ID NO: 5943723 - DNA, 14 bp, Homo sapiens
tccagagcccaagg

SEQ ID NO: 5943724 - DNA, 17 bp, Homo sapiens
tccagagccccacagcc

SEQ ID NO: 5943725 - DNA, 15 bp, Homo sapiens
tccagagcctgggcg

SEQ ID NO: 5943726 - DNA, 20 bp, Homo sapiens
tccagagcggaggctgtgtg

SEQ ID NO: 5943727 - DNA, 23 bp, Homo sapiens
tccagagcggaggctgtgtgcct

SEQ ID NO: 5943728 - DNA, 15 bp, Homo sapiens
tccagagctcatttc

SEQ ID NO: 5943729 - DNA, 23 bp, Homo sapiens
tccagagctctgacccacagcct

SEQ ID NO: 5943730 - DNA, 13 bp, Homo sapiens
tccagagctgcca

SEQ ID NO: 5943731 - DNA, 14 bp, Homo sapiens
tccagagctgcttc

SEQ ID NO: 5943732 - DNA, 16 bp, Homo sapiens
tccagagctgcttccc

SEQ ID NO: 5943733 - DNA, 18 bp, Homo sapiens
tccagagctgcttctgtc

SEQ ID NO: 5943734 - DNA, 17 bp, Homo sapiens
tccagagctggccaggc

SEQ ID NO: 5943735 - DNA, 18 bp, Homo sapiens
tccagagctgtcctcctg

SEQ ID NO: 5943736 - DNA, 22 bp, Homo sapiens
tccagagctgtcctcctggcac

SEQ ID NO: 5943737 - DNA, 21 bp, Homo sapiens
tccagaggaacaagcatgtct

SEQ ID NO: 5943738 - DNA, 15 bp, Homo sapiens
tccagaggacagctc

SEQ ID NO: 5943739 - DNA, 20 bp, Homo sapiens
tccagaggagagtggcctgg

SEQ ID NO: 5943740 - DNA, 21 bp, Homo sapiens
tccagaggagagtggcctggg

SEQ ID NO: 5943741 - DNA, 23 bp, Homo sapiens
tccagaggagagtggcctgggtc

SEQ ID NO: 5943742 - DNA, 12 bp, Homo sapiens
tccagaggaggt

SEQ ID NO: 5943743 - DNA, 16 bp, Homo sapiens
tccagaggaggtgccc

SEQ ID NO: 5943744 - DNA, 17 bp, Homo sapiens
tccagaggaggtgcccg

SEQ ID NO: 5943745 - DNA, 21 bp, Homo sapiens
tccagaggaggtgcccgggca

SEQ ID NO: 5943746 - DNA, 20 bp, Homo sapiens
tccagaggctattattttca

SEQ ID NO: 5943747 - DNA, 17 bp, Homo sapiens
tccagagggacagggtg

SEQ ID NO: 5943748 - DNA, 23 bp, Homo sapiens
tccagagggactggacagccagg

SEQ ID NO: 5943749 - DNA, 20 bp, Homo sapiens
tccagagggggccagaggga

SEQ ID NO: 5943750 - DNA, 15 bp, Homo sapiens
tccagaggtattcct

SEQ ID NO: 5943751 - DNA, 14 bp, Homo sapiens
tccagaggtgaggg

SEQ ID NO: 5943752 - DNA, 16 bp, Homo sapiens
tccagaggtggaggtg

SEQ ID NO: 5943753 - DNA, 14 bp, Homo sapiens
tccagagtagtttc

SEQ ID NO: 5943754 - DNA, 19 bp, Homo sapiens
tccagagtcaactgttccc

SEQ ID NO: 5943755 - DNA, 15 bp, Homo sapiens
tccagagtccctgcc

SEQ ID NO: 5943756 - DNA, 19 bp, Homo sapiens
tccagagtccctgcctgga

SEQ ID NO: 5943757 - DNA, 19 bp, Homo sapiens
tccagagtccggaggcagc

SEQ ID NO: 5943758 - DNA, 15 bp, Homo sapiens
tccagagtcctggcc

SEQ ID NO: 5943759 - DNA, 14 bp, Homo sapiens
tccagagtctgagc

SEQ ID NO: 5943760 - DNA, 20 bp, Homo sapiens
tccagagtgctgaggccagg

SEQ ID NO: 5943761 - DNA, 20 bp, Homo sapiens
tccagagtgtgcagactgat

SEQ ID NO: 5943762 - DNA, 22 bp, Homo sapiens
tccagagttctgtgacacatgc

SEQ ID NO: 5943763 - DNA, 18 bp, Homo sapiens
tccagataactctctttc

SEQ ID NO: 5943764 - DNA, 19 bp, Homo sapiens
tccagataactctctttcc

SEQ ID NO: 5943765 - DNA, 21 bp, Homo sapiens
tccagatagcctagggtgagg

SEQ ID NO: 5943766 - DNA, 22 bp, Homo sapiens
tccagatatccacataaatgct

SEQ ID NO: 5943767 - DNA, 22 bp, Homo sapiens
tccagatatgaacagggcccag

SEQ ID NO: 5943768 - DNA, 17 bp, Homo sapiens
tccagatcactgccaca

SEQ ID NO: 5943769 - DNA, 14 bp, Homo sapiens
tccagatccagact

SEQ ID NO: 5943770 - DNA, 19 bp, Homo sapiens
tccagatcccaggcccctg

SEQ ID NO: 5943771 - DNA, 23 bp, Homo sapiens
tccagatcccaggcccctggagg

SEQ ID NO: 5943772 - DNA, 15 bp, Homo sapiens
tccagatctgcactg

SEQ ID NO: 5943773 - DNA, 19 bp, Homo sapiens
tccagatcttgcctccaga

SEQ ID NO: 5943774 - DNA, 20 bp, Homo sapiens
tccagatcttgcctccagag

SEQ ID NO: 5943775 - DNA, 15 bp, Homo sapiens
tccagatgcagggca

SEQ ID NO: 5943776 - DNA, 16 bp, Homo sapiens
tccagatgcagggcag

SEQ ID NO: 5943777 - DNA, 14 bp, Homo sapiens
tccagatgcccgag

SEQ ID NO: 5943778 - DNA, 15 bp, Homo sapiens
tccagatggcaggct

SEQ ID NO: 5943779 - DNA, 21 bp, Homo sapiens
tccagatggtcatccagactc

SEQ ID NO: 5943780 - DNA, 19 bp, Homo sapiens
tccagatgtgatgcttgat

SEQ ID NO: 5943781 - DNA, 21 bp, Homo sapiens
tccagatgtggctactgacat

SEQ ID NO: 5943782 - DNA, 18 bp, Homo sapiens
tccagatgtttccagact

SEQ ID NO: 5943783 - DNA, 19 bp, Homo sapiens
tccagatgtttccagactt

SEQ ID NO: 5943784 - DNA, 15 bp, Homo sapiens
tccagatgtttctca

SEQ ID NO: 5943785 - DNA, 23 bp, Homo sapiens
tccagattatctatttgtgtgtg

SEQ ID NO: 5943786 - DNA, 18 bp, Homo sapiens
tccagattattggctgct

SEQ ID NO: 5943787 - DNA, 17 bp, Homo sapiens
tccagattattttctat

SEQ ID NO: 5943788 - DNA, 19 bp, Homo sapiens
tccagattattttctatat

SEQ ID NO: 5943789 - DNA, 22 bp, Homo sapiens
tccagattcagggagaatgttg

SEQ ID NO: 5943790 - DNA, 13 bp, Homo sapiens
tccagattcccag

SEQ ID NO: 5943791 - DNA, 20 bp, Homo sapiens
tccagattcccaggccaggc

SEQ ID NO: 5943792 - DNA, 17 bp, Homo sapiens
tccagattgaaaagtgt

SEQ ID NO: 5943793 - DNA, 20 bp, Homo sapiens
tccagattgaaaagtgtcct

SEQ ID NO: 5943794 - DNA, 12 bp, Homo sapiens
tccagattttta

SEQ ID NO: 5943795 - DNA, 20 bp, Homo sapiens
tccagcaaaatccaaactgc

SEQ ID NO: 5943796 - DNA, 23 bp, Homo sapiens
tccagcaaaatccaaactgctgt

SEQ ID NO: 5943797 - DNA, 15 bp, Homo sapiens
tccagcaaaatggaa

SEQ ID NO: 5943798 - DNA, 20 bp, Homo sapiens
tccagcaaaatggaagcaaa

SEQ ID NO: 5943799 - DNA, 16 bp, Homo sapiens
tccagcaacacagcct

SEQ ID NO: 5943800 - DNA, 14 bp, Homo sapiens
tccagcaataagaa

SEQ ID NO: 5943801 - DNA, 15 bp, Homo sapiens
tccagcaataagaaa

SEQ ID NO: 5943802 - DNA, 17 bp, Homo sapiens
tccagcaataagaaatg

SEQ ID NO: 5943803 - DNA, 19 bp, Homo sapiens
tccagcaataagaaatgaa

SEQ ID NO: 5943804 - DNA, 18 bp, Homo sapiens
tccagcaattctcctgcc

SEQ ID NO: 5943805 - DNA, 19 bp, Homo sapiens
tccagcacaaacacaaggt

SEQ ID NO: 5943806 - DNA, 22 bp, Homo sapiens
tccagcacatccccctctcctc

SEQ ID NO: 5943807 - DNA, 14 bp, Homo sapiens
tccagcaccacact

SEQ ID NO: 5943808 - DNA, 23 bp, Homo sapiens
tccagcaccatccgccagggccc

SEQ ID NO: 5943809 - DNA, 22 bp, Homo sapiens
tccagcaccttctttctggact

SEQ ID NO: 5943810 - DNA, 17 bp, Homo sapiens
tccagcacgttttctgg

SEQ ID NO: 5943811 - DNA, 20 bp, Homo sapiens
tccagcacgttttctggctt

SEQ ID NO: 5943812 - DNA, 23 bp, Homo sapiens
tccagcagaagacaaaaagacaa

SEQ ID NO: 5943813 - DNA, 14 bp, Homo sapiens
tccagcagaggtga

SEQ ID NO: 5943814 - DNA, 14 bp, Homo sapiens
tccagcagattatt

SEQ ID NO: 5943815 - DNA, 20 bp, Homo sapiens
tccagcagattattcactga

SEQ ID NO: 5943816 - DNA, 19 bp, Homo sapiens
tccagcagcacacctcagc

SEQ ID NO: 5943817 - DNA, 12 bp, Homo sapiens
tccagcagcagc

SEQ ID NO: 5943818 - DNA, 12 bp, Homo sapiens
tccagcagctgc

SEQ ID NO: 5943819 - DNA, 14 bp, Homo sapiens
tccagcagctgcac

SEQ ID NO: 5943820 - DNA, 12 bp, Homo sapiens
tccagcaggagg

SEQ ID NO: 5943821 - DNA, 17 bp, Homo sapiens
tccagcaggagggacag

SEQ ID NO: 5943822 - DNA, 16 bp, Homo sapiens
tccagcaggggtctcc

SEQ ID NO: 5943823 - DNA, 18 bp, Homo sapiens
tccagcaggtcacactgg

SEQ ID NO: 5943824 - DNA, 16 bp, Homo sapiens
tccagcagtgaaactt

SEQ ID NO: 5943825 - DNA, 20 bp, Homo sapiens
tccagcagtgaaacttgtgc

SEQ ID NO: 5943826 - DNA, 22 bp, Homo sapiens
tccagcagtgaaacttgtgcta

SEQ ID NO: 5943827 - DNA, 23 bp, Homo sapiens
tccagcagtgaaacttgtgctat

SEQ ID NO: 5943828 - DNA, 16 bp, Homo sapiens
tccagcagtgctgggc

SEQ ID NO: 5943829 - DNA, 19 bp, Homo sapiens
tccagcagtgctgggccca

SEQ ID NO: 5943830 - DNA, 19 bp, Homo sapiens
tccagcagtgttgctcagc

SEQ ID NO: 5943831 - DNA, 20 bp, Homo sapiens
tccagcagtgttgctcagct

SEQ ID NO: 5943832 - DNA, 23 bp, Homo sapiens
tccagcagtgttgctcagctcct

SEQ ID NO: 5943833 - DNA, 16 bp, Homo sapiens
tccagcagttaggcac

SEQ ID NO: 5943834 - DNA, 15 bp, Homo sapiens
tccagcatccagcct

SEQ ID NO: 5943835 - DNA, 17 bp, Homo sapiens
tccagcatccagcctgt

SEQ ID NO: 5943836 - DNA, 18 bp, Homo sapiens
tccagcatccagcctgtg

SEQ ID NO: 5943837 - DNA, 17 bp, Homo sapiens
tccagcatcccagcctc

SEQ ID NO: 5943838 - DNA, 24 bp, Homo sapiens
tccagcatcgtctcatgtaaaata

SEQ ID NO: 5943839 - DNA, 13 bp, Homo sapiens
tccagcatgtgtg

SEQ ID NO: 5943840 - DNA, 21 bp, Homo sapiens
tccagcattgttgagctgtca

SEQ ID NO: 5943841 - DNA, 21 bp, Homo sapiens
tccagcatttgccattcctgg

SEQ ID NO: 5943842 - DNA, 17 bp, Homo sapiens
tccagcatttttataaa

SEQ ID NO: 5943843 - DNA, 18 bp, Homo sapiens
tccagccaaacgggagct

SEQ ID NO: 5943844 - DNA, 14 bp, Homo sapiens
tccagccaaagcat

SEQ ID NO: 5943845 - DNA, 17 bp, Homo sapiens
tccagccaaagcatgcc

SEQ ID NO: 5943846 - DNA, 20 bp, Homo sapiens
tccagccaacccctgtggag

SEQ ID NO: 5943847 - DNA, 23 bp, Homo sapiens
tccagccaacccctgtggagccc

SEQ ID NO: 5943848 - DNA, 16 bp, Homo sapiens
tccagccaagagctct

SEQ ID NO: 5943849 - DNA, 22 bp, Homo sapiens
tccagccaagagctcttcatct

SEQ ID NO: 5943850 - DNA, 17 bp, Homo sapiens
tccagccacagaaaaga

SEQ ID NO: 5943851 - DNA, 23 bp, Homo sapiens
tccagccaccaaggctgcctgcc

SEQ ID NO: 5943852 - DNA, 11 bp, Homo sapiens
tccagccactt

SEQ ID NO: 5943853 - DNA, 23 bp, Homo sapiens
tccagccagcaatgatgtccaga

SEQ ID NO: 5943854 - DNA, 13 bp, Homo sapiens
tccagccagcgcc

SEQ ID NO: 5943855 - DNA, 20 bp, Homo sapiens
tccagccagcgcctccctcc

SEQ ID NO: 5943856 - DNA, 21 bp, Homo sapiens
tccagccagcgcctccctcca

SEQ ID NO: 5943857 - DNA, 22 bp, Homo sapiens
tccagccagcgcctccctccac

SEQ ID NO: 5943858 - DNA, 17 bp, Homo sapiens
tccagccagctcctgca

SEQ ID NO: 5943859 - DNA, 13 bp, Homo sapiens
tccagccaggccc

SEQ ID NO: 5943860 - DNA, 15 bp, Homo sapiens
tccagccaggcccag

SEQ ID NO: 5943861 - DNA, 20 bp, Homo sapiens
tccagccatcaagagactga

SEQ ID NO: 5943862 - DNA, 14 bp, Homo sapiens
tccagccattcctg

SEQ ID NO: 5943863 - DNA, 20 bp, Homo sapiens
tccagcccaaacctgggaag

SEQ ID NO: 5943864 - DNA, 16 bp, Homo sapiens
tccagcccacacccct

SEQ ID NO: 5943865 - DNA, 14 bp, Homo sapiens
tccagcccacagtg

SEQ ID NO: 5943866 - DNA, 15 bp, Homo sapiens
tccagcccacattgg

SEQ ID NO: 5943867 - DNA, 15 bp, Homo sapiens
tccagcccagacatc

SEQ ID NO: 5943868 - DNA, 20 bp, Homo sapiens
tccagcccagacccccagtg

SEQ ID NO: 5943869 - DNA, 11 bp, Homo sapiens
tccagcccatc

SEQ ID NO: 5943870 - DNA, 18 bp, Homo sapiens
tccagcccatctcggagc

SEQ ID NO: 5943871 - DNA, 19 bp, Homo sapiens
tccagcccatctcggagca

SEQ ID NO: 5943872 - DNA, 13 bp, Homo sapiens
tccagcccatgct

SEQ ID NO: 5943873 - DNA, 14 bp, Homo sapiens
tccagcccatgctg

SEQ ID NO: 5943874 - DNA, 17 bp, Homo sapiens
tccagcccatgctggct

SEQ ID NO: 5943875 - DNA, 18 bp, Homo sapiens
tccagcccatgctggctg

SEQ ID NO: 5943876 - DNA, 20 bp, Homo sapiens
tccagcccatgctggctggg

SEQ ID NO: 5943877 - DNA, 16 bp, Homo sapiens
tccagccccatagaaa

SEQ ID NO: 5943878 - DNA, 18 bp, Homo sapiens
tccagccccatagaaaac

SEQ ID NO: 5943879 - DNA, 13 bp, Homo sapiens
tccagccccccag

SEQ ID NO: 5943880 - DNA, 15 bp, Homo sapiens
tccagccccccaggc

SEQ ID NO: 5943881 - DNA, 17 bp, Homo sapiens
tccagccccccaggctg

SEQ ID NO: 5943882 - DNA, 15 bp, Homo sapiens
tcccagcctgactag

SEQ ID NO: 5943883 - DNA, 11 bp, Homo sapiens
tcccagcctgc

SEQ ID NO: 5943884 - DNA, 15 bp, Homo sapiens
tcccagcctgcaccc

SEQ ID NO: 5943885 - DNA, 12 bp, Homo sapiens
tcccagcctgcc

SEQ ID NO: 5943886 - DNA, 19 bp, Homo sapiens
tcccagcctgctgagagcc

SEQ ID NO: 5943887 - DNA, 23 bp, Homo sapiens
tcccagcctgctgagagccccca

SEQ ID NO: 5943888 - DNA, 15 bp, Homo sapiens
tcccagcctggccac

SEQ ID NO: 5943889 - DNA, 16 bp, Homo sapiens
tcccagcctggccacc

SEQ ID NO: 5943890 - DNA, 19 bp, Homo sapiens
tcccagcctggccaccagc

SEQ ID NO: 5943891 - DNA, 14 bp, Homo sapiens
tcccagcctggcct

SEQ ID NO: 5943892 - DNA, 12 bp, Homo sapiens
tcccagcctggg

SEQ ID NO: 5943893 - DNA, 15 bp, Homo sapiens
tcccagcctgggctc

SEQ ID NO: 5943894 - DNA, 10 bp, Homo sapiens
tcccagcctt

SEQ ID NO: 5943895 - DNA, 19 bp, Homo sapiens
tcccagcggatgctgccag

SEQ ID NO: 5943896 - DNA, 20 bp, Homo sapiens
tcccagcggctggtgcaggg

SEQ ID NO: 5943897 - DNA, 22 bp, Homo sapiens
tcccagcggctggtgcagggcc

SEQ ID NO: 5943898 - DNA, 15 bp, Homo sapiens
tcccagcgtgtgtat

SEQ ID NO: 5943899 - DNA, 17 bp, Homo sapiens
tcccagcgtgtgtatcc

SEQ ID NO: 5943900 - DNA, 18 bp, Homo sapiens
tcccagcgtgtgtatccg

SEQ ID NO: 5943901 - DNA, 21 bp, Homo sapiens
tcccagcgtgtgtatccgact

SEQ ID NO: 5943902 - DNA, 18 bp, Homo sapiens
tcccagctacacctgagg

SEQ ID NO: 5943903 - DNA, 19 bp, Homo sapiens
tcccagctacccaggaggc

SEQ ID NO: 5943904 - DNA, 17 bp, Homo sapiens
tcccagctacctgggag

SEQ ID NO: 5943905 - DNA, 15 bp, Homo sapiens
tcccagctactcagg

SEQ ID NO: 5943906 - DNA, 17 bp, Homo sapiens
tcccagctactcaggag

SEQ ID NO: 5943907 - DNA, 23 bp, Homo sapiens
tcccagctactcgggaggctgag

SEQ ID NO: 5943908 - DNA, 17 bp, Homo sapiens
tcccagctacttgggag

SEQ ID NO: 5943909 - DNA, 23 bp, Homo sapiens
tcccagctacttgggagcctgag

SEQ ID NO: 5943910 - DNA, 18 bp, Homo sapiens
tcccagctacttgggagg

SEQ ID NO: 5943911 - DNA, 20 bp, Homo sapiens
tcccagctcactgcagcctc

SEQ ID NO: 5943912 - DNA, 18 bp, Homo sapiens
tcccagctcagtgccaaa

SEQ ID NO: 5943913 - DNA, 11 bp, Homo sapiens
tcccagctccc

SEQ ID NO: 5943914 - DNA, 18 bp, Homo sapiens
tcccagctccccccgccc

SEQ ID NO: 5943915 - DNA, 15 bp, Homo sapiens
tcccagctcccctct

SEQ ID NO: 5943916 - DNA, 16 bp, Homo sapiens
tcccagctcccctctt

SEQ ID NO: 5943917 - DNA, 12 bp, Homo sapiens
tcccagctcctt

SEQ ID NO: 5943918 - DNA, 20 bp, Homo sapiens
tcccagctcctttctcctgt

SEQ ID NO: 5943919 - DNA, 14 bp, Homo sapiens
tcccagctctacat

SEQ ID NO: 5943920 - DNA, 19 bp, Homo sapiens
tcccagctctacattctgc

SEQ ID NO: 5943921 - DNA, 20 bp, Homo sapiens
tcccagctctagacaaccct

SEQ ID NO: 5943922 - DNA, 20 bp, Homo sapiens
tcccagctctagcctctgga

SEQ ID NO: 5943923 - DNA, 14 bp, Homo sapiens
tcccagctctccct

SEQ ID NO: 5943924 - DNA, 16 bp, Homo sapiens
tcccagctctccctct

SEQ ID NO: 5943925 - DNA, 19 bp, Homo sapiens
tcccagctctccctctggc

SEQ ID NO: 5943926 - DNA, 12 bp, Homo sapiens
tcccagctctgg

SEQ ID NO: 5943927 - DNA, 16 bp, Homo sapiens
tcccagctgacagtcc

SEQ ID NO: 5943928 - DNA, 18 bp, Homo sapiens
tcccagctgacagtcctc

SEQ ID NO: 5943929 - DNA, 14 bp, Homo sapiens
tcccagctgcactt

SEQ ID NO: 5943930 - DNA, 22 bp, Homo sapiens
tcccagctgcccctccctgcca

SEQ ID NO: 5943931 - DNA, 13 bp, Homo sapiens
tcccagctgcttt

SEQ ID NO: 5943932 - DNA, 14 bp, Homo sapiens
tcccagctgcttta

SEQ ID NO: 5943933 - DNA, 18 bp, Homo sapiens
tcccagctggcagcgcct

SEQ ID NO: 5943934 - DNA, 20 bp, Homo sapiens
tcccagctggcagcgcctcc

SEQ ID NO: 5943935 - DNA, 21 bp, Homo sapiens
tcccagctggcagcgcctccc

SEQ ID NO: 5943936 - DNA, 18 bp, Homo sapiens
tcccagctggtgtcactc

SEQ ID NO: 5943937 - DNA, 23 bp, Homo sapiens
tcccagctggtgtcactctgcct

SEQ ID NO: 5943938 - DNA, 20 bp, Homo sapiens
tcccagctgtaccggccact

SEQ ID NO: 5943939 - DNA, 22 bp, Homo sapiens
tcccagctgtaccggccactgc

SEQ ID NO: 5943940 - DNA, 22 bp, Homo sapiens
tcccagctgtctgtgtcagcct

SEQ ID NO: 5943941 - DNA, 13 bp, Homo sapiens
tcccagctgtgct

SEQ ID NO: 5943942 - DNA, 17 bp, Homo sapiens
tcccagcttcaaatgca

SEQ ID NO: 5943943 - DNA, 19 bp, Homo sapiens
tcccagcttcggcatttga

SEQ ID NO: 5943944 - DNA, 13 bp, Homo sapiens
tcccagcttgccc

SEQ ID NO: 5943945 - DNA, 16 bp, Homo sapiens
tcccagcttgcccccg

SEQ ID NO: 5943946 - DNA, 18 bp, Homo sapiens
tcccagcttgctgagggg

SEQ ID NO: 5943947 - DNA, 18 bp, Homo sapiens
tcccagcttggttccagg

SEQ ID NO: 5943948 - DNA, 15 bp, Homo sapiens
tcccaggaaccaaaa

SEQ ID NO: 5943949 - DNA, 16 bp, Homo sapiens
tcccaggaaccaaaaa

SEQ ID NO: 5943950 - DNA, 11 bp, Homo sapiens
tcccaggaagc

SEQ ID NO: 5943951 - DNA, 23 bp, Homo sapiens
tcccaggaagcagggagagttgg

SEQ ID NO: 5943952 - DNA, 15 bp, Homo sapiens
tcccaggaagcccag

SEQ ID NO: 5943953 - DNA, 11 bp, Homo sapiens
tcccaggacac

SEQ ID NO: 5943954 - DNA, 18 bp, Homo sapiens
tcccaggacaccacaccc

SEQ ID NO: 5943955 - DNA, 19 bp, Homo sapiens
tcccaggacaccacaccca

SEQ ID NO: 5943956 - DNA, 21 bp, Homo sapiens
tcccaggacaccacacccagc

SEQ ID NO: 5943957 - DNA, 22 bp, Homo sapiens
tcccaggacaccacacccagcc

SEQ ID NO: 5943958 - DNA, 19 bp, Homo sapiens
tcccaggacaggaaatatg

SEQ ID NO: 5943959 - DNA, 18 bp, Homo sapiens
tcccaggaccacaggctc

SEQ ID NO: 5943960 - DNA, 18 bp, Homo sapiens
tcccaggacccctcagct

SEQ ID NO: 5943961 - DNA, 23 bp, Homo sapiens
tcccaggaccctccactcactgc

SEQ ID NO: 5943962 - DNA, 16 bp, Homo sapiens
tcccaggaccctgggt

SEQ ID NO: 5943963 - DNA, 21 bp, Homo sapiens
tcccaggacctcggatgacca

SEQ ID NO: 5943964 - DNA, 17 bp, Homo sapiens
tcccaggacctgagcct

SEQ ID NO: 5943965 - DNA, 20 bp, Homo sapiens
tcccaggacctggagacagg

SEQ ID NO: 5943966 - DNA, 16 bp, Homo sapiens
tcccaggactcaccct

SEQ ID NO: 5943967 - DNA, 15 bp, Homo sapiens
tcccaggagaccatt

SEQ ID NO: 5943968 - DNA, 15 bp, Homo sapiens
tcccaggagacctga

SEQ ID NO: 5943969 - DNA, 18 bp, Homo sapiens
tcccaggagatgggtcca

SEQ ID NO: 5943970 - DNA, 17 bp, Homo sapiens
tcccaggagcctgccca

SEQ ID NO: 5943971 - DNA, 18 bp, Homo sapiens
tcccaggagcctgcccag

SEQ ID NO: 5943972 - DNA, 17 bp, Homo sapiens
tcccaggagctgcccag

SEQ ID NO: 5943973 - DNA, 19 bp, Homo sapiens
tcccaggaggggcctctga

SEQ ID NO: 5943974 - DNA, 14 bp, Homo sapiens
tcccaggaggtgca

SEQ ID NO: 5943975 - DNA, 23 bp, Homo sapiens
tcccaggaggtgcagtggagggg

SEQ ID NO: 5943976 - DNA, 14 bp, Homo sapiens
tcccaggaggtgct

SEQ ID NO: 5943977 - DNA, 18 bp, Homo sapiens
tcccaggaggtgcttgag

SEQ ID NO: 5943978 - DNA, 22 bp, Homo sapiens
tcccaggagtggaggaggcctg

SEQ ID NO: 5943979 - DNA, 20 bp, Homo sapiens
tcccaggatcagcagaagat

SEQ ID NO: 5943980 - DNA, 19 bp, Homo sapiens
tcccaggatcccctgctac

SEQ ID NO: 5943981 - DNA, 21 bp, Homo sapiens
tcccaggatccctcccagatc

SEQ ID NO: 5943982 - DNA, 11 bp, Homo sapiens
tcccaggatct

SEQ ID NO: 5943983 - DNA, 22 bp, Homo sapiens
tcccaggatgagcatcccagga

SEQ ID NO: 5943984 - DNA, 15 bp, Homo sapiens
tcccaggatgctggg

SEQ ID NO: 5943985 - DNA, 15 bp, Homo sapiens
tcccaggcaaataaa

SEQ ID NO: 5943986 - DNA, 18 bp, Homo sapiens
tcccaggcaaataaaatt

SEQ ID NO: 5943987 - DNA, 14 bp, Homo sapiens
tcccaggcaagcag

SEQ ID NO: 5943988 - DNA, 15 bp, Homo sapiens
tcccaggcaaggctg

SEQ ID NO: 5943989 - DNA, 17 bp, Homo sapiens
tcccaggcaaggctgtg

SEQ ID NO: 5943990 - DNA, 20 bp, Homo sapiens
tcccaggcaaggctgtggac

SEQ ID NO: 5943991 - DNA, 16 bp, Homo sapiens
tcccaggcactctctt

SEQ ID NO: 5943992 - DNA, 16 bp, Homo sapiens
tcccaggcagcgccac

SEQ ID NO: 5943993 - DNA, 21 bp, Homo sapiens
tcccaggcagcgccactgtcc

SEQ ID NO: 5943994 - DNA, 23 bp, Homo sapiens
tcccaggcagcgccactgtccgc

SEQ ID NO: 5943995 - DNA, 23 bp, Homo sapiens
tcccaggcatgcagctgcctggg

SEQ ID NO: 5943996 - DNA, 17 bp, Homo sapiens
tcccaggcattccccag

SEQ ID NO: 5943997 - DNA, 20 bp, Homo sapiens
tcccaggccaacagtagcca

SEQ ID NO: 5943998 - DNA, 19 bp, Homo sapiens
tcccaggccacctcagtct

SEQ ID NO: 5943999 - DNA, 14 bp, Homo sapiens
tcccaggccaggct

SEQ ID NO: 5944000 - DNA, 15 bp, Homo sapiens
tcccaggccaggctc

SEQ ID NO: 5944001 - DNA, 13 bp, Homo sapiens
tcccaggccaggg

SEQ ID NO: 5944002 - DNA, 18 bp, Homo sapiens
tcccaggccagggctggg

SEQ ID NO: 5944003 - DNA, 21 bp, Homo sapiens
tcccaggccagggctgggtca

SEQ ID NO: 5944004 - DNA, 10 bp, Homo sapiens
tcccaggccc

SEQ ID NO: 5944005 - DNA, 15 bp, Homo sapiens
tcccaggccccaggg

SEQ ID NO: 5944006 - DNA, 21 bp, Homo sapiens
tcccaggccccaggggagaaa

SEQ ID NO: 5944007 - DNA, 19 bp, Homo sapiens
tcccaggccccctgcatct

SEQ ID NO: 5944008 - DNA, 20 bp, Homo sapiens
tcccaggccccctgcatcta

SEQ ID NO: 5944009 - DNA, 19 bp, Homo sapiens
tcccaggcccctggaggct

SEQ ID NO: 5944010 - DNA, 15 bp, Homo sapiens
tcccaggcccgagat

SEQ ID NO: 5944011 - DNA, 18 bp, Homo sapiens
tcccaggccggcccagat

SEQ ID NO: 5944012 - DNA, 15 bp, Homo sapiens
tcccaggcctctgcc

SEQ ID NO: 5944013 - DNA, 18 bp, Homo sapiens
tcccaggcgccccttccc

SEQ ID NO: 5944014 - DNA, 16 bp, Homo sapiens
tcccaggctgagcctc

SEQ ID NO: 5944015 - DNA, 18 bp, Homo sapiens
tcccaggctgagcctcag

SEQ ID NO: 5944016 - DNA, 16 bp, Homo sapiens
tcccaggctgccccca

SEQ ID NO: 5944017 - DNA, 18 bp, Homo sapiens
tcccaggctgccggctcc

SEQ ID NO: 5944018 - DNA, 16 bp, Homo sapiens
tcccaggctgctggag

SEQ ID NO: 5944019 - DNA, 18 bp, Homo sapiens
tcccaggcttcaccctga

SEQ ID NO: 5944020 - DNA, 18 bp, Homo sapiens
tcccagggagtgagcagc

SEQ ID NO: 5944021 - DNA, 20 bp, Homo sapiens
tcccagggagtgagcagcta

SEQ ID NO: 5944022 - DNA, 10 bp, Homo sapiens
tcccagggat

SEQ ID NO: 5944023 - DNA, 16 bp, Homo sapiens
tcccagggcacccagg

SEQ ID NO: 5944024 - DNA, 16 bp, Homo sapiens
tcccagggccagggcc

SEQ ID NO: 5944025 - DNA, 15 bp, Homo sapiens
tcccagggcccgagc

SEQ ID NO: 5944026 - DNA, 13 bp, Homo sapiens
tcccagggcccta

SEQ ID NO: 5944027 - DNA, 13 bp, Homo sapiens
tcccagggccctc

SEQ ID NO: 5944028 - DNA, 20 bp, Homo sapiens
tcccagggccctcccagccc

SEQ ID NO: 5944029 - DNA, 20 bp, Homo sapiens
tcccagggccgcttctcctg

SEQ ID NO: 5944030 - DNA, 17 bp, Homo sapiens
tcccagggcctcctggg

SEQ ID NO: 5944031 - DNA, 19 bp, Homo sapiens
tcccagggctacacagacc

SEQ ID NO: 5944032 - DNA, 21 bp, Homo sapiens
tcccagggctacacagaccct

SEQ ID NO: 5944033 - DNA, 19 bp, Homo sapiens
tcccagggctactcactca

SEQ ID NO: 5944034 - DNA, 14 bp, Homo sapiens
tcccagggctctct

SEQ ID NO: 5944035 - DNA, 16 bp, Homo sapiens
tcccagggctctctgg

SEQ ID NO: 5944036 - DNA, 18 bp, Homo sapiens
tcccagggctctgcaggc

SEQ ID NO: 5944037 - DNA, 23 bp, Homo sapiens
tcccagggctctgcaggccactg

SEQ ID NO: 5944038 - DNA, 21 bp, Homo sapiens
tcccagggctggccctaggca

SEQ ID NO: 5944039 - DNA, 14 bp, Homo sapiens
tcccagggcttacg

SEQ ID NO: 5944040 - DNA, 18 bp, Homo sapiens
tcccaggggactgttcct

SEQ ID NO: 5944041 - DNA, 16 bp, Homo sapiens
tcccaggggagccagc

SEQ ID NO: 5944042 - DNA, 18 bp, Homo sapiens
tcccaggggagccagctg

SEQ ID NO: 5944043 - DNA, 21 bp, Homo sapiens
tcccaggggagccagctgctt

SEQ ID NO: 5944044 - DNA, 16 bp, Homo sapiens
tcccaggggcagccac

SEQ ID NO: 5944045 - DNA, 20 bp, Homo sapiens
tcccaggggcctttgcagcg

SEQ ID NO: 5944046 - DNA, 21 bp, Homo sapiens
tcccaggggtctccctgagcc

SEQ ID NO: 5944047 - DNA, 22 bp, Homo sapiens
tcccaggggtctccctgagcct

SEQ ID NO: 5944048 - DNA, 18 bp, Homo sapiens
tcccaggggtctccctgg

SEQ ID NO: 5944049 - DNA, 22 bp, Homo sapiens
tcccaggggtctccctggctcc

SEQ ID NO: 5944050 - DNA, 16 bp, Homo sapiens
tcccagggtagcccgc

SEQ ID NO: 5944051 - DNA, 23 bp, Homo sapiens
tcccagggtagcccgcctgccag

SEQ ID NO: 5944052 - DNA, 18 bp, Homo sapiens
tcccagggtcccaccccc

SEQ ID NO: 5944053 - DNA, 19 bp, Homo sapiens
tcccagggtcccaccccca

SEQ ID NO: 5944054 - DNA, 18 bp, Homo sapiens
tcccagggttttaacttt

SEQ ID NO: 5944055 - DNA, 19 bp, Homo sapiens
tcccaggtaagcaggagga

SEQ ID NO: 5944056 - DNA, 19 bp, Homo sapiens
tcccaggtaatttaaattg

SEQ ID NO: 5944057 - DNA, 16 bp, Homo sapiens
tcccaggtaccagctg

SEQ ID NO: 5944058 - DNA, 17 bp, Homo sapiens
tcccaggtaccagctgc

SEQ ID NO: 5944059 - DNA, 14 bp, Homo sapiens
tccccaccctgtcc

SEQ ID NO: 5944060 - DNA, 20 bp, Homo sapiens
tccccaccctgtcccaggca

SEQ ID NO: 5944061 - DNA, 16 bp, Homo sapiens
tccccaccgcagacag

SEQ ID NO: 5944062 - DNA, 22 bp, Homo sapiens
tccccaccgcagacaggaccag

SEQ ID NO: 5944063 - DNA, 15 bp, Homo sapiens
tccccacctacccag

SEQ ID NO: 5944064 - DNA, 18 bp, Homo sapiens
tccccacctacccagctg

SEQ ID NO: 5944065 - DNA, 14 bp, Homo sapiens
tccccacctcttcc

SEQ ID NO: 5944066 - DNA, 15 bp, Homo sapiens
tccccacctcttcct

SEQ ID NO: 5944067 - DNA, 15 bp, Homo sapiens
tccccacctggacac

SEQ ID NO: 5944068 - DNA, 17 bp, Homo sapiens
tccccacctggacacac

SEQ ID NO: 5944069 - DNA, 15 bp, Homo sapiens
tccccacctgtagct

SEQ ID NO: 5944070 - DNA, 22 bp, Homo sapiens
tccccaccttcaattcctgggc

SEQ ID NO: 5944071 - DNA, 23 bp, Homo sapiens
tccccaccttcaattcctgggcc

SEQ ID NO: 5944072 - DNA, 15 bp, Homo sapiens
tccccaccttcccca

SEQ ID NO: 5944073 - DNA, 19 bp, Homo sapiens
tccccaccttcccccaact

SEQ ID NO: 5944074 - DNA, 19 bp, Homo sapiens
tccccacgaggggacccat

SEQ ID NO: 5944075 - DNA, 17 bp, Homo sapiens
tccccacgccacagccc

SEQ ID NO: 5944076 - DNA, 20 bp, Homo sapiens
tccccacggaaggcgggctg

SEQ ID NO: 5944077 - DNA, 19 bp, Homo sapiens
tccccacggccgctccagg

SEQ ID NO: 5944078 - DNA, 20 bp, Homo sapiens
tccccacggccgctccaggg

SEQ ID NO: 5944079 - DNA, 23 bp, Homo sapiens
tccccacggggcctcgggacctc

SEQ ID NO: 5944080 - DNA, 18 bp, Homo sapiens
tccccactaataaagtgc

SEQ ID NO: 5944081 - DNA, 17 bp, Homo sapiens
tccccactccaccctgt

SEQ ID NO: 5944082 - DNA, 14 bp, Homo sapiens
tccccactccagca

SEQ ID NO: 5944083 - DNA, 15 bp, Homo sapiens
tccccactccagcag

SEQ ID NO: 5944084 - DNA, 21 bp, Homo sapiens
tccccactcccatctgattta

SEQ ID NO: 5944085 - DNA, 23 bp, Homo sapiens
tccccactcccccgtttctcctt

SEQ ID NO: 5944086 - DNA, 19 bp, Homo sapiens
tccccactccctgtccatc

SEQ ID NO: 5944087 - DNA, 16 bp, Homo sapiens
tccccactcccttggt

SEQ ID NO: 5944088 - DNA, 12 bp, Homo sapiens
tccccactcctc

SEQ ID NO: 5944089 - DNA, 14 bp, Homo sapiens
tccccactcctccg

SEQ ID NO: 5944090 - DNA, 19 bp, Homo sapiens
tccccactcctcctccagc

SEQ ID NO: 5944091 - DNA, 19 bp, Homo sapiens
tccccactctgctcccagc

SEQ ID NO: 5944092 - DNA, 17 bp, Homo sapiens
tccccactgccccacgt

SEQ ID NO: 5944093 - DNA, 15 bp, Homo sapiens
tccccactgcctact

SEQ ID NO: 5944094 - DNA, 14 bp, Homo sapiens
tccccactgcctgc

SEQ ID NO: 5944095 - DNA, 20 bp, Homo sapiens
tccccactgcctgcccaccc

SEQ ID NO: 5944096 - DNA, 14 bp, Homo sapiens
tccccactggagca

SEQ ID NO: 5944097 - DNA, 15 bp, Homo sapiens
tccccactgtatcta

SEQ ID NO: 5944098 - DNA, 19 bp, Homo sapiens
tccccactgtatctaggca

SEQ ID NO: 5944099 - DNA, 21 bp, Homo sapiens
tccccacttcactttcttcaa

SEQ ID NO: 5944100 - DNA, 12 bp, Homo sapiens
tccccagaacaa

SEQ ID NO: 5944101 - DNA, 22 bp, Homo sapiens
tccccagaagacacaggaaaca

SEQ ID NO: 5944102 - DNA, 17 bp, Homo sapiens
tccccagaatggaggca

SEQ ID NO: 5944103 - DNA, 12 bp, Homo sapiens
tccccagacaca

SEQ ID NO: 5944104 - DNA, 23 bp, Homo sapiens
tccccagacacattctcctgtgc

SEQ ID NO: 5944105 - DNA, 12 bp, Homo sapiens
tccccagacagg

SEQ ID NO: 5944106 - DNA, 15 bp, Homo sapiens
tccccagacagggct

SEQ ID NO: 5944107 - DNA, 19 bp, Homo sapiens
tccccagacagggctccag

SEQ ID NO: 5944108 - DNA, 16 bp, Homo sapiens
tccccagaccaaccct

SEQ ID NO: 5944109 - DNA, 19 bp, Homo sapiens
tccccagaccaaccctggg

SEQ ID NO: 5944110 - DNA, 20 bp, Homo sapiens
tccccagaccaaccctggga

SEQ ID NO: 5944111 - DNA, 23 bp, Homo sapiens
tccccagaccaaccctgggacct

SEQ ID NO: 5944112 - DNA, 13 bp, Homo sapiens
tccccagaccagt

SEQ ID NO: 5944113 - DNA, 17 bp, Homo sapiens
tccccagaccagtagtg

SEQ ID NO: 5944114 - DNA, 20 bp, Homo sapiens
tccccagaccagtagtgacc

SEQ ID NO: 5944115 - DNA, 20 bp, Homo sapiens
tccccagacccagaggtcca

SEQ ID NO: 5944116 - DNA, 16 bp, Homo sapiens
tccccagacctgagct

SEQ ID NO: 5944117 - DNA, 18 bp, Homo sapiens
tccccagacgcctggctg

SEQ ID NO: 5944118 - DNA, 12 bp, Homo sapiens
tccccagactca

SEQ ID NO: 5944119 - DNA, 15 bp, Homo sapiens
tccccagacttgcac

SEQ ID NO: 5944120 - DNA, 10 bp, Homo sapiens
tccccagaga

SEQ ID NO: 5944121 - DNA, 22 bp, Homo sapiens
tccccagagaaaggggagccca

SEQ ID NO: 5944122 - DNA, 18 bp, Homo sapiens
tccccagagagcaggcag

SEQ ID NO: 5944123 - DNA, 20 bp, Homo sapiens
tccccagagagcaggcaggg

SEQ ID NO: 5944124 - DNA, 17 bp, Homo sapiens
tccccagagatggctcc

SEQ ID NO: 5944125 - DNA, 19 bp, Homo sapiens
tccccagagatggctcctt

SEQ ID NO: 5944126 - DNA, 14 bp, Homo sapiens
tccccagagcattt

SEQ ID NO: 5944127 - DNA, 12 bp, Homo sapiens
tccccagagccc

SEQ ID NO: 5944128 - DNA, 14 bp, Homo sapiens
tccccagagcccag

SEQ ID NO: 5944129 - DNA, 21 bp, Homo sapiens
tccccagagcccagctcttgc

SEQ ID NO: 5944130 - DNA, 17 bp, Homo sapiens
tccccagagccctgcag

SEQ ID NO: 5944131 - DNA, 12 bp, Homo sapiens
tccccagagctc

SEQ ID NO: 5944132 - DNA, 16 bp, Homo sapiens
tccccagagctgcctg

SEQ ID NO: 5944133 - DNA, 23 bp, Homo sapiens
tccccagagctggcgctcagcag

SEQ ID NO: 5944134 - DNA, 15 bp, Homo sapiens
tccccagagctgtgc

SEQ ID NO: 5944135 - DNA, 19 bp, Homo sapiens
tccccagagtcctctatga

SEQ ID NO: 5944136 - DNA, 15 bp, Homo sapiens
tccccagagtgggat

SEQ ID NO: 5944137 - DNA, 15 bp, Homo sapiens
tccccagatatttat

SEQ ID NO: 5944138 - DNA, 19 bp, Homo sapiens
tccccagatatttatgtat

SEQ ID NO: 5944139 - DNA, 19 bp, Homo sapiens
tccccagatctgtcctggg

SEQ ID NO: 5944140 - DNA, 21 bp, Homo sapiens
tccccagatctgtcctggggg

SEQ ID NO: 5944141 - DNA, 22 bp, Homo sapiens
tccccagatctgtcctggggga

SEQ ID NO: 5944142 - DNA, 20 bp, Homo sapiens
tccccagattgcaacaggct

SEQ ID NO: 5944143 - DNA, 22 bp, Homo sapiens
tccccagattgcaacaggctgg

SEQ ID NO: 5944144 - DNA, 23 bp, Homo sapiens
tccccagattgcaacaggctggg

SEQ ID NO: 5944145 - DNA, 15 bp, Homo sapiens
tccccagcacctagg

SEQ ID NO: 5944146 - DNA, 14 bp, Homo sapiens
tccccagcagaatt

SEQ ID NO: 5944147 - DNA, 22 bp, Homo sapiens
tccccagcagggtcttttcatc

SEQ ID NO: 5944148 - DNA, 15 bp, Homo sapiens
tccccagcaggtggg

SEQ ID NO: 5944149 - DNA, 19 bp, Homo sapiens
tccccagcatgcaccacgg

SEQ ID NO: 5944150 - DNA, 13 bp, Homo sapiens
tccccagccacag

SEQ ID NO: 5944151 - DNA, 14 bp, Homo sapiens
tccccagccacagg

SEQ ID NO: 5944152 - DNA, 12 bp, Homo sapiens
tccccagccaga

SEQ ID NO: 5944153 - DNA, 15 bp, Homo sapiens
tccccagccagaagt

SEQ ID NO: 5944154 - DNA, 17 bp, Homo sapiens
tccccagccagaagtta

SEQ ID NO: 5944155 - DNA, 22 bp, Homo sapiens
tccccagccagaggtggagcca

SEQ ID NO: 5944156 - DNA, 21 bp, Homo sapiens
tccccagccagcccttccctg

SEQ ID NO: 5944157 - DNA, 16 bp, Homo sapiens
tccccagccagcctgg

SEQ ID NO: 5944158 - DNA, 16 bp, Homo sapiens
tccccagcccacctgc

SEQ ID NO: 5944159 - DNA, 20 bp, Homo sapiens
tccccagcccacctgctccc

SEQ ID NO: 5944160 - DNA, 13 bp, Homo sapiens
tccccagcccact

SEQ ID NO: 5944161 - DNA, 14 bp, Homo sapiens
tccccagcccactg

SEQ ID NO: 5944162 - DNA, 12 bp, Homo sapiens
tccccagcccag

SEQ ID NO: 5944163 - DNA, 14 bp, Homo sapiens
tccccagcccagag

SEQ ID NO: 5944164 - DNA, 15 bp, Homo sapiens
tccccagcccagaga

SEQ ID NO: 5944165 - DNA, 17 bp, Homo sapiens
tccccagcccagagaca

SEQ ID NO: 5944166 - DNA, 14 bp, Homo sapiens
tccccagcccaggg

SEQ ID NO: 5944167 - DNA, 24 bp, Homo sapiens
tccccagccccagccccttccatg

SEQ ID NO: 5944168 - DNA, 12 bp, Homo sapiens
tccccagccccc

SEQ ID NO: 5944169 - DNA, 13 bp, Homo sapiens
tccccagccccta

SEQ ID NO: 5944170 - DNA, 13 bp, Homo sapiens
tccccagcccctc

SEQ ID NO: 5944171 - DNA, 21 bp, Homo sapiens
tccccagcccctcctccctca

SEQ ID NO: 5944172 - DNA, 22 bp, Homo sapiens
tccccagcccctcctccctcag

SEQ ID NO: 5944173 - DNA, 20 bp, Homo sapiens
tccccagccctccccacctg

SEQ ID NO: 5944174 - DNA, 22 bp, Homo sapiens
tccccagccctccccacctgct

SEQ ID NO: 5944175 - DNA, 15 bp, Homo sapiens
tccccagccctggct

SEQ ID NO: 5944176 - DNA, 18 bp, Homo sapiens
tccccagccctggctctg

SEQ ID NO: 5944177 - DNA, 22 bp, Homo sapiens
tccccagccctgtcctggttcc

SEQ ID NO: 5944178 - DNA, 13 bp, Homo sapiens
tccccagcccttc

SEQ ID NO: 5944179 - DNA, 21 bp, Homo sapiens
tccccagcccttcctctgctc

SEQ ID NO: 5944180 - DNA, 15 bp, Homo sapiens
tccccagcctacctc

SEQ ID NO: 5944181 - DNA, 11 bp, Homo sapiens
tccccagcctg

SEQ ID NO: 5944182 - DNA, 14 bp, Homo sapiens
tccccagcctggca

SEQ ID NO: 5944183 - DNA, 23 bp, Homo sapiens
tccccagcctttgatcaggtggg

SEQ ID NO: 5944184 - DNA, 17 bp, Homo sapiens
tccccagctcacccctg

SEQ ID NO: 5944185 - DNA, 11 bp, Homo sapiens
tccccagctcc

SEQ ID NO: 5944186 - DNA, 14 bp, Homo sapiens
tccccagctccagc

SEQ ID NO: 5944187 - DNA, 16 bp, Homo sapiens
tccccagctcccagga

SEQ ID NO: 5944188 - DNA, 18 bp, Homo sapiens
tccccagctccccaggac

SEQ ID NO: 5944189 - DNA, 16 bp, Homo sapiens
tccccagctcccccag

SEQ ID NO: 5944190 - DNA, 18 bp, Homo sapiens
tccccagctcccttggga

SEQ ID NO: 5944191 - DNA, 20 bp, Homo sapiens
tccccagctccggagggggt

SEQ ID NO: 5944192 - DNA, 15 bp, Homo sapiens
tccccagctcttctc

SEQ ID NO: 5944193 - DNA, 15 bp, Homo sapiens
tccccagctggtcca

SEQ ID NO: 5944194 - DNA, 15 bp, Homo sapiens
tccccagctttctcc

SEQ ID NO: 5944195 - DNA, 20 bp, Homo sapiens
tccccaggaagtggctcaga

SEQ ID NO: 5944196 - DNA, 16 bp, Homo sapiens
tccccaggagctctct

SEQ ID NO: 5944197 - DNA, 21 bp, Homo sapiens
tccccaggagctctctgctga

SEQ ID NO: 5944198 - DNA, 18 bp, Homo sapiens
tccccaggaggccagcct

SEQ ID NO: 5944199 - DNA, 20 bp, Homo sapiens
tccccaggaggccagccttg

SEQ ID NO: 5944200 - DNA, 21 bp, Homo sapiens
tccccaggaggccagccttga

SEQ ID NO: 5944201 - DNA, 16 bp, Homo sapiens
tccccaggcacctcac

SEQ ID NO: 5944202 - DNA, 23 bp, Homo sapiens
tccccaggccaggccaccaggat

SEQ ID NO: 5944203 - DNA, 14 bp, Homo sapiens
tccccaggccaggt

SEQ ID NO: 5944204 - DNA, 19 bp, Homo sapiens
tccccaggccaggtccctg

SEQ ID NO: 5944205 - DNA, 11 bp, Homo sapiens
tccccaggccc

SEQ ID NO: 5944206 - DNA, 21 bp, Homo sapiens
tccccaggcccaccatcacca

SEQ ID NO: 5944207 - DNA, 15 bp, Homo sapiens
tccccaggcccagcc

SEQ ID NO: 5944208 - DNA, 22 bp, Homo sapiens
tccccaggcccagccctccttc

SEQ ID NO: 5944209 - DNA, 19 bp, Homo sapiens
tccccaggccccaggaagc

SEQ ID NO: 5944210 - DNA, 21 bp, Homo sapiens
tccccaggccccaggaagccg

SEQ ID NO: 5944211 - DNA, 23 bp, Homo sapiens
tccccaggccgtggctgcccaca

SEQ ID NO: 5944212 - DNA, 15 bp, Homo sapiens
tccccaggcctccag

SEQ ID NO: 5944213 - DNA, 17 bp, Homo sapiens
tccccaggcctccagcc

SEQ ID NO: 5944214 - DNA, 16 bp, Homo sapiens
tccccaggcctggctc

SEQ ID NO: 5944215 - DNA, 21 bp, Homo sapiens
tccccaggctgcccactctgg

SEQ ID NO: 5944216 - DNA, 16 bp, Homo sapiens
tccccaggctggagac

SEQ ID NO: 5944217 - DNA, 19 bp, Homo sapiens
tccccaggctggagacccc

SEQ ID NO: 5944218 - DNA, 17 bp, Homo sapiens
tccccagggaagcagca

SEQ ID NO: 5944219 - DNA, 20 bp, Homo sapiens
tccccagggaagcagcagcc

SEQ ID NO: 5944220 - DNA, 21 bp, Homo sapiens
tccccagggaagcagcagcct

SEQ ID NO: 5944221 - DNA, 15 bp, Homo sapiens
tccccagggaaggaa

SEQ ID NO: 5944222 - DNA, 14 bp, Homo sapiens
tccccagggagctc

SEQ ID NO: 5944223 - DNA, 15 bp, Homo sapiens
tccccagggagctct

SEQ ID NO: 5944224 - DNA, 11 bp, Homo sapiens
tccccagggca

SEQ ID NO: 5944225 - DNA, 13 bp, Homo sapiens
tccccagggcacg

SEQ ID NO: 5944226 - DNA, 17 bp, Homo sapiens
tccccagggcagcctcg

SEQ ID NO: 5944227 - DNA, 12 bp, Homo sapiens
tccccagggccc

SEQ ID NO: 5944228 - DNA, 16 bp, Homo sapiens
tccccagggcccctcc

SEQ ID NO: 5944229 - DNA, 17 bp, Homo sapiens
tccccagggctccctta

SEQ ID NO: 5944230 - DNA, 18 bp, Homo sapiens
tccccaggggaaaatgaa

SEQ ID NO: 5944231 - DNA, 14 bp, Homo sapiens
tccccaggggcatg

SEQ ID NO: 5944232 - DNA, 23 bp, Homo sapiens
tccccaggggtcccagccacccc

SEQ ID NO: 5944233 - DNA, 18 bp, Homo sapiens
tccccagggttctgtatt

SEQ ID NO: 5944234 - DNA, 15 bp, Homo sapiens
tccccaggtccagct

SEQ ID NO: 5944235 - DNA, 14 bp, Homo sapiens
tccccaggtctctc

SEQ ID NO: 5944236 - DNA, 20 bp, Homo sapiens
tccccaggtctctccactgc

SEQ ID NO: 5944237 - DNA, 21 bp, Homo sapiens
tccccaggtggaggtgccagg

SEQ ID NO: 5944238 - DNA, 14 bp, Homo sapiens
tccccggcaggcct

SEQ ID NO: 5944239 - DNA, 22 bp, Homo sapiens
tccccggcatcatttcccctcc

SEQ ID NO: 5944240 - DNA, 22 bp, Homo sapiens
tccccggcatgagactcagtgc

SEQ ID NO: 5944241 - DNA, 16 bp, Homo sapiens
tccccggcccctgccc

SEQ ID NO: 5944242 - DNA, 13 bp, Homo sapiens
tccccggcctcag

SEQ ID NO: 5944243 - DNA, 20 bp, Homo sapiens
tccccggcggggtgcctgct

SEQ ID NO: 5944244 - DNA, 19 bp, Homo sapiens
tccccggcggtgccgcgct

SEQ ID NO: 5944245 - DNA, 13 bp, Homo sapiens
tccccggctcgag

SEQ ID NO: 5944246 - DNA, 13 bp, Homo sapiens
tccccgggcagca

SEQ ID NO: 5944247 - DNA, 18 bp, Homo sapiens
tccccgggcagcagagag

SEQ ID NO: 5944248 - DNA, 21 bp, Homo sapiens
tccccgggcagcagagagaga

SEQ ID NO: 5944249 - DNA, 16 bp, Homo sapiens
tccccgggcatctttg

SEQ ID NO: 5944250 - DNA, 15 bp, Homo sapiens
tccccggggcccagg

SEQ ID NO: 5944251 - DNA, 17 bp, Homo sapiens
tccccggggcccagggg

SEQ ID NO: 5944252 - DNA, 23 bp, Homo sapiens
tccccgggtctctcactgttgca

SEQ ID NO: 5944253 - DNA, 22 bp, Homo sapiens
tccccggtcccttgagacctca

SEQ ID NO: 5944254 - DNA, 17 bp, Homo sapiens
tccccgtagccactctc

SEQ ID NO: 5944255 - DNA, 23 bp, Homo sapiens
tccccgtatgagttagaataata

SEQ ID NO: 5944256 - DNA, 14 bp, Homo sapiens
tccccgtcccctgc

SEQ ID NO: 5944257 - DNA, 22 bp, Homo sapiens
tccccgtcccctgcagcctggg

SEQ ID NO: 5944258 - DNA, 15 bp, Homo sapiens
tccccgtccctgtcc

SEQ ID NO: 5944259 - DNA, 14 bp, Homo sapiens
tccccgtctctgcc

SEQ ID NO: 5944260 - DNA, 20 bp, Homo sapiens
tccccgtgccccgcctcccc

SEQ ID NO: 5944261 - DNA, 20 bp, Homo sapiens
tccccgtgcggcccgtgcgc

SEQ ID NO: 5944262 - DNA, 22 bp, Homo sapiens
tccccgtgtaaaaagcctcctt

SEQ ID NO: 5944263 - DNA, 14 bp, Homo sapiens
tccccgttcctgac

SEQ ID NO: 5944264 - DNA, 17 bp, Homo sapiens
tcccctaaagccaggct

SEQ ID NO: 5944265 - DNA, 18 bp, Homo sapiens
tcccctaacccccagtcc

SEQ ID NO: 5944266 - DNA, 22 bp, Homo sapiens
tcccctaacccccagtcctcac

SEQ ID NO: 5944267 - DNA, 23 bp, Homo sapiens
tcccctaccccctcctctctgcc

SEQ ID NO: 5944268 - DNA, 15 bp, Homo sapiens
tcccctacggaccag

SEQ ID NO: 5944269 - DNA, 16 bp, Homo sapiens
tcccctacggaccagg

SEQ ID NO: 5944270 - DNA, 21 bp, Homo sapiens
tcccctagacatggcctctgg

SEQ ID NO: 5944271 - DNA, 15 bp, Homo sapiens
tcccctagagtccca

SEQ ID NO: 5944272 - DNA, 14 bp, Homo sapiens
tcccctagatccag

SEQ ID NO: 5944273 - DNA, 15 bp, Homo sapiens
tcccctagatccaga

SEQ ID NO: 5944274 - DNA, 16 bp, Homo sapiens
tcccctagctcaccag

SEQ ID NO: 5944275 - DNA, 22 bp, Homo sapiens
tcccctagggactgtcctagcc

SEQ ID NO: 5944276 - DNA, 20 bp, Homo sapiens
tcccctatccacccagccca

SEQ ID NO: 5944277 - DNA, 19 bp, Homo sapiens
tcccctatggggatggtcc

SEQ ID NO: 5944278 - DNA, 14 bp, Homo sapiens
tcccctcaaaaagc

SEQ ID NO: 5944279 - DNA, 19 bp, Homo sapiens
tcccctcaaactcattgca

SEQ ID NO: 5944280 - DNA, 16 bp, Homo sapiens
tcccctcaacaccctg

SEQ ID NO: 5944281 - DNA, 17 bp, Homo sapiens
tcccctcaacaccctgc

SEQ ID NO: 5944282 - DNA, 20 bp, Homo sapiens
tcccctcaacaccctgcttc

SEQ ID NO: 5944283 - DNA, 12 bp, Homo sapiens
tcccctcaagcc

SEQ ID NO: 5944284 - DNA, 21 bp, Homo sapiens
tcccctcaagccccttctctc

SEQ ID NO: 5944285 - DNA, 22 bp, Homo sapiens
tcccctcaagccccttctctca

SEQ ID NO: 5944286 - DNA, 24 bp, Homo sapiens
tcccctcaaggacaaagtctccag

SEQ ID NO: 5944287 - DNA, 14 bp, Homo sapiens
tcccctcacagact

SEQ ID NO: 5944288 - DNA, 17 bp, Homo sapiens
tcccctcacagactctt

SEQ ID NO: 5944289 - DNA, 13 bp, Homo sapiens
tcccctcacagcc

SEQ ID NO: 5944290 - DNA, 20 bp, Homo sapiens
tcccctcacagcctctgacc

SEQ ID NO: 5944291 - DNA, 21 bp, Homo sapiens
tcccctcacatcctcctgccc

SEQ ID NO: 5944292 - DNA, 21 bp, Homo sapiens
tcccctcacccgctgcccagc

SEQ ID NO: 5944293 - DNA, 17 bp, Homo sapiens
tcccctcacctcctcta

SEQ ID NO: 5944294 - DNA, 20 bp, Homo sapiens
tcccctcacgcaagtgccag

SEQ ID NO: 5944295 - DNA, 16 bp, Homo sapiens
tcccctcactctgtca

SEQ ID NO: 5944296 - DNA, 22 bp, Homo sapiens
tcccctcactctgtcagccagc

SEQ ID NO: 5944297 - DNA, 21 bp, Homo sapiens
tcccctcacttaaccacccca

SEQ ID NO: 5944298 - DNA, 13 bp, Homo sapiens
tcccctcagagct

SEQ ID NO: 5944299 - DNA, 16 bp, Homo sapiens
tcccctcagagctctt

SEQ ID NO: 5944300 - DNA, 14 bp, Homo sapiens
tcccctcagcctct

SEQ ID NO: 5944301 - DNA, 19 bp, Homo sapiens
tcccctcagcctcttctct

SEQ ID NO: 5944302 - DNA, 14 bp, Homo sapiens
tcccctcagcctgc

SEQ ID NO: 5944303 - DNA, 18 bp, Homo sapiens
tcccctcagcctgcccac

SEQ ID NO: 5944304 - DNA, 16 bp, Homo sapiens
tcccctcagcgcaggc

SEQ ID NO: 5944305 - DNA, 14 bp, Homo sapiens
tcccctcagctcca

SEQ ID NO: 5944306 - DNA, 13 bp, Homo sapiens
tcccctcattcag

SEQ ID NO: 5944307 - DNA, 19 bp, Homo sapiens
tcccctccacatcccagca

SEQ ID NO: 5944308 - DNA, 22 bp, Homo sapiens
tcccctccacgcaaggctgtgc

SEQ ID NO: 5944309 - DNA, 13 bp, Homo sapiens
tcccctccagacc

SEQ ID NO: 5944310 - DNA, 12 bp, Homo sapiens
tcccctccagga

SEQ ID NO: 5944311 - DNA, 13 bp, Homo sapiens
tcccctccaggaa

SEQ ID NO: 5944312 - DNA, 24 bp, Homo sapiens
tcccctccaggagggaccaccctc

SEQ ID NO: 5944313 - DNA, 21 bp, Homo sapiens
tcccctccatccccatcggcc

SEQ ID NO: 5944314 - DNA, 15 bp, Homo sapiens
tcccctccatccctg

SEQ ID NO: 5944315 - DNA, 23 bp, Homo sapiens
tcccctccatctggggatggaga

SEQ ID NO: 5944316 - DNA, 21 bp, Homo sapiens
tcccctcccaatcctctctcc

SEQ ID NO: 5944317 - DNA, 17 bp, Homo sapiens
tcccctcccacccacag

SEQ ID NO: 5944318 - DNA, 20 bp, Homo sapiens
tcccctcccacccacagcca

SEQ ID NO: 5944319 - DNA, 13 bp, Homo sapiens
tcccctcccagag

SEQ ID NO: 5944320 - DNA, 16 bp, Homo sapiens
tcccctcccaggggag

SEQ ID NO: 5944321 - DNA, 20 bp, Homo sapiens
tcccctcccaggggagccag

SEQ ID NO: 5944322 - DNA, 14 bp, Homo sapiens
tcccctcccagtcc

SEQ ID NO: 5944323 - DNA, 15 bp, Homo sapiens
tcccctcccagtcct

SEQ ID NO: 5944324 - DNA, 14 bp, Homo sapiens
tcccctcccatctg

SEQ ID NO: 5944325 - DNA, 15 bp, Homo sapiens
tcccctcccatctgg

SEQ ID NO: 5944326 - DNA, 15 bp, Homo sapiens
tcccctccccagccc

SEQ ID NO: 5944327 - DNA, 18 bp, Homo sapiens
tcccctccccagcccaat

SEQ ID NO: 5944328 - DNA, 17 bp, Homo sapiens
tcccctccccagctccc

SEQ ID NO: 5944329 - DNA, 20 bp, Homo sapiens
tcccctccccagctcccttg

SEQ ID NO: 5944330 - DNA, 18 bp, Homo sapiens
tcccctccccgccccctg

SEQ ID NO: 5944331 - DNA, 23 bp, Homo sapiens
tcccctccccgccccctgaaaca

SEQ ID NO: 5944332 - DNA, 18 bp, Homo sapiens
tcccctccccgcctggcc

SEQ ID NO: 5944333 - DNA, 19 bp, Homo sapiens
tcccctccccgcctggcca

SEQ ID NO: 5944334 - DNA, 21 bp, Homo sapiens
tcccctccccgcctggccagg

SEQ ID NO: 5944335 - DNA, 21 bp, Homo sapiens
tcccctccccgcgcgttcctt

SEQ ID NO: 5944336 - DNA, 11 bp, Homo sapiens
tcccctcccct

SEQ ID NO: 5944337 - DNA, 16 bp, Homo sapiens
tcccctcccctccttg

SEQ ID NO: 5944338 - DNA, 17 bp, Homo sapiens
tcccctcccctccttgt

SEQ ID NO: 5944339 - DNA, 23 bp, Homo sapiens
tcccctcccgacagcccatcacc

SEQ ID NO: 5944340 - DNA, 21 bp, Homo sapiens
tcccctcccgtcttcctcctc

SEQ ID NO: 5944341 - DNA, 15 bp, Homo sapiens
tcccctccctaccct

SEQ ID NO: 5944342 - DNA, 11 bp, Homo sapiens
tcccctccctc

SEQ ID NO: 5944343 - DNA, 16 bp, Homo sapiens
tcccctccctcctctg

SEQ ID NO: 5944344 - DNA, 12 bp, Homo sapiens
tcccctccctcg

SEQ ID NO: 5944345 - DNA, 14 bp, Homo sapiens
tcccctccctcgtg

SEQ ID NO: 5944346 - DNA, 12 bp, Homo sapiens
tcccctccctct

SEQ ID NO: 5944347 - DNA, 15 bp, Homo sapiens
tcccctccctctgtc

SEQ ID NO: 5944348 - DNA, 16 bp, Homo sapiens
tcccctccctcttcct

SEQ ID NO: 5944349 - DNA, 18 bp, Homo sapiens
tcccctccctcttccttc

SEQ ID NO: 5944350 - DNA, 18 bp, Homo sapiens
tcccctccctgcctgctc

SEQ ID NO: 5944351 - DNA, 16 bp, Homo sapiens
tcccctccctggctcc

SEQ ID NO: 5944352 - DNA, 22 bp, Homo sapiens
tcccctccgcagcagggaagct

SEQ ID NO: 5944353 - DNA, 23 bp, Homo sapiens
tcccctccgcagcagggaagctc

SEQ ID NO: 5944354 - DNA, 15 bp, Homo sapiens
tcccctcctcagtga

SEQ ID NO: 5944355 - DNA, 12 bp, Homo sapiens
tcccctcctcca

SEQ ID NO: 5944356 - DNA, 14 bp, Homo sapiens
tcccctcctccact

SEQ ID NO: 5944357 - DNA, 14 bp, Homo sapiens
tcccctcctctgct

SEQ ID NO: 5944358 - DNA, 15 bp, Homo sapiens
tcccctcctctgctt

SEQ ID NO: 5944359 - DNA, 18 bp, Homo sapiens
tcccctcctctgcttgcc

SEQ ID NO: 5944360 - DNA, 16 bp, Homo sapiens
tcccctcctcttccct

SEQ ID NO: 5944361 - DNA, 11 bp, Homo sapiens
tcccctcctgc

SEQ ID NO: 5944362 - DNA, 13 bp, Homo sapiens
tcccctcctgcac

SEQ ID NO: 5944363 - DNA, 14 bp, Homo sapiens
tcccctcctgcaca

SEQ ID NO: 5944364 - DNA, 14 bp, Homo sapiens
tcccctcctgctgg

SEQ ID NO: 5944365 - DNA, 10 bp, Homo sapiens
tcccctcctt

SEQ ID NO: 5944366 - DNA, 22 bp, Homo sapiens
tcccctccttccctcaccccca

SEQ ID NO: 5944367 - DNA, 18 bp, Homo sapiens
tcccctccttgcctcctg

SEQ ID NO: 5944368 - DNA, 21 bp, Homo sapiens
tcccctccttgcctcctgtgt

SEQ ID NO: 5944369 - DNA, 23 bp, Homo sapiens
tcccctccttgcctcctgtgtaa

SEQ ID NO: 5944370 - DNA, 18 bp, Homo sapiens
tcccctcctttaccccac

SEQ ID NO: 5944371 - DNA, 22 bp, Homo sapiens
tcccctcctttaccgaggacag

SEQ ID NO: 5944372 - DNA, 23 bp, Homo sapiens
tcccctcctttaccgaggacagc

SEQ ID NO: 5944373 - DNA, 20 bp, Homo sapiens
tcccctctcatccccctgtg

SEQ ID NO: 5944374 - DNA, 20 bp, Homo sapiens
tcccctctcatctgacctta

SEQ ID NO: 5944375 - DNA, 13 bp, Homo sapiens
tcccctctcccag

SEQ ID NO: 5944376 - DNA, 14 bp, Homo sapiens
tcccctctcccagg

SEQ ID NO: 5944377 - DNA, 14 bp, Homo sapiens
tcccctctcccctt

SEQ ID NO: 5944378 - DNA, 13 bp, Homo sapiens
tcccctctcctga

SEQ ID NO: 5944379 - DNA, 14 bp, Homo sapiens
tcccctctcctgag

SEQ ID NO: 5944380 - DNA, 15 bp, Homo sapiens
tcccctctcctgagc

SEQ ID NO: 5944381 - DNA, 14 bp, Homo sapiens
tcccctctcctgcc

SEQ ID NO: 5944382 - DNA, 19 bp, Homo sapiens
tcccctctcctgcgtgtgc

SEQ ID NO: 5944383 - DNA, 16 bp, Homo sapiens
tcccctctccttcctg

SEQ ID NO: 5944384 - DNA, 18 bp, Homo sapiens
tcccctctcgccccatcc

SEQ ID NO: 5944385 - DNA, 19 bp, Homo sapiens
tcccctctcgcgcccagca

SEQ ID NO: 5944386 - DNA, 16 bp, Homo sapiens
tcccctctctgcccct

SEQ ID NO: 5944387 - DNA, 19 bp, Homo sapiens
tcccctctctgtggctcca

SEQ ID NO: 5944388 - DNA, 21 bp, Homo sapiens
tcccctctcttcgtcctgatc

SEQ ID NO: 5944389 - DNA, 20 bp, Homo sapiens
tcccctctgcaaccccccag

SEQ ID NO: 5944390 - DNA, 14 bp, Homo sapiens
tcccctctgcccca

SEQ ID NO: 5944391 - DNA, 15 bp, Homo sapiens
tcccctctgccccac

SEQ ID NO: 5944392 - DNA, 13 bp, Homo sapiens
tcccctctgccct

SEQ ID NO: 5944393 - DNA, 19 bp, Homo sapiens
tcccctctgccctgtatat

SEQ ID NO: 5944394 - DNA, 13 bp, Homo sapiens
tcccctctgctgc

SEQ ID NO: 5944395 - DNA, 12 bp, Homo sapiens
tcccctctggct

SEQ ID NO: 5944396 - DNA, 22 bp, Homo sapiens
tcccctctggcttgacagcatg

SEQ ID NO: 5944397 - DNA, 22 bp, Homo sapiens
tcccctcttaaatgagaaagca

SEQ ID NO: 5944398 - DNA, 12 bp, Homo sapiens
tcccctcttcct

SEQ ID NO: 5944399 - DNA, 23 bp, Homo sapiens
tcccctcttcctaccctgcctcc

SEQ ID NO: 5944400 - DNA, 15 bp, Homo sapiens
tcccctcttctgagc

SEQ ID NO: 5944401 - DNA, 16 bp, Homo sapiens
tcccctcttctgagct

SEQ ID NO: 5944402 - DNA, 19 bp, Homo sapiens
tcccctcttcttctttcct

SEQ ID NO: 5944403 - DNA, 15 bp, Homo sapiens
tcccctcttgcccca

SEQ ID NO: 5944404 - DNA, 14 bp, Homo sapiens
tcccctgaaaaact

SEQ ID NO: 5944405 - DNA, 17 bp, Homo sapiens
tcccctgaatcctcaga

SEQ ID NO: 5944406 - DNA, 12 bp, Homo sapiens
tcccctgacagg

SEQ ID NO: 5944407 - DNA, 16 bp, Homo sapiens
tcccctgacctgtcca

SEQ ID NO: 5944408 - DNA, 18 bp, Homo sapiens
tcccctgagaccaccccc

SEQ ID NO: 5944409 - DNA, 20 bp, Homo sapiens
tcccctgagagtttcctcag

SEQ ID NO: 5944410 - DNA, 12 bp, Homo sapiens
tcccctgagccc

SEQ ID NO: 5944411 - DNA, 10 bp, Homo sapiens
tcccctgagg

SEQ ID NO: 5944412 - DNA, 18 bp, Homo sapiens
tcccctgaggctggcatc

SEQ ID NO: 5944413 - DNA, 20 bp, Homo sapiens
tcccctgaggttaaggggat

SEQ ID NO: 5944414 - DNA, 21 bp, Homo sapiens
tcccctgattacaccagcctc

SEQ ID NO: 5944415 - DNA, 12 bp, Homo sapiens
tcccctgcaatg

SEQ ID NO: 5944416 - DNA, 14 bp, Homo sapiens
tcccctgcactgga

SEQ ID NO: 5944417 - DNA, 17 bp, Homo sapiens
tccctaatgttttgctt

SEQ ID NO: 5944418 - DNA, 14 bp, Homo sapiens
tccctaattctctt

SEQ ID NO: 5944419 - DNA, 20 bp, Homo sapiens
tccctaattctcttcgctgt

SEQ ID NO: 5944420 - DNA, 17 bp, Homo sapiens
tccctaatttatgtgct

SEQ ID NO: 5944421 - DNA, 12 bp, Homo sapiens
tccctacacagg

SEQ ID NO: 5944422 - DNA, 15 bp, Homo sapiens
tccctacacagggcc

SEQ ID NO: 5944423 - DNA, 15 bp, Homo sapiens
tccctacactgatgc

SEQ ID NO: 5944424 - DNA, 18 bp, Homo sapiens
tccctacaggaggaacag

SEQ ID NO: 5944425 - DNA, 24 bp, Homo sapiens
tccctacatgtattgcacattgta

SEQ ID NO: 5944426 - DNA, 16 bp, Homo sapiens
tccctacattccccag

SEQ ID NO: 5944427 - DNA, 21 bp, Homo sapiens
tccctacccaatgtctcccac

SEQ ID NO: 5944428 - DNA, 13 bp, Homo sapiens
tccctacccacaa

SEQ ID NO: 5944429 - DNA, 17 bp, Homo sapiens
tccctacccacagggcc

SEQ ID NO: 5944430 - DNA, 18 bp, Homo sapiens
tccctacccacagggcct

SEQ ID NO: 5944431 - DNA, 24 bp, Homo sapiens
tccctacccacagggcctgacttt

SEQ ID NO: 5944432 - DNA, 14 bp, Homo sapiens
tccctacccactct

SEQ ID NO: 5944433 - DNA, 15 bp, Homo sapiens
tccctacccactctt

SEQ ID NO: 5944434 - DNA, 15 bp, Homo sapiens
tccctacccagtccc

SEQ ID NO: 5944435 - DNA, 22 bp, Homo sapiens
tccctaccccagggccctggcc

SEQ ID NO: 5944436 - DNA, 16 bp, Homo sapiens
tccctaccctctagag

SEQ ID NO: 5944437 - DNA, 16 bp, Homo sapiens
tccctaccctcttctc

SEQ ID NO: 5944438 - DNA, 15 bp, Homo sapiens
tccctacccttcctg

SEQ ID NO: 5944439 - DNA, 20 bp, Homo sapiens
tccctacctcaacctgtaaa

SEQ ID NO: 5944440 - DNA, 15 bp, Homo sapiens
tccctacctcaggca

SEQ ID NO: 5944441 - DNA, 19 bp, Homo sapiens
tccctacctccctcctcag

SEQ ID NO: 5944442 - DNA, 13 bp, Homo sapiens
tccctaccttgcc

SEQ ID NO: 5944443 - DNA, 14 bp, Homo sapiens
tccctaccttgcct

SEQ ID NO: 5944444 - DNA, 17 bp, Homo sapiens
tccctaccttgcctcct

SEQ ID NO: 5944445 - DNA, 19 bp, Homo sapiens
tccctactaacatcccaat

SEQ ID NO: 5944446 - DNA, 17 bp, Homo sapiens
tccctactagagacctc

SEQ ID NO: 5944447 - DNA, 15 bp, Homo sapiens
tccctactgtaattt

SEQ ID NO: 5944448 - DNA, 15 bp, Homo sapiens
tccctacttcctgtg

SEQ ID NO: 5944449 - DNA, 16 bp, Homo sapiens
tccctacttcctgtga

SEQ ID NO: 5944450 - DNA, 19 bp, Homo sapiens
tccctagaaacttccaaat

SEQ ID NO: 5944451 - DNA, 18 bp, Homo sapiens
tccctagaaagccatatt

SEQ ID NO: 5944452 - DNA, 22 bp, Homo sapiens
tccctagaaagccatattccag

SEQ ID NO: 5944453 - DNA, 24 bp, Homo sapiens
tccctagaagagcacagagccctg

SEQ ID NO: 5944454 - DNA, 14 bp, Homo sapiens
tccctagactttag

SEQ ID NO: 5944455 - DNA, 16 bp, Homo sapiens
tccctagagagaataa

SEQ ID NO: 5944456 - DNA, 18 bp, Homo sapiens
tccctagagagaataaat

SEQ ID NO: 5944457 - DNA, 23 bp, Homo sapiens
tccctagagagaataaattggat

SEQ ID NO: 5944458 - DNA, 20 bp, Homo sapiens
tccctagagggttcctgtag

SEQ ID NO: 5944459 - DNA, 12 bp, Homo sapiens
tccctagatcca

SEQ ID NO: 5944460 - DNA, 16 bp, Homo sapiens
tccctagatctttcta

SEQ ID NO: 5944461 - DNA, 15 bp, Homo sapiens
tccctagcagcccac

SEQ ID NO: 5944462 - DNA, 23 bp, Homo sapiens
tccctagcaggaacttctagctc

SEQ ID NO: 5944463 - DNA, 16 bp, Homo sapiens
tccctagccagcactt

SEQ ID NO: 5944464 - DNA, 22 bp, Homo sapiens
tccctagccagcacttgtatat

SEQ ID NO: 5944465 - DNA, 17 bp, Homo sapiens
tccctagcccttccagc

SEQ ID NO: 5944466 - DNA, 18 bp, Homo sapiens
tccctagcccttccagcc

SEQ ID NO: 5944467 - DNA, 19 bp, Homo sapiens
tccctagcccttccagcct

SEQ ID NO: 5944468 - DNA, 21 bp, Homo sapiens
tccctagcccttccagcctgg

SEQ ID NO: 5944469 - DNA, 18 bp, Homo sapiens
tccctagcctgcttttgt

SEQ ID NO: 5944470 - DNA, 14 bp, Homo sapiens
tccctagctgagga

SEQ ID NO: 5944471 - DNA, 21 bp, Homo sapiens
tccctagcttattttgtggct

SEQ ID NO: 5944472 - DNA, 15 bp, Homo sapiens
tccctaggagaccaa

SEQ ID NO: 5944473 - DNA, 20 bp, Homo sapiens
tccctaggagggaaggagct

SEQ ID NO: 5944474 - DNA, 18 bp, Homo sapiens
tccctaggcacctctgtg

SEQ ID NO: 5944475 - DNA, 20 bp, Homo sapiens
tccctaggcacctctgtgct

SEQ ID NO: 5944476 - DNA, 13 bp, Homo sapiens
tccctaggcccaa

SEQ ID NO: 5944477 - DNA, 14 bp, Homo sapiens
tccctaggcccaag

SEQ ID NO: 5944478 - DNA, 21 bp, Homo sapiens
tccctagggctggcagaaagg

SEQ ID NO: 5944479 - DNA, 20 bp, Homo sapiens
tccctagtagctgggattac

SEQ ID NO: 5944480 - DNA, 21 bp, Homo sapiens
tccctagtagctgggattaca

SEQ ID NO: 5944481 - DNA, 22 bp, Homo sapiens
tccctagtccccctgttttctg

SEQ ID NO: 5944482 - DNA, 15 bp, Homo sapiens
tccctagttacccac

SEQ ID NO: 5944483 - DNA, 22 bp, Homo sapiens
tccctagttagcatccaggctg

SEQ ID NO: 5944484 - DNA, 17 bp, Homo sapiens
tccctataataaaggct

SEQ ID NO: 5944485 - DNA, 17 bp, Homo sapiens
tccctatactgcttgga

SEQ ID NO: 5944486 - DNA, 20 bp, Homo sapiens
tccctataggaacagcccag

SEQ ID NO: 5944487 - DNA, 17 bp, Homo sapiens
tccctatatcagggcct

SEQ ID NO: 5944488 - DNA, 20 bp, Homo sapiens
tccctatatcagggcctgag

SEQ ID NO: 5944489 - DNA, 22 bp, Homo sapiens
tccctatatcagggcctgagtg

SEQ ID NO: 5944490 - DNA, 19 bp, Homo sapiens
tccctatatgcacccctgg

SEQ ID NO: 5944491 - DNA, 14 bp, Homo sapiens
tccctatcaaaaca

SEQ ID NO: 5944492 - DNA, 21 bp, Homo sapiens
tccctatcactgaagcttttt

SEQ ID NO: 5944493 - DNA, 19 bp, Homo sapiens
tccctatctattaaagtga

SEQ ID NO: 5944494 - DNA, 20 bp, Homo sapiens
tccctatctattaaagtgac

SEQ ID NO: 5944495 - DNA, 21 bp, Homo sapiens
tccctatctattaaagtgact

SEQ ID NO: 5944496 - DNA, 22 bp, Homo sapiens
tccctatctattaaagtgactt

SEQ ID NO: 5944497 - DNA, 19 bp, Homo sapiens
tccctatctttgccaccct

SEQ ID NO: 5944498 - DNA, 15 bp, Homo sapiens
tccctatgaaagatt

SEQ ID NO: 5944499 - DNA, 14 bp, Homo sapiens
tccctatggaaaga

SEQ ID NO: 5944500 - DNA, 19 bp, Homo sapiens
tccctatggctgagccttg

SEQ ID NO: 5944501 - DNA, 13 bp, Homo sapiens
tccctatgtattt

SEQ ID NO: 5944502 - DNA, 15 bp, Homo sapiens
tccctatgtatttgc

SEQ ID NO: 5944503 - DNA, 18 bp, Homo sapiens
tccctatgtatttgcagt

SEQ ID NO: 5944504 - DNA, 16 bp, Homo sapiens
tccctatgttgcccag

SEQ ID NO: 5944505 - DNA, 23 bp, Homo sapiens
tccctattagatacacttcttaa

SEQ ID NO: 5944506 - DNA, 21 bp, Homo sapiens
tccctattctgtgttttatct

SEQ ID NO: 5944507 - DNA, 21 bp, Homo sapiens
tccctatttttctctcctgtc

SEQ ID NO: 5944508 - DNA, 17 bp, Homo sapiens
tccctcaaagaggcctt

SEQ ID NO: 5944509 - DNA, 20 bp, Homo sapiens
tccctcaaagcttccattcc

SEQ ID NO: 5944510 - DNA, 22 bp, Homo sapiens
tccctcaaagcttccattccac

SEQ ID NO: 5944511 - DNA, 19 bp, Homo sapiens
tccctcaaatgacccaaag

SEQ ID NO: 5944512 - DNA, 22 bp, Homo sapiens
tccctcaacaagggagagacct

SEQ ID NO: 5944513 - DNA, 19 bp, Homo sapiens
tccctcaactgagggccag

SEQ ID NO: 5944514 - DNA, 21 bp, Homo sapiens
tccctcacacctcccttcatc

SEQ ID NO: 5944515 - DNA, 17 bp, Homo sapiens
tccctcacccacccaca

SEQ ID NO: 5944516 - DNA, 12 bp, Homo sapiens
tccctcaccccc

SEQ ID NO: 5944517 - DNA, 15 bp, Homo sapiens
tccctcaccccctcc

SEQ ID NO: 5944518 - DNA, 20 bp, Homo sapiens
tccctcaccccctcccaccc

SEQ ID NO: 5944519 - DNA, 23 bp, Homo sapiens
tccctcaccccctcccaccccca

SEQ ID NO: 5944520 - DNA, 22 bp, Homo sapiens
tccctcaccctgagccccttcc

SEQ ID NO: 5944521 - DNA, 20 bp, Homo sapiens
tccctcacctgtagcagcca

SEQ ID NO: 5944522 - DNA, 15 bp, Homo sapiens
tccctcaccttctga

SEQ ID NO: 5944523 - DNA, 21 bp, Homo sapiens
tccctcaccttggcaccagac

SEQ ID NO: 5944524 - DNA, 19 bp, Homo sapiens
tccctcacgtttcttcccc

SEQ ID NO: 5944525 - DNA, 20 bp, Homo sapiens
tccctcacgtttcttcccca

SEQ ID NO: 5944526 - DNA, 20 bp, Homo sapiens
tccctcactccacagagtga

SEQ ID NO: 5944527 - DNA, 19 bp, Homo sapiens
tccctcactcgtctccccc

SEQ ID NO: 5944528 - DNA, 14 bp, Homo sapiens
tccctcactctcag

SEQ ID NO: 5944529 - DNA, 11 bp, Homo sapiens
tccctcagacc

SEQ ID NO: 5944530 - DNA, 15 bp, Homo sapiens
tccctcagacccagg

SEQ ID NO: 5944531 - DNA, 16 bp, Homo sapiens
tccctcagacccagga

SEQ ID NO: 5944532 - DNA, 23 bp, Homo sapiens
tccctcagacccaggagtccaga

SEQ ID NO: 5944533 - DNA, 14 bp, Homo sapiens
tccctcagactggg

SEQ ID NO: 5944534 - DNA, 16 bp, Homo sapiens
tccctcagactggggc

SEQ ID NO: 5944535 - DNA, 16 bp, Homo sapiens
tccctcagagacacca

SEQ ID NO: 5944536 - DNA, 14 bp, Homo sapiens
tccctcagccacgc

SEQ ID NO: 5944537 - DNA, 22 bp, Homo sapiens
tccctcagccacgcctctctca

SEQ ID NO: 5944538 - DNA, 16 bp, Homo sapiens
tccctcagccctcatt

SEQ ID NO: 5944539 - DNA, 18 bp, Homo sapiens
tccctcagccctcattaa

SEQ ID NO: 5944540 - DNA, 13 bp, Homo sapiens
tccctcagcctca

SEQ ID NO: 5944541 - DNA, 17 bp, Homo sapiens
tccctcagcggaggggt

SEQ ID NO: 5944542 - DNA, 13 bp, Homo sapiens
tccctcaggccca

SEQ ID NO: 5944543 - DNA, 17 bp, Homo sapiens
tccctcaggcccaggag

SEQ ID NO: 5944544 - DNA, 18 bp, Homo sapiens
tccctcaggcccaggagt

SEQ ID NO: 5944545 - DNA, 22 bp, Homo sapiens
tccctcaggcccaggagtccag

SEQ ID NO: 5944546 - DNA, 15 bp, Homo sapiens
tccctcaggggcagg

SEQ ID NO: 5944547 - DNA, 18 bp, Homo sapiens
tccctcaggttctatttt

SEQ ID NO: 5944548 - DNA, 20 bp, Homo sapiens
tccctcagtctggcccttcc

SEQ ID NO: 5944549 - DNA, 15 bp, Homo sapiens
tccctcagtttctta

SEQ ID NO: 5944550 - DNA, 20 bp, Homo sapiens
tccctcatatgcatgccctt

SEQ ID NO: 5944551 - DNA, 21 bp, Homo sapiens
tccctcatctagtcttgacct

SEQ ID NO: 5944552 - DNA, 21 bp, Homo sapiens
tccctcatctgtccctccggg

SEQ ID NO: 5944553 - DNA, 19 bp, Homo sapiens
tccctcatcttgccccctc

SEQ ID NO: 5944554 - DNA, 14 bp, Homo sapiens
tccctcatgcagat

SEQ ID NO: 5944555 - DNA, 15 bp, Homo sapiens
tccctcatgcagata

SEQ ID NO: 5944556 - DNA, 15 bp, Homo sapiens
tccctcatggctctg

SEQ ID NO: 5944557 - DNA, 19 bp, Homo sapiens
tccctcatgtatacttcaa

SEQ ID NO: 5944558 - DNA, 14 bp, Homo sapiens
tccctcattcatct

SEQ ID NO: 5944559 - DNA, 20 bp, Homo sapiens
tccctcattcatcttgcaag

SEQ ID NO: 5944560 - DNA, 19 bp, Homo sapiens
tccctcatttcaggagcag

SEQ ID NO: 5944561 - DNA, 23 bp, Homo sapiens
tccctcatttcaggagcagcctc

SEQ ID NO: 5944562 - DNA, 18 bp, Homo sapiens
tccctcatttcattattt

SEQ ID NO: 5944563 - DNA, 15 bp, Homo sapiens
tccctccaacacaga

SEQ ID NO: 5944564 - DNA, 17 bp, Homo sapiens
tccctccaacacagatc

SEQ ID NO: 5944565 - DNA, 17 bp, Homo sapiens
tccctccaagcctggca

SEQ ID NO: 5944566 - DNA, 22 bp, Homo sapiens
tccctccaagcctggcacccac

SEQ ID NO: 5944567 - DNA, 13 bp, Homo sapiens
tccctccaaggct

SEQ ID NO: 5944568 - DNA, 20 bp, Homo sapiens
tccctccaaggctgtcttct

SEQ ID NO: 5944569 - DNA, 15 bp, Homo sapiens
tccctccaaggtcct

SEQ ID NO: 5944570 - DNA, 14 bp, Homo sapiens
tccctccaattccc

SEQ ID NO: 5944571 - DNA, 19 bp, Homo sapiens
tccctccaattccccctta

SEQ ID NO: 5944572 - DNA, 9 bp, Homo sapiens
tccctccac

SEQ ID NO: 5944573 - DNA, 18 bp, Homo sapiens
tccctccacacctccacc

SEQ ID NO: 5944574 - DNA, 20 bp, Homo sapiens
tccctccacacctccacccg

SEQ ID NO: 5944575 - DNA, 13 bp, Homo sapiens
tccctccaccagc

SEQ ID NO: 5944576 - DNA, 21 bp, Homo sapiens
tccctccaccagcctgctgac

SEQ ID NO: 5944577 - DNA, 14 bp, Homo sapiens
tccctccaccccag

SEQ ID NO: 5944578 - DNA, 16 bp, Homo sapiens
tccctccaccccagga

SEQ ID NO: 5944579 - DNA, 18 bp, Homo sapiens
tccctccaccccaggacg

SEQ ID NO: 5944580 - DNA, 19 bp, Homo sapiens
tccctccaccccagtcccc

SEQ ID NO: 5944581 - DNA, 23 bp, Homo sapiens
tccctccaccccagtccccggga

SEQ ID NO: 5944582 - DNA, 22 bp, Homo sapiens
tccctccacccccatgtggcag

SEQ ID NO: 5944583 - DNA, 11 bp, Homo sapiens
tccctccacct

SEQ ID NO: 5944584 - DNA, 14 bp, Homo sapiens
tccctccacctacc

SEQ ID NO: 5944585 - DNA, 13 bp, Homo sapiens
tccctccacctca

SEQ ID NO: 5944586 - DNA, 14 bp, Homo sapiens
tccctccacctccc

SEQ ID NO: 5944587 - DNA, 21 bp, Homo sapiens
tccctccacgcttagggtctg

SEQ ID NO: 5944588 - DNA, 18 bp, Homo sapiens
tccctccacgttcacccc

SEQ ID NO: 5944589 - DNA, 15 bp, Homo sapiens
tccctccactccatc

SEQ ID NO: 5944590 - DNA, 18 bp, Homo sapiens
tccctccactccatccct

SEQ ID NO: 5944591 - DNA, 15 bp, Homo sapiens
tccctccactcctcc

SEQ ID NO: 5944592 - DNA, 17 bp, Homo sapiens
tccctccactcctccca

SEQ ID NO: 5944593 - DNA, 22 bp, Homo sapiens
tccctccactcctcccaactct

SEQ ID NO: 5944594 - DNA, 14 bp, Homo sapiens
tccctctctggaga

SEQ ID NO: 5944595 - DNA, 15 bp, Homo sapiens
tccctctctggagaa

SEQ ID NO: 5944596 - DNA, 15 bp, Homo sapiens
tccctctctggtttc

SEQ ID NO: 5944597 - DNA, 15 bp, Homo sapiens
tccctctcttcccct

SEQ ID NO: 5944598 - DNA, 17 bp, Homo sapiens
tccctctcttccgggag

SEQ ID NO: 5944599 - DNA, 19 bp, Homo sapiens
tccctctcttccgggagct

SEQ ID NO: 5944600 - DNA, 21 bp, Homo sapiens
tccctctcttccgggagctgg

SEQ ID NO: 5944601 - DNA, 22 bp, Homo sapiens
tccctctcttccgggagctggt

SEQ ID NO: 5944602 - DNA, 14 bp, Homo sapiens
tccctctcttgcct

SEQ ID NO: 5944603 - DNA, 12 bp, Homo sapiens
tccctctgaccc

SEQ ID NO: 5944604 - DNA, 13 bp, Homo sapiens
tccctctgacctg

SEQ ID NO: 5944605 - DNA, 17 bp, Homo sapiens
tccctctgacctgcagg

SEQ ID NO: 5944606 - DNA, 18 bp, Homo sapiens
tccctctgcattgacctg

SEQ ID NO: 5944607 - DNA, 16 bp, Homo sapiens
tccctctgccccaagc

SEQ ID NO: 5944608 - DNA, 23 bp, Homo sapiens
tccctctgccccaagcagccagc

SEQ ID NO: 5944609 - DNA, 13 bp, Homo sapiens
tccctctgcctca

SEQ ID NO: 5944610 - DNA, 17 bp, Homo sapiens
tccctctgcctcatcct

SEQ ID NO: 5944611 - DNA, 14 bp, Homo sapiens
tccctctgcctggg

SEQ ID NO: 5944612 - DNA, 16 bp, Homo sapiens
tccctctgcctgggat

SEQ ID NO: 5944613 - DNA, 18 bp, Homo sapiens
tccctctgcctgtccctc

SEQ ID NO: 5944614 - DNA, 20 bp, Homo sapiens
tccctctgcctgtccctctc

SEQ ID NO: 5944615 - DNA, 13 bp, Homo sapiens
tccctctgctcag

SEQ ID NO: 5944616 - DNA, 14 bp, Homo sapiens
tccctctgctcagc

SEQ ID NO: 5944617 - DNA, 13 bp, Homo sapiens
tccctctgctcca

SEQ ID NO: 5944618 - DNA, 23 bp, Homo sapiens
tccctctgctccgtgtgtctcat

SEQ ID NO: 5944619 - DNA, 15 bp, Homo sapiens
tccctctgctcctgg

SEQ ID NO: 5944620 - DNA, 20 bp, Homo sapiens
tccctctgctcctggagcct

SEQ ID NO: 5944621 - DNA, 12 bp, Homo sapiens
tccctctgctct

SEQ ID NO: 5944622 - DNA, 13 bp, Homo sapiens
tccctctgctctc

SEQ ID NO: 5944623 - DNA, 13 bp, Homo sapiens
tccctctgctgct

SEQ ID NO: 5944624 - DNA, 20 bp, Homo sapiens
tccctctggagtttcatgtt

SEQ ID NO: 5944625 - DNA, 17 bp, Homo sapiens
tccctctggccctgcct

SEQ ID NO: 5944626 - DNA, 19 bp, Homo sapiens
tccctctggccctgccttc

SEQ ID NO: 5944627 - DNA, 12 bp, Homo sapiens
tccctctggctt

SEQ ID NO: 5944628 - DNA, 14 bp, Homo sapiens
tccctctggcttcc

SEQ ID NO: 5944629 - DNA, 12 bp, Homo sapiens
tccctctgggcc

SEQ ID NO: 5944630 - DNA, 13 bp, Homo sapiens
tccctctgggcct

SEQ ID NO: 5944631 - DNA, 14 bp, Homo sapiens
tccctctgggcctg

SEQ ID NO: 5944632 - DNA, 15 bp, Homo sapiens
tccctctgggcctgt

SEQ ID NO: 5944633 - DNA, 16 bp, Homo sapiens
tccctctgggcctgtt

SEQ ID NO: 5944634 - DNA, 17 bp, Homo sapiens
tccctctgggcctgttc

SEQ ID NO: 5944635 - DNA, 18 bp, Homo sapiens
tccctctgggcctgttct

SEQ ID NO: 5944636 - DNA, 20 bp, Homo sapiens
tccctctgggcctgttctct

SEQ ID NO: 5944637 - DNA, 20 bp, Homo sapiens
tccctctgtcatcctcagga

SEQ ID NO: 5944638 - DNA, 17 bp, Homo sapiens
tccctctgtcttttctc

SEQ ID NO: 5944639 - DNA, 23 bp, Homo sapiens
tccctctgtcttttctcctccgc

SEQ ID NO: 5944640 - DNA, 13 bp, Homo sapiens
tccctctgttgga

SEQ ID NO: 5944641 - DNA, 13 bp, Homo sapiens
tccctctgtttct

SEQ ID NO: 5944642 - DNA, 20 bp, Homo sapiens
tccctcttcactgtggccac

SEQ ID NO: 5944643 - DNA, 15 bp, Homo sapiens
tccctcttcccagca

SEQ ID NO: 5944644 - DNA, 16 bp, Homo sapiens
tccctcttcccagcac

SEQ ID NO: 5944645 - DNA, 13 bp, Homo sapiens
tccctcttccctg

SEQ ID NO: 5944646 - DNA, 15 bp, Homo sapiens
tccctcttcctctcc

SEQ ID NO: 5944647 - DNA, 15 bp, Homo sapiens
tccctcttccttccc

SEQ ID NO: 5944648 - DNA, 23 bp, Homo sapiens
tccctcttctaacccaactgact

SEQ ID NO: 5944649 - DNA, 15 bp, Homo sapiens
tccctcttctctcct

SEQ ID NO: 5944650 - DNA, 17 bp, Homo sapiens
tccctcttctctcctca

SEQ ID NO: 5944651 - DNA, 13 bp, Homo sapiens
tccctcttggttt

SEQ ID NO: 5944652 - DNA, 22 bp, Homo sapiens
tccctcttgtcagtgtagacac

SEQ ID NO: 5944653 - DNA, 13 bp, Homo sapiens
tccctcttgtggg

SEQ ID NO: 5944654 - DNA, 13 bp, Homo sapiens
tccctcttgtttt

SEQ ID NO: 5944655 - DNA, 22 bp, Homo sapiens
tccctcttgttttgtttgtctc

SEQ ID NO: 5944656 - DNA, 19 bp, Homo sapiens
tccctctttccccacctct

SEQ ID NO: 5944657 - DNA, 14 bp, Homo sapiens
tccctctttccctc

SEQ ID NO: 5944658 - DNA, 20 bp, Homo sapiens
tccctctttccctcccttcc

SEQ ID NO: 5944659 - DNA, 16 bp, Homo sapiens
tccctctttcctgtgc

SEQ ID NO: 5944660 - DNA, 12 bp, Homo sapiens
tccctctttcta

SEQ ID NO: 5944661 - DNA, 16 bp, Homo sapiens
tccctctttggaacag

SEQ ID NO: 5944662 - DNA, 23 bp, Homo sapiens
tccctctttggctcccctgtacc

SEQ ID NO: 5944663 - DNA, 13 bp, Homo sapiens
tccctcttttctt

SEQ ID NO: 5944664 - DNA, 14 bp, Homo sapiens
tccctcttttctta

SEQ ID NO: 5944665 - DNA, 16 bp, Homo sapiens
tccctcttttcttact

SEQ ID NO: 5944666 - DNA, 15 bp, Homo sapiens
tccctgaaaacccag

SEQ ID NO: 5944667 - DNA, 16 bp, Homo sapiens
tccctgaaaacccaga

SEQ ID NO: 5944668 - DNA, 19 bp, Homo sapiens
tccctgaaacactgcttct

SEQ ID NO: 5944669 - DNA, 20 bp, Homo sapiens
tccctgaaacactgcttctc

SEQ ID NO: 5944670 - DNA, 16 bp, Homo sapiens
tccctgaacactcatc

SEQ ID NO: 5944671 - DNA, 17 bp, Homo sapiens
tccctgaacagatacat

SEQ ID NO: 5944672 - DNA, 17 bp, Homo sapiens
tccctgaacatctgtgt

SEQ ID NO: 5944673 - DNA, 19 bp, Homo sapiens
tccctgaacccctggccag

SEQ ID NO: 5944674 - DNA, 16 bp, Homo sapiens
tccctgaacctcagtt

SEQ ID NO: 5944675 - DNA, 17 bp, Homo sapiens
tccctgaaccttcctgt

SEQ ID NO: 5944676 - DNA, 17 bp, Homo sapiens
tccctgaactcccagaa

SEQ ID NO: 5944677 - DNA, 16 bp, Homo sapiens
tccctgaactgggacc

SEQ ID NO: 5944678 - DNA, 17 bp, Homo sapiens
tccctgaactgggacct

SEQ ID NO: 5944679 - DNA, 18 bp, Homo sapiens
tccctgaagccagccttc

SEQ ID NO: 5944680 - DNA, 20 bp, Homo sapiens
tccctgaaggaaccaaagcg

SEQ ID NO: 5944681 - DNA, 17 bp, Homo sapiens
tccctgaaggccccgcc

SEQ ID NO: 5944682 - DNA, 22 bp, Homo sapiens
tccctgaaggccccgcccaggc

SEQ ID NO: 5944683 - DNA, 20 bp, Homo sapiens
tccctgaagtcttgcattga

SEQ ID NO: 5944684 - DNA, 17 bp, Homo sapiens
tccctgaatctgtgcct

SEQ ID NO: 5944685 - DNA, 18 bp, Homo sapiens
tccctgaatctgtgcctg

SEQ ID NO: 5944686 - DNA, 22 bp, Homo sapiens
tccctgacactgtctgctgccc

SEQ ID NO: 5944687 - DNA, 18 bp, Homo sapiens
tccctgaccaccctgcct

SEQ ID NO: 5944688 - DNA, 16 bp, Homo sapiens
tccctgaccctgtata

SEQ ID NO: 5944689 - DNA, 22 bp, Homo sapiens
tccctgaccttagcgttctgga

SEQ ID NO: 5944690 - DNA, 16 bp, Homo sapiens
tccctgaccttctcca

SEQ ID NO: 5944691 - DNA, 20 bp, Homo sapiens
tccctgaccttctccaggga

SEQ ID NO: 5944692 - DNA, 24 bp, Homo sapiens
tccctgacgacactgaagaatcaa

SEQ ID NO: 5944693 - DNA, 19 bp, Homo sapiens
tccctgacgtctgccacca

SEQ ID NO: 5944694 - DNA, 22 bp, Homo sapiens
tccctgactcattctgaaggag

SEQ ID NO: 5944695 - DNA, 17 bp, Homo sapiens
tccctgactccctgtgg

SEQ ID NO: 5944696 - DNA, 14 bp, Homo sapiens
tccctgactggcca

SEQ ID NO: 5944697 - DNA, 14 bp, Homo sapiens
tccctgactggcct

SEQ ID NO: 5944698 - DNA, 15 bp, Homo sapiens
tccctgactggcctg

SEQ ID NO: 5944699 - DNA, 15 bp, Homo sapiens
tccctgactgggagt

SEQ ID NO: 5944700 - DNA, 15 bp, Homo sapiens
tccctgacttcccag

SEQ ID NO: 5944701 - DNA, 17 bp, Homo sapiens
tccctgacttctccccc

SEQ ID NO: 5944702 - DNA, 15 bp, Homo sapiens
tccctgacttgcttt

SEQ ID NO: 5944703 - DNA, 16 bp, Homo sapiens
tccctgacttttctgt

SEQ ID NO: 5944704 - DNA, 19 bp, Homo sapiens
tccctgagaaacccaccag

SEQ ID NO: 5944705 - DNA, 16 bp, Homo sapiens
tccctgagcagtctac

SEQ ID NO: 5944706 - DNA, 12 bp, Homo sapiens
tccctgagcctg

SEQ ID NO: 5944707 - DNA, 20 bp, Homo sapiens
tccctgagcctgcattctgc

SEQ ID NO: 5944708 - DNA, 16 bp, Homo sapiens
tccctgagcctgcccc

SEQ ID NO: 5944709 - DNA, 21 bp, Homo sapiens
tccctgagcctgccccagctg

SEQ ID NO: 5944710 - DNA, 22 bp, Homo sapiens
tccctgagcctgccccagctgg

SEQ ID NO: 5944711 - DNA, 14 bp, Homo sapiens
tccctgaggaatga

SEQ ID NO: 5944712 - DNA, 20 bp, Homo sapiens
tccctgaggcaggtccccag

SEQ ID NO: 5944713 - DNA, 21 bp, Homo sapiens
tccctgaggcaggtccccaga

SEQ ID NO: 5944714 - DNA, 21 bp, Homo sapiens
tccctgagggcccttcccaac

SEQ ID NO: 5944715 - DNA, 22 bp, Homo sapiens
tccctgaggtacctttccaccc

SEQ ID NO: 5944716 - DNA, 22 bp, Homo sapiens
tccctgaggttaaacggtgccc

SEQ ID NO: 5944717 - DNA, 16 bp, Homo sapiens
tccctgagtcaccagg

SEQ ID NO: 5944718 - DNA, 21 bp, Homo sapiens
tccctgagtcaccaggaatgt

SEQ ID NO: 5944719 - DNA, 18 bp, Homo sapiens
tccctgagtctggacctc

SEQ ID NO: 5944720 - DNA, 22 bp, Homo sapiens
tccctgagtctggacctccatc

SEQ ID NO: 5944721 - DNA, 22 bp, Homo sapiens
tccctgagttgcaccattcttt

SEQ ID NO: 5944722 - DNA, 14 bp, Homo sapiens
tccctgataaatat

SEQ ID NO: 5944723 - DNA, 21 bp, Homo sapiens
tccctgataacaacctggaga

SEQ ID NO: 5944724 - DNA, 15 bp, Homo sapiens
tccctgatcccaccc

SEQ ID NO: 5944725 - DNA, 17 bp, Homo sapiens
tccctgatcccttccac

SEQ ID NO: 5944726 - DNA, 20 bp, Homo sapiens
tccctgatgacacccaccct

SEQ ID NO: 5944727 - DNA, 19 bp, Homo sapiens
tccctgatggaccctcagt

SEQ ID NO: 5944728 - DNA, 14 bp, Homo sapiens
tccctgatggggga

SEQ ID NO: 5944729 - DNA, 16 bp, Homo sapiens
tccctgatgtacagtt

SEQ ID NO: 5944730 - DNA, 20 bp, Homo sapiens
tccctgattaaagtgccttc

SEQ ID NO: 5944731 - DNA, 17 bp, Homo sapiens
tccctgattgacctgct

SEQ ID NO: 5944732 - DNA, 18 bp, Homo sapiens
tccctgattgacctgctc

SEQ ID NO: 5944733 - DNA, 13 bp, Homo sapiens
tccctgatttgga

SEQ ID NO: 5944734 - DNA, 15 bp, Homo sapiens
tccctgcaaaactcc

SEQ ID NO: 5944735 - DNA, 21 bp, Homo sapiens
tccctgcaagctccgcctccc

SEQ ID NO: 5944736 - DNA, 20 bp, Homo sapiens
tccctgcaaggtgcacctgc

SEQ ID NO: 5944737 - DNA, 21 bp, Homo sapiens
tccctgcacacggcacagagc

SEQ ID NO: 5944738 - DNA, 14 bp, Homo sapiens
tccctgcacagcct

SEQ ID NO: 5944739 - DNA, 22 bp, Homo sapiens
tccctgcacagtgacttctgag

SEQ ID NO: 5944740 - DNA, 16 bp, Homo sapiens
tccctgcacataaact

SEQ ID NO: 5944741 - DNA, 16 bp, Homo sapiens
tccctgcaccactctc

SEQ ID NO: 5944742 - DNA, 15 bp, Homo sapiens
tccctgcacccatga

SEQ ID NO: 5944743 - DNA, 13 bp, Homo sapiens
tccctgcaccctg

SEQ ID NO: 5944744 - DNA, 17 bp, Homo sapiens
tccctgcaccctggaaa

SEQ ID NO: 5944745 - DNA, 13 bp, Homo sapiens
tccctgcaccgcc

SEQ ID NO: 5944746 - DNA, 23 bp, Homo sapiens
  misc_feature (14)..(14): n is a, c, g or t
tccctgcacctgcnttgtccctg

SEQ ID NO: 5944747 - DNA, 23 bp, Homo sapiens
tccctgcacgcattttctctgta

SEQ ID NO: 5944748 - DNA, 21 bp, Homo sapiens
tccctgcactaaagccagcct

SEQ ID NO: 5944749 - DNA, 19 bp, Homo sapiens
tccctgcactccctcctgg

SEQ ID NO: 5944750 - DNA, 16 bp, Homo sapiens
tccctgcactgtgccc

SEQ ID NO: 5944751 - DNA, 17 bp, Homo sapiens
tccctgcactgtgcccc

SEQ ID NO: 5944752 - DNA, 14 bp, Homo sapiens
tccctgcactgtgt

SEQ ID NO: 5944753 - DNA, 15 bp, Homo sapiens
tccctgcagacctca

SEQ ID NO: 5944754 - DNA, 19 bp, Homo sapiens
tccctgcagacctcaagcc

SEQ ID NO: 5944755 - DNA, 22 bp, Homo sapiens
tccctgcagacctcaagccatc

SEQ ID NO: 5944756 - DNA, 22 bp, Homo sapiens
tccctgcagatgccaccctagc

SEQ ID NO: 5944757 - DNA, 12 bp, Homo sapiens
tccctgcagctg

SEQ ID NO: 5944758 - DNA, 14 bp, Homo sapiens
tccctgcagggcca

SEQ ID NO: 5944759 - DNA, 14 bp, Homo sapiens
tccctgcaggggct

SEQ ID NO: 5944760 - DNA, 22 bp, Homo sapiens
tccctgcagggtagggggcctg

SEQ ID NO: 5944761 - DNA, 19 bp, Homo sapiens
tccctgcatatgcttctga

SEQ ID NO: 5944762 - DNA, 22 bp, Homo sapiens
tccctgcatatgcttctgatgg

SEQ ID NO: 5944763 - DNA, 16 bp, Homo sapiens
tccctgcatccaatct

SEQ ID NO: 5944764 - DNA, 21 bp, Homo sapiens
tccctgcatcccttggcccct

SEQ ID NO: 5944765 - DNA, 20 bp, Homo sapiens
tccctgcatcctgaggccag

SEQ ID NO: 5944766 - DNA, 22 bp, Homo sapiens
tccctgcatctgaccagcagcg

SEQ ID NO: 5944767 - DNA, 13 bp, Homo sapiens
tccctgcatggca

SEQ ID NO: 5944768 - DNA, 22 bp, Homo sapiens
tccctgcatggcatcctccagc

SEQ ID NO: 5944769 - DNA, 20 bp, Homo sapiens
tccctgccaatgctccagct

SEQ ID NO: 5944770 - DNA, 14 bp, Homo sapiens
tccctgccaatgga

SEQ ID NO: 5944771 - DNA, 11 bp, Homo sapiens
tccctgccaca

SEQ ID NO: 5944772 - DNA, 15 bp, Homo sapiens
tcccttccacctgct

SEQ ID NO: 5944773 - DNA, 20 bp, Homo sapiens
tcccttccacctgctctgct

SEQ ID NO: 5944774 - DNA, 13 bp, Homo sapiens
tcccttccactgc

SEQ ID NO: 5944775 - DNA, 19 bp, Homo sapiens
tcccttccactgcctctgc

SEQ ID NO: 5944776 - DNA, 22 bp, Homo sapiens
tcccttccactgcctctgcctt

SEQ ID NO: 5944777 - DNA, 23 bp, Homo sapiens
tcccttccaggaatgctgggccc

SEQ ID NO: 5944778 - DNA, 19 bp, Homo sapiens
tcccttccagtttattcca

SEQ ID NO: 5944779 - DNA, 23 bp, Homo sapiens
tcccttccagtttattccagagc

SEQ ID NO: 5944780 - DNA, 14 bp, Homo sapiens
tcccttccatgccc

SEQ ID NO: 5944781 - DNA, 16 bp, Homo sapiens
tcccttccatgccctg

SEQ ID NO: 5944782 - DNA, 15 bp, Homo sapiens
tcccttccatttcta

SEQ ID NO: 5944783 - DNA, 16 bp, Homo sapiens
tcccttcccacctctc

SEQ ID NO: 5944784 - DNA, 16 bp, Homo sapiens
tcccttcccagtgggc

SEQ ID NO: 5944785 - DNA, 17 bp, Homo sapiens
tcccttcccagtgggct

SEQ ID NO: 5944786 - DNA, 19 bp, Homo sapiens
tcccttccccactctgctc

SEQ ID NO: 5944787 - DNA, 17 bp, Homo sapiens
tcccttcccccataagc

SEQ ID NO: 5944788 - DNA, 20 bp, Homo sapiens
tcccttccccctgctgatca

SEQ ID NO: 5944789 - DNA, 22 bp, Homo sapiens
tcccttccccttcaccgctccc

SEQ ID NO: 5944790 - DNA, 14 bp, Homo sapiens
tcccttcccgaccc

SEQ ID NO: 5944791 - DNA, 20 bp, Homo sapiens
tcccttccctaaagtgatgg

SEQ ID NO: 5944792 - DNA, 15 bp, Homo sapiens
tcccttccctgcagg

SEQ ID NO: 5944793 - DNA, 17 bp, Homo sapiens
tcccttcccttccactg

SEQ ID NO: 5944794 - DNA, 16 bp, Homo sapiens
tcccttccgaccctct

SEQ ID NO: 5944795 - DNA, 22 bp, Homo sapiens
tcccttccgaccctctgggaac

SEQ ID NO: 5944796 - DNA, 21 bp, Homo sapiens
tcccttccgtccatccccctt

SEQ ID NO: 5944797 - DNA, 22 bp, Homo sapiens
tcccttccgtccatcccccttc

SEQ ID NO: 5944798 - DNA, 14 bp, Homo sapiens
tcccttcctacagt

SEQ ID NO: 5944799 - DNA, 14 bp, Homo sapiens
tcccttcctattcc

SEQ ID NO: 5944800 - DNA, 12 bp, Homo sapiens
tcccttcctcca

SEQ ID NO: 5944801 - DNA, 14 bp, Homo sapiens
tcccttcctccatt

SEQ ID NO: 5944802 - DNA, 15 bp, Homo sapiens
tcccttcctcctctc

SEQ ID NO: 5944803 - DNA, 19 bp, Homo sapiens
tcccttcctcctctcctgg

SEQ ID NO: 5944804 - DNA, 20 bp, Homo sapiens
tcccttcctcggtggctctg

SEQ ID NO: 5944805 - DNA, 14 bp, Homo sapiens
tcccttcctcttcc

SEQ ID NO: 5944806 - DNA, 19 bp, Homo sapiens
tcccttcctgccagcccct

SEQ ID NO: 5944807 - DNA, 13 bp, Homo sapiens
tcccttcctggcc

SEQ ID NO: 5944808 - DNA, 15 bp, Homo sapiens
tcccttcctggcctc

SEQ ID NO: 5944809 - DNA, 14 bp, Homo sapiens
tcccttcctgtctg

SEQ ID NO: 5944810 - DNA, 14 bp, Homo sapiens
tcccttccttatgc

SEQ ID NO: 5944811 - DNA, 16 bp, Homo sapiens
tcccttccttcctctc

SEQ ID NO: 5944812 - DNA, 17 bp, Homo sapiens
tcccttccttgggcaga

SEQ ID NO: 5944813 - DNA, 16 bp, Homo sapiens
tcccttcctttctccc

SEQ ID NO: 5944814 - DNA, 18 bp, Homo sapiens
tcccttcgctctgctgga

SEQ ID NO: 5944815 - DNA, 23 bp, Homo sapiens
tcccttcggagccaacaagaccg

SEQ ID NO: 5944816 - DNA, 14 bp, Homo sapiens
tcccttcggccaaa

SEQ ID NO: 5944817 - DNA, 15 bp, Homo sapiens
tcccttcgtgtgtgc

SEQ ID NO: 5944818 - DNA, 15 bp, Homo sapiens
tcccttctacctgcc

SEQ ID NO: 5944819 - DNA, 22 bp, Homo sapiens
tcccttctagggttattgcatt

SEQ ID NO: 5944820 - DNA, 13 bp, Homo sapiens
tcccttctcagaa

SEQ ID NO: 5944821 - DNA, 16 bp, Homo sapiens
tcccttctcatctccc

SEQ ID NO: 5944822 - DNA, 22 bp, Homo sapiens
tcccttctcatctccccacgcc

SEQ ID NO: 5944823 - DNA, 11 bp, Homo sapiens
tcccttctcca

SEQ ID NO: 5944824 - DNA, 14 bp, Homo sapiens
tcccttctccccag

SEQ ID NO: 5944825 - DNA, 18 bp, Homo sapiens
tcccttctccccagccag

SEQ ID NO: 5944826 - DNA, 20 bp, Homo sapiens
tcccttctccccagccagag

SEQ ID NO: 5944827 - DNA, 14 bp, Homo sapiens
tcccttctccccct

SEQ ID NO: 5944828 - DNA, 15 bp, Homo sapiens
tcccttctccccctt

SEQ ID NO: 5944829 - DNA, 17 bp, Homo sapiens
tcccttctcccttgccc

SEQ ID NO: 5944830 - DNA, 18 bp, Homo sapiens
tcccttctcctgacctac

SEQ ID NO: 5944831 - DNA, 15 bp, Homo sapiens
tcccttctcctgccc

SEQ ID NO: 5944832 - DNA, 19 bp, Homo sapiens
tcccttctcgtgtttgctt

SEQ ID NO: 5944833 - DNA, 19 bp, Homo sapiens
tcccttctctcacccccac

SEQ ID NO: 5944834 - DNA, 14 bp, Homo sapiens
tcccttctctcagc

SEQ ID NO: 5944835 - DNA, 19 bp, Homo sapiens
tcccttctctcagcctcca

SEQ ID NO: 5944836 - DNA, 13 bp, Homo sapiens
tcccttctctctc

SEQ ID NO: 5944837 - DNA, 15 bp, Homo sapiens
tcccttctctctctc

SEQ ID NO: 5944838 - DNA, 19 bp, Homo sapiens
tcccttctctctttctaag

SEQ ID NO: 5944839 - DNA, 12 bp, Homo sapiens
tcccttctcttc

SEQ ID NO: 5944840 - DNA, 16 bp, Homo sapiens
tcccttctcttccagg

SEQ ID NO: 5944841 - DNA, 21 bp, Homo sapiens
tcccttctcttccaggcagcc

SEQ ID NO: 5944842 - DNA, 14 bp, Homo sapiens
tcccttctgctact

SEQ ID NO: 5944843 - DNA, 20 bp, Homo sapiens
tcccttctgctactggcaaa

SEQ ID NO: 5944844 - DNA, 19 bp, Homo sapiens
tcccttctggacactgaga

SEQ ID NO: 5944845 - DNA, 15 bp, Homo sapiens
tcccttctgggaaac

SEQ ID NO: 5944846 - DNA, 23 bp, Homo sapiens
tcccttcttgggtctgccctgcc

SEQ ID NO: 5944847 - DNA, 13 bp, Homo sapiens
tcccttcttggtt

SEQ ID NO: 5944848 - DNA, 21 bp, Homo sapiens
tcccttcttgtgcccttaaaa

SEQ ID NO: 5944849 - DNA, 20 bp, Homo sapiens
tcccttctttgcttcttttt

SEQ ID NO: 5944850 - DNA, 14 bp, Homo sapiens
tcccttcttttcct

SEQ ID NO: 5944851 - DNA, 17 bp, Homo sapiens
tcccttgaattgtgtat

SEQ ID NO: 5944852 - DNA, 21 bp, Homo sapiens
tcccttgaccaggcctgggcc

SEQ ID NO: 5944853 - DNA, 14 bp, Homo sapiens
tcccttgaccttaa

SEQ ID NO: 5944854 - DNA, 20 bp, Homo sapiens
tcccttgactttgctcctca

SEQ ID NO: 5944855 - DNA, 23 bp, Homo sapiens
tcccttgagaccaaaatttaagt

SEQ ID NO: 5944856 - DNA, 18 bp, Homo sapiens
tcccttgagacctcagcc

SEQ ID NO: 5944857 - DNA, 20 bp, Homo sapiens
tcccttgagatgagtttctg

SEQ ID NO: 5944858 - DNA, 14 bp, Homo sapiens
tcccttgagccctc

SEQ ID NO: 5944859 - DNA, 19 bp, Homo sapiens
tcccttgagggctgcagtt

SEQ ID NO: 5944860 - DNA, 15 bp, Homo sapiens
tcccttgatgaagaa

SEQ ID NO: 5944861 - DNA, 15 bp, Homo sapiens
tcccttgcaggggtc

SEQ ID NO: 5944862 - DNA, 17 bp, Homo sapiens
tcccttgccactttgca

SEQ ID NO: 5944863 - DNA, 16 bp, Homo sapiens
tcccttgccccaggcc

SEQ ID NO: 5944864 - DNA, 19 bp, Homo sapiens
tcccttgccccaggccagg

SEQ ID NO: 5944865 - DNA, 13 bp, Homo sapiens
tcccttgccctcc

SEQ ID NO: 5944866 - DNA, 19 bp, Homo sapiens
tcccttgccctgggctgcc

SEQ ID NO: 5944867 - DNA, 17 bp, Homo sapiens
tcccttgccctttccat

SEQ ID NO: 5944868 - DNA, 12 bp, Homo sapiens
tcccttgcctct

SEQ ID NO: 5944869 - DNA, 15 bp, Homo sapiens
tcccttgcctctgcc

SEQ ID NO: 5944870 - DNA, 22 bp, Homo sapiens
tcccttgcctctgccctggatt

SEQ ID NO: 5944871 - DNA, 20 bp, Homo sapiens
tcccttgcctttcgaggcct

SEQ ID NO: 5944872 - DNA, 17 bp, Homo sapiens
tcccttgctcagtgcct

SEQ ID NO: 5944873 - DNA, 20 bp, Homo sapiens
tcccttgctcatgagctcct

SEQ ID NO: 5944874 - DNA, 21 bp, Homo sapiens
tcccttgctcatgagctcctg

SEQ ID NO: 5944875 - DNA, 18 bp, Homo sapiens
tcccttgctgaacacaca

SEQ ID NO: 5944876 - DNA, 23 bp, Homo sapiens
tcccttgctggccccagccctgc

SEQ ID NO: 5944877 - DNA, 19 bp, Homo sapiens
tcccttgctgtaccatatt

SEQ ID NO: 5944878 - DNA, 20 bp, Homo sapiens
tcccttgcttgcctgcaggg

SEQ ID NO: 5944879 - DNA, 21 bp, Homo sapiens
tcccttgcttgcctgcagggc

SEQ ID NO: 5944880 - DNA, 15 bp, Homo sapiens
tcccttgctttgttt

SEQ ID NO: 5944881 - DNA, 23 bp, Homo sapiens
tcccttgcttttccctcttttct

SEQ ID NO: 5944882 - DNA, 19 bp, Homo sapiens
tcccttggaaagttcagcc

SEQ ID NO: 5944883 - DNA, 20 bp, Homo sapiens
tcccttggaaagttcagcca

SEQ ID NO: 5944884 - DNA, 21 bp, Homo sapiens
tcccttggacattttatgtct

SEQ ID NO: 5944885 - DNA, 23 bp, Homo sapiens
tcccttggacattttatgtcttt

SEQ ID NO: 5944886 - DNA, 14 bp, Homo sapiens
tcccttggccacgg

SEQ ID NO: 5944887 - DNA, 15 bp, Homo sapiens
tcccttggccacggc

SEQ ID NO: 5944888 - DNA, 19 bp, Homo sapiens
tcccttggccacggcctgg

SEQ ID NO: 5944889 - DNA, 22 bp, Homo sapiens
tcccttggccacggcctgggag

SEQ ID NO: 5944890 - DNA, 14 bp, Homo sapiens
tcccttggcctcag

SEQ ID NO: 5944891 - DNA, 12 bp, Homo sapiens
tcccttggcttt

SEQ ID NO: 5944892 - DNA, 16 bp, Homo sapiens
tcccttgggaaggaca

SEQ ID NO: 5944893 - DNA, 18 bp, Homo sapiens
tcccttgggaaggacaca

SEQ ID NO: 5944894 - DNA, 12 bp, Homo sapiens
tcccttgggctc

SEQ ID NO: 5944895 - DNA, 16 bp, Homo sapiens
tcccttgggctctgat

SEQ ID NO: 5944896 - DNA, 20 bp, Homo sapiens
tcccttggggaagggtgggg

SEQ ID NO: 5944897 - DNA, 20 bp, Homo sapiens
tcccttggtaattatatctg

SEQ ID NO: 5944898 - DNA, 22 bp, Homo sapiens
tcccttggtggcaaccccagac

SEQ ID NO: 5944899 - DNA, 15 bp, Homo sapiens
tcccttgtagctcct

SEQ ID NO: 5944900 - DNA, 16 bp, Homo sapiens
tcccttgtagctcctc

SEQ ID NO: 5944901 - DNA, 18 bp, Homo sapiens
tcccttgtattttgttaa

SEQ ID NO: 5944902 - DNA, 23 bp, Homo sapiens
tcccttgtccggaggatattaaa

SEQ ID NO: 5944903 - DNA, 16 bp, Homo sapiens
tcccttgtgcgtgggt

SEQ ID NO: 5944904 - DNA, 15 bp, Homo sapiens
tcccttgtgtcaaga

SEQ ID NO: 5944905 - DNA, 21 bp, Homo sapiens
tcccttgtgtcaagacatttc

SEQ ID NO: 5944906 - DNA, 13 bp, Homo sapiens
tcccttgtgtctg

SEQ ID NO: 5944907 - DNA, 18 bp, Homo sapiens
tcccttgtgtctgttgct

SEQ ID NO: 5944908 - DNA, 22 bp, Homo sapiens
tcccttgtgtgtaccacaccct

SEQ ID NO: 5944909 - DNA, 15 bp, Homo sapiens
tcccttgtgtgtgtg

SEQ ID NO: 5944910 - DNA, 13 bp, Homo sapiens
tcccttgtgttcc

SEQ ID NO: 5944911 - DNA, 18 bp, Homo sapiens
tcccttgttctctaagtt

SEQ ID NO: 5944912 - DNA, 18 bp, Homo sapiens
tccctttaaaattaaaaa

SEQ ID NO: 5944913 - DNA, 23 bp, Homo sapiens
tccctttaaagagagtttgccac

SEQ ID NO: 5944914 - DNA, 12 bp, Homo sapiens
tccctttacaat

SEQ ID NO: 5944915 - DNA, 20 bp, Homo sapiens
tccctttagctgtgttatta

SEQ ID NO: 5944916 - DNA, 18 bp, Homo sapiens
tccctttagttctgctgt

SEQ ID NO: 5944917 - DNA, 16 bp, Homo sapiens
tccctttatttcacat

SEQ ID NO: 5944918 - DNA, 12 bp, Homo sapiens
tccctttcacac

SEQ ID NO: 5944919 - DNA, 21 bp, Homo sapiens
tccctttcccatgatccagaa

SEQ ID NO: 5944920 - DNA, 13 bp, Homo sapiens
tccctttccccta

SEQ ID NO: 5944921 - DNA, 14 bp, Homo sapiens
tccctttccctgca

SEQ ID NO: 5944922 - DNA, 18 bp, Homo sapiens
tccctttccttccatccc

SEQ ID NO: 5944923 - DNA, 17 bp, Homo sapiens
tccctttccttcctaat

SEQ ID NO: 5944924 - DNA, 19 bp, Homo sapiens
tccctttcctttcctttca

SEQ ID NO: 5944925 - DNA, 15 bp, Homo sapiens
tccctttctaagcag

SEQ ID NO: 5944926 - DNA, 14 bp, Homo sapiens
tccctttctctctc

SEQ ID NO: 5944927 - DNA, 17 bp, Homo sapiens
tccctttctctctccac

SEQ ID NO: 5944928 - DNA, 22 bp, Homo sapiens
tccctttctctctcctctctgc

SEQ ID NO: 5944929 - DNA, 16 bp, Homo sapiens
tccctttcttctcccc

SEQ ID NO: 5944930 - DNA, 13 bp, Homo sapiens
tccctttcttggc

SEQ ID NO: 5944931 - DNA, 16 bp, Homo sapiens
tccctttcttggccag

SEQ ID NO: 5944932 - DNA, 20 bp, Homo sapiens
tccctttgcaacgctcactg

SEQ ID NO: 5944933 - DNA, 13 bp, Homo sapiens
tccctttgctcca

SEQ ID NO: 5944934 - DNA, 15 bp, Homo sapiens
tccctttgctccacc

SEQ ID NO: 5944935 - DNA, 20 bp, Homo sapiens
tccctttgctccaccccact

SEQ ID NO: 5944936 - DNA, 18 bp, Homo sapiens
tccctttggacaaatgca

SEQ ID NO: 5944937 - DNA, 23 bp, Homo sapiens
tccctttggggatagtctggaaa

SEQ ID NO: 5944938 - DNA, 22 bp, Homo sapiens
tccctttgtctgtcaatcacag

SEQ ID NO: 5944939 - DNA, 17 bp, Homo sapiens
tccctttgtctttcaaa

SEQ ID NO: 5944940 - DNA, 18 bp, Homo sapiens
tccctttgtctttcaaac

SEQ ID NO: 5944941 - DNA, 22 bp, Homo sapiens
tccctttgtggactttatttaa

SEQ ID NO: 5944942 - DNA, 15 bp, Homo sapiens
tccctttgttgctgt

SEQ ID NO: 5944943 - DNA, 15 bp, Homo sapiens
tcccttttaaagaat

SEQ ID NO: 5944944 - DNA, 18 bp, Homo sapiens
tcccttttaatcctggct

SEQ ID NO: 5944945 - DNA, 17 bp, Homo sapiens
tcccttttacatactgc

SEQ ID NO: 5944946 - DNA, 19 bp, Homo sapiens
tcccttttacatactgctg

SEQ ID NO: 5944947 - DNA, 23 bp, Homo sapiens
tcccttttataattaatgtttgt

SEQ ID NO: 5944948 - DNA, 18 bp, Homo sapiens
tcccttttcacctgaaat

SEQ ID NO: 5944949 - DNA, 16 bp, Homo sapiens
tcccttttcagataat

SEQ ID NO: 5944950 - DNA, 19 bp, Homo sapiens
tccgtgcgggaaattcagt

SEQ ID NO: 5944951 - DNA, 18 bp, Homo sapiens
tccgtgctaaggacttgt

SEQ ID NO: 5944952 - DNA, 23 bp, Homo sapiens
tccgtgctaaggacttgttagat

SEQ ID NO: 5944953 - DNA, 17 bp, Homo sapiens
tccgtgctgacagctgc

SEQ ID NO: 5944954 - DNA, 18 bp, Homo sapiens
tccgtgctgacagctgct

SEQ ID NO: 5944955 - DNA, 16 bp, Homo sapiens
tccgtgcttcctcagt

SEQ ID NO: 5944956 - DNA, 14 bp, Homo sapiens
tccgtggaacattc

SEQ ID NO: 5944957 - DNA, 22 bp, Homo sapiens
tccgtggaggaggttgggaggg

SEQ ID NO: 5944958 - DNA, 19 bp, Homo sapiens
tccgtggcaaccctcagct

SEQ ID NO: 5944959 - DNA, 20 bp, Homo sapiens
tccgtggcaaccctcagctg

SEQ ID NO: 5944960 - DNA, 19 bp, Homo sapiens
tccgtggccccgccctcag

SEQ ID NO: 5944961 - DNA, 20 bp, Homo sapiens
tccgtggccccgccctcagg

SEQ ID NO: 5944962 - DNA, 20 bp, Homo sapiens
tccgtgggaccctcagcagc

SEQ ID NO: 5944963 - DNA, 16 bp, Homo sapiens
tccgtgggacggtgcc

SEQ ID NO: 5944964 - DNA, 15 bp, Homo sapiens
tccgtgggcagctcc

SEQ ID NO: 5944965 - DNA, 16 bp, Homo sapiens
tccgtgggcagctcct

SEQ ID NO: 5944966 - DNA, 15 bp, Homo sapiens
tccgtgggttgctaa

SEQ ID NO: 5944967 - DNA, 20 bp, Homo sapiens
tccgtgggttgctaactgaa

SEQ ID NO: 5944968 - DNA, 21 bp, Homo sapiens
tccgtggtagaggcctggggc

SEQ ID NO: 5944969 - DNA, 16 bp, Homo sapiens
tccgtggttgccctag

SEQ ID NO: 5944970 - DNA, 15 bp, Homo sapiens
tccgtgtccaccccc

SEQ ID NO: 5944971 - DNA, 16 bp, Homo sapiens
tccgtgtgcctcctgt

SEQ ID NO: 5944972 - DNA, 19 bp, Homo sapiens
tccgtgtgcctcctgtgtg

SEQ ID NO: 5944973 - DNA, 20 bp, Homo sapiens
tccgtgtgcctcctgtgtgt

SEQ ID NO: 5944974 - DNA, 21 bp, Homo sapiens
tccgtgtgcctcctgtgtgtc

SEQ ID NO: 5944975 - DNA, 13 bp, Homo sapiens
tccgtgtggagca

SEQ ID NO: 5944976 - DNA, 17 bp, Homo sapiens
tccgtgtggatccaatg

SEQ ID NO: 5944977 - DNA, 15 bp, Homo sapiens
tccgtgtgtcccaga

SEQ ID NO: 5944978 - DNA, 16 bp, Homo sapiens
tccgtgtgtcccagat

SEQ ID NO: 5944979 - DNA, 14 bp, Homo sapiens
tccgtgtttctcta

SEQ ID NO: 5944980 - DNA, 15 bp, Homo sapiens
tccgtgtttctctaa

SEQ ID NO: 5944981 - DNA, 15 bp, Homo sapiens
tccgttagctcctgt

SEQ ID NO: 5944982 - DNA, 21 bp, Homo sapiens
tccgttaggaataacactgca

SEQ ID NO: 5944983 - DNA, 22 bp, Homo sapiens
tccgttcatctgaggagtccaa

SEQ ID NO: 5944984 - DNA, 13 bp, Homo sapiens
tccgttcattcat

SEQ ID NO: 5944985 - DNA, 16 bp, Homo sapiens
tccgttcattgctctc

SEQ ID NO: 5944986 - DNA, 12 bp, Homo sapiens
tccgttccagga

SEQ ID NO: 5944987 - DNA, 20 bp, Homo sapiens
tccgttcccacctctgagga

SEQ ID NO: 5944988 - DNA, 21 bp, Homo sapiens
tccgttcctccccctgctccc

SEQ ID NO: 5944989 - DNA, 14 bp, Homo sapiens
tccgttggaaagaa

SEQ ID NO: 5944990 - DNA, 17 bp, Homo sapiens
tccgttggaaagaacat

SEQ ID NO: 5944991 - DNA, 21 bp, Homo sapiens
tccgttggaaagaacatttaa

SEQ ID NO: 5944992 - DNA, 13 bp, Homo sapiens
tccgttggccact

SEQ ID NO: 5944993 - DNA, 16 bp, Homo sapiens
tccgtttatgggcctt

SEQ ID NO: 5944994 - DNA, 18 bp, Homo sapiens
tccgtttatgggccttgc

SEQ ID NO: 5944995 - DNA, 19 bp, Homo sapiens
tccgtttccaggtgtttat

SEQ ID NO: 5944996 - DNA, 16 bp, Homo sapiens
tccgtttcgcgctggc

SEQ ID NO: 5944997 - DNA, 20 bp, Homo sapiens
tccgtttgaccaatttgcac

SEQ ID NO: 5944998 - DNA, 20 bp, Homo sapiens
tccgtttgatttgtcactgc

SEQ ID NO: 5944999 - DNA, 14 bp, Homo sapiens
tccgttttgcctgt

SEQ ID NO: 5945000 - DNA, 15 bp, Homo sapiens
tccgtttttttttct

SEQ ID NO: 5945001 - DNA, 20 bp, Homo sapiens
tcctaaaaataagctttatt

SEQ ID NO: 5945002 - DNA, 12 bp, Homo sapiens
tcctaaaacaac

SEQ ID NO: 5945003 - DNA, 16 bp, Homo sapiens
tcctaaaacaacagat

SEQ ID NO: 5945004 - DNA, 14 bp, Homo sapiens
tcctaaaacaccct

SEQ ID NO: 5945005 - DNA, 23 bp, Homo sapiens
tcctaaaactgggattaagaaac

SEQ ID NO: 5945006 - DNA, 21 bp, Homo sapiens
tcctaaaacttggatggactt

SEQ ID NO: 5945007 - DNA, 23 bp, Homo sapiens
tcctaaaaggtgttgtaatggtg

SEQ ID NO: 5945008 - DNA, 17 bp, Homo sapiens
tcctaaaagttctcaat

SEQ ID NO: 5945009 - DNA, 18 bp, Homo sapiens
tcctaaaagttctcaatg

SEQ ID NO: 5945010 - DNA, 20 bp, Homo sapiens
tcctaaaagttctcaatgta

SEQ ID NO: 5945011 - DNA, 22 bp, Homo sapiens
tcctaaaataagggcagagtca

SEQ ID NO: 5945012 - DNA, 23 bp, Homo sapiens
tcctaaaataagggcagagtcac

SEQ ID NO: 5945013 - DNA, 11 bp, Homo sapiens
tcctaaacata

SEQ ID NO: 5945014 - DNA, 20 bp, Homo sapiens
tcctaaacccccgctccaga

SEQ ID NO: 5945015 - DNA, 14 bp, Homo sapiens
tcctaaactctcta

SEQ ID NO: 5945016 - DNA, 17 bp, Homo sapiens
tcctaaactctctagct

SEQ ID NO: 5945017 - DNA, 16 bp, Homo sapiens
tcctaaactctgaaat

SEQ ID NO: 5945018 - DNA, 20 bp, Homo sapiens
tcctaaagaagacattttct

SEQ ID NO: 5945019 - DNA, 14 bp, Homo sapiens
tcctaaagacctcc

SEQ ID NO: 5945020 - DNA, 15 bp, Homo sapiens
tcctaaagacctcca

SEQ ID NO: 5945021 - DNA, 18 bp, Homo sapiens
tcctaaagagagtatttt

SEQ ID NO: 5945022 - DNA, 17 bp, Homo sapiens
tcctaaagccatcatgc

SEQ ID NO: 5945023 - DNA, 15 bp, Homo sapiens
tcctaaagtctctgc

SEQ ID NO: 5945024 - DNA, 23 bp, Homo sapiens
tcctaaatatccaaagactgtac

SEQ ID NO: 5945025 - DNA, 21 bp, Homo sapiens
tcctaaatattatgagatgct

SEQ ID NO: 5945026 - DNA, 21 bp, Homo sapiens
tcctaaatattttcaagaaaa

SEQ ID NO: 5945027 - DNA, 19 bp, Homo sapiens
tcctaaatgcagtgaattg

SEQ ID NO: 5945028 - DNA, 19 bp, Homo sapiens
tcctaaattttcctgtcct

SEQ ID NO: 5945029 - DNA, 20 bp, Homo sapiens
tcctaaattttcctgtcctc

SEQ ID NO: 5945030 - DNA, 16 bp, Homo sapiens
tcctaacaaaagaact

SEQ ID NO: 5945031 - DNA, 20 bp, Homo sapiens
tcctaacaaaagatgaaagc

SEQ ID NO: 5945032 - DNA, 16 bp, Homo sapiens
tcctaacataacacta

SEQ ID NO: 5945033 - DNA, 20 bp, Homo sapiens
tcctaacatgcaccttgctc

SEQ ID NO: 5945034 - DNA, 21 bp, Homo sapiens
tcctaacatgcaccttgctcc

SEQ ID NO: 5945035 - DNA, 15 bp, Homo sapiens
tcctaaccactaaca

SEQ ID NO: 5945036 - DNA, 17 bp, Homo sapiens
tcctaaccactaacatt

SEQ ID NO: 5945037 - DNA, 15 bp, Homo sapiens
tcctaacccagcagt

SEQ ID NO: 5945038 - DNA, 15 bp, Homo sapiens
tcctaacctgtcaga

SEQ ID NO: 5945039 - DNA, 21 bp, Homo sapiens
tcctaacgttttctactttga

SEQ ID NO: 5945040 - DNA, 19 bp, Homo sapiens
tcctaactagaattagtat

SEQ ID NO: 5945041 - DNA, 18 bp, Homo sapiens
tcctaactgaagagacag

SEQ ID NO: 5945042 - DNA, 13 bp, Homo sapiens
tcctaacttcctt

SEQ ID NO: 5945043 - DNA, 15 bp, Homo sapiens
tcctaacttccttta

SEQ ID NO: 5945044 - DNA, 13 bp, Homo sapiens
tcctaagaaatat

SEQ ID NO: 5945045 - DNA, 22 bp, Homo sapiens
tcctaagaagcttctaataaat

SEQ ID NO: 5945046 - DNA, 13 bp, Homo sapiens
tcctaagacacaa

SEQ ID NO: 5945047 - DNA, 19 bp, Homo sapiens
tcctaagacacaaatgcat

SEQ ID NO: 5945048 - DNA, 21 bp, Homo sapiens
tcctaagacatttttcattca

SEQ ID NO: 5945049 - DNA, 20 bp, Homo sapiens
tcctaagacttcagtcctgg

SEQ ID NO: 5945050 - DNA, 16 bp, Homo sapiens
tcctaagagtgctggg

SEQ ID NO: 5945051 - DNA, 17 bp, Homo sapiens
tcctaagagtggaggag

SEQ ID NO: 5945052 - DNA, 16 bp, Homo sapiens
tcctaagcaaaaggga

SEQ ID NO: 5945053 - DNA, 17 bp, Homo sapiens
tcctaagcatctaagtt

SEQ ID NO: 5945054 - DNA, 18 bp, Homo sapiens
tcctaagctattcagtaa

SEQ ID NO: 5945055 - DNA, 20 bp, Homo sapiens
tcctaagctattcagtaata

SEQ ID NO: 5945056 - DNA, 22 bp, Homo sapiens
tcctaagctggagtgcagtggc

SEQ ID NO: 5945057 - DNA, 12 bp, Homo sapiens
tcctaaggaaac

SEQ ID NO: 5945058 - DNA, 15 bp, Homo sapiens
tcctaaggaaactgc

SEQ ID NO: 5945059 - DNA, 13 bp, Homo sapiens
tcctaaggaacct

SEQ ID NO: 5945060 - DNA, 18 bp, Homo sapiens
tcctaaggacacactaat

SEQ ID NO: 5945061 - DNA, 21 bp, Homo sapiens
tcctaaggcacccacaaataa

SEQ ID NO: 5945062 - DNA, 14 bp, Homo sapiens
tcctaaggcatgtt

SEQ ID NO: 5945063 - DNA, 21 bp, Homo sapiens
tcctaaggccactgttttaaa

SEQ ID NO: 5945064 - DNA, 14 bp, Homo sapiens
tcctaaggcccagc

SEQ ID NO: 5945065 - DNA, 17 bp, Homo sapiens
tcctaaggcccagctgc

SEQ ID NO: 5945066 - DNA, 18 bp, Homo sapiens
tcctaaggcccagctgcc

SEQ ID NO: 5945067 - DNA, 18 bp, Homo sapiens
tcctaaggctccccaccc

SEQ ID NO: 5945068 - DNA, 19 bp, Homo sapiens
tcctaaggctccccacccc

SEQ ID NO: 5945069 - DNA, 20 bp, Homo sapiens
tcctaaggctccccaccccg

SEQ ID NO: 5945070 - DNA, 20 bp, Homo sapiens
tcctaaggttcttgctttct

SEQ ID NO: 5945071 - DNA, 16 bp, Homo sapiens
tcctaagtcccttcct

SEQ ID NO: 5945072 - DNA, 22 bp, Homo sapiens
tcctaagtctgtcatcctctgg

SEQ ID NO: 5945073 - DNA, 20 bp, Homo sapiens
tcctaagttcttagatatct

SEQ ID NO: 5945074 - DNA, 18 bp, Homo sapiens
tcctaagtttctttgagg

SEQ ID NO: 5945075 - DNA, 13 bp, Homo sapiens
tcctaataaaaag

SEQ ID NO: 5945076 - DNA, 14 bp, Homo sapiens
tcctaataaaaagg

SEQ ID NO: 5945077 - DNA, 18 bp, Homo sapiens
tcctaataaagttctgta

SEQ ID NO: 5945078 - DNA, 19 bp, Homo sapiens
tcctaataatatcccactg

SEQ ID NO: 5945079 - DNA, 22 bp, Homo sapiens
tcctaataatatcccactggga

SEQ ID NO: 5945080 - DNA, 15 bp, Homo sapiens
tcctaatactgtcat

SEQ ID NO: 5945081 - DNA, 21 bp, Homo sapiens
tcctaatcaagagtctctcca

SEQ ID NO: 5945082 - DNA, 22 bp, Homo sapiens
tcctaatcaagagtctctccag

SEQ ID NO: 5945083 - DNA, 15 bp, Homo sapiens
tcctaatcactcaga

SEQ ID NO: 5945084 - DNA, 15 bp, Homo sapiens
tcctaatcatccaat

SEQ ID NO: 5945085 - DNA, 19 bp, Homo sapiens
tcctaatgagatatatctt

SEQ ID NO: 5945086 - DNA, 13 bp, Homo sapiens
tcctaatgcatta

SEQ ID NO: 5945087 - DNA, 14 bp, Homo sapiens
tcctaatggcatgg

SEQ ID NO: 5945088 - DNA, 17 bp, Homo sapiens
tcctaatggtgatgcag

SEQ ID NO: 5945089 - DNA, 20 bp, Homo sapiens
tcctaatggtgatgcagtct

SEQ ID NO: 5945090 - DNA, 19 bp, Homo sapiens
tcctaatgtgatcatatga

SEQ ID NO: 5945091 - DNA, 18 bp, Homo sapiens
tcctaattaccagtcttt

SEQ ID NO: 5945092 - DNA, 17 bp, Homo sapiens
tcctaattccacagctg

SEQ ID NO: 5945093 - DNA, 18 bp, Homo sapiens
tcctaattccacagctgc

SEQ ID NO: 5945094 - DNA, 13 bp, Homo sapiens
tcctaattcctgt

SEQ ID NO: 5945095 - DNA, 18 bp, Homo sapiens
tcctaattcctgtatgtt

SEQ ID NO: 5945096 - DNA, 19 bp, Homo sapiens
tcctaattcctgtatgtta

SEQ ID NO: 5945097 - DNA, 20 bp, Homo sapiens
tcctaattctatgattaaac

SEQ ID NO: 5945098 - DNA, 20 bp, Homo sapiens
tcctaattgtgcccctaaag

SEQ ID NO: 5945099 - DNA, 14 bp, Homo sapiens
tcctaatttccctt

SEQ ID NO: 5945100 - DNA, 16 bp, Homo sapiens
tcctaatttctcctcc

SEQ ID NO: 5945101 - DNA, 13 bp, Homo sapiens
tcctacaaaatgg

SEQ ID NO: 5945102 - DNA, 14 bp, Homo sapiens
tcctacaaaatgga

SEQ ID NO: 5945103 - DNA, 14 bp, Homo sapiens
tcctacaaagatgt

SEQ ID NO: 5945104 - DNA, 17 bp, Homo sapiens
tcctacaactaaaaata

SEQ ID NO: 5945105 - DNA, 14 bp, Homo sapiens
tcctacaacttaat

SEQ ID NO: 5945106 - DNA, 19 bp, Homo sapiens
tcctacaacttaatggaaa

SEQ ID NO: 5945107 - DNA, 20 bp, Homo sapiens
tcctacaagagcagcctgtg

SEQ ID NO: 5945108 - DNA, 14 bp, Homo sapiens
tcctacacaggaca

SEQ ID NO: 5945109 - DNA, 17 bp, Homo sapiens
tcctacacccttggact

SEQ ID NO: 5945110 - DNA, 18 bp, Homo sapiens
tcctacacccttggactt

SEQ ID NO: 5945111 - DNA, 19 bp, Homo sapiens
tcctacagaaaaaccttgg

SEQ ID NO: 5945112 - DNA, 22 bp, Homo sapiens
tcctacagaaatactgctctga

SEQ ID NO: 5945113 - DNA, 13 bp, Homo sapiens
tcctacagcacta

SEQ ID NO: 5945114 - DNA, 20 bp, Homo sapiens
tcctacagcactactgggtg

SEQ ID NO: 5945115 - DNA, 17 bp, Homo sapiens
tcctacagccccttttt

SEQ ID NO: 5945116 - DNA, 19 bp, Homo sapiens
tcctacaggcagtctctct

SEQ ID NO: 5945117 - DNA, 19 bp, Homo sapiens
tcctacaggcgctccaggc

SEQ ID NO: 5945118 - DNA, 13 bp, Homo sapiens
tcctacagtacaa

SEQ ID NO: 5945119 - DNA, 12 bp, Homo sapiens
tcctacagtgaa

SEQ ID NO: 5945120 - DNA, 13 bp, Homo sapiens
tcctacagtgaaa

SEQ ID NO: 5945121 - DNA, 21 bp, Homo sapiens
tcctacagtgactccctggga

SEQ ID NO: 5945122 - DNA, 23 bp, Homo sapiens
tcctacagttggaaatccatcca

SEQ ID NO: 5945123 - DNA, 14 bp, Homo sapiens
tcctacatacagca

SEQ ID NO: 5945124 - DNA, 15 bp, Homo sapiens
tcctacatacttctt

SEQ ID NO: 5945125 - DNA, 19 bp, Homo sapiens
tcctacatatcccttccag

SEQ ID NO: 5945126 - DNA, 15 bp, Homo sapiens
tcctacatccagctc

SEQ ID NO: 5945127 - DNA, 15 bp, Homo sapiens
tcctagtttgacctc

SEQ ID NO: 5945128 - DNA, 16 bp, Homo sapiens
tcctagtttgacctca

SEQ ID NO: 5945129 - DNA, 18 bp, Homo sapiens
tcctagtttgacctcaca

SEQ ID NO: 5945130 - DNA, 17 bp, Homo sapiens
tcctagtttgctgtggc

SEQ ID NO: 5945131 - DNA, 19 bp, Homo sapiens
tcctagtttgctgtggcct

SEQ ID NO: 5945132 - DNA, 13 bp, Homo sapiens
tcctagttttctc

SEQ ID NO: 5945133 - DNA, 21 bp, Homo sapiens
tcctagtttttctaatactaa

SEQ ID NO: 5945134 - DNA, 14 bp, Homo sapiens
tcctataaatgtga

SEQ ID NO: 5945135 - DNA, 17 bp, Homo sapiens
tcctataacttcttcct

SEQ ID NO: 5945136 - DNA, 21 bp, Homo sapiens
tcctataacttcttcctgctg

SEQ ID NO: 5945137 - DNA, 21 bp, Homo sapiens
tcctataagcttaaataggaa

SEQ ID NO: 5945138 - DNA, 20 bp, Homo sapiens
tcctataataaaatggcacc

SEQ ID NO: 5945139 - DNA, 21 bp, Homo sapiens
tcctataataaaatggcacct

SEQ ID NO: 5945140 - DNA, 22 bp, Homo sapiens
tcctataataaaatggcacctt

SEQ ID NO: 5945141 - DNA, 16 bp, Homo sapiens
tcctatacatttctgt

SEQ ID NO: 5945142 - DNA, 19 bp, Homo sapiens
tcctataccatatgtctgc

SEQ ID NO: 5945143 - DNA, 13 bp, Homo sapiens
tcctatactggtt

SEQ ID NO: 5945144 - DNA, 17 bp, Homo sapiens
tcctatagtcgtgggtg

SEQ ID NO: 5945145 - DNA, 22 bp, Homo sapiens
tcctatagttttactcctcagt

SEQ ID NO: 5945146 - DNA, 13 bp, Homo sapiens
tcctatatcatta

SEQ ID NO: 5945147 - DNA, 23 bp, Homo sapiens
tcctatatcattaaaagaacata

SEQ ID NO: 5945148 - DNA, 18 bp, Homo sapiens
tcctatatcctgtgactg

SEQ ID NO: 5945149 - DNA, 18 bp, Homo sapiens
tcctatattgttttcagt

SEQ ID NO: 5945150 - DNA, 20 bp, Homo sapiens
tcctatcaagccagtacgtg

SEQ ID NO: 5945151 - DNA, 14 bp, Homo sapiens
tcctatcacctccc

SEQ ID NO: 5945152 - DNA, 20 bp, Homo sapiens
tcctatcacctgtcttgcct

SEQ ID NO: 5945153 - DNA, 21 bp, Homo sapiens
tcctatccactgggcacaact

SEQ ID NO: 5945154 - DNA, 19 bp, Homo sapiens
tcctatccccaggccaggt

SEQ ID NO: 5945155 - DNA, 13 bp, Homo sapiens
tcctatcctccta

SEQ ID NO: 5945156 - DNA, 19 bp, Homo sapiens
tcctatcgatctggaaaga

SEQ ID NO: 5945157 - DNA, 23 bp, Homo sapiens
tcctatctccagcggccctgtca

SEQ ID NO: 5945158 - DNA, 13 bp, Homo sapiens
tcctatctgcagg

SEQ ID NO: 5945159 - DNA, 16 bp, Homo sapiens
tcctatctgggcttcc

SEQ ID NO: 5945160 - DNA, 20 bp, Homo sapiens
tcctatgaaatactttatag

SEQ ID NO: 5945161 - DNA, 18 bp, Homo sapiens
tcctatgaatgctttgca

SEQ ID NO: 5945162 - DNA, 22 bp, Homo sapiens
tcctatgatggatggcagactc

SEQ ID NO: 5945163 - DNA, 23 bp, Homo sapiens
tcctatgatggatggcagactct

SEQ ID NO: 5945164 - DNA, 12 bp, Homo sapiens
tcctatgatgta

SEQ ID NO: 5945165 - DNA, 15 bp, Homo sapiens
tcctatgatgtatac

SEQ ID NO: 5945166 - DNA, 16 bp, Homo sapiens
tcctatgatgtatact

SEQ ID NO: 5945167 - DNA, 12 bp, Homo sapiens
tcctatgcatgg

SEQ ID NO: 5945168 - DNA, 20 bp, Homo sapiens
tcctatgcatggtttcagca

SEQ ID NO: 5945169 - DNA, 21 bp, Homo sapiens
tcctatgcccaggtaccaccc

SEQ ID NO: 5945170 - DNA, 18 bp, Homo sapiens
tcctatgccttcaaatag

SEQ ID NO: 5945171 - DNA, 20 bp, Homo sapiens
tcctatgctattgacaataa

SEQ ID NO: 5945172 - DNA, 22 bp, Homo sapiens
tcctatgcttaataaaagaaca

SEQ ID NO: 5945173 - DNA, 13 bp, Homo sapiens
tcctatgctttga

SEQ ID NO: 5945174 - DNA, 14 bp, Homo sapiens
tcctatgctttgaa

SEQ ID NO: 5945175 - DNA, 13 bp, Homo sapiens
tcctatggaaaaa

SEQ ID NO: 5945176 - DNA, 15 bp, Homo sapiens
tcctatggaaaaggg

SEQ ID NO: 5945177 - DNA, 16 bp, Homo sapiens
tcctatggaaacattt

SEQ ID NO: 5945178 - DNA, 16 bp, Homo sapiens
tcctatggaatgtaaa

SEQ ID NO: 5945179 - DNA, 18 bp, Homo sapiens
tcctatggacaacttatt

SEQ ID NO: 5945180 - DNA, 19 bp, Homo sapiens
tcctatggacaacttattt

SEQ ID NO: 5945181 - DNA, 21 bp, Homo sapiens
tcctatggacaacttatttaa

SEQ ID NO: 5945182 - DNA, 14 bp, Homo sapiens
tcctatgtggcagc

SEQ ID NO: 5945183 - DNA, 15 bp, Homo sapiens
tcctatgtgtgcctc

SEQ ID NO: 5945184 - DNA, 11 bp, Homo sapiens
tcctatgtttg

SEQ ID NO: 5945185 - DNA, 18 bp, Homo sapiens
tcctatgtttttgttcaa

SEQ ID NO: 5945186 - DNA, 17 bp, Homo sapiens
tcctattaaaacacagc

SEQ ID NO: 5945187 - DNA, 16 bp, Homo sapiens
tcctattaatcttcag

SEQ ID NO: 5945188 - DNA, 18 bp, Homo sapiens
tcctattaatcttcagct

SEQ ID NO: 5945189 - DNA, 17 bp, Homo sapiens
tcctattaatttattaa

SEQ ID NO: 5945190 - DNA, 23 bp, Homo sapiens
tcctattaggctataagaagtag

SEQ ID NO: 5945191 - DNA, 13 bp, Homo sapiens
tcctattagtgtt

SEQ ID NO: 5945192 - DNA, 14 bp, Homo sapiens
tcctattagtgtta

SEQ ID NO: 5945193 - DNA, 18 bp, Homo sapiens
tcctattctataaaactc

SEQ ID NO: 5945194 - DNA, 14 bp, Homo sapiens
tcctattctattgc

SEQ ID NO: 5945195 - DNA, 16 bp, Homo sapiens
tcctattctcctgcca

SEQ ID NO: 5945196 - DNA, 21 bp, Homo sapiens
tcctattctgggcaaatagat

SEQ ID NO: 5945197 - DNA, 14 bp, Homo sapiens
tcctattgcaaagg

SEQ ID NO: 5945198 - DNA, 20 bp, Homo sapiens
tcctattgtacgctagagca

SEQ ID NO: 5945199 - DNA, 19 bp, Homo sapiens
tcctattgtgatttgactg

SEQ ID NO: 5945200 - DNA, 20 bp, Homo sapiens
tcctatttccccctcctccc

SEQ ID NO: 5945201 - DNA, 16 bp, Homo sapiens
tcctatttgcactgta

SEQ ID NO: 5945202 - DNA, 18 bp, Homo sapiens
tcctatttgccatgggct

SEQ ID NO: 5945203 - DNA, 17 bp, Homo sapiens
tcctatttgttttcatg

SEQ ID NO: 5945204 - DNA, 12 bp, Homo sapiens
tcctattttaaa

SEQ ID NO: 5945205 - DNA, 15 bp, Homo sapiens
tcctatttttcagaa

SEQ ID NO: 5945206 - DNA, 18 bp, Homo sapiens
tcctcaaaccacttgcct

SEQ ID NO: 5945207 - DNA, 23 bp, Homo sapiens
tcctcaaaccacttgcctggggc

SEQ ID NO: 5945208 - DNA, 16 bp, Homo sapiens
tcctcaaagaaagtgt

SEQ ID NO: 5945209 - DNA, 19 bp, Homo sapiens
tcctcaacaacaaaccaaa

SEQ ID NO: 5945210 - DNA, 22 bp, Homo sapiens
tcctcaacccctcccctccatc

SEQ ID NO: 5945211 - DNA, 17 bp, Homo sapiens
tcctcaagaaataaaag

SEQ ID NO: 5945212 - DNA, 16 bp, Homo sapiens
tcctcaagaagaaagt

SEQ ID NO: 5945213 - DNA, 12 bp, Homo sapiens
tcctcaagactt

SEQ ID NO: 5945214 - DNA, 22 bp, Homo sapiens
tcctcaagactttgatccttgg

SEQ ID NO: 5945215 - DNA, 16 bp, Homo sapiens
tcctcaagcaataatt

SEQ ID NO: 5945216 - DNA, 12 bp, Homo sapiens
tcctcaagcctg

SEQ ID NO: 5945217 - DNA, 18 bp, Homo sapiens
tcctcaagcctgtgggca

SEQ ID NO: 5945218 - DNA, 15 bp, Homo sapiens
tcctcaaggggccat

SEQ ID NO: 5945219 - DNA, 18 bp, Homo sapiens
tcctcaaggggccatcct

SEQ ID NO: 5945220 - DNA, 18 bp, Homo sapiens
tcctcaagtccccaagat

SEQ ID NO: 5945221 - DNA, 18 bp, Homo sapiens
tcctcaagttgtgtgcta

SEQ ID NO: 5945222 - DNA, 17 bp, Homo sapiens
tcctcaattccagggaa

SEQ ID NO: 5945223 - DNA, 20 bp, Homo sapiens
tcctcacaacatggtgtctg

SEQ ID NO: 5945224 - DNA, 13 bp, Homo sapiens
tcctcacaagcct

SEQ ID NO: 5945225 - DNA, 19 bp, Homo sapiens
tcctcacacccacctgctg

SEQ ID NO: 5945226 - DNA, 12 bp, Homo sapiens
tcctcacagcag

SEQ ID NO: 5945227 - DNA, 18 bp, Homo sapiens
tcctcacagcagtcacag

SEQ ID NO: 5945228 - DNA, 13 bp, Homo sapiens
tcctcacaggagc

SEQ ID NO: 5945229 - DNA, 14 bp, Homo sapiens
tcctcacaggagca

SEQ ID NO: 5945230 - DNA, 15 bp, Homo sapiens
tcctcacaggagcag

SEQ ID NO: 5945231 - DNA, 20 bp, Homo sapiens
tcctcacaggtgtctccata

SEQ ID NO: 5945232 - DNA, 12 bp, Homo sapiens
tcctcacatagc

SEQ ID NO: 5945233 - DNA, 22 bp, Homo sapiens
tcctcacatgactgaagggact

SEQ ID NO: 5945234 - DNA, 16 bp, Homo sapiens
tcctcacatgcagagt

SEQ ID NO: 5945235 - DNA, 16 bp, Homo sapiens
tcctcacatgcccgct

SEQ ID NO: 5945236 - DNA, 13 bp, Homo sapiens
tcctcacatgtgg

SEQ ID NO: 5945237 - DNA, 15 bp, Homo sapiens
tcctcacatgtggca

SEQ ID NO: 5945238 - DNA, 15 bp, Homo sapiens
tcctcaccaataact

SEQ ID NO: 5945239 - DNA, 18 bp, Homo sapiens
tcctcaccaataacttca

SEQ ID NO: 5945240 - DNA, 15 bp, Homo sapiens
tcctcaccatccaca

SEQ ID NO: 5945241 - DNA, 12 bp, Homo sapiens
tcctcacccacc

SEQ ID NO: 5945242 - DNA, 15 bp, Homo sapiens
tcctcacccacctct

SEQ ID NO: 5945243 - DNA, 20 bp, Homo sapiens
tcctcacccccagctttgct

SEQ ID NO: 5945244 - DNA, 12 bp, Homo sapiens
tcctcacccctg

SEQ ID NO: 5945245 - DNA, 19 bp, Homo sapiens
tcctcacccctgtcctcac

SEQ ID NO: 5945246 - DNA, 21 bp, Homo sapiens
tcctcacccctgtcctcactg

SEQ ID NO: 5945247 - DNA, 14 bp, Homo sapiens
tcctcaccctgtgg

SEQ ID NO: 5945248 - DNA, 18 bp, Homo sapiens
tcctcaccctgtgggacc

SEQ ID NO: 5945249 - DNA, 22 bp, Homo sapiens
tcctcacctaccctcaaagtag

SEQ ID NO: 5945250 - DNA, 15 bp, Homo sapiens
tcctcacctcatgcc

SEQ ID NO: 5945251 - DNA, 13 bp, Homo sapiens
tcctcacctctgg

SEQ ID NO: 5945252 - DNA, 22 bp, Homo sapiens
tcctcacctctggactggctag

SEQ ID NO: 5945253 - DNA, 14 bp, Homo sapiens
tcctcaccttaatt

SEQ ID NO: 5945254 - DNA, 23 bp, Homo sapiens
tcctcacgcaactcacacctcct

SEQ ID NO: 5945255 - DNA, 19 bp, Homo sapiens
tcctcactatttttttgtt

SEQ ID NO: 5945256 - DNA, 20 bp, Homo sapiens
tcctcactccaaaataggtg

SEQ ID NO: 5945257 - DNA, 20 bp, Homo sapiens
tcctcactccctaggcccaa

SEQ ID NO: 5945258 - DNA, 14 bp, Homo sapiens
tcctcactcccttc

SEQ ID NO: 5945259 - DNA, 17 bp, Homo sapiens
tcctcactcccttccca

SEQ ID NO: 5945260 - DNA, 16 bp, Homo sapiens
tcctcactcccttcta

SEQ ID NO: 5945261 - DNA, 21 bp, Homo sapiens
tcctcactctgtccctgtcct

SEQ ID NO: 5945262 - DNA, 21 bp, Homo sapiens
tcctcactcttcaaggaggcc

SEQ ID NO: 5945263 - DNA, 14 bp, Homo sapiens
tcctcactgccact

SEQ ID NO: 5945264 - DNA, 19 bp, Homo sapiens
tcctcactgccccaccagc

SEQ ID NO: 5945265 - DNA, 15 bp, Homo sapiens
tcctcactgcccgca

SEQ ID NO: 5945266 - DNA, 18 bp, Homo sapiens
tcctcactggaggagcag

SEQ ID NO: 5945267 - DNA, 20 bp, Homo sapiens
tcctcactggaggagcagct

SEQ ID NO: 5945268 - DNA, 20 bp, Homo sapiens
tcctcactgggctcactgca

SEQ ID NO: 5945269 - DNA, 14 bp, Homo sapiens
tcctcactgggtgg

SEQ ID NO: 5945270 - DNA, 14 bp, Homo sapiens
tcctcactgtatcc

SEQ ID NO: 5945271 - DNA, 23 bp, Homo sapiens
tcctcacttggctgtctgaccag

SEQ ID NO: 5945272 - DNA, 22 bp, Homo sapiens
tcctcagaccaggtggaattac

SEQ ID NO: 5945273 - DNA, 17 bp, Homo sapiens
tcctcagactctaagaa

SEQ ID NO: 5945274 - DNA, 13 bp, Homo sapiens
tcctcagagcagg

SEQ ID NO: 5945275 - DNA, 23 bp, Homo sapiens
tcctcagagcaggggccagatga

SEQ ID NO: 5945276 - DNA, 17 bp, Homo sapiens
tcctcagagcgccagga

SEQ ID NO: 5945277 - DNA, 19 bp, Homo sapiens
tcctcagaggctgagccct

SEQ ID NO: 5945278 - DNA, 22 bp, Homo sapiens
tcctcagaggctgagccctgta

SEQ ID NO: 5945279 - DNA, 19 bp, Homo sapiens
tcctcagagtcccggcgtt

SEQ ID NO: 5945280 - DNA, 21 bp, Homo sapiens
tcctcagatccccagctttct

SEQ ID NO: 5945281 - DNA, 15 bp, Homo sapiens
tcctcagattgctga

SEQ ID NO: 5945282 - DNA, 16 bp, Homo sapiens
tcctcagattgctgaa

SEQ ID NO: 5945283 - DNA, 14 bp, Homo sapiens
tcctcagcacccca

SEQ ID NO: 5945284 - DNA, 20 bp, Homo sapiens
tcctcagcaccccactcctc

SEQ ID NO: 5945285 - DNA, 21 bp, Homo sapiens
tcctcagcaccccactcctca

SEQ ID NO: 5945286 - DNA, 15 bp, Homo sapiens
tcctcagcacccctc

SEQ ID NO: 5945287 - DNA, 17 bp, Homo sapiens
tcctcagcacccctcca

SEQ ID NO: 5945288 - DNA, 20 bp, Homo sapiens
tcctcagcagcctcactgca

SEQ ID NO: 5945289 - DNA, 14 bp, Homo sapiens
tcctcagcaggcca

SEQ ID NO: 5945290 - DNA, 17 bp, Homo sapiens
tcctcagccccagggcc

SEQ ID NO: 5945291 - DNA, 23 bp, Homo sapiens
tcctcagccccagggccctgctc

SEQ ID NO: 5945292 - DNA, 13 bp, Homo sapiens
tcctcagccccca

SEQ ID NO: 5945293 - DNA, 17 bp, Homo sapiens
tcctcagcccccaggcc

SEQ ID NO: 5945294 - DNA, 24 bp, Homo sapiens
tcctcagcccccaggccaggtgag

SEQ ID NO: 5945295 - DNA, 18 bp, Homo sapiens
tcctcagcccctccagtc

SEQ ID NO: 5945296 - DNA, 23 bp, Homo sapiens
tcctcagcctctgcaactgcaag

SEQ ID NO: 5945297 - DNA, 21 bp, Homo sapiens
tcctcagcctgaaccccaggg

SEQ ID NO: 5945298 - DNA, 14 bp, Homo sapiens
tcctcagcctgggg

SEQ ID NO: 5945299 - DNA, 11 bp, Homo sapiens
tcctcagcctt

SEQ ID NO: 5945300 - DNA, 20 bp, Homo sapiens
tcctcagctcagctgggcca

SEQ ID NO: 5945301 - DNA, 12 bp, Homo sapiens
tcctcagctccc

SEQ ID NO: 5945302 - DNA, 21 bp, Homo sapiens
tcctcagctccctgcctgttt

SEQ ID NO: 5945303 - DNA, 12 bp, Homo sapiens
tcctcagctcta

SEQ ID NO: 5945304 - DNA, 17 bp, Homo sapiens
tcctcagctgcatggag

SEQ ID NO: 5945305 - DNA, 18 bp, Homo sapiens
tcctcccaaaatactaca

SEQ ID NO: 5945306 - DNA, 19 bp, Homo sapiens
tcctcccaactctggcctt

SEQ ID NO: 5945307 - DNA, 16 bp, Homo sapiens
tcctcccaagaggcca

SEQ ID NO: 5945308 - DNA, 13 bp, Homo sapiens
tcctcccaagctg

SEQ ID NO: 5945309 - DNA, 15 bp, Homo sapiens
tcctcccaaggtttg

SEQ ID NO: 5945310 - DNA, 16 bp, Homo sapiens
tcctcccaccagtggc

SEQ ID NO: 5945311 - DNA, 21 bp, Homo sapiens
tcctcccacccaacttcccct

SEQ ID NO: 5945312 - DNA, 20 bp, Homo sapiens
tcctcccacccggctgcaga

SEQ ID NO: 5945313 - DNA, 13 bp, Homo sapiens
tcctcccacctca

SEQ ID NO: 5945314 - DNA, 15 bp, Homo sapiens
tcctcccacctcagc

SEQ ID NO: 5945315 - DNA, 16 bp, Homo sapiens
tcctcccacctcagcc

SEQ ID NO: 5945316 - DNA, 18 bp, Homo sapiens
tcctcccacctcagcctc

SEQ ID NO: 5945317 - DNA, 20 bp, Homo sapiens
tcctcccacctcagcctccc

SEQ ID NO: 5945318 - DNA, 21 bp, Homo sapiens
tcctcccacctcagcctcccg

SEQ ID NO: 5945319 - DNA, 17 bp, Homo sapiens
tcctcccaccttggcct

SEQ ID NO: 5945320 - DNA, 19 bp, Homo sapiens
tcctcccacggggtccccg

SEQ ID NO: 5945321 - DNA, 13 bp, Homo sapiens
tcctcccactggg

SEQ ID NO: 5945322 - DNA, 12 bp, Homo sapiens
tcctcccagcac

SEQ ID NO: 5945323 - DNA, 16 bp, Homo sapiens
tcctcccagcacaggc

SEQ ID NO: 5945324 - DNA, 16 bp, Homo sapiens
tcctcccagctgcttt

SEQ ID NO: 5945325 - DNA, 22 bp, Homo sapiens
tcctcccagcttgtaggagctg

SEQ ID NO: 5945326 - DNA, 19 bp, Homo sapiens
tcctcccaggaagcccagg

SEQ ID NO: 5945327 - DNA, 19 bp, Homo sapiens
tcctcccaggaggtgcttg

SEQ ID NO: 5945328 - DNA, 19 bp, Homo sapiens
tcctcccaggcgccccttc

SEQ ID NO: 5945329 - DNA, 12 bp, Homo sapiens
tcctcccagggt

SEQ ID NO: 5945330 - DNA, 22 bp, Homo sapiens
tcctcccagggttttaactttg

SEQ ID NO: 5945331 - DNA, 18 bp, Homo sapiens
tcctcccaggtttcttct

SEQ ID NO: 5945332 - DNA, 22 bp, Homo sapiens
tcctcccaggtttcttctctgg

SEQ ID NO: 5945333 - DNA, 14 bp, Homo sapiens
tcctcccagtgaga

SEQ ID NO: 5945334 - DNA, 23 bp, Homo sapiens
tcctcccagtgagactgccccac

SEQ ID NO: 5945335 - DNA, 11 bp, Homo sapiens
tcctcccataa

SEQ ID NO: 5945336 - DNA, 13 bp, Homo sapiens
tcctcccatcccc

SEQ ID NO: 5945337 - DNA, 19 bp, Homo sapiens
tcctcccatcccctcaaca

SEQ ID NO: 5945338 - DNA, 13 bp, Homo sapiens
tcctcccatgtca

SEQ ID NO: 5945339 - DNA, 21 bp, Homo sapiens
tcctcccatgttatgcccagc

SEQ ID NO: 5945340 - DNA, 22 bp, Homo sapiens
tcctcccattgcccagtgagcc

SEQ ID NO: 5945341 - DNA, 16 bp, Homo sapiens
tcctccccaaatcaat

SEQ ID NO: 5945342 - DNA, 16 bp, Homo sapiens
tcctccccacactcca

SEQ ID NO: 5945343 - DNA, 18 bp, Homo sapiens
tcctccccacactccact

SEQ ID NO: 5945344 - DNA, 20 bp, Homo sapiens
tcctccccacactccactct

SEQ ID NO: 5945345 - DNA, 14 bp, Homo sapiens
tcctccccaccaga

SEQ ID NO: 5945346 - DNA, 17 bp, Homo sapiens
tcctccccaccagagct

SEQ ID NO: 5945347 - DNA, 22 bp, Homo sapiens
tcctccccaccagtctcaccca

SEQ ID NO: 5945348 - DNA, 18 bp, Homo sapiens
tcctccccaccctcctgg

SEQ ID NO: 5945349 - DNA, 19 bp, Homo sapiens
tcctccccaccctcctggc

SEQ ID NO: 5945350 - DNA, 16 bp, Homo sapiens
tcctccccaccctgtc

SEQ ID NO: 5945351 - DNA, 20 bp, Homo sapiens
tcctccccaccctgtcccag

SEQ ID NO: 5945352 - DNA, 22 bp, Homo sapiens
tcctccccaccctgtcccaggc

SEQ ID NO: 5945353 - DNA, 17 bp, Homo sapiens
tcctccccaccttcccc

SEQ ID NO: 5945354 - DNA, 20 bp, Homo sapiens
tcctccccaccttccccaga

SEQ ID NO: 5945355 - DNA, 13 bp, Homo sapiens
tcctccccagcag

SEQ ID NO: 5945356 - DNA, 13 bp, Homo sapiens
tcctccccagtct

SEQ ID NO: 5945357 - DNA, 15 bp, Homo sapiens
tcctccccatacaca

SEQ ID NO: 5945358 - DNA, 17 bp, Homo sapiens
tcctccccatacacaca

SEQ ID NO: 5945359 - DNA, 23 bp, Homo sapiens
tcctccccatacacacacaaacc

SEQ ID NO: 5945360 - DNA, 17 bp, Homo sapiens
tcctccccattcctaca

SEQ ID NO: 5945361 - DNA, 20 bp, Homo sapiens
tcctcccccaccccttaggc

SEQ ID NO: 5945362 - DNA, 14 bp, Homo sapiens
tcctcccccagagc

SEQ ID NO: 5945363 - DNA, 20 bp, Homo sapiens
tcctcccccgcaccccctcc

SEQ ID NO: 5945364 - DNA, 13 bp, Homo sapiens
tcctcccccggct

SEQ ID NO: 5945365 - DNA, 17 bp, Homo sapiens
tcctcccccggctgggc

SEQ ID NO: 5945366 - DNA, 18 bp, Homo sapiens
tcctcccccggctgggcc

SEQ ID NO: 5945367 - DNA, 19 bp, Homo sapiens
tcctcccccggctgggcct

SEQ ID NO: 5945368 - DNA, 13 bp, Homo sapiens
tcctccccctcct

SEQ ID NO: 5945369 - DNA, 19 bp, Homo sapiens
tcctccccctcctaggggg

SEQ ID NO: 5945370 - DNA, 14 bp, Homo sapiens
tcctccccctgcaa

SEQ ID NO: 5945371 - DNA, 14 bp, Homo sapiens
tcctccccctgcca

SEQ ID NO: 5945372 - DNA, 17 bp, Homo sapiens
tcctccccctgccagtg

SEQ ID NO: 5945373 - DNA, 20 bp, Homo sapiens
tcctccccctgccagtgcct

SEQ ID NO: 5945374 - DNA, 15 bp, Homo sapiens
tcctccccctgttct

SEQ ID NO: 5945375 - DNA, 16 bp, Homo sapiens
tcctccccctgttctg

SEQ ID NO: 5945376 - DNA, 16 bp, Homo sapiens
tcctccccctttgggg

SEQ ID NO: 5945377 - DNA, 19 bp, Homo sapiens
tcctccccctttggggtag

SEQ ID NO: 5945378 - DNA, 19 bp, Homo sapiens
tcctccccgcgccccagtc

SEQ ID NO: 5945379 - DNA, 13 bp, Homo sapiens
tcctccccggagc

SEQ ID NO: 5945380 - DNA, 18 bp, Homo sapiens
tcctcccctactctgccc

SEQ ID NO: 5945381 - DNA, 16 bp, Homo sapiens
tcctcccctcacagcc

SEQ ID NO: 5945382 - DNA, 17 bp, Homo sapiens
tcctcccctcacagcct

SEQ ID NO: 5945383 - DNA, 21 bp, Homo sapiens
tcctcccctcacagcctctga

SEQ ID NO: 5945384 - DNA, 18 bp, Homo sapiens
tcctcccctcctcctgga

SEQ ID NO: 5945385 - DNA, 20 bp, Homo sapiens
tcctcccctcctcttccctt

SEQ ID NO: 5945386 - DNA, 15 bp, Homo sapiens
tcctcccctcgccca

SEQ ID NO: 5945387 - DNA, 12 bp, Homo sapiens
tcctcccctctc

SEQ ID NO: 5945388 - DNA, 21 bp, Homo sapiens
tcctcccctctcatccccctg

SEQ ID NO: 5945389 - DNA, 14 bp, Homo sapiens
tcctcccctctctt

SEQ ID NO: 5945390 - DNA, 15 bp, Homo sapiens
tcctcccctggaagt

SEQ ID NO: 5945391 - DNA, 15 bp, Homo sapiens
tcctcccctggaggg

SEQ ID NO: 5945392 - DNA, 18 bp, Homo sapiens
tcctccccttccctgcaa

SEQ ID NO: 5945393 - DNA, 15 bp, Homo sapiens
tcctccccttcctgc

SEQ ID NO: 5945394 - DNA, 17 bp, Homo sapiens
tcctcccgactgaccac

SEQ ID NO: 5945395 - DNA, 13 bp, Homo sapiens
tcctcccgccctt

SEQ ID NO: 5945396 - DNA, 17 bp, Homo sapiens
tcctcccgggccctccc

SEQ ID NO: 5945397 - DNA, 22 bp, Homo sapiens
tcctcccgggccctcccttgga

SEQ ID NO: 5945398 - DNA, 16 bp, Homo sapiens
tcctcccgtcactcca

SEQ ID NO: 5945399 - DNA, 19 bp, Homo sapiens
tcctcccgttgcggggtgg

SEQ ID NO: 5945400 - DNA, 13 bp, Homo sapiens
tcctccctagctc

SEQ ID NO: 5945401 - DNA, 10 bp, Homo sapiens
tcctccctca

SEQ ID NO: 5945402 - DNA, 11 bp, Homo sapiens
tcctccctcag

SEQ ID NO: 5945403 - DNA, 12 bp, Homo sapiens
tcctccctcaga

SEQ ID NO: 5945404 - DNA, 19 bp, Homo sapiens
tcctccctcagacccagga

SEQ ID NO: 5945405 - DNA, 14 bp, Homo sapiens
tcctccctcagact

SEQ ID NO: 5945406 - DNA, 15 bp, Homo sapiens
tcctccctcagactc

SEQ ID NO: 5945407 - DNA, 12 bp, Homo sapiens
tcctccctcagc

SEQ ID NO: 5945408 - DNA, 13 bp, Homo sapiens
tcctccctcaggc

SEQ ID NO: 5945409 - DNA, 17 bp, Homo sapiens
tcctccctcaggcccag

SEQ ID NO: 5945410 - DNA, 16 bp, Homo sapiens
tcctccctccaagcct

SEQ ID NO: 5945411 - DNA, 22 bp, Homo sapiens
tcctccctccaagcctggcacc

SEQ ID NO: 5945412 - DNA, 24 bp, Homo sapiens
tcctccctccaagcctggcaccca

SEQ ID NO: 5945413 - DNA, 14 bp, Homo sapiens
tcctccctcccaca

SEQ ID NO: 5945414 - DNA, 14 bp, Homo sapiens
tcctccctcccagc

SEQ ID NO: 5945415 - DNA, 20 bp, Homo sapiens
tcctccctcccagctgcact

SEQ ID NO: 5945416 - DNA, 17 bp, Homo sapiens
tcctccctccctctccg

SEQ ID NO: 5945417 - DNA, 19 bp, Homo sapiens
tcctccctccctctttccc

SEQ ID NO: 5945418 - DNA, 18 bp, Homo sapiens
tcctccctccctgcaggg

SEQ ID NO: 5945419 - DNA, 11 bp, Homo sapiens
tcctccctcct

SEQ ID NO: 5945420 - DNA, 13 bp, Homo sapiens
tcctccctcctgc

SEQ ID NO: 5945421 - DNA, 18 bp, Homo sapiens
tcctccctcctgcaggct

SEQ ID NO: 5945422 - DNA, 19 bp, Homo sapiens
tcctccctcctgcaggctg

SEQ ID NO: 5945423 - DNA, 19 bp, Homo sapiens
tcctccctctgaggctgta

SEQ ID NO: 5945424 - DNA, 13 bp, Homo sapiens
tcctccctctgcc

SEQ ID NO: 5945425 - DNA, 14 bp, Homo sapiens
tcctccctctgcct

SEQ ID NO: 5945426 - DNA, 15 bp, Homo sapiens
tcctccctctgcctc

SEQ ID NO: 5945427 - DNA, 16 bp, Homo sapiens
tcctccctgaccctgc

SEQ ID NO: 5945428 - DNA, 20 bp, Homo sapiens
tcctccctgaccctgctcct

SEQ ID NO: 5945429 - DNA, 17 bp, Homo sapiens
tcctccctgacttttct

SEQ ID NO: 5945430 - DNA, 17 bp, Homo sapiens
tcctccctgccccccaa

SEQ ID NO: 5945431 - DNA, 19 bp, Homo sapiens
tcctccctgccctcgggtc

SEQ ID NO: 5945432 - DNA, 13 bp, Homo sapiens
tcctccctgcctg

SEQ ID NO: 5945433 - DNA, 19 bp, Homo sapiens
tcctccctgctcagctggc

SEQ ID NO: 5945434 - DNA, 21 bp, Homo sapiens
tcctccctgctcagctggccg

SEQ ID NO: 5945435 - DNA, 13 bp, Homo sapiens
tcctccctggaga

SEQ ID NO: 5945436 - DNA, 14 bp, Homo sapiens
tcctccctggctgc

SEQ ID NO: 5945437 - DNA, 17 bp, Homo sapiens
tcctccctggctgccct

SEQ ID NO: 5945438 - DNA, 22 bp, Homo sapiens
tcctccctggctgccctggccc

SEQ ID NO: 5945439 - DNA, 11 bp, Homo sapiens
tcctccctggg

SEQ ID NO: 5945440 - DNA, 18 bp, Homo sapiens
tcctccctgggatggacg

SEQ ID NO: 5945441 - DNA, 16 bp, Homo sapiens
tcctccctgggggcgg

SEQ ID NO: 5945442 - DNA, 17 bp, Homo sapiens
tcctccctgggggcggg

SEQ ID NO: 5945443 - DNA, 20 bp, Homo sapiens
tcctccctggtttgcagctg

SEQ ID NO: 5945444 - DNA, 11 bp, Homo sapiens
tcctccctgta

SEQ ID NO: 5945445 - DNA, 14 bp, Homo sapiens
tcctccctgtaact

SEQ ID NO: 5945446 - DNA, 18 bp, Homo sapiens
tcctccctgtctctgcat

SEQ ID NO: 5945447 - DNA, 22 bp, Homo sapiens
tcctccctgtgcccccagcctc

SEQ ID NO: 5945448 - DNA, 24 bp, Homo sapiens
tcctccctgtgcccccagcctcag

SEQ ID NO: 5945449 - DNA, 20 bp, Homo sapiens
tcctccctgttatctgctag

SEQ ID NO: 5945450 - DNA, 14 bp, Homo sapiens
tcctccctgttccc

SEQ ID NO: 5945451 - DNA, 16 bp, Homo sapiens
tcctccctgttcccca

SEQ ID NO: 5945452 - DNA, 14 bp, Homo sapiens
tcctcccttcccca

SEQ ID NO: 5945453 - DNA, 13 bp, Homo sapiens
tcctcccttcctt

SEQ ID NO: 5945454 - DNA, 17 bp, Homo sapiens
tcctcccttccttttcc

SEQ ID NO: 5945455 - DNA, 19 bp, Homo sapiens
tcctcccttccttttccct

SEQ ID NO: 5945456 - DNA, 21 bp, Homo sapiens
tcctcccttccttttccctgc

SEQ ID NO: 5945457 - DNA, 22 bp, Homo sapiens
tcctcccttccttttccctgct

SEQ ID NO: 5945458 - DNA, 14 bp, Homo sapiens
tcctcccttctgct

SEQ ID NO: 5945459 - DNA, 15 bp, Homo sapiens
tcctcccttctgcta

SEQ ID NO: 5945460 - DNA, 18 bp, Homo sapiens
tcctcccttctgctactg

SEQ ID NO: 5945461 - DNA, 16 bp, Homo sapiens
tcctcccttctttgct

SEQ ID NO: 5945462 - DNA, 18 bp, Homo sapiens
tcctcccttgccccaggc

SEQ ID NO: 5945463 - DNA, 19 bp, Homo sapiens
tcctccctttccttcctaa

SEQ ID NO: 5945464 - DNA, 14 bp, Homo sapiens
tcctccgaggccag

SEQ ID NO: 5945465 - DNA, 18 bp, Homo sapiens
tcctccgccttaccagga

SEQ ID NO: 5945466 - DNA, 18 bp, Homo sapiens
tcctccgctcccctttcc

SEQ ID NO: 5945467 - DNA, 18 bp, Homo sapiens
tcctccggggctcagccc

SEQ ID NO: 5945468 - DNA, 17 bp, Homo sapiens
tcctccggttgcatact

SEQ ID NO: 5945469 - DNA, 18 bp, Homo sapiens
tcctccgtccacccaggc

SEQ ID NO: 5945470 - DNA, 18 bp, Homo sapiens
tcctccgtccagccgcca

SEQ ID NO: 5945471 - DNA, 22 bp, Homo sapiens
tcctccgtccatatcagaactg

SEQ ID NO: 5945472 - DNA, 19 bp, Homo sapiens
tcctccgtgcttcctcagt

SEQ ID NO: 5945473 - DNA, 21 bp, Homo sapiens
tcctccgtgggcagctcctcg

SEQ ID NO: 5945474 - DNA, 17 bp, Homo sapiens
tcctcctaaacaaaaac

SEQ ID NO: 5945475 - DNA, 18 bp, Homo sapiens
tcctcctaaagacctcca

SEQ ID NO: 5945476 - DNA, 20 bp, Homo sapiens
tcctcctaaagacctccaaa

SEQ ID NO: 5945477 - DNA, 13 bp, Homo sapiens
tcctcctacctca

SEQ ID NO: 5945478 - DNA, 16 bp, Homo sapiens
tcctcctacctcagcc

SEQ ID NO: 5945479 - DNA, 17 bp, Homo sapiens
tcctcctacctcagcct

SEQ ID NO: 5945480 - DNA, 14 bp, Homo sapiens
tcctcctagaactc

SEQ ID NO: 5945481 - DNA, 20 bp, Homo sapiens
tcctcctaggcgctcagagg

SEQ ID NO: 5945482 - DNA, 22 bp, Homo sapiens
tcctcctaggcgctcagaggcc

SEQ ID NO: 5945483 - DNA, 13 bp, Homo sapiens
tcctcctataggg

SEQ ID NO: 5945484 - DNA, 19 bp, Homo sapiens
tcctctcagagcctcagct

SEQ ID NO: 5945485 - DNA, 23 bp, Homo sapiens
tcctctcagagcctcagcttctg

SEQ ID NO: 5945486 - DNA, 14 bp, Homo sapiens
tcctctcagcccct

SEQ ID NO: 5945487 - DNA, 13 bp, Homo sapiens
tcctctcagcttc

SEQ ID NO: 5945488 - DNA, 17 bp, Homo sapiens
tcctctcagttctctcc

SEQ ID NO: 5945489 - DNA, 19 bp, Homo sapiens
tcctctcatccttttctcc

SEQ ID NO: 5945490 - DNA, 15 bp, Homo sapiens
tcctctcattgtctt

SEQ ID NO: 5945491 - DNA, 20 bp, Homo sapiens
tcctctcattgtcttgttat

SEQ ID NO: 5945492 - DNA, 14 bp, Homo sapiens
tcctctcatttcca

SEQ ID NO: 5945493 - DNA, 14 bp, Homo sapiens
tcctctccaattgt

SEQ ID NO: 5945494 - DNA, 18 bp, Homo sapiens
tcctctccaattgtaaaa

SEQ ID NO: 5945495 - DNA, 20 bp, Homo sapiens
tcctctccaccctcctctag

SEQ ID NO: 5945496 - DNA, 13 bp, Homo sapiens
tcctctccactcc

SEQ ID NO: 5945497 - DNA, 16 bp, Homo sapiens
tcctctccactgcctt

SEQ ID NO: 5945498 - DNA, 17 bp, Homo sapiens
tcctctccactgccttc

SEQ ID NO: 5945499 - DNA, 22 bp, Homo sapiens
tcctctccactgctggacatga

SEQ ID NO: 5945500 - DNA, 17 bp, Homo sapiens
tcctctccagccttctc

SEQ ID NO: 5945501 - DNA, 23 bp, Homo sapiens
tcctctccagccttctctctctg

SEQ ID NO: 5945502 - DNA, 11 bp, Homo sapiens
tcctctccagg

SEQ ID NO: 5945503 - DNA, 14 bp, Homo sapiens
tcctctccaggaag

SEQ ID NO: 5945504 - DNA, 15 bp, Homo sapiens
tcctctccaggccag

SEQ ID NO: 5945505 - DNA, 13 bp, Homo sapiens
tcctctccatacc

SEQ ID NO: 5945506 - DNA, 21 bp, Homo sapiens
tcctctccatacctgcccctg

SEQ ID NO: 5945507 - DNA, 13 bp, Homo sapiens
tcctctccatgca

SEQ ID NO: 5945508 - DNA, 14 bp, Homo sapiens
tcctctccatttta

SEQ ID NO: 5945509 - DNA, 15 bp, Homo sapiens
tcctctccattttag

SEQ ID NO: 5945510 - DNA, 17 bp, Homo sapiens
tcctctcccaagtccac

SEQ ID NO: 5945511 - DNA, 20 bp, Homo sapiens
tcctctcccacagagtgctg

SEQ ID NO: 5945512 - DNA, 17 bp, Homo sapiens
tcctctcccatccccct

SEQ ID NO: 5945513 - DNA, 19 bp, Homo sapiens
tcctctcccattgtccctc

SEQ ID NO: 5945514 - DNA, 20 bp, Homo sapiens
tcctctcccattgtccctct

SEQ ID NO: 5945515 - DNA, 14 bp, Homo sapiens
tcctctccccagcc

SEQ ID NO: 5945516 - DNA, 16 bp, Homo sapiens
tcctctccccagccca

SEQ ID NO: 5945517 - DNA, 17 bp, Homo sapiens
tcctctccccagcccag

SEQ ID NO: 5945518 - DNA, 19 bp, Homo sapiens
tcctctccccagcccagag

SEQ ID NO: 5945519 - DNA, 20 bp, Homo sapiens
tcctctccccagcccagaga

SEQ ID NO: 5945520 - DNA, 13 bp, Homo sapiens
tcctctcccccag

SEQ ID NO: 5945521 - DNA, 20 bp, Homo sapiens
tcctctccccctcctccagg

SEQ ID NO: 5945522 - DNA, 14 bp, Homo sapiens
tcctctcccccttc

SEQ ID NO: 5945523 - DNA, 23 bp, Homo sapiens
tcctctcccccttcagctcctga

SEQ ID NO: 5945524 - DNA, 11 bp, Homo sapiens
tcctctcccct

SEQ ID NO: 5945525 - DNA, 17 bp, Homo sapiens
tcctctcccctccagcc

SEQ ID NO: 5945526 - DNA, 19 bp, Homo sapiens
tcctctcccctctaaggcc

SEQ ID NO: 5945527 - DNA, 20 bp, Homo sapiens
tcctctcccctctgccctgt

SEQ ID NO: 5945528 - DNA, 18 bp, Homo sapiens
tcctctccctcctggcca

SEQ ID NO: 5945529 - DNA, 17 bp, Homo sapiens
tcctctccctgccaagt

SEQ ID NO: 5945530 - DNA, 19 bp, Homo sapiens
tcctctccgcgccctccga

SEQ ID NO: 5945531 - DNA, 14 bp, Homo sapiens
tcctctcctaccca

SEQ ID NO: 5945532 - DNA, 19 bp, Homo sapiens
tcctctcctcctctgtgct

SEQ ID NO: 5945533 - DNA, 17 bp, Homo sapiens
tcctctcctgcccagct

SEQ ID NO: 5945534 - DNA, 21 bp, Homo sapiens
tcctctcctgcccagctctga

SEQ ID NO: 5945535 - DNA, 14 bp, Homo sapiens
tcctctcctggaaa

SEQ ID NO: 5945536 - DNA, 13 bp, Homo sapiens
tcctctcctggag

SEQ ID NO: 5945537 - DNA, 16 bp, Homo sapiens
tcctctcctggaggat

SEQ ID NO: 5945538 - DNA, 20 bp, Homo sapiens
tcctctccttgggctcctgg

SEQ ID NO: 5945539 - DNA, 13 bp, Homo sapiens
tcctctcgagccc

SEQ ID NO: 5945540 - DNA, 17 bp, Homo sapiens
tcctctcgagcccagat

SEQ ID NO: 5945541 - DNA, 18 bp, Homo sapiens
tcctctcgagcccagatg

SEQ ID NO: 5945542 - DNA, 15 bp, Homo sapiens
tcctctcgcggccct

SEQ ID NO: 5945543 - DNA, 19 bp, Homo sapiens
tcctctcgcggccctcagt

SEQ ID NO: 5945544 - DNA, 21 bp, Homo sapiens
tcctctcgtagaacctgcgca

SEQ ID NO: 5945545 - DNA, 19 bp, Homo sapiens
tcctctctaacctccttta

SEQ ID NO: 5945546 - DNA, 19 bp, Homo sapiens
tcctctctaccccccacct

SEQ ID NO: 5945547 - DNA, 13 bp, Homo sapiens
tcctctctcccac

SEQ ID NO: 5945548 - DNA, 15 bp, Homo sapiens
tcctctctccctgcc

SEQ ID NO: 5945549 - DNA, 19 bp, Homo sapiens
tcctctctccctgcctcac

SEQ ID NO: 5945550 - DNA, 21 bp, Homo sapiens
tcctctctcggagccctcaga

SEQ ID NO: 5945551 - DNA, 11 bp, Homo sapiens
tcctctctctc

SEQ ID NO: 5945552 - DNA, 16 bp, Homo sapiens
tcctctctctccctcc

SEQ ID NO: 5945553 - DNA, 19 bp, Homo sapiens
tcctctctctccctctttc

SEQ ID NO: 5945554 - DNA, 15 bp, Homo sapiens
tcctctctctctcta

SEQ ID NO: 5945555 - DNA, 14 bp, Homo sapiens
tcctctctctcttc

SEQ ID NO: 5945556 - DNA, 13 bp, Homo sapiens
tcctctctctgtg

SEQ ID NO: 5945557 - DNA, 17 bp, Homo sapiens
tcctctctgagtcaaat

SEQ ID NO: 5945558 - DNA, 21 bp, Homo sapiens
tcctctctgagtcaaatccag

SEQ ID NO: 5945559 - DNA, 23 bp, Homo sapiens
tcctctctgagtcaaatccagtg

SEQ ID NO: 5945560 - DNA, 11 bp, Homo sapiens
tcctctctgcc

SEQ ID NO: 5945561 - DNA, 13 bp, Homo sapiens
tcctctctgccct

SEQ ID NO: 5945562 - DNA, 12 bp, Homo sapiens
tcctctctgctg

SEQ ID NO: 5945563 - DNA, 14 bp, Homo sapiens
tcctctctgctggg

SEQ ID NO: 5945564 - DNA, 14 bp, Homo sapiens
tcctctctggcctt

SEQ ID NO: 5945565 - DNA, 13 bp, Homo sapiens
tcctctctgggcc

SEQ ID NO: 5945566 - DNA, 19 bp, Homo sapiens
tcctctctggggctgtgtt

SEQ ID NO: 5945567 - DNA, 22 bp, Homo sapiens
tcctctctggtggctgggctgc

SEQ ID NO: 5945568 - DNA, 21 bp, Homo sapiens
tcctctctgtctgtctctccc

SEQ ID NO: 5945569 - DNA, 20 bp, Homo sapiens
tcctctcttaaattcatatc

SEQ ID NO: 5945570 - DNA, 15 bp, Homo sapiens
tcctctcttccacag

SEQ ID NO: 5945571 - DNA, 19 bp, Homo sapiens
tcctctcttccacagtggc

SEQ ID NO: 5945572 - DNA, 17 bp, Homo sapiens
tcctctcttcctcttcc

SEQ ID NO: 5945573 - DNA, 14 bp, Homo sapiens
tcctctcttgggta

SEQ ID NO: 5945574 - DNA, 20 bp, Homo sapiens
tcctctctttgttctcagct

SEQ ID NO: 5945575 - DNA, 23 bp, Homo sapiens
tcctctctttgttctcagctccc

SEQ ID NO: 5945576 - DNA, 11 bp, Homo sapiens
tcctctgaaac

SEQ ID NO: 5945577 - DNA, 12 bp, Homo sapiens
tcctctgaaaca

SEQ ID NO: 5945578 - DNA, 14 bp, Homo sapiens
tcctctgaaacagc

SEQ ID NO: 5945579 - DNA, 19 bp, Homo sapiens
tcctctgaaacagctgcct

SEQ ID NO: 5945580 - DNA, 21 bp, Homo sapiens
tcctctgaaacagctgcctta

SEQ ID NO: 5945581 - DNA, 21 bp, Homo sapiens
tcctctgaaaccctcctccac

SEQ ID NO: 5945582 - DNA, 17 bp, Homo sapiens
tcctctgaagactgcta

SEQ ID NO: 5945583 - DNA, 15 bp, Homo sapiens
tcctctgactcaggg

SEQ ID NO: 5945584 - DNA, 15 bp, Homo sapiens
tcctctgactccact

SEQ ID NO: 5945585 - DNA, 17 bp, Homo sapiens
tcctctgactccactca

SEQ ID NO: 5945586 - DNA, 18 bp, Homo sapiens
tcctctgagattctaaga

SEQ ID NO: 5945587 - DNA, 14 bp, Homo sapiens
tcctctgagcagcc

SEQ ID NO: 5945588 - DNA, 15 bp, Homo sapiens
tcctctgagcagcct

SEQ ID NO: 5945589 - DNA, 14 bp, Homo sapiens
tcctctgagcccag

SEQ ID NO: 5945590 - DNA, 15 bp, Homo sapiens
tcctctgagcccagc

SEQ ID NO: 5945591 - DNA, 16 bp, Homo sapiens
tcctctgagcccagct

SEQ ID NO: 5945592 - DNA, 12 bp, Homo sapiens
tcctctgagcct

SEQ ID NO: 5945593 - DNA, 18 bp, Homo sapiens
tcctctgagctgttatct

SEQ ID NO: 5945594 - DNA, 21 bp, Homo sapiens
tcctctgaggatgatgtactt

SEQ ID NO: 5945595 - DNA, 18 bp, Homo sapiens
tcctctgagttctgtact

SEQ ID NO: 5945596 - DNA, 21 bp, Homo sapiens
tcctctgataatatattttca

SEQ ID NO: 5945597 - DNA, 20 bp, Homo sapiens
tcctctgatagctgtttcaa

SEQ ID NO: 5945598 - DNA, 22 bp, Homo sapiens
tcctctgatagctgtttcaaat

SEQ ID NO: 5945599 - DNA, 18 bp, Homo sapiens
tcctctgatttacattca

SEQ ID NO: 5945600 - DNA, 16 bp, Homo sapiens
tcctctgatttcaagg

SEQ ID NO: 5945601 - DNA, 12 bp, Homo sapiens
tcctctgcaagt

SEQ ID NO: 5945602 - DNA, 21 bp, Homo sapiens
tcctctgcaagtgctcaggga

SEQ ID NO: 5945603 - DNA, 20 bp, Homo sapiens
tcctctgcacgctcaatgcc

SEQ ID NO: 5945604 - DNA, 22 bp, Homo sapiens
tcctctgcacgctcaatgccca

SEQ ID NO: 5945605 - DNA, 12 bp, Homo sapiens
tcctctgcactc

SEQ ID NO: 5945606 - DNA, 14 bp, Homo sapiens
tcctctgcagcact

SEQ ID NO: 5945607 - DNA, 17 bp, Homo sapiens
tcctctgcagctgacct

SEQ ID NO: 5945608 - DNA, 18 bp, Homo sapiens
tcctctgcagtgccttgg

SEQ ID NO: 5945609 - DNA, 12 bp, Homo sapiens
tcctctgcagtt

SEQ ID NO: 5945610 - DNA, 15 bp, Homo sapiens
tcctctgccacctcc

SEQ ID NO: 5945611 - DNA, 17 bp, Homo sapiens
tcctctgccagcaggaa

SEQ ID NO: 5945612 - DNA, 13 bp, Homo sapiens
tcctctgccaggc

SEQ ID NO: 5945613 - DNA, 11 bp, Homo sapiens
tcctctgcccc

SEQ ID NO: 5945614 - DNA, 14 bp, Homo sapiens
tcctctgccccctc

SEQ ID NO: 5945615 - DNA, 23 bp, Homo sapiens
tcctctgccccctcccccgcaga

SEQ ID NO: 5945616 - DNA, 16 bp, Homo sapiens
tcctctgcccgggagc

SEQ ID NO: 5945617 - DNA, 22 bp, Homo sapiens
tcctctgcccgggagctcagga

SEQ ID NO: 5945618 - DNA, 16 bp, Homo sapiens
tcctctgcctacagcc

SEQ ID NO: 5945619 - DNA, 20 bp, Homo sapiens
tcctctgcctacagccaggt

SEQ ID NO: 5945620 - DNA, 22 bp, Homo sapiens
tcctctgcctgccccgccccca

SEQ ID NO: 5945621 - DNA, 19 bp, Homo sapiens
tcctctgctaaattgatgt

SEQ ID NO: 5945622 - DNA, 20 bp, Homo sapiens
tcctctgctatgcattttct

SEQ ID NO: 5945623 - DNA, 20 bp, Homo sapiens
tcctctgctcaccgcccatc

SEQ ID NO: 5945624 - DNA, 12 bp, Homo sapiens
tcctctgctcca

SEQ ID NO: 5945625 - DNA, 16 bp, Homo sapiens
tcctctgctccaacag

SEQ ID NO: 5945626 - DNA, 17 bp, Homo sapiens
tcctctgctccagcaac

SEQ ID NO: 5945627 - DNA, 12 bp, Homo sapiens
tcctctgctccc

SEQ ID NO: 5945628 - DNA, 20 bp, Homo sapiens
tcctctgctcccccttttcc

SEQ ID NO: 5945629 - DNA, 22 bp, Homo sapiens
tcctctgctgcatccccttcca

SEQ ID NO: 5945630 - DNA, 23 bp, Homo sapiens
tcctctgctgcatccccttccag

SEQ ID NO: 5945631 - DNA, 14 bp, Homo sapiens
tcctctgctgccat

SEQ ID NO: 5945632 - DNA, 12 bp, Homo sapiens
tcctctgctgct

SEQ ID NO: 5945633 - DNA, 16 bp, Homo sapiens
tcctctgctgctggct

SEQ ID NO: 5945634 - DNA, 14 bp, Homo sapiens
tcctctgctgggaa

SEQ ID NO: 5945635 - DNA, 14 bp, Homo sapiens
tcctctgctggttc

SEQ ID NO: 5945636 - DNA, 15 bp, Homo sapiens
tcctctgcttcctga

SEQ ID NO: 5945637 - DNA, 15 bp, Homo sapiens
tcctctgcttgccat

SEQ ID NO: 5945638 - DNA, 17 bp, Homo sapiens
tcctctgcttgccatcc

SEQ ID NO: 5945639 - DNA, 20 bp, Homo sapiens
tcctctgcttgccatccctc

SEQ ID NO: 5945640 - DNA, 21 bp, Homo sapiens
tcctctgcttgccatccctcc

SEQ ID NO: 5945641 - DNA, 19 bp, Homo sapiens
tcctctgcttgcctggaga

SEQ ID NO: 5945642 - DNA, 16 bp, Homo sapiens
tcctctgcttgtcatt

SEQ ID NO: 5945643 - DNA, 13 bp, Homo sapiens
tcctctgctttgc

SEQ ID NO: 5945644 - DNA, 22 bp, Homo sapiens
tcctctggacggcaggctcact

SEQ ID NO: 5945645 - DNA, 18 bp, Homo sapiens
tcctctggcaggcttccc

SEQ ID NO: 5945646 - DNA, 21 bp, Homo sapiens
tcctctggcccagcctaccct

SEQ ID NO: 5945647 - DNA, 15 bp, Homo sapiens
tcctctggcctgtgt

SEQ ID NO: 5945648 - DNA, 22 bp, Homo sapiens
tcctctggctccccaaggctgc

SEQ ID NO: 5945649 - DNA, 23 bp, Homo sapiens
tcctctggcttggccacagccag

SEQ ID NO: 5945650 - DNA, 12 bp, Homo sapiens
tcctctggcttt

SEQ ID NO: 5945651 - DNA, 19 bp, Homo sapiens
tcctctggctttcccagga

SEQ ID NO: 5945652 - DNA, 19 bp, Homo sapiens
tcctctgggcagcgctatc

SEQ ID NO: 5945653 - DNA, 14 bp, Homo sapiens
tcctctgggccctg

SEQ ID NO: 5945654 - DNA, 14 bp, Homo sapiens
tcctctgggcctgg

SEQ ID NO: 5945655 - DNA, 23 bp, Homo sapiens
tcctctggggaagggaaccagcc

SEQ ID NO: 5945656 - DNA, 13 bp, Homo sapiens
tcctctggggcct

SEQ ID NO: 5945657 - DNA, 17 bp, Homo sapiens
tcctctggggctctagg

SEQ ID NO: 5945658 - DNA, 17 bp, Homo sapiens
tcctctgggtttctaag

SEQ ID NO: 5945659 - DNA, 22 bp, Homo sapiens
tcctctgggtttctaagcagtt

SEQ ID NO: 5945660 - DNA, 22 bp, Homo sapiens
tcctctggttcctttcatctct

SEQ ID NO: 5945661 - DNA, 19 bp, Homo sapiens
tcctctgtacagagcccac

SEQ ID NO: 5945662 - DNA, 19 bp, Homo sapiens
tcctctgtcagtcacagcc

SEQ ID NO: 5945663 - DNA, 22 bp, Homo sapiens
tcctgacattaagacacacctc

SEQ ID NO: 5945664 - DNA, 23 bp, Homo sapiens
tcctgacatttgtttattttttg

SEQ ID NO: 5945665 - DNA, 11 bp, Homo sapiens
tcctgaccaaa

SEQ ID NO: 5945666 - DNA, 17 bp, Homo sapiens
tcctgaccaagactgag

SEQ ID NO: 5945667 - DNA, 14 bp, Homo sapiens
tcctgaccaccctc

SEQ ID NO: 5945668 - DNA, 19 bp, Homo sapiens
tcctgaccaccctcccctc

SEQ ID NO: 5945669 - DNA, 14 bp, Homo sapiens
tcctgaccagggca

SEQ ID NO: 5945670 - DNA, 14 bp, Homo sapiens
tcctgaccagttgc

SEQ ID NO: 5945671 - DNA, 21 bp, Homo sapiens
tcctgaccataatcctagccc

SEQ ID NO: 5945672 - DNA, 22 bp, Homo sapiens
tcctgaccataatcctagcccc

SEQ ID NO: 5945673 - DNA, 13 bp, Homo sapiens
tcctgacccaggc

SEQ ID NO: 5945674 - DNA, 16 bp, Homo sapiens
tcctgacccaggccgc

SEQ ID NO: 5945675 - DNA, 17 bp, Homo sapiens
tcctgacccaggccgca

SEQ ID NO: 5945676 - DNA, 14 bp, Homo sapiens
tcctgacccccatg

SEQ ID NO: 5945677 - DNA, 23 bp, Homo sapiens
tcctgaccccgccatgcatgcag

SEQ ID NO: 5945678 - DNA, 16 bp, Homo sapiens
tcctgacccctctcct

SEQ ID NO: 5945679 - DNA, 20 bp, Homo sapiens
tcctgacccggattggccct

SEQ ID NO: 5945680 - DNA, 21 bp, Homo sapiens
tcctgacccggattggccctg

SEQ ID NO: 5945681 - DNA, 23 bp, Homo sapiens
tcctgacccggattggccctgcc

SEQ ID NO: 5945682 - DNA, 15 bp, Homo sapiens
tcctgaccctcccac

SEQ ID NO: 5945683 - DNA, 15 bp, Homo sapiens
tcctgaccctcccta

SEQ ID NO: 5945684 - DNA, 16 bp, Homo sapiens
tcctgacctcaggtga

SEQ ID NO: 5945685 - DNA, 16 bp, Homo sapiens
tcctgacctccgccat

SEQ ID NO: 5945686 - DNA, 14 bp, Homo sapiens
tcctgacctcgtga

SEQ ID NO: 5945687 - DNA, 14 bp, Homo sapiens
tcctgacctgaggc

SEQ ID NO: 5945688 - DNA, 20 bp, Homo sapiens
tcctgacctgtctcaccatg

SEQ ID NO: 5945689 - DNA, 18 bp, Homo sapiens
tcctgacgaaactggccc

SEQ ID NO: 5945690 - DNA, 21 bp, Homo sapiens
tcctgacggcgcccccagtgt

SEQ ID NO: 5945691 - DNA, 18 bp, Homo sapiens
tcctgacgtctgaagctt

SEQ ID NO: 5945692 - DNA, 21 bp, Homo sapiens
tcctgactaagcctttgactt

SEQ ID NO: 5945693 - DNA, 19 bp, Homo sapiens
tcctgactcaacatgttac

SEQ ID NO: 5945694 - DNA, 14 bp, Homo sapiens
tcctgactccagtg

SEQ ID NO: 5945695 - DNA, 15 bp, Homo sapiens
tcctgactctctcct

SEQ ID NO: 5945696 - DNA, 15 bp, Homo sapiens
tcctgactctgcccc

SEQ ID NO: 5945697 - DNA, 19 bp, Homo sapiens
tcctgactgacacaggcca

SEQ ID NO: 5945698 - DNA, 21 bp, Homo sapiens
tcctgactgacacaggccagc

SEQ ID NO: 5945699 - DNA, 13 bp, Homo sapiens
tcctgactgggaa

SEQ ID NO: 5945700 - DNA, 16 bp, Homo sapiens
tcctgactgggctggg

SEQ ID NO: 5945701 - DNA, 22 bp, Homo sapiens
tcctgactgggctgggtttgct

SEQ ID NO: 5945702 - DNA, 13 bp, Homo sapiens
tcctgactggtgc

SEQ ID NO: 5945703 - DNA, 22 bp, Homo sapiens
tcctgactgtaacatattctgt

SEQ ID NO: 5945704 - DNA, 14 bp, Homo sapiens
tcctgactgtccta

SEQ ID NO: 5945705 - DNA, 16 bp, Homo sapiens
tcctgactgttctctt

SEQ ID NO: 5945706 - DNA, 22 bp, Homo sapiens
tcctgactgttctcttactgcc

SEQ ID NO: 5945707 - DNA, 16 bp, Homo sapiens
tcctgacttcaggggc

SEQ ID NO: 5945708 - DNA, 19 bp, Homo sapiens
tcctgacttcaggggctgc

SEQ ID NO: 5945709 - DNA, 14 bp, Homo sapiens
tcctgacttccctg

SEQ ID NO: 5945710 - DNA, 13 bp, Homo sapiens
tcctgacttttaa

SEQ ID NO: 5945711 - DNA, 19 bp, Homo sapiens
tcctgagaaaaaaggttcc

SEQ ID NO: 5945712 - DNA, 20 bp, Homo sapiens
tcctgagaaacgtccatctc

SEQ ID NO: 5945713 - DNA, 20 bp, Homo sapiens
tcctgagaaagcccacctgg

SEQ ID NO: 5945714 - DNA, 18 bp, Homo sapiens
tcctgagaaggcgaggag

SEQ ID NO: 5945715 - DNA, 23 bp, Homo sapiens
tcctgagaaggcgaggagagtgg

SEQ ID NO: 5945716 - DNA, 13 bp, Homo sapiens
tcctgagacacat

SEQ ID NO: 5945717 - DNA, 15 bp, Homo sapiens
tcctgagacacatgg

SEQ ID NO: 5945718 - DNA, 16 bp, Homo sapiens
tcctgagacacatggg

SEQ ID NO: 5945719 - DNA, 14 bp, Homo sapiens
tcctgagacctcaa

SEQ ID NO: 5945720 - DNA, 21 bp, Homo sapiens
tcctgagagacctgccctctc

SEQ ID NO: 5945721 - DNA, 19 bp, Homo sapiens
tcctgagagctgcatgtgt

SEQ ID NO: 5945722 - DNA, 13 bp, Homo sapiens
tcctgagaggtgc

SEQ ID NO: 5945723 - DNA, 15 bp, Homo sapiens
tcctgagattctggg

SEQ ID NO: 5945724 - DNA, 18 bp, Homo sapiens
tcctgagattctgggaaa

SEQ ID NO: 5945725 - DNA, 23 bp, Homo sapiens
tcctgagattctgggaaaggtgc

SEQ ID NO: 5945726 - DNA, 20 bp, Homo sapiens
tcctgagcacccgctgacat

SEQ ID NO: 5945727 - DNA, 14 bp, Homo sapiens
tcctgagcactgcc

SEQ ID NO: 5945728 - DNA, 17 bp, Homo sapiens
tcctgagcactgccagg

SEQ ID NO: 5945729 - DNA, 21 bp, Homo sapiens
tcctgagcactgccaggaggg

SEQ ID NO: 5945730 - DNA, 15 bp, Homo sapiens
tcctgagcagtccct

SEQ ID NO: 5945731 - DNA, 20 bp, Homo sapiens
tcctgagcagtccctgctta

SEQ ID NO: 5945732 - DNA, 22 bp, Homo sapiens
tcctgagccagggaacagcccc

SEQ ID NO: 5945733 - DNA, 22 bp, Homo sapiens
tcctgagcccaaccaggccctg

SEQ ID NO: 5945734 - DNA, 18 bp, Homo sapiens
tcctgagcccccagcttc

SEQ ID NO: 5945735 - DNA, 16 bp, Homo sapiens
tcctgagccccctgca

SEQ ID NO: 5945736 - DNA, 13 bp, Homo sapiens
tcctgagccccgc

SEQ ID NO: 5945737 - DNA, 12 bp, Homo sapiens
tcctgagcctcc

SEQ ID NO: 5945738 - DNA, 16 bp, Homo sapiens
tcctgagcctgtctct

SEQ ID NO: 5945739 - DNA, 13 bp, Homo sapiens
tcctgagcctgtg

SEQ ID NO: 5945740 - DNA, 15 bp, Homo sapiens
tcctgagcctgtggg

SEQ ID NO: 5945741 - DNA, 16 bp, Homo sapiens
tcctgagcctgtgggt

SEQ ID NO: 5945742 - DNA, 21 bp, Homo sapiens
tcctgagcgaaaacaggagag

SEQ ID NO: 5945743 - DNA, 21 bp, Homo sapiens
tcctgagctcggggggctctg

SEQ ID NO: 5945744 - DNA, 15 bp, Homo sapiens
tcctgagctggcctg

SEQ ID NO: 5945745 - DNA, 20 bp, Homo sapiens
tcctgagctggcctgtctgc

SEQ ID NO: 5945746 - DNA, 21 bp, Homo sapiens
tcctgagctgtcgctgcctcc

SEQ ID NO: 5945747 - DNA, 12 bp, Homo sapiens
tcctgagcttgg

SEQ ID NO: 5945748 - DNA, 16 bp, Homo sapiens
tcctgagcttggccag

SEQ ID NO: 5945749 - DNA, 19 bp, Homo sapiens
tcctgagcttggccagaag

SEQ ID NO: 5945750 - DNA, 13 bp, Homo sapiens
tcctgagctttat

SEQ ID NO: 5945751 - DNA, 12 bp, Homo sapiens
tcctgaggaccg

SEQ ID NO: 5945752 - DNA, 18 bp, Homo sapiens
tcctgaggagccctgagg

SEQ ID NO: 5945753 - DNA, 17 bp, Homo sapiens
tcctgaggagtgtcctg

SEQ ID NO: 5945754 - DNA, 18 bp, Homo sapiens
tcctgaggatcagaaagt

SEQ ID NO: 5945755 - DNA, 19 bp, Homo sapiens
tcctgaggcagaacctggt

SEQ ID NO: 5945756 - DNA, 23 bp, Homo sapiens
tcctgaggcagaacctggtggct

SEQ ID NO: 5945757 - DNA, 16 bp, Homo sapiens
tcctgaggccagtggc

SEQ ID NO: 5945758 - DNA, 16 bp, Homo sapiens
tcctgaggctccactt

SEQ ID NO: 5945759 - DNA, 17 bp, Homo sapiens
tcctgaggctccacttg

SEQ ID NO: 5945760 - DNA, 20 bp, Homo sapiens
tcctgaggctctctaagaaa

SEQ ID NO: 5945761 - DNA, 16 bp, Homo sapiens
tcctgaggctgggctc

SEQ ID NO: 5945762 - DNA, 19 bp, Homo sapiens
tcctgaggctgggctccct

SEQ ID NO: 5945763 - DNA, 15 bp, Homo sapiens
tcctgaggctggggc

SEQ ID NO: 5945764 - DNA, 21 bp, Homo sapiens
tcctgaggctggtagcagaat

SEQ ID NO: 5945765 - DNA, 22 bp, Homo sapiens
tcctgaggctgtttttggctgt

SEQ ID NO: 5945766 - DNA, 24 bp, Homo sapiens
tcctgagggctaattctgggaagg

SEQ ID NO: 5945767 - DNA, 16 bp, Homo sapiens
tcctgagggggaagtg

SEQ ID NO: 5945768 - DNA, 22 bp, Homo sapiens
tcctgagggtccccacctggga

SEQ ID NO: 5945769 - DNA, 16 bp, Homo sapiens
tcctgaggtctggatt

SEQ ID NO: 5945770 - DNA, 13 bp, Homo sapiens
tcctgaggtgcct

SEQ ID NO: 5945771 - DNA, 14 bp, Homo sapiens
tcctgaggtgcctc

SEQ ID NO: 5945772 - DNA, 17 bp, Homo sapiens
tcctgaggtgcctccca

SEQ ID NO: 5945773 - DNA, 16 bp, Homo sapiens
tcctgagtagctggga

SEQ ID NO: 5945774 - DNA, 22 bp, Homo sapiens
tcctgagtagctgggcctgtgc

SEQ ID NO: 5945775 - DNA, 18 bp, Homo sapiens
tcctgagtcttggcctgc

SEQ ID NO: 5945776 - DNA, 17 bp, Homo sapiens
tcctgagtggccaggga

SEQ ID NO: 5945777 - DNA, 19 bp, Homo sapiens
tcctgagtttctctctcct

SEQ ID NO: 5945778 - DNA, 18 bp, Homo sapiens
tcctgataaagcacagct

SEQ ID NO: 5945779 - DNA, 17 bp, Homo sapiens
tcctgataataattgat

SEQ ID NO: 5945780 - DNA, 18 bp, Homo sapiens
tcctgataataattgatc

SEQ ID NO: 5945781 - DNA, 15 bp, Homo sapiens
tcctgataccattct

SEQ ID NO: 5945782 - DNA, 16 bp, Homo sapiens
tcctgataccattcta

SEQ ID NO: 5945783 - DNA, 22 bp, Homo sapiens
tcctgataccattctattctcc

SEQ ID NO: 5945784 - DNA, 23 bp, Homo sapiens
tcctgatagcatatgacaaatgt

SEQ ID NO: 5945785 - DNA, 20 bp, Homo sapiens
tcctgatcaaggtgctcttc

SEQ ID NO: 5945786 - DNA, 21 bp, Homo sapiens
tcctgatccactttgggggag

SEQ ID NO: 5945787 - DNA, 18 bp, Homo sapiens
tcctgatcccagacccat

SEQ ID NO: 5945788 - DNA, 19 bp, Homo sapiens
tcctgatgaccaatgggat

SEQ ID NO: 5945789 - DNA, 17 bp, Homo sapiens
tcctgatgatttttatt

SEQ ID NO: 5945790 - DNA, 21 bp, Homo sapiens
tcctgatgccctcttctcctt

SEQ ID NO: 5945791 - DNA, 22 bp, Homo sapiens
tcctgatgccctcttctccttg

SEQ ID NO: 5945792 - DNA, 21 bp, Homo sapiens
tcctgatgcttcttcagagac

SEQ ID NO: 5945793 - DNA, 21 bp, Homo sapiens
tcctgatggaattgttatact

SEQ ID NO: 5945794 - DNA, 17 bp, Homo sapiens
tcctgatggacctgccc

SEQ ID NO: 5945795 - DNA, 22 bp, Homo sapiens
tcctgatggagtgtgcagacag

SEQ ID NO: 5945796 - DNA, 13 bp, Homo sapiens
tcctgatggccaa

SEQ ID NO: 5945797 - DNA, 15 bp, Homo sapiens
tcctgatggccaaga

SEQ ID NO: 5945798 - DNA, 17 bp, Homo sapiens
tcctgatggccaagagc

SEQ ID NO: 5945799 - DNA, 14 bp, Homo sapiens
tcctgatggccgct

SEQ ID NO: 5945800 - DNA, 20 bp, Homo sapiens
tcctgatggtcagctccctt

SEQ ID NO: 5945801 - DNA, 22 bp, Homo sapiens
tcctgatggtgtcattctgcct

SEQ ID NO: 5945802 - DNA, 24 bp, Homo sapiens
tcctgatggtgtcattctgcctgc

SEQ ID NO: 5945803 - DNA, 20 bp, Homo sapiens
tcctgatgttggtatctaag

SEQ ID NO: 5945804 - DNA, 20 bp, Homo sapiens
tcctgatgtttttctgtgtt

SEQ ID NO: 5945805 - DNA, 13 bp, Homo sapiens
tcctgattccaaa

SEQ ID NO: 5945806 - DNA, 15 bp, Homo sapiens
tcctgattccaaata

SEQ ID NO: 5945807 - DNA, 21 bp, Homo sapiens
tcctgattcccgcatggtttt

SEQ ID NO: 5945808 - DNA, 14 bp, Homo sapiens
tcctgattcctctc

SEQ ID NO: 5945809 - DNA, 20 bp, Homo sapiens
tcctgattgctctggaagcc

SEQ ID NO: 5945810 - DNA, 20 bp, Homo sapiens
tcctgattggtttctcttct

SEQ ID NO: 5945811 - DNA, 17 bp, Homo sapiens
tcctgattgtttacagt

SEQ ID NO: 5945812 - DNA, 16 bp, Homo sapiens
tcctgatttcagggaa

SEQ ID NO: 5945813 - DNA, 16 bp, Homo sapiens
tcctgatttctctgaa

SEQ ID NO: 5945814 - DNA, 14 bp, Homo sapiens
tcctgatttgagtt

SEQ ID NO: 5945815 - DNA, 17 bp, Homo sapiens
tcctgatttttcatatg

SEQ ID NO: 5945816 - DNA, 15 bp, Homo sapiens
tcctgcaaaggccct

SEQ ID NO: 5945817 - DNA, 14 bp, Homo sapiens
tcctgcaaatttag

SEQ ID NO: 5945818 - DNA, 17 bp, Homo sapiens
tcctgcaaatttagttt

SEQ ID NO: 5945819 - DNA, 20 bp, Homo sapiens
tcctgcaaccaaactcccat

SEQ ID NO: 5945820 - DNA, 16 bp, Homo sapiens
tcctgcaacgctgcct

SEQ ID NO: 5945821 - DNA, 17 bp, Homo sapiens
tcctgcaactcaaggac

SEQ ID NO: 5945822 - DNA, 14 bp, Homo sapiens
tcctgcaagagtgg

SEQ ID NO: 5945823 - DNA, 22 bp, Homo sapiens
tcctgcaagagtgggctttcca

SEQ ID NO: 5945824 - DNA, 15 bp, Homo sapiens
tcctgcaatctccag

SEQ ID NO: 5945825 - DNA, 20 bp, Homo sapiens
tcctgcaatctccagggctg

SEQ ID NO: 5945826 - DNA, 13 bp, Homo sapiens
tcctgcaatgaaa

SEQ ID NO: 5945827 - DNA, 14 bp, Homo sapiens
tcctgcaatgaaag

SEQ ID NO: 5945828 - DNA, 22 bp, Homo sapiens
tcctgcaatgaagtctctgaag

SEQ ID NO: 5945829 - DNA, 13 bp, Homo sapiens
tcctgcacacagg

SEQ ID NO: 5945830 - DNA, 18 bp, Homo sapiens
tcctgcacacagggcagt

SEQ ID NO: 5945831 - DNA, 21 bp, Homo sapiens
tcctgcacagattcccaggcc

SEQ ID NO: 5945832 - DNA, 22 bp, Homo sapiens
tcctgcacagattcccaggcca

SEQ ID NO: 5945833 - DNA, 18 bp, Homo sapiens
tcctgcaccccagcattc

SEQ ID NO: 5945834 - DNA, 23 bp, Homo sapiens
tcctgcaccccagcattccagct

SEQ ID NO: 5945835 - DNA, 18 bp, Homo sapiens
tcctgcaccggggcctgg

SEQ ID NO: 5945836 - DNA, 20 bp, Homo sapiens
tcctgcaccggggcctgggc

SEQ ID NO: 5945837 - DNA, 13 bp, Homo sapiens
tcctgcactccag

SEQ ID NO: 5945838 - DNA, 17 bp, Homo sapiens
tcctgcactgactctgg

SEQ ID NO: 5945839 - DNA, 21 bp, Homo sapiens
tcctgcacttacttgcttatt

SEQ ID NO: 5945840 - DNA, 19 bp, Homo sapiens
tcctggaaggacacagtga

SEQ ID NO: 5945841 - DNA, 21 bp, Homo sapiens
tcctggaagtcaaataaatgt

SEQ ID NO: 5945842 - DNA, 16 bp, Homo sapiens
tcctggaagtgtgtgt

SEQ ID NO: 5945843 - DNA, 13 bp, Homo sapiens
tcctggaataaac

SEQ ID NO: 5945844 - DNA, 22 bp, Homo sapiens
tcctggaataaacatctgtgtc

SEQ ID NO: 5945845 - DNA, 22 bp, Homo sapiens
tcctggaatatctccgtcaact

SEQ ID NO: 5945846 - DNA, 16 bp, Homo sapiens
tcctggaatgaagcat

SEQ ID NO: 5945847 - DNA, 17 bp, Homo sapiens
tcctggaatgaagcatg

SEQ ID NO: 5945848 - DNA, 20 bp, Homo sapiens
tcctggaatgaagcatgtag

SEQ ID NO: 5945849 - DNA, 13 bp, Homo sapiens
tcctggacacact

SEQ ID NO: 5945850 - DNA, 17 bp, Homo sapiens
tcctggacacctcccag

SEQ ID NO: 5945851 - DNA, 18 bp, Homo sapiens
tcctggacacctcccagg

SEQ ID NO: 5945852 - DNA, 23 bp, Homo sapiens
tcctggacacctcccaggggact

SEQ ID NO: 5945853 - DNA, 18 bp, Homo sapiens
tcctggacagtgagagca

SEQ ID NO: 5945854 - DNA, 15 bp, Homo sapiens
tcctggacatcacca

SEQ ID NO: 5945855 - DNA, 22 bp, Homo sapiens
tcctggacatgaagattctttc

SEQ ID NO: 5945856 - DNA, 14 bp, Homo sapiens
tcctggacattttt

SEQ ID NO: 5945857 - DNA, 14 bp, Homo sapiens
tcctggaccaggcc

SEQ ID NO: 5945858 - DNA, 17 bp, Homo sapiens
tcctggacccagcaggg

SEQ ID NO: 5945859 - DNA, 14 bp, Homo sapiens
tcctggacctgagt

SEQ ID NO: 5945860 - DNA, 22 bp, Homo sapiens
tcctggaccttgacagagcagc

SEQ ID NO: 5945861 - DNA, 16 bp, Homo sapiens
tcctggactccggagg

SEQ ID NO: 5945862 - DNA, 19 bp, Homo sapiens
tcctggactccggaggact

SEQ ID NO: 5945863 - DNA, 21 bp, Homo sapiens
tcctggactccggaggactga

SEQ ID NO: 5945864 - DNA, 14 bp, Homo sapiens
tcctggactgaggg

SEQ ID NO: 5945865 - DNA, 20 bp, Homo sapiens
tcctggactgagggggcctg

SEQ ID NO: 5945866 - DNA, 14 bp, Homo sapiens
tcctggactggccc

SEQ ID NO: 5945867 - DNA, 19 bp, Homo sapiens
tcctggacttacaaaatgc

SEQ ID NO: 5945868 - DNA, 12 bp, Homo sapiens
tcctggagactt

SEQ ID NO: 5945869 - DNA, 22 bp, Homo sapiens
tcctggagaggtggctgcgccc

SEQ ID NO: 5945870 - DNA, 14 bp, Homo sapiens
tcctggagagtctc

SEQ ID NO: 5945871 - DNA, 20 bp, Homo sapiens
tcctggagatagctggggct

SEQ ID NO: 5945872 - DNA, 21 bp, Homo sapiens
tcctggagcaagctctgccct

SEQ ID NO: 5945873 - DNA, 22 bp, Homo sapiens
tcctggagcaagctctgccctg

SEQ ID NO: 5945874 - DNA, 14 bp, Homo sapiens
tcctggagcagcag

SEQ ID NO: 5945875 - DNA, 14 bp, Homo sapiens
tcctggagcatccc

SEQ ID NO: 5945876 - DNA, 10 bp, Homo sapiens
tcctggagcc

SEQ ID NO: 5945877 - DNA, 18 bp, Homo sapiens
tcctggagccccagaacc

SEQ ID NO: 5945878 - DNA, 13 bp, Homo sapiens
tcctggagcccga

SEQ ID NO: 5945879 - DNA, 16 bp, Homo sapiens
tcctggagctctgtgg

SEQ ID NO: 5945880 - DNA, 22 bp, Homo sapiens
tcctggaggatgaccaggacta

SEQ ID NO: 5945881 - DNA, 14 bp, Homo sapiens
tcctggaggcccag

SEQ ID NO: 5945882 - DNA, 15 bp, Homo sapiens
tcctggaggcccagt

SEQ ID NO: 5945883 - DNA, 18 bp, Homo sapiens
tcctggaggcccagttca

SEQ ID NO: 5945884 - DNA, 23 bp, Homo sapiens
tcctggaggctcaaattttgagt

SEQ ID NO: 5945885 - DNA, 19 bp, Homo sapiens
tcctggaggctggggatgg

SEQ ID NO: 5945886 - DNA, 21 bp, Homo sapiens
tcctggagggaagcactgcct

SEQ ID NO: 5945887 - DNA, 18 bp, Homo sapiens
tcctggagggcgcccagc

SEQ ID NO: 5945888 - DNA, 20 bp, Homo sapiens
tcctggagggcgcccagcag

SEQ ID NO: 5945889 - DNA, 23 bp, Homo sapiens
tcctggagggcgcccagcagcct

SEQ ID NO: 5945890 - DNA, 11 bp, Homo sapiens
tcctggagggg

SEQ ID NO: 5945891 - DNA, 19 bp, Homo sapiens
tcctggaggggctggggac

SEQ ID NO: 5945892 - DNA, 18 bp, Homo sapiens
tcctggagggggcaagcc

SEQ ID NO: 5945893 - DNA, 20 bp, Homo sapiens
tcctggaggtgggagacaag

SEQ ID NO: 5945894 - DNA, 19 bp, Homo sapiens
tcctggaggttccccagcc

SEQ ID NO: 5945895 - DNA, 15 bp, Homo sapiens
tcctggagtctcact

SEQ ID NO: 5945896 - DNA, 13 bp, Homo sapiens
tcctggagtctga

SEQ ID NO: 5945897 - DNA, 15 bp, Homo sapiens
tcctggagtgccctg

SEQ ID NO: 5945898 - DNA, 18 bp, Homo sapiens
tcctggagtgccctgcag

SEQ ID NO: 5945899 - DNA, 18 bp, Homo sapiens
tcctggagttttgatttg

SEQ ID NO: 5945900 - DNA, 15 bp, Homo sapiens
tcctggataaaaaag

SEQ ID NO: 5945901 - DNA, 14 bp, Homo sapiens
tcctggattttctt

SEQ ID NO: 5945902 - DNA, 20 bp, Homo sapiens
tcctggattttctttctatg

SEQ ID NO: 5945903 - DNA, 21 bp, Homo sapiens
tcctggattttctttctatgt

SEQ ID NO: 5945904 - DNA, 15 bp, Homo sapiens
tcctggcaagtgacc

SEQ ID NO: 5945905 - DNA, 22 bp, Homo sapiens
tcctggcaatagtgtgttctga

SEQ ID NO: 5945906 - DNA, 22 bp, Homo sapiens
tcctggcacaatgttggagcag

SEQ ID NO: 5945907 - DNA, 19 bp, Homo sapiens
tcctggcacagaagaggag

SEQ ID NO: 5945908 - DNA, 20 bp, Homo sapiens
tcctggcacagtttttgtaa

SEQ ID NO: 5945909 - DNA, 22 bp, Homo sapiens
tcctggcacattgcccctctgc

SEQ ID NO: 5945910 - DNA, 14 bp, Homo sapiens
tcctggcacccggc

SEQ ID NO: 5945911 - DNA, 16 bp, Homo sapiens
tcctggcacccggccc

SEQ ID NO: 5945912 - DNA, 20 bp, Homo sapiens
tcctggcacccggcccctgc

SEQ ID NO: 5945913 - DNA, 17 bp, Homo sapiens
tcctggcacgccctact

SEQ ID NO: 5945914 - DNA, 18 bp, Homo sapiens
tcctggcacgccctactc

SEQ ID NO: 5945915 - DNA, 23 bp, Homo sapiens
tcctggcacgccctactccactg

SEQ ID NO: 5945916 - DNA, 22 bp, Homo sapiens
tcctggcactaccaaaggacac

SEQ ID NO: 5945917 - DNA, 17 bp, Homo sapiens
tcctggcactgcttcca

SEQ ID NO: 5945918 - DNA, 11 bp, Homo sapiens
tcctggcagcc

SEQ ID NO: 5945919 - DNA, 15 bp, Homo sapiens
tcctggcagcccaga

SEQ ID NO: 5945920 - DNA, 17 bp, Homo sapiens
tcctggcagcccagaga

SEQ ID NO: 5945921 - DNA, 13 bp, Homo sapiens
tcctggcagctgc

SEQ ID NO: 5945922 - DNA, 16 bp, Homo sapiens
tcctggcagctgctgt

SEQ ID NO: 5945923 - DNA, 18 bp, Homo sapiens
tcctggcagctgctgtgg

SEQ ID NO: 5945924 - DNA, 16 bp, Homo sapiens
tcctggcagctggacc

SEQ ID NO: 5945925 - DNA, 14 bp, Homo sapiens
tcctggcagggcag

SEQ ID NO: 5945926 - DNA, 19 bp, Homo sapiens
tcctggcagggcaggcaga

SEQ ID NO: 5945927 - DNA, 20 bp, Homo sapiens
tcctggcagggcaggcagag

SEQ ID NO: 5945928 - DNA, 22 bp, Homo sapiens
tcctggcagggcaggcagagct

SEQ ID NO: 5945929 - DNA, 23 bp, Homo sapiens
tcctggcagggccacctgcagga

SEQ ID NO: 5945930 - DNA, 17 bp, Homo sapiens
tcctggcagtttaaaaa

SEQ ID NO: 5945931 - DNA, 19 bp, Homo sapiens
tcctggccaagcaggctgg

SEQ ID NO: 5945932 - DNA, 11 bp, Homo sapiens
tcctggccaga

SEQ ID NO: 5945933 - DNA, 18 bp, Homo sapiens
tcctggccagacgctgcc

SEQ ID NO: 5945934 - DNA, 16 bp, Homo sapiens
tcctggccagatgtcg

SEQ ID NO: 5945935 - DNA, 21 bp, Homo sapiens
tcctggccagatgtcgctggg

SEQ ID NO: 5945936 - DNA, 20 bp, Homo sapiens
tcctggccatcccacaagtg

SEQ ID NO: 5945937 - DNA, 21 bp, Homo sapiens
tcctggccattttcttgcctg

SEQ ID NO: 5945938 - DNA, 15 bp, Homo sapiens
tcctggcccagcctt

SEQ ID NO: 5945939 - DNA, 12 bp, Homo sapiens
tcctggcccagg

SEQ ID NO: 5945940 - DNA, 14 bp, Homo sapiens
tcctggcccaggcc

SEQ ID NO: 5945941 - DNA, 17 bp, Homo sapiens
tcctggcccaggccttg

SEQ ID NO: 5945942 - DNA, 18 bp, Homo sapiens
tcctggcccatcagtgta

SEQ ID NO: 5945943 - DNA, 19 bp, Homo sapiens
tcctggccccagcccccac

SEQ ID NO: 5945944 - DNA, 20 bp, Homo sapiens
tcctggccccctcattcaga

SEQ ID NO: 5945945 - DNA, 14 bp, Homo sapiens
tcctggccccgggc

SEQ ID NO: 5945946 - DNA, 23 bp, Homo sapiens
tcctggccccgggctctggccac

SEQ ID NO: 5945947 - DNA, 18 bp, Homo sapiens
tcctggcccctgcctgct

SEQ ID NO: 5945948 - DNA, 23 bp, Homo sapiens
tcctggcccgccctcacctctga

SEQ ID NO: 5945949 - DNA, 16 bp, Homo sapiens
tcctggccctctgtgt

SEQ ID NO: 5945950 - DNA, 15 bp, Homo sapiens
tcctggccctggggg

SEQ ID NO: 5945951 - DNA, 15 bp, Homo sapiens
tcctggcccttcagt

SEQ ID NO: 5945952 - DNA, 14 bp, Homo sapiens
tcctggcctatccg

SEQ ID NO: 5945953 - DNA, 12 bp, Homo sapiens
tcctggcctcaa

SEQ ID NO: 5945954 - DNA, 18 bp, Homo sapiens
tcctggcctcactggctg

SEQ ID NO: 5945955 - DNA, 19 bp, Homo sapiens
tcctggcctcactggctgg

SEQ ID NO: 5945956 - DNA, 22 bp, Homo sapiens
tcctggcctcagactgcaccca

SEQ ID NO: 5945957 - DNA, 14 bp, Homo sapiens
tcctggcctcagag

SEQ ID NO: 5945958 - DNA, 15 bp, Homo sapiens
tcctggcctcagagc

SEQ ID NO: 5945959 - DNA, 23 bp, Homo sapiens
tcctggcctcagagcttcctggg

SEQ ID NO: 5945960 - DNA, 13 bp, Homo sapiens
tcctggcctccct

SEQ ID NO: 5945961 - DNA, 19 bp, Homo sapiens
tcctggcctcccttctcct

SEQ ID NO: 5945962 - DNA, 12 bp, Homo sapiens
tcctggcctcct

SEQ ID NO: 5945963 - DNA, 13 bp, Homo sapiens
tcctggcctcctt

SEQ ID NO: 5945964 - DNA, 11 bp, Homo sapiens
tcctggcctct

SEQ ID NO: 5945965 - DNA, 11 bp, Homo sapiens
tcctggcctga

SEQ ID NO: 5945966 - DNA, 14 bp, Homo sapiens
tcctggcctgagaa

SEQ ID NO: 5945967 - DNA, 23 bp, Homo sapiens
tcctggcctggcacatcagaaag

SEQ ID NO: 5945968 - DNA, 16 bp, Homo sapiens
tcctggcctggcttct

SEQ ID NO: 5945969 - DNA, 21 bp, Homo sapiens
tcctggccttcctcgttgggc

SEQ ID NO: 5945970 - DNA, 14 bp, Homo sapiens
tcctggccttctga

SEQ ID NO: 5945971 - DNA, 19 bp, Homo sapiens
tcctggcgggggtgggccg

SEQ ID NO: 5945972 - DNA, 17 bp, Homo sapiens
tcctggctaagcctctg

SEQ ID NO: 5945973 - DNA, 19 bp, Homo sapiens
tcctggctaagcctctgct

SEQ ID NO: 5945974 - DNA, 14 bp, Homo sapiens
tcctggctacatcc

SEQ ID NO: 5945975 - DNA, 24 bp, Homo sapiens
tcctggctacatcccagcctgtgg

SEQ ID NO: 5945976 - DNA, 17 bp, Homo sapiens
tcctggctcacagccac

SEQ ID NO: 5945977 - DNA, 17 bp, Homo sapiens
tcctggctcaggcccag

SEQ ID NO: 5945978 - DNA, 14 bp, Homo sapiens
tcctggctcccagg

SEQ ID NO: 5945979 - DNA, 16 bp, Homo sapiens
tcctggctccgcaggg

SEQ ID NO: 5945980 - DNA, 23 bp, Homo sapiens
tcctggctctaccctgtctgtcc

SEQ ID NO: 5945981 - DNA, 11 bp, Homo sapiens
tcctggctctg

SEQ ID NO: 5945982 - DNA, 13 bp, Homo sapiens
tcctggctctggg

SEQ ID NO: 5945983 - DNA, 23 bp, Homo sapiens
tcctggctcttgatacccccctc

SEQ ID NO: 5945984 - DNA, 24 bp, Homo sapiens
tcctggctgatgatccagaacagt

SEQ ID NO: 5945985 - DNA, 13 bp, Homo sapiens
tcctggctgccag

SEQ ID NO: 5945986 - DNA, 22 bp, Homo sapiens
tcctggctgcggcgtctgtctg

SEQ ID NO: 5945987 - DNA, 18 bp, Homo sapiens
tcctggctgctctcatgc

SEQ ID NO: 5945988 - DNA, 20 bp, Homo sapiens
tcctggctgctctcatgcct

SEQ ID NO: 5945989 - DNA, 16 bp, Homo sapiens
tcctggctggctgtgt

SEQ ID NO: 5945990 - DNA, 18 bp, Homo sapiens
tcctggctggctgtgtcc

SEQ ID NO: 5945991 - DNA, 21 bp, Homo sapiens
tcctggctgtgaatgccaaag

SEQ ID NO: 5945992 - DNA, 13 bp, Homo sapiens
tcctggctgtgac

SEQ ID NO: 5945993 - DNA, 22 bp, Homo sapiens
tcctggctgtgacacctggtgc

SEQ ID NO: 5945994 - DNA, 15 bp, Homo sapiens
tcctggctgtgccca

SEQ ID NO: 5945995 - DNA, 13 bp, Homo sapiens
tcctggcttcagg

SEQ ID NO: 5945996 - DNA, 14 bp, Homo sapiens
tcctggcttcaggc

SEQ ID NO: 5945997 - DNA, 20 bp, Homo sapiens
tcctggcttcccatccccag

SEQ ID NO: 5945998 - DNA, 23 bp, Homo sapiens
tcctggcttctagatctggaacc

SEQ ID NO: 5945999 - DNA, 22 bp, Homo sapiens
tcctgggaaacctgcctttgta

SEQ ID NO: 5946000 - DNA, 24 bp, Homo sapiens
tcctgggaaagggagatgtcagga

SEQ ID NO: 5946001 - DNA, 14 bp, Homo sapiens
tcctgggaaatatt

SEQ ID NO: 5946002 - DNA, 16 bp, Homo sapiens
tcctgggaaatattcc

SEQ ID NO: 5946003 - DNA, 22 bp, Homo sapiens
tcctgggaacacatctggctgc

SEQ ID NO: 5946004 - DNA, 16 bp, Homo sapiens
tcctgggaaggccacc

SEQ ID NO: 5946005 - DNA, 18 bp, Homo sapiens
tcctgggaaggccacctc

SEQ ID NO: 5946006 - DNA, 15 bp, Homo sapiens
tcctgggaatggaat

SEQ ID NO: 5946007 - DNA, 18 bp, Homo sapiens
tcctgggaatggaataac

SEQ ID NO: 5946008 - DNA, 15 bp, Homo sapiens
tcctgggaccccctc

SEQ ID NO: 5946009 - DNA, 16 bp, Homo sapiens
tcctgggaccccctcg

SEQ ID NO: 5946010 - DNA, 17 bp, Homo sapiens
tcctgggacctccccag

SEQ ID NO: 5946011 - DNA, 20 bp, Homo sapiens
tcctgggagaacctcaggct

SEQ ID NO: 5946012 - DNA, 23 bp, Homo sapiens
tcctgggagcccccaccacaaac

SEQ ID NO: 5946013 - DNA, 21 bp, Homo sapiens
tcctgggagctcatgtgtccc

SEQ ID NO: 5946014 - DNA, 20 bp, Homo sapiens
tcctgggaggacaggcaggc

SEQ ID NO: 5946015 - DNA, 18 bp, Homo sapiens
tcctgggaggatcctgag

SEQ ID NO: 5946016 - DNA, 18 bp, Homo sapiens
tcctgggaggctgcagcc

SEQ ID NO: 5946017 - DNA, 16 bp, Homo sapiens
tcctgttgaagacttc

SEQ ID NO: 5946018 - DNA, 22 bp, Homo sapiens
tcctgttgaagacttcctctct

SEQ ID NO: 5946019 - DNA, 16 bp, Homo sapiens
tcctgttgatcccagt

SEQ ID NO: 5946020 - DNA, 19 bp, Homo sapiens
tcctgttgatgggaaaagc

SEQ ID NO: 5946021 - DNA, 22 bp, Homo sapiens
tcctgttgcacccagccctggt

SEQ ID NO: 5946022 - DNA, 14 bp, Homo sapiens
tcctgttgcactga

SEQ ID NO: 5946023 - DNA, 22 bp, Homo sapiens
tcctgttgctctgtttcttcct

SEQ ID NO: 5946024 - DNA, 17 bp, Homo sapiens
tcctgttgctgtcttca

SEQ ID NO: 5946025 - DNA, 14 bp, Homo sapiens
tcctgttgggagag

SEQ ID NO: 5946026 - DNA, 17 bp, Homo sapiens
tcctgttgtcaagaata

SEQ ID NO: 5946027 - DNA, 22 bp, Homo sapiens
tcctgttgtgtaataacagaac

SEQ ID NO: 5946028 - DNA, 21 bp, Homo sapiens
tcctgttgttgttaatgaaaa

SEQ ID NO: 5946029 - DNA, 16 bp, Homo sapiens
tcctgtttaactccct

SEQ ID NO: 5946030 - DNA, 16 bp, Homo sapiens
tcctgtttcaagttca

SEQ ID NO: 5946031 - DNA, 17 bp, Homo sapiens
tcctgtttccagggtct

SEQ ID NO: 5946032 - DNA, 21 bp, Homo sapiens
tcctgtttcccttcccttcca

SEQ ID NO: 5946033 - DNA, 13 bp, Homo sapiens
tcctgtttctcat

SEQ ID NO: 5946034 - DNA, 13 bp, Homo sapiens
tcctgtttctgaa

SEQ ID NO: 5946035 - DNA, 17 bp, Homo sapiens
tcctgtttctgaaaaga

SEQ ID NO: 5946036 - DNA, 19 bp, Homo sapiens
tcctgtttctgaaaagaaa

SEQ ID NO: 5946037 - DNA, 22 bp, Homo sapiens
tcctgtttctgaaaagaaataa

SEQ ID NO: 5946038 - DNA, 21 bp, Homo sapiens
tcctgtttgaaatatcatgtt

SEQ ID NO: 5946039 - DNA, 20 bp, Homo sapiens
tcctgtttgaacccaggaga

SEQ ID NO: 5946040 - DNA, 15 bp, Homo sapiens
tcctgtttgcaggcc

SEQ ID NO: 5946041 - DNA, 12 bp, Homo sapiens
tcctgtttggaa

SEQ ID NO: 5946042 - DNA, 13 bp, Homo sapiens
tcctgtttggaac

SEQ ID NO: 5946043 - DNA, 23 bp, Homo sapiens
tcctgtttggtggggtggcacct

SEQ ID NO: 5946044 - DNA, 13 bp, Homo sapiens
tcctgtttgtcta

SEQ ID NO: 5946045 - DNA, 15 bp, Homo sapiens
tcctgtttgttttgt

SEQ ID NO: 5946046 - DNA, 16 bp, Homo sapiens
tcctgttttcacacct

SEQ ID NO: 5946047 - DNA, 14 bp, Homo sapiens
tcctgttttctccc

SEQ ID NO: 5946048 - DNA, 15 bp, Homo sapiens
tcctgtttttattat

SEQ ID NO: 5946049 - DNA, 16 bp, Homo sapiens
tcctgtttttctgggt

SEQ ID NO: 5946050 - DNA, 17 bp, Homo sapiens
tcctgtttttctgggtg

SEQ ID NO: 5946051 - DNA, 14 bp, Homo sapiens
tcctgtttttgtta

SEQ ID NO: 5946052 - DNA, 18 bp, Homo sapiens
tccttaaaaatcacactg

SEQ ID NO: 5946053 - DNA, 17 bp, Homo sapiens
tccttaaaaatgtatgt

SEQ ID NO: 5946054 - DNA, 19 bp, Homo sapiens
tccttaaaaatgtatgttg

SEQ ID NO: 5946055 - DNA, 14 bp, Homo sapiens
tccttaaaatgtgg

SEQ ID NO: 5946056 - DNA, 20 bp, Homo sapiens
tccttaaaattaagttgaaa

SEQ ID NO: 5946057 - DNA, 12 bp, Homo sapiens
tccttaaaattt

SEQ ID NO: 5946058 - DNA, 15 bp, Homo sapiens
tccttaaacagggca

SEQ ID NO: 5946059 - DNA, 23 bp, Homo sapiens
tccttaaacagggcatctccagg

SEQ ID NO: 5946060 - DNA, 15 bp, Homo sapiens
tccttaaactgtgtg

SEQ ID NO: 5946061 - DNA, 22 bp, Homo sapiens
tccttaaaggcaccatctaata

SEQ ID NO: 5946062 - DNA, 23 bp, Homo sapiens
tccttaaataaactcaatgagct

SEQ ID NO: 5946063 - DNA, 15 bp, Homo sapiens
tccttaaatatatat

SEQ ID NO: 5946064 - DNA, 15 bp, Homo sapiens
tccttaaatcttaat

SEQ ID NO: 5946065 - DNA, 14 bp, Homo sapiens
tccttaaatgaact

SEQ ID NO: 5946066 - DNA, 21 bp, Homo sapiens
tccttaaatgaactactgcta

SEQ ID NO: 5946067 - DNA, 23 bp, Homo sapiens
tccttaaatgaactactgctatt

SEQ ID NO: 5946068 - DNA, 18 bp, Homo sapiens
tccttaaatgtctaacaa

SEQ ID NO: 5946069 - DNA, 14 bp, Homo sapiens
tccttaacatttct

SEQ ID NO: 5946070 - DNA, 22 bp, Homo sapiens
tccttaacccacctctcctgcc

SEQ ID NO: 5946071 - DNA, 14 bp, Homo sapiens
tccttaactgtcca

SEQ ID NO: 5946072 - DNA, 11 bp, Homo sapiens
tccttaagaat

SEQ ID NO: 5946073 - DNA, 19 bp, Homo sapiens
tccttaagagaagaaatgt

SEQ ID NO: 5946074 - DNA, 14 bp, Homo sapiens
tccttaagccagga

SEQ ID NO: 5946075 - DNA, 20 bp, Homo sapiens
tccttaagctgcagagattt

SEQ ID NO: 5946076 - DNA, 16 bp, Homo sapiens
tccttaaggctctttt

SEQ ID NO: 5946077 - DNA, 17 bp, Homo sapiens
tccttaataaatgaatg

SEQ ID NO: 5946078 - DNA, 20 bp, Homo sapiens
tccttaataaatttaagttt

SEQ ID NO: 5946079 - DNA, 19 bp, Homo sapiens
tccttaattcactcccaca

SEQ ID NO: 5946080 - DNA, 20 bp, Homo sapiens
tccttaatttacctgttgtt

SEQ ID NO: 5946081 - DNA, 15 bp, Homo sapiens
tccttacaaatgatt

SEQ ID NO: 5946082 - DNA, 20 bp, Homo sapiens
tccttacaaatgattgcttt

SEQ ID NO: 5946083 - DNA, 22 bp, Homo sapiens
tccttacaagttagaaaacata

SEQ ID NO: 5946084 - DNA, 20 bp, Homo sapiens
tccttacctatttcctcaga

SEQ ID NO: 5946085 - DNA, 16 bp, Homo sapiens
tccttacctctggaac

SEQ ID NO: 5946086 - DNA, 15 bp, Homo sapiens
tccttacctggaaaa

SEQ ID NO: 5946087 - DNA, 20 bp, Homo sapiens
tccttacctttttatttgca

SEQ ID NO: 5946088 - DNA, 20 bp, Homo sapiens
tccttacgctttgtcacaca

SEQ ID NO: 5946089 - DNA, 22 bp, Homo sapiens
tccttactagattcataatgca

SEQ ID NO: 5946090 - DNA, 19 bp, Homo sapiens
tccttactcagagctgcgg

SEQ ID NO: 5946091 - DNA, 21 bp, Homo sapiens
tccttactcagagctgcgggc

SEQ ID NO: 5946092 - DNA, 19 bp, Homo sapiens
tccttactcccccaccact

SEQ ID NO: 5946093 - DNA, 23 bp, Homo sapiens
tccttactcccccaccactcagg

SEQ ID NO: 5946094 - DNA, 15 bp, Homo sapiens
tccttactctgagga

SEQ ID NO: 5946095 - DNA, 15 bp, Homo sapiens
tccttactgtctctc

SEQ ID NO: 5946096 - DNA, 17 bp, Homo sapiens
tccttactgtgtttcag

SEQ ID NO: 5946097 - DNA, 20 bp, Homo sapiens
tccttactgtgtttcagcat

SEQ ID NO: 5946098 - DNA, 22 bp, Homo sapiens
tccttacttccagcaaaatcca

SEQ ID NO: 5946099 - DNA, 19 bp, Homo sapiens
tccttagaaaaaaaattat

SEQ ID NO: 5946100 - DNA, 16 bp, Homo sapiens
tccttagaaaagccat

SEQ ID NO: 5946101 - DNA, 20 bp, Homo sapiens
tccttagaacattttaattc

SEQ ID NO: 5946102 - DNA, 12 bp, Homo sapiens
tccttagaatga

SEQ ID NO: 5946103 - DNA, 19 bp, Homo sapiens
tccttagaatggagggcaa

SEQ ID NO: 5946104 - DNA, 13 bp, Homo sapiens
tccttagacactt

SEQ ID NO: 5946105 - DNA, 18 bp, Homo sapiens
tccttagagaagtttgtg

SEQ ID NO: 5946106 - DNA, 15 bp, Homo sapiens
tccttagcaacagcc

SEQ ID NO: 5946107 - DNA, 14 bp, Homo sapiens
tccttagcagctca

SEQ ID NO: 5946108 - DNA, 16 bp, Homo sapiens
tccttagcagctcagg

SEQ ID NO: 5946109 - DNA, 18 bp, Homo sapiens
tccttagcagctcaggcg

SEQ ID NO: 5946110 - DNA, 13 bp, Homo sapiens
tccttagcctgga

SEQ ID NO: 5946111 - DNA, 15 bp, Homo sapiens
tccttagcctggacc

SEQ ID NO: 5946112 - DNA, 16 bp, Homo sapiens
tccttagctaaatgca

SEQ ID NO: 5946113 - DNA, 13 bp, Homo sapiens
tccttagctgcca

SEQ ID NO: 5946114 - DNA, 14 bp, Homo sapiens
tccttagctgccaa

SEQ ID NO: 5946115 - DNA, 15 bp, Homo sapiens
tccttagctgtaaaa

SEQ ID NO: 5946116 - DNA, 20 bp, Homo sapiens
tccttagcttagacctcagc

SEQ ID NO: 5946117 - DNA, 23 bp, Homo sapiens
tccttagcttagacctcagcctg

SEQ ID NO: 5946118 - DNA, 19 bp, Homo sapiens
tccttagctttccctgtgc

SEQ ID NO: 5946119 - DNA, 22 bp, Homo sapiens
tccttagctttccctgtgccac

SEQ ID NO: 5946120 - DNA, 22 bp, Homo sapiens
tccttaggaaaatgcttctgtt

SEQ ID NO: 5946121 - DNA, 20 bp, Homo sapiens
tccttaggagacgctgcact

SEQ ID NO: 5946122 - DNA, 22 bp, Homo sapiens
tccttaggaggccccctcctca

SEQ ID NO: 5946123 - DNA, 17 bp, Homo sapiens
tccttaggagtggggtt

SEQ ID NO: 5946124 - DNA, 17 bp, Homo sapiens
tccttaggcctctgaga

SEQ ID NO: 5946125 - DNA, 14 bp, Homo sapiens
tccttaggcttaca

SEQ ID NO: 5946126 - DNA, 23 bp, Homo sapiens
tccttaggcttacaatgtgcact

SEQ ID NO: 5946127 - DNA, 24 bp, Homo sapiens
tccttagggttttctctctatttc

SEQ ID NO: 5946128 - DNA, 22 bp, Homo sapiens
tccttaggtttttttccttctg

SEQ ID NO: 5946129 - DNA, 15 bp, Homo sapiens
tccttagtaaattcc

SEQ ID NO: 5946130 - DNA, 22 bp, Homo sapiens
tccttagtcttctcatagcatt

SEQ ID NO: 5946131 - DNA, 15 bp, Homo sapiens
tccttagtgccagga

SEQ ID NO: 5946132 - DNA, 16 bp, Homo sapiens
tccttagtgccaggag

SEQ ID NO: 5946133 - DNA, 12 bp, Homo sapiens
tccttagtgtat

SEQ ID NO: 5946134 - DNA, 16 bp, Homo sapiens
tccttataagaattaa

SEQ ID NO: 5946135 - DNA, 21 bp, Homo sapiens
tccttataggcctgtcccttg

SEQ ID NO: 5946136 - DNA, 17 bp, Homo sapiens
tccttatcaaaggacac

SEQ ID NO: 5946137 - DNA, 21 bp, Homo sapiens
tccttatcactgacacaaaaa

SEQ ID NO: 5946138 - DNA, 15 bp, Homo sapiens
tccttatcagaggcc

SEQ ID NO: 5946139 - DNA, 13 bp, Homo sapiens
tccttatccctct

SEQ ID NO: 5946140 - DNA, 15 bp, Homo sapiens
tccttatccctctct

SEQ ID NO: 5946141 - DNA, 18 bp, Homo sapiens
tccttatccctctcttcc

SEQ ID NO: 5946142 - DNA, 21 bp, Homo sapiens
tccttatccctctcttcccct

SEQ ID NO: 5946143 - DNA, 23 bp, Homo sapiens
tccttatcctacagtacaatcag

SEQ ID NO: 5946144 - DNA, 16 bp, Homo sapiens
tccttatctataaaag

SEQ ID NO: 5946145 - DNA, 20 bp, Homo sapiens
tccttatgcatgaaatgaat

SEQ ID NO: 5946146 - DNA, 23 bp, Homo sapiens
tccttatgccacccccgctggag

SEQ ID NO: 5946147 - DNA, 22 bp, Homo sapiens
tccttatgggatcatttttcca

SEQ ID NO: 5946148 - DNA, 15 bp, Homo sapiens
tccttatgtcctgtc

SEQ ID NO: 5946149 - DNA, 14 bp, Homo sapiens
tccttattcagcct

SEQ ID NO: 5946150 - DNA, 16 bp, Homo sapiens
tccttattcagcctta

SEQ ID NO: 5946151 - DNA, 13 bp, Homo sapiens
tccttattgttca

SEQ ID NO: 5946152 - DNA, 22 bp, Homo sapiens
tccttatttctctctcctggtg

SEQ ID NO: 5946153 - DNA, 20 bp, Homo sapiens
tccttatttgcttcattgta

SEQ ID NO: 5946154 - DNA, 15 bp, Homo sapiens
tccttattttcataa

SEQ ID NO: 5946155 - DNA, 14 bp, Homo sapiens
tccttcaaaacatt

SEQ ID NO: 5946156 - DNA, 19 bp, Homo sapiens
tccttcaaaatccttccaa

SEQ ID NO: 5946157 - DNA, 12 bp, Homo sapiens
tccttcaaataa

SEQ ID NO: 5946158 - DNA, 20 bp, Homo sapiens
tccttcaaataaagaaattt

SEQ ID NO: 5946159 - DNA, 19 bp, Homo sapiens
tccttcaacaaggcttgct

SEQ ID NO: 5946160 - DNA, 21 bp, Homo sapiens
tccttcaacaaggcttgctgc

SEQ ID NO: 5946161 - DNA, 22 bp, Homo sapiens
tccttcaacctgcatagccggt

SEQ ID NO: 5946162 - DNA, 23 bp, Homo sapiens
tccttcaacctgcatagccggtg

SEQ ID NO: 5946163 - DNA, 17 bp, Homo sapiens
tccttcaactctgtgag

SEQ ID NO: 5946164 - DNA, 19 bp, Homo sapiens
tccttcaagaactctgggc

SEQ ID NO: 5946165 - DNA, 20 bp, Homo sapiens
tccttcaagaactctgggct

SEQ ID NO: 5946166 - DNA, 21 bp, Homo sapiens
tccttcaagaactctgggctg

SEQ ID NO: 5946167 - DNA, 23 bp, Homo sapiens
tccttcaagaactctgggctgct

SEQ ID NO: 5946168 - DNA, 15 bp, Homo sapiens
tccttcaagccagca

SEQ ID NO: 5946169 - DNA, 18 bp, Homo sapiens
tccttcaagttagctcag

SEQ ID NO: 5946170 - DNA, 18 bp, Homo sapiens
tccttcacaatttcaatg

SEQ ID NO: 5946171 - DNA, 20 bp, Homo sapiens
tccttcacaggcagtgcatg

SEQ ID NO: 5946172 - DNA, 14 bp, Homo sapiens
tccttcacatcctg

SEQ ID NO: 5946173 - DNA, 14 bp, Homo sapiens
tccttcacatctcc

SEQ ID NO: 5946174 - DNA, 22 bp, Homo sapiens
tccttcaccaaagatctgctcc

SEQ ID NO: 5946175 - DNA, 19 bp, Homo sapiens
tccttcaccagagcccatg

SEQ ID NO: 5946176 - DNA, 19 bp, Homo sapiens
tccttcacctcactgaaaa

SEQ ID NO: 5946177 - DNA, 13 bp, Homo sapiens
tccttcacctttc

SEQ ID NO: 5946178 - DNA, 23 bp, Homo sapiens
tccttcacctttcccactttctt

SEQ ID NO: 5946179 - DNA, 18 bp, Homo sapiens
tccttcacctttgtcccc

SEQ ID NO: 5946180 - DNA, 21 bp, Homo sapiens
tccttcacctttgtccccacc

SEQ ID NO: 5946181 - DNA, 23 bp, Homo sapiens
tccttcacgaggaatctgggcct

SEQ ID NO: 5946182 - DNA, 18 bp, Homo sapiens
tccttcactcatccagcc

SEQ ID NO: 5946183 - DNA, 15 bp, Homo sapiens
tccttcactctgaca

SEQ ID NO: 5946184 - DNA, 19 bp, Homo sapiens
tccttcactctgacagtat

SEQ ID NO: 5946185 - DNA, 13 bp, Homo sapiens
tccttcactgaac

SEQ ID NO: 5946186 - DNA, 19 bp, Homo sapiens
tccttcactgaacatgcct

SEQ ID NO: 5946187 - DNA, 20 bp, Homo sapiens
tccttcactgccccacttct

SEQ ID NO: 5946188 - DNA, 23 bp, Homo sapiens
tccttcactggcgccttctcgga

SEQ ID NO: 5946189 - DNA, 12 bp, Homo sapiens
tccttcactgtt

SEQ ID NO: 5946190 - DNA, 14 bp, Homo sapiens
tccttcactgttcc

SEQ ID NO: 5946191 - DNA, 13 bp, Homo sapiens
tccttcagacacc

SEQ ID NO: 5946192 - DNA, 21 bp, Homo sapiens
tccttcagagagcagtgcttt

SEQ ID NO: 5946193 - DNA, 23 bp, Homo sapiens
tccttctctgaacacaggcagct

SEQ ID NO: 5946194 - DNA, 13 bp, Homo sapiens
tccttctctgcct

SEQ ID NO: 5946195 - DNA, 14 bp, Homo sapiens
tccttctctgggtc

SEQ ID NO: 5946196 - DNA, 11 bp, Homo sapiens
tccttctcttt

SEQ ID NO: 5946197 - DNA, 14 bp, Homo sapiens
tccttctctttaaa

SEQ ID NO: 5946198 - DNA, 15 bp, Homo sapiens
tccttctgaagtgtt

SEQ ID NO: 5946199 - DNA, 24 bp, Homo sapiens
tccttctgagcccggtaagagcaa

SEQ ID NO: 5946200 - DNA, 15 bp, Homo sapiens
tccttctgagctcca

SEQ ID NO: 5946201 - DNA, 17 bp, Homo sapiens
tccttctgagctccacc

SEQ ID NO: 5946202 - DNA, 16 bp, Homo sapiens
tccttctgagctcctg

SEQ ID NO: 5946203 - DNA, 18 bp, Homo sapiens
tccttctgagctcctgtc

SEQ ID NO: 5946204 - DNA, 20 bp, Homo sapiens
tccttctgcaaagtggcagg

SEQ ID NO: 5946205 - DNA, 19 bp, Homo sapiens
tccttctgcagtcagactg

SEQ ID NO: 5946206 - DNA, 15 bp, Homo sapiens
tccttctgccttttt

SEQ ID NO: 5946207 - DNA, 13 bp, Homo sapiens
tccttctgctccc

SEQ ID NO: 5946208 - DNA, 21 bp, Homo sapiens
tccttctgcttctccctggct

SEQ ID NO: 5946209 - DNA, 21 bp, Homo sapiens
tccttctggcagattcaaatc

SEQ ID NO: 5946210 - DNA, 13 bp, Homo sapiens
tccttctggctcc

SEQ ID NO: 5946211 - DNA, 22 bp, Homo sapiens
tccttctggctgtagataaata

SEQ ID NO: 5946212 - DNA, 13 bp, Homo sapiens
tccttctgggcat

SEQ ID NO: 5946213 - DNA, 22 bp, Homo sapiens
tccttctgtagcctgaagagtt

SEQ ID NO: 5946214 - DNA, 12 bp, Homo sapiens
tccttctgtcct

SEQ ID NO: 5946215 - DNA, 15 bp, Homo sapiens
tccttctgtgaagaa

SEQ ID NO: 5946216 - DNA, 21 bp, Homo sapiens
tccttctgtgaagaagccctg

SEQ ID NO: 5946217 - DNA, 12 bp, Homo sapiens
tccttctgttaa

SEQ ID NO: 5946218 - DNA, 16 bp, Homo sapiens
tccttcttactctcct

SEQ ID NO: 5946219 - DNA, 19 bp, Homo sapiens
tccttcttcagcaggaagg

SEQ ID NO: 5946220 - DNA, 20 bp, Homo sapiens
tccttcttcagcaggaaggg

SEQ ID NO: 5946221 - DNA, 21 bp, Homo sapiens
tccttcttcagcaggaagggt

SEQ ID NO: 5946222 - DNA, 17 bp, Homo sapiens
tccttcttccacttctc

SEQ ID NO: 5946223 - DNA, 12 bp, Homo sapiens
tccttcttccca

SEQ ID NO: 5946224 - DNA, 17 bp, Homo sapiens
tccttcttccccaaggc

SEQ ID NO: 5946225 - DNA, 22 bp, Homo sapiens
tccttcttccccaatatgcctg

SEQ ID NO: 5946226 - DNA, 13 bp, Homo sapiens
tccttcttccctg

SEQ ID NO: 5946227 - DNA, 17 bp, Homo sapiens
tccttcttgccctgagc

SEQ ID NO: 5946228 - DNA, 18 bp, Homo sapiens
tccttcttgccctgagct

SEQ ID NO: 5946229 - DNA, 17 bp, Homo sapiens
tccttcttgccttcaga

SEQ ID NO: 5946230 - DNA, 19 bp, Homo sapiens
tccttcttgctcagtccct

SEQ ID NO: 5946231 - DNA, 21 bp, Homo sapiens
tccttctttattgccccttct

SEQ ID NO: 5946232 - DNA, 22 bp, Homo sapiens
tccttctttctagttcagctgc

SEQ ID NO: 5946233 - DNA, 13 bp, Homo sapiens
tccttctttgata

SEQ ID NO: 5946234 - DNA, 16 bp, Homo sapiens
tccttctttgataatg

SEQ ID NO: 5946235 - DNA, 20 bp, Homo sapiens
tccttctttgataatgttaa

SEQ ID NO: 5946236 - DNA, 21 bp, Homo sapiens
tccttctttgggatagagaat

SEQ ID NO: 5946237 - DNA, 15 bp, Homo sapiens
tccttgaaaaacaaa

SEQ ID NO: 5946238 - DNA, 23 bp, Homo sapiens
tccttgaaaacactgttctctgc

SEQ ID NO: 5946239 - DNA, 22 bp, Homo sapiens
tccttgaacaagatgtgggcct

SEQ ID NO: 5946240 - DNA, 18 bp, Homo sapiens
tccttgaactgaggccct

SEQ ID NO: 5946241 - DNA, 23 bp, Homo sapiens
tccttgaagaactgcaggccctg

SEQ ID NO: 5946242 - DNA, 13 bp, Homo sapiens
tccttgaagaagg

SEQ ID NO: 5946243 - DNA, 18 bp, Homo sapiens
tccttgaagacatatcat

SEQ ID NO: 5946244 - DNA, 22 bp, Homo sapiens
tccttgaagacatatcatgtgt

SEQ ID NO: 5946245 - DNA, 12 bp, Homo sapiens
tccttgaagccg

SEQ ID NO: 5946246 - DNA, 14 bp, Homo sapiens
tccttgaagcttgt

SEQ ID NO: 5946247 - DNA, 14 bp, Homo sapiens
tccttgaccttcct

SEQ ID NO: 5946248 - DNA, 17 bp, Homo sapiens
tccttgaccttcctctg

SEQ ID NO: 5946249 - DNA, 16 bp, Homo sapiens
tccttgagaatctttg

SEQ ID NO: 5946250 - DNA, 21 bp, Homo sapiens
tccttgagacacggagcccag

SEQ ID NO: 5946251 - DNA, 13 bp, Homo sapiens
tccttgagactgg

SEQ ID NO: 5946252 - DNA, 23 bp, Homo sapiens
tccttgagatgatcgtagacaca

SEQ ID NO: 5946253 - DNA, 14 bp, Homo sapiens
tccttgaggacaga

SEQ ID NO: 5946254 - DNA, 13 bp, Homo sapiens
tccttgataacag

SEQ ID NO: 5946255 - DNA, 15 bp, Homo sapiens
tccttgataacagct

SEQ ID NO: 5946256 - DNA, 22 bp, Homo sapiens
tccttgataatgttgtggtttg

SEQ ID NO: 5946257 - DNA, 13 bp, Homo sapiens
tccttgatcattt

SEQ ID NO: 5946258 - DNA, 16 bp, Homo sapiens
tccttgatctgtatat

SEQ ID NO: 5946259 - DNA, 13 bp, Homo sapiens
tccttgatgaatc

SEQ ID NO: 5946260 - DNA, 15 bp, Homo sapiens
tccttgatgccagag

SEQ ID NO: 5946261 - DNA, 16 bp, Homo sapiens
tccttgatgccagagg

SEQ ID NO: 5946262 - DNA, 17 bp, Homo sapiens
tccttgatgccagaggg

SEQ ID NO: 5946263 - DNA, 19 bp, Homo sapiens
tccttgattacataatgtt

SEQ ID NO: 5946264 - DNA, 17 bp, Homo sapiens
tccttgattacttccac

SEQ ID NO: 5946265 - DNA, 22 bp, Homo sapiens
tccttgattttagccttctctg

SEQ ID NO: 5946266 - DNA, 21 bp, Homo sapiens
tccttgcaaccaggcagctga

SEQ ID NO: 5946267 - DNA, 10 bp, Homo sapiens
tccttgcaag

SEQ ID NO: 5946268 - DNA, 20 bp, Homo sapiens
tccttgcacccctcactctg

SEQ ID NO: 5946269 - DNA, 18 bp, Homo sapiens
tccttgcacctgagcctg

SEQ ID NO: 5946270 - DNA, 23 bp, Homo sapiens
tccttgcacgcgccctttctacc

SEQ ID NO: 5946271 - DNA, 15 bp, Homo sapiens
tccttgcagcagggc

SEQ ID NO: 5946272 - DNA, 16 bp, Homo sapiens
tccttgcagcagggct

SEQ ID NO: 5946273 - DNA, 19 bp, Homo sapiens
tccttgcagcagggctggg

SEQ ID NO: 5946274 - DNA, 22 bp, Homo sapiens
tccttgcagcagggctgggcct

SEQ ID NO: 5946275 - DNA, 17 bp, Homo sapiens
tccttgcaggggccgga

SEQ ID NO: 5946276 - DNA, 21 bp, Homo sapiens
tccttgcagtttaagatgaca

SEQ ID NO: 5946277 - DNA, 23 bp, Homo sapiens
tccttgcatcaaggggtcactta

SEQ ID NO: 5946278 - DNA, 17 bp, Homo sapiens
tccttgcatcaattttt

SEQ ID NO: 5946279 - DNA, 12 bp, Homo sapiens
tccttgccaccc

SEQ ID NO: 5946280 - DNA, 15 bp, Homo sapiens
tccttgccacccccc

SEQ ID NO: 5946281 - DNA, 14 bp, Homo sapiens
tccttgcccaggtg

SEQ ID NO: 5946282 - DNA, 18 bp, Homo sapiens
tccttgccccacagttgt

SEQ ID NO: 5946283 - DNA, 20 bp, Homo sapiens
tccttgccccacagttgtgt

SEQ ID NO: 5946284 - DNA, 24 bp, Homo sapiens
tccttgccccacagttgtgttcat

SEQ ID NO: 5946285 - DNA, 16 bp, Homo sapiens
tccttgccccactcct

SEQ ID NO: 5946286 - DNA, 12 bp, Homo sapiens
tccttgccccca

SEQ ID NO: 5946287 - DNA, 18 bp, Homo sapiens
tccttgcccccagtgcct

SEQ ID NO: 5946288 - DNA, 16 bp, Homo sapiens
tccttgccgctgggag

SEQ ID NO: 5946289 - DNA, 20 bp, Homo sapiens
tccttgccgctgggagagcc

SEQ ID NO: 5946290 - DNA, 16 bp, Homo sapiens
tccttgcctcctgtgt

SEQ ID NO: 5946291 - DNA, 18 bp, Homo sapiens
tccttgcctcctgtgtaa

SEQ ID NO: 5946292 - DNA, 16 bp, Homo sapiens
tccttgcctctgctct

SEQ ID NO: 5946293 - DNA, 19 bp, Homo sapiens
tccttgcctgctttctcca

SEQ ID NO: 5946294 - DNA, 22 bp, Homo sapiens
tccttgcctgtcaggaccattt

SEQ ID NO: 5946295 - DNA, 15 bp, Homo sapiens
tccttgcctgtctaa

SEQ ID NO: 5946296 - DNA, 14 bp, Homo sapiens
tccttgccttcttt

SEQ ID NO: 5946297 - DNA, 13 bp, Homo sapiens
tccttgccttgct

SEQ ID NO: 5946298 - DNA, 14 bp, Homo sapiens
tccttgccttgctt

SEQ ID NO: 5946299 - DNA, 20 bp, Homo sapiens
tccttgccttgcttctccca

SEQ ID NO: 5946300 - DNA, 13 bp, Homo sapiens
tccttgcgcctca

SEQ ID NO: 5946301 - DNA, 23 bp, Homo sapiens
tccttgcgcctcagccctcagtt

SEQ ID NO: 5946302 - DNA, 21 bp, Homo sapiens
tccttgcgtcccatgaggtct

SEQ ID NO: 5946303 - DNA, 14 bp, Homo sapiens
tccttgctacccag

SEQ ID NO: 5946304 - DNA, 16 bp, Homo sapiens
tccttgctagccctgg

SEQ ID NO: 5946305 - DNA, 15 bp, Homo sapiens
tccttgctatttcaa

SEQ ID NO: 5946306 - DNA, 15 bp, Homo sapiens
tccttgctcctggaa

SEQ ID NO: 5946307 - DNA, 16 bp, Homo sapiens
tccttgctcctggaac

SEQ ID NO: 5946308 - DNA, 23 bp, Homo sapiens
tccttgctcctggaacctggcag

SEQ ID NO: 5946309 - DNA, 17 bp, Homo sapiens
tccttgctcctggcctt

SEQ ID NO: 5946310 - DNA, 21 bp, Homo sapiens
tccttgctcctggccttgctg

SEQ ID NO: 5946311 - DNA, 19 bp, Homo sapiens
tccttgctctccctcttct

SEQ ID NO: 5946312 - DNA, 20 bp, Homo sapiens
tccttgctctccctcttctc

SEQ ID NO: 5946313 - DNA, 14 bp, Homo sapiens
tccttgctgacccc

SEQ ID NO: 5946314 - DNA, 17 bp, Homo sapiens
tccttgctgaccccagg

SEQ ID NO: 5946315 - DNA, 22 bp, Homo sapiens
tccttgctgtgggatgtgccag

SEQ ID NO: 5946316 - DNA, 14 bp, Homo sapiens
tccttgcttcctga

SEQ ID NO: 5946317 - DNA, 18 bp, Homo sapiens
tccttgctttcatcacta

SEQ ID NO: 5946318 - DNA, 14 bp, Homo sapiens
tccttgctttctct

SEQ ID NO: 5946319 - DNA, 15 bp, Homo sapiens
tccttgctttgctgt

SEQ ID NO: 5946320 - DNA, 14 bp, Homo sapiens
tccttgcttttatg

SEQ ID NO: 5946321 - DNA, 22 bp, Homo sapiens
tccttggaaaccgtgtgtccag

SEQ ID NO: 5946322 - DNA, 20 bp, Homo sapiens
tccttggaaatcaaatgtaa

SEQ ID NO: 5946323 - DNA, 16 bp, Homo sapiens
tccttggaagtttcat

SEQ ID NO: 5946324 - DNA, 16 bp, Homo sapiens
tccttggactcatttt

SEQ ID NO: 5946325 - DNA, 12 bp, Homo sapiens
tccttggactcc

SEQ ID NO: 5946326 - DNA, 22 bp, Homo sapiens
tccttggactgttttgaaaagt

SEQ ID NO: 5946327 - DNA, 13 bp, Homo sapiens
tccttggaggaca

SEQ ID NO: 5946328 - DNA, 16 bp, Homo sapiens
tccttggaggacagtg

SEQ ID NO: 5946329 - DNA, 14 bp, Homo sapiens
tccttggagtgctg

SEQ ID NO: 5946330 - DNA, 14 bp, Homo sapiens
tccttggatttgca

SEQ ID NO: 5946331 - DNA, 15 bp, Homo sapiens
tccttggatttgcat

SEQ ID NO: 5946332 - DNA, 16 bp, Homo sapiens
tccttggcaactttct

SEQ ID NO: 5946333 - DNA, 14 bp, Homo sapiens
tccttggcaccaaa

SEQ ID NO: 5946334 - DNA, 13 bp, Homo sapiens
tccttggcacccc

SEQ ID NO: 5946335 - DNA, 17 bp, Homo sapiens
tccttggcacccccatg

SEQ ID NO: 5946336 - DNA, 20 bp, Homo sapiens
tccttggcacccccatgctg

SEQ ID NO: 5946337 - DNA, 17 bp, Homo sapiens
tccttggccatgcagaa

SEQ ID NO: 5946338 - DNA, 12 bp, Homo sapiens
tccttggcccag

SEQ ID NO: 5946339 - DNA, 13 bp, Homo sapiens
tccttggcccagc

SEQ ID NO: 5946340 - DNA, 14 bp, Homo sapiens
tccttggccccctt

SEQ ID NO: 5946341 - DNA, 20 bp, Homo sapiens
tccttggccccctttcccgg

SEQ ID NO: 5946342 - DNA, 16 bp, Homo sapiens
tccttggcctttcctg

SEQ ID NO: 5946343 - DNA, 17 bp, Homo sapiens
tccttggcctttcctgg

SEQ ID NO: 5946344 - DNA, 18 bp, Homo sapiens
tccttggcctttcctgga

SEQ ID NO: 5946345 - DNA, 19 bp, Homo sapiens
tccttggcctttcctggaa

SEQ ID NO: 5946346 - DNA, 21 bp, Homo sapiens
tccttggcctttcctggaagc

SEQ ID NO: 5946347 - DNA, 21 bp, Homo sapiens
tccttggcggcaaaagcccat

SEQ ID NO: 5946348 - DNA, 21 bp, Homo sapiens
tccttggctgtatccatgtaa

SEQ ID NO: 5946349 - DNA, 18 bp, Homo sapiens
tccttggctttatgcaaa

SEQ ID NO: 5946350 - DNA, 21 bp, Homo sapiens
tccttggctttatgcaaatac

SEQ ID NO: 5946351 - DNA, 22 bp, Homo sapiens
tccttggctttatgcaaataca

SEQ ID NO: 5946352 - DNA, 18 bp, Homo sapiens
tccttggctttcagagcc

SEQ ID NO: 5946353 - DNA, 16 bp, Homo sapiens
tccttgggaggaagca

SEQ ID NO: 5946354 - DNA, 20 bp, Homo sapiens
tccttgggaggaagcagaat

SEQ ID NO: 5946355 - DNA, 22 bp, Homo sapiens
tccttgggaggccccactgggg

SEQ ID NO: 5946356 - DNA, 13 bp, Homo sapiens
tccttgggcactt

SEQ ID NO: 5946357 - DNA, 16 bp, Homo sapiens
tccttgggcagggtct

SEQ ID NO: 5946358 - DNA, 22 bp, Homo sapiens
tccttgggcagggtctctgctc

SEQ ID NO: 5946359 - DNA, 13 bp, Homo sapiens
tccttgggccctt

SEQ ID NO: 5946360 - DNA, 16 bp, Homo sapiens
tccttgggccctttga

SEQ ID NO: 5946361 - DNA, 17 bp, Homo sapiens
tccttgggcctggccag

SEQ ID NO: 5946362 - DNA, 19 bp, Homo sapiens
tccttgggcgtctccccca

SEQ ID NO: 5946363 - DNA, 21 bp, Homo sapiens
tccttgggcgtctcccccaga

SEQ ID NO: 5946364 - DNA, 22 bp, Homo sapiens
tccttgggcgtctcccccagag

SEQ ID NO: 5946365 - DNA, 20 bp, Homo sapiens
tccttgggcgtctctaatgt

SEQ ID NO: 5946366 - DNA, 14 bp, Homo sapiens
tccttgggctcctg

SEQ ID NO: 5946367 - DNA, 15 bp, Homo sapiens
tccttgggctcctgg

SEQ ID NO: 5946368 - DNA, 16 bp, Homo sapiens
tccttgggctcctggc

SEQ ID NO: 5946369 - DNA, 22 bp, Homo sapiens
tccttgggctcctggctgccag

SEQ ID NO: 5946370 - DNA, 23 bp, Homo sapiens
tccttgggctcctggctgccagg

SEQ ID NO: 5946371 - DNA, 20 bp, Homo sapiens
tcctttgaagaggaaaatga

SEQ ID NO: 5946372 - DNA, 16 bp, Homo sapiens
tcctttgacaaaagta

SEQ ID NO: 5946373 - DNA, 17 bp, Homo sapiens
tcctttgacaaaagtaa

SEQ ID NO: 5946374 - DNA, 17 bp, Homo sapiens
tcctttgactgtgctgg

SEQ ID NO: 5946375 - DNA, 22 bp, Homo sapiens
tcctttgacttattgtccccac

SEQ ID NO: 5946376 - DNA, 14 bp, Homo sapiens
tcctttgagaaaga

SEQ ID NO: 5946377 - DNA, 15 bp, Homo sapiens
tcctttgagtgtctt

SEQ ID NO: 5946378 - DNA, 21 bp, Homo sapiens
tcctttgagtgtcttctaact

SEQ ID NO: 5946379 - DNA, 22 bp, Homo sapiens
tcctttgatcagtataattttt

SEQ ID NO: 5946380 - DNA, 20 bp, Homo sapiens
tcctttgcaccatgtgaagt

SEQ ID NO: 5946381 - DNA, 15 bp, Homo sapiens
tcctttgcaccctgt

SEQ ID NO: 5946382 - DNA, 15 bp, Homo sapiens
tcctttgcactgagg

SEQ ID NO: 5946383 - DNA, 20 bp, Homo sapiens
tcctttgcactgagggccac

SEQ ID NO: 5946384 - DNA, 16 bp, Homo sapiens
tcctttgcagggcagc

SEQ ID NO: 5946385 - DNA, 17 bp, Homo sapiens
tcctttgcagggcagcc

SEQ ID NO: 5946386 - DNA, 13 bp, Homo sapiens
tcctttgcattca

SEQ ID NO: 5946387 - DNA, 13 bp, Homo sapiens
tcctttgcatttc

SEQ ID NO: 5946388 - DNA, 15 bp, Homo sapiens
tcctttgcatttctc

SEQ ID NO: 5946389 - DNA, 21 bp, Homo sapiens
tcctttgctagtgtctttgtc

SEQ ID NO: 5946390 - DNA, 23 bp, Homo sapiens
tcctttgctagtgtctttgtcat

SEQ ID NO: 5946391 - DNA, 13 bp, Homo sapiens
tcctttgctctga

SEQ ID NO: 5946392 - DNA, 21 bp, Homo sapiens
tcctttggactgttcaagcaa

SEQ ID NO: 5946393 - DNA, 20 bp, Homo sapiens
tcctttggcaatatcatatt

SEQ ID NO: 5946394 - DNA, 13 bp, Homo sapiens
tcctttggcaggc

SEQ ID NO: 5946395 - DNA, 19 bp, Homo sapiens
tcctttggcatgtttaatt

SEQ ID NO: 5946396 - DNA, 20 bp, Homo sapiens
tcctttggccactgtatttg

SEQ ID NO: 5946397 - DNA, 23 bp, Homo sapiens
tcctttggccactgtatttgtta

SEQ ID NO: 5946398 - DNA, 16 bp, Homo sapiens
tcctttggggcttctg

SEQ ID NO: 5946399 - DNA, 23 bp, Homo sapiens
tcctttgggtgactcgccataaa

SEQ ID NO: 5946400 - DNA, 18 bp, Homo sapiens
tcctttggtcctgtcccc

SEQ ID NO: 5946401 - DNA, 15 bp, Homo sapiens
tcctttggtgcctca

SEQ ID NO: 5946402 - DNA, 12 bp, Homo sapiens
tcctttgtaaaa

SEQ ID NO: 5946403 - DNA, 18 bp, Homo sapiens
tcctttgtaatcactccc

SEQ ID NO: 5946404 - DNA, 16 bp, Homo sapiens
tcctttgtagctactt

SEQ ID NO: 5946405 - DNA, 21 bp, Homo sapiens
tcctttgtattctgtcttcat

SEQ ID NO: 5946406 - DNA, 16 bp, Homo sapiens
tcctttgtcaaatggt

SEQ ID NO: 5946407 - DNA, 20 bp, Homo sapiens
tcctttgtcttacattggct

SEQ ID NO: 5946408 - DNA, 15 bp, Homo sapiens
tcctttgtctttctt

SEQ ID NO: 5946409 - DNA, 15 bp, Homo sapiens
tcctttgtgaatatt

SEQ ID NO: 5946410 - DNA, 22 bp, Homo sapiens
tcctttgtgtgtgtgtcagctg

SEQ ID NO: 5946411 - DNA, 15 bp, Homo sapiens
tcctttgtgtttcta

SEQ ID NO: 5946412 - DNA, 21 bp, Homo sapiens
tcctttgttattatcctgcat

SEQ ID NO: 5946413 - DNA, 12 bp, Homo sapiens
tcctttgttccc

SEQ ID NO: 5946414 - DNA, 15 bp, Homo sapiens
tcctttgttcccggc

SEQ ID NO: 5946415 - DNA, 18 bp, Homo sapiens
tcctttgttccctaagtc

SEQ ID NO: 5946416 - DNA, 16 bp, Homo sapiens
tcctttgttctgagca

SEQ ID NO: 5946417 - DNA, 24 bp, Homo sapiens
tcctttgttcttacctgtatgtct

SEQ ID NO: 5946418 - DNA, 18 bp, Homo sapiens
tcctttgttggcttcttt

SEQ ID NO: 5946419 - DNA, 23 bp, Homo sapiens
tccttttaaagaaaaaaattgaa

SEQ ID NO: 5946420 - DNA, 17 bp, Homo sapiens
tccttttaaagaaacaa

SEQ ID NO: 5946421 - DNA, 20 bp, Homo sapiens
tccttttaaatcttgatacc

SEQ ID NO: 5946422 - DNA, 12 bp, Homo sapiens
tccttttaactg

SEQ ID NO: 5946423 - DNA, 16 bp, Homo sapiens
tccttttaacttggat

SEQ ID NO: 5946424 - DNA, 14 bp, Homo sapiens
tccttttataagat

SEQ ID NO: 5946425 - DNA, 17 bp, Homo sapiens
tccttttatctccttgt

SEQ ID NO: 5946426 - DNA, 23 bp, Homo sapiens
tccttttatctccttgtggccta

SEQ ID NO: 5946427 - DNA, 21 bp, Homo sapiens
tccttttatctggtgcctcct

SEQ ID NO: 5946428 - DNA, 12 bp, Homo sapiens
tccttttatgtt

SEQ ID NO: 5946429 - DNA, 14 bp, Homo sapiens
tccttttatgttat

SEQ ID NO: 5946430 - DNA, 16 bp, Homo sapiens
tccttttattcacata

SEQ ID NO: 5946431 - DNA, 14 bp, Homo sapiens
tccttttattctgt

SEQ ID NO: 5946432 - DNA, 16 bp, Homo sapiens
tccttttatttataac

SEQ ID NO: 5946433 - DNA, 24 bp, Homo sapiens
tccttttatttcttcaccagattt

SEQ ID NO: 5946434 - DNA, 23 bp, Homo sapiens
tccttttcacagttctctccttc

SEQ ID NO: 5946435 - DNA, 12 bp, Homo sapiens
tccttttcacat

SEQ ID NO: 5946436 - DNA, 15 bp, Homo sapiens
tccttttcacatttt

SEQ ID NO: 5946437 - DNA, 12 bp, Homo sapiens
tccttttcactg

SEQ ID NO: 5946438 - DNA, 21 bp, Homo sapiens
tccttttcataggtctgaaat

SEQ ID NO: 5946439 - DNA, 13 bp, Homo sapiens
tccttttccagag

SEQ ID NO: 5946440 - DNA, 18 bp, Homo sapiens
tccttttccatcccactc

SEQ ID NO: 5946441 - DNA, 22 bp, Homo sapiens
tccttttcccctacagaatttt

SEQ ID NO: 5946442 - DNA, 11 bp, Homo sapiens
tccttttcctt

SEQ ID NO: 5946443 - DNA, 12 bp, Homo sapiens
tccttttccttt

SEQ ID NO: 5946444 - DNA, 17 bp, Homo sapiens
tccttttctctcctgtg

SEQ ID NO: 5946445 - DNA, 15 bp, Homo sapiens
tccttttctctgccc

SEQ ID NO: 5946446 - DNA, 15 bp, Homo sapiens
tccttttcttccttc

SEQ ID NO: 5946447 - DNA, 15 bp, Homo sapiens
tccttttcttctatg

SEQ ID NO: 5946448 - DNA, 14 bp, Homo sapiens
tccttttcttgctt

SEQ ID NO: 5946449 - DNA, 13 bp, Homo sapiens
tccttttcttgtc

SEQ ID NO: 5946450 - DNA, 23 bp, Homo sapiens
tccttttcttgtttatcagcagt

SEQ ID NO: 5946451 - DNA, 13 bp, Homo sapiens
tccttttctttaa

SEQ ID NO: 5946452 - DNA, 13 bp, Homo sapiens
tccttttctttct

SEQ ID NO: 5946453 - DNA, 16 bp, Homo sapiens
tccttttcttttgtta

SEQ ID NO: 5946454 - DNA, 11 bp, Homo sapiens
tccttttgaac

SEQ ID NO: 5946455 - DNA, 17 bp, Homo sapiens
tccttttgaattaaact

SEQ ID NO: 5946456 - DNA, 13 bp, Homo sapiens
tccttttgacact

SEQ ID NO: 5946457 - DNA, 16 bp, Homo sapiens
tccttttgacactgct

SEQ ID NO: 5946458 - DNA, 14 bp, Homo sapiens
tccttttgctcttt

SEQ ID NO: 5946459 - DNA, 17 bp, Homo sapiens
tccttttgctgtgtgaa

SEQ ID NO: 5946460 - DNA, 22 bp, Homo sapiens
tccttttgcttcatctggagtc

SEQ ID NO: 5946461 - DNA, 17 bp, Homo sapiens
tccttttggctggggag

SEQ ID NO: 5946462 - DNA, 14 bp, Homo sapiens
tccttttgtaaagt

SEQ ID NO: 5946463 - DNA, 16 bp, Homo sapiens
tccttttgtaaagtaa

SEQ ID NO: 5946464 - DNA, 21 bp, Homo sapiens
tccttttgtaaagtgaagaat

SEQ ID NO: 5946465 - DNA, 11 bp, Homo sapiens
tccttttgtag

SEQ ID NO: 5946466 - DNA, 20 bp, Homo sapiens
tccttttgtccacttgtaag

SEQ ID NO: 5946467 - DNA, 12 bp, Homo sapiens
tccttttgtgta

SEQ ID NO: 5946468 - DNA, 22 bp, Homo sapiens
tccttttgtgtaattttaaagt

SEQ ID NO: 5946469 - DNA, 12 bp, Homo sapiens
tccttttgtgtt

SEQ ID NO: 5946470 - DNA, 13 bp, Homo sapiens
tccttttgtgttc

SEQ ID NO: 5946471 - DNA, 16 bp, Homo sapiens
tccttttgtgttccaa

SEQ ID NO: 5946472 - DNA, 13 bp, Homo sapiens
tccttttgttttg

SEQ ID NO: 5946473 - DNA, 18 bp, Homo sapiens
tcctttttaaatgtgaat

SEQ ID NO: 5946474 - DNA, 19 bp, Homo sapiens
tcctttttaaccattccaa

SEQ ID NO: 5946475 - DNA, 12 bp, Homo sapiens
tcctttttaagg

SEQ ID NO: 5946476 - DNA, 13 bp, Homo sapiens
tcctttttataac

SEQ ID NO: 5946477 - DNA, 12 bp, Homo sapiens
tcctttttatga

SEQ ID NO: 5946478 - DNA, 13 bp, Homo sapiens
tcctttttattca

SEQ ID NO: 5946479 - DNA, 19 bp, Homo sapiens
tcctttttattccttttaa

SEQ ID NO: 5946480 - DNA, 22 bp, Homo sapiens
tcctttttattccttttaaaat

SEQ ID NO: 5946481 - DNA, 18 bp, Homo sapiens
tcctttttatttatatgt

SEQ ID NO: 5946482 - DNA, 14 bp, Homo sapiens
tcctttttccatca

SEQ ID NO: 5946483 - DNA, 15 bp, Homo sapiens
tcctttttccatcat

SEQ ID NO: 5946484 - DNA, 18 bp, Homo sapiens
tcctttttccatcatttt

SEQ ID NO: 5946485 - DNA, 12 bp, Homo sapiens
tcctttttcctc

SEQ ID NO: 5946486 - DNA, 12 bp, Homo sapiens
tcctttttctat

SEQ ID NO: 5946487 - DNA, 15 bp, Homo sapiens
tcctttttctgatta

SEQ ID NO: 5946488 - DNA, 14 bp, Homo sapiens
tcctttttctgcta

SEQ ID NO: 5946489 - DNA, 14 bp, Homo sapiens
tcctttttctttcc

SEQ ID NO: 5946490 - DNA, 16 bp, Homo sapiens
tcctttttgacactga

SEQ ID NO: 5946491 - DNA, 15 bp, Homo sapiens
tcctttttgtaaata

SEQ ID NO: 5946492 - DNA, 14 bp, Homo sapiens
tcctttttgtaact

SEQ ID NO: 5946493 - DNA, 13 bp, Homo sapiens
tcctttttgttat

SEQ ID NO: 5946494 - DNA, 14 bp, Homo sapiens
tcctttttgttatt

SEQ ID NO: 5946495 - DNA, 17 bp, Homo sapiens
tccttttttaaaataaa

SEQ ID NO: 5946496 - DNA, 11 bp, Homo sapiens
tccttttttcc

SEQ ID NO: 5946497 - DNA, 14 bp, Homo sapiens
tccttttttccttt

SEQ ID NO: 5946498 - DNA, 17 bp, Homo sapiens
tccttttttcctttctt

SEQ ID NO: 5946499 - DNA, 13 bp, Homo sapiens
tccttttttctct

SEQ ID NO: 5946500 - DNA, 17 bp, Homo sapiens
tccttttttctcttctg

SEQ ID NO: 5946501 - DNA, 18 bp, Homo sapiens
tccttttttgagattttt

SEQ ID NO: 5946502 - DNA, 19 bp, Homo sapiens
tccttttttgagatttttt

SEQ ID NO: 5946503 - DNA, 12 bp, Homo sapiens
tcctttttttcc

SEQ ID NO: 5946504 - DNA, 14 bp, Homo sapiens
tcctttttttgtac

SEQ ID NO: 5946505 - DNA, 12 bp, Homo sapiens
tcgaaaagaagg

SEQ ID NO: 5946506 - DNA, 14 bp, Homo sapiens
tcgaaaatcaaatg

SEQ ID NO: 5946507 - DNA, 21 bp, Homo sapiens
tcgaaaattcatttcacatta

SEQ ID NO: 5946508 - DNA, 13 bp, Homo sapiens
tcgaaacacagaa

SEQ ID NO: 5946509 - DNA, 14 bp, Homo sapiens
tcgaaacctgtgat

SEQ ID NO: 5946510 - DNA, 17 bp, Homo sapiens
tcgaaactgacagtatt

SEQ ID NO: 5946511 - DNA, 13 bp, Homo sapiens
tcgaaactgccaa

SEQ ID NO: 5946512 - DNA, 15 bp, Homo sapiens
tcgaaaggccttcag

SEQ ID NO: 5946513 - DNA, 14 bp, Homo sapiens
tcgaaagtaaaaaa

SEQ ID NO: 5946514 - DNA, 11 bp, Homo sapiens
tcgaaagtgtc

SEQ ID NO: 5946515 - DNA, 13 bp, Homo sapiens
tcgaaagtgtcat

SEQ ID NO: 5946516 - DNA, 18 bp, Homo sapiens
tcgaaagtgtcatcaatt

SEQ ID NO: 5946517 - DNA, 20 bp, Homo sapiens
tcgaaagttagtaggatatg

SEQ ID NO: 5946518 - DNA, 12 bp, Homo sapiens
tcgaaataacaa

SEQ ID NO: 5946519 - DNA, 13 bp, Homo sapiens
tcgaaatttcatt

SEQ ID NO: 5946520 - DNA, 14 bp, Homo sapiens
tcgaaatttcattt

SEQ ID NO: 5946521 - DNA, 12 bp, Homo sapiens
tcgaacaaactg

SEQ ID NO: 5946522 - DNA, 17 bp, Homo sapiens
tcgaacatgtttcactt

SEQ ID NO: 5946523 - DNA, 16 bp, Homo sapiens
tcgaaccaaggcagcc

SEQ ID NO: 5946524 - DNA, 17 bp, Homo sapiens
tcgaaccaaggcagcct

SEQ ID NO: 5946525 - DNA, 17 bp, Homo sapiens
tcgaacccacactgcaa

SEQ ID NO: 5946526 - DNA, 13 bp, Homo sapiens
tcgaacccactcc

SEQ ID NO: 5946527 - DNA, 13 bp, Homo sapiens
tcgaactcctgac

SEQ ID NO: 5946528 - DNA, 15 bp, Homo sapiens
tcgaactcctgacct

SEQ ID NO: 5946529 - DNA, 13 bp, Homo sapiens
tcgaactcgggag

SEQ ID NO: 5946530 - DNA, 15 bp, Homo sapiens
tcgaactggctgcaa

SEQ ID NO: 5946531 - DNA, 13 bp, Homo sapiens
tcgaactgtgctc

SEQ ID NO: 5946532 - DNA, 17 bp, Homo sapiens
tcgaactgtgctcccac

SEQ ID NO: 5946533 - DNA, 18 bp, Homo sapiens
tcgaactgtgctcccacg

SEQ ID NO: 5946534 - DNA, 14 bp, Homo sapiens
tcgaacttcacaac

SEQ ID NO: 5946535 - DNA, 22 bp, Homo sapiens
tcgaagaaacccttgctgcttt

SEQ ID NO: 5946536 - DNA, 17 bp, Homo sapiens
tcgaagacccagcagat

SEQ ID NO: 5946537 - DNA, 14 bp, Homo sapiens
tcgaagcaatcagc

SEQ ID NO: 5946538 - DNA, 17 bp, Homo sapiens
tcgaagcaatcagcaaa

SEQ ID NO: 5946539 - DNA, 18 bp, Homo sapiens
tcgaagcagtattctagt

SEQ ID NO: 5946540 - DNA, 10 bp, Homo sapiens
tcgaagccat

SEQ ID NO: 5946541 - DNA, 11 bp, Homo sapiens
tcgaagccatg

SEQ ID NO: 5946542 - DNA, 15 bp, Homo sapiens
tcgaagcccttccag

SEQ ID NO: 5946543 - DNA, 18 bp, Homo sapiens
tcgaagctgttctctgct

SEQ ID NO: 5946544 - DNA, 17 bp, Homo sapiens
tcgaaggagcagtgtga

SEQ ID NO: 5946545 - DNA, 12 bp, Homo sapiens
tcgaaggatgct

SEQ ID NO: 5946546 - DNA, 22 bp, Homo sapiens
tcgaaggggaggcacactttct

SEQ ID NO: 5946547 - DNA, 20 bp, Homo sapiens
tcgaagggtttttagagaat

SEQ ID NO: 5946548 - DNA, 18 bp, Homo sapiens
tcgaagtcagctaattgg

SEQ ID NO: 5946549 - DNA, 12 bp, Homo sapiens
tcgaagtcatta

SEQ ID NO: 5946550 - DNA, 12 bp, Homo sapiens
tcgaagtgctga

SEQ ID NO: 5946551 - DNA, 17 bp, Homo sapiens
tcgaagtgtttatgtaa

SEQ ID NO: 5946552 - DNA, 19 bp, Homo sapiens
tcgaagtgtttatgtaata

SEQ ID NO: 5946553 - DNA, 18 bp, Homo sapiens
tcgaatactttgaatgtt

SEQ ID NO: 5946554 - DNA, 19 bp, Homo sapiens
tcgcgggcagcgggccagg

SEQ ID NO: 5946555 - DNA, 18 bp, Homo sapiens
tcgcgtgccctcgctgct

SEQ ID NO: 5946556 - DNA, 21 bp, Homo sapiens
tcgcgtggatctaccctctag

SEQ ID NO: 5946557 - DNA, 17 bp, Homo sapiens
tcgctacatttccgcca

SEQ ID NO: 5946558 - DNA, 13 bp, Homo sapiens
tcgctatgtgcac

SEQ ID NO: 5946559 - DNA, 18 bp, Homo sapiens
tcgctattgtcaccaggg

SEQ ID NO: 5946560 - DNA, 13 bp, Homo sapiens
tcgctcactgttg

SEQ ID NO: 5946561 - DNA, 23 bp, Homo sapiens
tcgctcaggtgatcaaaataaag

SEQ ID NO: 5946562 - DNA, 14 bp, Homo sapiens
tcgctcagtctgtt

SEQ ID NO: 5946563 - DNA, 18 bp, Homo sapiens
tcgctcagtctgttcact

SEQ ID NO: 5946564 - DNA, 14 bp, Homo sapiens
tcgctccaactcca

SEQ ID NO: 5946565 - DNA, 18 bp, Homo sapiens
tcgctccccactctgctc

SEQ ID NO: 5946566 - DNA, 20 bp, Homo sapiens
tcgctccccactctgctctg

SEQ ID NO: 5946567 - DNA, 21 bp, Homo sapiens
tcgctccccactctgctctga

SEQ ID NO: 5946568 - DNA, 15 bp, Homo sapiens
tcgctcccctctgcc

SEQ ID NO: 5946569 - DNA, 17 bp, Homo sapiens
tcgctcccctctggaat

SEQ ID NO: 5946570 - DNA, 15 bp, Homo sapiens
tcgctccctcccagg

SEQ ID NO: 5946571 - DNA, 23 bp, Homo sapiens
tcgctccctgtagctctgcctcc

SEQ ID NO: 5946572 - DNA, 13 bp, Homo sapiens
tcgctcctcccag

SEQ ID NO: 5946573 - DNA, 11 bp, Homo sapiens
tcgctcctcct

SEQ ID NO: 5946574 - DNA, 15 bp, Homo sapiens
tcgctcctccttccc

SEQ ID NO: 5946575 - DNA, 18 bp, Homo sapiens
tcgctcctccttcccagg

SEQ ID NO: 5946576 - DNA, 15 bp, Homo sapiens
tcgctcctgcagccc

SEQ ID NO: 5946577 - DNA, 14 bp, Homo sapiens
tcgctcctgcccac

SEQ ID NO: 5946578 - DNA, 18 bp, Homo sapiens
tcgctccttcatttcagg

SEQ ID NO: 5946579 - DNA, 17 bp, Homo sapiens
tcgctctcgctctcgct

SEQ ID NO: 5946580 - DNA, 17 bp, Homo sapiens
tcgctctcgctctctct

SEQ ID NO: 5946581 - DNA, 22 bp, Homo sapiens
tcgctctctgtctccaggcagt

SEQ ID NO: 5946582 - DNA, 12 bp, Homo sapiens
tcgctctgctgg

SEQ ID NO: 5946583 - DNA, 13 bp, Homo sapiens
tcgctctgtcacc

SEQ ID NO: 5946584 - DNA, 22 bp, Homo sapiens
tcgctctgtcacccaggctgga

SEQ ID NO: 5946585 - DNA, 17 bp, Homo sapiens
tcgctctgtcgcccagg

SEQ ID NO: 5946586 - DNA, 19 bp, Homo sapiens
tcgctctgttacccagggt

SEQ ID NO: 5946587 - DNA, 17 bp, Homo sapiens
tcgctcttgaggagctc

SEQ ID NO: 5946588 - DNA, 14 bp, Homo sapiens
tcgctcttgggagt

SEQ ID NO: 5946589 - DNA, 15 bp, Homo sapiens
tcgctctttgagaaa

SEQ ID NO: 5946590 - DNA, 14 bp, Homo sapiens
tcgctgaaattgct

SEQ ID NO: 5946591 - DNA, 16 bp, Homo sapiens
tcgctgaacctgtctc

SEQ ID NO: 5946592 - DNA, 19 bp, Homo sapiens
tcgctgatatatgtgtttt

SEQ ID NO: 5946593 - DNA, 14 bp, Homo sapiens
tcgctgatgctggg

SEQ ID NO: 5946594 - DNA, 22 bp, Homo sapiens
tcgctgatgctgggctgggtgc

SEQ ID NO: 5946595 - DNA, 16 bp, Homo sapiens
tcgctgcacatggcct

SEQ ID NO: 5946596 - DNA, 14 bp, Homo sapiens
tcgctgccacccac

SEQ ID NO: 5946597 - DNA, 10 bp, Homo sapiens
tcgctgccag

SEQ ID NO: 5946598 - DNA, 11 bp, Homo sapiens
tcgctgccagg

SEQ ID NO: 5946599 - DNA, 13 bp, Homo sapiens
tcgctgccaggac

SEQ ID NO: 5946600 - DNA, 16 bp, Homo sapiens
tcgctgccaggacacc

SEQ ID NO: 5946601 - DNA, 17 bp, Homo sapiens
tcgctgccaggacacct

SEQ ID NO: 5946602 - DNA, 20 bp, Homo sapiens
tcgctgccatcaccgctggg

SEQ ID NO: 5946603 - DNA, 21 bp, Homo sapiens
tcgctgccatcaccgctgggt

SEQ ID NO: 5946604 - DNA, 24 bp, Homo sapiens
tcgctgcctccatggcagcagcca

SEQ ID NO: 5946605 - DNA, 19 bp, Homo sapiens
tcgctgctctagctggcag

SEQ ID NO: 5946606 - DNA, 14 bp, Homo sapiens
tcgctgctgctact

SEQ ID NO: 5946607 - DNA, 22 bp, Homo sapiens
tcgctggaatcaatttcccaga

SEQ ID NO: 5946608 - DNA, 18 bp, Homo sapiens
tcgctggacaacccagaa

SEQ ID NO: 5946609 - DNA, 15 bp, Homo sapiens
tcgctggactattgt

SEQ ID NO: 5946610 - DNA, 22 bp, Homo sapiens
tcgctggactctcagtctctga

SEQ ID NO: 5946611 - DNA, 15 bp, Homo sapiens
tcgctggcccccact

SEQ ID NO: 5946612 - DNA, 17 bp, Homo sapiens
tcgctggcccccactgg

SEQ ID NO: 5946613 - DNA, 21 bp, Homo sapiens
tcgctggcccccactggctgt

SEQ ID NO: 5946614 - DNA, 23 bp, Homo sapiens
tcgctggcccctttgggccctgc

SEQ ID NO: 5946615 - DNA, 13 bp, Homo sapiens
tcgctggctccta

SEQ ID NO: 5946616 - DNA, 22 bp, Homo sapiens
tcgctggctcctaccccatctc

SEQ ID NO: 5946617 - DNA, 23 bp, Homo sapiens
tcgctggctcctaccccatctcc

SEQ ID NO: 5946618 - DNA, 20 bp, Homo sapiens
tcgctggctgatcattgcag

SEQ ID NO: 5946619 - DNA, 15 bp, Homo sapiens
tcgctggctttctct

SEQ ID NO: 5946620 - DNA, 16 bp, Homo sapiens
tcgctggctttctctc

SEQ ID NO: 5946621 - DNA, 12 bp, Homo sapiens
tcgctgggtcct

SEQ ID NO: 5946622 - DNA, 20 bp, Homo sapiens
tcgctgtaccctttaagata

SEQ ID NO: 5946623 - DNA, 16 bp, Homo sapiens
tcgctgtatgatttag

SEQ ID NO: 5946624 - DNA, 22 bp, Homo sapiens
tcgctgtattttgagtttcagc

SEQ ID NO: 5946625 - DNA, 15 bp, Homo sapiens
tcgctgtcactggct

SEQ ID NO: 5946626 - DNA, 18 bp, Homo sapiens
tcgctgtcactggctggc

SEQ ID NO: 5946627 - DNA, 22 bp, Homo sapiens
tcgctgtccaagtgtttcttgt

SEQ ID NO: 5946628 - DNA, 14 bp, Homo sapiens
tcgctgtcccctca

SEQ ID NO: 5946629 - DNA, 14 bp, Homo sapiens
tcgctgtcctgctg

SEQ ID NO: 5946630 - DNA, 23 bp, Homo sapiens
tcgctgtgatgcatgagctccct

SEQ ID NO: 5946631 - DNA, 16 bp, Homo sapiens
tcgctgtgattttaag

SEQ ID NO: 5946632 - DNA, 20 bp, Homo sapiens
tcgctgtgattttaagacaa

SEQ ID NO: 5946633 - DNA, 13 bp, Homo sapiens
tcgctgtgccacc

SEQ ID NO: 5946634 - DNA, 19 bp, Homo sapiens
tcgctgtgccaccacccct

SEQ ID NO: 5946635 - DNA, 16 bp, Homo sapiens
tcgctgtggttgtttt

SEQ ID NO: 5946636 - DNA, 23 bp, Homo sapiens
tcgctgtgtcagcatagaagtaa

SEQ ID NO: 5946637 - DNA, 15 bp, Homo sapiens
tcgctgttgctgaat

SEQ ID NO: 5946638 - DNA, 17 bp, Homo sapiens
tcgcttagctgaaacct

SEQ ID NO: 5946639 - DNA, 19 bp, Homo sapiens
tcgcttaggtagaaactat

SEQ ID NO: 5946640 - DNA, 16 bp, Homo sapiens
tcgcttatatgtcctt

SEQ ID NO: 5946641 - DNA, 16 bp, Homo sapiens
tcgcttcataggcaga

SEQ ID NO: 5946642 - DNA, 20 bp, Homo sapiens
tcgcttcataggcagagccc

SEQ ID NO: 5946643 - DNA, 19 bp, Homo sapiens
tcgcttcccccatagccac

SEQ ID NO: 5946644 - DNA, 15 bp, Homo sapiens
tcgcttccgcatcct

SEQ ID NO: 5946645 - DNA, 16 bp, Homo sapiens
tcgcttctcctccagg

SEQ ID NO: 5946646 - DNA, 14 bp, Homo sapiens
tcgcttcttgcctc

SEQ ID NO: 5946647 - DNA, 19 bp, Homo sapiens
tcgcttcttgcctctgtgc

SEQ ID NO: 5946648 - DNA, 13 bp, Homo sapiens
tcgcttgagccca

SEQ ID NO: 5946649 - DNA, 15 bp, Homo sapiens
tcgcttgagcccagg

SEQ ID NO: 5946650 - DNA, 17 bp, Homo sapiens
tcgcttgagcccaggag

SEQ ID NO: 5946651 - DNA, 18 bp, Homo sapiens
tcgcttgagcccaggagt

SEQ ID NO: 5946652 - DNA, 12 bp, Homo sapiens
tcgcttgccaaa

SEQ ID NO: 5946653 - DNA, 14 bp, Homo sapiens
tcgcttgcttctgc

SEQ ID NO: 5946654 - DNA, 19 bp, Homo sapiens
tcgcttgcttctgcagcaa

SEQ ID NO: 5946655 - DNA, 14 bp, Homo sapiens
tcgcttgttttaaa

SEQ ID NO: 5946656 - DNA, 21 bp, Homo sapiens
tcgcttttgccttttcaaatc

SEQ ID NO: 5946657 - DNA, 14 bp, Homo sapiens
tcgcttttggtgcc

SEQ ID NO: 5946658 - DNA, 16 bp, Homo sapiens
tcggaaaaaaaaaaag

SEQ ID NO: 5946659 - DNA, 21 bp, Homo sapiens
tcggaaaaaaaaaaagaaaaa

SEQ ID NO: 5946660 - DNA, 19 bp, Homo sapiens
tcggaaaaataatcaaaag

SEQ ID NO: 5946661 - DNA, 22 bp, Homo sapiens
tcggaaaagcgtctttaagaga

SEQ ID NO: 5946662 - DNA, 16 bp, Homo sapiens
tcggaaacactgactt

SEQ ID NO: 5946663 - DNA, 14 bp, Homo sapiens
tcggaacagcagat

SEQ ID NO: 5946664 - DNA, 20 bp, Homo sapiens
tcggaacccaagcttagaac

SEQ ID NO: 5946665 - DNA, 16 bp, Homo sapiens
tcggaaccgctcacct

SEQ ID NO: 5946666 - DNA, 17 bp, Homo sapiens
tcggaaccgctcaccta

SEQ ID NO: 5946667 - DNA, 19 bp, Homo sapiens
tcggaaccgctcacctaga

SEQ ID NO: 5946668 - DNA, 18 bp, Homo sapiens
tcggaactgtcctttcct

SEQ ID NO: 5946669 - DNA, 16 bp, Homo sapiens
tcggaagagagggctg

SEQ ID NO: 5946670 - DNA, 20 bp, Homo sapiens
tcggaagccgtctgactcca

SEQ ID NO: 5946671 - DNA, 12 bp, Homo sapiens
tcggaagcctgt

SEQ ID NO: 5946672 - DNA, 15 bp, Homo sapiens
tcggaagcctgtcct

SEQ ID NO: 5946673 - DNA, 19 bp, Homo sapiens
tcggaaggctggctgggca

SEQ ID NO: 5946674 - DNA, 19 bp, Homo sapiens
tcggaattcataataaatt

SEQ ID NO: 5946675 - DNA, 20 bp, Homo sapiens
tcggaattcataataaattt

SEQ ID NO: 5946676 - DNA, 16 bp, Homo sapiens
tcggacacccagggtc

SEQ ID NO: 5946677 - DNA, 21 bp, Homo sapiens
tcggacatgcttttctgccac

SEQ ID NO: 5946678 - DNA, 22 bp, Homo sapiens
tcggacatgcttttctgccact

SEQ ID NO: 5946679 - DNA, 15 bp, Homo sapiens
tcggacattctaatg

SEQ ID NO: 5946680 - DNA, 19 bp, Homo sapiens
tcggacattctaatgcata

SEQ ID NO: 5946681 - DNA, 18 bp, Homo sapiens
tcggaccactaggcctga

SEQ ID NO: 5946682 - DNA, 20 bp, Homo sapiens
tcggacccaccccaactctc

SEQ ID NO: 5946683 - DNA, 18 bp, Homo sapiens
tcggaccgaaggtgacag

SEQ ID NO: 5946684 - DNA, 23 bp, Homo sapiens
tcggaccgcttgtggggacccag

SEQ ID NO: 5946685 - DNA, 18 bp, Homo sapiens
tcggacctcagtttctgt

SEQ ID NO: 5946686 - DNA, 19 bp, Homo sapiens
tcggacctcagtttctgtt

SEQ ID NO: 5946687 - DNA, 19 bp, Homo sapiens
tcggacggggcaggcgctg

SEQ ID NO: 5946688 - DNA, 11 bp, Homo sapiens
tcggactgcca

SEQ ID NO: 5946689 - DNA, 23 bp, Homo sapiens
tcggacttactgcctgaccttgg

SEQ ID NO: 5946690 - DNA, 17 bp, Homo sapiens
tcggacttgaatgctgc

SEQ ID NO: 5946691 - DNA, 18 bp, Homo sapiens
tcggacttgaatgctgcc

SEQ ID NO: 5946692 - DNA, 12 bp, Homo sapiens
tcggagaagagc

SEQ ID NO: 5946693 - DNA, 21 bp, Homo sapiens
tcggagaagagcgcagtgttt

SEQ ID NO: 5946694 - DNA, 14 bp, Homo sapiens
tcggagacagtgat

SEQ ID NO: 5946695 - DNA, 15 bp, Homo sapiens
tcggagacagtgatc

SEQ ID NO: 5946696 - DNA, 17 bp, Homo sapiens
tcggagactatggcctc

SEQ ID NO: 5946697 - DNA, 17 bp, Homo sapiens
tcggagactgccccacg

SEQ ID NO: 5946698 - DNA, 13 bp, Homo sapiens
tcggagagcagca

SEQ ID NO: 5946699 - DNA, 20 bp, Homo sapiens
tcggagaggctgtctggggc

SEQ ID NO: 5946700 - DNA, 11 bp, Homo sapiens
tcggagaggga

SEQ ID NO: 5946701 - DNA, 16 bp, Homo sapiens
tcggagcatcccggag

SEQ ID NO: 5946702 - DNA, 21 bp, Homo sapiens
tcggagcatcccggaggaaat

SEQ ID NO: 5946703 - DNA, 23 bp, Homo sapiens
tcggagcatcccggaggaaatct

SEQ ID NO: 5946704 - DNA, 19 bp, Homo sapiens
tcggagcatggtgttttca

SEQ ID NO: 5946705 - DNA, 19 bp, Homo sapiens
tcggagccccccactcagt

SEQ ID NO: 5946706 - DNA, 22 bp, Homo sapiens
tcggagccccccactcagtagg

SEQ ID NO: 5946707 - DNA, 15 bp, Homo sapiens
tcggagccctgtctc

SEQ ID NO: 5946708 - DNA, 14 bp, Homo sapiens
tcggagcctgcctc

SEQ ID NO: 5946709 - DNA, 19 bp, Homo sapiens
tcggagcgaagcagagagg

SEQ ID NO: 5946710 - DNA, 15 bp, Homo sapiens
tcggagctgccagcc

SEQ ID NO: 5946711 - DNA, 21 bp, Homo sapiens
tcggagctgcctgcagcacat

SEQ ID NO: 5946712 - DNA, 13 bp, Homo sapiens
tcggagctggctg

SEQ ID NO: 5946713 - DNA, 14 bp, Homo sapiens
tcggaggccaggcc

SEQ ID NO: 5946714 - DNA, 16 bp, Homo sapiens
tcggaggcccatgccc

SEQ ID NO: 5946715 - DNA, 17 bp, Homo sapiens
tcggaggccccactgat

SEQ ID NO: 5946716 - DNA, 20 bp, Homo sapiens
tcggaggctacccgctgtgg

SEQ ID NO: 5946717 - DNA, 15 bp, Homo sapiens
tcggaggctcctccc

SEQ ID NO: 5946718 - DNA, 18 bp, Homo sapiens
tcggaggctcctccctct

SEQ ID NO: 5946719 - DNA, 20 bp, Homo sapiens
tcggaggctcctccctctgc

SEQ ID NO: 5946720 - DNA, 14 bp, Homo sapiens
tcggaggctgcccc

SEQ ID NO: 5946721 - DNA, 23 bp, Homo sapiens
tcggaggctgcccccggccccct

SEQ ID NO: 5946722 - DNA, 14 bp, Homo sapiens
tcggaggcttggga

SEQ ID NO: 5946723 - DNA, 22 bp, Homo sapiens
tcggaggcttgtcagagctggg

SEQ ID NO: 5946724 - DNA, 19 bp, Homo sapiens
tcggagggaaattgtaaat

SEQ ID NO: 5946725 - DNA, 20 bp, Homo sapiens
tcggagggatggagaaagaa

SEQ ID NO: 5946726 - DNA, 17 bp, Homo sapiens
tcggagggccgcagggc

SEQ ID NO: 5946727 - DNA, 20 bp, Homo sapiens
tcggagggccgcagggccca

SEQ ID NO: 5946728 - DNA, 21 bp, Homo sapiens
tcggagggccgcagggcccac

SEQ ID NO: 5946729 - DNA, 16 bp, Homo sapiens
tcggagtagaaattgt

SEQ ID NO: 5946730 - DNA, 16 bp, Homo sapiens
tcggagtgcctggagt

SEQ ID NO: 5946731 - DNA, 14 bp, Homo sapiens
tcggagtggacacc

SEQ ID NO: 5946732 - DNA, 18 bp, Homo sapiens
tcgtgcctataaatagta

SEQ ID NO: 5946733 - DNA, 20 bp, Homo sapiens
tcgtgcctccttccacctcc

SEQ ID NO: 5946734 - DNA, 18 bp, Homo sapiens
tcgtgcctgggggagaga

SEQ ID NO: 5946735 - DNA, 14 bp, Homo sapiens
tcgtgcctgtgtcc

SEQ ID NO: 5946736 - DNA, 18 bp, Homo sapiens
tcgtgcggaatcagcttc

SEQ ID NO: 5946737 - DNA, 17 bp, Homo sapiens
tcgtgctccgcagggcg

SEQ ID NO: 5946738 - DNA, 13 bp, Homo sapiens
tcgtgctggagga

SEQ ID NO: 5946739 - DNA, 14 bp, Homo sapiens
tcgtgctggaggaa

SEQ ID NO: 5946740 - DNA, 19 bp, Homo sapiens
tcgtgctgtgctctggcac

SEQ ID NO: 5946741 - DNA, 23 bp, Homo sapiens
tcgtggaagaagggccaccctga

SEQ ID NO: 5946742 - DNA, 17 bp, Homo sapiens
tcgtggacacacacaga

SEQ ID NO: 5946743 - DNA, 22 bp, Homo sapiens
tcgtggacacacacagactatt

SEQ ID NO: 5946744 - DNA, 16 bp, Homo sapiens
tcgtggacacctgccc

SEQ ID NO: 5946745 - DNA, 17 bp, Homo sapiens
tcgtggacacctgccct

SEQ ID NO: 5946746 - DNA, 19 bp, Homo sapiens
tcgtggacacctgccctgc

SEQ ID NO: 5946747 - DNA, 14 bp, Homo sapiens
tcgtggactccagc

SEQ ID NO: 5946748 - DNA, 15 bp, Homo sapiens
tcgtggactccagct

SEQ ID NO: 5946749 - DNA, 20 bp, Homo sapiens
tcgtggactgagtgggaagc

SEQ ID NO: 5946750 - DNA, 12 bp, Homo sapiens
tcgtggagagct

SEQ ID NO: 5946751 - DNA, 18 bp, Homo sapiens
tcgtggagagctaggagc

SEQ ID NO: 5946752 - DNA, 24 bp, Homo sapiens
tcgtggagagctaggagcaaagcc

SEQ ID NO: 5946753 - DNA, 17 bp, Homo sapiens
tcgtggagatgtcttcg

SEQ ID NO: 5946754 - DNA, 11 bp, Homo sapiens
tcgtggagctc

SEQ ID NO: 5946755 - DNA, 14 bp, Homo sapiens
tcgtggattgtttt

SEQ ID NO: 5946756 - DNA, 23 bp, Homo sapiens
tcgtggcagataatcagcctctt

SEQ ID NO: 5946757 - DNA, 17 bp, Homo sapiens
tcgtggccagcccggct

SEQ ID NO: 5946758 - DNA, 20 bp, Homo sapiens
tcgtgggatctgcccctccc

SEQ ID NO: 5946759 - DNA, 15 bp, Homo sapiens
tcgtgggctctggct

SEQ ID NO: 5946760 - DNA, 16 bp, Homo sapiens
tcgtgggctctggctc

SEQ ID NO: 5946761 - DNA, 17 bp, Homo sapiens
tcgtgggctctggctcc

SEQ ID NO: 5946762 - DNA, 18 bp, Homo sapiens
tcgtggggtgtgctggga

SEQ ID NO: 5946763 - DNA, 19 bp, Homo sapiens
tcgtgggttcttcctctgt

SEQ ID NO: 5946764 - DNA, 16 bp, Homo sapiens
tcgtggtagaagccag

SEQ ID NO: 5946765 - DNA, 17 bp, Homo sapiens
tcgtggtagaagccagt

SEQ ID NO: 5946766 - DNA, 14 bp, Homo sapiens
tcgtggtaggactg

SEQ ID NO: 5946767 - DNA, 20 bp, Homo sapiens
tcgtggtaggactgtagaaa

SEQ ID NO: 5946768 - DNA, 15 bp, Homo sapiens
tcgtggtatgtatgg

SEQ ID NO: 5946769 - DNA, 22 bp, Homo sapiens
tcgtggtgatcaattaaatgta

SEQ ID NO: 5946770 - DNA, 15 bp, Homo sapiens
tcgtgtaaattatgt

SEQ ID NO: 5946771 - DNA, 15 bp, Homo sapiens
tcgtgtactgcaaag

SEQ ID NO: 5946772 - DNA, 22 bp, Homo sapiens
tcgtgtagtggaagagcagcct

SEQ ID NO: 5946773 - DNA, 13 bp, Homo sapiens
tcgtgtatcctgg

SEQ ID NO: 5946774 - DNA, 16 bp, Homo sapiens
tcgtgtatcctggggc

SEQ ID NO: 5946775 - DNA, 15 bp, Homo sapiens
tcgtgtattccatat

SEQ ID NO: 5946776 - DNA, 15 bp, Homo sapiens
tcgtgtatttattac

SEQ ID NO: 5946777 - DNA, 16 bp, Homo sapiens
tcgtgtcagtaattta

SEQ ID NO: 5946778 - DNA, 22 bp, Homo sapiens
tcgtgtcatactcgagtctgag

SEQ ID NO: 5946779 - DNA, 13 bp, Homo sapiens
tcgtgtcctgcta

SEQ ID NO: 5946780 - DNA, 14 bp, Homo sapiens
tcgtgtcctgctag

SEQ ID NO: 5946781 - DNA, 20 bp, Homo sapiens
tcgtgtcctgctagctgtct

SEQ ID NO: 5946782 - DNA, 14 bp, Homo sapiens
tcgtgtctctggtc

SEQ ID NO: 5946783 - DNA, 14 bp, Homo sapiens
tcgtgtctgctgtt

SEQ ID NO: 5946784 - DNA, 20 bp, Homo sapiens
tcgtgtctggcgttgtgggg

SEQ ID NO: 5946785 - DNA, 17 bp, Homo sapiens
tcgtgtgcaacagacaa

SEQ ID NO: 5946786 - DNA, 15 bp, Homo sapiens
tcgtgtgcccaccag

SEQ ID NO: 5946787 - DNA, 14 bp, Homo sapiens
tcgtgtgccgctgc

SEQ ID NO: 5946788 - DNA, 14 bp, Homo sapiens
tcgtgtgctgctgc

SEQ ID NO: 5946789 - DNA, 15 bp, Homo sapiens
tcgtgtgctgctgct

SEQ ID NO: 5946790 - DNA, 17 bp, Homo sapiens
tcgtgtgctgctgctgc

SEQ ID NO: 5946791 - DNA, 22 bp, Homo sapiens
tcgtgtgctgctgctgctattg

SEQ ID NO: 5946792 - DNA, 13 bp, Homo sapiens
tcgtgtggctcct

SEQ ID NO: 5946793 - DNA, 22 bp, Homo sapiens
tcgtgtgtgttatttccccagc

SEQ ID NO: 5946794 - DNA, 14 bp, Homo sapiens
tcgtgttatgaatc

SEQ ID NO: 5946795 - DNA, 19 bp, Homo sapiens
tcgtgttatgaatctgtgc

SEQ ID NO: 5946796 - DNA, 17 bp, Homo sapiens
tcgtgttcgctggctga

SEQ ID NO: 5946797 - DNA, 16 bp, Homo sapiens
tcgtgttggtattttc

SEQ ID NO: 5946798 - DNA, 15 bp, Homo sapiens
tcgtgtttacaaaag

SEQ ID NO: 5946799 - DNA, 16 bp, Homo sapiens
tcgttaaaaagttgtt

SEQ ID NO: 5946800 - DNA, 12 bp, Homo sapiens
tcgttaacattg

SEQ ID NO: 5946801 - DNA, 21 bp, Homo sapiens
tcgttaactgtgtatgtacat

SEQ ID NO: 5946802 - DNA, 19 bp, Homo sapiens
tcgttaatagattatttca

SEQ ID NO: 5946803 - DNA, 19 bp, Homo sapiens
tcgttaattaatgtcatgt

SEQ ID NO: 5946804 - DNA, 20 bp, Homo sapiens
tcgttaattaatgtcatgtt

SEQ ID NO: 5946805 - DNA, 14 bp, Homo sapiens
tcgttacctgccgc

SEQ ID NO: 5946806 - DNA, 12 bp, Homo sapiens
tcgttactggca

SEQ ID NO: 5946807 - DNA, 18 bp, Homo sapiens
tcgttagaggagcaacag

SEQ ID NO: 5946808 - DNA, 21 bp, Homo sapiens
tcgttagggaagagaaacagg

SEQ ID NO: 5946809 - DNA, 14 bp, Homo sapiens
tcgttatctactga

SEQ ID NO: 5946810 - DNA, 16 bp, Homo sapiens
tcgttattataaatgt

SEQ ID NO: 5946811 - DNA, 15 bp, Homo sapiens
tcgttcaaaacattc

SEQ ID NO: 5946812 - DNA, 16 bp, Homo sapiens
tcgttcaaaagtggag

SEQ ID NO: 5946813 - DNA, 15 bp, Homo sapiens
tcgttcaaagcatga

SEQ ID NO: 5946814 - DNA, 14 bp, Homo sapiens
tcgttcaactccac

SEQ ID NO: 5946815 - DNA, 19 bp, Homo sapiens
tcgttcattgcctttccag

SEQ ID NO: 5946816 - DNA, 14 bp, Homo sapiens
tcgttccccacccc

SEQ ID NO: 5946817 - DNA, 16 bp, Homo sapiens
tcgttccctgattatt

SEQ ID NO: 5946818 - DNA, 21 bp, Homo sapiens
tcgttcctatacatttctgtt

SEQ ID NO: 5946819 - DNA, 17 bp, Homo sapiens
tcgttctcgtgacccag

SEQ ID NO: 5946820 - DNA, 21 bp, Homo sapiens
tcgttctgtactgttactggg

SEQ ID NO: 5946821 - DNA, 14 bp, Homo sapiens
tcgttctgtgtttg

SEQ ID NO: 5946822 - DNA, 15 bp, Homo sapiens
tcgttctgtttacat

SEQ ID NO: 5946823 - DNA, 19 bp, Homo sapiens
tcgttctgtttacatcagt

SEQ ID NO: 5946824 - DNA, 21 bp, Homo sapiens
tcgttctgtttacatcagttt

SEQ ID NO: 5946825 - DNA, 17 bp, Homo sapiens
tcgttcttcatgggggt

SEQ ID NO: 5946826 - DNA, 16 bp, Homo sapiens
tcgttgactttaggga

SEQ ID NO: 5946827 - DNA, 19 bp, Homo sapiens
tcgttgatgctaataaata

SEQ ID NO: 5946828 - DNA, 15 bp, Homo sapiens
tcgttgcacagctgt

SEQ ID NO: 5946829 - DNA, 22 bp, Homo sapiens
tcgttgcacagctgtttgaaat

SEQ ID NO: 5946830 - DNA, 18 bp, Homo sapiens
tcgttgcagcactgccca

SEQ ID NO: 5946831 - DNA, 11 bp, Homo sapiens
tcgttgcatgg

SEQ ID NO: 5946832 - DNA, 12 bp, Homo sapiens
tcgttgcatggt

SEQ ID NO: 5946833 - DNA, 19 bp, Homo sapiens
tcgttggatgtctgtgagt

SEQ ID NO: 5946834 - DNA, 21 bp, Homo sapiens
tcgttgggccgctctgatttc

SEQ ID NO: 5946835 - DNA, 19 bp, Homo sapiens
tcgttggtagagccctcag

SEQ ID NO: 5946836 - DNA, 17 bp, Homo sapiens
tcgttggttgtttctct

SEQ ID NO: 5946837 - DNA, 22 bp, Homo sapiens
tcgttgttcccactgaaatgga

SEQ ID NO: 5946838 - DNA, 14 bp, Homo sapiens
tcgtttaatgaatg

SEQ ID NO: 5946839 - DNA, 22 bp, Homo sapiens
tcgtttacactgcacattgaat

SEQ ID NO: 5946840 - DNA, 15 bp, Homo sapiens
tcgtttactccatgt

SEQ ID NO: 5946841 - DNA, 17 bp, Homo sapiens
tcgtttagtgccaatgt

SEQ ID NO: 5946842 - DNA, 14 bp, Homo sapiens
tcgtttatattgta

SEQ ID NO: 5946843 - DNA, 16 bp, Homo sapiens
tcgtttcaaaaacaca

SEQ ID NO: 5946844 - DNA, 16 bp, Homo sapiens
tcgtttccatcatgtc

SEQ ID NO: 5946845 - DNA, 23 bp, Homo sapiens
tcgtttgatagtgcttcttgtaa

SEQ ID NO: 5946846 - DNA, 15 bp, Homo sapiens
tcgtttgatttcaaa

SEQ ID NO: 5946847 - DNA, 14 bp, Homo sapiens
tcgtttgcctccag

SEQ ID NO: 5946848 - DNA, 16 bp, Homo sapiens
tcgtttggtcttaggt

SEQ ID NO: 5946849 - DNA, 13 bp, Homo sapiens
tcgtttgtttgtt

SEQ ID NO: 5946850 - DNA, 20 bp, Homo sapiens
tcgtttgtttgtttgtttaa

SEQ ID NO: 5946851 - DNA, 14 bp, Homo sapiens
tcgttttcaaagat

SEQ ID NO: 5946852 - DNA, 20 bp, Homo sapiens
tcgttttcataacttgctga

SEQ ID NO: 5946853 - DNA, 16 bp, Homo sapiens
tcgttttctttgctgt

SEQ ID NO: 5946854 - DNA, 21 bp, Homo sapiens
tcgttttctttgctgtgccaa

SEQ ID NO: 5946855 - DNA, 18 bp, Homo sapiens
tcgtttttatattaatgt

SEQ ID NO: 5946856 - DNA, 20 bp, Homo sapiens
tcgtttttgtattttcatga

SEQ ID NO: 5946857 - DNA, 17 bp, Homo sapiens
tcgtttttttcattcca

SEQ ID NO: 5946858 - DNA, 22 bp, Homo sapiens
tcgtttttttggtcactccagt

SEQ ID NO: 5946859 - DNA, 21 bp, Homo sapiens
tctaaaaaaataaacaaagtg

SEQ ID NO: 5946860 - DNA, 17 bp, Homo sapiens
tctaaaaaataactgtg

SEQ ID NO: 5946861 - DNA, 14 bp, Homo sapiens
tctaaaaacaccaa

SEQ ID NO: 5946862 - DNA, 16 bp, Homo sapiens
tctaaaaagaaaaaga

SEQ ID NO: 5946863 - DNA, 19 bp, Homo sapiens
tctaaaaagacctggcctt

SEQ ID NO: 5946864 - DNA, 18 bp, Homo sapiens
tctaaaaagatgtaataa

SEQ ID NO: 5946865 - DNA, 18 bp, Homo sapiens
tctaaaaagattagcaag

SEQ ID NO: 5946866 - DNA, 12 bp, Homo sapiens
tctaaaaataaa

SEQ ID NO: 5946867 - DNA, 16 bp, Homo sapiens
tctaaaaataaaatga

SEQ ID NO: 5946868 - DNA, 22 bp, Homo sapiens
tctaaaaataaaccaaaggaca

SEQ ID NO: 5946869 - DNA, 18 bp, Homo sapiens
tctaaaaataactgtaat

SEQ ID NO: 5946870 - DNA, 14 bp, Homo sapiens
tctaaaaatataca

SEQ ID NO: 5946871 - DNA, 17 bp, Homo sapiens
tctaaaaatgaagatga

SEQ ID NO: 5946872 - DNA, 16 bp, Homo sapiens
tctaaaaattgataga

SEQ ID NO: 5946873 - DNA, 18 bp, Homo sapiens
tctaaaacaaaatctgaa

SEQ ID NO: 5946874 - DNA, 11 bp, Homo sapiens
tctaaaacaat

SEQ ID NO: 5946875 - DNA, 17 bp, Homo sapiens
tctaaaacatagactga

SEQ ID NO: 5946876 - DNA, 18 bp, Homo sapiens
tctaaaacatagactgaa

SEQ ID NO: 5946877 - DNA, 19 bp, Homo sapiens
tctaaaacattaattgagg

SEQ ID NO: 5946878 - DNA, 21 bp, Homo sapiens
tctaaaactaaatagcatgta

SEQ ID NO: 5946879 - DNA, 18 bp, Homo sapiens
tctaaaactgtactttga

SEQ ID NO: 5946880 - DNA, 11 bp, Homo sapiens
tctaaaagaaa

SEQ ID NO: 5946881 - DNA, 17 bp, Homo sapiens
tctaaaagattctttaa

SEQ ID NO: 5946882 - DNA, 16 bp, Homo sapiens
tctaaaaggaggacag

SEQ ID NO: 5946883 - DNA, 17 bp, Homo sapiens
tctaaaaggtaatgtgt

SEQ ID NO: 5946884 - DNA, 14 bp, Homo sapiens
tctaaaagtagaca

SEQ ID NO: 5946885 - DNA, 23 bp, Homo sapiens
tctaaaagtttctacattcagat

SEQ ID NO: 5946886 - DNA, 22 bp, Homo sapiens
tctaaaatagcaataactgaaa

SEQ ID NO: 5946887 - DNA, 14 bp, Homo sapiens
tctaaaatgaaata

SEQ ID NO: 5946888 - DNA, 13 bp, Homo sapiens
tctaaaatgagtt

SEQ ID NO: 5946889 - DNA, 12 bp, Homo sapiens
tctaaaatgatt

SEQ ID NO: 5946890 - DNA, 13 bp, Homo sapiens
tctaaaatgcaaa

SEQ ID NO: 5946891 - DNA, 21 bp, Homo sapiens
tctaaaatgcctcagtgtatt

SEQ ID NO: 5946892 - DNA, 17 bp, Homo sapiens
tctaaaatggacatttt

SEQ ID NO: 5946893 - DNA, 12 bp, Homo sapiens
tctaaaatgtca

SEQ ID NO: 5946894 - DNA, 20 bp, Homo sapiens
tctaaaatgtgatgttctaa

SEQ ID NO: 5946895 - DNA, 12 bp, Homo sapiens
tctaaaatgttt

SEQ ID NO: 5946896 - DNA, 13 bp, Homo sapiens
tctaaaatgtttt

SEQ ID NO: 5946897 - DNA, 19 bp, Homo sapiens
tctaaaatgttttatgaca

SEQ ID NO: 5946898 - DNA, 18 bp, Homo sapiens
tctaaaattataaatgac

SEQ ID NO: 5946899 - DNA, 22 bp, Homo sapiens
tctaaaattgagttcttcctgt

SEQ ID NO: 5946900 - DNA, 23 bp, Homo sapiens
tctaaaattgagttcttcctgta

SEQ ID NO: 5946901 - DNA, 18 bp, Homo sapiens
tctaaaatttaaaattaa

SEQ ID NO: 5946902 - DNA, 15 bp, Homo sapiens
tctaaaatttgtaat

SEQ ID NO: 5946903 - DNA, 12 bp, Homo sapiens
tctaaacaatga

SEQ ID NO: 5946904 - DNA, 20 bp, Homo sapiens
tctaaacaatgaattcttca

SEQ ID NO: 5946905 - DNA, 21 bp, Homo sapiens
tctaaacaatgaattcttcaa

SEQ ID NO: 5946906 - DNA, 20 bp, Homo sapiens
tctaaacaatgctgatttgg

SEQ ID NO: 5946907 - DNA, 23 bp, Homo sapiens
tctaaacacaacaataactttta

SEQ ID NO: 5946908 - DNA, 12 bp, Homo sapiens
tctaaacacaca

SEQ ID NO: 5946909 - DNA, 15 bp, Homo sapiens
tctaaacacacaagt

SEQ ID NO: 5946910 - DNA, 22 bp, Homo sapiens
tctaaacacacttagaatacta

SEQ ID NO: 5946911 - DNA, 19 bp, Homo sapiens
tctaattccaagatccaat

SEQ ID NO: 5946912 - DNA, 22 bp, Homo sapiens
tctaattcccattttgcaaaat

SEQ ID NO: 5946913 - DNA, 13 bp, Homo sapiens
tctaattctaacc

SEQ ID NO: 5946914 - DNA, 21 bp, Homo sapiens
tctaattctattaaagtgcta

SEQ ID NO: 5946915 - DNA, 16 bp, Homo sapiens
tctaattctctaggaa

SEQ ID NO: 5946916 - DNA, 14 bp, Homo sapiens
tctaattctgattc

SEQ ID NO: 5946917 - DNA, 13 bp, Homo sapiens
tctaattcttcat

SEQ ID NO: 5946918 - DNA, 17 bp, Homo sapiens
tctaattcttcctttgt

SEQ ID NO: 5946919 - DNA, 15 bp, Homo sapiens
tctaattcttttcaa

SEQ ID NO: 5946920 - DNA, 17 bp, Homo sapiens
tctaattcttttcaaaa

SEQ ID NO: 5946921 - DNA, 21 bp, Homo sapiens
tctaattgaattttcaagcat

SEQ ID NO: 5946922 - DNA, 19 bp, Homo sapiens
tctaattgcatctcaaaat

SEQ ID NO: 5946923 - DNA, 13 bp, Homo sapiens
tctaattgcttat

SEQ ID NO: 5946924 - DNA, 14 bp, Homo sapiens
tctaattgcttatt

SEQ ID NO: 5946925 - DNA, 12 bp, Homo sapiens
tctaattgtaag

SEQ ID NO: 5946926 - DNA, 19 bp, Homo sapiens
tctaattgtacccttcttg

SEQ ID NO: 5946927 - DNA, 12 bp, Homo sapiens
tctaatttactg

SEQ ID NO: 5946928 - DNA, 13 bp, Homo sapiens
tctaatttataaa

SEQ ID NO: 5946929 - DNA, 14 bp, Homo sapiens
tctaatttataaaa

SEQ ID NO: 5946930 - DNA, 17 bp, Homo sapiens
tctaatttatacaaaat

SEQ ID NO: 5946931 - DNA, 19 bp, Homo sapiens
tctaatttatacaaaataa

SEQ ID NO: 5946932 - DNA, 14 bp, Homo sapiens
tctaatttcattca

SEQ ID NO: 5946933 - DNA, 15 bp, Homo sapiens
tctaatttcattcaa

SEQ ID NO: 5946934 - DNA, 22 bp, Homo sapiens
tctaatttgaactggtattgtt

SEQ ID NO: 5946935 - DNA, 14 bp, Homo sapiens
tctaatttgctgct

SEQ ID NO: 5946936 - DNA, 16 bp, Homo sapiens
tctaattttggatgga

SEQ ID NO: 5946937 - DNA, 16 bp, Homo sapiens
tctaattttgtgctct

SEQ ID NO: 5946938 - DNA, 22 bp, Homo sapiens
tctaattttgtgctctttcctg

SEQ ID NO: 5946939 - DNA, 14 bp, Homo sapiens
tctaatttttaaga

SEQ ID NO: 5946940 - DNA, 15 bp, Homo sapiens
tctaatttttattaa

SEQ ID NO: 5946941 - DNA, 17 bp, Homo sapiens
tctaatttttattcata

SEQ ID NO: 5946942 - DNA, 18 bp, Homo sapiens
tctacaaaaaaccaggat

SEQ ID NO: 5946943 - DNA, 19 bp, Homo sapiens
tctacaaaaaataaaataa

SEQ ID NO: 5946944 - DNA, 22 bp, Homo sapiens
tctacaaaaaatgcagaactta

SEQ ID NO: 5946945 - DNA, 23 bp, Homo sapiens
tctacaaaaaggtataaataata

SEQ ID NO: 5946946 - DNA, 15 bp, Homo sapiens
tctacaaaaatttat

SEQ ID NO: 5946947 - DNA, 14 bp, Homo sapiens
tctacaaaagcaaa

SEQ ID NO: 5946948 - DNA, 23 bp, Homo sapiens
tctacaaaagtgaaccatctcag

SEQ ID NO: 5946949 - DNA, 19 bp, Homo sapiens
tctacaaacttttataaat

SEQ ID NO: 5946950 - DNA, 21 bp, Homo sapiens
tctacaaacttttataaatgt

SEQ ID NO: 5946951 - DNA, 13 bp, Homo sapiens
tctacaaataatt

SEQ ID NO: 5946952 - DNA, 19 bp, Homo sapiens
tctacaaataattttagtg

SEQ ID NO: 5946953 - DNA, 11 bp, Homo sapiens
tctacaaattt

SEQ ID NO: 5946954 - DNA, 17 bp, Homo sapiens
tctacaaatttttctgt

SEQ ID NO: 5946955 - DNA, 13 bp, Homo sapiens
tctacaaccagag

SEQ ID NO: 5946956 - DNA, 23 bp, Homo sapiens
tctacaaccagagccccccacaa

SEQ ID NO: 5946957 - DNA, 17 bp, Homo sapiens
tctacaactcatacact

SEQ ID NO: 5946958 - DNA, 16 bp, Homo sapiens
tctacaactggagttt

SEQ ID NO: 5946959 - DNA, 13 bp, Homo sapiens
tctacaagccaaa

SEQ ID NO: 5946960 - DNA, 23 bp, Homo sapiens
tctacaagccaaaagtccctccc

SEQ ID NO: 5946961 - DNA, 19 bp, Homo sapiens
tctacaaggactttccaaa

SEQ ID NO: 5946962 - DNA, 16 bp, Homo sapiens
tctacaaggtgttcat

SEQ ID NO: 5946963 - DNA, 19 bp, Homo sapiens
tctacaagtatatgtgaaa

SEQ ID NO: 5946964 - DNA, 15 bp, Homo sapiens
tctacaatctattta

SEQ ID NO: 5946965 - DNA, 14 bp, Homo sapiens
tctacaatctcttt

SEQ ID NO: 5946966 - DNA, 19 bp, Homo sapiens
tctacaatctctttttgtt

SEQ ID NO: 5946967 - DNA, 15 bp, Homo sapiens
tctacaatgtgaact

SEQ ID NO: 5946968 - DNA, 14 bp, Homo sapiens
tctacacacccata

SEQ ID NO: 5946969 - DNA, 11 bp, Homo sapiens
tctacacagcc

SEQ ID NO: 5946970 - DNA, 16 bp, Homo sapiens
tctacacagcctggac

SEQ ID NO: 5946971 - DNA, 18 bp, Homo sapiens
tctacacagtaaaaactt

SEQ ID NO: 5946972 - DNA, 14 bp, Homo sapiens
tctacacatacaga

SEQ ID NO: 5946973 - DNA, 19 bp, Homo sapiens
tctacacatacagaaagaa

SEQ ID NO: 5946974 - DNA, 21 bp, Homo sapiens
tctacacatataaacacagta

SEQ ID NO: 5946975 - DNA, 22 bp, Homo sapiens
tctacacatataaacacagtaa

SEQ ID NO: 5946976 - DNA, 21 bp, Homo sapiens
tctacacatataaattgtctt

SEQ ID NO: 5946977 - DNA, 19 bp, Homo sapiens
tctacacatatatgtatat

SEQ ID NO: 5946978 - DNA, 12 bp, Homo sapiens
tctacacatgtt

SEQ ID NO: 5946979 - DNA, 15 bp, Homo sapiens
tctacacatttcatc

SEQ ID NO: 5946980 - DNA, 16 bp, Homo sapiens
tctacacatttcatct

SEQ ID NO: 5946981 - DNA, 15 bp, Homo sapiens
tctacaccaattaat

SEQ ID NO: 5946982 - DNA, 21 bp, Homo sapiens
tctacaccttgcttttttact

SEQ ID NO: 5946983 - DNA, 14 bp, Homo sapiens
tctacacggactga

SEQ ID NO: 5946984 - DNA, 19 bp, Homo sapiens
tctacactaaaatttaaat

SEQ ID NO: 5946985 - DNA, 15 bp, Homo sapiens
tctacactcacaatc

SEQ ID NO: 5946986 - DNA, 15 bp, Homo sapiens
tctacactcatctta

SEQ ID NO: 5946987 - DNA, 11 bp, Homo sapiens
tctacactctc

SEQ ID NO: 5946988 - DNA, 16 bp, Homo sapiens
tctacactgcaatcat

SEQ ID NO: 5946989 - DNA, 13 bp, Homo sapiens
tctacactgcctt

SEQ ID NO: 5946990 - DNA, 22 bp, Homo sapiens
tctacactgccttaccttcact

SEQ ID NO: 5946991 - DNA, 12 bp, Homo sapiens
tctacactgtgc

SEQ ID NO: 5946992 - DNA, 13 bp, Homo sapiens
tctacagaaaaac

SEQ ID NO: 5946993 - DNA, 12 bp, Homo sapiens
tctacagaaaat

SEQ ID NO: 5946994 - DNA, 13 bp, Homo sapiens
tctacagaaaatg

SEQ ID NO: 5946995 - DNA, 15 bp, Homo sapiens
tctacagaacaaaga

SEQ ID NO: 5946996 - DNA, 16 bp, Homo sapiens
tctacagaacaaagaa

SEQ ID NO: 5946997 - DNA, 13 bp, Homo sapiens
tctacagagaaaa

SEQ ID NO: 5946998 - DNA, 21 bp, Homo sapiens
tctacagagaaaatgaatttg

SEQ ID NO: 5946999 - DNA, 17 bp, Homo sapiens
tctacagagcttccctg

SEQ ID NO: 5947000 - DNA, 19 bp, Homo sapiens
tctacagagcttccctgac

SEQ ID NO: 5947001 - DNA, 16 bp, Homo sapiens
tctacagaggccatgg

SEQ ID NO: 5947002 - DNA, 21 bp, Homo sapiens
tctacagatcctttttccatc

SEQ ID NO: 5947003 - DNA, 23 bp, Homo sapiens
tctacagatcctttttccatcat

SEQ ID NO: 5947004 - DNA, 18 bp, Homo sapiens
tctacagatgagtcacac

SEQ ID NO: 5947005 - DNA, 16 bp, Homo sapiens
tctacagatgtcccat

SEQ ID NO: 5947006 - DNA, 14 bp, Homo sapiens
tctacagcaaattt

SEQ ID NO: 5947007 - DNA, 19 bp, Homo sapiens
tctacagccttgtccccct

SEQ ID NO: 5947008 - DNA, 20 bp, Homo sapiens
tctacagctcccccagctcc

SEQ ID NO: 5947009 - DNA, 21 bp, Homo sapiens
tctacagcttctattcattat

SEQ ID NO: 5947010 - DNA, 15 bp, Homo sapiens
tctacaggaaataca

SEQ ID NO: 5947011 - DNA, 23 bp, Homo sapiens
tctacaggacaaagggagggagc

SEQ ID NO: 5947012 - DNA, 17 bp, Homo sapiens
tctacaggcctgcagcc

SEQ ID NO: 5947013 - DNA, 20 bp, Homo sapiens
tctacaggcctgcagcccct

SEQ ID NO: 5947014 - DNA, 20 bp, Homo sapiens
tctacaggtccgtttcctta

SEQ ID NO: 5947015 - DNA, 18 bp, Homo sapiens
tctacagtacttccagat

SEQ ID NO: 5947016 - DNA, 18 bp, Homo sapiens
tctacagtcgtaaaagag

SEQ ID NO: 5947017 - DNA, 22 bp, Homo sapiens
tctacagtggttttatactgaa

SEQ ID NO: 5947018 - DNA, 23 bp, Homo sapiens
tctacagttaattatgtgcatat

SEQ ID NO: 5947019 - DNA, 23 bp, Homo sapiens
tctacatatgataggcagcactg

SEQ ID NO: 5947020 - DNA, 16 bp, Homo sapiens
tctacatatgatctgt

SEQ ID NO: 5947021 - DNA, 21 bp, Homo sapiens
tctacatatgatctgtctgtg

SEQ ID NO: 5947022 - DNA, 12 bp, Homo sapiens
tctacatcactc

SEQ ID NO: 5947023 - DNA, 12 bp, Homo sapiens
tctacatctttt

SEQ ID NO: 5947024 - DNA, 19 bp, Homo sapiens
tctacatcttttttcacaa

SEQ ID NO: 5947025 - DNA, 11 bp, Homo sapiens
tctacatgtga

SEQ ID NO: 5947026 - DNA, 14 bp, Homo sapiens
tctacatgtgccac

SEQ ID NO: 5947027 - DNA, 20 bp, Homo sapiens
tctacatgtgccaccaacat

SEQ ID NO: 5947028 - DNA, 14 bp, Homo sapiens
tctacattaaaatg

SEQ ID NO: 5947029 - DNA, 17 bp, Homo sapiens
tctacattaaaatgaca

SEQ ID NO: 5947030 - DNA, 20 bp, Homo sapiens
tctacattaaaatgacaaac

SEQ ID NO: 5947031 - DNA, 15 bp, Homo sapiens
tctacattaaatcac

SEQ ID NO: 5947032 - DNA, 17 bp, Homo sapiens
tctacattaacttgaaa

SEQ ID NO: 5947033 - DNA, 15 bp, Homo sapiens
tctacattctctatt

SEQ ID NO: 5947034 - DNA, 17 bp, Homo sapiens
tctacattctctatttt

SEQ ID NO: 5947035 - DNA, 20 bp, Homo sapiens
tctacattcttggttgttaa

SEQ ID NO: 5947036 - DNA, 18 bp, Homo sapiens
tctacattgagcatttga

SEQ ID NO: 5947037 - DNA, 20 bp, Homo sapiens
tctacattgagcatttgaaa

SEQ ID NO: 5947038 - DNA, 11 bp, Homo sapiens
tctacatttaa

SEQ ID NO: 5947039 - DNA, 20 bp, Homo sapiens
tctacatttaaacaagtatt

SEQ ID NO: 5947040 - DNA, 11 bp, Homo sapiens
tctacatttca

SEQ ID NO: 5947041 - DNA, 22 bp, Homo sapiens
tctacatttgcagatgttcaaa

SEQ ID NO: 5947042 - DNA, 16 bp, Homo sapiens
tctacatttgtttgta

SEQ ID NO: 5947043 - DNA, 21 bp, Homo sapiens
tctacattttttaaaactgaa

SEQ ID NO: 5947044 - DNA, 17 bp, Homo sapiens
tctaccaaataatttca

SEQ ID NO: 5947045 - DNA, 17 bp, Homo sapiens
tctaccaacctgttcaa

SEQ ID NO: 5947046 - DNA, 14 bp, Homo sapiens
tctaccaactttca

SEQ ID NO: 5947047 - DNA, 18 bp, Homo sapiens
tctaccaagacataatgc

SEQ ID NO: 5947048 - DNA, 19 bp, Homo sapiens
tctaccaagacataatgca

SEQ ID NO: 5947049 - DNA, 16 bp, Homo sapiens
tctaccacacacagcc

SEQ ID NO: 5947050 - DNA, 17 bp, Homo sapiens
tctaccacacacagcct

SEQ ID NO: 5947051 - DNA, 17 bp, Homo sapiens
tctaccaccacaccaaa

SEQ ID NO: 5947052 - DNA, 20 bp, Homo sapiens
tctaccactggtgtaaaaaa

SEQ ID NO: 5947053 - DNA, 23 bp, Homo sapiens
tctaccactggtgtaaaaaacaa

SEQ ID NO: 5947054 - DNA, 13 bp, Homo sapiens
tctaccagactgt

SEQ ID NO: 5947055 - DNA, 17 bp, Homo sapiens
tctaccagactgtgtat

SEQ ID NO: 5947056 - DNA, 14 bp, Homo sapiens
tctaccagtctatt

SEQ ID NO: 5947057 - DNA, 23 bp, Homo sapiens
tctaccagtgcaggctggccagc

SEQ ID NO: 5947058 - DNA, 21 bp, Homo sapiens
tctaccagttggcagacagcc

SEQ ID NO: 5947059 - DNA, 12 bp, Homo sapiens
tctaccatctcc

SEQ ID NO: 5947060 - DNA, 18 bp, Homo sapiens
tctaccatttcagagagg

SEQ ID NO: 5947061 - DNA, 17 bp, Homo sapiens
tctaccattttctggtt

SEQ ID NO: 5947062 - DNA, 16 bp, Homo sapiens
tctacccaaaccctag

SEQ ID NO: 5947063 - DNA, 13 bp, Homo sapiens
tctacccaaagga

SEQ ID NO: 5947064 - DNA, 12 bp, Homo sapiens
tctacccagact

SEQ ID NO: 5947065 - DNA, 22 bp, Homo sapiens
tctacccagagaagccccttcc

SEQ ID NO: 5947066 - DNA, 23 bp, Homo sapiens
tctacccagagccttctcctgcc

SEQ ID NO: 5947067 - DNA, 16 bp, Homo sapiens
tctacccagcccatct

SEQ ID NO: 5947068 - DNA, 20 bp, Homo sapiens
tctacccagcgagccctggt

SEQ ID NO: 5947069 - DNA, 13 bp, Homo sapiens
tctacccagggcc

SEQ ID NO: 5947070 - DNA, 16 bp, Homo sapiens
tctacccagggcctgc

SEQ ID NO: 5947071 - DNA, 19 bp, Homo sapiens
tctacccatctcccccatc

SEQ ID NO: 5947072 - DNA, 17 bp, Homo sapiens
tctacccatgagcctgc

SEQ ID NO: 5947073 - DNA, 21 bp, Homo sapiens
tctacccatgagcctgcccgc

SEQ ID NO: 5947074 - DNA, 23 bp, Homo sapiens
tctacccatgttgggaaaaactg

SEQ ID NO: 5947075 - DNA, 16 bp, Homo sapiens
tctaccccaaggccag

SEQ ID NO: 5947076 - DNA, 16 bp, Homo sapiens
tctaccccagactaga

SEQ ID NO: 5947077 - DNA, 18 bp, Homo sapiens
tctaccccagactagatg

SEQ ID NO: 5947078 - DNA, 21 bp, Homo sapiens
tctaccccagggagaatctga

SEQ ID NO: 5947079 - DNA, 23 bp, Homo sapiens
tctacccctcccggccctgcctg

SEQ ID NO: 5947080 - DNA, 12 bp, Homo sapiens
tctacccctgct

SEQ ID NO: 5947081 - DNA, 14 bp, Homo sapiens
tctacccctttctt

SEQ ID NO: 5947082 - DNA, 18 bp, Homo sapiens
tctacccctttcttctcg

SEQ ID NO: 5947083 - DNA, 16 bp, Homo sapiens
tctacccggcccagag

SEQ ID NO: 5947084 - DNA, 15 bp, Homo sapiens
tctacccgttccaaa

SEQ ID NO: 5947085 - DNA, 21 bp, Homo sapiens
tctaccctctggttgggagat

SEQ ID NO: 5947086 - DNA, 16 bp, Homo sapiens
tctaccctgcagcttg

SEQ ID NO: 5947087 - DNA, 15 bp, Homo sapiens
tctaccctgctccct

SEQ ID NO: 5947088 - DNA, 21 bp, Homo sapiens
tctaccctggcactataatgt

SEQ ID NO: 5947089 - DNA, 12 bp, Homo sapiens
tctaccctggga

SEQ ID NO: 5947090 - DNA, 17 bp, Homo sapiens
tctagggaaatgaaaga

SEQ ID NO: 5947091 - DNA, 19 bp, Homo sapiens
tctagggaaggccacctgc

SEQ ID NO: 5947092 - DNA, 18 bp, Homo sapiens
tctagggacccctcctcc

SEQ ID NO: 5947093 - DNA, 23 bp, Homo sapiens
tctagggacccctcgccccagcc

SEQ ID NO: 5947094 - DNA, 22 bp, Homo sapiens
tctagggatataaaaacagatt

SEQ ID NO: 5947095 - DNA, 13 bp, Homo sapiens
tctagggcagagt

SEQ ID NO: 5947096 - DNA, 22 bp, Homo sapiens
tctagggcggagaggctgcact

SEQ ID NO: 5947097 - DNA, 19 bp, Homo sapiens
tctagggctgggaaacact

SEQ ID NO: 5947098 - DNA, 14 bp, Homo sapiens
tctaggggcagcct

SEQ ID NO: 5947099 - DNA, 17 bp, Homo sapiens
tctaggggcagcctccg

SEQ ID NO: 5947100 - DNA, 19 bp, Homo sapiens
tctaggggtagctggtggt

SEQ ID NO: 5947101 - DNA, 19 bp, Homo sapiens
tctaggggtcaggctccat

SEQ ID NO: 5947102 - DNA, 18 bp, Homo sapiens
tctagggtccctgaacgc

SEQ ID NO: 5947103 - DNA, 15 bp, Homo sapiens
tctaggtaaattaca

SEQ ID NO: 5947104 - DNA, 21 bp, Homo sapiens
tctaggtacgatgacagtgtt

SEQ ID NO: 5947105 - DNA, 17 bp, Homo sapiens
tctaggtcctggcttct

SEQ ID NO: 5947106 - DNA, 11 bp, Homo sapiens
tctaggtcttg

SEQ ID NO: 5947107 - DNA, 21 bp, Homo sapiens
tctaggtcttggttagagaag

SEQ ID NO: 5947108 - DNA, 21 bp, Homo sapiens
tctaggtggaggttgtgcatg

SEQ ID NO: 5947109 - DNA, 17 bp, Homo sapiens
tctaggtggcaggacaa

SEQ ID NO: 5947110 - DNA, 20 bp, Homo sapiens
tctaggttaaagctaaactg

SEQ ID NO: 5947111 - DNA, 16 bp, Homo sapiens
tctaggttatacaata

SEQ ID NO: 5947112 - DNA, 17 bp, Homo sapiens
tctaggtttaactcaga

SEQ ID NO: 5947113 - DNA, 19 bp, Homo sapiens
tctaggtttaactcagatc

SEQ ID NO: 5947114 - DNA, 20 bp, Homo sapiens
tctaggtttaactcagatca

SEQ ID NO: 5947115 - DNA, 17 bp, Homo sapiens
tctaggtttatgacagt

SEQ ID NO: 5947116 - DNA, 16 bp, Homo sapiens
tctagtaacaatacat

SEQ ID NO: 5947117 - DNA, 19 bp, Homo sapiens
tctagtaataaagactcta

SEQ ID NO: 5947118 - DNA, 14 bp, Homo sapiens
tctagtaatatatt

SEQ ID NO: 5947119 - DNA, 14 bp, Homo sapiens
tctagtacataatt

SEQ ID NO: 5947120 - DNA, 17 bp, Homo sapiens
tctagtacctgtgactc

SEQ ID NO: 5947121 - DNA, 17 bp, Homo sapiens
tctagtacttgaaaaag

SEQ ID NO: 5947122 - DNA, 13 bp, Homo sapiens
tctagtagaaaga

SEQ ID NO: 5947123 - DNA, 19 bp, Homo sapiens
tctagtagttagaaattaa

SEQ ID NO: 5947124 - DNA, 19 bp, Homo sapiens
tctagtagttgttctgaaa

SEQ ID NO: 5947125 - DNA, 23 bp, Homo sapiens
tctagtatctattgtgttggctt

SEQ ID NO: 5947126 - DNA, 15 bp, Homo sapiens
tctagtatgaaatta

SEQ ID NO: 5947127 - DNA, 17 bp, Homo sapiens
tctagtatgaaattata

SEQ ID NO: 5947128 - DNA, 14 bp, Homo sapiens
tctagtatgtcttg

SEQ ID NO: 5947129 - DNA, 22 bp, Homo sapiens
tctagtatgtcttgaaacatgt

SEQ ID NO: 5947130 - DNA, 23 bp, Homo sapiens
tctagtatgtcttgaaacatgtt

SEQ ID NO: 5947131 - DNA, 24 bp, Homo sapiens
tctagtattccagacctgaagaat

SEQ ID NO: 5947132 - DNA, 16 bp, Homo sapiens
tctagtatttgaacaa

SEQ ID NO: 5947133 - DNA, 15 bp, Homo sapiens
tctagtattttatct

SEQ ID NO: 5947134 - DNA, 17 bp, Homo sapiens
tctagtcaactgctgtt

SEQ ID NO: 5947135 - DNA, 18 bp, Homo sapiens
tctagtcaactgctgttt

SEQ ID NO: 5947136 - DNA, 22 bp, Homo sapiens
tctagtcaactgctgttttatg

SEQ ID NO: 5947137 - DNA, 11 bp, Homo sapiens
tctagtcaata

SEQ ID NO: 5947138 - DNA, 15 bp, Homo sapiens
tctagtcacataaat

SEQ ID NO: 5947139 - DNA, 22 bp, Homo sapiens
tctagtcccttctctctttcta

SEQ ID NO: 5947140 - DNA, 18 bp, Homo sapiens
tctagtccgtcctggcac

SEQ ID NO: 5947141 - DNA, 16 bp, Homo sapiens
tctagtcctattctat

SEQ ID NO: 5947142 - DNA, 14 bp, Homo sapiens
tctagtccttgtct

SEQ ID NO: 5947143 - DNA, 20 bp, Homo sapiens
tctagtctcctttgcactga

SEQ ID NO: 5947144 - DNA, 22 bp, Homo sapiens
tctagtctcctttgcactgagg

SEQ ID NO: 5947145 - DNA, 16 bp, Homo sapiens
tctagtctctgatttg

SEQ ID NO: 5947146 - DNA, 15 bp, Homo sapiens
tctagtctgagcttc

SEQ ID NO: 5947147 - DNA, 19 bp, Homo sapiens
tctagtctggaactgctgc

SEQ ID NO: 5947148 - DNA, 22 bp, Homo sapiens
tctagtctggaactgctgctga

SEQ ID NO: 5947149 - DNA, 23 bp, Homo sapiens
tctagtctggaactgctgctgac

SEQ ID NO: 5947150 - DNA, 14 bp, Homo sapiens
tctagtgaaactgc

SEQ ID NO: 5947151 - DNA, 14 bp, Homo sapiens
tctagtgaagatgt

SEQ ID NO: 5947152 - DNA, 11 bp, Homo sapiens
tctagtgaatg

SEQ ID NO: 5947153 - DNA, 23 bp, Homo sapiens
tctagtgataagaattcttaaca

SEQ ID NO: 5947154 - DNA, 15 bp, Homo sapiens
tctagtgatttcctg

SEQ ID NO: 5947155 - DNA, 17 bp, Homo sapiens
tctagtgcagctgaaat

SEQ ID NO: 5947156 - DNA, 20 bp, Homo sapiens
tctagtgcagctgaaattga

SEQ ID NO: 5947157 - DNA, 16 bp, Homo sapiens
tctagtgcagctgatt

SEQ ID NO: 5947158 - DNA, 15 bp, Homo sapiens
tctagtgcaggaaaa

SEQ ID NO: 5947159 - DNA, 16 bp, Homo sapiens
tctagtgccattattt

SEQ ID NO: 5947160 - DNA, 20 bp, Homo sapiens
tctagtgccctccacagccg

SEQ ID NO: 5947161 - DNA, 23 bp, Homo sapiens
tctagtgccttctaaaggtgttg

SEQ ID NO: 5947162 - DNA, 15 bp, Homo sapiens
tctagtgctaaacct

SEQ ID NO: 5947163 - DNA, 23 bp, Homo sapiens
tctagtgctaaacctatctgtat

SEQ ID NO: 5947164 - DNA, 15 bp, Homo sapiens
tctagtgctgtgaaa

SEQ ID NO: 5947165 - DNA, 21 bp, Homo sapiens
tctagtggaaagattgtgtct

SEQ ID NO: 5947166 - DNA, 22 bp, Homo sapiens
tctagtggaaagattgtgtctg

SEQ ID NO: 5947167 - DNA, 24 bp, Homo sapiens
tctagtgggacagcccagagcctg

SEQ ID NO: 5947168 - DNA, 16 bp, Homo sapiens
tctagtggtctgattt

SEQ ID NO: 5947169 - DNA, 16 bp, Homo sapiens
tctagtggtctttgta

SEQ ID NO: 5947170 - DNA, 17 bp, Homo sapiens
tctagtgtatactctgt

SEQ ID NO: 5947171 - DNA, 21 bp, Homo sapiens
tctagtgtatactctgtagtc

SEQ ID NO: 5947172 - DNA, 22 bp, Homo sapiens
tctagtgtatactctgtagtct

SEQ ID NO: 5947173 - DNA, 16 bp, Homo sapiens
tctagtgtatcaaaat

SEQ ID NO: 5947174 - DNA, 12 bp, Homo sapiens
tctagtgttcag

SEQ ID NO: 5947175 - DNA, 17 bp, Homo sapiens
tctagtgtttgattgtc

SEQ ID NO: 5947176 - DNA, 20 bp, Homo sapiens
tctagtgtttttttccctct

SEQ ID NO: 5947177 - DNA, 15 bp, Homo sapiens
tctagttaagtcgct

SEQ ID NO: 5947178 - DNA, 17 bp, Homo sapiens
tctagttagcaggaaat

SEQ ID NO: 5947179 - DNA, 18 bp, Homo sapiens
tctagttagctgctttaa

SEQ ID NO: 5947180 - DNA, 14 bp, Homo sapiens
tctagttatttatt

SEQ ID NO: 5947181 - DNA, 12 bp, Homo sapiens
tctagttcaaga

SEQ ID NO: 5947182 - DNA, 12 bp, Homo sapiens
tctagttcactc

SEQ ID NO: 5947183 - DNA, 16 bp, Homo sapiens
tctagttcagaaggaa

SEQ ID NO: 5947184 - DNA, 21 bp, Homo sapiens
tctagttccctcagtgtgaag

SEQ ID NO: 5947185 - DNA, 12 bp, Homo sapiens
tctagttctaga

SEQ ID NO: 5947186 - DNA, 13 bp, Homo sapiens
tctagttctagat

SEQ ID NO: 5947187 - DNA, 15 bp, Homo sapiens
tctagttctgccagg

SEQ ID NO: 5947188 - DNA, 13 bp, Homo sapiens
tctagttctttgt

SEQ ID NO: 5947189 - DNA, 16 bp, Homo sapiens
tctagttgacttcaaa

SEQ ID NO: 5947190 - DNA, 21 bp, Homo sapiens
tctagttgaggagtttcctaa

SEQ ID NO: 5947191 - DNA, 22 bp, Homo sapiens
tctagttggttgatgccttttt

SEQ ID NO: 5947192 - DNA, 22 bp, Homo sapiens
tctagttgtggacttttcccca

SEQ ID NO: 5947193 - DNA, 12 bp, Homo sapiens
tctagtttcctg

SEQ ID NO: 5947194 - DNA, 21 bp, Homo sapiens
tctagtttctcaaaaccctta

SEQ ID NO: 5947195 - DNA, 16 bp, Homo sapiens
tctagtttctttctgt

SEQ ID NO: 5947196 - DNA, 15 bp, Homo sapiens
tctagtttcttttga

SEQ ID NO: 5947197 - DNA, 22 bp, Homo sapiens
tctagtttgattaaattcttgc

SEQ ID NO: 5947198 - DNA, 11 bp, Homo sapiens
tctagttttca

SEQ ID NO: 5947199 - DNA, 22 bp, Homo sapiens
tctagtttttggaaaaaccttg

SEQ ID NO: 5947200 - DNA, 20 bp, Homo sapiens
tctagttttttcttcctttt

SEQ ID NO: 5947201 - DNA, 18 bp, Homo sapiens
tctagttttttttgtaaa

SEQ ID NO: 5947202 - DNA, 12 bp, Homo sapiens
tctataaaaata

SEQ ID NO: 5947203 - DNA, 16 bp, Homo sapiens
tctataaaactctgca

SEQ ID NO: 5947204 - DNA, 17 bp, Homo sapiens
tctataaaatagatata

SEQ ID NO: 5947205 - DNA, 19 bp, Homo sapiens
tctataaaatagatataaa

SEQ ID NO: 5947206 - DNA, 14 bp, Homo sapiens
tctataaacatgaa

SEQ ID NO: 5947207 - DNA, 13 bp, Homo sapiens
tctataaaccgaa

SEQ ID NO: 5947208 - DNA, 21 bp, Homo sapiens
tctataaactataacctctcc

SEQ ID NO: 5947209 - DNA, 15 bp, Homo sapiens
tctataaagaaactt

SEQ ID NO: 5947210 - DNA, 16 bp, Homo sapiens
tctataaagaaacttt

SEQ ID NO: 5947211 - DNA, 21 bp, Homo sapiens
tctataaagaaacttttgaaa

SEQ ID NO: 5947212 - DNA, 22 bp, Homo sapiens
tctataaagaaacttttgaaaa

SEQ ID NO: 5947213 - DNA, 20 bp, Homo sapiens
tctataaagaagaacttgca

SEQ ID NO: 5947214 - DNA, 20 bp, Homo sapiens
tctataaagcatttaacccc

SEQ ID NO: 5947215 - DNA, 13 bp, Homo sapiens
tctataaagggtc

SEQ ID NO: 5947216 - DNA, 12 bp, Homo sapiens
tctataaagtat

SEQ ID NO: 5947217 - DNA, 13 bp, Homo sapiens
tctataaatatat

SEQ ID NO: 5947218 - DNA, 15 bp, Homo sapiens
tctataaatgaatgt

SEQ ID NO: 5947219 - DNA, 16 bp, Homo sapiens
tctataaatgaatgtg

SEQ ID NO: 5947220 - DNA, 21 bp, Homo sapiens
tctataaatgactattgtaat

SEQ ID NO: 5947221 - DNA, 22 bp, Homo sapiens
tctataacaaaggatacttatt

SEQ ID NO: 5947222 - DNA, 16 bp, Homo sapiens
tctataacagaaagtt

SEQ ID NO: 5947223 - DNA, 22 bp, Homo sapiens
tctataacagatcctttcaaaa

SEQ ID NO: 5947224 - DNA, 16 bp, Homo sapiens
tctataagtagtaaat

SEQ ID NO: 5947225 - DNA, 21 bp, Homo sapiens
tctataagtagtaaatcagaa

SEQ ID NO: 5947226 - DNA, 16 bp, Homo sapiens
tctataagtatataaa

SEQ ID NO: 5947227 - DNA, 19 bp, Homo sapiens
tctataagtatataaatac

SEQ ID NO: 5947228 - DNA, 18 bp, Homo sapiens
tctataagtgttcagtgt

SEQ ID NO: 5947229 - DNA, 22 bp, Homo sapiens
tctataagtgttcagtgttgac

SEQ ID NO: 5947230 - DNA, 18 bp, Homo sapiens
tctataagttgtaccaaa

SEQ ID NO: 5947231 - DNA, 20 bp, Homo sapiens
tctataagttgtaccaaaac

SEQ ID NO: 5947232 - DNA, 23 bp, Homo sapiens
tctataatgaacatgaaggcttt

SEQ ID NO: 5947233 - DNA, 15 bp, Homo sapiens
tctataatgtgcctg

SEQ ID NO: 5947234 - DNA, 16 bp, Homo sapiens
tctataatttacctaa

SEQ ID NO: 5947235 - DNA, 22 bp, Homo sapiens
tctataatttccatttacttaa

SEQ ID NO: 5947236 - DNA, 13 bp, Homo sapiens
tctatacaaaaaa

SEQ ID NO: 5947237 - DNA, 21 bp, Homo sapiens
tctatacaaatataaatctta

SEQ ID NO: 5947238 - DNA, 18 bp, Homo sapiens
tctatacacaccctgccc

SEQ ID NO: 5947239 - DNA, 22 bp, Homo sapiens
tctatacagtagcttgaaattg

SEQ ID NO: 5947240 - DNA, 14 bp, Homo sapiens
tctatacatgtttg

SEQ ID NO: 5947241 - DNA, 17 bp, Homo sapiens
tctataccaataaagtg

SEQ ID NO: 5947242 - DNA, 14 bp, Homo sapiens
tctatacctgcctt

SEQ ID NO: 5947243 - DNA, 15 bp, Homo sapiens
tctatacctgtgtcc

SEQ ID NO: 5947244 - DNA, 17 bp, Homo sapiens
tctatactgtggcctgc

SEQ ID NO: 5947245 - DNA, 20 bp, Homo sapiens
tctatactgtggcctgcagg

SEQ ID NO: 5947246 - DNA, 14 bp, Homo sapiens
tctatactttctca

SEQ ID NO: 5947247 - DNA, 16 bp, Homo sapiens
tctatactttgttctg

SEQ ID NO: 5947248 - DNA, 21 bp, Homo sapiens
tctatagaaaaagtaaaagat

SEQ ID NO: 5947249 - DNA, 14 bp, Homo sapiens
tctatagaaagtgt

SEQ ID NO: 5947250 - DNA, 16 bp, Homo sapiens
tctatagaaagtgttc

SEQ ID NO: 5947251 - DNA, 19 bp, Homo sapiens
tctatagaaagtgttctgt

SEQ ID NO: 5947252 - DNA, 16 bp, Homo sapiens
tctatagactctagga

SEQ ID NO: 5947253 - DNA, 17 bp, Homo sapiens
tctatagcagtcatcat

SEQ ID NO: 5947254 - DNA, 17 bp, Homo sapiens
tctatagcatcacttaa

SEQ ID NO: 5947255 - DNA, 20 bp, Homo sapiens
tctatagcatcacttaaaac

SEQ ID NO: 5947256 - DNA, 16 bp, Homo sapiens
tctatagcatttaaag

SEQ ID NO: 5947257 - DNA, 17 bp, Homo sapiens
tctatagccaaaaatag

SEQ ID NO: 5947258 - DNA, 19 bp, Homo sapiens
tctatagccataaacctga

SEQ ID NO: 5947259 - DNA, 13 bp, Homo sapiens
tctatagctcttc

SEQ ID NO: 5947260 - DNA, 23 bp, Homo sapiens
tctataggtcatgatttctgtga

SEQ ID NO: 5947261 - DNA, 18 bp, Homo sapiens
tctataggtgtcttcaga

SEQ ID NO: 5947262 - DNA, 13 bp, Homo sapiens
tctatataaaaaa

SEQ ID NO: 5947263 - DNA, 21 bp, Homo sapiens
tctatataaaaaatatatgta

SEQ ID NO: 5947264 - DNA, 22 bp, Homo sapiens
tctatataaaaaatatatgtaa

SEQ ID NO: 5947265 - DNA, 12 bp, Homo sapiens
tctatataaaat

SEQ ID NO: 5947266 - DNA, 14 bp, Homo sapiens
tctatataaaataa

SEQ ID NO: 5947267 - DNA, 19 bp, Homo sapiens
tctcaggaggggcagcgca

SEQ ID NO: 5947268 - DNA, 20 bp, Homo sapiens
tctcaggaggtgtctcctac

SEQ ID NO: 5947269 - DNA, 13 bp, Homo sapiens
tctcaggatccaa

SEQ ID NO: 5947270 - DNA, 15 bp, Homo sapiens
tctcaggatccaagc

SEQ ID NO: 5947271 - DNA, 13 bp, Homo sapiens
tctcaggcaccag

SEQ ID NO: 5947272 - DNA, 20 bp, Homo sapiens
tctcaggcaccagtccctgt

SEQ ID NO: 5947273 - DNA, 19 bp, Homo sapiens
tctcaggccacctgccccc

SEQ ID NO: 5947274 - DNA, 13 bp, Homo sapiens
tctcaggccagct

SEQ ID NO: 5947275 - DNA, 18 bp, Homo sapiens
tctcaggccagctgcttg

SEQ ID NO: 5947276 - DNA, 21 bp, Homo sapiens
tctcaggccagctgcttgggc

SEQ ID NO: 5947277 - DNA, 21 bp, Homo sapiens
tctcaggccccgggcttccct

SEQ ID NO: 5947278 - DNA, 21 bp, Homo sapiens
tctcaggccctgaaggttcct

SEQ ID NO: 5947279 - DNA, 17 bp, Homo sapiens
tctcaggccgagagcct

SEQ ID NO: 5947280 - DNA, 23 bp, Homo sapiens
tctcaggccggcagccccagcct

SEQ ID NO: 5947281 - DNA, 15 bp, Homo sapiens
tctcaggcctctgct

SEQ ID NO: 5947282 - DNA, 17 bp, Homo sapiens
tctcaggctaggccagc

SEQ ID NO: 5947283 - DNA, 18 bp, Homo sapiens
tctcaggctaggccagca

SEQ ID NO: 5947284 - DNA, 22 bp, Homo sapiens
tctcaggctaggccagcagggg

SEQ ID NO: 5947285 - DNA, 14 bp, Homo sapiens
tctcaggctctgcc

SEQ ID NO: 5947286 - DNA, 17 bp, Homo sapiens
tctcaggctctgccctg

SEQ ID NO: 5947287 - DNA, 20 bp, Homo sapiens
tctcaggctggcatctcccc

SEQ ID NO: 5947288 - DNA, 18 bp, Homo sapiens
tctcaggctggtgggagg

SEQ ID NO: 5947289 - DNA, 19 bp, Homo sapiens
tctcaggctgtcccaagct

SEQ ID NO: 5947290 - DNA, 23 bp, Homo sapiens
tctcaggctgtcccaagctccca

SEQ ID NO: 5947291 - DNA, 15 bp, Homo sapiens
tctcaggctgtgctt

SEQ ID NO: 5947292 - DNA, 19 bp, Homo sapiens
tctcaggctgtgcttacct

SEQ ID NO: 5947293 - DNA, 15 bp, Homo sapiens
tctcaggcttctgca

SEQ ID NO: 5947294 - DNA, 18 bp, Homo sapiens
tctcagggaactgaccct

SEQ ID NO: 5947295 - DNA, 21 bp, Homo sapiens
tctcagggaactgaccctcag

SEQ ID NO: 5947296 - DNA, 16 bp, Homo sapiens
tctcagggaagcccag

SEQ ID NO: 5947297 - DNA, 12 bp, Homo sapiens
tctcagggaggg

SEQ ID NO: 5947298 - DNA, 19 bp, Homo sapiens
tctcagggatggagggaag

SEQ ID NO: 5947299 - DNA, 17 bp, Homo sapiens
tctcagggcctggcagg

SEQ ID NO: 5947300 - DNA, 22 bp, Homo sapiens
tctcagggcctggcaggccagt

SEQ ID NO: 5947301 - DNA, 14 bp, Homo sapiens
tctcagggcctggt

SEQ ID NO: 5947302 - DNA, 21 bp, Homo sapiens
tctcagggctggagcctgggg

SEQ ID NO: 5947303 - DNA, 22 bp, Homo sapiens
tctcaggggccagtgagggctg

SEQ ID NO: 5947304 - DNA, 16 bp, Homo sapiens
tctcaggggctgtttg

SEQ ID NO: 5947305 - DNA, 18 bp, Homo sapiens
tctcagggtcactgtcct

SEQ ID NO: 5947306 - DNA, 16 bp, Homo sapiens
tctcagggtctctgct

SEQ ID NO: 5947307 - DNA, 18 bp, Homo sapiens
tctcagggtctctgctgc

SEQ ID NO: 5947308 - DNA, 19 bp, Homo sapiens
tctcagggtctctgctgcc

SEQ ID NO: 5947309 - DNA, 20 bp, Homo sapiens
tctcagggtctctgctgccg

SEQ ID NO: 5947310 - DNA, 18 bp, Homo sapiens
tctcagggtgtcccagac

SEQ ID NO: 5947311 - DNA, 22 bp, Homo sapiens
tctcagggttctgagtcagagg

SEQ ID NO: 5947312 - DNA, 13 bp, Homo sapiens
tctcaggtcactc

SEQ ID NO: 5947313 - DNA, 14 bp, Homo sapiens
tctcaggtcactcc

SEQ ID NO: 5947314 - DNA, 14 bp, Homo sapiens
tctcaggtccagct

SEQ ID NO: 5947315 - DNA, 22 bp, Homo sapiens
tctcaggtgacggactcagact

SEQ ID NO: 5947316 - DNA, 19 bp, Homo sapiens
tctcaggtgacgtgattct

SEQ ID NO: 5947317 - DNA, 20 bp, Homo sapiens
tctcaggtgacgtgattcta

SEQ ID NO: 5947318 - DNA, 14 bp, Homo sapiens
tctcaggtgccact

SEQ ID NO: 5947319 - DNA, 15 bp, Homo sapiens
tctcaggtgccactc

SEQ ID NO: 5947320 - DNA, 17 bp, Homo sapiens
tctcaggtgccactccc

SEQ ID NO: 5947321 - DNA, 22 bp, Homo sapiens
tctcaggtgccactccctgagc

SEQ ID NO: 5947322 - DNA, 23 bp, Homo sapiens
tctcaggtggaggcaacagggcc

SEQ ID NO: 5947323 - DNA, 20 bp, Homo sapiens
tctcaggtttgttttgtgaa

SEQ ID NO: 5947324 - DNA, 17 bp, Homo sapiens
tctcagtactttggagg

SEQ ID NO: 5947325 - DNA, 21 bp, Homo sapiens
tctcagtcactttttcccctg

SEQ ID NO: 5947326 - DNA, 22 bp, Homo sapiens
tctcagtcactttttcccctgc

SEQ ID NO: 5947327 - DNA, 20 bp, Homo sapiens
tctcagtcatgcataaatat

SEQ ID NO: 5947328 - DNA, 18 bp, Homo sapiens
tctcagtccagcagtttc

SEQ ID NO: 5947329 - DNA, 16 bp, Homo sapiens
tctcagtcctaatttg

SEQ ID NO: 5947330 - DNA, 13 bp, Homo sapiens
tctcagtctcaca

SEQ ID NO: 5947331 - DNA, 11 bp, Homo sapiens
tctcagtctct

SEQ ID NO: 5947332 - DNA, 15 bp, Homo sapiens
tctcagtctctgagc

SEQ ID NO: 5947333 - DNA, 18 bp, Homo sapiens
tctcagtctctgagcagt

SEQ ID NO: 5947334 - DNA, 13 bp, Homo sapiens
tctcagtcttttc

SEQ ID NO: 5947335 - DNA, 20 bp, Homo sapiens
tctcagtgaagactatgaaa

SEQ ID NO: 5947336 - DNA, 18 bp, Homo sapiens
tctcagtgatttcctaca

SEQ ID NO: 5947337 - DNA, 21 bp, Homo sapiens
tctcagtgccaactgtggctg

SEQ ID NO: 5947338 - DNA, 14 bp, Homo sapiens
tctcagtgccttct

SEQ ID NO: 5947339 - DNA, 16 bp, Homo sapiens
tctcagtgccttctct

SEQ ID NO: 5947340 - DNA, 21 bp, Homo sapiens
tctcagtgtgcccttctctta

SEQ ID NO: 5947341 - DNA, 22 bp, Homo sapiens
tctcagtgtgcccttctcttat

SEQ ID NO: 5947342 - DNA, 23 bp, Homo sapiens
tctcagtgtgtgtgtgtggtcca

SEQ ID NO: 5947343 - DNA, 14 bp, Homo sapiens
tctcagtgttggta

SEQ ID NO: 5947344 - DNA, 18 bp, Homo sapiens
tctcagttatgtagtttc

SEQ ID NO: 5947345 - DNA, 18 bp, Homo sapiens
tctcagttcgtgtttgat

SEQ ID NO: 5947346 - DNA, 21 bp, Homo sapiens
tctcagttcgtgtttgattcc

SEQ ID NO: 5947347 - DNA, 16 bp, Homo sapiens
tctcagttctctccct

SEQ ID NO: 5947348 - DNA, 16 bp, Homo sapiens
tctcagttctcttgct

SEQ ID NO: 5947349 - DNA, 21 bp, Homo sapiens
tctcagttgcagaaaatgaac

SEQ ID NO: 5947350 - DNA, 22 bp, Homo sapiens
tctcagttgcagaaaatgaact

SEQ ID NO: 5947351 - DNA, 19 bp, Homo sapiens
tctcagtttctgcctgggc

SEQ ID NO: 5947352 - DNA, 16 bp, Homo sapiens
tctcagttttcataag

SEQ ID NO: 5947353 - DNA, 18 bp, Homo sapiens
tctcagtttttcttaata

SEQ ID NO: 5947354 - DNA, 22 bp, Homo sapiens
tctcagtttttcttaatatata

SEQ ID NO: 5947355 - DNA, 16 bp, Homo sapiens
tctcagtttttgctga

SEQ ID NO: 5947356 - DNA, 12 bp, Homo sapiens
tctcataaaact

SEQ ID NO: 5947357 - DNA, 15 bp, Homo sapiens
tctcataaaactgtg

SEQ ID NO: 5947358 - DNA, 12 bp, Homo sapiens
tctcataagcac

SEQ ID NO: 5947359 - DNA, 13 bp, Homo sapiens
tctcataatcctt

SEQ ID NO: 5947360 - DNA, 14 bp, Homo sapiens
tctcataatgcttt

SEQ ID NO: 5947361 - DNA, 22 bp, Homo sapiens
tctcataatttatacaggtcat

SEQ ID NO: 5947362 - DNA, 15 bp, Homo sapiens
tctcataattttgca

SEQ ID NO: 5947363 - DNA, 14 bp, Homo sapiens
tctcatacataaaa

SEQ ID NO: 5947364 - DNA, 16 bp, Homo sapiens
tctcatacctctgacc

SEQ ID NO: 5947365 - DNA, 15 bp, Homo sapiens
tctcatacgtccacc

SEQ ID NO: 5947366 - DNA, 17 bp, Homo sapiens
tctcatactatttaaga

SEQ ID NO: 5947367 - DNA, 17 bp, Homo sapiens
tctcatagaacattgat

SEQ ID NO: 5947368 - DNA, 21 bp, Homo sapiens
tctcatagaacattgatctgt

SEQ ID NO: 5947369 - DNA, 20 bp, Homo sapiens
tctcatagcaggaaatgtag

SEQ ID NO: 5947370 - DNA, 21 bp, Homo sapiens
tctcataggaaaagtacattt

SEQ ID NO: 5947371 - DNA, 22 bp, Homo sapiens
tctcataggaaaagtacattta

SEQ ID NO: 5947372 - DNA, 16 bp, Homo sapiens
tctcataggaattaaa

SEQ ID NO: 5947373 - DNA, 22 bp, Homo sapiens
tctcataggctatgccatgtgc

SEQ ID NO: 5947374 - DNA, 16 bp, Homo sapiens
tctcataggttaaaaa

SEQ ID NO: 5947375 - DNA, 20 bp, Homo sapiens
tctcatatatattttaaaaa

SEQ ID NO: 5947376 - DNA, 15 bp, Homo sapiens
tctcatatcactgaa

SEQ ID NO: 5947377 - DNA, 18 bp, Homo sapiens
tctcatatcactgaagga

SEQ ID NO: 5947378 - DNA, 15 bp, Homo sapiens
tctcatatttttaca

SEQ ID NO: 5947379 - DNA, 15 bp, Homo sapiens
tctcatcaactgaat

SEQ ID NO: 5947380 - DNA, 18 bp, Homo sapiens
tctcatcaacttaaaagt

SEQ ID NO: 5947381 - DNA, 20 bp, Homo sapiens
tctcatcaacttaaaagtca

SEQ ID NO: 5947382 - DNA, 16 bp, Homo sapiens
tctcatcacacacatg

SEQ ID NO: 5947383 - DNA, 19 bp, Homo sapiens
tctcatcactcccctccaa

SEQ ID NO: 5947384 - DNA, 22 bp, Homo sapiens
tctcatcagcccaggtcccagt

SEQ ID NO: 5947385 - DNA, 12 bp, Homo sapiens
tctcatcaggca

SEQ ID NO: 5947386 - DNA, 19 bp, Homo sapiens
tctcatcatccttgcttta

SEQ ID NO: 5947387 - DNA, 15 bp, Homo sapiens
tctcatcatgtctat

SEQ ID NO: 5947388 - DNA, 15 bp, Homo sapiens
tctcatccaaaagtg

SEQ ID NO: 5947389 - DNA, 21 bp, Homo sapiens
tctcatcctattacttttcat

SEQ ID NO: 5947390 - DNA, 14 bp, Homo sapiens
tctcatcctccagt

SEQ ID NO: 5947391 - DNA, 13 bp, Homo sapiens
tctcatcctcctt

SEQ ID NO: 5947392 - DNA, 23 bp, Homo sapiens
tctcatcctggcacgccctactc

SEQ ID NO: 5947393 - DNA, 14 bp, Homo sapiens
tctcatcctttcct

SEQ ID NO: 5947394 - DNA, 18 bp, Homo sapiens
tctcatccttttctccta

SEQ ID NO: 5947395 - DNA, 21 bp, Homo sapiens
tctcatcggaggcccatgccc

SEQ ID NO: 5947396 - DNA, 20 bp, Homo sapiens
tctcatctagtacctttgga

SEQ ID NO: 5947397 - DNA, 21 bp, Homo sapiens
tctcatctccccacgcccgtc

SEQ ID NO: 5947398 - DNA, 12 bp, Homo sapiens
tctcatctcctg

SEQ ID NO: 5947399 - DNA, 19 bp, Homo sapiens
tctcatctcctgaccctcc

SEQ ID NO: 5947400 - DNA, 24 bp, Homo sapiens
tctcatctcctgaccctcccactc

SEQ ID NO: 5947401 - DNA, 18 bp, Homo sapiens
tctcatctcttcaggttc

SEQ ID NO: 5947402 - DNA, 18 bp, Homo sapiens
tctcatctcttcttttaa

SEQ ID NO: 5947403 - DNA, 13 bp, Homo sapiens
tctcatctgcacc

SEQ ID NO: 5947404 - DNA, 16 bp, Homo sapiens
tctcatctgcaccctt

SEQ ID NO: 5947405 - DNA, 11 bp, Homo sapiens
tctcatctggg

SEQ ID NO: 5947406 - DNA, 20 bp, Homo sapiens
tctcatctgtaaaaccaggc

SEQ ID NO: 5947407 - DNA, 14 bp, Homo sapiens
tctcatctgtctcg

SEQ ID NO: 5947408 - DNA, 13 bp, Homo sapiens
tctcatctgtgat

SEQ ID NO: 5947409 - DNA, 14 bp, Homo sapiens
tctcatcttgcctc

SEQ ID NO: 5947410 - DNA, 14 bp, Homo sapiens
tctcatcttgttct

SEQ ID NO: 5947411 - DNA, 13 bp, Homo sapiens
tctcatgaacctc

SEQ ID NO: 5947412 - DNA, 16 bp, Homo sapiens
tctcatgaagccctta

SEQ ID NO: 5947413 - DNA, 22 bp, Homo sapiens
tctcatgaagcccttagggaga

SEQ ID NO: 5947414 - DNA, 20 bp, Homo sapiens
tctcatgaagctaataaaat

SEQ ID NO: 5947415 - DNA, 17 bp, Homo sapiens
tctcatgagaagccaag

SEQ ID NO: 5947416 - DNA, 23 bp, Homo sapiens
tctcatgataccacctttactgt

SEQ ID NO: 5947417 - DNA, 17 bp, Homo sapiens
tctcatgattccatgcc

SEQ ID NO: 5947418 - DNA, 15 bp, Homo sapiens
tctcatgatttacag

SEQ ID NO: 5947419 - DNA, 21 bp, Homo sapiens
tctcatgcatagacaagtgtt

SEQ ID NO: 5947420 - DNA, 16 bp, Homo sapiens
tctcatgccagcagca

SEQ ID NO: 5947421 - DNA, 12 bp, Homo sapiens
tctcatgccagt

SEQ ID NO: 5947422 - DNA, 19 bp, Homo sapiens
tctcatgccagtgccttat

SEQ ID NO: 5947423 - DNA, 13 bp, Homo sapiens
tctcatgcccact

SEQ ID NO: 5947424 - DNA, 21 bp, Homo sapiens
tctcatgcccctggctgggac

SEQ ID NO: 5947425 - DNA, 21 bp, Homo sapiens
tctcatgcctcagcctcctga

SEQ ID NO: 5947426 - DNA, 12 bp, Homo sapiens
tctcatgcctga

SEQ ID NO: 5947427 - DNA, 15 bp, Homo sapiens
tctcatgcctgagaa

SEQ ID NO: 5947428 - DNA, 23 bp, Homo sapiens
tctcatgcctgagaatgcctagg

SEQ ID NO: 5947429 - DNA, 14 bp, Homo sapiens
tctcatgcctgcct

SEQ ID NO: 5947430 - DNA, 16 bp, Homo sapiens
tctcatgcctgcctga

SEQ ID NO: 5947431 - DNA, 15 bp, Homo sapiens
tctcatgctccttaa

SEQ ID NO: 5947432 - DNA, 16 bp, Homo sapiens
tctcatggaccagtgg

SEQ ID NO: 5947433 - DNA, 23 bp, Homo sapiens
tctcatggaccagtggctggtct

SEQ ID NO: 5947434 - DNA, 20 bp, Homo sapiens
tctcatggagaagcagaaat

SEQ ID NO: 5947435 - DNA, 15 bp, Homo sapiens
tctcatggagaagtt

SEQ ID NO: 5947436 - DNA, 16 bp, Homo sapiens
tctcatggagaagtta

SEQ ID NO: 5947437 - DNA, 13 bp, Homo sapiens
tctcatgggaagc

SEQ ID NO: 5947438 - DNA, 17 bp, Homo sapiens
tctcatgggtggcactc

SEQ ID NO: 5947439 - DNA, 19 bp, Homo sapiens
tctcatggtacttcctctg

SEQ ID NO: 5947440 - DNA, 20 bp, Homo sapiens
tctcatggtacttcctctgt

SEQ ID NO: 5947441 - DNA, 15 bp, Homo sapiens
tctcatggtcccact

SEQ ID NO: 5947442 - DNA, 19 bp, Homo sapiens
tctcatggtcccacttccc

SEQ ID NO: 5947443 - DNA, 23 bp, Homo sapiens
tctcatggtcccacttccccatc

SEQ ID NO: 5947444 - DNA, 16 bp, Homo sapiens
tctcccatttcctgat

SEQ ID NO: 5947445 - DNA, 18 bp, Homo sapiens
tctcccatttcctgatct

SEQ ID NO: 5947446 - DNA, 23 bp, Homo sapiens
tctcccattttggaatttgcctg

SEQ ID NO: 5947447 - DNA, 23 bp, Homo sapiens
tctccccaacccccattctcatc

SEQ ID NO: 5947448 - DNA, 21 bp, Homo sapiens
tctccccaatccatgcttcac

SEQ ID NO: 5947449 - DNA, 23 bp, Homo sapiens
tctccccaatgagacttgccttc

SEQ ID NO: 5947450 - DNA, 15 bp, Homo sapiens
tctccccacagcctc

SEQ ID NO: 5947451 - DNA, 13 bp, Homo sapiens
tctccccacccac

SEQ ID NO: 5947452 - DNA, 14 bp, Homo sapiens
tctccccaccccta

SEQ ID NO: 5947453 - DNA, 20 bp, Homo sapiens
tctccccacgagggctggct

SEQ ID NO: 5947454 - DNA, 19 bp, Homo sapiens
tctccccactccaccctgt

SEQ ID NO: 5947455 - DNA, 12 bp, Homo sapiens
tctccccactga

SEQ ID NO: 5947456 - DNA, 15 bp, Homo sapiens
tctccccagagcatt

SEQ ID NO: 5947457 - DNA, 16 bp, Homo sapiens
tctccccagagcattt

SEQ ID NO: 5947458 - DNA, 12 bp, Homo sapiens
tctccccagagt

SEQ ID NO: 5947459 - DNA, 16 bp, Homo sapiens
tctccccagcccagag

SEQ ID NO: 5947460 - DNA, 17 bp, Homo sapiens
tctccccagcccagaga

SEQ ID NO: 5947461 - DNA, 15 bp, Homo sapiens
tctccccagccccct

SEQ ID NO: 5947462 - DNA, 20 bp, Homo sapiens
tctccccagccccctcccac

SEQ ID NO: 5947463 - DNA, 15 bp, Homo sapiens
tctccccagcctggc

SEQ ID NO: 5947464 - DNA, 12 bp, Homo sapiens
tctccccaggaa

SEQ ID NO: 5947465 - DNA, 12 bp, Homo sapiens
tctccccaggcc

SEQ ID NO: 5947466 - DNA, 13 bp, Homo sapiens
tctccccaggcct

SEQ ID NO: 5947467 - DNA, 14 bp, Homo sapiens
tctccccaggcctc

SEQ ID NO: 5947468 - DNA, 18 bp, Homo sapiens
tctccccaggcctccagc

SEQ ID NO: 5947469 - DNA, 22 bp, Homo sapiens
tctccccaggtccagctctgga

SEQ ID NO: 5947470 - DNA, 10 bp, Homo sapiens
tctccccagt

SEQ ID NO: 5947471 - DNA, 17 bp, Homo sapiens
tctccccagtcctcagg

SEQ ID NO: 5947472 - DNA, 14 bp, Homo sapiens
tctccccagtgcct

SEQ ID NO: 5947473 - DNA, 16 bp, Homo sapiens
tctccccagtgcctgc

SEQ ID NO: 5947474 - DNA, 18 bp, Homo sapiens
tctccccagtgcctgcca

SEQ ID NO: 5947475 - DNA, 20 bp, Homo sapiens
tctccccagtgcctgccact

SEQ ID NO: 5947476 - DNA, 17 bp, Homo sapiens
tctccccatatataaat

SEQ ID NO: 5947477 - DNA, 14 bp, Homo sapiens
tctccccatcccca

SEQ ID NO: 5947478 - DNA, 16 bp, Homo sapiens
tctccccatccccatt

SEQ ID NO: 5947479 - DNA, 21 bp, Homo sapiens
tctccccatccccttcctaaa

SEQ ID NO: 5947480 - DNA, 14 bp, Homo sapiens
tctcccccaaccca

SEQ ID NO: 5947481 - DNA, 20 bp, Homo sapiens
tctcccccaaccccctgcaa

SEQ ID NO: 5947482 - DNA, 20 bp, Homo sapiens
tctcccccacaagagcccca

SEQ ID NO: 5947483 - DNA, 22 bp, Homo sapiens
tctcccccacaagagccccaaa

SEQ ID NO: 5947484 - DNA, 15 bp, Homo sapiens
tctcccccaccctgt

SEQ ID NO: 5947485 - DNA, 17 bp, Homo sapiens
tctcccccactccacta

SEQ ID NO: 5947486 - DNA, 14 bp, Homo sapiens
tctcccccagcccc

SEQ ID NO: 5947487 - DNA, 22 bp, Homo sapiens
tctcccccagccccatcctctg

SEQ ID NO: 5947488 - DNA, 13 bp, Homo sapiens
tctccccccatcc

SEQ ID NO: 5947489 - DNA, 13 bp, Homo sapiens
tctcccccccggg

SEQ ID NO: 5947490 - DNA, 15 bp, Homo sapiens
tctccccccgcctgc

SEQ ID NO: 5947491 - DNA, 16 bp, Homo sapiens
tctcccccgacactgc

SEQ ID NO: 5947492 - DNA, 18 bp, Homo sapiens
tctcccccgacactgctg

SEQ ID NO: 5947493 - DNA, 21 bp, Homo sapiens
tctcccccgacactgctgcac

SEQ ID NO: 5947494 - DNA, 14 bp, Homo sapiens
tctcccccgcccaa

SEQ ID NO: 5947495 - DNA, 18 bp, Homo sapiens
tctcccccgccctgcccc

SEQ ID NO: 5947496 - DNA, 13 bp, Homo sapiens
tctccccctcagc

SEQ ID NO: 5947497 - DNA, 23 bp, Homo sapiens
tctccccctcagctctccctcac

SEQ ID NO: 5947498 - DNA, 14 bp, Homo sapiens
tctccccctcctga

SEQ ID NO: 5947499 - DNA, 15 bp, Homo sapiens
tctccccctgcagcc

SEQ ID NO: 5947500 - DNA, 19 bp, Homo sapiens
tctccccctgcagccgtgc

SEQ ID NO: 5947501 - DNA, 14 bp, Homo sapiens
tctcccccttcagc

SEQ ID NO: 5947502 - DNA, 19 bp, Homo sapiens
tctcccccttcagctcctg

SEQ ID NO: 5947503 - DNA, 21 bp, Homo sapiens
tctcccccttcagctcctgag

SEQ ID NO: 5947504 - DNA, 22 bp, Homo sapiens
tctcccccttgccctcattctt

SEQ ID NO: 5947505 - DNA, 14 bp, Homo sapiens
tctccccgcagccc

SEQ ID NO: 5947506 - DNA, 23 bp, Homo sapiens
tctccccgcagtcgtcccaggct

SEQ ID NO: 5947507 - DNA, 16 bp, Homo sapiens
tctccccgcagtgttt

SEQ ID NO: 5947508 - DNA, 22 bp, Homo sapiens
tctccccgctaaggaagatatc

SEQ ID NO: 5947509 - DNA, 22 bp, Homo sapiens
tctccccgctcaggggcctgga

SEQ ID NO: 5947510 - DNA, 16 bp, Homo sapiens
tctccccgctctggat

SEQ ID NO: 5947511 - DNA, 20 bp, Homo sapiens
tctccccggacaagcccagg

SEQ ID NO: 5947512 - DNA, 21 bp, Homo sapiens
tctccccggacaagcccagga

SEQ ID NO: 5947513 - DNA, 22 bp, Homo sapiens
tctccccggacaagcccaggac

SEQ ID NO: 5947514 - DNA, 22 bp, Homo sapiens
tctccccggcaggcctgagaat

SEQ ID NO: 5947515 - DNA, 19 bp, Homo sapiens
tctccccggtaatgtcact

SEQ ID NO: 5947516 - DNA, 20 bp, Homo sapiens
tctccccggtaatgtcactg

SEQ ID NO: 5947517 - DNA, 19 bp, Homo sapiens
tctccccgtgtcctctccc

SEQ ID NO: 5947518 - DNA, 13 bp, Homo sapiens
tctcccctcaaag

SEQ ID NO: 5947519 - DNA, 16 bp, Homo sapiens
tctcccctcaaagtct

SEQ ID NO: 5947520 - DNA, 23 bp, Homo sapiens
tctcccctcaaagtctgcaactt

SEQ ID NO: 5947521 - DNA, 21 bp, Homo sapiens
tctcccctcacatcctcctgc

SEQ ID NO: 5947522 - DNA, 13 bp, Homo sapiens
tctcccctcagag

SEQ ID NO: 5947523 - DNA, 13 bp, Homo sapiens
tctcccctcagct

SEQ ID NO: 5947524 - DNA, 16 bp, Homo sapiens
tctcccctccagaccc

SEQ ID NO: 5947525 - DNA, 16 bp, Homo sapiens
tctcccctccagcctt

SEQ ID NO: 5947526 - DNA, 13 bp, Homo sapiens
tctcccctccctc

SEQ ID NO: 5947527 - DNA, 22 bp, Homo sapiens
tctcccctccctcttccttccc

SEQ ID NO: 5947528 - DNA, 22 bp, Homo sapiens
tctcccctcccttgtccttgaa

SEQ ID NO: 5947529 - DNA, 13 bp, Homo sapiens
tctcccctcctgc

SEQ ID NO: 5947530 - DNA, 15 bp, Homo sapiens
tctcccctcctgcac

SEQ ID NO: 5947531 - DNA, 20 bp, Homo sapiens
tctcccctcctgcacacagg

SEQ ID NO: 5947532 - DNA, 15 bp, Homo sapiens
tctcccctctctgct

SEQ ID NO: 5947533 - DNA, 12 bp, Homo sapiens
tctcccctctgc

SEQ ID NO: 5947534 - DNA, 16 bp, Homo sapiens
tctcccctcttctgag

SEQ ID NO: 5947535 - DNA, 17 bp, Homo sapiens
tctcccctcttctgagc

SEQ ID NO: 5947536 - DNA, 19 bp, Homo sapiens
tctcccctcttctgagcta

SEQ ID NO: 5947537 - DNA, 20 bp, Homo sapiens
tctcccctgaatcctcagag

SEQ ID NO: 5947538 - DNA, 12 bp, Homo sapiens
tctcccctgcac

SEQ ID NO: 5947539 - DNA, 13 bp, Homo sapiens
tctcccctgcact

SEQ ID NO: 5947540 - DNA, 14 bp, Homo sapiens
tctcccctgcactg

SEQ ID NO: 5947541 - DNA, 15 bp, Homo sapiens
tctcccctgcactgt

SEQ ID NO: 5947542 - DNA, 14 bp, Homo sapiens
tctcccctgccccc

SEQ ID NO: 5947543 - DNA, 18 bp, Homo sapiens
tctcccctgccccctgca

SEQ ID NO: 5947544 - DNA, 21 bp, Homo sapiens
tctcccctgccccctgcagga

SEQ ID NO: 5947545 - DNA, 14 bp, Homo sapiens
tctcccctgccctg

SEQ ID NO: 5947546 - DNA, 22 bp, Homo sapiens
tctcccctgcccttcctcctga

SEQ ID NO: 5947547 - DNA, 17 bp, Homo sapiens
tctccccttcctggaca

SEQ ID NO: 5947548 - DNA, 21 bp, Homo sapiens
tctccccttcctggacacact

SEQ ID NO: 5947549 - DNA, 22 bp, Homo sapiens
tctccccttcctggacacactc

SEQ ID NO: 5947550 - DNA, 23 bp, Homo sapiens
tctccccttcctggacacactct

SEQ ID NO: 5947551 - DNA, 16 bp, Homo sapiens
tctccccttcctggca

SEQ ID NO: 5947552 - DNA, 12 bp, Homo sapiens
tctccccttctc

SEQ ID NO: 5947553 - DNA, 17 bp, Homo sapiens
tctcccctttgctaacg

SEQ ID NO: 5947554 - DNA, 13 bp, Homo sapiens
tctccccttttcc

SEQ ID NO: 5947555 - DNA, 20 bp, Homo sapiens
tctcccgaagtcctctgtgg

SEQ ID NO: 5947556 - DNA, 21 bp, Homo sapiens
tctcccgcaccaggccgggct

SEQ ID NO: 5947557 - DNA, 17 bp, Homo sapiens
tctcccgccattggcct

SEQ ID NO: 5947558 - DNA, 14 bp, Homo sapiens
tctcccgcctcagc

SEQ ID NO: 5947559 - DNA, 16 bp, Homo sapiens
tctcccgcctcagcct

SEQ ID NO: 5947560 - DNA, 21 bp, Homo sapiens
tctcccgcctcagcctcctga

SEQ ID NO: 5947561 - DNA, 13 bp, Homo sapiens
tctcccgctgctg

SEQ ID NO: 5947562 - DNA, 15 bp, Homo sapiens
tctcccgctgctgct

SEQ ID NO: 5947563 - DNA, 18 bp, Homo sapiens
tctcccgcttcctggcct

SEQ ID NO: 5947564 - DNA, 20 bp, Homo sapiens
tctcccgcttcctggcctcc

SEQ ID NO: 5947565 - DNA, 20 bp, Homo sapiens
tctcccggaggttgggtggg

SEQ ID NO: 5947566 - DNA, 16 bp, Homo sapiens
tctcccggttcttcca

SEQ ID NO: 5947567 - DNA, 13 bp, Homo sapiens
tctccctaaaata

SEQ ID NO: 5947568 - DNA, 21 bp, Homo sapiens
tctccctaaaataaaaaccag

SEQ ID NO: 5947569 - DNA, 22 bp, Homo sapiens
tctccctaaaataaaaaccaga

SEQ ID NO: 5947570 - DNA, 17 bp, Homo sapiens
tctccctacctccctcc

SEQ ID NO: 5947571 - DNA, 20 bp, Homo sapiens
tctccctacctccctcctca

SEQ ID NO: 5947572 - DNA, 16 bp, Homo sapiens
tctccctaccttgcct

SEQ ID NO: 5947573 - DNA, 21 bp, Homo sapiens
tctccctacttagacccagtc

SEQ ID NO: 5947574 - DNA, 15 bp, Homo sapiens
tctccctagaaacaa

SEQ ID NO: 5947575 - DNA, 15 bp, Homo sapiens
tctccctagcccttc

SEQ ID NO: 5947576 - DNA, 21 bp, Homo sapiens
tctccctataatgctggagcg

SEQ ID NO: 5947577 - DNA, 18 bp, Homo sapiens
tctccctataccgagacc

SEQ ID NO: 5947578 - DNA, 19 bp, Homo sapiens
tctccctatgttgcccagg

SEQ ID NO: 5947579 - DNA, 23 bp, Homo sapiens
tctccctcacagcacagagaaga

SEQ ID NO: 5947580 - DNA, 11 bp, Homo sapiens
tctccctcagg

SEQ ID NO: 5947581 - DNA, 12 bp, Homo sapiens
tctccctcaggg

SEQ ID NO: 5947582 - DNA, 18 bp, Homo sapiens
tctccctcagtctggccc

SEQ ID NO: 5947583 - DNA, 11 bp, Homo sapiens
tctccctccac

SEQ ID NO: 5947584 - DNA, 12 bp, Homo sapiens
tctccctccagg

SEQ ID NO: 5947585 - DNA, 13 bp, Homo sapiens
tctccctccaggg

SEQ ID NO: 5947586 - DNA, 19 bp, Homo sapiens
tctccctcccccagagccc

SEQ ID NO: 5947587 - DNA, 20 bp, Homo sapiens
tctccctcccccagagcccc

SEQ ID NO: 5947588 - DNA, 18 bp, Homo sapiens
tctccctcccctgccatt

SEQ ID NO: 5947589 - DNA, 17 bp, Homo sapiens
tctccctccctctctca

SEQ ID NO: 5947590 - DNA, 22 bp, Homo sapiens
tctccctccctctctcatgaga

SEQ ID NO: 5947591 - DNA, 14 bp, Homo sapiens
tctccctcccttgg

SEQ ID NO: 5947592 - DNA, 18 bp, Homo sapiens
tctccctcctctgcccgg

SEQ ID NO: 5947593 - DNA, 14 bp, Homo sapiens
tctccctcctggcc

SEQ ID NO: 5947594 - DNA, 17 bp, Homo sapiens
tctccctcctggccaga

SEQ ID NO: 5947595 - DNA, 19 bp, Homo sapiens
tctccctcgaacccacact

SEQ ID NO: 5947596 - DNA, 23 bp, Homo sapiens
tctccctcgacagcgcccctgct

SEQ ID NO: 5947597 - DNA, 21 bp, Homo sapiens
tctccctctaggctctgcctt

SEQ ID NO: 5947598 - DNA, 13 bp, Homo sapiens
tctccctctctct

SEQ ID NO: 5947599 - DNA, 16 bp, Homo sapiens
tctccctctggatcaa

SEQ ID NO: 5947600 - DNA, 17 bp, Homo sapiens
tctccctctggccctgc

SEQ ID NO: 5947601 - DNA, 18 bp, Homo sapiens
tctccctctggccctgcc

SEQ ID NO: 5947602 - DNA, 19 bp, Homo sapiens
tctccctctggccctgcct

SEQ ID NO: 5947603 - DNA, 19 bp, Homo sapiens
tctccctctgtcttttctc

SEQ ID NO: 5947604 - DNA, 21 bp, Homo sapiens
tctccctcttctcaagtgcct

SEQ ID NO: 5947605 - DNA, 15 bp, Homo sapiens
tctccctctttttct

SEQ ID NO: 5947606 - DNA, 19 bp, Homo sapiens
tctccctctttttctctgt

SEQ ID NO: 5947607 - DNA, 15 bp, Homo sapiens
tctccctgaccctgt

SEQ ID NO: 5947608 - DNA, 19 bp, Homo sapiens
tctccctgaccttctccag

SEQ ID NO: 5947609 - DNA, 20 bp, Homo sapiens
tctccctgagcctgccccag

SEQ ID NO: 5947610 - DNA, 21 bp, Homo sapiens
tctccctgagcctgccccagc

SEQ ID NO: 5947611 - DNA, 19 bp, Homo sapiens
tctccctgcagccttttct

SEQ ID NO: 5947612 - DNA, 19 bp, Homo sapiens
tctccctgcatcctgaggc

SEQ ID NO: 5947613 - DNA, 13 bp, Homo sapiens
tctccctgcatgg

SEQ ID NO: 5947614 - DNA, 14 bp, Homo sapiens
tctccctgcatggc

SEQ ID NO: 5947615 - DNA, 10 bp, Homo sapiens
tctccctgcc

SEQ ID NO: 5947616 - DNA, 20 bp, Homo sapiens
tctccctgccaagtctcaga

SEQ ID NO: 5947617 - DNA, 14 bp, Homo sapiens
tctccctgccagag

SEQ ID NO: 5947618 - DNA, 12 bp, Homo sapiens
tctccctgccat

SEQ ID NO: 5947619 - DNA, 13 bp, Homo sapiens
tctccctgccatc

SEQ ID NO: 5947620 - DNA, 19 bp, Homo sapiens
tctccctgccatccccctc

SEQ ID NO: 5947621 - DNA, 22 bp, Homo sapiens
tctccctgccatccccctctca

SEQ ID NO: 5947622 - DNA, 13 bp, Homo sapiens
tctccctgccgcc

SEQ ID NO: 5947623 - DNA, 14 bp, Homo sapiens
tctctctatatata

SEQ ID NO: 5947624 - DNA, 18 bp, Homo sapiens
tctctctatatatacatg

SEQ ID NO: 5947625 - DNA, 21 bp, Homo sapiens
tctctctatatatacatgtat

SEQ ID NO: 5947626 - DNA, 13 bp, Homo sapiens
tctctctatgcct

SEQ ID NO: 5947627 - DNA, 23 bp, Homo sapiens
tctctctcactcacattttctca

SEQ ID NO: 5947628 - DNA, 14 bp, Homo sapiens
tctctctcactccc

SEQ ID NO: 5947629 - DNA, 12 bp, Homo sapiens
tctctctccaag

SEQ ID NO: 5947630 - DNA, 13 bp, Homo sapiens
tctctctccaccc

SEQ ID NO: 5947631 - DNA, 14 bp, Homo sapiens
tctctctcccaact

SEQ ID NO: 5947632 - DNA, 18 bp, Homo sapiens
tctctctcccatggagcc

SEQ ID NO: 5947633 - DNA, 13 bp, Homo sapiens
tctctctccctcc

SEQ ID NO: 5947634 - DNA, 14 bp, Homo sapiens
tctctctccctcca

SEQ ID NO: 5947635 - DNA, 12 bp, Homo sapiens
tctctctcctct

SEQ ID NO: 5947636 - DNA, 15 bp, Homo sapiens
tctctctcctctttg

SEQ ID NO: 5947637 - DNA, 20 bp, Homo sapiens
tctctctcgaccttctggta

SEQ ID NO: 5947638 - DNA, 14 bp, Homo sapiens
tctctctctaaggt

SEQ ID NO: 5947639 - DNA, 13 bp, Homo sapiens
tctctctctacaa

SEQ ID NO: 5947640 - DNA, 10 bp, Homo sapiens
tctctctctc

SEQ ID NO: 5947641 - DNA, 12 bp, Homo sapiens
tctctctctcca

SEQ ID NO: 5947642 - DNA, 12 bp, Homo sapiens
tctctctctcct

SEQ ID NO: 5947643 - DNA, 14 bp, Homo sapiens
tctctctctcctca

SEQ ID NO: 5947644 - DNA, 13 bp, Homo sapiens
tctctctctctcc

SEQ ID NO: 5947645 - DNA, 14 bp, Homo sapiens
tctctctctctcca

SEQ ID NO: 5947646 - DNA, 16 bp, Homo sapiens
tctctctctctctgtt

SEQ ID NO: 5947647 - DNA, 14 bp, Homo sapiens
tctctctctctgtt

SEQ ID NO: 5947648 - DNA, 15 bp, Homo sapiens
tctctctctctgttc

SEQ ID NO: 5947649 - DNA, 12 bp, Homo sapiens
tctctctctggt

SEQ ID NO: 5947650 - DNA, 11 bp, Homo sapiens
tctctctctgt

SEQ ID NO: 5947651 - DNA, 13 bp, Homo sapiens
tctctctctgtgt

SEQ ID NO: 5947652 - DNA, 14 bp, Homo sapiens
tctctctctgttgt

SEQ ID NO: 5947653 - DNA, 13 bp, Homo sapiens
tctctctctttct

SEQ ID NO: 5947654 - DNA, 14 bp, Homo sapiens
tctctctgaggaca

SEQ ID NO: 5947655 - DNA, 12 bp, Homo sapiens
tctctctgcagc

SEQ ID NO: 5947656 - DNA, 14 bp, Homo sapiens
tctctctgcagctg

SEQ ID NO: 5947657 - DNA, 15 bp, Homo sapiens
tctctctgcagctgc

SEQ ID NO: 5947658 - DNA, 16 bp, Homo sapiens
tctctctgcagctgcc

SEQ ID NO: 5947659 - DNA, 18 bp, Homo sapiens
tctctctgcagctgccgg

SEQ ID NO: 5947660 - DNA, 12 bp, Homo sapiens
tctctctgccaa

SEQ ID NO: 5947661 - DNA, 14 bp, Homo sapiens
tctctctgcccaac

SEQ ID NO: 5947662 - DNA, 13 bp, Homo sapiens
tctctctgccccc

SEQ ID NO: 5947663 - DNA, 14 bp, Homo sapiens
tctctctgccctct

SEQ ID NO: 5947664 - DNA, 13 bp, Homo sapiens
tctctctgcctat

SEQ ID NO: 5947665 - DNA, 13 bp, Homo sapiens
tctctctgcctgt

SEQ ID NO: 5947666 - DNA, 11 bp, Homo sapiens
tctctctgctc

SEQ ID NO: 5947667 - DNA, 14 bp, Homo sapiens
tctctctgctcagt

SEQ ID NO: 5947668 - DNA, 12 bp, Homo sapiens
tctctctgctcc

SEQ ID NO: 5947669 - DNA, 13 bp, Homo sapiens
tctctctgctcct

SEQ ID NO: 5947670 - DNA, 11 bp, Homo sapiens
tctctctggac

SEQ ID NO: 5947671 - DNA, 16 bp, Homo sapiens
tctctctggatggaac

SEQ ID NO: 5947672 - DNA, 13 bp, Homo sapiens
tctctctggcttc

SEQ ID NO: 5947673 - DNA, 22 bp, Homo sapiens
tctctctggcttctctcttttc

SEQ ID NO: 5947674 - DNA, 15 bp, Homo sapiens
tctctctggggccct

SEQ ID NO: 5947675 - DNA, 18 bp, Homo sapiens
tctctctggggccctggg

SEQ ID NO: 5947676 - DNA, 14 bp, Homo sapiens
tctctctgggtcag

SEQ ID NO: 5947677 - DNA, 12 bp, Homo sapiens
tctctctgtgaa

SEQ ID NO: 5947678 - DNA, 14 bp, Homo sapiens
tctctctgtgaata

SEQ ID NO: 5947679 - DNA, 20 bp, Homo sapiens
tctctctgtgaatacaatta

SEQ ID NO: 5947680 - DNA, 15 bp, Homo sapiens
tctctctgtgctggt

SEQ ID NO: 5947681 - DNA, 11 bp, Homo sapiens
tctctctgtgg

SEQ ID NO: 5947682 - DNA, 13 bp, Homo sapiens
tctctctgtgtgg

SEQ ID NO: 5947683 - DNA, 14 bp, Homo sapiens
tctctctgtgtggc

SEQ ID NO: 5947684 - DNA, 13 bp, Homo sapiens
tctctctgttaaa

SEQ ID NO: 5947685 - DNA, 17 bp, Homo sapiens
tctctctgttaaagatc

SEQ ID NO: 5947686 - DNA, 12 bp, Homo sapiens
tctctctgttcc

SEQ ID NO: 5947687 - DNA, 15 bp, Homo sapiens
tctctctgttccctt

SEQ ID NO: 5947688 - DNA, 18 bp, Homo sapiens
tctctcttcagactctca

SEQ ID NO: 5947689 - DNA, 10 bp, Homo sapiens
tctctcttcc

SEQ ID NO: 5947690 - DNA, 14 bp, Homo sapiens
tctctcttccctca

SEQ ID NO: 5947691 - DNA, 15 bp, Homo sapiens
tctctcttctcagag

SEQ ID NO: 5947692 - DNA, 12 bp, Homo sapiens
tctctcttctct

SEQ ID NO: 5947693 - DNA, 20 bp, Homo sapiens
tctctcttctgctccaccct

SEQ ID NO: 5947694 - DNA, 20 bp, Homo sapiens
tctctcttgcctgaggggaa

SEQ ID NO: 5947695 - DNA, 18 bp, Homo sapiens
tctctcttggacccacct

SEQ ID NO: 5947696 - DNA, 17 bp, Homo sapiens
tctctcttgggccaagc

SEQ ID NO: 5947697 - DNA, 20 bp, Homo sapiens
tctctcttgggccaagccag

SEQ ID NO: 5947698 - DNA, 18 bp, Homo sapiens
tctctcttgtcacatgga

SEQ ID NO: 5947699 - DNA, 16 bp, Homo sapiens
tctctctttatacagc

SEQ ID NO: 5947700 - DNA, 19 bp, Homo sapiens
tctctctttcctccaccca

SEQ ID NO: 5947701 - DNA, 12 bp, Homo sapiens
tctctctttgga

SEQ ID NO: 5947702 - DNA, 23 bp, Homo sapiens
tctctctttgtgggttggccagg

SEQ ID NO: 5947703 - DNA, 14 bp, Homo sapiens
tctctcttttcatt

SEQ ID NO: 5947704 - DNA, 18 bp, Homo sapiens
tctctcttttcctcctcc

SEQ ID NO: 5947705 - DNA, 11 bp, Homo sapiens
tctctcttttg

SEQ ID NO: 5947706 - DNA, 13 bp, Homo sapiens
tctctctttttct

SEQ ID NO: 5947707 - DNA, 15 bp, Homo sapiens
tctctgaaaattctg

SEQ ID NO: 5947708 - DNA, 16 bp, Homo sapiens
tctctgaacacaggca

SEQ ID NO: 5947709 - DNA, 19 bp, Homo sapiens
tctctgaacacaggcagct

SEQ ID NO: 5947710 - DNA, 20 bp, Homo sapiens
tctctgaacacaggcagctt

SEQ ID NO: 5947711 - DNA, 21 bp, Homo sapiens
tctctgaacacaggcagcttt

SEQ ID NO: 5947712 - DNA, 16 bp, Homo sapiens
tctctgaacagaaaac

SEQ ID NO: 5947713 - DNA, 21 bp, Homo sapiens
tctctgaactggtagaaaaac

SEQ ID NO: 5947714 - DNA, 23 bp, Homo sapiens
tctctgaagatctaaacttttga

SEQ ID NO: 5947715 - DNA, 12 bp, Homo sapiens
tctctgaagcat

SEQ ID NO: 5947716 - DNA, 21 bp, Homo sapiens
tctctgaaggaggccacctcc

SEQ ID NO: 5947717 - DNA, 11 bp, Homo sapiens
tctctgaaggg

SEQ ID NO: 5947718 - DNA, 22 bp, Homo sapiens
tctctgaaggtaagatcattta

SEQ ID NO: 5947719 - DNA, 23 bp, Homo sapiens
tctctgaatgagcctttgtgctt

SEQ ID NO: 5947720 - DNA, 20 bp, Homo sapiens
tctctgacgcttgtgacagt

SEQ ID NO: 5947721 - DNA, 18 bp, Homo sapiens
tctctgactgctttggat

SEQ ID NO: 5947722 - DNA, 17 bp, Homo sapiens
tctctgacttctgcctg

SEQ ID NO: 5947723 - DNA, 23 bp, Homo sapiens
tctctgagaaccaaaagatgcct

SEQ ID NO: 5947724 - DNA, 16 bp, Homo sapiens
tctctgagagagatga

SEQ ID NO: 5947725 - DNA, 17 bp, Homo sapiens
tctctgagatgcccctc

SEQ ID NO: 5947726 - DNA, 16 bp, Homo sapiens
tctctgagcagtgggg

SEQ ID NO: 5947727 - DNA, 19 bp, Homo sapiens
tctctgagcagtggggagc

SEQ ID NO: 5947728 - DNA, 19 bp, Homo sapiens
tctctgagctccagtggaa

SEQ ID NO: 5947729 - DNA, 16 bp, Homo sapiens
tctctgagctggggag

SEQ ID NO: 5947730 - DNA, 15 bp, Homo sapiens
tctctgagctttgtt

SEQ ID NO: 5947731 - DNA, 14 bp, Homo sapiens
tctctgaggacact

SEQ ID NO: 5947732 - DNA, 14 bp, Homo sapiens
tctctgagggtgat

SEQ ID NO: 5947733 - DNA, 14 bp, Homo sapiens
tctctgagtacatt

SEQ ID NO: 5947734 - DNA, 18 bp, Homo sapiens
tctctgagtcagctgacc

SEQ ID NO: 5947735 - DNA, 17 bp, Homo sapiens
tctctgagtctggactt

SEQ ID NO: 5947736 - DNA, 22 bp, Homo sapiens
tctctgagtggaggaagcccac

SEQ ID NO: 5947737 - DNA, 20 bp, Homo sapiens
tctctgagtgtctctgcctg

SEQ ID NO: 5947738 - DNA, 21 bp, Homo sapiens
tctctgagttttagttggtct

SEQ ID NO: 5947739 - DNA, 15 bp, Homo sapiens
tctctgatacacagt

SEQ ID NO: 5947740 - DNA, 19 bp, Homo sapiens
tctctgatcttgtgctcag

SEQ ID NO: 5947741 - DNA, 22 bp, Homo sapiens
tctctgatcttgtgctcagcat

SEQ ID NO: 5947742 - DNA, 14 bp, Homo sapiens
tctctgatggcact

SEQ ID NO: 5947743 - DNA, 20 bp, Homo sapiens
tctctgatgtgatatccact

SEQ ID NO: 5947744 - DNA, 20 bp, Homo sapiens
tctctgattccctgatttaa

SEQ ID NO: 5947745 - DNA, 20 bp, Homo sapiens
tctctgcaatgcttctgtag

SEQ ID NO: 5947746 - DNA, 21 bp, Homo sapiens
tctctgcaattttactgtgaa

SEQ ID NO: 5947747 - DNA, 12 bp, Homo sapiens
tctctgcacaga

SEQ ID NO: 5947748 - DNA, 15 bp, Homo sapiens
tctctgcagacttcc

SEQ ID NO: 5947749 - DNA, 14 bp, Homo sapiens
tctctgcagatgtg

SEQ ID NO: 5947750 - DNA, 18 bp, Homo sapiens
tctctgcagccagcccag

SEQ ID NO: 5947751 - DNA, 12 bp, Homo sapiens
tctctgcagctg

SEQ ID NO: 5947752 - DNA, 13 bp, Homo sapiens
tctctgcagctgc

SEQ ID NO: 5947753 - DNA, 22 bp, Homo sapiens
tctctgcaggatgggtgaaacc

SEQ ID NO: 5947754 - DNA, 14 bp, Homo sapiens
tctctgcaggtccc

SEQ ID NO: 5947755 - DNA, 19 bp, Homo sapiens
tctctgcaggtccctaata

SEQ ID NO: 5947756 - DNA, 20 bp, Homo sapiens
tctctgcaggtccctaataa

SEQ ID NO: 5947757 - DNA, 19 bp, Homo sapiens
tctctgcagtaaaacacat

SEQ ID NO: 5947758 - DNA, 19 bp, Homo sapiens
tctctgcagtttttcccaa

SEQ ID NO: 5947759 - DNA, 22 bp, Homo sapiens
tctctgcatccatttgaacaca

SEQ ID NO: 5947760 - DNA, 18 bp, Homo sapiens
tctctgcatctactccca

SEQ ID NO: 5947761 - DNA, 17 bp, Homo sapiens
tctctgcatctgaccac

SEQ ID NO: 5947762 - DNA, 16 bp, Homo sapiens
tctctgcatcttcagt

SEQ ID NO: 5947763 - DNA, 12 bp, Homo sapiens
tctctgccaaag

SEQ ID NO: 5947764 - DNA, 13 bp, Homo sapiens
tctctgccaaagc

SEQ ID NO: 5947765 - DNA, 13 bp, Homo sapiens
tctctgccaagat

SEQ ID NO: 5947766 - DNA, 13 bp, Homo sapiens
tctctgccagccg

SEQ ID NO: 5947767 - DNA, 17 bp, Homo sapiens
tctctgccagccgctgg

SEQ ID NO: 5947768 - DNA, 13 bp, Homo sapiens
tctctgccagctc

SEQ ID NO: 5947769 - DNA, 14 bp, Homo sapiens
tctctgccagctcc

SEQ ID NO: 5947770 - DNA, 15 bp, Homo sapiens
tctctgccagtgaca

SEQ ID NO: 5947771 - DNA, 22 bp, Homo sapiens
tctctgccagttacttgggctt

SEQ ID NO: 5947772 - DNA, 10 bp, Homo sapiens
tctctgccat

SEQ ID NO: 5947773 - DNA, 18 bp, Homo sapiens
tctctgccataaatgatt

SEQ ID NO: 5947774 - DNA, 15 bp, Homo sapiens
tctctgccattctgt

SEQ ID NO: 5947775 - DNA, 23 bp, Homo sapiens
tctctgccattctgtgcaggctg

SEQ ID NO: 5947776 - DNA, 13 bp, Homo sapiens
tctctgcccaacc

SEQ ID NO: 5947777 - DNA, 13 bp, Homo sapiens
tctctgcccagcc

SEQ ID NO: 5947778 - DNA, 16 bp, Homo sapiens
tctctgcccagccggg

SEQ ID NO: 5947779 - DNA, 14 bp, Homo sapiens
tctctgcccattcc

SEQ ID NO: 5947780 - DNA, 14 bp, Homo sapiens
tctctgccccagcc

SEQ ID NO: 5947781 - DNA, 20 bp, Homo sapiens
tctctgcccccaaaagtgtc

SEQ ID NO: 5947782 - DNA, 20 bp, Homo sapiens
tctctgcccccattgatttt

SEQ ID NO: 5947783 - DNA, 12 bp, Homo sapiens
tctctgcccctg

SEQ ID NO: 5947784 - DNA, 17 bp, Homo sapiens
tctctgcccctgatcac

SEQ ID NO: 5947785 - DNA, 22 bp, Homo sapiens
tctctgccctaatgcgcaggct

SEQ ID NO: 5947786 - DNA, 16 bp, Homo sapiens
tctctgccctccaaga

SEQ ID NO: 5947787 - DNA, 16 bp, Homo sapiens
tctctgccctctccct

SEQ ID NO: 5947788 - DNA, 17 bp, Homo sapiens
tctctgccctgccctgg

SEQ ID NO: 5947789 - DNA, 20 bp, Homo sapiens
tctctgccctgggctcctct

SEQ ID NO: 5947790 - DNA, 21 bp, Homo sapiens
tctctgccctgggctcctctt

SEQ ID NO: 5947791 - DNA, 14 bp, Homo sapiens
tctctgccctgtgt

SEQ ID NO: 5947792 - DNA, 20 bp, Homo sapiens
tctctgcccttgatcagccc

SEQ ID NO: 5947793 - DNA, 17 bp, Homo sapiens
tctctgccgcctgcgtt

SEQ ID NO: 5947794 - DNA, 15 bp, Homo sapiens
tctctgccggctctt

SEQ ID NO: 5947795 - DNA, 19 bp, Homo sapiens
tctctgccggctctttcct

SEQ ID NO: 5947796 - DNA, 24 bp, Homo sapiens
tctctgccggtggggccagcgctg

SEQ ID NO: 5947797 - DNA, 21 bp, Homo sapiens
tctctgcctagaatctttatt

SEQ ID NO: 5947798 - DNA, 21 bp, Homo sapiens
tctctgcctatttattggggt

SEQ ID NO: 5947799 - DNA, 19 bp, Homo sapiens
tctctgcctcacctggtcg

SEQ ID NO: 5947800 - DNA, 12 bp, Homo sapiens
tctctgcctcct

SEQ ID NO: 5947801 - DNA, 11 bp, Homo sapiens
tctctgcctct

SEQ ID NO: 5947802 - DNA, 15 bp, Homo sapiens
tctctgcctcttccc

SEQ ID NO: 5947803 - DNA, 13 bp, Homo sapiens
tctctgcctgaca

SEQ ID NO: 5947804 - DNA, 19 bp, Homo sapiens
tctctgcctgacaaggcca

SEQ ID NO: 5947805 - DNA, 19 bp, Homo sapiens
tctctgcctgcttcctgga

SEQ ID NO: 5947806 - DNA, 18 bp, Homo sapiens
tctgaaggaatagccaga

SEQ ID NO: 5947807 - DNA, 23 bp, Homo sapiens
tctgaaggaatagccagagagga

SEQ ID NO: 5947808 - DNA, 20 bp, Homo sapiens
tctgaaggacacttcctgcc

SEQ ID NO: 5947809 - DNA, 22 bp, Homo sapiens
tctgaaggacattgcggacagc

SEQ ID NO: 5947810 - DNA, 20 bp, Homo sapiens
tctgaaggagagagtctttt

SEQ ID NO: 5947811 - DNA, 19 bp, Homo sapiens
tctgaaggagattttcctt

SEQ ID NO: 5947812 - DNA, 20 bp, Homo sapiens
tctgaaggagccccattcct

SEQ ID NO: 5947813 - DNA, 21 bp, Homo sapiens
tctgaaggagccccattcctg

SEQ ID NO: 5947814 - DNA, 22 bp, Homo sapiens
tctgaaggatcctggaaccact

SEQ ID NO: 5947815 - DNA, 12 bp, Homo sapiens
tctgaaggattt

SEQ ID NO: 5947816 - DNA, 20 bp, Homo sapiens
tctgaaggattttaaatgct

SEQ ID NO: 5947817 - DNA, 18 bp, Homo sapiens
tctgaaggcaaatataag

SEQ ID NO: 5947818 - DNA, 14 bp, Homo sapiens
tctgaaggcctcca

SEQ ID NO: 5947819 - DNA, 18 bp, Homo sapiens
tctgaaggctgggttctg

SEQ ID NO: 5947820 - DNA, 13 bp, Homo sapiens
tctgaagggaccc

SEQ ID NO: 5947821 - DNA, 19 bp, Homo sapiens
tctgaagggaggggaagag

SEQ ID NO: 5947822 - DNA, 13 bp, Homo sapiens
tctgaagggaggt

SEQ ID NO: 5947823 - DNA, 21 bp, Homo sapiens
tctgaaggggaaaacctcagt

SEQ ID NO: 5947824 - DNA, 23 bp, Homo sapiens
tctgaaggtaaagggacactgga

SEQ ID NO: 5947825 - DNA, 18 bp, Homo sapiens
tctgaaggtccaaagagt

SEQ ID NO: 5947826 - DNA, 23 bp, Homo sapiens
tctgaaggttggaactgctgcca

SEQ ID NO: 5947827 - DNA, 22 bp, Homo sapiens
tctgaagtagagtgttggaaat

SEQ ID NO: 5947828 - DNA, 20 bp, Homo sapiens
tctgaagtagtgtgagtgtt

SEQ ID NO: 5947829 - DNA, 23 bp, Homo sapiens
tctgaagtcacatcacaggacac

SEQ ID NO: 5947830 - DNA, 19 bp, Homo sapiens
tctgaagtcccttcctgtc

SEQ ID NO: 5947831 - DNA, 15 bp, Homo sapiens
tctgaagtctgagcc

SEQ ID NO: 5947832 - DNA, 18 bp, Homo sapiens
tctgaagtctgagcccat

SEQ ID NO: 5947833 - DNA, 22 bp, Homo sapiens
tctgaagtctgagcccatttct

SEQ ID NO: 5947834 - DNA, 22 bp, Homo sapiens
tctgaagtgggaaaaaatagac

SEQ ID NO: 5947835 - DNA, 18 bp, Homo sapiens
tctgaagttatatttcct

SEQ ID NO: 5947836 - DNA, 19 bp, Homo sapiens
tctgaagttatatttccta

SEQ ID NO: 5947837 - DNA, 16 bp, Homo sapiens
tctgaagttggacagc

SEQ ID NO: 5947838 - DNA, 16 bp, Homo sapiens
tctgaagttggccccc

SEQ ID NO: 5947839 - DNA, 10 bp, Homo sapiens
tctgaataaa

SEQ ID NO: 5947840 - DNA, 11 bp, Homo sapiens
tctgaataaaa

SEQ ID NO: 5947841 - DNA, 13 bp, Homo sapiens
tctgaataaaaaa

SEQ ID NO: 5947842 - DNA, 15 bp, Homo sapiens
tctgaataaaaaaga

SEQ ID NO: 5947843 - DNA, 17 bp, Homo sapiens
tctgaataaaaaagatt

SEQ ID NO: 5947844 - DNA, 14 bp, Homo sapiens
tctgaataacttga

SEQ ID NO: 5947845 - DNA, 15 bp, Homo sapiens
tctgaataacttgaa

SEQ ID NO: 5947846 - DNA, 15 bp, Homo sapiens
tctgaataagcactt

SEQ ID NO: 5947847 - DNA, 16 bp, Homo sapiens
tctgaatacaaacatt

SEQ ID NO: 5947848 - DNA, 22 bp, Homo sapiens
tctgaatatatgatttgcatgt

SEQ ID NO: 5947849 - DNA, 10 bp, Homo sapiens
tctgaatatt

SEQ ID NO: 5947850 - DNA, 15 bp, Homo sapiens
tctgaatattagatg

SEQ ID NO: 5947851 - DNA, 15 bp, Homo sapiens
tctgaatattttgta

SEQ ID NO: 5947852 - DNA, 18 bp, Homo sapiens
tctgaatcaaaagctgaa

SEQ ID NO: 5947853 - DNA, 19 bp, Homo sapiens
tctgaatcaagcacactgt

SEQ ID NO: 5947854 - DNA, 21 bp, Homo sapiens
tctgaatcaagcacactgtat

SEQ ID NO: 5947855 - DNA, 12 bp, Homo sapiens
tctgaatcactg

SEQ ID NO: 5947856 - DNA, 17 bp, Homo sapiens
tctgaatcactgttgag

SEQ ID NO: 5947857 - DNA, 16 bp, Homo sapiens
tctgaatctccttgtt

SEQ ID NO: 5947858 - DNA, 15 bp, Homo sapiens
tctgaatctctcaaa

SEQ ID NO: 5947859 - DNA, 17 bp, Homo sapiens
tctgaatctctcaaaat

SEQ ID NO: 5947860 - DNA, 19 bp, Homo sapiens
tctgaatctctcaaaatgt

SEQ ID NO: 5947861 - DNA, 17 bp, Homo sapiens
tctgaatcttctgaaac

SEQ ID NO: 5947862 - DNA, 22 bp, Homo sapiens
tctgaatgaaaataactgaacc

SEQ ID NO: 5947863 - DNA, 23 bp, Homo sapiens
tctgaatgagcctttgtgctttt

SEQ ID NO: 5947864 - DNA, 16 bp, Homo sapiens
tctgaatgctgctact

SEQ ID NO: 5947865 - DNA, 17 bp, Homo sapiens
tctgaatgcttctaagt

SEQ ID NO: 5947866 - DNA, 22 bp, Homo sapiens
tctgaatgcttctaagtaaata

SEQ ID NO: 5947867 - DNA, 13 bp, Homo sapiens
tctgaatggtcca

SEQ ID NO: 5947868 - DNA, 16 bp, Homo sapiens
tctgaatgtagccagc

SEQ ID NO: 5947869 - DNA, 14 bp, Homo sapiens
tctgaatgtattta

SEQ ID NO: 5947870 - DNA, 15 bp, Homo sapiens
tctgaatgtcccaga

SEQ ID NO: 5947871 - DNA, 16 bp, Homo sapiens
tctgaatgtcccagag

SEQ ID NO: 5947872 - DNA, 13 bp, Homo sapiens
tctgaatgttaca

SEQ ID NO: 5947873 - DNA, 12 bp, Homo sapiens
tctgaatgtttg

SEQ ID NO: 5947874 - DNA, 21 bp, Homo sapiens
tctgaattaattaatttggag

SEQ ID NO: 5947875 - DNA, 19 bp, Homo sapiens
tctgaattagtccttgctt

SEQ ID NO: 5947876 - DNA, 19 bp, Homo sapiens
tctgaattcataaaaataa

SEQ ID NO: 5947877 - DNA, 15 bp, Homo sapiens
tctgaattctgccct

SEQ ID NO: 5947878 - DNA, 14 bp, Homo sapiens
tctgaattggaagg

SEQ ID NO: 5947879 - DNA, 20 bp, Homo sapiens
tctgaattgttgaaactaaa

SEQ ID NO: 5947880 - DNA, 18 bp, Homo sapiens
tctgaatttaattctttc

SEQ ID NO: 5947881 - DNA, 12 bp, Homo sapiens
tctgaatttatt

SEQ ID NO: 5947882 - DNA, 15 bp, Homo sapiens
tctgaatttcctttt

SEQ ID NO: 5947883 - DNA, 14 bp, Homo sapiens
tctgaatttgcaaa

SEQ ID NO: 5947884 - DNA, 16 bp, Homo sapiens
tctgaatttgcaaagt

SEQ ID NO: 5947885 - DNA, 23 bp, Homo sapiens
tctgaattttagacgatcacaga

SEQ ID NO: 5947886 - DNA, 13 bp, Homo sapiens
tctgaattttcag

SEQ ID NO: 5947887 - DNA, 18 bp, Homo sapiens
tctgaattttgcaatgta

SEQ ID NO: 5947888 - DNA, 21 bp, Homo sapiens
tctgaattttggggattttca

SEQ ID NO: 5947889 - DNA, 17 bp, Homo sapiens
tctgaatttttaaacaa

SEQ ID NO: 5947890 - DNA, 16 bp, Homo sapiens
tctgacaaagtcatga

SEQ ID NO: 5947891 - DNA, 21 bp, Homo sapiens
tctgacaaagtcatgaagctc

SEQ ID NO: 5947892 - DNA, 15 bp, Homo sapiens
tctgacaacagactt

SEQ ID NO: 5947893 - DNA, 16 bp, Homo sapiens
tctgacaagctggcca

SEQ ID NO: 5947894 - DNA, 19 bp, Homo sapiens
tctgacaatgcgtggcaca

SEQ ID NO: 5947895 - DNA, 21 bp, Homo sapiens
tctgacaattaacatacatca

SEQ ID NO: 5947896 - DNA, 14 bp, Homo sapiens
tctgacacaaaaaa

SEQ ID NO: 5947897 - DNA, 12 bp, Homo sapiens
tctgacacacag

SEQ ID NO: 5947898 - DNA, 16 bp, Homo sapiens
tctgacacatgctctc

SEQ ID NO: 5947899 - DNA, 20 bp, Homo sapiens
tctgacacgcaagtgtgtga

SEQ ID NO: 5947900 - DNA, 17 bp, Homo sapiens
tctgacacttgtggtat

SEQ ID NO: 5947901 - DNA, 18 bp, Homo sapiens
tctgacactttctgctgg

SEQ ID NO: 5947902 - DNA, 22 bp, Homo sapiens
tctgacagagcaagcgaaagag

SEQ ID NO: 5947903 - DNA, 15 bp, Homo sapiens
tctgacagcagcctg

SEQ ID NO: 5947904 - DNA, 16 bp, Homo sapiens
tctgacagcagcctgt

SEQ ID NO: 5947905 - DNA, 19 bp, Homo sapiens
tctgacagcagcctgtgag

SEQ ID NO: 5947906 - DNA, 22 bp, Homo sapiens
tctgacagcaggccactagtga

SEQ ID NO: 5947907 - DNA, 15 bp, Homo sapiens
tctgacagccagagc

SEQ ID NO: 5947908 - DNA, 21 bp, Homo sapiens
tctgacagccctgcggagacc

SEQ ID NO: 5947909 - DNA, 13 bp, Homo sapiens
tctgacagcctca

SEQ ID NO: 5947910 - DNA, 16 bp, Homo sapiens
tctgacaggaagactg

SEQ ID NO: 5947911 - DNA, 18 bp, Homo sapiens
tctgacaggtgaattgga

SEQ ID NO: 5947912 - DNA, 20 bp, Homo sapiens
tctgacagtccacaggggcc

SEQ ID NO: 5947913 - DNA, 23 bp, Homo sapiens
tctgacataatccagtaaaataa

SEQ ID NO: 5947914 - DNA, 18 bp, Homo sapiens
tctgacatccacatgctc

SEQ ID NO: 5947915 - DNA, 12 bp, Homo sapiens
tctgacatccct

SEQ ID NO: 5947916 - DNA, 15 bp, Homo sapiens
tctgacatcccttcc

SEQ ID NO: 5947917 - DNA, 17 bp, Homo sapiens
tctgacatcccttcctg

SEQ ID NO: 5947918 - DNA, 23 bp, Homo sapiens
tctgacatcccttcctggaaaca

SEQ ID NO: 5947919 - DNA, 17 bp, Homo sapiens
tctgacatcctgacctc

SEQ ID NO: 5947920 - DNA, 16 bp, Homo sapiens
tctgacatctctgcaa

SEQ ID NO: 5947921 - DNA, 23 bp, Homo sapiens
tctgacatgtaagaaaatgttac

SEQ ID NO: 5947922 - DNA, 23 bp, Homo sapiens
tctgacattaacagttttccatg

SEQ ID NO: 5947923 - DNA, 22 bp, Homo sapiens
tctgacattatgtggttttaga

SEQ ID NO: 5947924 - DNA, 23 bp, Homo sapiens
tctgacattatgtggttttagat

SEQ ID NO: 5947925 - DNA, 13 bp, Homo sapiens
tctgacattctca

SEQ ID NO: 5947926 - DNA, 21 bp, Homo sapiens
tctgacattctcaggaagccc

SEQ ID NO: 5947927 - DNA, 16 bp, Homo sapiens
tctgaccaaaaccaga

SEQ ID NO: 5947928 - DNA, 12 bp, Homo sapiens
tctgaccacact

SEQ ID NO: 5947929 - DNA, 18 bp, Homo sapiens
tctgaccacacttcctgt

SEQ ID NO: 5947930 - DNA, 22 bp, Homo sapiens
tctgaccacacttcctgtccag

SEQ ID NO: 5947931 - DNA, 14 bp, Homo sapiens
tctgaccagagaat

SEQ ID NO: 5947932 - DNA, 20 bp, Homo sapiens
tctgaccatctgtgactata

SEQ ID NO: 5947933 - DNA, 18 bp, Homo sapiens
tctgaccatttcaggggt

SEQ ID NO: 5947934 - DNA, 22 bp, Homo sapiens
tctgacccaagtggggcctcct

SEQ ID NO: 5947935 - DNA, 13 bp, Homo sapiens
tctgacccacagc

SEQ ID NO: 5947936 - DNA, 21 bp, Homo sapiens
tctgacccacagcctccaagt

SEQ ID NO: 5947937 - DNA, 22 bp, Homo sapiens
tctgacccacagcctccaagtc

SEQ ID NO: 5947938 - DNA, 15 bp, Homo sapiens
tctgacccactgctt

SEQ ID NO: 5947939 - DNA, 17 bp, Homo sapiens
tctgacccactttgtaa

SEQ ID NO: 5947940 - DNA, 21 bp, Homo sapiens
tctgacccagggcctaggacg

SEQ ID NO: 5947941 - DNA, 14 bp, Homo sapiens
tctgacccagtgag

SEQ ID NO: 5947942 - DNA, 15 bp, Homo sapiens
tctgacccatgctgc

SEQ ID NO: 5947943 - DNA, 20 bp, Homo sapiens
tctgacccatgctgccctgt

SEQ ID NO: 5947944 - DNA, 23 bp, Homo sapiens
tctgacccatgctgccctgtgag

SEQ ID NO: 5947945 - DNA, 13 bp, Homo sapiens
tctgaccccaagg

SEQ ID NO: 5947946 - DNA, 24 bp, Homo sapiens
tctgaccccaagggggctgctgct

SEQ ID NO: 5947947 - DNA, 18 bp, Homo sapiens
tctgaccccacttatgct

SEQ ID NO: 5947948 - DNA, 21 bp, Homo sapiens
tctgaccccacttatgctgct

SEQ ID NO: 5947949 - DNA, 23 bp, Homo sapiens
tctgaccccacttatgctgctgt

SEQ ID NO: 5947950 - DNA, 13 bp, Homo sapiens
tctgaccccagcc

SEQ ID NO: 5947951 - DNA, 14 bp, Homo sapiens
tctgaccccagccc

SEQ ID NO: 5947952 - DNA, 17 bp, Homo sapiens
tctgaccccagcccaga

SEQ ID NO: 5947953 - DNA, 22 bp, Homo sapiens
tctgaccccagtggaaaacaaa

SEQ ID NO: 5947954 - DNA, 13 bp, Homo sapiens
tctgacccctcct

SEQ ID NO: 5947955 - DNA, 21 bp, Homo sapiens
tctgacccggttgcagtcact

SEQ ID NO: 5947956 - DNA, 12 bp, Homo sapiens
tctgaccctcct

SEQ ID NO: 5947957 - DNA, 17 bp, Homo sapiens
tctgaccctgggctttc

SEQ ID NO: 5947958 - DNA, 17 bp, Homo sapiens
tctgaccgttttcactt

SEQ ID NO: 5947959 - DNA, 21 bp, Homo sapiens
tctgacctaaaagttgaaaag

SEQ ID NO: 5947960 - DNA, 14 bp, Homo sapiens
tctgacctcagcat

SEQ ID NO: 5947961 - DNA, 16 bp, Homo sapiens
tctgacctcctctggg

SEQ ID NO: 5947962 - DNA, 14 bp, Homo sapiens
tctgacctctgctg

SEQ ID NO: 5947963 - DNA, 15 bp, Homo sapiens
tctgacctctgctga

SEQ ID NO: 5947964 - DNA, 18 bp, Homo sapiens
tctgacctctttggaaac

SEQ ID NO: 5947965 - DNA, 16 bp, Homo sapiens
tctgacctgcaggcca

SEQ ID NO: 5947966 - DNA, 17 bp, Homo sapiens
tctgacctgcaggccaa

SEQ ID NO: 5947967 - DNA, 19 bp, Homo sapiens
tctgacctgcaggccaaga

SEQ ID NO: 5947968 - DNA, 23 bp, Homo sapiens
tctgacctgcccccgctctgcca

SEQ ID NO: 5947969 - DNA, 12 bp, Homo sapiens
tctgacctggtg

SEQ ID NO: 5947970 - DNA, 20 bp, Homo sapiens
tctgaccttcacagggacag

SEQ ID NO: 5947971 - DNA, 21 bp, Homo sapiens
tctgaccttcacagggacaga

SEQ ID NO: 5947972 - DNA, 15 bp, Homo sapiens
tctgaccttcagctc

SEQ ID NO: 5947973 - DNA, 18 bp, Homo sapiens
tctgaccttccagagccc

SEQ ID NO: 5947974 - DNA, 21 bp, Homo sapiens
tctgaccttccagagcccaag

SEQ ID NO: 5947975 - DNA, 15 bp, Homo sapiens
tctgaccttgctgcc

SEQ ID NO: 5947976 - DNA, 21 bp, Homo sapiens
tctgaccttgtgaacatcaga

SEQ ID NO: 5947977 - DNA, 19 bp, Homo sapiens
tctgacgcaccactgccaa

SEQ ID NO: 5947978 - DNA, 18 bp, Homo sapiens
tctgacgcagcctgagaa

SEQ ID NO: 5947979 - DNA, 20 bp, Homo sapiens
tctgacgcagcctgagaatg

SEQ ID NO: 5947980 - DNA, 17 bp, Homo sapiens
tctgacgcttgtgacag

SEQ ID NO: 5947981 - DNA, 18 bp, Homo sapiens
tctgacgcttgtgacagt

SEQ ID NO: 5947982 - DNA, 15 bp, Homo sapiens
tctgacgggatttgt

SEQ ID NO: 5947983 - DNA, 13 bp, Homo sapiens
tctgcccctccct

SEQ ID NO: 5947984 - DNA, 15 bp, Homo sapiens
tctgcccctccctgc

SEQ ID NO: 5947985 - DNA, 18 bp, Homo sapiens
tctgcccctccctgcttc

SEQ ID NO: 5947986 - DNA, 20 bp, Homo sapiens
tctgcccctccgtccccagg

SEQ ID NO: 5947987 - DNA, 21 bp, Homo sapiens
tctgcccctccgtccccaggg

SEQ ID NO: 5947988 - DNA, 20 bp, Homo sapiens
tctgcccctctactgttgca

SEQ ID NO: 5947989 - DNA, 13 bp, Homo sapiens
tctgcccctcttc

SEQ ID NO: 5947990 - DNA, 15 bp, Homo sapiens
tctgcccctgatcac

SEQ ID NO: 5947991 - DNA, 19 bp, Homo sapiens
tctgcccctgcagctggaa

SEQ ID NO: 5947992 - DNA, 21 bp, Homo sapiens
tctgccccttgaccccacacg

SEQ ID NO: 5947993 - DNA, 19 bp, Homo sapiens
tctgccccttgggcctccc

SEQ ID NO: 5947994 - DNA, 14 bp, Homo sapiens
tctgcccgcagagc

SEQ ID NO: 5947995 - DNA, 10 bp, Homo sapiens
tctgcccggg

SEQ ID NO: 5947996 - DNA, 18 bp, Homo sapiens
tctgcccgggccccttgc

SEQ ID NO: 5947997 - DNA, 18 bp, Homo sapiens
tctgccctcattactggg

SEQ ID NO: 5947998 - DNA, 14 bp, Homo sapiens
tctgccctccaaga

SEQ ID NO: 5947999 - DNA, 16 bp, Homo sapiens
tctgccctccctggcc

SEQ ID NO: 5948000 - DNA, 19 bp, Homo sapiens
tctgccctccctggcctca

SEQ ID NO: 5948001 - DNA, 22 bp, Homo sapiens
tctgccctcgggtggggctggt

SEQ ID NO: 5948002 - DNA, 14 bp, Homo sapiens
tctgccctctgctg

SEQ ID NO: 5948003 - DNA, 16 bp, Homo sapiens
tctgccctctgctgct

SEQ ID NO: 5948004 - DNA, 13 bp, Homo sapiens
tctgccctgagcc

SEQ ID NO: 5948005 - DNA, 19 bp, Homo sapiens
tctgccctgagccctccac

SEQ ID NO: 5948006 - DNA, 13 bp, Homo sapiens
tctgccctgccca

SEQ ID NO: 5948007 - DNA, 14 bp, Homo sapiens
tctgccctgcccac

SEQ ID NO: 5948008 - DNA, 18 bp, Homo sapiens
tctgccctgccctagctc

SEQ ID NO: 5948009 - DNA, 15 bp, Homo sapiens
tctgccctgcctgag

SEQ ID NO: 5948010 - DNA, 17 bp, Homo sapiens
tctgccctgcctgagga

SEQ ID NO: 5948011 - DNA, 11 bp, Homo sapiens
tctgccctgcg

SEQ ID NO: 5948012 - DNA, 12 bp, Homo sapiens
tctgccctggat

SEQ ID NO: 5948013 - DNA, 13 bp, Homo sapiens
tctgccctggctg

SEQ ID NO: 5948014 - DNA, 14 bp, Homo sapiens
tctgccctggctgc

SEQ ID NO: 5948015 - DNA, 15 bp, Homo sapiens
tctgccctggctgct

SEQ ID NO: 5948016 - DNA, 14 bp, Homo sapiens
tctgccctgggctc

SEQ ID NO: 5948017 - DNA, 13 bp, Homo sapiens
tctgccctgtata

SEQ ID NO: 5948018 - DNA, 19 bp, Homo sapiens
tctgcccttatggagctca

SEQ ID NO: 5948019 - DNA, 16 bp, Homo sapiens
tctgcccttcacccca

SEQ ID NO: 5948020 - DNA, 16 bp, Homo sapiens
tctgcccttcccctcc

SEQ ID NO: 5948021 - DNA, 15 bp, Homo sapiens
tctgcccttcctcca

SEQ ID NO: 5948022 - DNA, 16 bp, Homo sapiens
tctgcccttcctccag

SEQ ID NO: 5948023 - DNA, 17 bp, Homo sapiens
tctgcccttcctccagg

SEQ ID NO: 5948024 - DNA, 19 bp, Homo sapiens
tctgcccttctctgcctcc

SEQ ID NO: 5948025 - DNA, 12 bp, Homo sapiens
tctgcccttggg

SEQ ID NO: 5948026 - DNA, 22 bp, Homo sapiens
tctgccctttaagagcacccgg

SEQ ID NO: 5948027 - DNA, 22 bp, Homo sapiens
tctgccctttcctaggcccagg

SEQ ID NO: 5948028 - DNA, 19 bp, Homo sapiens
tctgccgaccgcctgcttc

SEQ ID NO: 5948029 - DNA, 21 bp, Homo sapiens
tctgccgaccgcctgcttcac

SEQ ID NO: 5948030 - DNA, 22 bp, Homo sapiens
tctgccgaccgcctgcttcaca

SEQ ID NO: 5948031 - DNA, 14 bp, Homo sapiens
tctgccgcagccct

SEQ ID NO: 5948032 - DNA, 15 bp, Homo sapiens
tctgccgcctggggc

SEQ ID NO: 5948033 - DNA, 19 bp, Homo sapiens
tctgccgctacctccctcc

SEQ ID NO: 5948034 - DNA, 13 bp, Homo sapiens
tctgccgctgcca

SEQ ID NO: 5948035 - DNA, 14 bp, Homo sapiens
tctgccgctgccat

SEQ ID NO: 5948036 - DNA, 15 bp, Homo sapiens
tctgccggccctggg

SEQ ID NO: 5948037 - DNA, 17 bp, Homo sapiens
tctgccggccctggggc

SEQ ID NO: 5948038 - DNA, 23 bp, Homo sapiens
tctgccggctctttccttgctca

SEQ ID NO: 5948039 - DNA, 19 bp, Homo sapiens
tctgccggtcgggcagcca

SEQ ID NO: 5948040 - DNA, 21 bp, Homo sapiens
tctgccggtgctcggagaaga

SEQ ID NO: 5948041 - DNA, 16 bp, Homo sapiens
tctgccggtggggcca

SEQ ID NO: 5948042 - DNA, 22 bp, Homo sapiens
tctgccggtggggccagcgctg

SEQ ID NO: 5948043 - DNA, 23 bp, Homo sapiens
tctgccggtggggccagcgctga

SEQ ID NO: 5948044 - DNA, 14 bp, Homo sapiens
tctgccgtctctgg

SEQ ID NO: 5948045 - DNA, 15 bp, Homo sapiens
tctgccgtctctgga

SEQ ID NO: 5948046 - DNA, 22 bp, Homo sapiens
tctgcctaaccatgggctcagg

SEQ ID NO: 5948047 - DNA, 23 bp, Homo sapiens
tctgcctaaccatgggctcaggg

SEQ ID NO: 5948048 - DNA, 20 bp, Homo sapiens
tctgcctaacttgtaaaaag

SEQ ID NO: 5948049 - DNA, 13 bp, Homo sapiens
tctgcctaaggac

SEQ ID NO: 5948050 - DNA, 16 bp, Homo sapiens
tctgcctaaggacttc

SEQ ID NO: 5948051 - DNA, 23 bp, Homo sapiens
tctgcctaaggacttctttaatt

SEQ ID NO: 5948052 - DNA, 15 bp, Homo sapiens
tctgcctacagccag

SEQ ID NO: 5948053 - DNA, 19 bp, Homo sapiens
tctgcctacgttctcttta

SEQ ID NO: 5948054 - DNA, 17 bp, Homo sapiens
tctgcctagaaacagtg

SEQ ID NO: 5948055 - DNA, 18 bp, Homo sapiens
tctgcctagaatctttat

SEQ ID NO: 5948056 - DNA, 19 bp, Homo sapiens
tctgcctagagtgtagcct

SEQ ID NO: 5948057 - DNA, 16 bp, Homo sapiens
tctgcctaggagctgg

SEQ ID NO: 5948058 - DNA, 21 bp, Homo sapiens
tctgcctaggagctggctggc

SEQ ID NO: 5948059 - DNA, 23 bp, Homo sapiens
tctgcctataaatttactctgtt

SEQ ID NO: 5948060 - DNA, 22 bp, Homo sapiens
tctgcctatgcactgaagagct

SEQ ID NO: 5948061 - DNA, 23 bp, Homo sapiens
tctgcctatgcactgaagagctc

SEQ ID NO: 5948062 - DNA, 16 bp, Homo sapiens
tctgcctatttattgg

SEQ ID NO: 5948063 - DNA, 19 bp, Homo sapiens
tctgcctcaactccaccct

SEQ ID NO: 5948064 - DNA, 16 bp, Homo sapiens
tctgcctcaatgtgaa

SEQ ID NO: 5948065 - DNA, 21 bp, Homo sapiens
tctgcctcaatgtgaatcaga

SEQ ID NO: 5948066 - DNA, 20 bp, Homo sapiens
tctgcctcacatagcttaca

SEQ ID NO: 5948067 - DNA, 21 bp, Homo sapiens
tctgcctcaccgcttccctcc

SEQ ID NO: 5948068 - DNA, 20 bp, Homo sapiens
tctgcctcagacgttgcctg

SEQ ID NO: 5948069 - DNA, 16 bp, Homo sapiens
tctgcctcagcctcct

SEQ ID NO: 5948070 - DNA, 16 bp, Homo sapiens
tctgcctcatcctcct

SEQ ID NO: 5948071 - DNA, 21 bp, Homo sapiens
tctgcctcatcctcctcctca

SEQ ID NO: 5948072 - DNA, 19 bp, Homo sapiens
tctgcctccaacccagcag

SEQ ID NO: 5948073 - DNA, 14 bp, Homo sapiens
tctgcctccaccct

SEQ ID NO: 5948074 - DNA, 15 bp, Homo sapiens
tctgcctccagccaa

SEQ ID NO: 5948075 - DNA, 19 bp, Homo sapiens
tctgcctcctcctcacgca

SEQ ID NO: 5948076 - DNA, 13 bp, Homo sapiens
tctgcctcctggt

SEQ ID NO: 5948077 - DNA, 17 bp, Homo sapiens
tctgcctctaactccct

SEQ ID NO: 5948078 - DNA, 19 bp, Homo sapiens
tctgcctctaactccctcc

SEQ ID NO: 5948079 - DNA, 21 bp, Homo sapiens
tctgcctctaactccctcctc

SEQ ID NO: 5948080 - DNA, 21 bp, Homo sapiens
tctgcctctagtccccaaggc

SEQ ID NO: 5948081 - DNA, 15 bp, Homo sapiens
tctgcctctctagga

SEQ ID NO: 5948082 - DNA, 13 bp, Homo sapiens
tctgcctctctgg

SEQ ID NO: 5948083 - DNA, 22 bp, Homo sapiens
tctgcctctgacacacagctct

SEQ ID NO: 5948084 - DNA, 13 bp, Homo sapiens
tctgcctctgggc

SEQ ID NO: 5948085 - DNA, 14 bp, Homo sapiens
tctgcctctgggca

SEQ ID NO: 5948086 - DNA, 18 bp, Homo sapiens
tctgcctcttctgggagg

SEQ ID NO: 5948087 - DNA, 19 bp, Homo sapiens
tctgcctcttctgggaggg

SEQ ID NO: 5948088 - DNA, 20 bp, Homo sapiens
tctgcctgaagtcacacagt

SEQ ID NO: 5948089 - DNA, 17 bp, Homo sapiens
tctgcctgacaaggcca

SEQ ID NO: 5948090 - DNA, 16 bp, Homo sapiens
tctgcctgacagcatc

SEQ ID NO: 5948091 - DNA, 16 bp, Homo sapiens
tctgcctgaccccagg

SEQ ID NO: 5948092 - DNA, 15 bp, Homo sapiens
tctgcctgagattct

SEQ ID NO: 5948093 - DNA, 16 bp, Homo sapiens
tctgcctgagattctt

SEQ ID NO: 5948094 - DNA, 18 bp, Homo sapiens
tctgcctgcactccctgg

SEQ ID NO: 5948095 - DNA, 21 bp, Homo sapiens
tctgcctgcactccctggcct

SEQ ID NO: 5948096 - DNA, 14 bp, Homo sapiens
tctgcctgcccagg

SEQ ID NO: 5948097 - DNA, 15 bp, Homo sapiens
tctgcctgcccaggc

SEQ ID NO: 5948098 - DNA, 14 bp, Homo sapiens
tctgcctgccccgc

SEQ ID NO: 5948099 - DNA, 12 bp, Homo sapiens
tctgcctgccct

SEQ ID NO: 5948100 - DNA, 14 bp, Homo sapiens
tctgcctgccctga

SEQ ID NO: 5948101 - DNA, 15 bp, Homo sapiens
tctgcctgctgggct

SEQ ID NO: 5948102 - DNA, 17 bp, Homo sapiens
tctgcctgcttcctgga

SEQ ID NO: 5948103 - DNA, 18 bp, Homo sapiens
tctgcctgcttcctggac

SEQ ID NO: 5948104 - DNA, 20 bp, Homo sapiens
tctgcctgcttcctggaccg

SEQ ID NO: 5948105 - DNA, 9 bp, Homo sapiens
tctgcctgg

SEQ ID NO: 5948106 - DNA, 16 bp, Homo sapiens
tctgcctggagcctgg

SEQ ID NO: 5948107 - DNA, 23 bp, Homo sapiens
tctgcctggaggcaaaggcctgg

SEQ ID NO: 5948108 - DNA, 10 bp, Homo sapiens
tctgcctggc

SEQ ID NO: 5948109 - DNA, 17 bp, Homo sapiens
tctgcctggcctggctc

SEQ ID NO: 5948110 - DNA, 14 bp, Homo sapiens
tctgcctgggatgc

SEQ ID NO: 5948111 - DNA, 19 bp, Homo sapiens
tctgcctgggatgcccttc

SEQ ID NO: 5948112 - DNA, 19 bp, Homo sapiens
tctgcctgggcaatggcca

SEQ ID NO: 5948113 - DNA, 23 bp, Homo sapiens
tctgcctgggccgtggcacagct

SEQ ID NO: 5948114 - DNA, 14 bp, Homo sapiens
tctgcctgggctct

SEQ ID NO: 5948115 - DNA, 23 bp, Homo sapiens
tctgcctggggcctccagaagct

SEQ ID NO: 5948116 - DNA, 21 bp, Homo sapiens
tctgcctgggttttgttccct

SEQ ID NO: 5948117 - DNA, 22 bp, Homo sapiens
tctgcctggttccctccccaag

SEQ ID NO: 5948118 - DNA, 21 bp, Homo sapiens
tctgcctggttttatttatat

SEQ ID NO: 5948119 - DNA, 13 bp, Homo sapiens
tctgcctgtattt

SEQ ID NO: 5948120 - DNA, 13 bp, Homo sapiens
tctgcctgtccct

SEQ ID NO: 5948121 - DNA, 13 bp, Homo sapiens
tctgcctgtgccc

SEQ ID NO: 5948122 - DNA, 22 bp, Homo sapiens
tctgcctgttataactctgcac

SEQ ID NO: 5948123 - DNA, 20 bp, Homo sapiens
tctgccttaaaaccaaagag

SEQ ID NO: 5948124 - DNA, 17 bp, Homo sapiens
tctgccttactggtttc

SEQ ID NO: 5948125 - DNA, 23 bp, Homo sapiens
tctgccttactggtttccccagg

SEQ ID NO: 5948126 - DNA, 13 bp, Homo sapiens
tctgccttagcct

SEQ ID NO: 5948127 - DNA, 17 bp, Homo sapiens
tctgccttagcctacca

SEQ ID NO: 5948128 - DNA, 19 bp, Homo sapiens
tctgccttatctcatttct

SEQ ID NO: 5948129 - DNA, 19 bp, Homo sapiens
tctgccttcacaaatgtca

SEQ ID NO: 5948130 - DNA, 12 bp, Homo sapiens
tctgccttccag

SEQ ID NO: 5948131 - DNA, 20 bp, Homo sapiens
tctgccttccagcccagacc

SEQ ID NO: 5948132 - DNA, 13 bp, Homo sapiens
tctgccttcccaa

SEQ ID NO: 5948133 - DNA, 18 bp, Homo sapiens
tctgccttctcaggcccc

SEQ ID NO: 5948134 - DNA, 21 bp, Homo sapiens
tctgccttgcacaaaaagcac

SEQ ID NO: 5948135 - DNA, 13 bp, Homo sapiens
tctgccttgcact

SEQ ID NO: 5948136 - DNA, 12 bp, Homo sapiens
tctgccttgcct

SEQ ID NO: 5948137 - DNA, 13 bp, Homo sapiens
tctgccttgcctt

SEQ ID NO: 5948138 - DNA, 13 bp, Homo sapiens
tctgccttgctgc

SEQ ID NO: 5948139 - DNA, 16 bp, Homo sapiens
tctgccttggacacca

SEQ ID NO: 5948140 - DNA, 14 bp, Homo sapiens
tctgccttggcctc

SEQ ID NO: 5948141 - DNA, 20 bp, Homo sapiens
tctgccttggcttggacaaa

SEQ ID NO: 5948142 - DNA, 20 bp, Homo sapiens
tctgcctttaattttcttgt

SEQ ID NO: 5948143 - DNA, 11 bp, Homo sapiens
tctgcctttat

SEQ ID NO: 5948144 - DNA, 14 bp, Homo sapiens
tctgcctttatgat

SEQ ID NO: 5948145 - DNA, 23 bp, Homo sapiens
tctgcctttattgtgtttgtcat

SEQ ID NO: 5948146 - DNA, 19 bp, Homo sapiens
tctgcctttcccccctcac

SEQ ID NO: 5948147 - DNA, 10 bp, Homo sapiens
tctgcctttg

SEQ ID NO: 5948148 - DNA, 13 bp, Homo sapiens
tctgcctttgagc

SEQ ID NO: 5948149 - DNA, 18 bp, Homo sapiens
tctgcctttgagcttctc

SEQ ID NO: 5948150 - DNA, 21 bp, Homo sapiens
tctgcctttgccaggtgactg

SEQ ID NO: 5948151 - DNA, 16 bp, Homo sapiens
tctgcctttgttcact

SEQ ID NO: 5948152 - DNA, 19 bp, Homo sapiens
tctgccttttttcacagcc

SEQ ID NO: 5948153 - DNA, 14 bp, Homo sapiens
tctgcgaagtccta

SEQ ID NO: 5948154 - DNA, 18 bp, Homo sapiens
tctgcgacgatccccatg

SEQ ID NO: 5948155 - DNA, 17 bp, Homo sapiens
tctgcgattttatctgt

SEQ ID NO: 5948156 - DNA, 21 bp, Homo sapiens
tctgcgccaggcagagctgag

SEQ ID NO: 5948157 - DNA, 20 bp, Homo sapiens
tctgcgccccgcctccccat

SEQ ID NO: 5948158 - DNA, 13 bp, Homo sapiens
tctgcgcccttgt

SEQ ID NO: 5948159 - DNA, 15 bp, Homo sapiens
tctgcgccgctgtgc

SEQ ID NO: 5948160 - DNA, 19 bp, Homo sapiens
tctgcgcggatgtagcatg

SEQ ID NO: 5948161 - DNA, 14 bp, Homo sapiens
tctgcggagcacac

SEQ ID NO: 5948162 - DNA, 23 bp, Homo sapiens
tctggcccaagctgggctccctt

SEQ ID NO: 5948163 - DNA, 14 bp, Homo sapiens
tctggcccaccagg

SEQ ID NO: 5948164 - DNA, 21 bp, Homo sapiens
tctggcccagccatggctgga

SEQ ID NO: 5948165 - DNA, 12 bp, Homo sapiens
tctggcccaggc

SEQ ID NO: 5948166 - DNA, 13 bp, Homo sapiens
tctggcccaggct

SEQ ID NO: 5948167 - DNA, 22 bp, Homo sapiens
tctggcccaggctggcccccac

SEQ ID NO: 5948168 - DNA, 13 bp, Homo sapiens
tctggcccagggt

SEQ ID NO: 5948169 - DNA, 24 bp, Homo sapiens
tctggccccctattgtctccaagg

SEQ ID NO: 5948170 - DNA, 24 bp, Homo sapiens
tctggcccctccgcgagggctact

SEQ ID NO: 5948171 - DNA, 13 bp, Homo sapiens
tctggccctagac

SEQ ID NO: 5948172 - DNA, 23 bp, Homo sapiens
tctggccctcacccctgccctgg

SEQ ID NO: 5948173 - DNA, 18 bp, Homo sapiens
tctggccctgacttctgg

SEQ ID NO: 5948174 - DNA, 22 bp, Homo sapiens
tctggccctgacttctggagat

SEQ ID NO: 5948175 - DNA, 14 bp, Homo sapiens
tctggccctgctgc

SEQ ID NO: 5948176 - DNA, 17 bp, Homo sapiens
tctggccctgctgcccc

SEQ ID NO: 5948177 - DNA, 20 bp, Homo sapiens
tctggccctggcgggtggct

SEQ ID NO: 5948178 - DNA, 21 bp, Homo sapiens
tctggccctggggatcttccc

SEQ ID NO: 5948179 - DNA, 23 bp, Homo sapiens
tctggccctgtgtaggggcaggg

SEQ ID NO: 5948180 - DNA, 18 bp, Homo sapiens
tctggccctgttgtgggg

SEQ ID NO: 5948181 - DNA, 21 bp, Homo sapiens
tctggcccttacacactcagg

SEQ ID NO: 5948182 - DNA, 14 bp, Homo sapiens
tctggcccttggaa

SEQ ID NO: 5948183 - DNA, 15 bp, Homo sapiens
tctggcccttggaat

SEQ ID NO: 5948184 - DNA, 17 bp, Homo sapiens
tctggcccttggaataa

SEQ ID NO: 5948185 - DNA, 15 bp, Homo sapiens
tctggccgccacccc

SEQ ID NO: 5948186 - DNA, 18 bp, Homo sapiens
tctggccgctgcagtcag

SEQ ID NO: 5948187 - DNA, 14 bp, Homo sapiens
tctggccggtgctg

SEQ ID NO: 5948188 - DNA, 18 bp, Homo sapiens
tctggccggtgctgggtt

SEQ ID NO: 5948189 - DNA, 17 bp, Homo sapiens
tctggcctaaaatcttg

SEQ ID NO: 5948190 - DNA, 20 bp, Homo sapiens
tctggcctagtcccttccac

SEQ ID NO: 5948191 - DNA, 13 bp, Homo sapiens
tctggcctcagca

SEQ ID NO: 5948192 - DNA, 14 bp, Homo sapiens
tctggcctccagcc

SEQ ID NO: 5948193 - DNA, 14 bp, Homo sapiens
tctggcctcccaca

SEQ ID NO: 5948194 - DNA, 21 bp, Homo sapiens
tctggcctcctaaggctcccc

SEQ ID NO: 5948195 - DNA, 12 bp, Homo sapiens
tctggcctgagg

SEQ ID NO: 5948196 - DNA, 11 bp, Homo sapiens
tctggcctgcc

SEQ ID NO: 5948197 - DNA, 14 bp, Homo sapiens
tctggcctggccag

SEQ ID NO: 5948198 - DNA, 13 bp, Homo sapiens
tctggcctggcct

SEQ ID NO: 5948199 - DNA, 17 bp, Homo sapiens
tctggcctggcctggcc

SEQ ID NO: 5948200 - DNA, 18 bp, Homo sapiens
tctggcctggcctggccc

SEQ ID NO: 5948201 - DNA, 19 bp, Homo sapiens
tctggcctggcctggccct

SEQ ID NO: 5948202 - DNA, 23 bp, Homo sapiens
tctggcctggcctggccctgccc

SEQ ID NO: 5948203 - DNA, 21 bp, Homo sapiens
tctggccttggttcctccagc

SEQ ID NO: 5948204 - DNA, 22 bp, Homo sapiens
tctggccttggttcctccagca

SEQ ID NO: 5948205 - DNA, 14 bp, Homo sapiens
tctggcctttccta

SEQ ID NO: 5948206 - DNA, 14 bp, Homo sapiens
tctggccttttcct

SEQ ID NO: 5948207 - DNA, 22 bp, Homo sapiens
tctggcgacagttttccttctc

SEQ ID NO: 5948208 - DNA, 21 bp, Homo sapiens
tctggcgcccctgcctgtgcc

SEQ ID NO: 5948209 - DNA, 22 bp, Homo sapiens
tctggcggaggtctctgggagc

SEQ ID NO: 5948210 - DNA, 16 bp, Homo sapiens
tctggcggtggccaca

SEQ ID NO: 5948211 - DNA, 20 bp, Homo sapiens
tctggcgttctcaagaatct

SEQ ID NO: 5948212 - DNA, 23 bp, Homo sapiens
tctggctagagccgaggggagag

SEQ ID NO: 5948213 - DNA, 17 bp, Homo sapiens
tctggctagagggccca

SEQ ID NO: 5948214 - DNA, 23 bp, Homo sapiens
tctggctaggggccgagtccagg

SEQ ID NO: 5948215 - DNA, 22 bp, Homo sapiens
tctggctatgcatttgaaaatt

SEQ ID NO: 5948216 - DNA, 14 bp, Homo sapiens
tctggctcagctgt

SEQ ID NO: 5948217 - DNA, 19 bp, Homo sapiens
tctggctcagggcccacct

SEQ ID NO: 5948218 - DNA, 22 bp, Homo sapiens
tctggctccccaaggctgcaaa

SEQ ID NO: 5948219 - DNA, 16 bp, Homo sapiens
tctggctccctgcccc

SEQ ID NO: 5948220 - DNA, 17 bp, Homo sapiens
tctggctccctgcccct

SEQ ID NO: 5948221 - DNA, 16 bp, Homo sapiens
tctggctccgaaaaac

SEQ ID NO: 5948222 - DNA, 15 bp, Homo sapiens
tctggctcctccttc

SEQ ID NO: 5948223 - DNA, 14 bp, Homo sapiens
tctggctcctgttt

SEQ ID NO: 5948224 - DNA, 12 bp, Homo sapiens
tctggctctaat

SEQ ID NO: 5948225 - DNA, 15 bp, Homo sapiens
tctggctctccccaa

SEQ ID NO: 5948226 - DNA, 13 bp, Homo sapiens
tctggctctgcct

SEQ ID NO: 5948227 - DNA, 14 bp, Homo sapiens
tctggctctgctgg

SEQ ID NO: 5948228 - DNA, 15 bp, Homo sapiens
tctggctcttccagg

SEQ ID NO: 5948229 - DNA, 23 bp, Homo sapiens
tctggctcttccaggctgggaga

SEQ ID NO: 5948230 - DNA, 16 bp, Homo sapiens
tctggctgaaaatggt

SEQ ID NO: 5948231 - DNA, 16 bp, Homo sapiens
tctggctgaaccctgt

SEQ ID NO: 5948232 - DNA, 19 bp, Homo sapiens
tctggctgaaccctgtgct

SEQ ID NO: 5948233 - DNA, 20 bp, Homo sapiens
tctggctgaaccctgtgctg

SEQ ID NO: 5948234 - DNA, 12 bp, Homo sapiens
tctggctgagcc

SEQ ID NO: 5948235 - DNA, 17 bp, Homo sapiens
tctggctgagcccctgg

SEQ ID NO: 5948236 - DNA, 18 bp, Homo sapiens
tctggctgagcccctggg

SEQ ID NO: 5948237 - DNA, 15 bp, Homo sapiens
tctggctgagctgaa

SEQ ID NO: 5948238 - DNA, 20 bp, Homo sapiens
tctggctgcaagggccagag

SEQ ID NO: 5948239 - DNA, 14 bp, Homo sapiens
tctggctgcagagc

SEQ ID NO: 5948240 - DNA, 21 bp, Homo sapiens
tctggctgccccaacctgctg

SEQ ID NO: 5948241 - DNA, 19 bp, Homo sapiens
tctggctgcctggcccagg

SEQ ID NO: 5948242 - DNA, 21 bp, Homo sapiens
tctggctggctaactggaagc

SEQ ID NO: 5948243 - DNA, 20 bp, Homo sapiens
tctggctggtgttaacagaa

SEQ ID NO: 5948244 - DNA, 19 bp, Homo sapiens
tctggctgtctagaatgtg

SEQ ID NO: 5948245 - DNA, 17 bp, Homo sapiens
tctggctgtgacagcct

SEQ ID NO: 5948246 - DNA, 13 bp, Homo sapiens
tctggctgtggtc

SEQ ID NO: 5948247 - DNA, 19 bp, Homo sapiens
tctggctgtgtggccaagg

SEQ ID NO: 5948248 - DNA, 18 bp, Homo sapiens
tctggctgtttagcagaa

SEQ ID NO: 5948249 - DNA, 19 bp, Homo sapiens
tctggctgtttagcagaac

SEQ ID NO: 5948250 - DNA, 23 bp, Homo sapiens
tctggcttaaacaacacctcctc

SEQ ID NO: 5948251 - DNA, 14 bp, Homo sapiens
tctggcttagaaat

SEQ ID NO: 5948252 - DNA, 23 bp, Homo sapiens
tctggcttagacaccacctggag

SEQ ID NO: 5948253 - DNA, 17 bp, Homo sapiens
tctggcttagtgccacc

SEQ ID NO: 5948254 - DNA, 22 bp, Homo sapiens
tctggcttagtgccacccacct

SEQ ID NO: 5948255 - DNA, 22 bp, Homo sapiens
tctggcttatgctcagaagcca

SEQ ID NO: 5948256 - DNA, 21 bp, Homo sapiens
tctggcttattttaatgtgat

SEQ ID NO: 5948257 - DNA, 21 bp, Homo sapiens
tctggcttcaaaaagccacag

SEQ ID NO: 5948258 - DNA, 22 bp, Homo sapiens
tctggcttcagcccccaccagg

SEQ ID NO: 5948259 - DNA, 15 bp, Homo sapiens
tctggcttccaggta

SEQ ID NO: 5948260 - DNA, 24 bp, Homo sapiens
tctggcttccaggtatctccagga

SEQ ID NO: 5948261 - DNA, 20 bp, Homo sapiens
tctggcttccctaaactgca

SEQ ID NO: 5948262 - DNA, 23 bp, Homo sapiens
tctggcttccctaaactgcagcc

SEQ ID NO: 5948263 - DNA, 15 bp, Homo sapiens
tctggcttccctgcc

SEQ ID NO: 5948264 - DNA, 17 bp, Homo sapiens
tctggcttccctgccca

SEQ ID NO: 5948265 - DNA, 18 bp, Homo sapiens
tctggcttccctgcccaa

SEQ ID NO: 5948266 - DNA, 19 bp, Homo sapiens
tctggcttccctgcccaat

SEQ ID NO: 5948267 - DNA, 22 bp, Homo sapiens
tctggcttctagagatgtgcct

SEQ ID NO: 5948268 - DNA, 20 bp, Homo sapiens
tctggcttctctcttttcct

SEQ ID NO: 5948269 - DNA, 18 bp, Homo sapiens
tctggcttctgaagagcc

SEQ ID NO: 5948270 - DNA, 12 bp, Homo sapiens
tctggcttctgc

SEQ ID NO: 5948271 - DNA, 13 bp, Homo sapiens
tctggcttctgca

SEQ ID NO: 5948272 - DNA, 16 bp, Homo sapiens
tctggcttctgcatta

SEQ ID NO: 5948273 - DNA, 13 bp, Homo sapiens
tctggcttctgct

SEQ ID NO: 5948274 - DNA, 18 bp, Homo sapiens
tctggcttgacagcatga

SEQ ID NO: 5948275 - DNA, 14 bp, Homo sapiens
tctggcttgactgg

SEQ ID NO: 5948276 - DNA, 21 bp, Homo sapiens
tctggcttggccacagccagg

SEQ ID NO: 5948277 - DNA, 14 bp, Homo sapiens
tctggctttaagcc

SEQ ID NO: 5948278 - DNA, 13 bp, Homo sapiens
tctggctttgctc

SEQ ID NO: 5948279 - DNA, 19 bp, Homo sapiens
tctggctttgctctattaa

SEQ ID NO: 5948280 - DNA, 15 bp, Homo sapiens
tctggctttgttctt

SEQ ID NO: 5948281 - DNA, 21 bp, Homo sapiens
tctggctttgttcttgtcatc

SEQ ID NO: 5948282 - DNA, 20 bp, Homo sapiens
tctggctttttcctctgagc

SEQ ID NO: 5948283 - DNA, 22 bp, Homo sapiens
tctggctttttcctctgagccc

SEQ ID NO: 5948284 - DNA, 24 bp, Homo sapiens
tctggctttttctgccactgagga

SEQ ID NO: 5948285 - DNA, 17 bp, Homo sapiens
tctgggaaacagtcccg

SEQ ID NO: 5948286 - DNA, 18 bp, Homo sapiens
tctgggaaaggtgctcaa

SEQ ID NO: 5948287 - DNA, 22 bp, Homo sapiens
tctgggaaaggtgctcaaagat

SEQ ID NO: 5948288 - DNA, 21 bp, Homo sapiens
tctgggaaatgttttaatgcc

SEQ ID NO: 5948289 - DNA, 23 bp, Homo sapiens
tctgggaaattgaagtgtcttct

SEQ ID NO: 5948290 - DNA, 15 bp, Homo sapiens
tctgggaacctccca

SEQ ID NO: 5948291 - DNA, 18 bp, Homo sapiens
tctgggaacctcccagag

SEQ ID NO: 5948292 - DNA, 22 bp, Homo sapiens
tctgggaacctcccagaggtcc

SEQ ID NO: 5948293 - DNA, 15 bp, Homo sapiens
tctgggaactcccaa

SEQ ID NO: 5948294 - DNA, 20 bp, Homo sapiens
tctgggaactgaatcaggaa

SEQ ID NO: 5948295 - DNA, 23 bp, Homo sapiens
tctgggaactgaatcaggaaact

SEQ ID NO: 5948296 - DNA, 19 bp, Homo sapiens
tctgggaagcttgagcctc

SEQ ID NO: 5948297 - DNA, 13 bp, Homo sapiens
tctgggaagggag

SEQ ID NO: 5948298 - DNA, 23 bp, Homo sapiens
tctgggaagggagagggcctctg

SEQ ID NO: 5948299 - DNA, 18 bp, Homo sapiens
tctgggaatcatgtccat

SEQ ID NO: 5948300 - DNA, 18 bp, Homo sapiens
tctgggaatcctggacag

SEQ ID NO: 5948301 - DNA, 17 bp, Homo sapiens
tctgggaattgtgtgtc

SEQ ID NO: 5948302 - DNA, 19 bp, Homo sapiens
tctgggacaggcaccatgc

SEQ ID NO: 5948303 - DNA, 17 bp, Homo sapiens
tctgggaccaggctcca

SEQ ID NO: 5948304 - DNA, 16 bp, Homo sapiens
tctgggacccacagaa

SEQ ID NO: 5948305 - DNA, 19 bp, Homo sapiens
tctgggacccacagaactt

SEQ ID NO: 5948306 - DNA, 15 bp, Homo sapiens
tctgggacccactcc

SEQ ID NO: 5948307 - DNA, 14 bp, Homo sapiens
tctgggaccccagc

SEQ ID NO: 5948308 - DNA, 16 bp, Homo sapiens
tctgggaccccagctg

SEQ ID NO: 5948309 - DNA, 18 bp, Homo sapiens
tctgggaccccagctgct

SEQ ID NO: 5948310 - DNA, 15 bp, Homo sapiens
tctgggaccctttcc

SEQ ID NO: 5948311 - DNA, 13 bp, Homo sapiens
tctgggacctcag

SEQ ID NO: 5948312 - DNA, 15 bp, Homo sapiens
tctgggactccaggt

SEQ ID NO: 5948313 - DNA, 16 bp, Homo sapiens
tctgggactccaggtc

SEQ ID NO: 5948314 - DNA, 13 bp, Homo sapiens
tctgggacttcct

SEQ ID NO: 5948315 - DNA, 15 bp, Homo sapiens
tctgggacttccttg

SEQ ID NO: 5948316 - DNA, 21 bp, Homo sapiens
tctgggacttggtttccccaa

SEQ ID NO: 5948317 - DNA, 13 bp, Homo sapiens
tctgggagaaaat

SEQ ID NO: 5948318 - DNA, 20 bp, Homo sapiens
tctgggagaaaatcatcaag

SEQ ID NO: 5948319 - DNA, 17 bp, Homo sapiens
tctgggagacttactgc

SEQ ID NO: 5948320 - DNA, 16 bp, Homo sapiens
tctgggagagccagct

SEQ ID NO: 5948321 - DNA, 21 bp, Homo sapiens
tctgggagagccagctttgct

SEQ ID NO: 5948322 - DNA, 15 bp, Homo sapiens
tctgggagagcctgg

SEQ ID NO: 5948323 - DNA, 16 bp, Homo sapiens
tctgggagagcctggc

SEQ ID NO: 5948324 - DNA, 15 bp, Homo sapiens
tctgggagaggattt

SEQ ID NO: 5948325 - DNA, 16 bp, Homo sapiens
tctgggagcagaaaca

SEQ ID NO: 5948326 - DNA, 18 bp, Homo sapiens
tctgggagctcaaggcca

SEQ ID NO: 5948327 - DNA, 14 bp, Homo sapiens
tctgggagctggag

SEQ ID NO: 5948328 - DNA, 14 bp, Homo sapiens
tctgggagcttctt

SEQ ID NO: 5948329 - DNA, 13 bp, Homo sapiens
tctgggaggcagg

SEQ ID NO: 5948330 - DNA, 14 bp, Homo sapiens
tctgggaggcaggt

SEQ ID NO: 5948331 - DNA, 13 bp, Homo sapiens
tctgggaggctgg

SEQ ID NO: 5948332 - DNA, 23 bp, Homo sapiens
tctgggaggctggtctccctcca

SEQ ID NO: 5948333 - DNA, 13 bp, Homo sapiens
tctgggaggcttc

SEQ ID NO: 5948334 - DNA, 15 bp, Homo sapiens
tctgggagggaagtg

SEQ ID NO: 5948335 - DNA, 19 bp, Homo sapiens
tctgggagggcagcagggc

SEQ ID NO: 5948336 - DNA, 18 bp, Homo sapiens
tctgggagggggtgagag

SEQ ID NO: 5948337 - DNA, 19 bp, Homo sapiens
tctgggagggggtgagagg

SEQ ID NO: 5948338 - DNA, 18 bp, Homo sapiens
tctgggaggtcttggccg

SEQ ID NO: 5948339 - DNA, 20 bp, Homo sapiens
tctgtgatcttttaaagtgt

SEQ ID NO: 5948340 - DNA, 20 bp, Homo sapiens
tctgtgatgacattccctgc

SEQ ID NO: 5948341 - DNA, 14 bp, Homo sapiens
tctgtgatgagctg

SEQ ID NO: 5948342 - DNA, 16 bp, Homo sapiens
tctgtgatgatcctca

SEQ ID NO: 5948343 - DNA, 22 bp, Homo sapiens
tctgtgatggatggacacaaaa

SEQ ID NO: 5948344 - DNA, 23 bp, Homo sapiens
tctgtgatgtcagtagtgcctgt

SEQ ID NO: 5948345 - DNA, 22 bp, Homo sapiens
tctgtgattacatagatcagcc

SEQ ID NO: 5948346 - DNA, 24 bp, Homo sapiens
tctgtgattacatagatcagccat

SEQ ID NO: 5948347 - DNA, 17 bp, Homo sapiens
tctgtgattacctctca

SEQ ID NO: 5948348 - DNA, 16 bp, Homo sapiens
tctgtgattgggtggg

SEQ ID NO: 5948349 - DNA, 13 bp, Homo sapiens
tctgtgatttctt

SEQ ID NO: 5948350 - DNA, 15 bp, Homo sapiens
tctgtgatttcttct

SEQ ID NO: 5948351 - DNA, 18 bp, Homo sapiens
tctgtgcaaacagtaacg

SEQ ID NO: 5948352 - DNA, 14 bp, Homo sapiens
tctgtgcaataaaa

SEQ ID NO: 5948353 - DNA, 22 bp, Homo sapiens
tctgtgcacactaagaaatggg

SEQ ID NO: 5948354 - DNA, 13 bp, Homo sapiens
tctgtgcacctgg

SEQ ID NO: 5948355 - DNA, 13 bp, Homo sapiens
tctgtgcagatgc

SEQ ID NO: 5948356 - DNA, 21 bp, Homo sapiens
tctgtgcagatgctttgccca

SEQ ID NO: 5948357 - DNA, 14 bp, Homo sapiens
tctgtgcagggcac

SEQ ID NO: 5948358 - DNA, 17 bp, Homo sapiens
tctgtgcagggctggtt

SEQ ID NO: 5948359 - DNA, 19 bp, Homo sapiens
tctgtgcatctggcctggg

SEQ ID NO: 5948360 - DNA, 22 bp, Homo sapiens
tctgtgcatctggcctgggggc

SEQ ID NO: 5948361 - DNA, 12 bp, Homo sapiens
tctgtgcatgtg

SEQ ID NO: 5948362 - DNA, 15 bp, Homo sapiens
tctgtgcattcatgc

SEQ ID NO: 5948363 - DNA, 20 bp, Homo sapiens
tctgtgccaaagcagctaca

SEQ ID NO: 5948364 - DNA, 22 bp, Homo sapiens
tctgtgccagaaacagtgggag

SEQ ID NO: 5948365 - DNA, 13 bp, Homo sapiens
tctgtgccagagc

SEQ ID NO: 5948366 - DNA, 16 bp, Homo sapiens
tctgtgccagagcctg

SEQ ID NO: 5948367 - DNA, 17 bp, Homo sapiens
tctgtgccagagcctgg

SEQ ID NO: 5948368 - DNA, 18 bp, Homo sapiens
tctgtgccagagcctggg

SEQ ID NO: 5948369 - DNA, 19 bp, Homo sapiens
tctgtgccagagcctgggg

SEQ ID NO: 5948370 - DNA, 21 bp, Homo sapiens
tctgtgccagggcagcatttt

SEQ ID NO: 5948371 - DNA, 17 bp, Homo sapiens
tctgtgccatagaacaa

SEQ ID NO: 5948372 - DNA, 15 bp, Homo sapiens
tctgtgccatggatt

SEQ ID NO: 5948373 - DNA, 16 bp, Homo sapiens
tctgtgccatggcccc

SEQ ID NO: 5948374 - DNA, 17 bp, Homo sapiens
tctgtgccatggccccc

SEQ ID NO: 5948375 - DNA, 18 bp, Homo sapiens
tctgtgccattttctgta

SEQ ID NO: 5948376 - DNA, 20 bp, Homo sapiens
tctgtgcccatgggcactgc

SEQ ID NO: 5948377 - DNA, 15 bp, Homo sapiens
tctgtgccccatgcc

SEQ ID NO: 5948378 - DNA, 17 bp, Homo sapiens
tctgtgccccatgcctg

SEQ ID NO: 5948379 - DNA, 17 bp, Homo sapiens
tctgtgccctccaaaga

SEQ ID NO: 5948380 - DNA, 21 bp, Homo sapiens
tctgtgccctggctccatgct

SEQ ID NO: 5948381 - DNA, 20 bp, Homo sapiens
tctgtgcctacatgttctca

SEQ ID NO: 5948382 - DNA, 19 bp, Homo sapiens
tctgtgcctccaggaccag

SEQ ID NO: 5948383 - DNA, 17 bp, Homo sapiens
tctgtgcctccccccag

SEQ ID NO: 5948384 - DNA, 18 bp, Homo sapiens
tctgtgcctccccccaga

SEQ ID NO: 5948385 - DNA, 19 bp, Homo sapiens
tctgtgcctccccccagac

SEQ ID NO: 5948386 - DNA, 20 bp, Homo sapiens
tctgtgcctccccccagacc

SEQ ID NO: 5948387 - DNA, 15 bp, Homo sapiens
tctgtgcctgaatat

SEQ ID NO: 5948388 - DNA, 21 bp, Homo sapiens
tctgtgcctggagctcctggg

SEQ ID NO: 5948389 - DNA, 13 bp, Homo sapiens
tctgtgcctggga

SEQ ID NO: 5948390 - DNA, 15 bp, Homo sapiens
tctgtgcctgggatc

SEQ ID NO: 5948391 - DNA, 22 bp, Homo sapiens
tctgtgcctgggatcagtgggg

SEQ ID NO: 5948392 - DNA, 18 bp, Homo sapiens
tctgtgcctgtctgtcca

SEQ ID NO: 5948393 - DNA, 15 bp, Homo sapiens
tctgtgcgtgtggcg

SEQ ID NO: 5948394 - DNA, 13 bp, Homo sapiens
tctgtgctcagga

SEQ ID NO: 5948395 - DNA, 14 bp, Homo sapiens
tctgtgctcctcct

SEQ ID NO: 5948396 - DNA, 19 bp, Homo sapiens
tctgtgctgactctggcct

SEQ ID NO: 5948397 - DNA, 13 bp, Homo sapiens
tctgtgctggcca

SEQ ID NO: 5948398 - DNA, 18 bp, Homo sapiens
tctgtgctgtgcctgcta

SEQ ID NO: 5948399 - DNA, 20 bp, Homo sapiens
tctgtgctgtgcctgctaga

SEQ ID NO: 5948400 - DNA, 22 bp, Homo sapiens
tctgtgctgtgtatgtgaacca

SEQ ID NO: 5948401 - DNA, 14 bp, Homo sapiens
tctgtgctgtttca

SEQ ID NO: 5948402 - DNA, 18 bp, Homo sapiens
tctgtgctgtttcaaagt

SEQ ID NO: 5948403 - DNA, 20 bp, Homo sapiens
tctgtgcttccttggttcat

SEQ ID NO: 5948404 - DNA, 16 bp, Homo sapiens
tctgtgctttccagct

SEQ ID NO: 5948405 - DNA, 22 bp, Homo sapiens
tctgtggaaaaataaaggaaat

SEQ ID NO: 5948406 - DNA, 22 bp, Homo sapiens
tctgtggaaaagccatctcagg

SEQ ID NO: 5948407 - DNA, 16 bp, Homo sapiens
tctgtggaaagtgtaa

SEQ ID NO: 5948408 - DNA, 16 bp, Homo sapiens
tctgtggaaatatgag

SEQ ID NO: 5948409 - DNA, 15 bp, Homo sapiens
tctgtggacactgtg

SEQ ID NO: 5948410 - DNA, 16 bp, Homo sapiens
tctgtggacactgtgg

SEQ ID NO: 5948411 - DNA, 19 bp, Homo sapiens
tctgtggactgaccttgta

SEQ ID NO: 5948412 - DNA, 21 bp, Homo sapiens
tctgtggagagtgagaataat

SEQ ID NO: 5948413 - DNA, 23 bp, Homo sapiens
tctgtggagcgtccttgtccccg

SEQ ID NO: 5948414 - DNA, 17 bp, Homo sapiens
tctgtggagctgccaca

SEQ ID NO: 5948415 - DNA, 18 bp, Homo sapiens
tctgtggagctgccacag

SEQ ID NO: 5948416 - DNA, 16 bp, Homo sapiens
tctgtggaggacagac

SEQ ID NO: 5948417 - DNA, 21 bp, Homo sapiens
tctgtggagggagggcagctg

SEQ ID NO: 5948418 - DNA, 17 bp, Homo sapiens
tctgtggaggggccctc

SEQ ID NO: 5948419 - DNA, 17 bp, Homo sapiens
tctgtggagggttgcca

SEQ ID NO: 5948420 - DNA, 18 bp, Homo sapiens
tctgtggagggttgccat

SEQ ID NO: 5948421 - DNA, 18 bp, Homo sapiens
tctgtggagttcctgctc

SEQ ID NO: 5948422 - DNA, 21 bp, Homo sapiens
tctgtggagttcctgctccgt

SEQ ID NO: 5948423 - DNA, 18 bp, Homo sapiens
tctgtggatacagtgccc

SEQ ID NO: 5948424 - DNA, 14 bp, Homo sapiens
tctgtggattctat

SEQ ID NO: 5948425 - DNA, 21 bp, Homo sapiens
tctgtggccagagtcttggac

SEQ ID NO: 5948426 - DNA, 14 bp, Homo sapiens
tctgtggccagcct

SEQ ID NO: 5948427 - DNA, 19 bp, Homo sapiens
tctgtggccagcctggcat

SEQ ID NO: 5948428 - DNA, 13 bp, Homo sapiens
tctgtggccagga

SEQ ID NO: 5948429 - DNA, 14 bp, Homo sapiens
tctgtggccaggag

SEQ ID NO: 5948430 - DNA, 22 bp, Homo sapiens
tctgtggccgccatctgcgcag

SEQ ID NO: 5948431 - DNA, 23 bp, Homo sapiens
tctgtggcctgtgtccagcagct

SEQ ID NO: 5948432 - DNA, 18 bp, Homo sapiens
tctgtggccttggccctg

SEQ ID NO: 5948433 - DNA, 21 bp, Homo sapiens
tctgtggctgccatcagaaat

SEQ ID NO: 5948434 - DNA, 15 bp, Homo sapiens
tctgtggctggctct

SEQ ID NO: 5948435 - DNA, 23 bp, Homo sapiens
tctgtggctggctctaccttcct

SEQ ID NO: 5948436 - DNA, 16 bp, Homo sapiens
tctgtgggaaaaaaga

SEQ ID NO: 5948437 - DNA, 19 bp, Homo sapiens
tctgtgggaaaaaagaaaa

SEQ ID NO: 5948438 - DNA, 23 bp, Homo sapiens
tctgtgggactggcccacccctc

SEQ ID NO: 5948439 - DNA, 18 bp, Homo sapiens
tctgtgggagctcagctc

SEQ ID NO: 5948440 - DNA, 22 bp, Homo sapiens
tctgtgggagctcagctcgctg

SEQ ID NO: 5948441 - DNA, 23 bp, Homo sapiens
tctgtgggatgggatggtggagg

SEQ ID NO: 5948442 - DNA, 17 bp, Homo sapiens
tctgtgggcatggccgc

SEQ ID NO: 5948443 - DNA, 18 bp, Homo sapiens
tctgtgggcatggccgct

SEQ ID NO: 5948444 - DNA, 12 bp, Homo sapiens
tctgtgggcccc

SEQ ID NO: 5948445 - DNA, 15 bp, Homo sapiens
tctgtgggcccctca

SEQ ID NO: 5948446 - DNA, 19 bp, Homo sapiens
tctgtgggcccctcaacag

SEQ ID NO: 5948447 - DNA, 23 bp, Homo sapiens
tctgtgggccctaccctcctgct

SEQ ID NO: 5948448 - DNA, 19 bp, Homo sapiens
tctgtgggcgggcccagca

SEQ ID NO: 5948449 - DNA, 17 bp, Homo sapiens
tctgtggggctgggcac

SEQ ID NO: 5948450 - DNA, 23 bp, Homo sapiens
tctgtggggtggttccgggctgg

SEQ ID NO: 5948451 - DNA, 22 bp, Homo sapiens
tctgtgggtccgataatatctt

SEQ ID NO: 5948452 - DNA, 15 bp, Homo sapiens
tctgtgggtctctgg

SEQ ID NO: 5948453 - DNA, 17 bp, Homo sapiens
tctgtgggtctctggaa

SEQ ID NO: 5948454 - DNA, 22 bp, Homo sapiens
tctgtggtccagaagaaattat

SEQ ID NO: 5948455 - DNA, 21 bp, Homo sapiens
tctgtggtgcctctcttggct

SEQ ID NO: 5948456 - DNA, 23 bp, Homo sapiens
tctgtggtggttcattccacagg

SEQ ID NO: 5948457 - DNA, 16 bp, Homo sapiens
tctgtggttcctctgc

SEQ ID NO: 5948458 - DNA, 18 bp, Homo sapiens
tctgtggttcctctgctc

SEQ ID NO: 5948459 - DNA, 21 bp, Homo sapiens
tctgtggttctataataagtt

SEQ ID NO: 5948460 - DNA, 12 bp, Homo sapiens
tctgtggttggc

SEQ ID NO: 5948461 - DNA, 19 bp, Homo sapiens
tctgtggttttcccctccc

SEQ ID NO: 5948462 - DNA, 21 bp, Homo sapiens
tctgtggttttcccctccctg

SEQ ID NO: 5948463 - DNA, 22 bp, Homo sapiens
tctgtggttttcccctccctgg

SEQ ID NO: 5948464 - DNA, 17 bp, Homo sapiens
tctgtggttttttttga

SEQ ID NO: 5948465 - DNA, 19 bp, Homo sapiens
tctgtggttttttttgaat

SEQ ID NO: 5948466 - DNA, 23 bp, Homo sapiens
tctgtgtaaatctaactacaagg

SEQ ID NO: 5948467 - DNA, 21 bp, Homo sapiens
tctgtgtaacatccaagccag

SEQ ID NO: 5948468 - DNA, 20 bp, Homo sapiens
tctgtgtaaccagctcagtg

SEQ ID NO: 5948469 - DNA, 21 bp, Homo sapiens
tctgtgtaaccagctcagtgt

SEQ ID NO: 5948470 - DNA, 19 bp, Homo sapiens
tctgtgtaaccattttata

SEQ ID NO: 5948471 - DNA, 22 bp, Homo sapiens
tctgtgtaactttaaacatcta

SEQ ID NO: 5948472 - DNA, 16 bp, Homo sapiens
tctgtgtaatctctga

SEQ ID NO: 5948473 - DNA, 14 bp, Homo sapiens
tctgtgtacaaaga

SEQ ID NO: 5948474 - DNA, 14 bp, Homo sapiens
tctgtgtacaattt

SEQ ID NO: 5948475 - DNA, 13 bp, Homo sapiens
tctgtgtacattt

SEQ ID NO: 5948476 - DNA, 21 bp, Homo sapiens
tctgtgtaccacttcctgagg

SEQ ID NO: 5948477 - DNA, 22 bp, Homo sapiens
tctgtgtaccacttctgtgggc

SEQ ID NO: 5948478 - DNA, 14 bp, Homo sapiens
tctgtgtatacata

SEQ ID NO: 5948479 - DNA, 15 bp, Homo sapiens
tctgtgtatacatat

SEQ ID NO: 5948480 - DNA, 19 bp, Homo sapiens
tctgtgtatatctcttgga

SEQ ID NO: 5948481 - DNA, 19 bp, Homo sapiens
tctgtgtatattatttggc

SEQ ID NO: 5948482 - DNA, 13 bp, Homo sapiens
tctgtgtatcttt

SEQ ID NO: 5948483 - DNA, 14 bp, Homo sapiens
tctgtgtcacgtga

SEQ ID NO: 5948484 - DNA, 15 bp, Homo sapiens
tctgtgtcacgtgac

SEQ ID NO: 5948485 - DNA, 23 bp, Homo sapiens
tctgtgtcacgtgaccctgtgcc

SEQ ID NO: 5948486 - DNA, 14 bp, Homo sapiens
tctgtgtcactggc

SEQ ID NO: 5948487 - DNA, 14 bp, Homo sapiens
tctgtgtcatttct

SEQ ID NO: 5948488 - DNA, 22 bp, Homo sapiens
tctgtgtccaattatgcactgg

SEQ ID NO: 5948489 - DNA, 13 bp, Homo sapiens
tctgtgtcccagc

SEQ ID NO: 5948490 - DNA, 16 bp, Homo sapiens
tctgtgtcccagccac

SEQ ID NO: 5948491 - DNA, 17 bp, Homo sapiens
tctgtgtcccagccacg

SEQ ID NO: 5948492 - DNA, 11 bp, Homo sapiens
tctgtgtcctt

SEQ ID NO: 5948493 - DNA, 20 bp, Homo sapiens
tctgtgtctaagattctaga

SEQ ID NO: 5948494 - DNA, 11 bp, Homo sapiens
tctgtgtctct

SEQ ID NO: 5948495 - DNA, 16 bp, Homo sapiens
tctgtgtctgagtggc

SEQ ID NO: 5948496 - DNA, 12 bp, Homo sapiens
tctgtgtctgtg

SEQ ID NO: 5948497 - DNA, 11 bp, Homo sapiens
tctgtgtcttt

SEQ ID NO: 5948498 - DNA, 21 bp, Homo sapiens
tctgtgtctttcacagctcct

SEQ ID NO: 5948499 - DNA, 16 bp, Homo sapiens
tctgtgtgaaactttc

SEQ ID NO: 5948500 - DNA, 19 bp, Homo sapiens
tctgtgtgaaactttcatt

SEQ ID NO: 5948501 - DNA, 15 bp, Homo sapiens
tctgtgtgaatgtgg

SEQ ID NO: 5948502 - DNA, 18 bp, Homo sapiens
tctgtgtgatgaactttc

SEQ ID NO: 5948503 - DNA, 22 bp, Homo sapiens
tctgtgtgcaagtgtgtgcaca

SEQ ID NO: 5948504 - DNA, 19 bp, Homo sapiens
tctgtgtgcaccttaccaa

SEQ ID NO: 5948505 - DNA, 22 bp, Homo sapiens
tctgtgtgcaccttaccaactt

SEQ ID NO: 5948506 - DNA, 15 bp, Homo sapiens
tctgtgtgcatattt

SEQ ID NO: 5948507 - DNA, 17 bp, Homo sapiens
tctgtgtgcatatttgt

SEQ ID NO: 5948508 - DNA, 17 bp, Homo sapiens
tctgtgtgccctagggc

SEQ ID NO: 5948509 - DNA, 16 bp, Homo sapiens
tctgtgtgccctgaaa

SEQ ID NO: 5948510 - DNA, 12 bp, Homo sapiens
tctgtgtgctac

SEQ ID NO: 5948511 - DNA, 20 bp, Homo sapiens
tctgtgtgctactaacagat

SEQ ID NO: 5948512 - DNA, 22 bp, Homo sapiens
tctgtgtgctactaacagatta

SEQ ID NO: 5948513 - DNA, 16 bp, Homo sapiens
tctgtgtggcaaacat

SEQ ID NO: 5948514 - DNA, 19 bp, Homo sapiens
tctgtgtggcaaattaaac

SEQ ID NO: 5948515 - DNA, 16 bp, Homo sapiens
tcttagtggatgttct

SEQ ID NO: 5948516 - DNA, 19 bp, Homo sapiens
tcttagtgtggtatttgct

SEQ ID NO: 5948517 - DNA, 20 bp, Homo sapiens
tcttagttaatctttgaaaa

SEQ ID NO: 5948518 - DNA, 18 bp, Homo sapiens
tcttagttcatatatcaa

SEQ ID NO: 5948519 - DNA, 11 bp, Homo sapiens
tcttagtttac

SEQ ID NO: 5948520 - DNA, 18 bp, Homo sapiens
tcttagtttgaatgaaac

SEQ ID NO: 5948521 - DNA, 20 bp, Homo sapiens
tcttataaaccttgtcaata

SEQ ID NO: 5948522 - DNA, 14 bp, Homo sapiens
tcttataaatttgg

SEQ ID NO: 5948523 - DNA, 16 bp, Homo sapiens
tcttataactcaacat

SEQ ID NO: 5948524 - DNA, 16 bp, Homo sapiens
tcttataactgtttta

SEQ ID NO: 5948525 - DNA, 15 bp, Homo sapiens
tcttataacttctga

SEQ ID NO: 5948526 - DNA, 18 bp, Homo sapiens
tcttataacttctgaagt

SEQ ID NO: 5948527 - DNA, 17 bp, Homo sapiens
tcttataatactctgtt

SEQ ID NO: 5948528 - DNA, 14 bp, Homo sapiens
tcttataatttaaa

SEQ ID NO: 5948529 - DNA, 22 bp, Homo sapiens
tcttatacaacagcaaaccctg

SEQ ID NO: 5948530 - DNA, 14 bp, Homo sapiens
tcttatactgaaaa

SEQ ID NO: 5948531 - DNA, 18 bp, Homo sapiens
tcttatactgtacaataa

SEQ ID NO: 5948532 - DNA, 21 bp, Homo sapiens
tcttatactgtacaataaaaa

SEQ ID NO: 5948533 - DNA, 12 bp, Homo sapiens
tcttatagaata

SEQ ID NO: 5948534 - DNA, 14 bp, Homo sapiens
tcttatagaataaa

SEQ ID NO: 5948535 - DNA, 23 bp, Homo sapiens
tcttatagaataaaagctgtgga

SEQ ID NO: 5948536 - DNA, 19 bp, Homo sapiens
tcttatagaatatttatta

SEQ ID NO: 5948537 - DNA, 13 bp, Homo sapiens
tcttatagatttt

SEQ ID NO: 5948538 - DNA, 15 bp, Homo sapiens
tcttatagatttttt

SEQ ID NO: 5948539 - DNA, 18 bp, Homo sapiens
tcttatagcactttgaaa

SEQ ID NO: 5948540 - DNA, 17 bp, Homo sapiens
tcttatatctgaagatt

SEQ ID NO: 5948541 - DNA, 16 bp, Homo sapiens
tcttatattttatcaa

SEQ ID NO: 5948542 - DNA, 14 bp, Homo sapiens
tcttatatttttct

SEQ ID NO: 5948543 - DNA, 21 bp, Homo sapiens
tcttatcaagtgttacagagg

SEQ ID NO: 5948544 - DNA, 21 bp, Homo sapiens
tcttatcacaaaaaagaaaat

SEQ ID NO: 5948545 - DNA, 22 bp, Homo sapiens
tcttatcacacttgcaaatgaa

SEQ ID NO: 5948546 - DNA, 19 bp, Homo sapiens
tcttatcactaagaaagaa

SEQ ID NO: 5948547 - DNA, 22 bp, Homo sapiens
tcttatccaattcattatgtca

SEQ ID NO: 5948548 - DNA, 17 bp, Homo sapiens
tcttatccacaaagtac

SEQ ID NO: 5948549 - DNA, 19 bp, Homo sapiens
tcttatccacaaagtactc

SEQ ID NO: 5948550 - DNA, 14 bp, Homo sapiens
tcttatccccagct

SEQ ID NO: 5948551 - DNA, 15 bp, Homo sapiens
tcttatccccagctg

SEQ ID NO: 5948552 - DNA, 16 bp, Homo sapiens
tcttatccccagctgt

SEQ ID NO: 5948553 - DNA, 19 bp, Homo sapiens
tcttatcccccccagcctg

SEQ ID NO: 5948554 - DNA, 21 bp, Homo sapiens
tcttatcccccccagcctggc

SEQ ID NO: 5948555 - DNA, 15 bp, Homo sapiens
tcttatcctctctct

SEQ ID NO: 5948556 - DNA, 20 bp, Homo sapiens
tcttatctactgactgaaat

SEQ ID NO: 5948557 - DNA, 23 bp, Homo sapiens
tcttatctagcaagaagattcta

SEQ ID NO: 5948558 - DNA, 20 bp, Homo sapiens
tcttatctcagtcatgcata

SEQ ID NO: 5948559 - DNA, 22 bp, Homo sapiens
tcttatctcagtcatgcataaa

SEQ ID NO: 5948560 - DNA, 17 bp, Homo sapiens
tcttatctcatcctttc

SEQ ID NO: 5948561 - DNA, 18 bp, Homo sapiens
tcttatctgagctgagcc

SEQ ID NO: 5948562 - DNA, 17 bp, Homo sapiens
tcttatctgttcagtgt

SEQ ID NO: 5948563 - DNA, 15 bp, Homo sapiens
tcttatcttgaccat

SEQ ID NO: 5948564 - DNA, 18 bp, Homo sapiens
tcttatgaataagcactt

SEQ ID NO: 5948565 - DNA, 12 bp, Homo sapiens
tcttatgaatag

SEQ ID NO: 5948566 - DNA, 15 bp, Homo sapiens
tcttatgaatagaca

SEQ ID NO: 5948567 - DNA, 20 bp, Homo sapiens
tcttatgactaaattttctt

SEQ ID NO: 5948568 - DNA, 12 bp, Homo sapiens
tcttatgatttt

SEQ ID NO: 5948569 - DNA, 17 bp, Homo sapiens
tcttatgcaaaatggaa

SEQ ID NO: 5948570 - DNA, 14 bp, Homo sapiens
tcttatgccttttc

SEQ ID NO: 5948571 - DNA, 21 bp, Homo sapiens
tcttatgcttccattaacaaa

SEQ ID NO: 5948572 - DNA, 16 bp, Homo sapiens
tcttatggagacctag

SEQ ID NO: 5948573 - DNA, 12 bp, Homo sapiens
tcttatggatgt

SEQ ID NO: 5948574 - DNA, 18 bp, Homo sapiens
tcttatggccaaattcaa

SEQ ID NO: 5948575 - DNA, 16 bp, Homo sapiens
tcttatgggctgggtt

SEQ ID NO: 5948576 - DNA, 18 bp, Homo sapiens
tcttatggtccagaaact

SEQ ID NO: 5948577 - DNA, 22 bp, Homo sapiens
tcttatggtcttgatcctccaa

SEQ ID NO: 5948578 - DNA, 15 bp, Homo sapiens
tcttatggtggaaga

SEQ ID NO: 5948579 - DNA, 14 bp, Homo sapiens
tcttatgtaaagta

SEQ ID NO: 5948580 - DNA, 15 bp, Homo sapiens
tcttatgtaaagtat

SEQ ID NO: 5948581 - DNA, 20 bp, Homo sapiens
tcttatgtaaagtatgtttt

SEQ ID NO: 5948582 - DNA, 17 bp, Homo sapiens
tcttatgtacctctttt

SEQ ID NO: 5948583 - DNA, 12 bp, Homo sapiens
tcttatgtgaca

SEQ ID NO: 5948584 - DNA, 13 bp, Homo sapiens
tcttatgtgacat

SEQ ID NO: 5948585 - DNA, 16 bp, Homo sapiens
tcttatgtgacattaa

SEQ ID NO: 5948586 - DNA, 21 bp, Homo sapiens
tcttatgtgacattaacaaat

SEQ ID NO: 5948587 - DNA, 22 bp, Homo sapiens
tcttatgttatcaccttccaaa

SEQ ID NO: 5948588 - DNA, 12 bp, Homo sapiens
tcttatgttgat

SEQ ID NO: 5948589 - DNA, 20 bp, Homo sapiens
tcttattaaagtttcaaaaa

SEQ ID NO: 5948590 - DNA, 21 bp, Homo sapiens
tcttattaaagtttcaaaaat

SEQ ID NO: 5948591 - DNA, 22 bp, Homo sapiens
tcttattaaagtttcaaaaatc

SEQ ID NO: 5948592 - DNA, 20 bp, Homo sapiens
tcttattaatcatacaaact

SEQ ID NO: 5948593 - DNA, 15 bp, Homo sapiens
tcttattacccaaac

SEQ ID NO: 5948594 - DNA, 22 bp, Homo sapiens
tcttattagttccccaaataca

SEQ ID NO: 5948595 - DNA, 18 bp, Homo sapiens
tcttattcaaagaaatat

SEQ ID NO: 5948596 - DNA, 17 bp, Homo sapiens
tcttattcaaagatgat

SEQ ID NO: 5948597 - DNA, 17 bp, Homo sapiens
tcttattcactgagtct

SEQ ID NO: 5948598 - DNA, 17 bp, Homo sapiens
tcttattcagtaaaaaa

SEQ ID NO: 5948599 - DNA, 15 bp, Homo sapiens
tcttattcagtgaaa

SEQ ID NO: 5948600 - DNA, 24 bp, Homo sapiens
tcttattcccaaactacagaataa

SEQ ID NO: 5948601 - DNA, 12 bp, Homo sapiens
tcttattccgag

SEQ ID NO: 5948602 - DNA, 15 bp, Homo sapiens
tcttattcctttaaa

SEQ ID NO: 5948603 - DNA, 14 bp, Homo sapiens
tcttattccttttt

SEQ ID NO: 5948604 - DNA, 14 bp, Homo sapiens
tcttattctttcgt

SEQ ID NO: 5948605 - DNA, 15 bp, Homo sapiens
tcttattgaaatgca

SEQ ID NO: 5948606 - DNA, 16 bp, Homo sapiens
tcttattgaataaaga

SEQ ID NO: 5948607 - DNA, 17 bp, Homo sapiens
tcttattgaataaagag

SEQ ID NO: 5948608 - DNA, 16 bp, Homo sapiens
tcttattgaatttgtt

SEQ ID NO: 5948609 - DNA, 16 bp, Homo sapiens
tcttattgcgctgcta

SEQ ID NO: 5948610 - DNA, 20 bp, Homo sapiens
tcttattgttctttcatatg

SEQ ID NO: 5948611 - DNA, 16 bp, Homo sapiens
tcttatttaaattttc

SEQ ID NO: 5948612 - DNA, 18 bp, Homo sapiens
tcttatttaaattttcag

SEQ ID NO: 5948613 - DNA, 14 bp, Homo sapiens
tcttatttaactta

SEQ ID NO: 5948614 - DNA, 14 bp, Homo sapiens
tcttatttaagtat

SEQ ID NO: 5948615 - DNA, 13 bp, Homo sapiens
tcttatttaatta

SEQ ID NO: 5948616 - DNA, 23 bp, Homo sapiens
tcttatttacagataacttcttt

SEQ ID NO: 5948617 - DNA, 15 bp, Homo sapiens
tcttatttacccttt

SEQ ID NO: 5948618 - DNA, 16 bp, Homo sapiens
tcttatttatatatga

SEQ ID NO: 5948619 - DNA, 15 bp, Homo sapiens
tcttatttattaact

SEQ ID NO: 5948620 - DNA, 20 bp, Homo sapiens
tcttatttattttagcaaat

SEQ ID NO: 5948621 - DNA, 21 bp, Homo sapiens
tcttatttattttagcaaatc

SEQ ID NO: 5948622 - DNA, 22 bp, Homo sapiens
tcttatttcactaaatgtaaaa

SEQ ID NO: 5948623 - DNA, 15 bp, Homo sapiens
tcttatttccccttt

SEQ ID NO: 5948624 - DNA, 19 bp, Homo sapiens
tcttatttctttcctttaa

SEQ ID NO: 5948625 - DNA, 11 bp, Homo sapiens
tcttatttgct

SEQ ID NO: 5948626 - DNA, 14 bp, Homo sapiens
tcttatttggaatt

SEQ ID NO: 5948627 - DNA, 18 bp, Homo sapiens
tcttatttggaattgaca

SEQ ID NO: 5948628 - DNA, 23 bp, Homo sapiens
tcttatttgtttggtcactgcta

SEQ ID NO: 5948629 - DNA, 15 bp, Homo sapiens
tcttattttagtata

SEQ ID NO: 5948630 - DNA, 19 bp, Homo sapiens
tcttattttcttggaattt

SEQ ID NO: 5948631 - DNA, 16 bp, Homo sapiens
tcttattttgtaataa

SEQ ID NO: 5948632 - DNA, 14 bp, Homo sapiens
tcttattttgtgga

SEQ ID NO: 5948633 - DNA, 15 bp, Homo sapiens
tcttatttttctagt

SEQ ID NO: 5948634 - DNA, 14 bp, Homo sapiens
tcttatttttgtac

SEQ ID NO: 5948635 - DNA, 16 bp, Homo sapiens
tcttcaaaaactgttt

SEQ ID NO: 5948636 - DNA, 19 bp, Homo sapiens
tcttcaaaaagcagagtgg

SEQ ID NO: 5948637 - DNA, 16 bp, Homo sapiens
tcttcaaaagtaatgc

SEQ ID NO: 5948638 - DNA, 20 bp, Homo sapiens
tcttcaaaagtaatgcctct

SEQ ID NO: 5948639 - DNA, 22 bp, Homo sapiens
tcttcaaaagtaatgcctctgt

SEQ ID NO: 5948640 - DNA, 17 bp, Homo sapiens
tcttcaaaatgtatata

SEQ ID NO: 5948641 - DNA, 15 bp, Homo sapiens
tcttcaaagccacat

SEQ ID NO: 5948642 - DNA, 19 bp, Homo sapiens
tcttcaaatccttccaaaa

SEQ ID NO: 5948643 - DNA, 22 bp, Homo sapiens
tcttcaaatccttccaaaaatt

SEQ ID NO: 5948644 - DNA, 14 bp, Homo sapiens
tcttcaaatgcctg

SEQ ID NO: 5948645 - DNA, 12 bp, Homo sapiens
tcttcaaatgtt

SEQ ID NO: 5948646 - DNA, 22 bp, Homo sapiens
tcttcaaatgtttaaaccacta

SEQ ID NO: 5948647 - DNA, 14 bp, Homo sapiens
tcttcaaattaaag

SEQ ID NO: 5948648 - DNA, 16 bp, Homo sapiens
tcttcaaattagaaga

SEQ ID NO: 5948649 - DNA, 19 bp, Homo sapiens
tcttcaaattagaagacat

SEQ ID NO: 5948650 - DNA, 23 bp, Homo sapiens
tcttcaacatcaatgttcattgt

SEQ ID NO: 5948651 - DNA, 17 bp, Homo sapiens
tcttcaacatcctgcca

SEQ ID NO: 5948652 - DNA, 18 bp, Homo sapiens
tcttcaacatcctgccag

SEQ ID NO: 5948653 - DNA, 22 bp, Homo sapiens
tcttcaacatcctgccagcccc

SEQ ID NO: 5948654 - DNA, 14 bp, Homo sapiens
tcttcaacatgaca

SEQ ID NO: 5948655 - DNA, 17 bp, Homo sapiens
tcttcaaccaaggccac

SEQ ID NO: 5948656 - DNA, 20 bp, Homo sapiens
tcttcaaccagggattgttt

SEQ ID NO: 5948657 - DNA, 16 bp, Homo sapiens
tcttcaaccctgccct

SEQ ID NO: 5948658 - DNA, 20 bp, Homo sapiens
tcttcaaccctgccctgcac

SEQ ID NO: 5948659 - DNA, 14 bp, Homo sapiens
tcttcaactcctgg

SEQ ID NO: 5948660 - DNA, 15 bp, Homo sapiens
tcttcaactcctggg

SEQ ID NO: 5948661 - DNA, 23 bp, Homo sapiens
tcttcaagaaagaattcctgcag

SEQ ID NO: 5948662 - DNA, 11 bp, Homo sapiens
tcttcaagagg

SEQ ID NO: 5948663 - DNA, 20 bp, Homo sapiens
tcttcaagcacctgcagatt

SEQ ID NO: 5948664 - DNA, 19 bp, Homo sapiens
tcttcaagccagctctagg

SEQ ID NO: 5948665 - DNA, 12 bp, Homo sapiens
tcttcaagcctg

SEQ ID NO: 5948666 - DNA, 17 bp, Homo sapiens
tcttcaagcctgggcgt

SEQ ID NO: 5948667 - DNA, 11 bp, Homo sapiens
tcttcaaggcc

SEQ ID NO: 5948668 - DNA, 14 bp, Homo sapiens
tcttcaaggccaag

SEQ ID NO: 5948669 - DNA, 15 bp, Homo sapiens
tcttcaaggcttcag

SEQ ID NO: 5948670 - DNA, 17 bp, Homo sapiens
tcttcaaggtgtaaaat

SEQ ID NO: 5948671 - DNA, 14 bp, Homo sapiens
tcttcaataaacca

SEQ ID NO: 5948672 - DNA, 22 bp, Homo sapiens
tcttcaataaattaagttttat

SEQ ID NO: 5948673 - DNA, 18 bp, Homo sapiens
tcttcaatagctaagcat

SEQ ID NO: 5948674 - DNA, 17 bp, Homo sapiens
tcttcaatatgaaggac

SEQ ID NO: 5948675 - DNA, 17 bp, Homo sapiens
tcttcaatatgaatcta

SEQ ID NO: 5948676 - DNA, 18 bp, Homo sapiens
tcttcaatatgaatctat

SEQ ID NO: 5948677 - DNA, 14 bp, Homo sapiens
tcttcaatctctgt

SEQ ID NO: 5948678 - DNA, 16 bp, Homo sapiens
tcttcaatgatcaaat

SEQ ID NO: 5948679 - DNA, 18 bp, Homo sapiens
tcttcaatggaatacagt

SEQ ID NO: 5948680 - DNA, 23 bp, Homo sapiens
tcttcaatggcaccttcattctc

SEQ ID NO: 5948681 - DNA, 22 bp, Homo sapiens
tcttcaattaatggaaaactgt

SEQ ID NO: 5948682 - DNA, 14 bp, Homo sapiens
tcttcaatttgaaa

SEQ ID NO: 5948683 - DNA, 19 bp, Homo sapiens
tcttcaatttgaaatcacc

SEQ ID NO: 5948684 - DNA, 18 bp, Homo sapiens
tcttcaatttgtataaaa

SEQ ID NO: 5948685 - DNA, 20 bp, Homo sapiens
tcttcaatttgtataaaatg

SEQ ID NO: 5948686 - DNA, 15 bp, Homo sapiens
tcttcacaacagatt

SEQ ID NO: 5948687 - DNA, 13 bp, Homo sapiens
tcttcacaacctc

SEQ ID NO: 5948688 - DNA, 23 bp, Homo sapiens
tcttcacaatatccaatgaagaa

SEQ ID NO: 5948689 - DNA, 16 bp, Homo sapiens
tcttcacaatttagtt

SEQ ID NO: 5948690 - DNA, 15 bp, Homo sapiens
tcttcacagtgcagc

SEQ ID NO: 5948691 - DNA, 22 bp, Homo sapiens
tcttcacatgtaactttcgtaa

SEQ ID NO: 5948692 - DNA, 14 bp, Homo sapiens
tcttcaccaggaag

SEQ ID NO: 5948693 - DNA, 20 bp, Homo sapiens
tcttcaccccggcaggccct

SEQ ID NO: 5948694 - DNA, 11 bp, Homo sapiens
tcttctgctcc

SEQ ID NO: 5948695 - DNA, 19 bp, Homo sapiens
tcttctgctccacccttgg

SEQ ID NO: 5948696 - DNA, 18 bp, Homo sapiens
tcttctgcttaggagaga

SEQ ID NO: 5948697 - DNA, 14 bp, Homo sapiens
tcttctggaatatt

SEQ ID NO: 5948698 - DNA, 18 bp, Homo sapiens
tcttctggagtttctcta

SEQ ID NO: 5948699 - DNA, 17 bp, Homo sapiens
tcttctgggagggcagc

SEQ ID NO: 5948700 - DNA, 22 bp, Homo sapiens
tcttctgggagggcagcagggc

SEQ ID NO: 5948701 - DNA, 22 bp, Homo sapiens
tcttctgggcagagcctgtccc

SEQ ID NO: 5948702 - DNA, 12 bp, Homo sapiens
tcttctgggcta

SEQ ID NO: 5948703 - DNA, 18 bp, Homo sapiens
tcttctggggcaggctgg

SEQ ID NO: 5948704 - DNA, 20 bp, Homo sapiens
tcttctggggcaggctgggc

SEQ ID NO: 5948705 - DNA, 22 bp, Homo sapiens
tcttctggggcaggctgggcca

SEQ ID NO: 5948706 - DNA, 11 bp, Homo sapiens
tcttctgggta

SEQ ID NO: 5948707 - DNA, 23 bp, Homo sapiens
tcttctggtagcatattcatggt

SEQ ID NO: 5948708 - DNA, 13 bp, Homo sapiens
tcttctggtctgt

SEQ ID NO: 5948709 - DNA, 23 bp, Homo sapiens
tcttctggtgcatgttcttttct

SEQ ID NO: 5948710 - DNA, 17 bp, Homo sapiens
tcttctggtttcccttt

SEQ ID NO: 5948711 - DNA, 18 bp, Homo sapiens
tcttctgtaccaaaaata

SEQ ID NO: 5948712 - DNA, 20 bp, Homo sapiens
tcttctgtacgtctgacagg

SEQ ID NO: 5948713 - DNA, 22 bp, Homo sapiens
tcttctgtacgtctgacaggca

SEQ ID NO: 5948714 - DNA, 14 bp, Homo sapiens
tcttctgtagctat

SEQ ID NO: 5948715 - DNA, 22 bp, Homo sapiens
tcttctgtatataaatgggaac

SEQ ID NO: 5948716 - DNA, 16 bp, Homo sapiens
tcttctgtatttctag

SEQ ID NO: 5948717 - DNA, 19 bp, Homo sapiens
tcttctgtatttctaggca

SEQ ID NO: 5948718 - DNA, 13 bp, Homo sapiens
tcttctgtcatcc

SEQ ID NO: 5948719 - DNA, 17 bp, Homo sapiens
tcttctgtcatcccgct

SEQ ID NO: 5948720 - DNA, 12 bp, Homo sapiens
tcttctgtccaa

SEQ ID NO: 5948721 - DNA, 20 bp, Homo sapiens
tcttctgtcccaagtctcca

SEQ ID NO: 5948722 - DNA, 13 bp, Homo sapiens
tcttctgtccctg

SEQ ID NO: 5948723 - DNA, 13 bp, Homo sapiens
tcttctgtggacc

SEQ ID NO: 5948724 - DNA, 15 bp, Homo sapiens
tcttctgtgtttatg

SEQ ID NO: 5948725 - DNA, 14 bp, Homo sapiens
tcttctgttcccaa

SEQ ID NO: 5948726 - DNA, 14 bp, Homo sapiens
tcttctgttctcaa

SEQ ID NO: 5948727 - DNA, 22 bp, Homo sapiens
tcttctgtttcataatgcagaa

SEQ ID NO: 5948728 - DNA, 17 bp, Homo sapiens
tcttctgttttctgttt

SEQ ID NO: 5948729 - DNA, 13 bp, Homo sapiens
tcttctgtttttc

SEQ ID NO: 5948730 - DNA, 17 bp, Homo sapiens
tcttctgtttttctcaa

SEQ ID NO: 5948731 - DNA, 21 bp, Homo sapiens
tcttctgtttttctcaaataa

SEQ ID NO: 5948732 - DNA, 13 bp, Homo sapiens
tcttcttaaacca

SEQ ID NO: 5948733 - DNA, 18 bp, Homo sapiens
tcttcttaacagtttagt

SEQ ID NO: 5948734 - DNA, 15 bp, Homo sapiens
tcttcttaaccctga

SEQ ID NO: 5948735 - DNA, 19 bp, Homo sapiens
tcttcttaaccctgaacaa

SEQ ID NO: 5948736 - DNA, 22 bp, Homo sapiens
tcttcttaatatgttcttttaa

SEQ ID NO: 5948737 - DNA, 17 bp, Homo sapiens
tcttcttaatgtacata

SEQ ID NO: 5948738 - DNA, 15 bp, Homo sapiens
tcttcttactagggg

SEQ ID NO: 5948739 - DNA, 21 bp, Homo sapiens
tcttcttatcacacttgcaaa

SEQ ID NO: 5948740 - DNA, 24 bp, Homo sapiens
tcttcttatcacacttgcaaatga

SEQ ID NO: 5948741 - DNA, 15 bp, Homo sapiens
tcttcttattttggt

SEQ ID NO: 5948742 - DNA, 15 bp, Homo sapiens
tcttcttcaaataca

SEQ ID NO: 5948743 - DNA, 23 bp, Homo sapiens
tcttcttcatccaacttccaaga

SEQ ID NO: 5948744 - DNA, 18 bp, Homo sapiens
tcttcttccacacatgca

SEQ ID NO: 5948745 - DNA, 22 bp, Homo sapiens
tcttcttccctccctatctaac

SEQ ID NO: 5948746 - DNA, 22 bp, Homo sapiens
tcttcttcccttaactccaaga

SEQ ID NO: 5948747 - DNA, 19 bp, Homo sapiens
tcttcttcctgaagctgag

SEQ ID NO: 5948748 - DNA, 12 bp, Homo sapiens
tcttcttctaag

SEQ ID NO: 5948749 - DNA, 14 bp, Homo sapiens
tcttcttctaagaa

SEQ ID NO: 5948750 - DNA, 13 bp, Homo sapiens
tcttcttctcaag

SEQ ID NO: 5948751 - DNA, 15 bp, Homo sapiens
tcttcttgcatctaa

SEQ ID NO: 5948752 - DNA, 16 bp, Homo sapiens
tcttcttgcatctaat

SEQ ID NO: 5948753 - DNA, 23 bp, Homo sapiens
tcttcttgcggcaccgcccaccc

SEQ ID NO: 5948754 - DNA, 21 bp, Homo sapiens
tcttcttgggagtatgttgtc

SEQ ID NO: 5948755 - DNA, 19 bp, Homo sapiens
tcttcttggggcccagtgc

SEQ ID NO: 5948756 - DNA, 16 bp, Homo sapiens
tcttcttggtctcagt

SEQ ID NO: 5948757 - DNA, 18 bp, Homo sapiens
tcttcttgtggagatttt

SEQ ID NO: 5948758 - DNA, 17 bp, Homo sapiens
tcttcttgttctgagat

SEQ ID NO: 5948759 - DNA, 19 bp, Homo sapiens
tcttcttgttgaccctttt

SEQ ID NO: 5948760 - DNA, 15 bp, Homo sapiens
tcttcttgtttctcc

SEQ ID NO: 5948761 - DNA, 21 bp, Homo sapiens
tcttctttaaggaagaataaa

SEQ ID NO: 5948762 - DNA, 14 bp, Homo sapiens
tcttctttaatttt

SEQ ID NO: 5948763 - DNA, 14 bp, Homo sapiens
tcttctttaccaga

SEQ ID NO: 5948764 - DNA, 23 bp, Homo sapiens
tcttctttaggattgtgatggtt

SEQ ID NO: 5948765 - DNA, 20 bp, Homo sapiens
tcttctttattattcctagt

SEQ ID NO: 5948766 - DNA, 13 bp, Homo sapiens
tcttctttattgc

SEQ ID NO: 5948767 - DNA, 17 bp, Homo sapiens
tcttctttccagacccc

SEQ ID NO: 5948768 - DNA, 17 bp, Homo sapiens
tcttctttccattcttc

SEQ ID NO: 5948769 - DNA, 11 bp, Homo sapiens
tcttctttccc

SEQ ID NO: 5948770 - DNA, 13 bp, Homo sapiens
tcttctttcccaa

SEQ ID NO: 5948771 - DNA, 14 bp, Homo sapiens
tcttctttcccaaa

SEQ ID NO: 5948772 - DNA, 19 bp, Homo sapiens
tcttctttcccaatcttct

SEQ ID NO: 5948773 - DNA, 12 bp, Homo sapiens
tcttctttccct

SEQ ID NO: 5948774 - DNA, 12 bp, Homo sapiens
tcttctttcctt

SEQ ID NO: 5948775 - DNA, 14 bp, Homo sapiens
tcttctttctccat

SEQ ID NO: 5948776 - DNA, 16 bp, Homo sapiens
tcttctttctccatgg

SEQ ID NO: 5948777 - DNA, 14 bp, Homo sapiens
tcttctttctcctg

SEQ ID NO: 5948778 - DNA, 13 bp, Homo sapiens
tcttctttctgag

SEQ ID NO: 5948779 - DNA, 11 bp, Homo sapiens
tcttctttctt

SEQ ID NO: 5948780 - DNA, 21 bp, Homo sapiens
tcttctttctttcttttgcag

SEQ ID NO: 5948781 - DNA, 18 bp, Homo sapiens
tcttctttgatagtgtaa

SEQ ID NO: 5948782 - DNA, 20 bp, Homo sapiens
tcttctttggaaataaaaga

SEQ ID NO: 5948783 - DNA, 23 bp, Homo sapiens
tcttctttgggatgctatttcag

SEQ ID NO: 5948784 - DNA, 15 bp, Homo sapiens
tcttctttgtgcctt

SEQ ID NO: 5948785 - DNA, 13 bp, Homo sapiens
tcttctttgtggt

SEQ ID NO: 5948786 - DNA, 14 bp, Homo sapiens
tcttcttttacttg

SEQ ID NO: 5948787 - DNA, 18 bp, Homo sapiens
tcttcttttcccatttac

SEQ ID NO: 5948788 - DNA, 15 bp, Homo sapiens
tcttcttttcctgca

SEQ ID NO: 5948789 - DNA, 14 bp, Homo sapiens
tcttcttttctatt

SEQ ID NO: 5948790 - DNA, 21 bp, Homo sapiens
tcttcttttgggaggatttga

SEQ ID NO: 5948791 - DNA, 15 bp, Homo sapiens
tcttcttttgtgaag

SEQ ID NO: 5948792 - DNA, 16 bp, Homo sapiens
tcttctttttcaggct

SEQ ID NO: 5948793 - DNA, 15 bp, Homo sapiens
tcttctttttctttt

SEQ ID NO: 5948794 - DNA, 21 bp, Homo sapiens
tcttctttttgaaatcagcat

SEQ ID NO: 5948795 - DNA, 18 bp, Homo sapiens
tcttctttttgctgttgt

SEQ ID NO: 5948796 - DNA, 20 bp, Homo sapiens
tcttctttttgctgttgttt

SEQ ID NO: 5948797 - DNA, 23 bp, Homo sapiens
tcttctttttgttaacagcaacg

SEQ ID NO: 5948798 - DNA, 17 bp, Homo sapiens
tcttctttttttgtgat

SEQ ID NO: 5948799 - DNA, 22 bp, Homo sapiens
tcttgaaaaaaaaaatatgtat

SEQ ID NO: 5948800 - DNA, 14 bp, Homo sapiens
tcttgaaaactgtg

SEQ ID NO: 5948801 - DNA, 13 bp, Homo sapiens
tcttgaaaatgcc

SEQ ID NO: 5948802 - DNA, 19 bp, Homo sapiens
tcttgaaaatgccaccatc

SEQ ID NO: 5948803 - DNA, 16 bp, Homo sapiens
tcttgaaacagcctgg

SEQ ID NO: 5948804 - DNA, 13 bp, Homo sapiens
tcttgaaacatgt

SEQ ID NO: 5948805 - DNA, 13 bp, Homo sapiens
tcttgaaacctga

SEQ ID NO: 5948806 - DNA, 14 bp, Homo sapiens
tcttgaaagctgtg

SEQ ID NO: 5948807 - DNA, 16 bp, Homo sapiens
tcttgaaatgaaaggg

SEQ ID NO: 5948808 - DNA, 22 bp, Homo sapiens
tcttgaaatgaaagggaaactg

SEQ ID NO: 5948809 - DNA, 21 bp, Homo sapiens
tcttgaacactcatgctgaaa

SEQ ID NO: 5948810 - DNA, 16 bp, Homo sapiens
tcttgaaccagaacca

SEQ ID NO: 5948811 - DNA, 17 bp, Homo sapiens
tcttgaacctgtgctca

SEQ ID NO: 5948812 - DNA, 17 bp, Homo sapiens
tcttgaacgagcagccc

SEQ ID NO: 5948813 - DNA, 19 bp, Homo sapiens
tcttgaacgagcagcccag

SEQ ID NO: 5948814 - DNA, 22 bp, Homo sapiens
tcttgaacgagcagcccagggc

SEQ ID NO: 5948815 - DNA, 16 bp, Homo sapiens
tcttgaactcctagac

SEQ ID NO: 5948816 - DNA, 15 bp, Homo sapiens
tcttgaactcctgac

SEQ ID NO: 5948817 - DNA, 15 bp, Homo sapiens
tcttgaactcctggc

SEQ ID NO: 5948818 - DNA, 17 bp, Homo sapiens
tcttgaactcctggcct

SEQ ID NO: 5948819 - DNA, 15 bp, Homo sapiens
tcttgaactgagctt

SEQ ID NO: 5948820 - DNA, 22 bp, Homo sapiens
tcttgaactgggctcaagtgat

SEQ ID NO: 5948821 - DNA, 18 bp, Homo sapiens
tcttgaacttgaaaaaaa

SEQ ID NO: 5948822 - DNA, 18 bp, Homo sapiens
tcttgaagaaaggcaaat

SEQ ID NO: 5948823 - DNA, 18 bp, Homo sapiens
tcttgaagaataaattct

SEQ ID NO: 5948824 - DNA, 13 bp, Homo sapiens
tcttgaagaatat

SEQ ID NO: 5948825 - DNA, 22 bp, Homo sapiens
tcttgaagaatgaagacatttc

SEQ ID NO: 5948826 - DNA, 13 bp, Homo sapiens
tcttgaagacttt

SEQ ID NO: 5948827 - DNA, 23 bp, Homo sapiens
tcttgaagcatttcaaagccctg

SEQ ID NO: 5948828 - DNA, 20 bp, Homo sapiens
tcttgaagctgggctgtctc

SEQ ID NO: 5948829 - DNA, 21 bp, Homo sapiens
tcttgaagctgggctgtctct

SEQ ID NO: 5948830 - DNA, 16 bp, Homo sapiens
tcttgaagggcccagg

SEQ ID NO: 5948831 - DNA, 15 bp, Homo sapiens
tcttgaagtcagcca

SEQ ID NO: 5948832 - DNA, 13 bp, Homo sapiens
tcttgaagtcatt

SEQ ID NO: 5948833 - DNA, 16 bp, Homo sapiens
tcttgaagtccaggac

SEQ ID NO: 5948834 - DNA, 17 bp, Homo sapiens
tcttgaagtccaggact

SEQ ID NO: 5948835 - DNA, 13 bp, Homo sapiens
tcttgaagtcctg

SEQ ID NO: 5948836 - DNA, 19 bp, Homo sapiens
tcttgaagtcctggcttca

SEQ ID NO: 5948837 - DNA, 22 bp, Homo sapiens
tcttgaagtcctggcttcaggc

SEQ ID NO: 5948838 - DNA, 23 bp, Homo sapiens
tcttgaagtcctggcttcaggca

SEQ ID NO: 5948839 - DNA, 17 bp, Homo sapiens
tcttgaagtctgtacag

SEQ ID NO: 5948840 - DNA, 17 bp, Homo sapiens
tcttgaatagcttatgt

SEQ ID NO: 5948841 - DNA, 14 bp, Homo sapiens
tcttgaatataaaa

SEQ ID NO: 5948842 - DNA, 13 bp, Homo sapiens
tcttgaatatttg

SEQ ID NO: 5948843 - DNA, 22 bp, Homo sapiens
tcttgaatatttgcttaaaatt

SEQ ID NO: 5948844 - DNA, 13 bp, Homo sapiens
tcttgaatcccat

SEQ ID NO: 5948845 - DNA, 22 bp, Homo sapiens
tcttgaatggcaatgttttgct

SEQ ID NO: 5948846 - DNA, 17 bp, Homo sapiens
tcttgaattgttatgaa

SEQ ID NO: 5948847 - DNA, 19 bp, Homo sapiens
tcttgaattgttatgaaaa

SEQ ID NO: 5948848 - DNA, 21 bp, Homo sapiens
tcttgaatttaataatctgta

SEQ ID NO: 5948849 - DNA, 15 bp, Homo sapiens
tcttgaatttctgac

SEQ ID NO: 5948850 - DNA, 19 bp, Homo sapiens
tcttgaatttttttctgca

SEQ ID NO: 5948851 - DNA, 20 bp, Homo sapiens
tcttgaatttttttctgcac

SEQ ID NO: 5948852 - DNA, 21 bp, Homo sapiens
tcttgaatttttttctgcaca

SEQ ID NO: 5948853 - DNA, 13 bp, Homo sapiens
tcttgacaaaacc

SEQ ID NO: 5948854 - DNA, 18 bp, Homo sapiens
tcttgacaatcatctcca

SEQ ID NO: 5948855 - DNA, 22 bp, Homo sapiens
tcttgacaccagctgttctgtc

SEQ ID NO: 5948856 - DNA, 15 bp, Homo sapiens
tcttgacagaaagca

SEQ ID NO: 5948857 - DNA, 17 bp, Homo sapiens
tcttgacagaaagcagt

SEQ ID NO: 5948858 - DNA, 20 bp, Homo sapiens
tcttgacagagcctgcccca

SEQ ID NO: 5948859 - DNA, 15 bp, Homo sapiens
tcttgaccctgcacc

SEQ ID NO: 5948860 - DNA, 21 bp, Homo sapiens
tcttgaccctgtcacttgctg

SEQ ID NO: 5948861 - DNA, 14 bp, Homo sapiens
tcttgacctctcca

SEQ ID NO: 5948862 - DNA, 18 bp, Homo sapiens
tcttgacctctccagcat

SEQ ID NO: 5948863 - DNA, 19 bp, Homo sapiens
tcttgactaggtattgtct

SEQ ID NO: 5948864 - DNA, 18 bp, Homo sapiens
tcttgactcatggcagct

SEQ ID NO: 5948865 - DNA, 19 bp, Homo sapiens
tcttgactcatggcagctg

SEQ ID NO: 5948866 - DNA, 22 bp, Homo sapiens
tcttgactccactactttactg

SEQ ID NO: 5948867 - DNA, 19 bp, Homo sapiens
tcttgactccttggtgcta

SEQ ID NO: 5948868 - DNA, 13 bp, Homo sapiens
tcttgactctaaa

SEQ ID NO: 5948869 - DNA, 14 bp, Homo sapiens
tcttgactctaaat

SEQ ID NO: 5948870 - DNA, 15 bp, Homo sapiens
tcttgactctaaatg

SEQ ID NO: 5948871 - DNA, 19 bp, Homo sapiens
tcttgactgtcacggaaca

SEQ ID NO: 5948872 - DNA, 15 bp, Homo sapiens
tctttaaaacaaaac

SEQ ID NO: 5948873 - DNA, 16 bp, Homo sapiens
tctttaaaacaaaaca

SEQ ID NO: 5948874 - DNA, 15 bp, Homo sapiens
tctttaaaagaatga

SEQ ID NO: 5948875 - DNA, 14 bp, Homo sapiens
tctttaaaagagag

SEQ ID NO: 5948876 - DNA, 15 bp, Homo sapiens
tctttaaaagagaga

SEQ ID NO: 5948877 - DNA, 17 bp, Homo sapiens
tctttaaaagagagaga

SEQ ID NO: 5948878 - DNA, 21 bp, Homo sapiens
tctttaaaagatataagactt

SEQ ID NO: 5948879 - DNA, 12 bp, Homo sapiens
tctttaaaagct

SEQ ID NO: 5948880 - DNA, 18 bp, Homo sapiens
tctttaaaaggaaagaaa

SEQ ID NO: 5948881 - DNA, 16 bp, Homo sapiens
tctttaaaataaaaaa

SEQ ID NO: 5948882 - DNA, 22 bp, Homo sapiens
tctttaaaataaaaaagcaaaa

SEQ ID NO: 5948883 - DNA, 20 bp, Homo sapiens
tctttaaaatgtaaagccat

SEQ ID NO: 5948884 - DNA, 11 bp, Homo sapiens
tctttaaacag

SEQ ID NO: 5948885 - DNA, 13 bp, Homo sapiens
tctttaaactact

SEQ ID NO: 5948886 - DNA, 14 bp, Homo sapiens
tctttaaactactg

SEQ ID NO: 5948887 - DNA, 16 bp, Homo sapiens
tctttaaactactgaa

SEQ ID NO: 5948888 - DNA, 19 bp, Homo sapiens
tctttaaactataggtaat

SEQ ID NO: 5948889 - DNA, 16 bp, Homo sapiens
tctttaaataaaaata

SEQ ID NO: 5948890 - DNA, 14 bp, Homo sapiens
tctttaaataaatg

SEQ ID NO: 5948891 - DNA, 16 bp, Homo sapiens
tctttaaataaatgtg

SEQ ID NO: 5948892 - DNA, 14 bp, Homo sapiens
tctttaaataataa

SEQ ID NO: 5948893 - DNA, 13 bp, Homo sapiens
tctttaaatatat

SEQ ID NO: 5948894 - DNA, 16 bp, Homo sapiens
tctttaaatatatatt

SEQ ID NO: 5948895 - DNA, 17 bp, Homo sapiens
tctttaaatgatgtaca

SEQ ID NO: 5948896 - DNA, 22 bp, Homo sapiens
tctttaaattatgacgtgcaca

SEQ ID NO: 5948897 - DNA, 22 bp, Homo sapiens
tctttaaatttttatcttactt

SEQ ID NO: 5948898 - DNA, 22 bp, Homo sapiens
tctttaacacattctttataaa

SEQ ID NO: 5948899 - DNA, 19 bp, Homo sapiens
tctttaacatacatctaag

SEQ ID NO: 5948900 - DNA, 12 bp, Homo sapiens
tctttaacatag

SEQ ID NO: 5948901 - DNA, 14 bp, Homo sapiens
tctttaacatatca

SEQ ID NO: 5948902 - DNA, 19 bp, Homo sapiens
tctttaaccacttttcaat

SEQ ID NO: 5948903 - DNA, 17 bp, Homo sapiens
tctttaaccctcactgg

SEQ ID NO: 5948904 - DNA, 16 bp, Homo sapiens
tctttaaccttgtata

SEQ ID NO: 5948905 - DNA, 17 bp, Homo sapiens
tctttaaccttgtataa

SEQ ID NO: 5948906 - DNA, 18 bp, Homo sapiens
tctttaaccttgtataaa

SEQ ID NO: 5948907 - DNA, 14 bp, Homo sapiens
tctttaactcagga

SEQ ID NO: 5948908 - DNA, 14 bp, Homo sapiens
tctttaactgtcat

SEQ ID NO: 5948909 - DNA, 16 bp, Homo sapiens
tctttaacttgtaata

SEQ ID NO: 5948910 - DNA, 11 bp, Homo sapiens
tctttaacttt

SEQ ID NO: 5948911 - DNA, 14 bp, Homo sapiens
tctttaagagactc

SEQ ID NO: 5948912 - DNA, 23 bp, Homo sapiens
tctttaaggaagaataaaaaaga

SEQ ID NO: 5948913 - DNA, 13 bp, Homo sapiens
tctttaaggagat

SEQ ID NO: 5948914 - DNA, 16 bp, Homo sapiens
tctttaaggagataga

SEQ ID NO: 5948915 - DNA, 17 bp, Homo sapiens
tctttaagtgaaggatt

SEQ ID NO: 5948916 - DNA, 21 bp, Homo sapiens
tctttaagttttgattaatgt

SEQ ID NO: 5948917 - DNA, 23 bp, Homo sapiens
tctttaataacaaggagatttct

SEQ ID NO: 5948918 - DNA, 12 bp, Homo sapiens
tctttaatattt

SEQ ID NO: 5948919 - DNA, 13 bp, Homo sapiens
tctttaatatttt

SEQ ID NO: 5948920 - DNA, 22 bp, Homo sapiens
tctttaatcaatgtgacatgtt

SEQ ID NO: 5948921 - DNA, 23 bp, Homo sapiens
tctttaatcattttgcctctttt

SEQ ID NO: 5948922 - DNA, 16 bp, Homo sapiens
tctttaatcccagttt

SEQ ID NO: 5948923 - DNA, 15 bp, Homo sapiens
tctttaatcttcagt

SEQ ID NO: 5948924 - DNA, 17 bp, Homo sapiens
tctttaatgcaatatac

SEQ ID NO: 5948925 - DNA, 17 bp, Homo sapiens
tctttaatgctgtcttt

SEQ ID NO: 5948926 - DNA, 20 bp, Homo sapiens
tctttaatgctgtctttgtg

SEQ ID NO: 5948927 - DNA, 13 bp, Homo sapiens
tctttaatgcttt

SEQ ID NO: 5948928 - DNA, 16 bp, Homo sapiens
tctttaatgcttttat

SEQ ID NO: 5948929 - DNA, 22 bp, Homo sapiens
tctttaatgtcacaggcaggtc

SEQ ID NO: 5948930 - DNA, 19 bp, Homo sapiens
tctttaatttgttgtagat

SEQ ID NO: 5948931 - DNA, 14 bp, Homo sapiens
tctttaattttaca

SEQ ID NO: 5948932 - DNA, 14 bp, Homo sapiens
tctttaattttgga

SEQ ID NO: 5948933 - DNA, 15 bp, Homo sapiens
tctttaattttggaa

SEQ ID NO: 5948934 - DNA, 18 bp, Homo sapiens
tctttaattttggaattt

SEQ ID NO: 5948935 - DNA, 22 bp, Homo sapiens
tctttacaaaacaaactcattc

SEQ ID NO: 5948936 - DNA, 14 bp, Homo sapiens
tctttacaaaatga

SEQ ID NO: 5948937 - DNA, 20 bp, Homo sapiens
tctttacaaactgaagataa

SEQ ID NO: 5948938 - DNA, 21 bp, Homo sapiens
tctttacataattcagagtgg

SEQ ID NO: 5948939 - DNA, 12 bp, Homo sapiens
tctttacatcta

SEQ ID NO: 5948940 - DNA, 20 bp, Homo sapiens
tctttacccaaggattttta

SEQ ID NO: 5948941 - DNA, 21 bp, Homo sapiens
tctttacccaaggatttttaa

SEQ ID NO: 5948942 - DNA, 21 bp, Homo sapiens
tctttacccctgctgacctcc

SEQ ID NO: 5948943 - DNA, 16 bp, Homo sapiens
tctttacctgagacca

SEQ ID NO: 5948944 - DNA, 18 bp, Homo sapiens
tctttacctgagaccagt

SEQ ID NO: 5948945 - DNA, 14 bp, Homo sapiens
tctttaccttcatt

SEQ ID NO: 5948946 - DNA, 16 bp, Homo sapiens
tctttaccttctaaaa

SEQ ID NO: 5948947 - DNA, 14 bp, Homo sapiens
tctttacgtactgt

SEQ ID NO: 5948948 - DNA, 15 bp, Homo sapiens
tctttacgtactgta

SEQ ID NO: 5948949 - DNA, 18 bp, Homo sapiens
tctttacgtactgtaact

SEQ ID NO: 5948950 - DNA, 19 bp, Homo sapiens
tctttacgtactgtaactg

SEQ ID NO: 5948951 - DNA, 15 bp, Homo sapiens
tctttactagactga

SEQ ID NO: 5948952 - DNA, 21 bp, Homo sapiens
tctttactcccttcctggcct

SEQ ID NO: 5948953 - DNA, 23 bp, Homo sapiens
tctttactcctcacacttactgt

SEQ ID NO: 5948954 - DNA, 17 bp, Homo sapiens
tctttactcggcgtgct

SEQ ID NO: 5948955 - DNA, 21 bp, Homo sapiens
tctttactcggcgtgctcctt

SEQ ID NO: 5948956 - DNA, 18 bp, Homo sapiens
tctttactcgtccccttt

SEQ ID NO: 5948957 - DNA, 14 bp, Homo sapiens
tctttactctctcc

SEQ ID NO: 5948958 - DNA, 19 bp, Homo sapiens
tctttactgcactcagatt

SEQ ID NO: 5948959 - DNA, 19 bp, Homo sapiens
tctttactggtgatttctg

SEQ ID NO: 5948960 - DNA, 18 bp, Homo sapiens
tctttacttaacatatct

SEQ ID NO: 5948961 - DNA, 12 bp, Homo sapiens
tctttacttatc

SEQ ID NO: 5948962 - DNA, 13 bp, Homo sapiens
tctttacttatct

SEQ ID NO: 5948963 - DNA, 21 bp, Homo sapiens
tctttagaaaacccaagtttt

SEQ ID NO: 5948964 - DNA, 11 bp, Homo sapiens
tctttagaaca

SEQ ID NO: 5948965 - DNA, 12 bp, Homo sapiens
tctttagaattt

SEQ ID NO: 5948966 - DNA, 14 bp, Homo sapiens
tctttagagaactg

SEQ ID NO: 5948967 - DNA, 16 bp, Homo sapiens
tctttagagaactgaa

SEQ ID NO: 5948968 - DNA, 22 bp, Homo sapiens
tctttagagaatccgtattgaa

SEQ ID NO: 5948969 - DNA, 12 bp, Homo sapiens
tctttagagtta

SEQ ID NO: 5948970 - DNA, 14 bp, Homo sapiens
tctttagagttaga

SEQ ID NO: 5948971 - DNA, 18 bp, Homo sapiens
tctttagagttagactgt

SEQ ID NO: 5948972 - DNA, 19 bp, Homo sapiens
tctttagagttagactgtt

SEQ ID NO: 5948973 - DNA, 20 bp, Homo sapiens
tctttagatagccctgtcct

SEQ ID NO: 5948974 - DNA, 23 bp, Homo sapiens
tctttagatagccctgtcctggt

SEQ ID NO: 5948975 - DNA, 18 bp, Homo sapiens
tctttagcagtttcctca

SEQ ID NO: 5948976 - DNA, 21 bp, Homo sapiens
tctttagcagtttcctcagtg

SEQ ID NO: 5948977 - DNA, 23 bp, Homo sapiens
tctttagcagtttcctcagtgat

SEQ ID NO: 5948978 - DNA, 19 bp, Homo sapiens
tctttagccagaatctcat

SEQ ID NO: 5948979 - DNA, 18 bp, Homo sapiens
tctttagcttacctgggc

SEQ ID NO: 5948980 - DNA, 16 bp, Homo sapiens
tctttagcttttacca

SEQ ID NO: 5948981 - DNA, 17 bp, Homo sapiens
tctttaggacataaaga

SEQ ID NO: 5948982 - DNA, 15 bp, Homo sapiens
tctttaggagattta

SEQ ID NO: 5948983 - DNA, 23 bp, Homo sapiens
tctttaggattgtgatggttcgt

SEQ ID NO: 5948984 - DNA, 15 bp, Homo sapiens
tctttaggctttcaa

SEQ ID NO: 5948985 - DNA, 21 bp, Homo sapiens
tctttaggtctttgtaagaac

SEQ ID NO: 5948986 - DNA, 18 bp, Homo sapiens
tctttaggtgcctcctgt

SEQ ID NO: 5948987 - DNA, 13 bp, Homo sapiens
tctttagtactca

SEQ ID NO: 5948988 - DNA, 11 bp, Homo sapiens
tctttagtata

SEQ ID NO: 5948989 - DNA, 21 bp, Homo sapiens
tctttagttagtgattatatt

SEQ ID NO: 5948990 - DNA, 18 bp, Homo sapiens
tctttagttgaattccaa

SEQ ID NO: 5948991 - DNA, 23 bp, Homo sapiens
tctttagtttttggttgggaatg

SEQ ID NO: 5948992 - DNA, 17 bp, Homo sapiens
tctttataaccaccaag

SEQ ID NO: 5948993 - DNA, 21 bp, Homo sapiens
tctttataacccatattttcc

SEQ ID NO: 5948994 - DNA, 12 bp, Homo sapiens
tctttataagaa

SEQ ID NO: 5948995 - DNA, 17 bp, Homo sapiens
tctttataatggctctg

SEQ ID NO: 5948996 - DNA, 20 bp, Homo sapiens
tctttatacaacagtgctaa

SEQ ID NO: 5948997 - DNA, 21 bp, Homo sapiens
tctttatacaacagtgctaaa

SEQ ID NO: 5948998 - DNA, 15 bp, Homo sapiens
tctttatactctctt

SEQ ID NO: 5948999 - DNA, 21 bp, Homo sapiens
tctttatactctcttcccttt

SEQ ID NO: 5949000 - DNA, 16 bp, Homo sapiens
tctttatactgtaatt

SEQ ID NO: 5949001 - DNA, 21 bp, Homo sapiens
tctttatagaaggaatttgta

SEQ ID NO: 5949002 - DNA, 22 bp, Homo sapiens
tctttatagtgaagtgttaata

SEQ ID NO: 5949003 - DNA, 22 bp, Homo sapiens
tctttatataaggtcatagatt

SEQ ID NO: 5949004 - DNA, 16 bp, Homo sapiens
tctttatatacaataa

SEQ ID NO: 5949005 - DNA, 17 bp, Homo sapiens
tctttatatacaataat

SEQ ID NO: 5949006 - DNA, 21 bp, Homo sapiens
tctttatatacaataatggaa

SEQ ID NO: 5949007 - DNA, 14 bp, Homo sapiens
tctttatattgtca

SEQ ID NO: 5949008 - DNA, 16 bp, Homo sapiens
tctttatatttcaata

SEQ ID NO: 5949009 - DNA, 21 bp, Homo sapiens
tctttatattttgggtactgg

SEQ ID NO: 5949010 - DNA, 23 bp, Homo sapiens
tctttatcaagcaacattcttgt

SEQ ID NO: 5949011 - DNA, 13 bp, Homo sapiens
tctttatcctaaa

SEQ ID NO: 5949012 - DNA, 21 bp, Homo sapiens
tctttatgaattattttgata

SEQ ID NO: 5949013 - DNA, 16 bp, Homo sapiens
tctttatgcaaaaaca

SEQ ID NO: 5949014 - DNA, 15 bp, Homo sapiens
tctttatgcttgcaa

SEQ ID NO: 5949015 - DNA, 22 bp, Homo sapiens
tctttatggaaaaattgacaaa

SEQ ID NO: 5949016 - DNA, 15 bp, Homo sapiens
tctttatgtcaatct

SEQ ID NO: 5949017 - DNA, 14 bp, Homo sapiens
tctttatgtttttc

SEQ ID NO: 5949018 - DNA, 18 bp, Homo sapiens
tctttattaacctcagca

SEQ ID NO: 5949019 - DNA, 15 bp, Homo sapiens
tctttattacacaaa

SEQ ID NO: 5949020 - DNA, 15 bp, Homo sapiens
tctttattatggaaa

SEQ ID NO: 5949021 - DNA, 21 bp, Homo sapiens
tctttattattcctagtcttt

SEQ ID NO: 5949022 - DNA, 13 bp, Homo sapiens
tctttattcctag

SEQ ID NO: 5949023 - DNA, 14 bp, Homo sapiens
tctttattgagaaa

SEQ ID NO: 5949024 - DNA, 15 bp, Homo sapiens
tctttattgagaaag

SEQ ID NO: 5949025 - DNA, 21 bp, Homo sapiens
tctttattgcactaggaattc

SEQ ID NO: 5949026 - DNA, 18 bp, Homo sapiens
tctttattgccccttctt

SEQ ID NO: 5949027 - DNA, 13 bp, Homo sapiens
tctttattgtctg

SEQ ID NO: 5949028 - DNA, 14 bp, Homo sapiens
tctttattgtctgt

SEQ ID NO: 5949029 - DNA, 16 bp, Homo sapiens
tctttattgtctgtaa

SEQ ID NO: 5949030 - DNA, 17 bp, Homo sapiens
tctttattgtctgtaaa

SEQ ID NO: 5949031 - DNA, 18 bp, Homo sapiens
tctttatttatttatatt

SEQ ID NO: 5949032 - DNA, 22 bp, Homo sapiens
tctttattttactagaaatggg

SEQ ID NO: 5949033 - DNA, 18 bp, Homo sapiens
tctttattttattattca

SEQ ID NO: 5949034 - DNA, 12 bp, Homo sapiens
tctttattttga

SEQ ID NO: 5949035 - DNA, 12 bp, Homo sapiens
tctttattttgt

SEQ ID NO: 5949036 - DNA, 18 bp, Homo sapiens
tctttattttgtgtaaaa

SEQ ID NO: 5949037 - DNA, 11 bp, Homo sapiens
tctttcaaaac

SEQ ID NO: 5949038 - DNA, 20 bp, Homo sapiens
tctttcaaaaccttttgaaa

SEQ ID NO: 5949039 - DNA, 15 bp, Homo sapiens
tctttcaaaagcctt

SEQ ID NO: 5949040 - DNA, 12 bp, Homo sapiens
tctttcaaactc

SEQ ID NO: 5949041 - DNA, 18 bp, Homo sapiens
tctttcaaagaaatccaa

SEQ ID NO: 5949042 - DNA, 19 bp, Homo sapiens
tctttcaacttatttctga

SEQ ID NO: 5949043 - DNA, 21 bp, Homo sapiens
tctttcaacttgcaatttgca

SEQ ID NO: 5949044 - DNA, 21 bp, Homo sapiens
tctttcaagaactatatataa

SEQ ID NO: 5949045 - DNA, 14 bp, Homo sapiens
tctttcaagacagc

SEQ ID NO: 5949046 - DNA, 22 bp, Homo sapiens
tctttcaagacagcctaatgaa

SEQ ID NO: 5949047 - DNA, 20 bp, Homo sapiens
tctttcaagcagtcgtgcct

SEQ ID NO: 5949048 - DNA, 21 bp, Homo sapiens
tctttcaagcagtcgtgcctg

SEQ ID NO: 5949049 - DNA, 20 bp, Homo sapiens
tctttcaagggctttcctgt

SEQ ID NO: 5949050 - DNA, 16 bp, Homo sapiens
tctttcaagtgaatct

SEQ ID NO: 5949051 - DNA, 16 bp, Homo sapiens
tcttttctgttattgt

SEQ ID NO: 5949052 - DNA, 18 bp, Homo sapiens
tcttttcttactcctcct

SEQ ID NO: 5949053 - DNA, 19 bp, Homo sapiens
tcttttcttactcctcctc

SEQ ID NO: 5949054 - DNA, 15 bp, Homo sapiens
tcttttcttctcagg

SEQ ID NO: 5949055 - DNA, 12 bp, Homo sapiens
tcttttcttgga

SEQ ID NO: 5949056 - DNA, 22 bp, Homo sapiens
tcttttcttggcaaaagccttg

SEQ ID NO: 5949057 - DNA, 20 bp, Homo sapiens
tcttttcttggcgttcctgc

SEQ ID NO: 5949058 - DNA, 16 bp, Homo sapiens
tcttttctttagagca

SEQ ID NO: 5949059 - DNA, 16 bp, Homo sapiens
tcttttctttctgtct

SEQ ID NO: 5949060 - DNA, 18 bp, Homo sapiens
tcttttctttgccatctc

SEQ ID NO: 5949061 - DNA, 17 bp, Homo sapiens
tcttttctttgtatcat

SEQ ID NO: 5949062 - DNA, 14 bp, Homo sapiens
tcttttctttttac

SEQ ID NO: 5949063 - DNA, 21 bp, Homo sapiens
tcttttgaaacagattccatt

SEQ ID NO: 5949064 - DNA, 22 bp, Homo sapiens
tcttttgaagaagttcttaaat

SEQ ID NO: 5949065 - DNA, 12 bp, Homo sapiens
tcttttgaagca

SEQ ID NO: 5949066 - DNA, 17 bp, Homo sapiens
tcttttgaagtgtttta

SEQ ID NO: 5949067 - DNA, 17 bp, Homo sapiens
tcttttgaataatgtag

SEQ ID NO: 5949068 - DNA, 16 bp, Homo sapiens
tcttttgaatgttaag

SEQ ID NO: 5949069 - DNA, 17 bp, Homo sapiens
tcttttgacatgtggaa

SEQ ID NO: 5949070 - DNA, 22 bp, Homo sapiens
tcttttgaccccttcctgtctg

SEQ ID NO: 5949071 - DNA, 16 bp, Homo sapiens
tcttttgagtccttgt

SEQ ID NO: 5949072 - DNA, 16 bp, Homo sapiens
tcttttgatacattta

SEQ ID NO: 5949073 - DNA, 12 bp, Homo sapiens
tcttttgattct

SEQ ID NO: 5949074 - DNA, 23 bp, Homo sapiens
tcttttgcaggagtttgtggtaa

SEQ ID NO: 5949075 - DNA, 18 bp, Homo sapiens
tcttttgcatgtcgcaca

SEQ ID NO: 5949076 - DNA, 21 bp, Homo sapiens
tcttttgcccttcacagtgtt

SEQ ID NO: 5949077 - DNA, 23 bp, Homo sapiens
tcttttgccttttgcaaccagga

SEQ ID NO: 5949078 - DNA, 17 bp, Homo sapiens
tcttttgctactaagtt

SEQ ID NO: 5949079 - DNA, 20 bp, Homo sapiens
tcttttgcttgccaaagtac

SEQ ID NO: 5949080 - DNA, 19 bp, Homo sapiens
tcttttggaagttttgcta

SEQ ID NO: 5949081 - DNA, 20 bp, Homo sapiens
tcttttggaagttttgctag

SEQ ID NO: 5949082 - DNA, 16 bp, Homo sapiens
tcttttggggaagtga

SEQ ID NO: 5949083 - DNA, 20 bp, Homo sapiens
tcttttggggaagtgaggaa

SEQ ID NO: 5949084 - DNA, 14 bp, Homo sapiens
tcttttgggtaaaa

SEQ ID NO: 5949085 - DNA, 22 bp, Homo sapiens
tcttttgggtaaaatctgtaat

SEQ ID NO: 5949086 - DNA, 12 bp, Homo sapiens
tcttttggttat

SEQ ID NO: 5949087 - DNA, 10 bp, Homo sapiens
tcttttgtaa

SEQ ID NO: 5949088 - DNA, 19 bp, Homo sapiens
tcttttgtaaggtttttgt

SEQ ID NO: 5949089 - DNA, 14 bp, Homo sapiens
tcttttgtaagtat

SEQ ID NO: 5949090 - DNA, 12 bp, Homo sapiens
tcttttgtaatt

SEQ ID NO: 5949091 - DNA, 15 bp, Homo sapiens
tcttttgtaatttaa

SEQ ID NO: 5949092 - DNA, 10 bp, Homo sapiens
tcttttgtat

SEQ ID NO: 5949093 - DNA, 13 bp, Homo sapiens
tcttttgtctccc

SEQ ID NO: 5949094 - DNA, 15 bp, Homo sapiens
tcttttgtgcatatg

SEQ ID NO: 5949095 - DNA, 15 bp, Homo sapiens
tcttttgtgtcctgt

SEQ ID NO: 5949096 - DNA, 22 bp, Homo sapiens
tcttttgtgttcctatggaaac

SEQ ID NO: 5949097 - DNA, 11 bp, Homo sapiens
tcttttgttac

SEQ ID NO: 5949098 - DNA, 19 bp, Homo sapiens
tcttttgttactcttggga

SEQ ID NO: 5949099 - DNA, 16 bp, Homo sapiens
tcttttgttactgttc

SEQ ID NO: 5949100 - DNA, 17 bp, Homo sapiens
tcttttgttactgttct

SEQ ID NO: 5949101 - DNA, 21 bp, Homo sapiens
tcttttgttactgttcttgct

SEQ ID NO: 5949102 - DNA, 22 bp, Homo sapiens
tcttttgttactgttcttgctg

SEQ ID NO: 5949103 - DNA, 12 bp, Homo sapiens
tcttttgttctc

SEQ ID NO: 5949104 - DNA, 16 bp, Homo sapiens
tcttttgttcttgata

SEQ ID NO: 5949105 - DNA, 15 bp, Homo sapiens
tcttttgttgtttct

SEQ ID NO: 5949106 - DNA, 18 bp, Homo sapiens
tcttttgttgtttcttaa

SEQ ID NO: 5949107 - DNA, 14 bp, Homo sapiens
tcttttgtttcatt

SEQ ID NO: 5949108 - DNA, 12 bp, Homo sapiens
tcttttgtttcc

SEQ ID NO: 5949109 - DNA, 12 bp, Homo sapiens
tcttttgtttgg

SEQ ID NO: 5949110 - DNA, 16 bp, Homo sapiens
tcttttgttttcttca

SEQ ID NO: 5949111 - DNA, 17 bp, Homo sapiens
tcttttgttttcttcat

SEQ ID NO: 5949112 - DNA, 15 bp, Homo sapiens
tctttttaaaatggt

SEQ ID NO: 5949113 - DNA, 12 bp, Homo sapiens
tctttttaaagt

SEQ ID NO: 5949114 - DNA, 13 bp, Homo sapiens
tctttttaagaat

SEQ ID NO: 5949115 - DNA, 17 bp, Homo sapiens
tctttttaagctcagtg

SEQ ID NO: 5949116 - DNA, 21 bp, Homo sapiens
tctttttaagcttatttaatt

SEQ ID NO: 5949117 - DNA, 14 bp, Homo sapiens
tctttttaaggaca

SEQ ID NO: 5949118 - DNA, 16 bp, Homo sapiens
tctttttaagtaatgt

SEQ ID NO: 5949119 - DNA, 11 bp, Homo sapiens
tctttttaatt

SEQ ID NO: 5949120 - DNA, 19 bp, Homo sapiens
tctttttacagcattgtct

SEQ ID NO: 5949121 - DNA, 20 bp, Homo sapiens
tctttttacagcattgtctt

SEQ ID NO: 5949122 - DNA, 13 bp, Homo sapiens
tctttttacagtt

SEQ ID NO: 5949123 - DNA, 12 bp, Homo sapiens
tctttttacata

SEQ ID NO: 5949124 - DNA, 22 bp, Homo sapiens
tctttttacattgtgaatgctg

SEQ ID NO: 5949125 - DNA, 15 bp, Homo sapiens
tctttttactgttga

SEQ ID NO: 5949126 - DNA, 15 bp, Homo sapiens
tctttttatcatgat

SEQ ID NO: 5949127 - DNA, 14 bp, Homo sapiens
tctttttatgcaaa

SEQ ID NO: 5949128 - DNA, 14 bp, Homo sapiens
tctttttatgcatt

SEQ ID NO: 5949129 - DNA, 22 bp, Homo sapiens
tctttttattgatgtgcaaaaa

SEQ ID NO: 5949130 - DNA, 18 bp, Homo sapiens
tctttttatttaaatgtg

SEQ ID NO: 5949131 - DNA, 21 bp, Homo sapiens
tctttttattttttaattatt

SEQ ID NO: 5949132 - DNA, 18 bp, Homo sapiens
tctttttcactctgtgtc

SEQ ID NO: 5949133 - DNA, 19 bp, Homo sapiens
tctttttcaggctcgccaa

SEQ ID NO: 5949134 - DNA, 16 bp, Homo sapiens
tctttttcattttgca

SEQ ID NO: 5949135 - DNA, 20 bp, Homo sapiens
tctttttccagaatttggaa

SEQ ID NO: 5949136 - DNA, 13 bp, Homo sapiens
tctttttccagtg

SEQ ID NO: 5949137 - DNA, 23 bp, Homo sapiens
tctttttcccctatcctgttctt

SEQ ID NO: 5949138 - DNA, 13 bp, Homo sapiens
tctttttcccttt

SEQ ID NO: 5949139 - DNA, 17 bp, Homo sapiens
tctttttccctttcctt

SEQ ID NO: 5949140 - DNA, 10 bp, Homo sapiens
tctttttcct

SEQ ID NO: 5949141 - DNA, 13 bp, Homo sapiens
tctttttcctcct

SEQ ID NO: 5949142 - DNA, 15 bp, Homo sapiens
tctttttcctcctgg

SEQ ID NO: 5949143 - DNA, 20 bp, Homo sapiens
tctttttcgtataatcttgt

SEQ ID NO: 5949144 - DNA, 12 bp, Homo sapiens
tctttttctacc

SEQ ID NO: 5949145 - DNA, 11 bp, Homo sapiens
tctttttctcc

SEQ ID NO: 5949146 - DNA, 15 bp, Homo sapiens
tctttttctccaccc

SEQ ID NO: 5949147 - DNA, 15 bp, Homo sapiens
tctttttctgttgta

SEQ ID NO: 5949148 - DNA, 16 bp, Homo sapiens
tctttttctgttgtaa

SEQ ID NO: 5949149 - DNA, 12 bp, Homo sapiens
tctttttcttct

SEQ ID NO: 5949150 - DNA, 13 bp, Homo sapiens
tctttttcttggg

SEQ ID NO: 5949151 - DNA, 15 bp, Homo sapiens
tctttttcttgtcat

SEQ ID NO: 5949152 - DNA, 16 bp, Homo sapiens
tctttttctttctttg

SEQ ID NO: 5949153 - DNA, 14 bp, Homo sapiens
tctttttcttttct

SEQ ID NO: 5949154 - DNA, 13 bp, Homo sapiens
tctttttgaaaat

SEQ ID NO: 5949155 - DNA, 15 bp, Homo sapiens
tctttttgaagtatt

SEQ ID NO: 5949156 - DNA, 14 bp, Homo sapiens
tctttttgaatctt

SEQ ID NO: 5949157 - DNA, 22 bp, Homo sapiens
tctttttgaccctcattcttta

SEQ ID NO: 5949158 - DNA, 21 bp, Homo sapiens
tctttttgccagttttccctg

SEQ ID NO: 5949159 - DNA, 22 bp, Homo sapiens
tctttttgccagttttccctgg

SEQ ID NO: 5949160 - DNA, 13 bp, Homo sapiens
tctttttgccctt

SEQ ID NO: 5949161 - DNA, 20 bp, Homo sapiens
tctttttgctctaaaatatt

SEQ ID NO: 5949162 - DNA, 13 bp, Homo sapiens
tctttttgcttct

SEQ ID NO: 5949163 - DNA, 22 bp, Homo sapiens
tctttttggactcagcccacct

SEQ ID NO: 5949164 - DNA, 13 bp, Homo sapiens
tctttttgtaatt

SEQ ID NO: 5949165 - DNA, 15 bp, Homo sapiens
tctttttgtgtgcag

SEQ ID NO: 5949166 - DNA, 16 bp, Homo sapiens
tctttttgttgtaaaa

SEQ ID NO: 5949167 - DNA, 13 bp, Homo sapiens
tctttttgtttca

SEQ ID NO: 5949168 - DNA, 12 bp, Homo sapiens
tctttttgtttg

SEQ ID NO: 5949169 - DNA, 19 bp, Homo sapiens
tctttttgtttttctttta

SEQ ID NO: 5949170 - DNA, 23 bp, Homo sapiens
tcttttttaaaggggtctgttct

SEQ ID NO: 5949171 - DNA, 16 bp, Homo sapiens
tcttttttaaatgttt

SEQ ID NO: 5949172 - DNA, 19 bp, Homo sapiens
tcttttttaaatgtttctt

SEQ ID NO: 5949173 - DNA, 17 bp, Homo sapiens
tcttttttaataaacta

SEQ ID NO: 5949174 - DNA, 19 bp, Homo sapiens
tcttttttaataaactact

SEQ ID NO: 5949175 - DNA, 18 bp, Homo sapiens
tcttttttacaaaggctg

SEQ ID NO: 5949176 - DNA, 15 bp, Homo sapiens
tcttttttactcatt

SEQ ID NO: 5949177 - DNA, 20 bp, Homo sapiens
tcttttttactcattgaaat

SEQ ID NO: 5949178 - DNA, 20 bp, Homo sapiens
tcttttttagcataaaattt

SEQ ID NO: 5949179 - DNA, 15 bp, Homo sapiens
tcttttttatgtgat

SEQ ID NO: 5949180 - DNA, 16 bp, Homo sapiens
tcttttttattaatca

SEQ ID NO: 5949181 - DNA, 21 bp, Homo sapiens
tcttttttattaatcactgtg

SEQ ID NO: 5949182 - DNA, 14 bp, Homo sapiens
tcttttttcaatgt

SEQ ID NO: 5949183 - DNA, 20 bp, Homo sapiens
tcttttttcaatgtactgta

SEQ ID NO: 5949184 - DNA, 20 bp, Homo sapiens
tcttttttcagttattttga

SEQ ID NO: 5949185 - DNA, 21 bp, Homo sapiens
tcttttttcatttcttcctca

SEQ ID NO: 5949186 - DNA, 13 bp, Homo sapiens
tcttttttcgttt

SEQ ID NO: 5949187 - DNA, 14 bp, Homo sapiens
tcttttttctatct

SEQ ID NO: 5949188 - DNA, 17 bp, Homo sapiens
tcttttttgagtgtgca

SEQ ID NO: 5949189 - DNA, 15 bp, Homo sapiens
tcttttttgctttct

SEQ ID NO: 5949190 - DNA, 23 bp, Homo sapiens
tcttttttgtttgtttctttgtg

SEQ ID NO: 5949191 - DNA, 20 bp, Homo sapiens
tctttttttaaaaagttgat

SEQ ID NO: 5949192 - DNA, 18 bp, Homo sapiens
tctttttttattaaacag

SEQ ID NO: 5949193 - DNA, 13 bp, Homo sapiens
tctttttttctgt

SEQ ID NO: 5949194 - DNA, 15 bp, Homo sapiens
tctttttttcttgaa

SEQ ID NO: 5949195 - DNA, 13 bp, Homo sapiens
tctttttttgcat

SEQ ID NO: 5949196 - DNA, 23 bp, Homo sapiens
tcttttttttaataaggaaaaaa

SEQ ID NO: 5949197 - DNA, 22 bp, Homo sapiens
tcttttttttaatgtgctgtgt

SEQ ID NO: 5949198 - DNA, 17 bp, Homo sapiens
tcttttttttaatgttt

SEQ ID NO: 5949199 - DNA, 22 bp, Homo sapiens
tcttttttttaggcaaaacctt

SEQ ID NO: 5949200 - DNA, 22 bp, Homo sapiens
tcttttttttcctttgaacgtg

SEQ ID NO: 5949201 - DNA, 16 bp, Homo sapiens
tctttttttttaagtt

SEQ ID NO: 5949202 - DNA, 18 bp, Homo sapiens
tctttttttttaagttct

SEQ ID NO: 5949203 - DNA, 20 bp, Homo sapiens
tctttttttttaagttctta

SEQ ID NO: 5949204 - DNA, 19 bp, Homo sapiens
tcttttttttttctgttga

SEQ ID NO: 5949205 - DNA, 22 bp, Homo sapiens
tctttttttttttttaataaat

SEQ ID NO: 5949206 - DNA, 23 bp, Homo sapiens
tctttttttttttttataaaagc

SEQ ID NO: 5949207 - DNA, 18 bp, Homo sapiens
tgaaaaaaaaaaagaaga

SEQ ID NO: 5949208 - DNA, 19 bp, Homo sapiens
tgaaaaaaaaaaagaagaa

SEQ ID NO: 5949209 - DNA, 20 bp, Homo sapiens
tgaaaaaaaaaatgctgaac

SEQ ID NO: 5949210 - DNA, 21 bp, Homo sapiens
tgaaaaaaaaaatgctgaaca

SEQ ID NO: 5949211 - DNA, 22 bp, Homo sapiens
tgaaaaaaaaaatgctgaacat

SEQ ID NO: 5949212 - DNA, 13 bp, Homo sapiens
tgaaaaaaaaagg

SEQ ID NO: 5949213 - DNA, 15 bp, Homo sapiens
tgaaaaaaaaagggg

SEQ ID NO: 5949214 - DNA, 20 bp, Homo sapiens
tgaaaaaaaaattatttgcc

SEQ ID NO: 5949215 - DNA, 22 bp, Homo sapiens
tgaaaaaaaaattatttgcctt

SEQ ID NO: 5949216 - DNA, 16 bp, Homo sapiens
tgaaaaaaaagtttca

SEQ ID NO: 5949217 - DNA, 19 bp, Homo sapiens
tgaaaaaaaattcctttca

SEQ ID NO: 5949218 - DNA, 16 bp, Homo sapiens
tgaaaaaaacttcatt

SEQ ID NO: 5949219 - DNA, 13 bp, Homo sapiens
tgaaaaaaagaaa

SEQ ID NO: 5949220 - DNA, 16 bp, Homo sapiens
tgaaaaaaagaaacga

SEQ ID NO: 5949221 - DNA, 19 bp, Homo sapiens
tgaaaaaaagaaacgaaaa

SEQ ID NO: 5949222 - DNA, 20 bp, Homo sapiens
tgaaaaaaagggcactctga

SEQ ID NO: 5949223 - DNA, 16 bp, Homo sapiens
tgaaaaaaagtttaca

SEQ ID NO: 5949224 - DNA, 18 bp, Homo sapiens
tgaaaaaaatgatctatt

SEQ ID NO: 5949225 - DNA, 21 bp, Homo sapiens
tgaaaaaaatgatctattgca

SEQ ID NO: 5949226 - DNA, 16 bp, Homo sapiens
tgaaaaaaattattca

SEQ ID NO: 5949227 - DNA, 23 bp, Homo sapiens
tgaaaaaaattattcatgctctc

SEQ ID NO: 5949228 - DNA, 21 bp, Homo sapiens
tgaaaaaaattttagaacagt

SEQ ID NO: 5949229 - DNA, 14 bp, Homo sapiens
tgaaaaaactatat

SEQ ID NO: 5949230 - DNA, 18 bp, Homo sapiens
tgaaagcttcaaagttta

SEQ ID NO: 5949231 - DNA, 14 bp, Homo sapiens
tgaaagctttgaaa

SEQ ID NO: 5949232 - DNA, 22 bp, Homo sapiens
tgaaagctttgaaataaaataa

SEQ ID NO: 5949233 - DNA, 12 bp, Homo sapiens
tgaaaggaaaaa

SEQ ID NO: 5949234 - DNA, 12 bp, Homo sapiens
tgaaaggaaaga

SEQ ID NO: 5949235 - DNA, 13 bp, Homo sapiens
tgaaaggaaagtg

SEQ ID NO: 5949236 - DNA, 17 bp, Homo sapiens
tgaaaggaacatttttt

SEQ ID NO: 5949237 - DNA, 22 bp, Homo sapiens
tgaaaggaattttgctaagtaa

SEQ ID NO: 5949238 - DNA, 19 bp, Homo sapiens
tgaaaggacctcttctgaa

SEQ ID NO: 5949239 - DNA, 18 bp, Homo sapiens
tgaaaggagacaatggtt

SEQ ID NO: 5949240 - DNA, 22 bp, Homo sapiens
tgaaaggagagcatcggcctag

SEQ ID NO: 5949241 - DNA, 16 bp, Homo sapiens
tgaaaggattctctaa

SEQ ID NO: 5949242 - DNA, 18 bp, Homo sapiens
tgaaaggcaaacatttga

SEQ ID NO: 5949243 - DNA, 19 bp, Homo sapiens
tgaaaggcaggcctatttc

SEQ ID NO: 5949244 - DNA, 21 bp, Homo sapiens
tgaaaggcaggcctatttcat

SEQ ID NO: 5949245 - DNA, 22 bp, Homo sapiens
tgaaaggcaggcctatttcatc

SEQ ID NO: 5949246 - DNA, 17 bp, Homo sapiens
tgaaaggcagggcaaga

SEQ ID NO: 5949247 - DNA, 23 bp, Homo sapiens
tgaaaggcagggcccttggggct

SEQ ID NO: 5949248 - DNA, 20 bp, Homo sapiens
tgaaaggcagtagtcatttt

SEQ ID NO: 5949249 - DNA, 15 bp, Homo sapiens
tgaaaggccagcagc

SEQ ID NO: 5949250 - DNA, 17 bp, Homo sapiens
tgaaaggctatcctgct

SEQ ID NO: 5949251 - DNA, 15 bp, Homo sapiens
tgaaaggcttttaaa

SEQ ID NO: 5949252 - DNA, 13 bp, Homo sapiens
tgaaagggaaact

SEQ ID NO: 5949253 - DNA, 22 bp, Homo sapiens
tgaaagggagctatcaggaaca

SEQ ID NO: 5949254 - DNA, 17 bp, Homo sapiens
tgaaagggatcatcatg

SEQ ID NO: 5949255 - DNA, 17 bp, Homo sapiens
tgaaagggcccagagag

SEQ ID NO: 5949256 - DNA, 20 bp, Homo sapiens
tgaaaggggacacctgtaca

SEQ ID NO: 5949257 - DNA, 22 bp, Homo sapiens
tgaaagggtttgtaatacttta

SEQ ID NO: 5949258 - DNA, 16 bp, Homo sapiens
tgaaaggtaatctgaa

SEQ ID NO: 5949259 - DNA, 19 bp, Homo sapiens
tgaaaggtaatctgaaaca

SEQ ID NO: 5949260 - DNA, 16 bp, Homo sapiens
tgaaaggtaatttgag

SEQ ID NO: 5949261 - DNA, 14 bp, Homo sapiens
tgaaaggtactata

SEQ ID NO: 5949262 - DNA, 16 bp, Homo sapiens
tgaaaggtacttcaaa

SEQ ID NO: 5949263 - DNA, 18 bp, Homo sapiens
tgaaaggttggccttact

SEQ ID NO: 5949264 - DNA, 22 bp, Homo sapiens
tgaaagtaactgttttcttctt

SEQ ID NO: 5949265 - DNA, 15 bp, Homo sapiens
tgaaagtaatttcaa

SEQ ID NO: 5949266 - DNA, 16 bp, Homo sapiens
tgaaagtaatttcaag

SEQ ID NO: 5949267 - DNA, 17 bp, Homo sapiens
tgaaagtaatttcaaga

SEQ ID NO: 5949268 - DNA, 23 bp, Homo sapiens
tgaaagtacatttggagacacaa

SEQ ID NO: 5949269 - DNA, 17 bp, Homo sapiens
tgaaagtagagctagct

SEQ ID NO: 5949270 - DNA, 23 bp, Homo sapiens
tgaaagtagagctagctgccact

SEQ ID NO: 5949271 - DNA, 15 bp, Homo sapiens
tgaaagtagggggct

SEQ ID NO: 5949272 - DNA, 12 bp, Homo sapiens
tgaaagtataat

SEQ ID NO: 5949273 - DNA, 19 bp, Homo sapiens
tgaaagtattcacatcatt

SEQ ID NO: 5949274 - DNA, 21 bp, Homo sapiens
tgaaagtattcagaaattaaa

SEQ ID NO: 5949275 - DNA, 13 bp, Homo sapiens
tgaaagtcaaatt

SEQ ID NO: 5949276 - DNA, 18 bp, Homo sapiens
tgaaagtcaaatttactt

SEQ ID NO: 5949277 - DNA, 19 bp, Homo sapiens
tgaaagtcaaatttacttt

SEQ ID NO: 5949278 - DNA, 22 bp, Homo sapiens
tgaaagtcaaatttactttaaa

SEQ ID NO: 5949279 - DNA, 14 bp, Homo sapiens
tgaaagtcagttta

SEQ ID NO: 5949280 - DNA, 16 bp, Homo sapiens
tgaaagtccagaaact

SEQ ID NO: 5949281 - DNA, 13 bp, Homo sapiens
tgaaagtcccaga

SEQ ID NO: 5949282 - DNA, 17 bp, Homo sapiens
tgaaagtctgtccttga

SEQ ID NO: 5949283 - DNA, 23 bp, Homo sapiens
tgaaagtctgtccttgaaggact

SEQ ID NO: 5949284 - DNA, 23 bp, Homo sapiens
tgaaagtcttgtgactagtgctg

SEQ ID NO: 5949285 - DNA, 17 bp, Homo sapiens
tgaaagtgacagagacc

SEQ ID NO: 5949286 - DNA, 19 bp, Homo sapiens
tgaaagtgaggaaataaag

SEQ ID NO: 5949287 - DNA, 14 bp, Homo sapiens
tgaaagtgcatttt

SEQ ID NO: 5949288 - DNA, 18 bp, Homo sapiens
tgaaagtgcatttttgta

SEQ ID NO: 5949289 - DNA, 22 bp, Homo sapiens
tgaaagtgccaaaataaagtct

SEQ ID NO: 5949290 - DNA, 24 bp, Homo sapiens
tgaaagtgccaaaataaagtctgt

SEQ ID NO: 5949291 - DNA, 16 bp, Homo sapiens
tgaaagtgcctttgca

SEQ ID NO: 5949292 - DNA, 15 bp, Homo sapiens
tgaaagtgctgctct

SEQ ID NO: 5949293 - DNA, 16 bp, Homo sapiens
tgaaagtggcaagctc

SEQ ID NO: 5949294 - DNA, 17 bp, Homo sapiens
tgaaagtgtaaaataga

SEQ ID NO: 5949295 - DNA, 15 bp, Homo sapiens
tgaaagtgtcgtctc

SEQ ID NO: 5949296 - DNA, 17 bp, Homo sapiens
tgaaagtgttttactct

SEQ ID NO: 5949297 - DNA, 22 bp, Homo sapiens
tgaaagtgttttactctttttc

SEQ ID NO: 5949298 - DNA, 19 bp, Homo sapiens
tgaaagtgtttttctttaa

SEQ ID NO: 5949299 - DNA, 20 bp, Homo sapiens
tgaaagttagagattttaca

SEQ ID NO: 5949300 - DNA, 21 bp, Homo sapiens
tgaaagttagagattttacaa

SEQ ID NO: 5949301 - DNA, 14 bp, Homo sapiens
tgaaagttgccatt

SEQ ID NO: 5949302 - DNA, 18 bp, Homo sapiens
tgaaagttgccattattc

SEQ ID NO: 5949303 - DNA, 19 bp, Homo sapiens
tgaaagttgccattattct

SEQ ID NO: 5949304 - DNA, 20 bp, Homo sapiens
tgaaagttgccattattcta

SEQ ID NO: 5949305 - DNA, 14 bp, Homo sapiens
tgaaagttgctttt

SEQ ID NO: 5949306 - DNA, 22 bp, Homo sapiens
tgaaagttgtgatctgttgtaa

SEQ ID NO: 5949307 - DNA, 19 bp, Homo sapiens
tgaaagtttccttattttc

SEQ ID NO: 5949308 - DNA, 20 bp, Homo sapiens
tgaaagtttccttattttca

SEQ ID NO: 5949309 - DNA, 23 bp, Homo sapiens
tgaaagtttcttcaactctgaat

SEQ ID NO: 5949310 - DNA, 17 bp, Homo sapiens
tgaaagtttgcactgta

SEQ ID NO: 5949311 - DNA, 20 bp, Homo sapiens
tgaaagtttgttctgcagag

SEQ ID NO: 5949312 - DNA, 19 bp, Homo sapiens
tgaaagttttccagtattg

SEQ ID NO: 5949313 - DNA, 20 bp, Homo sapiens
tgaaagttttccagtattga

SEQ ID NO: 5949314 - DNA, 17 bp, Homo sapiens
tgaaagttttgtaaaag

SEQ ID NO: 5949315 - DNA, 17 bp, Homo sapiens
tgaaagtttttaattca

SEQ ID NO: 5949316 - DNA, 23 bp, Homo sapiens
tgaaagtttttaattcatatttt

SEQ ID NO: 5949317 - DNA, 20 bp, Homo sapiens
tgaaagtttttctgaaagtg

SEQ ID NO: 5949318 - DNA, 23 bp, Homo sapiens
tgaaataaaaaaaaaaggatgaa

SEQ ID NO: 5949319 - DNA, 18 bp, Homo sapiens
tgaaataaaaaaagattt

SEQ ID NO: 5949320 - DNA, 12 bp, Homo sapiens
tgaaataaaaat

SEQ ID NO: 5949321 - DNA, 16 bp, Homo sapiens
tgaaataaaaattatg

SEQ ID NO: 5949322 - DNA, 19 bp, Homo sapiens
tgaaataaaactggctttg

SEQ ID NO: 5949323 - DNA, 14 bp, Homo sapiens
tgaaataaaagcta

SEQ ID NO: 5949324 - DNA, 14 bp, Homo sapiens
tgaaataaaataac

SEQ ID NO: 5949325 - DNA, 17 bp, Homo sapiens
tgaaataaaatgccata

SEQ ID NO: 5949326 - DNA, 11 bp, Homo sapiens
tgaaataaaca

SEQ ID NO: 5949327 - DNA, 14 bp, Homo sapiens
tgaaataaacactg

SEQ ID NO: 5949328 - DNA, 22 bp, Homo sapiens
tgaaataaacactggtgccaac

SEQ ID NO: 5949329 - DNA, 23 bp, Homo sapiens
tgaaataaacagtctaaagaaga

SEQ ID NO: 5949330 - DNA, 18 bp, Homo sapiens
tgaaataaacctgcactg

SEQ ID NO: 5949331 - DNA, 18 bp, Homo sapiens
tgaaataaacgtcttaaa

SEQ ID NO: 5949332 - DNA, 23 bp, Homo sapiens
tgaaataaacgtcttaaatattc

SEQ ID NO: 5949333 - DNA, 22 bp, Homo sapiens
tgaaataaatgtttcaaatgca

SEQ ID NO: 5949334 - DNA, 15 bp, Homo sapiens
tgaaataaattctga

SEQ ID NO: 5949335 - DNA, 18 bp, Homo sapiens
tgaaataaattctgattc

SEQ ID NO: 5949336 - DNA, 20 bp, Homo sapiens
tgaaataaattggtgataag

SEQ ID NO: 5949337 - DNA, 22 bp, Homo sapiens
tgaaataacagccttaaatcct

SEQ ID NO: 5949338 - DNA, 16 bp, Homo sapiens
tgaaataacatggcct

SEQ ID NO: 5949339 - DNA, 17 bp, Homo sapiens
tgaaataacatggcctt

SEQ ID NO: 5949340 - DNA, 18 bp, Homo sapiens
tgaaataaccgtaaaggt

SEQ ID NO: 5949341 - DNA, 20 bp, Homo sapiens
tgaaataactggaacaaatt

SEQ ID NO: 5949342 - DNA, 20 bp, Homo sapiens
tgaaataagaattcagacat

SEQ ID NO: 5949343 - DNA, 23 bp, Homo sapiens
tgaaataagccagacatcaacag

SEQ ID NO: 5949344 - DNA, 17 bp, Homo sapiens
tgaaataagttgtttca

SEQ ID NO: 5949345 - DNA, 17 bp, Homo sapiens
tgaaataataaaatgca

SEQ ID NO: 5949346 - DNA, 13 bp, Homo sapiens
tgaaataatatat

SEQ ID NO: 5949347 - DNA, 18 bp, Homo sapiens
tgaaataatatatttctt

SEQ ID NO: 5949348 - DNA, 19 bp, Homo sapiens
tgaaataatatatttcttc

SEQ ID NO: 5949349 - DNA, 23 bp, Homo sapiens
tgaaataatgtgtagttcatgta

SEQ ID NO: 5949350 - DNA, 18 bp, Homo sapiens
tgaaataatttgtgtctg

SEQ ID NO: 5949351 - DNA, 20 bp, Homo sapiens
tgaaataatttttaactttt

SEQ ID NO: 5949352 - DNA, 22 bp, Homo sapiens
tgaaatacatatgataaatttg

SEQ ID NO: 5949353 - DNA, 13 bp, Homo sapiens
tgaaatacatcct

SEQ ID NO: 5949354 - DNA, 21 bp, Homo sapiens
tgaaataccaacctgaagaca

SEQ ID NO: 5949355 - DNA, 22 bp, Homo sapiens
tgaaataccagtgaaccaaaga

SEQ ID NO: 5949356 - DNA, 23 bp, Homo sapiens
tgaaataccagtgaaccaaagag

SEQ ID NO: 5949357 - DNA, 12 bp, Homo sapiens
tgaaatacctat

SEQ ID NO: 5949358 - DNA, 24 bp, Homo sapiens
tgaaatacctattaattcttaata

SEQ ID NO: 5949359 - DNA, 21 bp, Homo sapiens
tgaaatacctttgcctggata

SEQ ID NO: 5949360 - DNA, 16 bp, Homo sapiens
tgaaatacctttgtag

SEQ ID NO: 5949361 - DNA, 21 bp, Homo sapiens
tgaaatacctttgtagttact

SEQ ID NO: 5949362 - DNA, 16 bp, Homo sapiens
tgaaatactaaaagca

SEQ ID NO: 5949363 - DNA, 13 bp, Homo sapiens
tgaaatactactt

SEQ ID NO: 5949364 - DNA, 14 bp, Homo sapiens
tgaaatactccagc

SEQ ID NO: 5949365 - DNA, 13 bp, Homo sapiens
tgaaatacttgaa

SEQ ID NO: 5949366 - DNA, 13 bp, Homo sapiens
tgaaatactttat

SEQ ID NO: 5949367 - DNA, 17 bp, Homo sapiens
tgaaatagattttttca

SEQ ID NO: 5949368 - DNA, 22 bp, Homo sapiens
tgaaatagccgaactccaggct

SEQ ID NO: 5949369 - DNA, 16 bp, Homo sapiens
tgaaatagctttactg

SEQ ID NO: 5949370 - DNA, 23 bp, Homo sapiens
tgaaatagctttactgtttctca

SEQ ID NO: 5949371 - DNA, 15 bp, Homo sapiens
tgaaataggaaacaa

SEQ ID NO: 5949372 - DNA, 18 bp, Homo sapiens
tgaaatagtcctgaagtt

SEQ ID NO: 5949373 - DNA, 16 bp, Homo sapiens
tgaaatagtctgtgtg

SEQ ID NO: 5949374 - DNA, 17 bp, Homo sapiens
tgaaatagtctgtgtga

SEQ ID NO: 5949375 - DNA, 22 bp, Homo sapiens
tgaaatagtggttcttggaaaa

SEQ ID NO: 5949376 - DNA, 19 bp, Homo sapiens
tgaaatagttcaaactgca

SEQ ID NO: 5949377 - DNA, 17 bp, Homo sapiens
tgaaatagttctgccac

SEQ ID NO: 5949378 - DNA, 13 bp, Homo sapiens
tgaaatataaact

SEQ ID NO: 5949379 - DNA, 16 bp, Homo sapiens
tgaaatataaactgtg

SEQ ID NO: 5949380 - DNA, 14 bp, Homo sapiens
tgaaatataaatta

SEQ ID NO: 5949381 - DNA, 21 bp, Homo sapiens
tgaaatataaattatctgaat

SEQ ID NO: 5949382 - DNA, 12 bp, Homo sapiens
tgaaatataatt

SEQ ID NO: 5949383 - DNA, 15 bp, Homo sapiens
tgaaatataattgta

SEQ ID NO: 5949384 - DNA, 15 bp, Homo sapiens
tgaaatatacacaca

SEQ ID NO: 5949385 - DNA, 18 bp, Homo sapiens
tgaaatatagttgaaagt

SEQ ID NO: 5949386 - DNA, 22 bp, Homo sapiens
tgaaatatagttgaaagtaaaa

SEQ ID NO: 5949387 - DNA, 13 bp, Homo sapiens
tgaaatatataat

SEQ ID NO: 5949388 - DNA, 17 bp, Homo sapiens
tgaaatatatattgtaa

SEQ ID NO: 5949389 - DNA, 16 bp, Homo sapiens
tgaaatatattatttc

SEQ ID NO: 5949390 - DNA, 16 bp, Homo sapiens
tgaaatatattttaaa

SEQ ID NO: 5949391 - DNA, 21 bp, Homo sapiens
tgaaatatattttaaatgtgg

SEQ ID NO: 5949392 - DNA, 23 bp, Homo sapiens
tgaaatatcatcacgtatgttat

SEQ ID NO: 5949393 - DNA, 17 bp, Homo sapiens
tgaaatatccacccagc

SEQ ID NO: 5949394 - DNA, 14 bp, Homo sapiens
tgaaatatccagga

SEQ ID NO: 5949395 - DNA, 17 bp, Homo sapiens
tgaaatatcctgcttga

SEQ ID NO: 5949396 - DNA, 16 bp, Homo sapiens
tgaaatatgatgttaa

SEQ ID NO: 5949397 - DNA, 13 bp, Homo sapiens
tgaaatatgcata

SEQ ID NO: 5949398 - DNA, 16 bp, Homo sapiens
tgaaatatgcatgtac

SEQ ID NO: 5949399 - DNA, 18 bp, Homo sapiens
tgaaatatgctcttttgt

SEQ ID NO: 5949400 - DNA, 15 bp, Homo sapiens
tgaaatatggaactg

SEQ ID NO: 5949401 - DNA, 20 bp, Homo sapiens
tgaaatatggaactgtaata

SEQ ID NO: 5949402 - DNA, 17 bp, Homo sapiens
tgaaatatgtataactt

SEQ ID NO: 5949403 - DNA, 23 bp, Homo sapiens
tgaaatatgtataactttaactt

SEQ ID NO: 5949404 - DNA, 18 bp, Homo sapiens
tgaaatatgtgaagccca

SEQ ID NO: 5949405 - DNA, 15 bp, Homo sapiens
tgaaatattcttagg

SEQ ID NO: 5949406 - DNA, 14 bp, Homo sapiens
tgaactcctgacct

SEQ ID NO: 5949407 - DNA, 15 bp, Homo sapiens
tgaactcctgacctc

SEQ ID NO: 5949408 - DNA, 13 bp, Homo sapiens
tgaactcctgcca

SEQ ID NO: 5949409 - DNA, 15 bp, Homo sapiens
tgaactcctggcctc

SEQ ID NO: 5949410 - DNA, 14 bp, Homo sapiens
tgaactcctgggct

SEQ ID NO: 5949411 - DNA, 16 bp, Homo sapiens
tgaactcctgggctca

SEQ ID NO: 5949412 - DNA, 14 bp, Homo sapiens
tgaactcgcaggga

SEQ ID NO: 5949413 - DNA, 15 bp, Homo sapiens
tgaactctattttga

SEQ ID NO: 5949414 - DNA, 13 bp, Homo sapiens
tgaactctcaaat

SEQ ID NO: 5949415 - DNA, 15 bp, Homo sapiens
tgaactctcccctcc

SEQ ID NO: 5949416 - DNA, 20 bp, Homo sapiens
tgaactctcccctccccatc

SEQ ID NO: 5949417 - DNA, 23 bp, Homo sapiens
tgaactctcccctccccatctgt

SEQ ID NO: 5949418 - DNA, 16 bp, Homo sapiens
tgaactctgaactttg

SEQ ID NO: 5949419 - DNA, 19 bp, Homo sapiens
tgaactcttagaaatgaag

SEQ ID NO: 5949420 - DNA, 22 bp, Homo sapiens
tgaactcttagtgattgagact

SEQ ID NO: 5949421 - DNA, 15 bp, Homo sapiens
tgaactcttcactct

SEQ ID NO: 5949422 - DNA, 14 bp, Homo sapiens
tgaactcttgataa

SEQ ID NO: 5949423 - DNA, 16 bp, Homo sapiens
tgaactcttggcctca

SEQ ID NO: 5949424 - DNA, 14 bp, Homo sapiens
tgaactctttcaaa

SEQ ID NO: 5949425 - DNA, 20 bp, Homo sapiens
tgaactctttctggcctgcc

SEQ ID NO: 5949426 - DNA, 23 bp, Homo sapiens
tgaactctttctggcctgccttc

SEQ ID NO: 5949427 - DNA, 22 bp, Homo sapiens
tgaactgaacaccattgaaggc

SEQ ID NO: 5949428 - DNA, 14 bp, Homo sapiens
tgaactgaactctg

SEQ ID NO: 5949429 - DNA, 12 bp, Homo sapiens
tgaactgagcca

SEQ ID NO: 5949430 - DNA, 16 bp, Homo sapiens
tgaactgagcttggaa

SEQ ID NO: 5949431 - DNA, 13 bp, Homo sapiens
tgaactgaggccc

SEQ ID NO: 5949432 - DNA, 15 bp, Homo sapiens
tgaactgataaagat

SEQ ID NO: 5949433 - DNA, 14 bp, Homo sapiens
tgaactgataattt

SEQ ID NO: 5949434 - DNA, 18 bp, Homo sapiens
tgaactgataatttttgt

SEQ ID NO: 5949435 - DNA, 18 bp, Homo sapiens
tgaactgatagttactgt

SEQ ID NO: 5949436 - DNA, 13 bp, Homo sapiens
tgaactgattttt

SEQ ID NO: 5949437 - DNA, 16 bp, Homo sapiens
tgaactgcaaagcttt

SEQ ID NO: 5949438 - DNA, 18 bp, Homo sapiens
tgaactgcaacaacgcct

SEQ ID NO: 5949439 - DNA, 16 bp, Homo sapiens
tgaactgcacaatgca

SEQ ID NO: 5949440 - DNA, 18 bp, Homo sapiens
tgaactgcagcaatcaca

SEQ ID NO: 5949441 - DNA, 23 bp, Homo sapiens
tgaactgcaggataaaatggtac

SEQ ID NO: 5949442 - DNA, 13 bp, Homo sapiens
tgaactgcagtga

SEQ ID NO: 5949443 - DNA, 18 bp, Homo sapiens
tgaactgcatgtataaat

SEQ ID NO: 5949444 - DNA, 13 bp, Homo sapiens
tgaactgccaaga

SEQ ID NO: 5949445 - DNA, 12 bp, Homo sapiens
tgaactgcccac

SEQ ID NO: 5949446 - DNA, 23 bp, Homo sapiens
tgaactgcctcaggaccccactg

SEQ ID NO: 5949447 - DNA, 12 bp, Homo sapiens
tgaactgctcta

SEQ ID NO: 5949448 - DNA, 13 bp, Homo sapiens
tgaactgctgcca

SEQ ID NO: 5949449 - DNA, 14 bp, Homo sapiens
tgaactgctgccaa

SEQ ID NO: 5949450 - DNA, 15 bp, Homo sapiens
tgaactgctgctggt

SEQ ID NO: 5949451 - DNA, 12 bp, Homo sapiens
tgaactgctttt

SEQ ID NO: 5949452 - DNA, 21 bp, Homo sapiens
tgaactgcttttaaaagtgca

SEQ ID NO: 5949453 - DNA, 15 bp, Homo sapiens
tgaactggaagaaag

SEQ ID NO: 5949454 - DNA, 23 bp, Homo sapiens
tgaactggaccctgttgctaagc

SEQ ID NO: 5949455 - DNA, 11 bp, Homo sapiens
tgaactggctt

SEQ ID NO: 5949456 - DNA, 17 bp, Homo sapiens
tgaactggcttgtacat

SEQ ID NO: 5949457 - DNA, 20 bp, Homo sapiens
tgaactggcttgtacatttt

SEQ ID NO: 5949458 - DNA, 14 bp, Homo sapiens
tgaactgggacctt

SEQ ID NO: 5949459 - DNA, 14 bp, Homo sapiens
tgaactgggcacag

SEQ ID NO: 5949460 - DNA, 18 bp, Homo sapiens
tgaactgggcacagattg

SEQ ID NO: 5949461 - DNA, 20 bp, Homo sapiens
tgaactgggccttaactgtt

SEQ ID NO: 5949462 - DNA, 22 bp, Homo sapiens
tgaactgggcgaatgtcttatt

SEQ ID NO: 5949463 - DNA, 12 bp, Homo sapiens
tgaactgggctc

SEQ ID NO: 5949464 - DNA, 19 bp, Homo sapiens
tgaactgggtacttgtgga

SEQ ID NO: 5949465 - DNA, 17 bp, Homo sapiens
tgaactggtagaaaaac

SEQ ID NO: 5949466 - DNA, 20 bp, Homo sapiens
tgaactggtagaaaaacatc

SEQ ID NO: 5949467 - DNA, 14 bp, Homo sapiens
tgaactgtattatt

SEQ ID NO: 5949468 - DNA, 19 bp, Homo sapiens
tgaactgtattattgcaat

SEQ ID NO: 5949469 - DNA, 22 bp, Homo sapiens
tgaactgtattctagtggctgt

SEQ ID NO: 5949470 - DNA, 12 bp, Homo sapiens
tgaactgtgaac

SEQ ID NO: 5949471 - DNA, 13 bp, Homo sapiens
tgaactgtgacag

SEQ ID NO: 5949472 - DNA, 10 bp, Homo sapiens
tgaactgtgg

SEQ ID NO: 5949473 - DNA, 12 bp, Homo sapiens
tgaactgtggaa

SEQ ID NO: 5949474 - DNA, 13 bp, Homo sapiens
tgaactgttacaa

SEQ ID NO: 5949475 - DNA, 18 bp, Homo sapiens
tgaactgttagatgctga

SEQ ID NO: 5949476 - DNA, 14 bp, Homo sapiens
tgaactgttgccct

SEQ ID NO: 5949477 - DNA, 17 bp, Homo sapiens
tgaactgttgcccttct

SEQ ID NO: 5949478 - DNA, 19 bp, Homo sapiens
tgaactgttgcccttctgt

SEQ ID NO: 5949479 - DNA, 15 bp, Homo sapiens
tgaactgttgtctgg

SEQ ID NO: 5949480 - DNA, 15 bp, Homo sapiens
tgaacttaaaatgaa

SEQ ID NO: 5949481 - DNA, 17 bp, Homo sapiens
tgaacttaaataaatgt

SEQ ID NO: 5949482 - DNA, 22 bp, Homo sapiens
tgaacttaaataaatgtcatta

SEQ ID NO: 5949483 - DNA, 19 bp, Homo sapiens
tgaacttagaactatgcta

SEQ ID NO: 5949484 - DNA, 21 bp, Homo sapiens
tgaacttagatgttaaatgtt

SEQ ID NO: 5949485 - DNA, 18 bp, Homo sapiens
tgaacttagattttacat

SEQ ID NO: 5949486 - DNA, 21 bp, Homo sapiens
tgaacttatttacacatagtt

SEQ ID NO: 5949487 - DNA, 16 bp, Homo sapiens
tgaacttccaagctcc

SEQ ID NO: 5949488 - DNA, 16 bp, Homo sapiens
tgaacttccaggaaag

SEQ ID NO: 5949489 - DNA, 14 bp, Homo sapiens
tgaacttccatttg

SEQ ID NO: 5949490 - DNA, 23 bp, Homo sapiens
tgaacttcccacacgattagctt

SEQ ID NO: 5949491 - DNA, 24 bp, Homo sapiens
tgaacttcccacacgattagcttt

SEQ ID NO: 5949492 - DNA, 19 bp, Homo sapiens
tgaacttcctgcttcctca

SEQ ID NO: 5949493 - DNA, 21 bp, Homo sapiens
tgaacttcgcatcaaaagaca

SEQ ID NO: 5949494 - DNA, 15 bp, Homo sapiens
tgaacttctctcaga

SEQ ID NO: 5949495 - DNA, 14 bp, Homo sapiens
tgaacttgaaaaaa

SEQ ID NO: 5949496 - DNA, 13 bp, Homo sapiens
tgaacttgaaatt

SEQ ID NO: 5949497 - DNA, 14 bp, Homo sapiens
tgaacttgaaattt

SEQ ID NO: 5949498 - DNA, 18 bp, Homo sapiens
tgaacttgaaatttgaat

SEQ ID NO: 5949499 - DNA, 17 bp, Homo sapiens
tgaacttgactgggtga

SEQ ID NO: 5949500 - DNA, 18 bp, Homo sapiens
tgaacttgagatctgtat

SEQ ID NO: 5949501 - DNA, 20 bp, Homo sapiens
tgaacttgagatctgtataa

SEQ ID NO: 5949502 - DNA, 17 bp, Homo sapiens
tgaacttgagctctgta

SEQ ID NO: 5949503 - DNA, 21 bp, Homo sapiens
tgaacttgagctctgtaactt

SEQ ID NO: 5949504 - DNA, 22 bp, Homo sapiens
tgaacttgagctctgtaactta

SEQ ID NO: 5949505 - DNA, 17 bp, Homo sapiens
tgaacttgcaggcaagc

SEQ ID NO: 5949506 - DNA, 14 bp, Homo sapiens
tgaacttgctcttt

SEQ ID NO: 5949507 - DNA, 22 bp, Homo sapiens
tgaacttggatattcaagcctt

SEQ ID NO: 5949508 - DNA, 14 bp, Homo sapiens
tgaacttggcgctg

SEQ ID NO: 5949509 - DNA, 14 bp, Homo sapiens
tgaacttggctttc

SEQ ID NO: 5949510 - DNA, 23 bp, Homo sapiens
tgaacttggctttcctgtttcta

SEQ ID NO: 5949511 - DNA, 14 bp, Homo sapiens
tgaacttgggaggg

SEQ ID NO: 5949512 - DNA, 22 bp, Homo sapiens
tgaacttgtaaaggaatttaaa

SEQ ID NO: 5949513 - DNA, 19 bp, Homo sapiens
tgaacttgtagctgtaaaa

SEQ ID NO: 5949514 - DNA, 14 bp, Homo sapiens
tgaacttgttactt

SEQ ID NO: 5949515 - DNA, 18 bp, Homo sapiens
tgaacttgttacttgcag

SEQ ID NO: 5949516 - DNA, 19 bp, Homo sapiens
tgaactttcagcagtctaa

SEQ ID NO: 5949517 - DNA, 14 bp, Homo sapiens
tgaactttccaaaa

SEQ ID NO: 5949518 - DNA, 21 bp, Homo sapiens
tgaactttctcagcatatata

SEQ ID NO: 5949519 - DNA, 14 bp, Homo sapiens
tgaactttctccct

SEQ ID NO: 5949520 - DNA, 11 bp, Homo sapiens
tgaactttgac

SEQ ID NO: 5949521 - DNA, 17 bp, Homo sapiens
tgaactttgacctctgc

SEQ ID NO: 5949522 - DNA, 20 bp, Homo sapiens
tgaactttgaggaggaagca

SEQ ID NO: 5949523 - DNA, 18 bp, Homo sapiens
tgaactttgccaaaaaaa

SEQ ID NO: 5949524 - DNA, 14 bp, Homo sapiens
tgaactttggagag

SEQ ID NO: 5949525 - DNA, 18 bp, Homo sapiens
tgaactttgggaagcctt

SEQ ID NO: 5949526 - DNA, 18 bp, Homo sapiens
tgaactttgtcagtgttg

SEQ ID NO: 5949527 - DNA, 17 bp, Homo sapiens
tgaactttgtttccaga

SEQ ID NO: 5949528 - DNA, 19 bp, Homo sapiens
tgaactttgtttccagaaa

SEQ ID NO: 5949529 - DNA, 12 bp, Homo sapiens
tgaacttttcaa

SEQ ID NO: 5949530 - DNA, 13 bp, Homo sapiens
tgaacttttcaaa

SEQ ID NO: 5949531 - DNA, 18 bp, Homo sapiens
tgaacttttcaaaataaa

SEQ ID NO: 5949532 - DNA, 21 bp, Homo sapiens
tgaacttttgtaatttgaatt

SEQ ID NO: 5949533 - DNA, 13 bp, Homo sapiens
tgaacttttgtac

SEQ ID NO: 5949534 - DNA, 14 bp, Homo sapiens
tgaacttttgtact

SEQ ID NO: 5949535 - DNA, 22 bp, Homo sapiens
tgaactttttatttgaggagac

SEQ ID NO: 5949536 - DNA, 15 bp, Homo sapiens
tgaagaaaaaataca

SEQ ID NO: 5949537 - DNA, 20 bp, Homo sapiens
tgaagaaaaaatcagaacta

SEQ ID NO: 5949538 - DNA, 22 bp, Homo sapiens
tgaagaaaaaatggcaagagat

SEQ ID NO: 5949539 - DNA, 21 bp, Homo sapiens
tgaagaaaaagacctgcattt

SEQ ID NO: 5949540 - DNA, 22 bp, Homo sapiens
tgaagaaaaagacctgcatttg

SEQ ID NO: 5949541 - DNA, 20 bp, Homo sapiens
tgaagaaaaaggacaaataa

SEQ ID NO: 5949542 - DNA, 19 bp, Homo sapiens
tgaagaaaaaggctggctg

SEQ ID NO: 5949543 - DNA, 13 bp, Homo sapiens
tgaagaaaaagta

SEQ ID NO: 5949544 - DNA, 23 bp, Homo sapiens
tgaagaaaacagctgcatggcac

SEQ ID NO: 5949545 - DNA, 15 bp, Homo sapiens
tgaagaaaacttgaa

SEQ ID NO: 5949546 - DNA, 18 bp, Homo sapiens
tgaagaaaaggggagcac

SEQ ID NO: 5949547 - DNA, 16 bp, Homo sapiens
tgaagaaaatacttaa

SEQ ID NO: 5949548 - DNA, 18 bp, Homo sapiens
tgaagaaaatacttaaat

SEQ ID NO: 5949549 - DNA, 14 bp, Homo sapiens
tgaagaaaatcctt

SEQ ID NO: 5949550 - DNA, 16 bp, Homo sapiens
tgaagaaaatgacttt

SEQ ID NO: 5949551 - DNA, 17 bp, Homo sapiens
tgaagaaaatgacttta

SEQ ID NO: 5949552 - DNA, 15 bp, Homo sapiens
tgaagaaacacagca

SEQ ID NO: 5949553 - DNA, 19 bp, Homo sapiens
tgaagaaacacagcatgca

SEQ ID NO: 5949554 - DNA, 13 bp, Homo sapiens
tgaagaaacgctt

SEQ ID NO: 5949555 - DNA, 20 bp, Homo sapiens
tgaagaaagagactgtgggg

SEQ ID NO: 5949556 - DNA, 14 bp, Homo sapiens
tgaagaaagcccct

SEQ ID NO: 5949557 - DNA, 22 bp, Homo sapiens
tgaagaaagcctcagtgaaaca

SEQ ID NO: 5949558 - DNA, 19 bp, Homo sapiens
tgaagaaagggaggcccag

SEQ ID NO: 5949559 - DNA, 20 bp, Homo sapiens
tgaagaaagggaggcccagc

SEQ ID NO: 5949560 - DNA, 13 bp, Homo sapiens
tgaagaaagtcaa

SEQ ID NO: 5949561 - DNA, 17 bp, Homo sapiens
tgaagaaatctttccag

SEQ ID NO: 5949562 - DNA, 15 bp, Homo sapiens
tgaagaaatgatgga

SEQ ID NO: 5949563 - DNA, 20 bp, Homo sapiens
tgaagaaattatacgtacat

SEQ ID NO: 5949564 - DNA, 17 bp, Homo sapiens
tgaagaacacagcatgt

SEQ ID NO: 5949565 - DNA, 19 bp, Homo sapiens
tgaagaacacagcatgtgc

SEQ ID NO: 5949566 - DNA, 15 bp, Homo sapiens
tgaagaacagtaact

SEQ ID NO: 5949567 - DNA, 20 bp, Homo sapiens
tgaagaacagtaactgccat

SEQ ID NO: 5949568 - DNA, 13 bp, Homo sapiens
tgaagaacatgtg

SEQ ID NO: 5949569 - DNA, 16 bp, Homo sapiens
tgaagaaccctctgtc

SEQ ID NO: 5949570 - DNA, 21 bp, Homo sapiens
tgaagaaccctgcagggccct

SEQ ID NO: 5949571 - DNA, 17 bp, Homo sapiens
tgaagaactagcatata

SEQ ID NO: 5949572 - DNA, 18 bp, Homo sapiens
tgaagaactattatattg

SEQ ID NO: 5949573 - DNA, 23 bp, Homo sapiens
tgaagaactgcaggccctggcct

SEQ ID NO: 5949574 - DNA, 19 bp, Homo sapiens
tgaagaactgcatgtggct

SEQ ID NO: 5949575 - DNA, 20 bp, Homo sapiens
tgaagaactgttgcctaatt

SEQ ID NO: 5949576 - DNA, 23 bp, Homo sapiens
tgaagaagaaccagcccagcctg

SEQ ID NO: 5949577 - DNA, 22 bp, Homo sapiens
tgaagaagaccagtcacagcca

SEQ ID NO: 5949578 - DNA, 14 bp, Homo sapiens
tgaagaagatggta

SEQ ID NO: 5949579 - DNA, 23 bp, Homo sapiens
tgaagaagccatcaattttaaca

SEQ ID NO: 5949580 - DNA, 22 bp, Homo sapiens
tgaagaagctaaatcctttact

SEQ ID NO: 5949581 - DNA, 13 bp, Homo sapiens
tgaagaagctggg

SEQ ID NO: 5949582 - DNA, 19 bp, Homo sapiens
tgaagaaggaagctgtgtt

SEQ ID NO: 5949583 - DNA, 23 bp, Homo sapiens
tgaagaaggaagctgtgttgaaa

SEQ ID NO: 5949584 - DNA, 23 bp, Homo sapiens
tgaagaaggaaggcctgagcccc

SEQ ID NO: 5949585 - DNA, 20 bp, Homo sapiens
tgaagtctccccgcagccct

SEQ ID NO: 5949586 - DNA, 17 bp, Homo sapiens
tgaagtctccttttgtc

SEQ ID NO: 5949587 - DNA, 20 bp, Homo sapiens
tgaagtctctttttcttcct

SEQ ID NO: 5949588 - DNA, 14 bp, Homo sapiens
tgaagtctgacaat

SEQ ID NO: 5949589 - DNA, 17 bp, Homo sapiens
tgaagtctgagcccatt

SEQ ID NO: 5949590 - DNA, 20 bp, Homo sapiens
tgaagtctgagcccatttct

SEQ ID NO: 5949591 - DNA, 13 bp, Homo sapiens
tgaagtcttccct

SEQ ID NO: 5949592 - DNA, 22 bp, Homo sapiens
tgaagtcttccctcagatttcc

SEQ ID NO: 5949593 - DNA, 10 bp, Homo sapiens
tgaagtcttg

SEQ ID NO: 5949594 - DNA, 13 bp, Homo sapiens
tgaagtcttgtat

SEQ ID NO: 5949595 - DNA, 20 bp, Homo sapiens
tgaagtctttgtacagacaa

SEQ ID NO: 5949596 - DNA, 17 bp, Homo sapiens
tgaagtgaaaaagtttt

SEQ ID NO: 5949597 - DNA, 14 bp, Homo sapiens
tgaagtgaaactgc

SEQ ID NO: 5949598 - DNA, 18 bp, Homo sapiens
tgaagtgaaggagaaagg

SEQ ID NO: 5949599 - DNA, 17 bp, Homo sapiens
tgaagtgaattcctgca

SEQ ID NO: 5949600 - DNA, 19 bp, Homo sapiens
tgaagtgaccccagctcca

SEQ ID NO: 5949601 - DNA, 23 bp, Homo sapiens
tgaagtgaccccagctccaggca

SEQ ID NO: 5949602 - DNA, 20 bp, Homo sapiens
tgaagtgactgttgtaccat

SEQ ID NO: 5949603 - DNA, 23 bp, Homo sapiens
tgaagtgatgttgtttaacataa

SEQ ID NO: 5949604 - DNA, 18 bp, Homo sapiens
tgaagtgcagctcatgtt

SEQ ID NO: 5949605 - DNA, 18 bp, Homo sapiens
tgaagtgcatgggtcagg

SEQ ID NO: 5949606 - DNA, 12 bp, Homo sapiens
tgaagtgcatgt

SEQ ID NO: 5949607 - DNA, 20 bp, Homo sapiens
tgaagtgcctctgattctat

SEQ ID NO: 5949608 - DNA, 16 bp, Homo sapiens
tgaagtgcgtgaatgt

SEQ ID NO: 5949609 - DNA, 21 bp, Homo sapiens
tgaagtgctgggcaagtttac

SEQ ID NO: 5949610 - DNA, 15 bp, Homo sapiens
tgaagtgctgtttta

SEQ ID NO: 5949611 - DNA, 20 bp, Homo sapiens
tgaagtgcttgtatagcttt

SEQ ID NO: 5949612 - DNA, 14 bp, Homo sapiens
tgaagtggccctcc

SEQ ID NO: 5949613 - DNA, 17 bp, Homo sapiens
tgaagtggccctccctc

SEQ ID NO: 5949614 - DNA, 18 bp, Homo sapiens
tgaagtggccctccctca

SEQ ID NO: 5949615 - DNA, 17 bp, Homo sapiens
tgaagtggcctcttgga

SEQ ID NO: 5949616 - DNA, 20 bp, Homo sapiens
tgaagtgggaaagcattttc

SEQ ID NO: 5949617 - DNA, 22 bp, Homo sapiens
tgaagtggtgtgatcccagctc

SEQ ID NO: 5949618 - DNA, 23 bp, Homo sapiens
tgaagtggtgtgatcccagctca

SEQ ID NO: 5949619 - DNA, 21 bp, Homo sapiens
tgaagtggttcagtctagaag

SEQ ID NO: 5949620 - DNA, 23 bp, Homo sapiens
tgaagtggtttgcaggtcagcct

SEQ ID NO: 5949621 - DNA, 18 bp, Homo sapiens
tgaagtgtaggcagacac

SEQ ID NO: 5949622 - DNA, 19 bp, Homo sapiens
tgaagtgtaggcagacaca

SEQ ID NO: 5949623 - DNA, 22 bp, Homo sapiens
tgaagtgtcgagtccagtcctt

SEQ ID NO: 5949624 - DNA, 13 bp, Homo sapiens
tgaagtgtcttct

SEQ ID NO: 5949625 - DNA, 14 bp, Homo sapiens
tgaagtgtcttctg

SEQ ID NO: 5949626 - DNA, 15 bp, Homo sapiens
tgaagtgtcttctgt

SEQ ID NO: 5949627 - DNA, 16 bp, Homo sapiens
tgaagtgtcttctgtt

SEQ ID NO: 5949628 - DNA, 19 bp, Homo sapiens
tgaagtgtggctggtgtcc

SEQ ID NO: 5949629 - DNA, 18 bp, Homo sapiens
tgaagtgtgtttccttca

SEQ ID NO: 5949630 - DNA, 18 bp, Homo sapiens
tgaagtgttaatacatca

SEQ ID NO: 5949631 - DNA, 17 bp, Homo sapiens
tgaagtgttagactata

SEQ ID NO: 5949632 - DNA, 23 bp, Homo sapiens
tgaagtgttatttcatccaggga

SEQ ID NO: 5949633 - DNA, 19 bp, Homo sapiens
tgaagtgttccctttttca

SEQ ID NO: 5949634 - DNA, 17 bp, Homo sapiens
tgaagtgttctgagctg

SEQ ID NO: 5949635 - DNA, 22 bp, Homo sapiens
tgaagtgttgtggagaaaagag

SEQ ID NO: 5949636 - DNA, 22 bp, Homo sapiens
tgaagttaagcacaaccatgtt

SEQ ID NO: 5949637 - DNA, 23 bp, Homo sapiens
tgaagttacatgcataaaagggt

SEQ ID NO: 5949638 - DNA, 15 bp, Homo sapiens
tgaagttagaattcc

SEQ ID NO: 5949639 - DNA, 18 bp, Homo sapiens
tgaagttagctttaactt

SEQ ID NO: 5949640 - DNA, 19 bp, Homo sapiens
tgaagttaggttcttaaaa

SEQ ID NO: 5949641 - DNA, 21 bp, Homo sapiens
tgaagttagtggaaatctgaa

SEQ ID NO: 5949642 - DNA, 12 bp, Homo sapiens
tgaagttatatt

SEQ ID NO: 5949643 - DNA, 13 bp, Homo sapiens
tgaagttatattt

SEQ ID NO: 5949644 - DNA, 16 bp, Homo sapiens
tgaagttatgctgtca

SEQ ID NO: 5949645 - DNA, 12 bp, Homo sapiens
tgaagttcatct

SEQ ID NO: 5949646 - DNA, 17 bp, Homo sapiens
tgaagttcatcttgcag

SEQ ID NO: 5949647 - DNA, 13 bp, Homo sapiens
tgaagttcatgaa

SEQ ID NO: 5949648 - DNA, 16 bp, Homo sapiens
tgaagttcatggtgat

SEQ ID NO: 5949649 - DNA, 18 bp, Homo sapiens
tgaagttcatggtgatca

SEQ ID NO: 5949650 - DNA, 16 bp, Homo sapiens
tgaagttctgaaattt

SEQ ID NO: 5949651 - DNA, 14 bp, Homo sapiens
tgaagttctgagcc

SEQ ID NO: 5949652 - DNA, 18 bp, Homo sapiens
tgaagttgattcatattg

SEQ ID NO: 5949653 - DNA, 13 bp, Homo sapiens
tgaagttgctgct

SEQ ID NO: 5949654 - DNA, 22 bp, Homo sapiens
tgaagttgctgcttctcccagg

SEQ ID NO: 5949655 - DNA, 15 bp, Homo sapiens
tgaagttgctgttta

SEQ ID NO: 5949656 - DNA, 21 bp, Homo sapiens
tgaagttgctgtttatttttt

SEQ ID NO: 5949657 - DNA, 14 bp, Homo sapiens
tgaagttggacagc

SEQ ID NO: 5949658 - DNA, 13 bp, Homo sapiens
tgaagttggttta

SEQ ID NO: 5949659 - DNA, 17 bp, Homo sapiens
tgaagttgtacaacacc

SEQ ID NO: 5949660 - DNA, 16 bp, Homo sapiens
tgaagttgtggaggag

SEQ ID NO: 5949661 - DNA, 22 bp, Homo sapiens
tgaagttgttactaactaaact

SEQ ID NO: 5949662 - DNA, 18 bp, Homo sapiens
tgaagtttaattgtctca

SEQ ID NO: 5949663 - DNA, 19 bp, Homo sapiens
tgaagtttaattgtctcaa

SEQ ID NO: 5949664 - DNA, 17 bp, Homo sapiens
tgaagtttacaatcaaa

SEQ ID NO: 5949665 - DNA, 14 bp, Homo sapiens
tgaagtttacattt

SEQ ID NO: 5949666 - DNA, 16 bp, Homo sapiens
tgaagtttacattttt

SEQ ID NO: 5949667 - DNA, 17 bp, Homo sapiens
tgaagtttacattttta

SEQ ID NO: 5949668 - DNA, 16 bp, Homo sapiens
tgaagtttatacagta

SEQ ID NO: 5949669 - DNA, 20 bp, Homo sapiens
tgaagtttatacagtacagt

SEQ ID NO: 5949670 - DNA, 17 bp, Homo sapiens
tgaagtttattattttc

SEQ ID NO: 5949671 - DNA, 19 bp, Homo sapiens
tgaagtttattattttcaa

SEQ ID NO: 5949672 - DNA, 13 bp, Homo sapiens
tgaagtttcaagt

SEQ ID NO: 5949673 - DNA, 17 bp, Homo sapiens
tgaagtttcactccgga

SEQ ID NO: 5949674 - DNA, 21 bp, Homo sapiens
tgaagtttcatttatgataca

SEQ ID NO: 5949675 - DNA, 16 bp, Homo sapiens
tgaagtttccgccccc

SEQ ID NO: 5949676 - DNA, 18 bp, Homo sapiens
tgaagtttccgcccccgc

SEQ ID NO: 5949677 - DNA, 23 bp, Homo sapiens
tgaagtttcctatgactaattca

SEQ ID NO: 5949678 - DNA, 12 bp, Homo sapiens
tgaagtttgaat

SEQ ID NO: 5949679 - DNA, 18 bp, Homo sapiens
tgaagtttgaatgttaaa

SEQ ID NO: 5949680 - DNA, 20 bp, Homo sapiens
tgaagtttgaatgttaaata

SEQ ID NO: 5949681 - DNA, 16 bp, Homo sapiens
tgaagtttggagatag

SEQ ID NO: 5949682 - DNA, 18 bp, Homo sapiens
tgaagtttgtcaggcaca

SEQ ID NO: 5949683 - DNA, 17 bp, Homo sapiens
tgaagttttacattgtt

SEQ ID NO: 5949684 - DNA, 18 bp, Homo sapiens
tgaagttttatacactgg

SEQ ID NO: 5949685 - DNA, 18 bp, Homo sapiens
tgaagttttattttaaat

SEQ ID NO: 5949686 - DNA, 20 bp, Homo sapiens
tgaagttttggagagggaag

SEQ ID NO: 5949687 - DNA, 23 bp, Homo sapiens
tgaagtttttattttaaacattt

SEQ ID NO: 5949688 - DNA, 14 bp, Homo sapiens
tgaagtttttgaaa

SEQ ID NO: 5949689 - DNA, 15 bp, Homo sapiens
tgaagtttttgaaat

SEQ ID NO: 5949690 - DNA, 20 bp, Homo sapiens
tgaagtttttgaaatacctt

SEQ ID NO: 5949691 - DNA, 22 bp, Homo sapiens
tgaagtttttttgctgctgcct

SEQ ID NO: 5949692 - DNA, 21 bp, Homo sapiens
tgaataaaaaacatttgtaca

SEQ ID NO: 5949693 - DNA, 23 bp, Homo sapiens
tgaataaaaaacatttgtacatt

SEQ ID NO: 5949694 - DNA, 16 bp, Homo sapiens
tgaataaaaaagattc

SEQ ID NO: 5949695 - DNA, 20 bp, Homo sapiens
tgaataaaaactttgctaaa

SEQ ID NO: 5949696 - DNA, 21 bp, Homo sapiens
tgaataaaaactttgctaaat

SEQ ID NO: 5949697 - DNA, 13 bp, Homo sapiens
tgaataaaaagaa

SEQ ID NO: 5949698 - DNA, 15 bp, Homo sapiens
tgaataaaaagtgaa

SEQ ID NO: 5949699 - DNA, 19 bp, Homo sapiens
tgaataaaaagtgaacttt

SEQ ID NO: 5949700 - DNA, 15 bp, Homo sapiens
tgaataaaaatgcac

SEQ ID NO: 5949701 - DNA, 14 bp, Homo sapiens
tgaataaaaattaa

SEQ ID NO: 5949702 - DNA, 12 bp, Homo sapiens
tgaataaaacct

SEQ ID NO: 5949703 - DNA, 13 bp, Homo sapiens
tgaataaaagaat

SEQ ID NO: 5949704 - DNA, 15 bp, Homo sapiens
tgaataaaaggctgg

SEQ ID NO: 5949705 - DNA, 13 bp, Homo sapiens
tgaataaaatgtt

SEQ ID NO: 5949706 - DNA, 15 bp, Homo sapiens
tgaataaaatgttta

SEQ ID NO: 5949707 - DNA, 20 bp, Homo sapiens
tgaataaaattattttggat

SEQ ID NO: 5949708 - DNA, 16 bp, Homo sapiens
tgaataaaattgttat

SEQ ID NO: 5949709 - DNA, 21 bp, Homo sapiens
tgaataaaattgttatttcaa

SEQ ID NO: 5949710 - DNA, 14 bp, Homo sapiens
tgaataaaccaaga

SEQ ID NO: 5949711 - DNA, 13 bp, Homo sapiens
tgaataaactgaa

SEQ ID NO: 5949712 - DNA, 15 bp, Homo sapiens
tgaataaactgaata

SEQ ID NO: 5949713 - DNA, 16 bp, Homo sapiens
tgaataaactgaatat

SEQ ID NO: 5949714 - DNA, 13 bp, Homo sapiens
tgaataaacttca

SEQ ID NO: 5949715 - DNA, 15 bp, Homo sapiens
tgaataaacttcagc

SEQ ID NO: 5949716 - DNA, 11 bp, Homo sapiens
tgaataaagaa

SEQ ID NO: 5949717 - DNA, 15 bp, Homo sapiens
tgaataaagaatact

SEQ ID NO: 5949718 - DNA, 16 bp, Homo sapiens
tgaataaagaatactt

SEQ ID NO: 5949719 - DNA, 18 bp, Homo sapiens
tgaataaagaatacttga

SEQ ID NO: 5949720 - DNA, 23 bp, Homo sapiens
tgaataaagaatgccatttctca

SEQ ID NO: 5949721 - DNA, 16 bp, Homo sapiens
tgaataaagacaccta

SEQ ID NO: 5949722 - DNA, 17 bp, Homo sapiens
tgaataaagcacgtgca

SEQ ID NO: 5949723 - DNA, 20 bp, Homo sapiens
tgaataaagcctgcttttta

SEQ ID NO: 5949724 - DNA, 22 bp, Homo sapiens
tgaataaagcctttgtatcttt

SEQ ID NO: 5949725 - DNA, 21 bp, Homo sapiens
tgaataaagggaacatgcagc

SEQ ID NO: 5949726 - DNA, 13 bp, Homo sapiens
tgaataaagtctg

SEQ ID NO: 5949727 - DNA, 14 bp, Homo sapiens
tgaataaagtgcaa

SEQ ID NO: 5949728 - DNA, 17 bp, Homo sapiens
tgaataaagtgcaaaca

SEQ ID NO: 5949729 - DNA, 22 bp, Homo sapiens
tgaataaagttagtgtgttgtc

SEQ ID NO: 5949730 - DNA, 21 bp, Homo sapiens
tgaataaatacccattgaact

SEQ ID NO: 5949731 - DNA, 13 bp, Homo sapiens
tgaataaatacct

SEQ ID NO: 5949732 - DNA, 15 bp, Homo sapiens
tgaataaatacctct

SEQ ID NO: 5949733 - DNA, 17 bp, Homo sapiens
tgaataaatgtatctga

SEQ ID NO: 5949734 - DNA, 13 bp, Homo sapiens
tgaataaatgtca

SEQ ID NO: 5949735 - DNA, 15 bp, Homo sapiens
tgaataaatgtcact

SEQ ID NO: 5949736 - DNA, 20 bp, Homo sapiens
tgaataaatgtcactttttg

SEQ ID NO: 5949737 - DNA, 21 bp, Homo sapiens
tgaataaattctataggaaca

SEQ ID NO: 5949738 - DNA, 14 bp, Homo sapiens
tgaataacaacaat

SEQ ID NO: 5949739 - DNA, 23 bp, Homo sapiens
tgaataacagtagtcctttgata

SEQ ID NO: 5949740 - DNA, 21 bp, Homo sapiens
tgaataacctgaggattctat

SEQ ID NO: 5949741 - DNA, 16 bp, Homo sapiens
tgaataacctgcacag

SEQ ID NO: 5949742 - DNA, 22 bp, Homo sapiens
tgaataacctgcacaggcttgc

SEQ ID NO: 5949743 - DNA, 15 bp, Homo sapiens
tgaataacttgaaga

SEQ ID NO: 5949744 - DNA, 15 bp, Homo sapiens
tgaataagcactttt

SEQ ID NO: 5949745 - DNA, 22 bp, Homo sapiens
tgaataagccattctgactcat

SEQ ID NO: 5949746 - DNA, 14 bp, Homo sapiens
tgaataagtattct

SEQ ID NO: 5949747 - DNA, 13 bp, Homo sapiens
tgaataagttgat

SEQ ID NO: 5949748 - DNA, 13 bp, Homo sapiens
tgaataagtttta

SEQ ID NO: 5949749 - DNA, 17 bp, Homo sapiens
tgaataataaatacaca

SEQ ID NO: 5949750 - DNA, 20 bp, Homo sapiens
tgaataataagcaggatgtt

SEQ ID NO: 5949751 - DNA, 22 bp, Homo sapiens
tgaataatgaaaataaaacaca

SEQ ID NO: 5949752 - DNA, 15 bp, Homo sapiens
tgaataatgagttgt

SEQ ID NO: 5949753 - DNA, 17 bp, Homo sapiens
tgaataatgcctttgta

SEQ ID NO: 5949754 - DNA, 16 bp, Homo sapiens
tgaataatggaaaatg

SEQ ID NO: 5949755 - DNA, 19 bp, Homo sapiens
tgaataatggaaaatgcca

SEQ ID NO: 5949756 - DNA, 18 bp, Homo sapiens
tgaataatggtaccagat

SEQ ID NO: 5949757 - DNA, 23 bp, Homo sapiens
tgaataatgtctagattttgaaa

SEQ ID NO: 5949758 - DNA, 22 bp, Homo sapiens
tgaataatttcccaattaggaa

SEQ ID NO: 5949759 - DNA, 17 bp, Homo sapiens
tgaatacaaacatttca

SEQ ID NO: 5949760 - DNA, 15 bp, Homo sapiens
tgaatacaattaaag

SEQ ID NO: 5949761 - DNA, 18 bp, Homo sapiens
tgaatacaattaaaggtc

SEQ ID NO: 5949762 - DNA, 20 bp, Homo sapiens
tgaatacaattaaaggtcct

SEQ ID NO: 5949763 - DNA, 20 bp, Homo sapiens
tgaatttgcaaagtactgta

SEQ ID NO: 5949764 - DNA, 19 bp, Homo sapiens
tgaatttgcacggtttgtg

SEQ ID NO: 5949765 - DNA, 23 bp, Homo sapiens
tgaatttgcatgtctaattcatt

SEQ ID NO: 5949766 - DNA, 17 bp, Homo sapiens
tgaatttgccagaggac

SEQ ID NO: 5949767 - DNA, 15 bp, Homo sapiens
tgaatttgccctggg

SEQ ID NO: 5949768 - DNA, 11 bp, Homo sapiens
tgaatttggag

SEQ ID NO: 5949769 - DNA, 14 bp, Homo sapiens
tgaatttggagact

SEQ ID NO: 5949770 - DNA, 18 bp, Homo sapiens
tgaatttggggctactta

SEQ ID NO: 5949771 - DNA, 20 bp, Homo sapiens
tgaatttggggctacttata

SEQ ID NO: 5949772 - DNA, 21 bp, Homo sapiens
tgaatttgtaagcaacttgct

SEQ ID NO: 5949773 - DNA, 22 bp, Homo sapiens
tgaatttgtaagcaacttgctt

SEQ ID NO: 5949774 - DNA, 13 bp, Homo sapiens
tgaatttgtaatg

SEQ ID NO: 5949775 - DNA, 13 bp, Homo sapiens
tgaatttgtagtt

SEQ ID NO: 5949776 - DNA, 14 bp, Homo sapiens
tgaatttgtagttg

SEQ ID NO: 5949777 - DNA, 18 bp, Homo sapiens
tgaatttgtcgcaaagac

SEQ ID NO: 5949778 - DNA, 12 bp, Homo sapiens
tgaatttgttag

SEQ ID NO: 5949779 - DNA, 14 bp, Homo sapiens
tgaatttgtttaag

SEQ ID NO: 5949780 - DNA, 15 bp, Homo sapiens
tgaattttaaaatct

SEQ ID NO: 5949781 - DNA, 23 bp, Homo sapiens
tgaattttaaatctaaatctatt

SEQ ID NO: 5949782 - DNA, 17 bp, Homo sapiens
tgaattttaaatgttca

SEQ ID NO: 5949783 - DNA, 17 bp, Homo sapiens
tgaattttaagggtttc

SEQ ID NO: 5949784 - DNA, 16 bp, Homo sapiens
tgaattttacatggct

SEQ ID NO: 5949785 - DNA, 14 bp, Homo sapiens
tgaattttagcttt

SEQ ID NO: 5949786 - DNA, 15 bp, Homo sapiens
tgaattttagctttt

SEQ ID NO: 5949787 - DNA, 16 bp, Homo sapiens
tgaattttagcttttg

SEQ ID NO: 5949788 - DNA, 20 bp, Homo sapiens
tgaattttattgaaagctca

SEQ ID NO: 5949789 - DNA, 18 bp, Homo sapiens
tgaattttcaagcatctc

SEQ ID NO: 5949790 - DNA, 17 bp, Homo sapiens
tgaattttcaaggcctt

SEQ ID NO: 5949791 - DNA, 17 bp, Homo sapiens
tgaattttcacatgaac

SEQ ID NO: 5949792 - DNA, 19 bp, Homo sapiens
tgaattttcacatgaacat

SEQ ID NO: 5949793 - DNA, 15 bp, Homo sapiens
tgaattttcatttta

SEQ ID NO: 5949794 - DNA, 18 bp, Homo sapiens
tgaattttccaagaacat

SEQ ID NO: 5949795 - DNA, 15 bp, Homo sapiens
tgaattttccacgca

SEQ ID NO: 5949796 - DNA, 17 bp, Homo sapiens
tgaattttctaaaagct

SEQ ID NO: 5949797 - DNA, 22 bp, Homo sapiens
tgaattttctaaaagctttcat

SEQ ID NO: 5949798 - DNA, 16 bp, Homo sapiens
tgaattttctgcagct

SEQ ID NO: 5949799 - DNA, 23 bp, Homo sapiens
tgaattttctgcagctgtttcaa

SEQ ID NO: 5949800 - DNA, 19 bp, Homo sapiens
tgaattttctggaaaatgc

SEQ ID NO: 5949801 - DNA, 21 bp, Homo sapiens
tgaattttctggaaaatgctt

SEQ ID NO: 5949802 - DNA, 16 bp, Homo sapiens
tgaattttgcaatgta

SEQ ID NO: 5949803 - DNA, 18 bp, Homo sapiens
tgaattttgcaatgtatt

SEQ ID NO: 5949804 - DNA, 21 bp, Homo sapiens
tgaattttgtaagtataagaa

SEQ ID NO: 5949805 - DNA, 17 bp, Homo sapiens
tgaattttgtgttagag

SEQ ID NO: 5949806 - DNA, 19 bp, Homo sapiens
tgaattttgttctctggga

SEQ ID NO: 5949807 - DNA, 20 bp, Homo sapiens
tgaattttgttctctgggag

SEQ ID NO: 5949808 - DNA, 14 bp, Homo sapiens
tgaattttgttgct

SEQ ID NO: 5949809 - DNA, 21 bp, Homo sapiens
tgaattttgtttttattttca

SEQ ID NO: 5949810 - DNA, 19 bp, Homo sapiens
tgaatttttaaacaagtat

SEQ ID NO: 5949811 - DNA, 21 bp, Homo sapiens
tgaatttttaaacaagtattt

SEQ ID NO: 5949812 - DNA, 16 bp, Homo sapiens
tgaatttttaaagaca

SEQ ID NO: 5949813 - DNA, 13 bp, Homo sapiens
tgaatttttaagc

SEQ ID NO: 5949814 - DNA, 17 bp, Homo sapiens
tgaatttttatgatttc

SEQ ID NO: 5949815 - DNA, 18 bp, Homo sapiens
tgaatttttatgtgtgat

SEQ ID NO: 5949816 - DNA, 14 bp, Homo sapiens
tgaatttttattgt

SEQ ID NO: 5949817 - DNA, 17 bp, Homo sapiens
tgaatttttgcaataat

SEQ ID NO: 5949818 - DNA, 15 bp, Homo sapiens
tgaatttttgcctat

SEQ ID NO: 5949819 - DNA, 22 bp, Homo sapiens
tgaatttttgcctatctttaaa

SEQ ID NO: 5949820 - DNA, 18 bp, Homo sapiens
tgaattttttcctaccat

SEQ ID NO: 5949821 - DNA, 19 bp, Homo sapiens
tgaattttttgaaatgggc

SEQ ID NO: 5949822 - DNA, 21 bp, Homo sapiens
tgaatttttttcgctatggga

SEQ ID NO: 5949823 - DNA, 19 bp, Homo sapiens
tgaatttttttctgcacag

SEQ ID NO: 5949824 - DNA, 20 bp, Homo sapiens
tgaatttttttctgcacagc

SEQ ID NO: 5949825 - DNA, 21 bp, Homo sapiens
tgaatttttttctgcacagct

SEQ ID NO: 5949826 - DNA, 15 bp, Homo sapiens
tgaattttttttaac

SEQ ID NO: 5949827 - DNA, 16 bp, Homo sapiens
tgaattttttttaaca

SEQ ID NO: 5949828 - DNA, 18 bp, Homo sapiens
tgaattttttttaacatt

SEQ ID NO: 5949829 - DNA, 19 bp, Homo sapiens
tgaattttttttaacattc

SEQ ID NO: 5949830 - DNA, 21 bp, Homo sapiens
tgaattttttttaatgcttaa

SEQ ID NO: 5949831 - DNA, 23 bp, Homo sapiens
tgaattttttttttaaatgattc

SEQ ID NO: 5949832 - DNA, 21 bp, Homo sapiens
tgacaaaaaaaaaatagagag

SEQ ID NO: 5949833 - DNA, 22 bp, Homo sapiens
tgacaaaaaggtgcagaaggca

SEQ ID NO: 5949834 - DNA, 15 bp, Homo sapiens
tgacaaaaaggtgct

SEQ ID NO: 5949835 - DNA, 19 bp, Homo sapiens
tgacaaaaagtttccatat

SEQ ID NO: 5949836 - DNA, 16 bp, Homo sapiens
tgacaaaaatgtttgt

SEQ ID NO: 5949837 - DNA, 17 bp, Homo sapiens
tgacaaaaattattttt

SEQ ID NO: 5949838 - DNA, 14 bp, Homo sapiens
tgacaaaaattcaa

SEQ ID NO: 5949839 - DNA, 18 bp, Homo sapiens
tgacaaaaattcaactca

SEQ ID NO: 5949840 - DNA, 17 bp, Homo sapiens
tgacaaaactaaccttg

SEQ ID NO: 5949841 - DNA, 15 bp, Homo sapiens
tgacaaaagctcatg

SEQ ID NO: 5949842 - DNA, 15 bp, Homo sapiens
tgacaaaagtaaatg

SEQ ID NO: 5949843 - DNA, 14 bp, Homo sapiens
tgacaaaagtgaca

SEQ ID NO: 5949844 - DNA, 20 bp, Homo sapiens
tgacaaaagtgacagatgtt

SEQ ID NO: 5949845 - DNA, 17 bp, Homo sapiens
tgacaaaataacatttg

SEQ ID NO: 5949846 - DNA, 20 bp, Homo sapiens
tgacaaaatatataatggtt

SEQ ID NO: 5949847 - DNA, 18 bp, Homo sapiens
tgacaaaatgggaggagg

SEQ ID NO: 5949848 - DNA, 19 bp, Homo sapiens
tgacaaaatgggaggagga

SEQ ID NO: 5949849 - DNA, 23 bp, Homo sapiens
tgacaaaatgggaggaggaaaga

SEQ ID NO: 5949850 - DNA, 20 bp, Homo sapiens
tgacaaaatgttatttccct

SEQ ID NO: 5949851 - DNA, 16 bp, Homo sapiens
tgacaaaattcatttg

SEQ ID NO: 5949852 - DNA, 13 bp, Homo sapiens
tgacaaacagcta

SEQ ID NO: 5949853 - DNA, 19 bp, Homo sapiens
tgacaaacgtccccagcgg

SEQ ID NO: 5949854 - DNA, 19 bp, Homo sapiens
tgacaaactggcaggtacc

SEQ ID NO: 5949855 - DNA, 13 bp, Homo sapiens
tgacaaagaaaat

SEQ ID NO: 5949856 - DNA, 14 bp, Homo sapiens
tgacaaagaaaatg

SEQ ID NO: 5949857 - DNA, 15 bp, Homo sapiens
tgacaaagaaaccca

SEQ ID NO: 5949858 - DNA, 20 bp, Homo sapiens
tgacaaagaagaccacaaat

SEQ ID NO: 5949859 - DNA, 19 bp, Homo sapiens
tgacaaagactgagtacgt

SEQ ID NO: 5949860 - DNA, 21 bp, Homo sapiens
tgacaaagagtagacatttct

SEQ ID NO: 5949861 - DNA, 22 bp, Homo sapiens
tgacaaagcagattcagaaatg

SEQ ID NO: 5949862 - DNA, 12 bp, Homo sapiens
tgacaaagccat

SEQ ID NO: 5949863 - DNA, 18 bp, Homo sapiens
tgacaaaggaaacacata

SEQ ID NO: 5949864 - DNA, 16 bp, Homo sapiens
tgacaaaggagccttg

SEQ ID NO: 5949865 - DNA, 17 bp, Homo sapiens
tgacaaaggagccttga

SEQ ID NO: 5949866 - DNA, 15 bp, Homo sapiens
tgacaaaggatgaag

SEQ ID NO: 5949867 - DNA, 20 bp, Homo sapiens
tgacaaaggtggtaaattca

SEQ ID NO: 5949868 - DNA, 20 bp, Homo sapiens
tgacaaagtgccgtgataat

SEQ ID NO: 5949869 - DNA, 22 bp, Homo sapiens
tgacaaagtgggtactttctga

SEQ ID NO: 5949870 - DNA, 16 bp, Homo sapiens
tgacaaagtgttgaaa

SEQ ID NO: 5949871 - DNA, 16 bp, Homo sapiens
tgacaaagttacaaat

SEQ ID NO: 5949872 - DNA, 16 bp, Homo sapiens
tgacaaataagattaa

SEQ ID NO: 5949873 - DNA, 20 bp, Homo sapiens
tgacaaatcaagtttccaag

SEQ ID NO: 5949874 - DNA, 15 bp, Homo sapiens
tgacaaatctgtgta

SEQ ID NO: 5949875 - DNA, 16 bp, Homo sapiens
tgacaaatgaaagaga

SEQ ID NO: 5949876 - DNA, 16 bp, Homo sapiens
tgacaaatgtgtatgt

SEQ ID NO: 5949877 - DNA, 23 bp, Homo sapiens
tgacaaatgtgtatgtgtggttt

SEQ ID NO: 5949878 - DNA, 17 bp, Homo sapiens
tgacaaatgtttctaag

SEQ ID NO: 5949879 - DNA, 21 bp, Homo sapiens
tgacaaatgtttctaaggtaa

SEQ ID NO: 5949880 - DNA, 16 bp, Homo sapiens
tgacaaattgtaacta

SEQ ID NO: 5949881 - DNA, 18 bp, Homo sapiens
tgacaaattgtaactaca

SEQ ID NO: 5949882 - DNA, 17 bp, Homo sapiens
tgacaaattttaattat

SEQ ID NO: 5949883 - DNA, 12 bp, Homo sapiens
tgacaacacagc

SEQ ID NO: 5949884 - DNA, 12 bp, Homo sapiens
tgacaacacatg

SEQ ID NO: 5949885 - DNA, 16 bp, Homo sapiens
tgacaacactacacgc

SEQ ID NO: 5949886 - DNA, 19 bp, Homo sapiens
tgacaacacttaatagcaa

SEQ ID NO: 5949887 - DNA, 20 bp, Homo sapiens
tgacaacacttaatagcaac

SEQ ID NO: 5949888 - DNA, 19 bp, Homo sapiens
tgacaacagaaaaacaatc

SEQ ID NO: 5949889 - DNA, 22 bp, Homo sapiens
tgacaacagaagcttcagaagt

SEQ ID NO: 5949890 - DNA, 13 bp, Homo sapiens
tgacaacagactg

SEQ ID NO: 5949891 - DNA, 16 bp, Homo sapiens
tgacaacagactgaat

SEQ ID NO: 5949892 - DNA, 14 bp, Homo sapiens
tgacaacagcctga

SEQ ID NO: 5949893 - DNA, 16 bp, Homo sapiens
tgacaacagcctgaga

SEQ ID NO: 5949894 - DNA, 17 bp, Homo sapiens
tgacaacagcctgagaa

SEQ ID NO: 5949895 - DNA, 18 bp, Homo sapiens
tgacaacagcctgagaaa

SEQ ID NO: 5949896 - DNA, 18 bp, Homo sapiens
tgacaacatcccacagtg

SEQ ID NO: 5949897 - DNA, 19 bp, Homo sapiens
tgacaacatgaaacctatt

SEQ ID NO: 5949898 - DNA, 16 bp, Homo sapiens
tgacaacatggcttct

SEQ ID NO: 5949899 - DNA, 16 bp, Homo sapiens
tgacaacatttctata

SEQ ID NO: 5949900 - DNA, 19 bp, Homo sapiens
tgacaacatttttgtacat

SEQ ID NO: 5949901 - DNA, 19 bp, Homo sapiens
tgacaaccattaaagtcag

SEQ ID NO: 5949902 - DNA, 17 bp, Homo sapiens
tgacaacctagaatgtc

SEQ ID NO: 5949903 - DNA, 20 bp, Homo sapiens
tgacaacctccattctattt

SEQ ID NO: 5949904 - DNA, 21 bp, Homo sapiens
tgacaacctccattctatttt

SEQ ID NO: 5949905 - DNA, 14 bp, Homo sapiens
tgacaacctttgtg

SEQ ID NO: 5949906 - DNA, 15 bp, Homo sapiens
tgacaacctttgtgt

SEQ ID NO: 5949907 - DNA, 22 bp, Homo sapiens
tgacaacctttgtgtaataaaa

SEQ ID NO: 5949908 - DNA, 15 bp, Homo sapiens
tgacaacgaaagtaa

SEQ ID NO: 5949909 - DNA, 15 bp, Homo sapiens
tgacaacgtctcttc

SEQ ID NO: 5949910 - DNA, 22 bp, Homo sapiens
tgacaactacagaaaaaccaga

SEQ ID NO: 5949911 - DNA, 17 bp, Homo sapiens
tgacaactgaaagaaaa

SEQ ID NO: 5949912 - DNA, 18 bp, Homo sapiens
tgacaactgaaagaaaaa

SEQ ID NO: 5949913 - DNA, 20 bp, Homo sapiens
tgacaactgcacatgaaagt

SEQ ID NO: 5949914 - DNA, 17 bp, Homo sapiens
tgacaactggcaggcag

SEQ ID NO: 5949915 - DNA, 13 bp, Homo sapiens
tgacaactgtgac

SEQ ID NO: 5949916 - DNA, 14 bp, Homo sapiens
tgacaactgtgact

SEQ ID NO: 5949917 - DNA, 15 bp, Homo sapiens
tgacaactgtgactg

SEQ ID NO: 5949918 - DNA, 16 bp, Homo sapiens
tgacaactgtgactgt

SEQ ID NO: 5949919 - DNA, 19 bp, Homo sapiens
tgacaactgtttaattgaa

SEQ ID NO: 5949920 - DNA, 16 bp, Homo sapiens
tgacaacttagctcag

SEQ ID NO: 5949921 - DNA, 22 bp, Homo sapiens
tgacaacttcccagtgaattct

SEQ ID NO: 5949922 - DNA, 14 bp, Homo sapiens
tgacaacttctaat

SEQ ID NO: 5949923 - DNA, 15 bp, Homo sapiens
tgacaacttctaatt

SEQ ID NO: 5949924 - DNA, 19 bp, Homo sapiens
tgacaacttctaattgcca

SEQ ID NO: 5949925 - DNA, 19 bp, Homo sapiens
tgacaactttgccagcttt

SEQ ID NO: 5949926 - DNA, 22 bp, Homo sapiens
tgacaagagcctgatctcttcc

SEQ ID NO: 5949927 - DNA, 15 bp, Homo sapiens
tgacaagataaagga

SEQ ID NO: 5949928 - DNA, 16 bp, Homo sapiens
tgacaagataaaggaa

SEQ ID NO: 5949929 - DNA, 16 bp, Homo sapiens
tgacaagatggtccat

SEQ ID NO: 5949930 - DNA, 19 bp, Homo sapiens
tgacaagatggtccatttg

SEQ ID NO: 5949931 - DNA, 23 bp, Homo sapiens
tgacaagatggtccatttgttcc

SEQ ID NO: 5949932 - DNA, 20 bp, Homo sapiens
tgacaagcagatactgctgt

SEQ ID NO: 5949933 - DNA, 12 bp, Homo sapiens
tgacaagcatca

SEQ ID NO: 5949934 - DNA, 16 bp, Homo sapiens
tgacaagcctttgtgc

SEQ ID NO: 5949935 - DNA, 19 bp, Homo sapiens
tgacaagctaggaaagagg

SEQ ID NO: 5949936 - DNA, 20 bp, Homo sapiens
tgacaagctaggacacctgt

SEQ ID NO: 5949937 - DNA, 20 bp, Homo sapiens
tgacaagctcacagaccttt

SEQ ID NO: 5949938 - DNA, 15 bp, Homo sapiens
tgacaagctgacttg

SEQ ID NO: 5949939 - DNA, 19 bp, Homo sapiens
tgacaagctggccaaagtc

SEQ ID NO: 5949940 - DNA, 13 bp, Homo sapiens
tgacatagccttt

SEQ ID NO: 5949941 - DNA, 19 bp, Homo sapiens
tgacataggccaaggccca

SEQ ID NO: 5949942 - DNA, 19 bp, Homo sapiens
tgacataggtcataaagca

SEQ ID NO: 5949943 - DNA, 17 bp, Homo sapiens
tgacatagtctggctgt

SEQ ID NO: 5949944 - DNA, 18 bp, Homo sapiens
tgacatagtggatggaca

SEQ ID NO: 5949945 - DNA, 21 bp, Homo sapiens
tgacatagtggatggacagat

SEQ ID NO: 5949946 - DNA, 18 bp, Homo sapiens
tgacatatacatacttac

SEQ ID NO: 5949947 - DNA, 15 bp, Homo sapiens
tgacatatctacact

SEQ ID NO: 5949948 - DNA, 12 bp, Homo sapiens
tgacatattatg

SEQ ID NO: 5949949 - DNA, 17 bp, Homo sapiens
tgacatattatgcctga

SEQ ID NO: 5949950 - DNA, 20 bp, Homo sapiens
tgacatattatgcctgaatg

SEQ ID NO: 5949951 - DNA, 13 bp, Homo sapiens
tgacatattcaag

SEQ ID NO: 5949952 - DNA, 13 bp, Homo sapiens
tgacatatttaat

SEQ ID NO: 5949953 - DNA, 14 bp, Homo sapiens
tgacatatttaatg

SEQ ID NO: 5949954 - DNA, 17 bp, Homo sapiens
tgacatatttaatgttt

SEQ ID NO: 5949955 - DNA, 21 bp, Homo sapiens
tgacatatttaatgttttaaa

SEQ ID NO: 5949956 - DNA, 22 bp, Homo sapiens
tgacatatttaatgttttaaat

SEQ ID NO: 5949957 - DNA, 23 bp, Homo sapiens
tgacatatttaatgttttaaatg

SEQ ID NO: 5949958 - DNA, 17 bp, Homo sapiens
tgacatcaaagcctggc

SEQ ID NO: 5949959 - DNA, 18 bp, Homo sapiens
tgacatcaagggaggaag

SEQ ID NO: 5949960 - DNA, 15 bp, Homo sapiens
tgacatcaagtgtaa

SEQ ID NO: 5949961 - DNA, 18 bp, Homo sapiens
tgacatcaagtgtaatta

SEQ ID NO: 5949962 - DNA, 22 bp, Homo sapiens
tgacatcaagtgtaattagctt

SEQ ID NO: 5949963 - DNA, 20 bp, Homo sapiens
tgacatcaccaagtgtggaa

SEQ ID NO: 5949964 - DNA, 21 bp, Homo sapiens
tgacatcaccaagtgtggaat

SEQ ID NO: 5949965 - DNA, 17 bp, Homo sapiens
tgacatcaccacagttt

SEQ ID NO: 5949966 - DNA, 16 bp, Homo sapiens
tgacatcacttgtaca

SEQ ID NO: 5949967 - DNA, 18 bp, Homo sapiens
tgacatcacttgtacaaa

SEQ ID NO: 5949968 - DNA, 19 bp, Homo sapiens
tgacatcacttgtacaaaa

SEQ ID NO: 5949969 - DNA, 21 bp, Homo sapiens
tgacatcacttgtacaaaata

SEQ ID NO: 5949970 - DNA, 23 bp, Homo sapiens
tgacatcacttgtacaaaataaa

SEQ ID NO: 5949971 - DNA, 22 bp, Homo sapiens
tgacatcagaagtaactcccac

SEQ ID NO: 5949972 - DNA, 17 bp, Homo sapiens
tgacatcagattgttaa

SEQ ID NO: 5949973 - DNA, 17 bp, Homo sapiens
tgacatcagatttctta

SEQ ID NO: 5949974 - DNA, 19 bp, Homo sapiens
tgacatcagcactgccaac

SEQ ID NO: 5949975 - DNA, 14 bp, Homo sapiens
tgacatcagcatca

SEQ ID NO: 5949976 - DNA, 22 bp, Homo sapiens
tgacatcaggtgatccacctgc

SEQ ID NO: 5949977 - DNA, 18 bp, Homo sapiens
tgacatcaggtttttccc

SEQ ID NO: 5949978 - DNA, 17 bp, Homo sapiens
tgacatcagtggcatgg

SEQ ID NO: 5949979 - DNA, 23 bp, Homo sapiens
tgacatcagttcctttgtgtgta

SEQ ID NO: 5949980 - DNA, 15 bp, Homo sapiens
tgacatccaaatcta

SEQ ID NO: 5949981 - DNA, 13 bp, Homo sapiens
tgacatccaagct

SEQ ID NO: 5949982 - DNA, 15 bp, Homo sapiens
tgacatccacatgca

SEQ ID NO: 5949983 - DNA, 21 bp, Homo sapiens
tgacatccacatgcacatgta

SEQ ID NO: 5949984 - DNA, 17 bp, Homo sapiens
tgacatccacatgctct

SEQ ID NO: 5949985 - DNA, 17 bp, Homo sapiens
tgacatccagaaagctg

SEQ ID NO: 5949986 - DNA, 18 bp, Homo sapiens
tgacatccagagatgact

SEQ ID NO: 5949987 - DNA, 23 bp, Homo sapiens
tgacatccaggatggctgcaagc

SEQ ID NO: 5949988 - DNA, 15 bp, Homo sapiens
tgacatcccttcctg

SEQ ID NO: 5949989 - DNA, 19 bp, Homo sapiens
tgacatcccttcctggaaa

SEQ ID NO: 5949990 - DNA, 23 bp, Homo sapiens
tgacatcccttcctggaaacagc

SEQ ID NO: 5949991 - DNA, 21 bp, Homo sapiens
tgacatcctttcttttaatga

SEQ ID NO: 5949992 - DNA, 23 bp, Homo sapiens
tgacatctacgaagccacaggcc

SEQ ID NO: 5949993 - DNA, 14 bp, Homo sapiens
tgacatctcagggg

SEQ ID NO: 5949994 - DNA, 15 bp, Homo sapiens
tgacatctcaggggc

SEQ ID NO: 5949995 - DNA, 19 bp, Homo sapiens
tgacatctcaggggccaga

SEQ ID NO: 5949996 - DNA, 21 bp, Homo sapiens
tgacatctcaggggccagagg

SEQ ID NO: 5949997 - DNA, 22 bp, Homo sapiens
tgacatctcaggggccagagga

SEQ ID NO: 5949998 - DNA, 12 bp, Homo sapiens
tgacatctcctc

SEQ ID NO: 5949999 - DNA, 19 bp, Homo sapiens
tgacatctcctctatcaca

SEQ ID NO: 5950000 - DNA, 22 bp, Homo sapiens
tgacatctctattccccaccct

SEQ ID NO: 5950001 - DNA, 13 bp, Homo sapiens
tgacatctctgca

SEQ ID NO: 5950002 - DNA, 14 bp, Homo sapiens
tgacatctctgcaa

SEQ ID NO: 5950003 - DNA, 23 bp, Homo sapiens
tgacatctctgcaatcttctcag

SEQ ID NO: 5950004 - DNA, 12 bp, Homo sapiens
tgacatctcttt

SEQ ID NO: 5950005 - DNA, 14 bp, Homo sapiens
tgacatctctttga

SEQ ID NO: 5950006 - DNA, 18 bp, Homo sapiens
tgacatctgattggcaga

SEQ ID NO: 5950007 - DNA, 17 bp, Homo sapiens
tgacatcttagtatttg

SEQ ID NO: 5950008 - DNA, 12 bp, Homo sapiens
tgacatcttatt

SEQ ID NO: 5950009 - DNA, 16 bp, Homo sapiens
tgacatcttcaaagct

SEQ ID NO: 5950010 - DNA, 17 bp, Homo sapiens
tgacatctttttaaagc

SEQ ID NO: 5950011 - DNA, 12 bp, Homo sapiens
tgacatgaaaaa

SEQ ID NO: 5950012 - DNA, 21 bp, Homo sapiens
tgacatgaaaattacaacaga

SEQ ID NO: 5950013 - DNA, 13 bp, Homo sapiens
tgacatgaagcat

SEQ ID NO: 5950014 - DNA, 15 bp, Homo sapiens
tgacatgaagctgtt

SEQ ID NO: 5950015 - DNA, 21 bp, Homo sapiens
tgacatgaattttagcttttg

SEQ ID NO: 5950016 - DNA, 19 bp, Homo sapiens
tgacatgaccctctgtccc

SEQ ID NO: 5950017 - DNA, 19 bp, Homo sapiens
tgacatgacgtggtaaaat

SEQ ID NO: 5950018 - DNA, 23 bp, Homo sapiens
tgacatgacgtggtaaaatgtga

SEQ ID NO: 5950019 - DNA, 16 bp, Homo sapiens
tgacatgagtctccag

SEQ ID NO: 5950020 - DNA, 16 bp, Homo sapiens
tgacatgatatacaat

SEQ ID NO: 5950021 - DNA, 14 bp, Homo sapiens
tgacatgatcgctt

SEQ ID NO: 5950022 - DNA, 15 bp, Homo sapiens
tgacatgattccttc

SEQ ID NO: 5950023 - DNA, 22 bp, Homo sapiens
tgacatgattccttcctgttct

SEQ ID NO: 5950024 - DNA, 18 bp, Homo sapiens
tgacatgcacagtttgca

SEQ ID NO: 5950025 - DNA, 19 bp, Homo sapiens
tgacatgcactgacccttc

SEQ ID NO: 5950026 - DNA, 21 bp, Homo sapiens
tgacatgcactgacccttcca

SEQ ID NO: 5950027 - DNA, 12 bp, Homo sapiens
tgacatgcattg

SEQ ID NO: 5950028 - DNA, 16 bp, Homo sapiens
tgacatgccaccctct

SEQ ID NO: 5950029 - DNA, 20 bp, Homo sapiens
tgacatgccaccctctccat

SEQ ID NO: 5950030 - DNA, 19 bp, Homo sapiens
tgacatgccatccattctg

SEQ ID NO: 5950031 - DNA, 20 bp, Homo sapiens
tgacatgccatccattctgc

SEQ ID NO: 5950032 - DNA, 17 bp, Homo sapiens
tgacatgcctatatgag

SEQ ID NO: 5950033 - DNA, 18 bp, Homo sapiens
tgacatgcgggctgggca

SEQ ID NO: 5950034 - DNA, 21 bp, Homo sapiens
tgacatgcgggctgggcagct

SEQ ID NO: 5950035 - DNA, 12 bp, Homo sapiens
tgacatggaccc

SEQ ID NO: 5950036 - DNA, 20 bp, Homo sapiens
tgacatggacccactaccct

SEQ ID NO: 5950037 - DNA, 15 bp, Homo sapiens
tgacatggggaaggc

SEQ ID NO: 5950038 - DNA, 14 bp, Homo sapiens
tgacatgggtgggg

SEQ ID NO: 5950039 - DNA, 21 bp, Homo sapiens
tgacatggtgcctgagaggca

SEQ ID NO: 5950040 - DNA, 14 bp, Homo sapiens
tgacatggtgctgt

SEQ ID NO: 5950041 - DNA, 15 bp, Homo sapiens
tgacatggtgctgtg

SEQ ID NO: 5950042 - DNA, 16 bp, Homo sapiens
tgacatgtaagaaaat

SEQ ID NO: 5950043 - DNA, 20 bp, Homo sapiens
tgacatgtaatgaatggtca

SEQ ID NO: 5950044 - DNA, 13 bp, Homo sapiens
tgacatgtacaga

SEQ ID NO: 5950045 - DNA, 15 bp, Homo sapiens
tgacatgtacagaga

SEQ ID NO: 5950046 - DNA, 22 bp, Homo sapiens
tgacatgtaccccctttccctt

SEQ ID NO: 5950047 - DNA, 13 bp, Homo sapiens
tgacatgtagctt

SEQ ID NO: 5950048 - DNA, 18 bp, Homo sapiens
tgacatgtattttttcct

SEQ ID NO: 5950049 - DNA, 16 bp, Homo sapiens
tgacatgtccctacac

SEQ ID NO: 5950050 - DNA, 14 bp, Homo sapiens
tgacatgtccttct

SEQ ID NO: 5950051 - DNA, 16 bp, Homo sapiens
tgacatgtctactttt

SEQ ID NO: 5950052 - DNA, 13 bp, Homo sapiens
tgacatgtctttt

SEQ ID NO: 5950053 - DNA, 17 bp, Homo sapiens
tgacatgtgaaaccttt

SEQ ID NO: 5950054 - DNA, 19 bp, Homo sapiens
tgacatgtgaaaccttttt

SEQ ID NO: 5950055 - DNA, 16 bp, Homo sapiens
tgacatgtgactccta

SEQ ID NO: 5950056 - DNA, 16 bp, Homo sapiens
tgacatgtgcagtgct

SEQ ID NO: 5950057 - DNA, 14 bp, Homo sapiens
tgacatgtggaaag

SEQ ID NO: 5950058 - DNA, 15 bp, Homo sapiens
tgacatgtgtcaagc

SEQ ID NO: 5950059 - DNA, 14 bp, Homo sapiens
tgacattaacaaat

SEQ ID NO: 5950060 - DNA, 17 bp, Homo sapiens
tgacattaacagttttc

SEQ ID NO: 5950061 - DNA, 19 bp, Homo sapiens
tgacattaacagttttcca

SEQ ID NO: 5950062 - DNA, 15 bp, Homo sapiens
tgacattaagaatgt

SEQ ID NO: 5950063 - DNA, 21 bp, Homo sapiens
tgacattaagacacacctctg

SEQ ID NO: 5950064 - DNA, 20 bp, Homo sapiens
tgacattatgtggttttaga

SEQ ID NO: 5950065 - DNA, 19 bp, Homo sapiens
tgacattatgttttattta

SEQ ID NO: 5950066 - DNA, 15 bp, Homo sapiens
tgacattattaaagt

SEQ ID NO: 5950067 - DNA, 18 bp, Homo sapiens
tgacattcagaaaacttc

SEQ ID NO: 5950068 - DNA, 15 bp, Homo sapiens
tgacattcatgcctg

SEQ ID NO: 5950069 - DNA, 17 bp, Homo sapiens
tgacattcatgcctggc

SEQ ID NO: 5950070 - DNA, 10 bp, Homo sapiens
tgacattcct

SEQ ID NO: 5950071 - DNA, 18 bp, Homo sapiens
tgacattccttgtcacca

SEQ ID NO: 5950072 - DNA, 20 bp, Homo sapiens
tgacattccttgtcaccagc

SEQ ID NO: 5950073 - DNA, 20 bp, Homo sapiens
tgacattctacagttgtgat

SEQ ID NO: 5950074 - DNA, 22 bp, Homo sapiens
tgacattctctattgtaatttt

SEQ ID NO: 5950075 - DNA, 23 bp, Homo sapiens
tgacattctctattgtaattttg

SEQ ID NO: 5950076 - DNA, 20 bp, Homo sapiens
tgacattctgaatgcttcta

SEQ ID NO: 5950077 - DNA, 20 bp, Homo sapiens
tgacattgaaatctaggaaa

SEQ ID NO: 5950078 - DNA, 14 bp, Homo sapiens
tgacattgactatt

SEQ ID NO: 5950079 - DNA, 15 bp, Homo sapiens
tgacattgatgtgtt

SEQ ID NO: 5950080 - DNA, 17 bp, Homo sapiens
tgacattgatgtgttcg

SEQ ID NO: 5950081 - DNA, 21 bp, Homo sapiens
tgacattgatgtgttcggttt

SEQ ID NO: 5950082 - DNA, 16 bp, Homo sapiens
tgacattgcctcaggc

SEQ ID NO: 5950083 - DNA, 18 bp, Homo sapiens
tgacattgtaagaggtgg

SEQ ID NO: 5950084 - DNA, 13 bp, Homo sapiens
tgacattgtcaga

SEQ ID NO: 5950085 - DNA, 16 bp, Homo sapiens
tgacattgtcagaatg

SEQ ID NO: 5950086 - DNA, 22 bp, Homo sapiens
tgacattgtcagaatgttgtgt

SEQ ID NO: 5950087 - DNA, 11 bp, Homo sapiens
tgacattgtct

SEQ ID NO: 5950088 - DNA, 12 bp, Homo sapiens
tgacatttaaat

SEQ ID NO: 5950089 - DNA, 19 bp, Homo sapiens
tgacatttacaggagggcc

SEQ ID NO: 5950090 - DNA, 15 bp, Homo sapiens
tgacatttagaactt

SEQ ID NO: 5950091 - DNA, 19 bp, Homo sapiens
tgacatttagtccctcaag

SEQ ID NO: 5950092 - DNA, 15 bp, Homo sapiens
tgacatttatatatt

SEQ ID NO: 5950093 - DNA, 16 bp, Homo sapiens
tgacatttatatattg

SEQ ID NO: 5950094 - DNA, 19 bp, Homo sapiens
tgacatttatatattgaat

SEQ ID NO: 5950095 - DNA, 18 bp, Homo sapiens
tgacatttatatttgtgt

SEQ ID NO: 5950096 - DNA, 14 bp, Homo sapiens
tgacatttatgtct

SEQ ID NO: 5950097 - DNA, 22 bp, Homo sapiens
tgacatttatgtctcatgtaat

SEQ ID NO: 5950098 - DNA, 23 bp, Homo sapiens
tgacatttatgtctcatgtaatt

SEQ ID NO: 5950099 - DNA, 21 bp, Homo sapiens
tgacatttatttttcatttag

SEQ ID NO: 5950100 - DNA, 11 bp, Homo sapiens
tgacatttcat

SEQ ID NO: 5950101 - DNA, 13 bp, Homo sapiens
tgacatttcatct

SEQ ID NO: 5950102 - DNA, 15 bp, Homo sapiens
tgacatttcatctgg

SEQ ID NO: 5950103 - DNA, 16 bp, Homo sapiens
tgacatttcccaagtc

SEQ ID NO: 5950104 - DNA, 22 bp, Homo sapiens
tgacatttcccaagtcagacag

SEQ ID NO: 5950105 - DNA, 14 bp, Homo sapiens
tgacatttctcaaa

SEQ ID NO: 5950106 - DNA, 14 bp, Homo sapiens
tgacatttcttaaa

SEQ ID NO: 5950107 - DNA, 15 bp, Homo sapiens
tgacatttcttaaaa

SEQ ID NO: 5950108 - DNA, 13 bp, Homo sapiens
tgacatttctttg

SEQ ID NO: 5950109 - DNA, 14 bp, Homo sapiens
tgacatttctttgt

SEQ ID NO: 5950110 - DNA, 18 bp, Homo sapiens
tgacatttgacagtgtgg

SEQ ID NO: 5950111 - DNA, 15 bp, Homo sapiens
tgacatttggagagg

SEQ ID NO: 5950112 - DNA, 24 bp, Homo sapiens
tgacatttgggagacatgtgacat

SEQ ID NO: 5950113 - DNA, 16 bp, Homo sapiens
tgacatttgtcatttt

SEQ ID NO: 5950114 - DNA, 17 bp, Homo sapiens
tgacatttgtcctgcag

SEQ ID NO: 5950115 - DNA, 20 bp, Homo sapiens
tgacatttgtcctgcagagc

SEQ ID NO: 5950116 - DNA, 16 bp, Homo sapiens
tgacatttgtttattt

SEQ ID NO: 5950117 - DNA, 14 bp, Homo sapiens
tgacattttacatt

SEQ ID NO: 5950118 - DNA, 12 bp, Homo sapiens
tgacgcatcctg

SEQ ID NO: 5950119 - DNA, 20 bp, Homo sapiens
tgacgcatgtaaagatgctg

SEQ ID NO: 5950120 - DNA, 17 bp, Homo sapiens
tgacgccatcccagccc

SEQ ID NO: 5950121 - DNA, 19 bp, Homo sapiens
tgacgccatcccagcccca

SEQ ID NO: 5950122 - DNA, 18 bp, Homo sapiens
tgacgcccaccttcgggc

SEQ ID NO: 5950123 - DNA, 12 bp, Homo sapiens
tgacgcccagct

SEQ ID NO: 5950124 - DNA, 14 bp, Homo sapiens
tgacgcccagctcc

SEQ ID NO: 5950125 - DNA, 21 bp, Homo sapiens
tgacgcccgagagcctcgctt

SEQ ID NO: 5950126 - DNA, 22 bp, Homo sapiens
tgacgcccgagagcctcgcttt

SEQ ID NO: 5950127 - DNA, 21 bp, Homo sapiens
tgacgccctgcgttggagcca

SEQ ID NO: 5950128 - DNA, 17 bp, Homo sapiens
tgacgcctactggggca

SEQ ID NO: 5950129 - DNA, 12 bp, Homo sapiens
tgacgcctctgg

SEQ ID NO: 5950130 - DNA, 17 bp, Homo sapiens
tgacgcctgagacagca

SEQ ID NO: 5950131 - DNA, 23 bp, Homo sapiens
tgacgcctgatggtgctgctcag

SEQ ID NO: 5950132 - DNA, 19 bp, Homo sapiens
tgacgcctgccctccccag

SEQ ID NO: 5950133 - DNA, 19 bp, Homo sapiens
tgacgctcagccccaggcc

SEQ ID NO: 5950134 - DNA, 15 bp, Homo sapiens
tgacgctgaataaat

SEQ ID NO: 5950135 - DNA, 21 bp, Homo sapiens
tgacgctgatacataactaaa

SEQ ID NO: 5950136 - DNA, 21 bp, Homo sapiens
tgacgcttgtgacagtgcctc

SEQ ID NO: 5950137 - DNA, 17 bp, Homo sapiens
tgacggacatccaggcg

SEQ ID NO: 5950138 - DNA, 22 bp, Homo sapiens
tgacggccaggctccctgacca

SEQ ID NO: 5950139 - DNA, 19 bp, Homo sapiens
tgacggccagggagaagct

SEQ ID NO: 5950140 - DNA, 14 bp, Homo sapiens
tgacggcctgcctg

SEQ ID NO: 5950141 - DNA, 15 bp, Homo sapiens
tgacggccttcttgg

SEQ ID NO: 5950142 - DNA, 18 bp, Homo sapiens
tgacggcgcccccagtgt

SEQ ID NO: 5950143 - DNA, 19 bp, Homo sapiens
tgacggcgcccccagtgtg

SEQ ID NO: 5950144 - DNA, 15 bp, Homo sapiens
tgacgggaggcccca

SEQ ID NO: 5950145 - DNA, 15 bp, Homo sapiens
tgacgggatgctctt

SEQ ID NO: 5950146 - DNA, 14 bp, Homo sapiens
tgacgggccaggcc

SEQ ID NO: 5950147 - DNA, 15 bp, Homo sapiens
tgacgggccaggccc

SEQ ID NO: 5950148 - DNA, 16 bp, Homo sapiens
tgacgggccaggccct

SEQ ID NO: 5950149 - DNA, 20 bp, Homo sapiens
tgacgggccgcaggagggag

SEQ ID NO: 5950150 - DNA, 22 bp, Homo sapiens
tgacgggccgcaggagggaggc

SEQ ID NO: 5950151 - DNA, 17 bp, Homo sapiens
tgacggggcctccttct

SEQ ID NO: 5950152 - DNA, 21 bp, Homo sapiens
tgacggtcctttaggcagcct

SEQ ID NO: 5950153 - DNA, 20 bp, Homo sapiens
tgacggtgttaattttgcta

SEQ ID NO: 5950154 - DNA, 22 bp, Homo sapiens
tgacggtgttaattttgctaac

SEQ ID NO: 5950155 - DNA, 20 bp, Homo sapiens
tgacggttcctacacaggac

SEQ ID NO: 5950156 - DNA, 15 bp, Homo sapiens
tgacggtttctcccc

SEQ ID NO: 5950157 - DNA, 19 bp, Homo sapiens
tgacgtacaagtagttctg

SEQ ID NO: 5950158 - DNA, 22 bp, Homo sapiens
tgacgtacaagtagttctgtat

SEQ ID NO: 5950159 - DNA, 13 bp, Homo sapiens
tgacgtattatct

SEQ ID NO: 5950160 - DNA, 23 bp, Homo sapiens
tgacgtcactttttggccatgta

SEQ ID NO: 5950161 - DNA, 17 bp, Homo sapiens
tgacgtcttaggtggca

SEQ ID NO: 5950162 - DNA, 13 bp, Homo sapiens
tgacgtgactcag

SEQ ID NO: 5950163 - DNA, 16 bp, Homo sapiens
tgacgtgactcagagc

SEQ ID NO: 5950164 - DNA, 16 bp, Homo sapiens
tgacgtgcacaaacct

SEQ ID NO: 5950165 - DNA, 21 bp, Homo sapiens
tgacgtgcacaaaccttcttt

SEQ ID NO: 5950166 - DNA, 23 bp, Homo sapiens
tgacgtgcacctgtactcaggag

SEQ ID NO: 5950167 - DNA, 15 bp, Homo sapiens
tgacgtgcactgtga

SEQ ID NO: 5950168 - DNA, 23 bp, Homo sapiens
tgacgtgcactgtgaatcctggc

SEQ ID NO: 5950169 - DNA, 23 bp, Homo sapiens
tgacgtggagcggggtatgaaga

SEQ ID NO: 5950170 - DNA, 18 bp, Homo sapiens
tgacgtgggcatcatttt

SEQ ID NO: 5950171 - DNA, 16 bp, Homo sapiens
tgacgtgtgtggctgg

SEQ ID NO: 5950172 - DNA, 17 bp, Homo sapiens
tgacgtgtgtggctggg

SEQ ID NO: 5950173 - DNA, 15 bp, Homo sapiens
tgacgttgttgtcat

SEQ ID NO: 5950174 - DNA, 15 bp, Homo sapiens
tgactaaaaaacaaa

SEQ ID NO: 5950175 - DNA, 22 bp, Homo sapiens
tgactaaaaatacttaaatttg

SEQ ID NO: 5950176 - DNA, 20 bp, Homo sapiens
tgactaaaaatgcatctggc

SEQ ID NO: 5950177 - DNA, 19 bp, Homo sapiens
tgactaaaccattgtgcat

SEQ ID NO: 5950178 - DNA, 15 bp, Homo sapiens
tgactaaactaccac

SEQ ID NO: 5950179 - DNA, 19 bp, Homo sapiens
tgactaaactaccacctca

SEQ ID NO: 5950180 - DNA, 20 bp, Homo sapiens
tgactaaactaccacctcag

SEQ ID NO: 5950181 - DNA, 21 bp, Homo sapiens
tgactaaactaccacctcagg

SEQ ID NO: 5950182 - DNA, 22 bp, Homo sapiens
tgactaaagacctgctgtaata

SEQ ID NO: 5950183 - DNA, 12 bp, Homo sapiens
tgactaaagcat

SEQ ID NO: 5950184 - DNA, 12 bp, Homo sapiens
tgactaaataaa

SEQ ID NO: 5950185 - DNA, 15 bp, Homo sapiens
tgactaaattcgtga

SEQ ID NO: 5950186 - DNA, 18 bp, Homo sapiens
tgactaaattcgtgattt

SEQ ID NO: 5950187 - DNA, 16 bp, Homo sapiens
tgactaaatttgggga

SEQ ID NO: 5950188 - DNA, 14 bp, Homo sapiens
tgactaaattttct

SEQ ID NO: 5950189 - DNA, 22 bp, Homo sapiens
tgactaacaagatttgtaatta

SEQ ID NO: 5950190 - DNA, 15 bp, Homo sapiens
tgactaactcaaata

SEQ ID NO: 5950191 - DNA, 23 bp, Homo sapiens
tgactaactcaaatacacatttg

SEQ ID NO: 5950192 - DNA, 20 bp, Homo sapiens
tgactaagaattttgtttta

SEQ ID NO: 5950193 - DNA, 18 bp, Homo sapiens
tgactaagccaagctgtg

SEQ ID NO: 5950194 - DNA, 20 bp, Homo sapiens
tgactaagccaagctgtgtt

SEQ ID NO: 5950195 - DNA, 14 bp, Homo sapiens
tgactaagcctttg

SEQ ID NO: 5950196 - DNA, 22 bp, Homo sapiens
tgactaataaaaaactgtgaac

SEQ ID NO: 5950197 - DNA, 20 bp, Homo sapiens
tgactaatgaggcattacaa

SEQ ID NO: 5950198 - DNA, 14 bp, Homo sapiens
tgactaatggcatg

SEQ ID NO: 5950199 - DNA, 15 bp, Homo sapiens
tgactaatggcatga

SEQ ID NO: 5950200 - DNA, 11 bp, Homo sapiens
tgactaattag

SEQ ID NO: 5950201 - DNA, 14 bp, Homo sapiens
tgactaattagggt

SEQ ID NO: 5950202 - DNA, 15 bp, Homo sapiens
tgactaattcttgca

SEQ ID NO: 5950203 - DNA, 22 bp, Homo sapiens
tgactaattcttgcatattttg

SEQ ID NO: 5950204 - DNA, 13 bp, Homo sapiens
tgactaattgtat

SEQ ID NO: 5950205 - DNA, 18 bp, Homo sapiens
tgactaattgtataacag

SEQ ID NO: 5950206 - DNA, 20 bp, Homo sapiens
tgactaattgtataacaggt

SEQ ID NO: 5950207 - DNA, 21 bp, Homo sapiens
tgactaattgtataacaggtt

SEQ ID NO: 5950208 - DNA, 23 bp, Homo sapiens
tgactaattgtataacaggttat

SEQ ID NO: 5950209 - DNA, 22 bp, Homo sapiens
tgactaattttacatgtttata

SEQ ID NO: 5950210 - DNA, 17 bp, Homo sapiens
tgactacagtcaggaaa

SEQ ID NO: 5950211 - DNA, 20 bp, Homo sapiens
tgactactaacaaatgtaaa

SEQ ID NO: 5950212 - DNA, 21 bp, Homo sapiens
tgactactaacaaatgtaaaa

SEQ ID NO: 5950213 - DNA, 15 bp, Homo sapiens
tgactactacacact

SEQ ID NO: 5950214 - DNA, 17 bp, Homo sapiens
tgactactactctgcca

SEQ ID NO: 5950215 - DNA, 20 bp, Homo sapiens
tgactactactctgccaatc

SEQ ID NO: 5950216 - DNA, 18 bp, Homo sapiens
tgactactatggctgttt

SEQ ID NO: 5950217 - DNA, 21 bp, Homo sapiens
tgactagaagggccagtcctg

SEQ ID NO: 5950218 - DNA, 17 bp, Homo sapiens
tgactagaggcagggag

SEQ ID NO: 5950219 - DNA, 21 bp, Homo sapiens
tgactagaggcagggagggga

SEQ ID NO: 5950220 - DNA, 22 bp, Homo sapiens
tgactagatatcaatcagtaat

SEQ ID NO: 5950221 - DNA, 22 bp, Homo sapiens
tgactagcaaacaaaaatagaa

SEQ ID NO: 5950222 - DNA, 21 bp, Homo sapiens
tgactagggagccatgtttca

SEQ ID NO: 5950223 - DNA, 19 bp, Homo sapiens
tgactagggattcaggctg

SEQ ID NO: 5950224 - DNA, 21 bp, Homo sapiens
tgactaggtacaggcaagctt

SEQ ID NO: 5950225 - DNA, 18 bp, Homo sapiens
tgactaggttctgtagag

SEQ ID NO: 5950226 - DNA, 20 bp, Homo sapiens
tgactagtacaaattataaa

SEQ ID NO: 5950227 - DNA, 16 bp, Homo sapiens
tgactagtagatttct

SEQ ID NO: 5950228 - DNA, 21 bp, Homo sapiens
tgactagtagatttctatgat

SEQ ID NO: 5950229 - DNA, 16 bp, Homo sapiens
tgactagtcatagaaa

SEQ ID NO: 5950230 - DNA, 18 bp, Homo sapiens
tgactagtcatagaaata

SEQ ID NO: 5950231 - DNA, 21 bp, Homo sapiens
tgactagtgcctagaaagcaa

SEQ ID NO: 5950232 - DNA, 15 bp, Homo sapiens
tgactagtgctgaag

SEQ ID NO: 5950233 - DNA, 21 bp, Homo sapiens
tgactagtgctgaagcttatt

SEQ ID NO: 5950234 - DNA, 21 bp, Homo sapiens
tgactataaacattaaaagaa

SEQ ID NO: 5950235 - DNA, 13 bp, Homo sapiens
tgactataaagct

SEQ ID NO: 5950236 - DNA, 15 bp, Homo sapiens
tgactataaagctgt

SEQ ID NO: 5950237 - DNA, 19 bp, Homo sapiens
tgactataacaaaatctgg

SEQ ID NO: 5950238 - DNA, 16 bp, Homo sapiens
tgactataatgcctct

SEQ ID NO: 5950239 - DNA, 17 bp, Homo sapiens
tgactataccaactggg

SEQ ID NO: 5950240 - DNA, 16 bp, Homo sapiens
tgactatatagagatg

SEQ ID NO: 5950241 - DNA, 18 bp, Homo sapiens
tgactatatagagatgtt

SEQ ID NO: 5950242 - DNA, 14 bp, Homo sapiens
tgactatcacatac

SEQ ID NO: 5950243 - DNA, 18 bp, Homo sapiens
tgactatcacatacaatt

SEQ ID NO: 5950244 - DNA, 20 bp, Homo sapiens
tgactatcacatacaatttg

SEQ ID NO: 5950245 - DNA, 22 bp, Homo sapiens
tgactatcacatacaatttgca

SEQ ID NO: 5950246 - DNA, 17 bp, Homo sapiens
tgactatggagtcttgt

SEQ ID NO: 5950247 - DNA, 22 bp, Homo sapiens
tgactatggagtcttgtgaaag

SEQ ID NO: 5950248 - DNA, 12 bp, Homo sapiens
tgactatgtaaa

SEQ ID NO: 5950249 - DNA, 18 bp, Homo sapiens
tgactatgtccagattgg

SEQ ID NO: 5950250 - DNA, 22 bp, Homo sapiens
tgactattacttttctgtttag

SEQ ID NO: 5950251 - DNA, 22 bp, Homo sapiens
tgactattctcaaatgctggca

SEQ ID NO: 5950252 - DNA, 21 bp, Homo sapiens
tgactattctgagatgactat

SEQ ID NO: 5950253 - DNA, 22 bp, Homo sapiens
tgactattctgagatgactatt

SEQ ID NO: 5950254 - DNA, 13 bp, Homo sapiens
tgactattctgta

SEQ ID NO: 5950255 - DNA, 20 bp, Homo sapiens
tgactattcttgatgtaaaa

SEQ ID NO: 5950256 - DNA, 20 bp, Homo sapiens
tgactattgaagttgcagat

SEQ ID NO: 5950257 - DNA, 20 bp, Homo sapiens
tgactattgtaatgccaata

SEQ ID NO: 5950258 - DNA, 18 bp, Homo sapiens
tgactatttgacccccac

SEQ ID NO: 5950259 - DNA, 17 bp, Homo sapiens
tgactattttcgttcat

SEQ ID NO: 5950260 - DNA, 23 bp, Homo sapiens
tgactcaaactcctcccttttat

SEQ ID NO: 5950261 - DNA, 12 bp, Homo sapiens
tgactcaaagat

SEQ ID NO: 5950262 - DNA, 14 bp, Homo sapiens
tgactcaaagatga

SEQ ID NO: 5950263 - DNA, 15 bp, Homo sapiens
tgactcaagaagtga

SEQ ID NO: 5950264 - DNA, 22 bp, Homo sapiens
tgactcaagaagtgaagaatgc

SEQ ID NO: 5950265 - DNA, 16 bp, Homo sapiens
tgactcaagattccca

SEQ ID NO: 5950266 - DNA, 18 bp, Homo sapiens
tgactcaagattttttct

SEQ ID NO: 5950267 - DNA, 19 bp, Homo sapiens
tgactcaagtttttacaaa

SEQ ID NO: 5950268 - DNA, 20 bp, Homo sapiens
tgactcacaagaagaccaga

SEQ ID NO: 5950269 - DNA, 18 bp, Homo sapiens
tgactcacacttactgca

SEQ ID NO: 5950270 - DNA, 20 bp, Homo sapiens
tgactcacaggccctggaga

SEQ ID NO: 5950271 - DNA, 11 bp, Homo sapiens
tgactcaccca

SEQ ID NO: 5950272 - DNA, 14 bp, Homo sapiens
tgactcacccaagc

SEQ ID NO: 5950273 - DNA, 14 bp, Homo sapiens
tgactcagaggctg

SEQ ID NO: 5950274 - DNA, 17 bp, Homo sapiens
tgactcagaggctggga

SEQ ID NO: 5950275 - DNA, 20 bp, Homo sapiens
tgactcagcagaggcagtgg

SEQ ID NO: 5950276 - DNA, 15 bp, Homo sapiens
tgactcagctaatgt

SEQ ID NO: 5950277 - DNA, 19 bp, Homo sapiens
tgactcagctaatgtcaca

SEQ ID NO: 5950278 - DNA, 16 bp, Homo sapiens
tgactcaggagcctcc

SEQ ID NO: 5950279 - DNA, 18 bp, Homo sapiens
tgactcaggagcctccta

SEQ ID NO: 5950280 - DNA, 21 bp, Homo sapiens
tgactcaggcgcctggcacat

SEQ ID NO: 5950281 - DNA, 21 bp, Homo sapiens
tgactcaggcgggcaccaagg

SEQ ID NO: 5950282 - DNA, 22 bp, Homo sapiens
tgactcaggtggtgtccttctt

SEQ ID NO: 5950283 - DNA, 22 bp, Homo sapiens
tgactcagtgtctgcctttaaa

SEQ ID NO: 5950284 - DNA, 14 bp, Homo sapiens
tgactcatccccac

SEQ ID NO: 5950285 - DNA, 18 bp, Homo sapiens
tgactcatccccacagct

SEQ ID NO: 5950286 - DNA, 14 bp, Homo sapiens
tgactcatccgcct

SEQ ID NO: 5950287 - DNA, 21 bp, Homo sapiens
tgactcatccgcctggcccgg

SEQ ID NO: 5950288 - DNA, 13 bp, Homo sapiens
tgactcatcctct

SEQ ID NO: 5950289 - DNA, 12 bp, Homo sapiens
tgactcatgcct

SEQ ID NO: 5950290 - DNA, 15 bp, Homo sapiens
tgactcatgcctctg

SEQ ID NO: 5950291 - DNA, 16 bp, Homo sapiens
tgactcatgcctctga

SEQ ID NO: 5950292 - DNA, 16 bp, Homo sapiens
tgactccaaccattca

SEQ ID NO: 5950293 - DNA, 14 bp, Homo sapiens
tgagaaggcagcca

SEQ ID NO: 5950294 - DNA, 16 bp, Homo sapiens
tgagaaggcagccacc

SEQ ID NO: 5950295 - DNA, 19 bp, Homo sapiens
tgagaaggccaatagtttt

SEQ ID NO: 5950296 - DNA, 14 bp, Homo sapiens
tgagaaggccccag

SEQ ID NO: 5950297 - DNA, 19 bp, Homo sapiens
tgagaaggccctgtgccct

SEQ ID NO: 5950298 - DNA, 16 bp, Homo sapiens
tgagaagggcctgctc

SEQ ID NO: 5950299 - DNA, 21 bp, Homo sapiens
tgagaagggcctgctctgctt

SEQ ID NO: 5950300 - DNA, 24 bp, Homo sapiens
tgagaagggctcagagaggacaaa

SEQ ID NO: 5950301 - DNA, 23 bp, Homo sapiens
tgagaaggggaggacctctgggc

SEQ ID NO: 5950302 - DNA, 15 bp, Homo sapiens
tgagaaggtgcctgc

SEQ ID NO: 5950303 - DNA, 17 bp, Homo sapiens
tgagaaggtgcctgcca

SEQ ID NO: 5950304 - DNA, 22 bp, Homo sapiens
tgagaaggttactgagtgagtt

SEQ ID NO: 5950305 - DNA, 15 bp, Homo sapiens
tgagaaggtttattg

SEQ ID NO: 5950306 - DNA, 17 bp, Homo sapiens
tgagaaggtttattgtt

SEQ ID NO: 5950307 - DNA, 22 bp, Homo sapiens
tgagaagtaaattattttatgt

SEQ ID NO: 5950308 - DNA, 21 bp, Homo sapiens
tgagaagtgaatgctgggact

SEQ ID NO: 5950309 - DNA, 15 bp, Homo sapiens
tgagaagtgccttct

SEQ ID NO: 5950310 - DNA, 17 bp, Homo sapiens
tgagaagtgccttctcc

SEQ ID NO: 5950311 - DNA, 14 bp, Homo sapiens
tgagaagtgtatat

SEQ ID NO: 5950312 - DNA, 23 bp, Homo sapiens
tgagaagttaagcagcctttctg

SEQ ID NO: 5950313 - DNA, 15 bp, Homo sapiens
tgagaagttctcaga

SEQ ID NO: 5950314 - DNA, 17 bp, Homo sapiens
tgagaagttttgtacag

SEQ ID NO: 5950315 - DNA, 18 bp, Homo sapiens
tgagaagttttgtacaga

SEQ ID NO: 5950316 - DNA, 21 bp, Homo sapiens
tgagaataaatgagcattttt

SEQ ID NO: 5950317 - DNA, 20 bp, Homo sapiens
tgagaataagttcatacaat

SEQ ID NO: 5950318 - DNA, 23 bp, Homo sapiens
tgagaataagttcatacaatcgt

SEQ ID NO: 5950319 - DNA, 15 bp, Homo sapiens
tgagaataattgtgt

SEQ ID NO: 5950320 - DNA, 23 bp, Homo sapiens
tgagaatacaagatattatgtat

SEQ ID NO: 5950321 - DNA, 16 bp, Homo sapiens
tgagaatagaaacgta

SEQ ID NO: 5950322 - DNA, 24 bp, Homo sapiens
tgagaatagaaacgtaaactatga

SEQ ID NO: 5950323 - DNA, 17 bp, Homo sapiens
tgagaatagaaggaaac

SEQ ID NO: 5950324 - DNA, 18 bp, Homo sapiens
tgagaatagaaggaaact

SEQ ID NO: 5950325 - DNA, 15 bp, Homo sapiens
tgagaatagctttaa

SEQ ID NO: 5950326 - DNA, 16 bp, Homo sapiens
tgagaatataccttat

SEQ ID NO: 5950327 - DNA, 18 bp, Homo sapiens
tgagaatataccttattt

SEQ ID NO: 5950328 - DNA, 22 bp, Homo sapiens
tgagaatataccttatttattt

SEQ ID NO: 5950329 - DNA, 22 bp, Homo sapiens
tgagaatcacggtggtaaagaa

SEQ ID NO: 5950330 - DNA, 18 bp, Homo sapiens
tgagaatcactgctccag

SEQ ID NO: 5950331 - DNA, 20 bp, Homo sapiens
tgagaatcagatcatttcaa

SEQ ID NO: 5950332 - DNA, 20 bp, Homo sapiens
tgagaatcccaaatttgatt

SEQ ID NO: 5950333 - DNA, 20 bp, Homo sapiens
tgagaatcctctcctttctt

SEQ ID NO: 5950334 - DNA, 15 bp, Homo sapiens
tgagaatcctgcctc

SEQ ID NO: 5950335 - DNA, 17 bp, Homo sapiens
tgagaatctaggccacc

SEQ ID NO: 5950336 - DNA, 19 bp, Homo sapiens
tgagaatctaggccacccc

SEQ ID NO: 5950337 - DNA, 21 bp, Homo sapiens
tgagaatctttattgagaaag

SEQ ID NO: 5950338 - DNA, 13 bp, Homo sapiens
tgagaatgaacaa

SEQ ID NO: 5950339 - DNA, 17 bp, Homo sapiens
tgagaatgacagccttt

SEQ ID NO: 5950340 - DNA, 18 bp, Homo sapiens
tgagaatgagtgggaatc

SEQ ID NO: 5950341 - DNA, 21 bp, Homo sapiens
tgagaatgcccaactcttcat

SEQ ID NO: 5950342 - DNA, 15 bp, Homo sapiens
tgagaatgcctaggc

SEQ ID NO: 5950343 - DNA, 17 bp, Homo sapiens
tgagaatgcctaggcca

SEQ ID NO: 5950344 - DNA, 22 bp, Homo sapiens
tgagaatgcctaggccagctcc

SEQ ID NO: 5950345 - DNA, 17 bp, Homo sapiens
tgagaatggcctggagc

SEQ ID NO: 5950346 - DNA, 20 bp, Homo sapiens
tgagaatgtcatttgctaat

SEQ ID NO: 5950347 - DNA, 18 bp, Homo sapiens
tgagaatgtgccatgtat

SEQ ID NO: 5950348 - DNA, 21 bp, Homo sapiens
tgagaatgttaccagacttca

SEQ ID NO: 5950349 - DNA, 22 bp, Homo sapiens
tgagaatgttaccagacttcaa

SEQ ID NO: 5950350 - DNA, 23 bp, Homo sapiens
tgagaatgttaccagacttcaag

SEQ ID NO: 5950351 - DNA, 15 bp, Homo sapiens
tgagaattaaaataa

SEQ ID NO: 5950352 - DNA, 16 bp, Homo sapiens
tgagaattaagtttta

SEQ ID NO: 5950353 - DNA, 13 bp, Homo sapiens
tgagaattacaga

SEQ ID NO: 5950354 - DNA, 18 bp, Homo sapiens
tgagaattacagaaaatt

SEQ ID NO: 5950355 - DNA, 12 bp, Homo sapiens
tgagaattaccc

SEQ ID NO: 5950356 - DNA, 19 bp, Homo sapiens
tgagaattactgtttgaaa

SEQ ID NO: 5950357 - DNA, 19 bp, Homo sapiens
tgagaattattcctttcct

SEQ ID NO: 5950358 - DNA, 18 bp, Homo sapiens
tgagaattcagctgcccc

SEQ ID NO: 5950359 - DNA, 16 bp, Homo sapiens
tgagaattccaaggag

SEQ ID NO: 5950360 - DNA, 13 bp, Homo sapiens
tgagaatttctaa

SEQ ID NO: 5950361 - DNA, 15 bp, Homo sapiens
tgagaatttctaaaa

SEQ ID NO: 5950362 - DNA, 18 bp, Homo sapiens
tgagaatttgtgtggata

SEQ ID NO: 5950363 - DNA, 13 bp, Homo sapiens
tgagaattttaaa

SEQ ID NO: 5950364 - DNA, 9 bp, Homo sapiens
tgagacaaa

SEQ ID NO: 5950365 - DNA, 15 bp, Homo sapiens
tgagacaaaaaggaa

SEQ ID NO: 5950366 - DNA, 18 bp, Homo sapiens
tgagacaaaaaggaaaca

SEQ ID NO: 5950367 - DNA, 17 bp, Homo sapiens
tgagacaaaagaaaaaa

SEQ ID NO: 5950368 - DNA, 14 bp, Homo sapiens
tgagacaaacatgc

SEQ ID NO: 5950369 - DNA, 17 bp, Homo sapiens
tgagacaagccctggca

SEQ ID NO: 5950370 - DNA, 18 bp, Homo sapiens
tgagacaagccctggcaa

SEQ ID NO: 5950371 - DNA, 16 bp, Homo sapiens
tgagacaatgccttgt

SEQ ID NO: 5950372 - DNA, 12 bp, Homo sapiens
tgagacaatgtt

SEQ ID NO: 5950373 - DNA, 20 bp, Homo sapiens
tgagacaatgttttcttcaa

SEQ ID NO: 5950374 - DNA, 21 bp, Homo sapiens
tgagacacagcccagagactg

SEQ ID NO: 5950375 - DNA, 14 bp, Homo sapiens
tgagacacgatgcc

SEQ ID NO: 5950376 - DNA, 21 bp, Homo sapiens
tgagacacggagcccagccct

SEQ ID NO: 5950377 - DNA, 15 bp, Homo sapiens
tgagacactgcacag

SEQ ID NO: 5950378 - DNA, 16 bp, Homo sapiens
tgagacactgtcaaga

SEQ ID NO: 5950379 - DNA, 22 bp, Homo sapiens
tgagacactgtcaagattaagt

SEQ ID NO: 5950380 - DNA, 15 bp, Homo sapiens
tgagacactgtctct

SEQ ID NO: 5950381 - DNA, 14 bp, Homo sapiens
tgagacagaatctc

SEQ ID NO: 5950382 - DNA, 19 bp, Homo sapiens
tgagacagaatctcagtct

SEQ ID NO: 5950383 - DNA, 13 bp, Homo sapiens
tgagacagcaagt

SEQ ID NO: 5950384 - DNA, 14 bp, Homo sapiens
tgagacagcaagtt

SEQ ID NO: 5950385 - DNA, 13 bp, Homo sapiens
tgagacagcacca

SEQ ID NO: 5950386 - DNA, 23 bp, Homo sapiens
tgagacagcaccactgctgagga

SEQ ID NO: 5950387 - DNA, 18 bp, Homo sapiens
tgagacagccacttggtt

SEQ ID NO: 5950388 - DNA, 17 bp, Homo sapiens
tgagacagcccgggctc

SEQ ID NO: 5950389 - DNA, 20 bp, Homo sapiens
tgagacagcccgggctctgc

SEQ ID NO: 5950390 - DNA, 17 bp, Homo sapiens
tgagacaggcagtttca

SEQ ID NO: 5950391 - DNA, 24 bp, Homo sapiens
tgagacaggcagtttcagagatgg

SEQ ID NO: 5950392 - DNA, 14 bp, Homo sapiens
tgagacaggctggg

SEQ ID NO: 5950393 - DNA, 23 bp, Homo sapiens
tgagacagggtctcactctgtca

SEQ ID NO: 5950394 - DNA, 18 bp, Homo sapiens
tgagacagggttttttca

SEQ ID NO: 5950395 - DNA, 19 bp, Homo sapiens
tgagacagggttttttcat

SEQ ID NO: 5950396 - DNA, 21 bp, Homo sapiens
tgagacagggttttttcattt

SEQ ID NO: 5950397 - DNA, 23 bp, Homo sapiens
tgagacagggttttttcattttt

SEQ ID NO: 5950398 - DNA, 16 bp, Homo sapiens
tgagacaggtgcctgg

SEQ ID NO: 5950399 - DNA, 14 bp, Homo sapiens
tgagacagtctgga

SEQ ID NO: 5950400 - DNA, 16 bp, Homo sapiens
tgagacagtgaatttg

SEQ ID NO: 5950401 - DNA, 14 bp, Homo sapiens
tgagacagtgcaca

SEQ ID NO: 5950402 - DNA, 17 bp, Homo sapiens
tgagacagtgggaaata

SEQ ID NO: 5950403 - DNA, 18 bp, Homo sapiens
tgagacagtgggaaatat

SEQ ID NO: 5950404 - DNA, 14 bp, Homo sapiens
tgagacagtggggg

SEQ ID NO: 5950405 - DNA, 14 bp, Homo sapiens
tgagacagtttctt

SEQ ID NO: 5950406 - DNA, 18 bp, Homo sapiens
tgagacagtttcttagct

SEQ ID NO: 5950407 - DNA, 20 bp, Homo sapiens
tgagacagtttcttagcttt

SEQ ID NO: 5950408 - DNA, 21 bp, Homo sapiens
tgagacagtttcttagctttt

SEQ ID NO: 5950409 - DNA, 16 bp, Homo sapiens
tgagacatcaggaagg

SEQ ID NO: 5950410 - DNA, 17 bp, Homo sapiens
tgagacatccctcatct

SEQ ID NO: 5950411 - DNA, 17 bp, Homo sapiens
tgagacattacagtttg

SEQ ID NO: 5950412 - DNA, 17 bp, Homo sapiens
tgagaccaagccggtgc

SEQ ID NO: 5950413 - DNA, 21 bp, Homo sapiens
tgagaccaagtctctctaaga

SEQ ID NO: 5950414 - DNA, 21 bp, Homo sapiens
tgagaccacagagagagggga

SEQ ID NO: 5950415 - DNA, 23 bp, Homo sapiens
tgagaccacagtttacctcaggt

SEQ ID NO: 5950416 - DNA, 19 bp, Homo sapiens
tgagaccaccctgggcaac

SEQ ID NO: 5950417 - DNA, 14 bp, Homo sapiens
tgagaccagaagaa

SEQ ID NO: 5950418 - DNA, 17 bp, Homo sapiens
tgagaccagaagaaaag

SEQ ID NO: 5950419 - DNA, 19 bp, Homo sapiens
tgagaccagaagaaaagac

SEQ ID NO: 5950420 - DNA, 15 bp, Homo sapiens
tgagaccagcctgcc

SEQ ID NO: 5950421 - DNA, 21 bp, Homo sapiens
tgagaccagcctgccaggccc

SEQ ID NO: 5950422 - DNA, 19 bp, Homo sapiens
tgagaccagcctggccaac

SEQ ID NO: 5950423 - DNA, 15 bp, Homo sapiens
tgagaccagcctggg

SEQ ID NO: 5950424 - DNA, 18 bp, Homo sapiens
tgagaccaggctgggcat

SEQ ID NO: 5950425 - DNA, 17 bp, Homo sapiens
tgagaccagggtggcca

SEQ ID NO: 5950426 - DNA, 19 bp, Homo sapiens
tgagaccagggtggccaca

SEQ ID NO: 5950427 - DNA, 20 bp, Homo sapiens
tgagaccagtggtctggaaa

SEQ ID NO: 5950428 - DNA, 23 bp, Homo sapiens
tgagaccagtggtctggaaacag

SEQ ID NO: 5950429 - DNA, 17 bp, Homo sapiens
tgagaccatccattctc

SEQ ID NO: 5950430 - DNA, 14 bp, Homo sapiens
tgagacccagcccc

SEQ ID NO: 5950431 - DNA, 19 bp, Homo sapiens
tgagacccagccccttccc

SEQ ID NO: 5950432 - DNA, 20 bp, Homo sapiens
tgagacccagccccttcccc

SEQ ID NO: 5950433 - DNA, 12 bp, Homo sapiens
tgagacccagga

SEQ ID NO: 5950434 - DNA, 14 bp, Homo sapiens
tgagacccaggact

SEQ ID NO: 5950435 - DNA, 16 bp, Homo sapiens
tgagacccaggactcc

SEQ ID NO: 5950436 - DNA, 22 bp, Homo sapiens
tgagaccccagtgcctgcacat

SEQ ID NO: 5950437 - DNA, 15 bp, Homo sapiens
tgagacccccacacc

SEQ ID NO: 5950438 - DNA, 16 bp, Homo sapiens
tgagacccccacacct

SEQ ID NO: 5950439 - DNA, 21 bp, Homo sapiens
tgagacccccatctctacaaa

SEQ ID NO: 5950440 - DNA, 14 bp, Homo sapiens
tgagacccctggcc

SEQ ID NO: 5950441 - DNA, 16 bp, Homo sapiens
tgagacccctgtctcc

SEQ ID NO: 5950442 - DNA, 19 bp, Homo sapiens
tgagacccctttaaactgt

SEQ ID NO: 5950443 - DNA, 23 bp, Homo sapiens
tgagaccctcgccacggggaggg

SEQ ID NO: 5950444 - DNA, 14 bp, Homo sapiens
tgagaccctcttct

SEQ ID NO: 5950445 - DNA, 15 bp, Homo sapiens
tgagaccctgggaga

SEQ ID NO: 5950446 - DNA, 19 bp, Homo sapiens
tgagaccctgggagagaag

SEQ ID NO: 5950447 - DNA, 14 bp, Homo sapiens
tgagaccctgtctc

SEQ ID NO: 5950448 - DNA, 15 bp, Homo sapiens
tgagaccctgtctct

SEQ ID NO: 5950449 - DNA, 22 bp, Homo sapiens
tgagaccctttaaatgcctgcg

SEQ ID NO: 5950450 - DNA, 14 bp, Homo sapiens
tgagacccttttct

SEQ ID NO: 5950451 - DNA, 18 bp, Homo sapiens
tgagacctacaggctgac

SEQ ID NO: 5950452 - DNA, 19 bp, Homo sapiens
tgagacctacaggctgacg

SEQ ID NO: 5950453 - DNA, 11 bp, Homo sapiens
tgagacctcaa

SEQ ID NO: 5950454 - DNA, 19 bp, Homo sapiens
tgagacctcaaatcactgc

SEQ ID NO: 5950455 - DNA, 14 bp, Homo sapiens
tgagacctcagcca

SEQ ID NO: 5950456 - DNA, 14 bp, Homo sapiens
tgagacctcagctt

SEQ ID NO: 5950457 - DNA, 22 bp, Homo sapiens
tgagacctcagcttggcactca

SEQ ID NO: 5950458 - DNA, 20 bp, Homo sapiens
tgagacctcgccggccttgt

SEQ ID NO: 5950459 - DNA, 22 bp, Homo sapiens
tgagacctgaaggacctccccc

SEQ ID NO: 5950460 - DNA, 12 bp, Homo sapiens
tgagacctgccc

SEQ ID NO: 5950461 - DNA, 16 bp, Homo sapiens
tgagacctttcctctc

SEQ ID NO: 5950462 - DNA, 22 bp, Homo sapiens
tgagacgaatgccattggaacc

SEQ ID NO: 5950463 - DNA, 23 bp, Homo sapiens
tgagacgaggcaggggctctgct

SEQ ID NO: 5950464 - DNA, 21 bp, Homo sapiens
tgagacgccaccattcctgga

SEQ ID NO: 5950465 - DNA, 19 bp, Homo sapiens
tgagacggagtctcagtct

SEQ ID NO: 5950466 - DNA, 15 bp, Homo sapiens
tgagacggagtcttg

SEQ ID NO: 5950467 - DNA, 19 bp, Homo sapiens
tgagacggatggaaggaga

SEQ ID NO: 5950468 - DNA, 21 bp, Homo sapiens
tgagacggatggaaggagaga

SEQ ID NO: 5950469 - DNA, 14 bp, Homo sapiens
tgagccaggcctgg

SEQ ID NO: 5950470 - DNA, 18 bp, Homo sapiens
tgagccaggcctgggtct

SEQ ID NO: 5950471 - DNA, 20 bp, Homo sapiens
tgagccaggcttttctcagg

SEQ ID NO: 5950472 - DNA, 15 bp, Homo sapiens
tgagccagggaacag

SEQ ID NO: 5950473 - DNA, 18 bp, Homo sapiens
tgagccagggaacagccc

SEQ ID NO: 5950474 - DNA, 13 bp, Homo sapiens
tgagccagggtct

SEQ ID NO: 5950475 - DNA, 22 bp, Homo sapiens
tgagccagggtctccagaaagc

SEQ ID NO: 5950476 - DNA, 14 bp, Homo sapiens
tgagccagtaatct

SEQ ID NO: 5950477 - DNA, 16 bp, Homo sapiens
tgagccagtaatcttt

SEQ ID NO: 5950478 - DNA, 17 bp, Homo sapiens
tgagccagtaatcttta

SEQ ID NO: 5950479 - DNA, 18 bp, Homo sapiens
tgagccagtaatctttat

SEQ ID NO: 5950480 - DNA, 13 bp, Homo sapiens
tgagccagtccca

SEQ ID NO: 5950481 - DNA, 14 bp, Homo sapiens
tgagccagtcccag

SEQ ID NO: 5950482 - DNA, 17 bp, Homo sapiens
tgagccagtcccagggg

SEQ ID NO: 5950483 - DNA, 18 bp, Homo sapiens
tgagccagtcccaggggc

SEQ ID NO: 5950484 - DNA, 15 bp, Homo sapiens
tgagccagtgattat

SEQ ID NO: 5950485 - DNA, 22 bp, Homo sapiens
tgagccagttcagtacctggag

SEQ ID NO: 5950486 - DNA, 14 bp, Homo sapiens
tgagccatattaat

SEQ ID NO: 5950487 - DNA, 13 bp, Homo sapiens
tgagccatcacta

SEQ ID NO: 5950488 - DNA, 17 bp, Homo sapiens
tgagccatcatttcctg

SEQ ID NO: 5950489 - DNA, 23 bp, Homo sapiens
tgagccatgatcgagccactgca

SEQ ID NO: 5950490 - DNA, 18 bp, Homo sapiens
tgagccatgattttctaa

SEQ ID NO: 5950491 - DNA, 16 bp, Homo sapiens
tgagccatgcctccct

SEQ ID NO: 5950492 - DNA, 19 bp, Homo sapiens
tgagccatgcctccctggg

SEQ ID NO: 5950493 - DNA, 14 bp, Homo sapiens
tgagccatttaatt

SEQ ID NO: 5950494 - DNA, 21 bp, Homo sapiens
tgagcccaacactcacttaat

SEQ ID NO: 5950495 - DNA, 18 bp, Homo sapiens
tgagcccaagcacacatg

SEQ ID NO: 5950496 - DNA, 21 bp, Homo sapiens
tgagcccaccagggacacctc

SEQ ID NO: 5950497 - DNA, 12 bp, Homo sapiens
tgagcccactct

SEQ ID NO: 5950498 - DNA, 22 bp, Homo sapiens
tgagcccactgcccaccccctc

SEQ ID NO: 5950499 - DNA, 19 bp, Homo sapiens
tgagcccactgtgcgtggg

SEQ ID NO: 5950500 - DNA, 19 bp, Homo sapiens
tgagcccagaaaaaaggac

SEQ ID NO: 5950501 - DNA, 20 bp, Homo sapiens
tgagcccagaaaaaaggact

SEQ ID NO: 5950502 - DNA, 23 bp, Homo sapiens
tgagcccagaagctcaaggctgc

SEQ ID NO: 5950503 - DNA, 16 bp, Homo sapiens
tgagcccagccacctc

SEQ ID NO: 5950504 - DNA, 18 bp, Homo sapiens
tgagcccagccacctccc

SEQ ID NO: 5950505 - DNA, 19 bp, Homo sapiens
tgagcccagccacctccca

SEQ ID NO: 5950506 - DNA, 18 bp, Homo sapiens
tgagcccagccctgttct

SEQ ID NO: 5950507 - DNA, 13 bp, Homo sapiens
tgagcccagctgc

SEQ ID NO: 5950508 - DNA, 14 bp, Homo sapiens
tgagcccagctgcc

SEQ ID NO: 5950509 - DNA, 20 bp, Homo sapiens
tgagcccagctgcctggaga

SEQ ID NO: 5950510 - DNA, 13 bp, Homo sapiens
tgagcccaggaag

SEQ ID NO: 5950511 - DNA, 13 bp, Homo sapiens
tgagcccaggagt

SEQ ID NO: 5950512 - DNA, 14 bp, Homo sapiens
tgagcccagggagg

SEQ ID NO: 5950513 - DNA, 15 bp, Homo sapiens
tgagcccagggaggc

SEQ ID NO: 5950514 - DNA, 19 bp, Homo sapiens
tgagcccattcttctgggt

SEQ ID NO: 5950515 - DNA, 13 bp, Homo sapiens
tgagccccaaaag

SEQ ID NO: 5950516 - DNA, 21 bp, Homo sapiens
tgagccccaagtcctgaagag

SEQ ID NO: 5950517 - DNA, 12 bp, Homo sapiens
tgagccccacag

SEQ ID NO: 5950518 - DNA, 19 bp, Homo sapiens
tgagccccacctctccaag

SEQ ID NO: 5950519 - DNA, 17 bp, Homo sapiens
tgagccccagcgggctg

SEQ ID NO: 5950520 - DNA, 17 bp, Homo sapiens
tgagccccagtgctgga

SEQ ID NO: 5950521 - DNA, 19 bp, Homo sapiens
tgagccccagtgctggaag

SEQ ID NO: 5950522 - DNA, 23 bp, Homo sapiens
tgagcccccaccggaactgggct

SEQ ID NO: 5950523 - DNA, 13 bp, Homo sapiens
tgagcccccagct

SEQ ID NO: 5950524 - DNA, 16 bp, Homo sapiens
tgagcccccagcttcc

SEQ ID NO: 5950525 - DNA, 13 bp, Homo sapiens
tgagcccccccct

SEQ ID NO: 5950526 - DNA, 20 bp, Homo sapiens
tgagccccctgcacccaccc

SEQ ID NO: 5950527 - DNA, 19 bp, Homo sapiens
tgagccccgccctcttcct

SEQ ID NO: 5950528 - DNA, 21 bp, Homo sapiens
tgagcccctaccccacaccag

SEQ ID NO: 5950529 - DNA, 11 bp, Homo sapiens
tgagcccctcc

SEQ ID NO: 5950530 - DNA, 22 bp, Homo sapiens
tgagcccctccccagccagccc

SEQ ID NO: 5950531 - DNA, 22 bp, Homo sapiens
tgagcccctgtctagagaggga

SEQ ID NO: 5950532 - DNA, 20 bp, Homo sapiens
tgagcccctttgcctgtcaa

SEQ ID NO: 5950533 - DNA, 16 bp, Homo sapiens
tgagcccgcagcccag

SEQ ID NO: 5950534 - DNA, 16 bp, Homo sapiens
tgagcccgggctgcct

SEQ ID NO: 5950535 - DNA, 19 bp, Homo sapiens
tgagcccgggctgcctggg

SEQ ID NO: 5950536 - DNA, 20 bp, Homo sapiens
tgagcccgggctgcctgggc

SEQ ID NO: 5950537 - DNA, 23 bp, Homo sapiens
tgagccctactccctgcagatgc

SEQ ID NO: 5950538 - DNA, 14 bp, Homo sapiens
tgagccctcagaac

SEQ ID NO: 5950539 - DNA, 20 bp, Homo sapiens
tgagccctcagaacccttgg

SEQ ID NO: 5950540 - DNA, 19 bp, Homo sapiens
tgagccctcctgagggccg

SEQ ID NO: 5950541 - DNA, 22 bp, Homo sapiens
tgagccctcctggaatggagct

SEQ ID NO: 5950542 - DNA, 22 bp, Homo sapiens
tgagccctccttcttgccctga

SEQ ID NO: 5950543 - DNA, 15 bp, Homo sapiens
tgagccctctagggc

SEQ ID NO: 5950544 - DNA, 17 bp, Homo sapiens
tgagccctctagggcag

SEQ ID NO: 5950545 - DNA, 22 bp, Homo sapiens
tgagccctctagggcagggtgg

SEQ ID NO: 5950546 - DNA, 17 bp, Homo sapiens
tgagccctctcactcca

SEQ ID NO: 5950547 - DNA, 20 bp, Homo sapiens
tgagccctctcactccagcc

SEQ ID NO: 5950548 - DNA, 16 bp, Homo sapiens
tgagccctgaggaggc

SEQ ID NO: 5950549 - DNA, 17 bp, Homo sapiens
tgagccctgccctcact

SEQ ID NO: 5950550 - DNA, 14 bp, Homo sapiens
tgagccctgctctt

SEQ ID NO: 5950551 - DNA, 15 bp, Homo sapiens
tgagccctgctcttc

SEQ ID NO: 5950552 - DNA, 17 bp, Homo sapiens
tgagccctgctcttctc

SEQ ID NO: 5950553 - DNA, 21 bp, Homo sapiens
tgagccctgctcttctctccc

SEQ ID NO: 5950554 - DNA, 14 bp, Homo sapiens
tgagccctggaccc

SEQ ID NO: 5950555 - DNA, 13 bp, Homo sapiens
tgagccctggctg

SEQ ID NO: 5950556 - DNA, 13 bp, Homo sapiens
tgagccctgggga

SEQ ID NO: 5950557 - DNA, 16 bp, Homo sapiens
tgagccctgtacccac

SEQ ID NO: 5950558 - DNA, 17 bp, Homo sapiens
tgagccctgtacccacc

SEQ ID NO: 5950559 - DNA, 19 bp, Homo sapiens
tgagccctgtacccacccc

SEQ ID NO: 5950560 - DNA, 21 bp, Homo sapiens
tgagccctgtacccaccccag

SEQ ID NO: 5950561 - DNA, 18 bp, Homo sapiens
tgagccctgtcctgccta

SEQ ID NO: 5950562 - DNA, 20 bp, Homo sapiens
tgagcccttgcacaggccac

SEQ ID NO: 5950563 - DNA, 15 bp, Homo sapiens
tgagcccttgtttca

SEQ ID NO: 5950564 - DNA, 20 bp, Homo sapiens
tgagccgagattgcgccact

SEQ ID NO: 5950565 - DNA, 17 bp, Homo sapiens
tgagccgatctggtctc

SEQ ID NO: 5950566 - DNA, 14 bp, Homo sapiens
tgagccgcagagaa

SEQ ID NO: 5950567 - DNA, 23 bp, Homo sapiens
tgagccgcatcttctccatctgg

SEQ ID NO: 5950568 - DNA, 17 bp, Homo sapiens
tgagccgcccaaggcct

SEQ ID NO: 5950569 - DNA, 22 bp, Homo sapiens
tgagccgcctcggagtgtggcc

SEQ ID NO: 5950570 - DNA, 22 bp, Homo sapiens
tgagccgcggggaagctggctt

SEQ ID NO: 5950571 - DNA, 21 bp, Homo sapiens
tgagccggagggcaccaggga

SEQ ID NO: 5950572 - DNA, 20 bp, Homo sapiens
tgagccgggcccctgggctt

SEQ ID NO: 5950573 - DNA, 14 bp, Homo sapiens
tgagccgtgaactg

SEQ ID NO: 5950574 - DNA, 20 bp, Homo sapiens
tgagcctaaaaataaagcac

SEQ ID NO: 5950575 - DNA, 16 bp, Homo sapiens
tgagcctacgctgaag

SEQ ID NO: 5950576 - DNA, 17 bp, Homo sapiens
tgagcctagccctggga

SEQ ID NO: 5950577 - DNA, 18 bp, Homo sapiens
tgagcctatatcagtcgt

SEQ ID NO: 5950578 - DNA, 16 bp, Homo sapiens
tgagcctcaaccttct

SEQ ID NO: 5950579 - DNA, 23 bp, Homo sapiens
tgagcctcaaccttctgggggaa

SEQ ID NO: 5950580 - DNA, 23 bp, Homo sapiens
tgagcctcaatttcctcatctgg

SEQ ID NO: 5950581 - DNA, 11 bp, Homo sapiens
tgagcctcaga

SEQ ID NO: 5950582 - DNA, 17 bp, Homo sapiens
tgagcctcagcatcctg

SEQ ID NO: 5950583 - DNA, 20 bp, Homo sapiens
tgagcctccatttctggctt

SEQ ID NO: 5950584 - DNA, 14 bp, Homo sapiens
tgagcctcccccaa

SEQ ID NO: 5950585 - DNA, 17 bp, Homo sapiens
tgagcctcgtgtcatct

SEQ ID NO: 5950586 - DNA, 13 bp, Homo sapiens
tgagcctctcacc

SEQ ID NO: 5950587 - DNA, 15 bp, Homo sapiens
tgagcctctcacctg

SEQ ID NO: 5950588 - DNA, 19 bp, Homo sapiens
tgagcctctcacctgtact

SEQ ID NO: 5950589 - DNA, 14 bp, Homo sapiens
tgagcctctgcgcc

SEQ ID NO: 5950590 - DNA, 15 bp, Homo sapiens
tgagcctctgcgcct

SEQ ID NO: 5950591 - DNA, 22 bp, Homo sapiens
tgagcctctttaacagctttct

SEQ ID NO: 5950592 - DNA, 13 bp, Homo sapiens
tgagcctgagcct

SEQ ID NO: 5950593 - DNA, 21 bp, Homo sapiens
tgagcctgatgtttacagtgt

SEQ ID NO: 5950594 - DNA, 17 bp, Homo sapiens
tgagcctgcatcttctt

SEQ ID NO: 5950595 - DNA, 12 bp, Homo sapiens
tgagcctgccca

SEQ ID NO: 5950596 - DNA, 23 bp, Homo sapiens
tgagcctgcccagttggaggaga

SEQ ID NO: 5950597 - DNA, 14 bp, Homo sapiens
tgagcctgccccag

SEQ ID NO: 5950598 - DNA, 15 bp, Homo sapiens
tgagcctgcccgctg

SEQ ID NO: 5950599 - DNA, 17 bp, Homo sapiens
tgagcctgccctcactc

SEQ ID NO: 5950600 - DNA, 13 bp, Homo sapiens
tgagcctgccgag

SEQ ID NO: 5950601 - DNA, 13 bp, Homo sapiens
tgagcctgctgga

SEQ ID NO: 5950602 - DNA, 11 bp, Homo sapiens
tgagcctggca

SEQ ID NO: 5950603 - DNA, 12 bp, Homo sapiens
tgagcctggccc

SEQ ID NO: 5950604 - DNA, 18 bp, Homo sapiens
tgagcctggctgtccaac

SEQ ID NO: 5950605 - DNA, 22 bp, Homo sapiens
tgagcctgggaggtcaaggctg

SEQ ID NO: 5950606 - DNA, 13 bp, Homo sapiens
tgagcctgggcca

SEQ ID NO: 5950607 - DNA, 14 bp, Homo sapiens
tgagcctgggccag

SEQ ID NO: 5950608 - DNA, 15 bp, Homo sapiens
tgagcctggtcctgg

SEQ ID NO: 5950609 - DNA, 16 bp, Homo sapiens
tgagcctggtcctggc

SEQ ID NO: 5950610 - DNA, 13 bp, Homo sapiens
tgagcctgtccaa

SEQ ID NO: 5950611 - DNA, 18 bp, Homo sapiens
tgagcctgtgaccttggg

SEQ ID NO: 5950612 - DNA, 20 bp, Homo sapiens
tgagcctgtgcctggctaga

SEQ ID NO: 5950613 - DNA, 20 bp, Homo sapiens
tgagcctgtgggtccccact

SEQ ID NO: 5950614 - DNA, 17 bp, Homo sapiens
tgagcctgtttattgcc

SEQ ID NO: 5950615 - DNA, 17 bp, Homo sapiens
tgagccttagctcccag

SEQ ID NO: 5950616 - DNA, 20 bp, Homo sapiens
tgagccttagctcccagcta

SEQ ID NO: 5950617 - DNA, 17 bp, Homo sapiens
tgagccttattaaaata

SEQ ID NO: 5950618 - DNA, 18 bp, Homo sapiens
tgagccttattaaaatat

SEQ ID NO: 5950619 - DNA, 14 bp, Homo sapiens
tgagccttcagagt

SEQ ID NO: 5950620 - DNA, 18 bp, Homo sapiens
tgagccttcaggccagct

SEQ ID NO: 5950621 - DNA, 18 bp, Homo sapiens
tgagccttcgtgcccccc

SEQ ID NO: 5950622 - DNA, 19 bp, Homo sapiens
tgagccttcgtgccccccc

SEQ ID NO: 5950623 - DNA, 14 bp, Homo sapiens
tgagccttctgagc

SEQ ID NO: 5950624 - DNA, 19 bp, Homo sapiens
tgagccttgaactttgacc

SEQ ID NO: 5950625 - DNA, 15 bp, Homo sapiens
tgagccttgcagata

SEQ ID NO: 5950626 - DNA, 23 bp, Homo sapiens
tgagccttgcagatatctgcatg

SEQ ID NO: 5950627 - DNA, 13 bp, Homo sapiens
tgagccttgtaat

SEQ ID NO: 5950628 - DNA, 23 bp, Homo sapiens
tgagcctttgtgctttttgtcat

SEQ ID NO: 5950629 - DNA, 16 bp, Homo sapiens
tgagccttttcttata

SEQ ID NO: 5950630 - DNA, 15 bp, Homo sapiens
tgagcgaaaacagga

SEQ ID NO: 5950631 - DNA, 17 bp, Homo sapiens
tgagcgaaaacaggaga

SEQ ID NO: 5950632 - DNA, 14 bp, Homo sapiens
tgagcgaagccccc

SEQ ID NO: 5950633 - DNA, 13 bp, Homo sapiens
tgagcgacagtga

SEQ ID NO: 5950634 - DNA, 14 bp, Homo sapiens
tgagcgacagtgag

SEQ ID NO: 5950635 - DNA, 15 bp, Homo sapiens
tgagcgagctgggcc

SEQ ID NO: 5950636 - DNA, 18 bp, Homo sapiens
tgagcgaggaaaaacaac

SEQ ID NO: 5950637 - DNA, 22 bp, Homo sapiens
tgagcgaggagatgctccttgg

SEQ ID NO: 5950638 - DNA, 15 bp, Homo sapiens
tgagcgagtggatgc

SEQ ID NO: 5950639 - DNA, 15 bp, Homo sapiens
tgagcgcaagccaca

SEQ ID NO: 5950640 - DNA, 17 bp, Homo sapiens
tgagcgcaagccacagc

SEQ ID NO: 5950641 - DNA, 18 bp, Homo sapiens
tgagcgcaagccacagcc

SEQ ID NO: 5950642 - DNA, 20 bp, Homo sapiens
tgagcgcaagccacagcctg

SEQ ID NO: 5950643 - DNA, 21 bp, Homo sapiens
tgagcgcaagccacagcctgt

SEQ ID NO: 5950644 - DNA, 23 bp, Homo sapiens
tgagcgcacgcgcgcacacacac

SEQ ID NO: 5950645 - DNA, 18 bp, Homo sapiens
tgagcgccccgcccccac

SEQ ID NO: 5950646 - DNA, 19 bp, Homo sapiens
tgagcgccccgcccccacc

SEQ ID NO: 5950647 - DNA, 21 bp, Homo sapiens
tgaggctcaagaggcccaggg

SEQ ID NO: 5950648 - DNA, 17 bp, Homo sapiens
tgaggctcagccctgag

SEQ ID NO: 5950649 - DNA, 18 bp, Homo sapiens
tgaggctctctaagaaaa

SEQ ID NO: 5950650 - DNA, 20 bp, Homo sapiens
tgaggctctctaagaaaaga

SEQ ID NO: 5950651 - DNA, 21 bp, Homo sapiens
tgaggctctgacccagtgaga

SEQ ID NO: 5950652 - DNA, 18 bp, Homo sapiens
tgaggctctttctgggcc

SEQ ID NO: 5950653 - DNA, 13 bp, Homo sapiens
tgaggctgaggca

SEQ ID NO: 5950654 - DNA, 12 bp, Homo sapiens
tgaggctgcagc

SEQ ID NO: 5950655 - DNA, 22 bp, Homo sapiens
tgaggctgcagcaggtgctggg

SEQ ID NO: 5950656 - DNA, 15 bp, Homo sapiens
tgaggctgctgccag

SEQ ID NO: 5950657 - DNA, 23 bp, Homo sapiens
tgaggctgctgccaggcccggca

SEQ ID NO: 5950658 - DNA, 16 bp, Homo sapiens
tgaggctgctgccatc

SEQ ID NO: 5950659 - DNA, 23 bp, Homo sapiens
tgaggctgctttccaaagccaat

SEQ ID NO: 5950660 - DNA, 21 bp, Homo sapiens
tgaggctggactccagatctg

SEQ ID NO: 5950661 - DNA, 14 bp, Homo sapiens
tgaggctggcacag

SEQ ID NO: 5950662 - DNA, 15 bp, Homo sapiens
tgaggctggcacagg

SEQ ID NO: 5950663 - DNA, 16 bp, Homo sapiens
tgaggctggcatcctg

SEQ ID NO: 5950664 - DNA, 22 bp, Homo sapiens
tgaggctggcatcctggctggc

SEQ ID NO: 5950665 - DNA, 16 bp, Homo sapiens
tgaggctggctggggg

SEQ ID NO: 5950666 - DNA, 21 bp, Homo sapiens
tgaggctggctgggggcagga

SEQ ID NO: 5950667 - DNA, 22 bp, Homo sapiens
tgaggctgggccagcctcagct

SEQ ID NO: 5950668 - DNA, 23 bp, Homo sapiens
tgaggctgggccagcctcagctc

SEQ ID NO: 5950669 - DNA, 16 bp, Homo sapiens
tgaggctgggctccct

SEQ ID NO: 5950670 - DNA, 21 bp, Homo sapiens
tgaggctgggctcccttccca

SEQ ID NO: 5950671 - DNA, 19 bp, Homo sapiens
tgaggctgggggagagccg

SEQ ID NO: 5950672 - DNA, 21 bp, Homo sapiens
tgaggctgggggcgggggagc

SEQ ID NO: 5950673 - DNA, 18 bp, Homo sapiens
tgaggctggtagcagaat

SEQ ID NO: 5950674 - DNA, 18 bp, Homo sapiens
tgaggctgtcctgtacat

SEQ ID NO: 5950675 - DNA, 11 bp, Homo sapiens
tgaggctgtgg

SEQ ID NO: 5950676 - DNA, 21 bp, Homo sapiens
tgaggctgtggtcacagcgga

SEQ ID NO: 5950677 - DNA, 16 bp, Homo sapiens
tgaggcttagagagag

SEQ ID NO: 5950678 - DNA, 23 bp, Homo sapiens
tgaggcttagctttgctctgcca

SEQ ID NO: 5950679 - DNA, 14 bp, Homo sapiens
tgaggcttccaggc

SEQ ID NO: 5950680 - DNA, 22 bp, Homo sapiens
tgaggcttccaggctcttcctg

SEQ ID NO: 5950681 - DNA, 16 bp, Homo sapiens
tgaggcttcttcctgg

SEQ ID NO: 5950682 - DNA, 17 bp, Homo sapiens
tgaggcttcttcctgga

SEQ ID NO: 5950683 - DNA, 23 bp, Homo sapiens
tgaggcttcttcctggatggggc

SEQ ID NO: 5950684 - DNA, 15 bp, Homo sapiens
tgaggcttgctgaga

SEQ ID NO: 5950685 - DNA, 17 bp, Homo sapiens
tgaggcttgctgagagg

SEQ ID NO: 5950686 - DNA, 17 bp, Homo sapiens
tgaggcttgggcccagt

SEQ ID NO: 5950687 - DNA, 19 bp, Homo sapiens
tgaggcttgggcccagtag

SEQ ID NO: 5950688 - DNA, 14 bp, Homo sapiens
tgagggaaaacata

SEQ ID NO: 5950689 - DNA, 21 bp, Homo sapiens
tgagggaaagagcttataaaa

SEQ ID NO: 5950690 - DNA, 21 bp, Homo sapiens
tgagggaaagtgcatatgaaa

SEQ ID NO: 5950691 - DNA, 16 bp, Homo sapiens
tgagggaaatctgtaa

SEQ ID NO: 5950692 - DNA, 17 bp, Homo sapiens
tgagggaacagacagga

SEQ ID NO: 5950693 - DNA, 17 bp, Homo sapiens
tgagggaagagtagctg

SEQ ID NO: 5950694 - DNA, 12 bp, Homo sapiens
tgagggaagccc

SEQ ID NO: 5950695 - DNA, 15 bp, Homo sapiens
tgagggaagcccacc

SEQ ID NO: 5950696 - DNA, 16 bp, Homo sapiens
tgagggaagcccaccc

SEQ ID NO: 5950697 - DNA, 21 bp, Homo sapiens
tgagggaaggagcccagccag

SEQ ID NO: 5950698 - DNA, 17 bp, Homo sapiens
tgagggacagagcccca

SEQ ID NO: 5950699 - DNA, 13 bp, Homo sapiens
tgagggacatgct

SEQ ID NO: 5950700 - DNA, 18 bp, Homo sapiens
tgagggaccagccaagag

SEQ ID NO: 5950701 - DNA, 21 bp, Homo sapiens
tgagggaccgagcccagcaga

SEQ ID NO: 5950702 - DNA, 19 bp, Homo sapiens
tgagggaccttggagagct

SEQ ID NO: 5950703 - DNA, 15 bp, Homo sapiens
tgagggacgagcaga

SEQ ID NO: 5950704 - DNA, 19 bp, Homo sapiens
tgagggacgagcagagcgc

SEQ ID NO: 5950705 - DNA, 23 bp, Homo sapiens
tgagggacgagcagagcgcagcc

SEQ ID NO: 5950706 - DNA, 13 bp, Homo sapiens
tgagggacgtggt

SEQ ID NO: 5950707 - DNA, 13 bp, Homo sapiens
tgagggactctga

SEQ ID NO: 5950708 - DNA, 18 bp, Homo sapiens
tgagggagaatcctccct

SEQ ID NO: 5950709 - DNA, 17 bp, Homo sapiens
tgagggagacagaccac

SEQ ID NO: 5950710 - DNA, 13 bp, Homo sapiens
tgagggagagact

SEQ ID NO: 5950711 - DNA, 23 bp, Homo sapiens
tgagggaggacaggcgggaggag

SEQ ID NO: 5950712 - DNA, 15 bp, Homo sapiens
tgagggaggacctgg

SEQ ID NO: 5950713 - DNA, 19 bp, Homo sapiens
tgagggaggacctggggca

SEQ ID NO: 5950714 - DNA, 22 bp, Homo sapiens
tgagggaggacctggggcacag

SEQ ID NO: 5950715 - DNA, 13 bp, Homo sapiens
tgagggaggaggc

SEQ ID NO: 5950716 - DNA, 18 bp, Homo sapiens
tgagggaggaggccacct

SEQ ID NO: 5950717 - DNA, 13 bp, Homo sapiens
tgagggaggcaga

SEQ ID NO: 5950718 - DNA, 18 bp, Homo sapiens
tgagggaggcagaaaggg

SEQ ID NO: 5950719 - DNA, 20 bp, Homo sapiens
tgagggagggagccatggaa

SEQ ID NO: 5950720 - DNA, 21 bp, Homo sapiens
tgagggagggggcgctcagga

SEQ ID NO: 5950721 - DNA, 14 bp, Homo sapiens
tgagggagttaggg

SEQ ID NO: 5950722 - DNA, 23 bp, Homo sapiens
tgagggataaccccaggcactgt

SEQ ID NO: 5950723 - DNA, 17 bp, Homo sapiens
tgagggataagcaaaag

SEQ ID NO: 5950724 - DNA, 19 bp, Homo sapiens
tgagggatacccatcccat

SEQ ID NO: 5950725 - DNA, 18 bp, Homo sapiens
tgagggatcactgccaaa

SEQ ID NO: 5950726 - DNA, 21 bp, Homo sapiens
tgagggatgccataccttgag

SEQ ID NO: 5950727 - DNA, 19 bp, Homo sapiens
tgagggatgggcctggcat

SEQ ID NO: 5950728 - DNA, 18 bp, Homo sapiens
tgagggcaaaccaggctg

SEQ ID NO: 5950729 - DNA, 13 bp, Homo sapiens
tgagggcaaagat

SEQ ID NO: 5950730 - DNA, 23 bp, Homo sapiens
tgagggcaaagatggtggctgtg

SEQ ID NO: 5950731 - DNA, 13 bp, Homo sapiens
tgagggcaagggg

SEQ ID NO: 5950732 - DNA, 22 bp, Homo sapiens
tgagggcactctctgccagctc

SEQ ID NO: 5950733 - DNA, 18 bp, Homo sapiens
tgagggcagactggggca

SEQ ID NO: 5950734 - DNA, 14 bp, Homo sapiens
tgagggcagcagcc

SEQ ID NO: 5950735 - DNA, 16 bp, Homo sapiens
tgagggcagcagccag

SEQ ID NO: 5950736 - DNA, 17 bp, Homo sapiens
tgagggcagcagccagc

SEQ ID NO: 5950737 - DNA, 18 bp, Homo sapiens
tgagggcagcagccagcc

SEQ ID NO: 5950738 - DNA, 23 bp, Homo sapiens
tgagggcagcagccagccctgcc

SEQ ID NO: 5950739 - DNA, 17 bp, Homo sapiens
tgagggcagtgcccttt

SEQ ID NO: 5950740 - DNA, 19 bp, Homo sapiens
tgagggcagtggggagcat

SEQ ID NO: 5950741 - DNA, 18 bp, Homo sapiens
tgagggcagttcgcagcc

SEQ ID NO: 5950742 - DNA, 20 bp, Homo sapiens
tgagggcagttcgcagccac

SEQ ID NO: 5950743 - DNA, 21 bp, Homo sapiens
tgagggcagttcgcagccacc

SEQ ID NO: 5950744 - DNA, 17 bp, Homo sapiens
tgagggcatctctgagt

SEQ ID NO: 5950745 - DNA, 14 bp, Homo sapiens
tgagggcatgtgcg

SEQ ID NO: 5950746 - DNA, 21 bp, Homo sapiens
tgagggcattaaaaatagtaa

SEQ ID NO: 5950747 - DNA, 20 bp, Homo sapiens
tgagggcatttggcttcctc

SEQ ID NO: 5950748 - DNA, 21 bp, Homo sapiens
tgagggcatttggcttcctct

SEQ ID NO: 5950749 - DNA, 22 bp, Homo sapiens
tgagggcatttggcttcctctg

SEQ ID NO: 5950750 - DNA, 22 bp, Homo sapiens
tgagggccaccaggaagcacag

SEQ ID NO: 5950751 - DNA, 20 bp, Homo sapiens
tgagggccacctccacaccc

SEQ ID NO: 5950752 - DNA, 13 bp, Homo sapiens
tgagggccagtga

SEQ ID NO: 5950753 - DNA, 14 bp, Homo sapiens
tgagggccagtgat

SEQ ID NO: 5950754 - DNA, 13 bp, Homo sapiens
tgagggcccagag

SEQ ID NO: 5950755 - DNA, 14 bp, Homo sapiens
tgagggcccagagc

SEQ ID NO: 5950756 - DNA, 16 bp, Homo sapiens
tgagggcccagagcag

SEQ ID NO: 5950757 - DNA, 18 bp, Homo sapiens
tgagggcccagagcagga

SEQ ID NO: 5950758 - DNA, 13 bp, Homo sapiens
tgagggcccagcc

SEQ ID NO: 5950759 - DNA, 16 bp, Homo sapiens
tgagggcccagccagg

SEQ ID NO: 5950760 - DNA, 17 bp, Homo sapiens
tgagggcccagccagga

SEQ ID NO: 5950761 - DNA, 19 bp, Homo sapiens
tgagggcccagccaggagc

SEQ ID NO: 5950762 - DNA, 21 bp, Homo sapiens
tgagggcccagccaggagcag

SEQ ID NO: 5950763 - DNA, 15 bp, Homo sapiens
tgagggcccctctgc

SEQ ID NO: 5950764 - DNA, 16 bp, Homo sapiens
tgagggcccctctgcc

SEQ ID NO: 5950765 - DNA, 18 bp, Homo sapiens
tgagggcccgtgtaaata

SEQ ID NO: 5950766 - DNA, 18 bp, Homo sapiens
tgagggcctcagagcctg

SEQ ID NO: 5950767 - DNA, 19 bp, Homo sapiens
tgagggcctcagagcctga

SEQ ID NO: 5950768 - DNA, 18 bp, Homo sapiens
tgagggcctgctggaggc

SEQ ID NO: 5950769 - DNA, 19 bp, Homo sapiens
tgagggcctgctggaggcc

SEQ ID NO: 5950770 - DNA, 14 bp, Homo sapiens
tgagggccttctta

SEQ ID NO: 5950771 - DNA, 16 bp, Homo sapiens
tgagggcggggtgtct

SEQ ID NO: 5950772 - DNA, 19 bp, Homo sapiens
tgagggcgtgaaacacaat

SEQ ID NO: 5950773 - DNA, 22 bp, Homo sapiens
tgagggctaaaaaggtcctgta

SEQ ID NO: 5950774 - DNA, 17 bp, Homo sapiens
tgagggctctgtttgtg

SEQ ID NO: 5950775 - DNA, 16 bp, Homo sapiens
tgagggctgacaaggc

SEQ ID NO: 5950776 - DNA, 13 bp, Homo sapiens
tgagggctgcagt

SEQ ID NO: 5950777 - DNA, 17 bp, Homo sapiens
tgagggctgccagcagc

SEQ ID NO: 5950778 - DNA, 21 bp, Homo sapiens
tgagggctgccagcagccccg

SEQ ID NO: 5950779 - DNA, 13 bp, Homo sapiens
tgagggcttgtag

SEQ ID NO: 5950780 - DNA, 22 bp, Homo sapiens
tgaggggaagccattttccagt

SEQ ID NO: 5950781 - DNA, 13 bp, Homo sapiens
tgaggggaatctg

SEQ ID NO: 5950782 - DNA, 13 bp, Homo sapiens
tgaggggaccagg

SEQ ID NO: 5950783 - DNA, 15 bp, Homo sapiens
tgaggggaccaggag

SEQ ID NO: 5950784 - DNA, 21 bp, Homo sapiens
tgaggggagcatgcttccctg

SEQ ID NO: 5950785 - DNA, 14 bp, Homo sapiens
tgaggggagccagg

SEQ ID NO: 5950786 - DNA, 18 bp, Homo sapiens
tgaggggagccaggaggg

SEQ ID NO: 5950787 - DNA, 14 bp, Homo sapiens
tgaggggaggggcc

SEQ ID NO: 5950788 - DNA, 23 bp, Homo sapiens
tgaggggaggggcctcccccagc

SEQ ID NO: 5950789 - DNA, 15 bp, Homo sapiens
tgaggggaggggggc

SEQ ID NO: 5950790 - DNA, 14 bp, Homo sapiens
tgaggggaggtggc

SEQ ID NO: 5950791 - DNA, 16 bp, Homo sapiens
tgaggggaggtggcca

SEQ ID NO: 5950792 - DNA, 21 bp, Homo sapiens
tgaggggaggtggccagcccg

SEQ ID NO: 5950793 - DNA, 16 bp, Homo sapiens
tgaggggattctctac

SEQ ID NO: 5950794 - DNA, 18 bp, Homo sapiens
tgaggggcagcctgcctt

SEQ ID NO: 5950795 - DNA, 13 bp, Homo sapiens
tgaggggcaggac

SEQ ID NO: 5950796 - DNA, 17 bp, Homo sapiens
tgaggggcatctgcccc

SEQ ID NO: 5950797 - DNA, 23 bp, Homo sapiens
tgaggggccaccccgtgcccctg

SEQ ID NO: 5950798 - DNA, 13 bp, Homo sapiens
tgaggggccactg

SEQ ID NO: 5950799 - DNA, 23 bp, Homo sapiens
tgaggggccactgacccacctgc

SEQ ID NO: 5950800 - DNA, 18 bp, Homo sapiens
tgaggggccaggggcagg

SEQ ID NO: 5950801 - DNA, 19 bp, Homo sapiens
tgaggggccaggggcaggc

SEQ ID NO: 5950802 - DNA, 23 bp, Homo sapiens
tgaggggccccagcgtctgcagg

SEQ ID NO: 5950803 - DNA, 21 bp, Homo sapiens
tgaggggcccctggcccagga

SEQ ID NO: 5950804 - DNA, 16 bp, Homo sapiens
tgaggggcctgcgccc

SEQ ID NO: 5950805 - DNA, 22 bp, Homo sapiens
tgaggggcctgcgcccagagct

SEQ ID NO: 5950806 - DNA, 16 bp, Homo sapiens
tgaggggctaccagga

SEQ ID NO: 5950807 - DNA, 19 bp, Homo sapiens
tgaggggctaccctgggaa

SEQ ID NO: 5950808 - DNA, 15 bp, Homo sapiens
tgaggggctccgggt

SEQ ID NO: 5950809 - DNA, 17 bp, Homo sapiens
tgaggggctggggaggg

SEQ ID NO: 5950810 - DNA, 14 bp, Homo sapiens
tgaggggctgtgac

SEQ ID NO: 5950811 - DNA, 22 bp, Homo sapiens
tgaggggcttccctctgctcca

SEQ ID NO: 5950812 - DNA, 17 bp, Homo sapiens
tgagggggaattcctgg

SEQ ID NO: 5950813 - DNA, 18 bp, Homo sapiens
tgagggggaattcctgga

SEQ ID NO: 5950814 - DNA, 19 bp, Homo sapiens
tgagggggctcagttctgg

SEQ ID NO: 5950815 - DNA, 22 bp, Homo sapiens
tgaggggggccgtgcccagggg

SEQ ID NO: 5950816 - DNA, 16 bp, Homo sapiens
tgagggggtcatgccg

SEQ ID NO: 5950817 - DNA, 18 bp, Homo sapiens
tgaggggtaaaagctgat

SEQ ID NO: 5950818 - DNA, 23 bp, Homo sapiens
tgaggggtcgacttcgggctggc

SEQ ID NO: 5950819 - DNA, 18 bp, Homo sapiens
tgaggggtgtccgagagg

SEQ ID NO: 5950820 - DNA, 22 bp, Homo sapiens
tgaggggtgtccgagaggctgg

SEQ ID NO: 5950821 - DNA, 19 bp, Homo sapiens
tgaggggttacctccctcg

SEQ ID NO: 5950822 - DNA, 18 bp, Homo sapiens
tgaggggttcctcccctc

SEQ ID NO: 5950823 - DNA, 23 bp, Homo sapiens
tgagtacagagtgtggactctgg

SEQ ID NO: 5950824 - DNA, 15 bp, Homo sapiens
tgagtacagcagaaa

SEQ ID NO: 5950825 - DNA, 20 bp, Homo sapiens
tgagtacatgcacactcatg

SEQ ID NO: 5950826 - DNA, 16 bp, Homo sapiens
tgagtaccaggggctg

SEQ ID NO: 5950827 - DNA, 17 bp, Homo sapiens
tgagtaccaggggctgg

SEQ ID NO: 5950828 - DNA, 21 bp, Homo sapiens
tgagtacccctgctttgggct

SEQ ID NO: 5950829 - DNA, 19 bp, Homo sapiens
tgagtacctgcaaaaatga

SEQ ID NO: 5950830 - DNA, 24 bp, Homo sapiens
tgagtacggatgggaaactattgt

SEQ ID NO: 5950831 - DNA, 16 bp, Homo sapiens
tgagtacgttgtgcat

SEQ ID NO: 5950832 - DNA, 18 bp, Homo sapiens
tgagtacgttgtgcattt

SEQ ID NO: 5950833 - DNA, 19 bp, Homo sapiens
tgagtacgttgtgcatttg

SEQ ID NO: 5950834 - DNA, 17 bp, Homo sapiens
tgagtactacagtcctc

SEQ ID NO: 5950835 - DNA, 21 bp, Homo sapiens
tgagtactacagtcctcccat

SEQ ID NO: 5950836 - DNA, 22 bp, Homo sapiens
tgagtactacagtcctcccatc

SEQ ID NO: 5950837 - DNA, 14 bp, Homo sapiens
tgagtactggaata

SEQ ID NO: 5950838 - DNA, 15 bp, Homo sapiens
tgagtactggaataa

SEQ ID NO: 5950839 - DNA, 22 bp, Homo sapiens
tgagtactgttaagaataataa

SEQ ID NO: 5950840 - DNA, 17 bp, Homo sapiens
tgagtagaaaggccttt

SEQ ID NO: 5950841 - DNA, 14 bp, Homo sapiens
tgagtagagttgat

SEQ ID NO: 5950842 - DNA, 14 bp, Homo sapiens
tgagtagatattac

SEQ ID NO: 5950843 - DNA, 22 bp, Homo sapiens
tgagtagctctgcctttgctct

SEQ ID NO: 5950844 - DNA, 12 bp, Homo sapiens
tgagtagctggg

SEQ ID NO: 5950845 - DNA, 13 bp, Homo sapiens
tgagtagctggga

SEQ ID NO: 5950846 - DNA, 13 bp, Homo sapiens
tgagtagctgggc

SEQ ID NO: 5950847 - DNA, 22 bp, Homo sapiens
tgagtagctgggcctgtgcact

SEQ ID NO: 5950848 - DNA, 15 bp, Homo sapiens
tgagtaggccctgct

SEQ ID NO: 5950849 - DNA, 14 bp, Homo sapiens
tgagtagtctcatg

SEQ ID NO: 5950850 - DNA, 20 bp, Homo sapiens
tgagtagtcttatgtaaagt

SEQ ID NO: 5950851 - DNA, 22 bp, Homo sapiens
tgagtagtcttatgtaaagtat

SEQ ID NO: 5950852 - DNA, 19 bp, Homo sapiens
tgagtagttactaaaattt

SEQ ID NO: 5950853 - DNA, 21 bp, Homo sapiens
tgagtataaaataaagcaaat

SEQ ID NO: 5950854 - DNA, 19 bp, Homo sapiens
tgagtataagataaaataa

SEQ ID NO: 5950855 - DNA, 23 bp, Homo sapiens
tgagtataatacattacatgtaa

SEQ ID NO: 5950856 - DNA, 16 bp, Homo sapiens
tgagtataatgaacac

SEQ ID NO: 5950857 - DNA, 18 bp, Homo sapiens
tgagtatacaatatataa

SEQ ID NO: 5950858 - DNA, 14 bp, Homo sapiens
tgagtatatgtaac

SEQ ID NO: 5950859 - DNA, 23 bp, Homo sapiens
tgagtatcataatatattgtgtt

SEQ ID NO: 5950860 - DNA, 15 bp, Homo sapiens
tgagtatctgtggga

SEQ ID NO: 5950861 - DNA, 19 bp, Homo sapiens
tgagtatgcttgggccctg

SEQ ID NO: 5950862 - DNA, 21 bp, Homo sapiens
tgagtatgcttgggccctgca

SEQ ID NO: 5950863 - DNA, 16 bp, Homo sapiens
tgagtatgtgaagata

SEQ ID NO: 5950864 - DNA, 12 bp, Homo sapiens
tgagtatgtgtg

SEQ ID NO: 5950865 - DNA, 14 bp, Homo sapiens
tgagtattaaaatg

SEQ ID NO: 5950866 - DNA, 17 bp, Homo sapiens
tgagtattaaaatgtat

SEQ ID NO: 5950867 - DNA, 16 bp, Homo sapiens
tgagtattacacatta

SEQ ID NO: 5950868 - DNA, 18 bp, Homo sapiens
tgagtattccatgagctg

SEQ ID NO: 5950869 - DNA, 13 bp, Homo sapiens
tgagtattctcat

SEQ ID NO: 5950870 - DNA, 21 bp, Homo sapiens
tgagtattgtttaaaatgtaa

SEQ ID NO: 5950871 - DNA, 15 bp, Homo sapiens
tgagtatttgctgtt

SEQ ID NO: 5950872 - DNA, 12 bp, Homo sapiens
tgagtatttggt

SEQ ID NO: 5950873 - DNA, 19 bp, Homo sapiens
tgagtatttggtccaaaaa

SEQ ID NO: 5950874 - DNA, 15 bp, Homo sapiens
tgagtcaaaacaaag

SEQ ID NO: 5950875 - DNA, 15 bp, Homo sapiens
tgagtcaaaagcctg

SEQ ID NO: 5950876 - DNA, 18 bp, Homo sapiens
tgagtcaaatccagtggt

SEQ ID NO: 5950877 - DNA, 21 bp, Homo sapiens
tgagtcaaatccagtggtggg

SEQ ID NO: 5950878 - DNA, 18 bp, Homo sapiens
tgagtcaagttgttcctt

SEQ ID NO: 5950879 - DNA, 17 bp, Homo sapiens
tgagtcaatcagccttt

SEQ ID NO: 5950880 - DNA, 18 bp, Homo sapiens
tgagtcaatcagccttta

SEQ ID NO: 5950881 - DNA, 14 bp, Homo sapiens
tgagtcaccaagcc

SEQ ID NO: 5950882 - DNA, 17 bp, Homo sapiens
tgagtcaccaagcccag

SEQ ID NO: 5950883 - DNA, 18 bp, Homo sapiens
tgagtcaccaagcccagt

SEQ ID NO: 5950884 - DNA, 20 bp, Homo sapiens
tgagtcaccctacctgtgcc

SEQ ID NO: 5950885 - DNA, 15 bp, Homo sapiens
tgagtcacctgctcc

SEQ ID NO: 5950886 - DNA, 16 bp, Homo sapiens
tgagtcacctgctcca

SEQ ID NO: 5950887 - DNA, 22 bp, Homo sapiens
tgagtcacgctggggctctctg

SEQ ID NO: 5950888 - DNA, 14 bp, Homo sapiens
tgagtcagaaaaca

SEQ ID NO: 5950889 - DNA, 17 bp, Homo sapiens
tgagtcagaatgtgaaa

SEQ ID NO: 5950890 - DNA, 21 bp, Homo sapiens
tgagtcagaggacaccatcca

SEQ ID NO: 5950891 - DNA, 13 bp, Homo sapiens
tgagtcagcacct

SEQ ID NO: 5950892 - DNA, 15 bp, Homo sapiens
tgagtcagcaccttg

SEQ ID NO: 5950893 - DNA, 22 bp, Homo sapiens
tgagtcagggcccagaggctga

SEQ ID NO: 5950894 - DNA, 20 bp, Homo sapiens
tgagtcaggtttgagtagag

SEQ ID NO: 5950895 - DNA, 20 bp, Homo sapiens
tgagtcagtctctctctccc

SEQ ID NO: 5950896 - DNA, 14 bp, Homo sapiens
tgagtcagtctctt

SEQ ID NO: 5950897 - DNA, 14 bp, Homo sapiens
tgagtcagtgaagt

SEQ ID NO: 5950898 - DNA, 16 bp, Homo sapiens
tgagtcagtgctctca

SEQ ID NO: 5950899 - DNA, 17 bp, Homo sapiens
tgagtcatcaaaaagag

SEQ ID NO: 5950900 - DNA, 17 bp, Homo sapiens
tgagtcatgtctttcct

SEQ ID NO: 5950901 - DNA, 15 bp, Homo sapiens
tgagtcattatgtag

SEQ ID NO: 5950902 - DNA, 12 bp, Homo sapiens
tgagtcattgac

SEQ ID NO: 5950903 - DNA, 14 bp, Homo sapiens
tgagtcattgactt

SEQ ID NO: 5950904 - DNA, 16 bp, Homo sapiens
tgagtcattgacttca

SEQ ID NO: 5950905 - DNA, 13 bp, Homo sapiens
tgagtcatttaaa

SEQ ID NO: 5950906 - DNA, 16 bp, Homo sapiens
tgagtcatttaaatgt

SEQ ID NO: 5950907 - DNA, 13 bp, Homo sapiens
tgagtccacgccc

SEQ ID NO: 5950908 - DNA, 19 bp, Homo sapiens
tgagtccacgcccaccagc

SEQ ID NO: 5950909 - DNA, 21 bp, Homo sapiens
tgagtccacgcccaccagcct

SEQ ID NO: 5950910 - DNA, 14 bp, Homo sapiens
tgagtccagagctt

SEQ ID NO: 5950911 - DNA, 17 bp, Homo sapiens
tgagtccagctttcctt

SEQ ID NO: 5950912 - DNA, 14 bp, Homo sapiens
tgagtccatgaaaa

SEQ ID NO: 5950913 - DNA, 19 bp, Homo sapiens
tgagtccattctcccaggt

SEQ ID NO: 5950914 - DNA, 20 bp, Homo sapiens
tgagtcccaggagctgccca

SEQ ID NO: 5950915 - DNA, 21 bp, Homo sapiens
tgagtcccaggctgagcctca

SEQ ID NO: 5950916 - DNA, 15 bp, Homo sapiens
tgagtcccagtggga

SEQ ID NO: 5950917 - DNA, 16 bp, Homo sapiens
tgagtcccagtgggag

SEQ ID NO: 5950918 - DNA, 19 bp, Homo sapiens
tgagtcccagtgggaggcg

SEQ ID NO: 5950919 - DNA, 15 bp, Homo sapiens
tgagtccccacctgc

SEQ ID NO: 5950920 - DNA, 21 bp, Homo sapiens
tgagtccccacctgcggctcc

SEQ ID NO: 5950921 - DNA, 14 bp, Homo sapiens
tgagtcccctactc

SEQ ID NO: 5950922 - DNA, 16 bp, Homo sapiens
tgagtcccctccagga

SEQ ID NO: 5950923 - DNA, 16 bp, Homo sapiens
tgagtccctccatgca

SEQ ID NO: 5950924 - DNA, 12 bp, Homo sapiens
tgagtccctgct

SEQ ID NO: 5950925 - DNA, 21 bp, Homo sapiens
tgagtccgcctgcgcctccat

SEQ ID NO: 5950926 - DNA, 15 bp, Homo sapiens
tgagtcctaggactt

SEQ ID NO: 5950927 - DNA, 17 bp, Homo sapiens
tgagtcctaggacttaa

SEQ ID NO: 5950928 - DNA, 13 bp, Homo sapiens
tgagtcctggggt

SEQ ID NO: 5950929 - DNA, 16 bp, Homo sapiens
tgagtcctggtccctc

SEQ ID NO: 5950930 - DNA, 19 bp, Homo sapiens
tgagtcctgtctctgcctg

SEQ ID NO: 5950931 - DNA, 18 bp, Homo sapiens
tgagtccttgatttcaaa

SEQ ID NO: 5950932 - DNA, 14 bp, Homo sapiens
tgagtcgaggacag

SEQ ID NO: 5950933 - DNA, 19 bp, Homo sapiens
tgagtcgaggacagggagg

SEQ ID NO: 5950934 - DNA, 23 bp, Homo sapiens
tgagtcggccccacatgggaacc

SEQ ID NO: 5950935 - DNA, 17 bp, Homo sapiens
tgagtcggctgggcagg

SEQ ID NO: 5950936 - DNA, 19 bp, Homo sapiens
tgagtcggctgggcagggc

SEQ ID NO: 5950937 - DNA, 16 bp, Homo sapiens
tgagtctacctgagca

SEQ ID NO: 5950938 - DNA, 19 bp, Homo sapiens
tgagtctatcctagtcttc

SEQ ID NO: 5950939 - DNA, 17 bp, Homo sapiens
tgagtctatgttcaaag

SEQ ID NO: 5950940 - DNA, 20 bp, Homo sapiens
tgagtctatgttcaaagact

SEQ ID NO: 5950941 - DNA, 23 bp, Homo sapiens
tgagtctcattcctctgtccccg

SEQ ID NO: 5950942 - DNA, 14 bp, Homo sapiens
tgagtctccagggc

SEQ ID NO: 5950943 - DNA, 23 bp, Homo sapiens
tgagtctcccaaggctgcgtctg

SEQ ID NO: 5950944 - DNA, 15 bp, Homo sapiens
tgagtctctctgggc

SEQ ID NO: 5950945 - DNA, 22 bp, Homo sapiens
tgagtctctggggcaggctgct

SEQ ID NO: 5950946 - DNA, 14 bp, Homo sapiens
tgagtctcttcaga

SEQ ID NO: 5950947 - DNA, 20 bp, Homo sapiens
tgagtctcttttttattctg

SEQ ID NO: 5950948 - DNA, 16 bp, Homo sapiens
tgagtctgaattctgc

SEQ ID NO: 5950949 - DNA, 21 bp, Homo sapiens
tgagtctgaattctgctctaa

SEQ ID NO: 5950950 - DNA, 15 bp, Homo sapiens
tgagtctgaggcccc

SEQ ID NO: 5950951 - DNA, 18 bp, Homo sapiens
tgagtctgagtcctgtct

SEQ ID NO: 5950952 - DNA, 20 bp, Homo sapiens
tgagtctggacctccatccc

SEQ ID NO: 5950953 - DNA, 18 bp, Homo sapiens
tgagtctgggatattctt

SEQ ID NO: 5950954 - DNA, 16 bp, Homo sapiens
tgagtctggtggagga

SEQ ID NO: 5950955 - DNA, 18 bp, Homo sapiens
tgagtctggtggaggagc

SEQ ID NO: 5950956 - DNA, 12 bp, Homo sapiens
tgagtctgtaat

SEQ ID NO: 5950957 - DNA, 21 bp, Homo sapiens
tgagtctgtactaaacagtaa

SEQ ID NO: 5950958 - DNA, 16 bp, Homo sapiens
tgagtctgtcataata

SEQ ID NO: 5950959 - DNA, 17 bp, Homo sapiens
tgagtctgtccagataa

SEQ ID NO: 5950960 - DNA, 18 bp, Homo sapiens
tgagtctgtccagataag

SEQ ID NO: 5950961 - DNA, 20 bp, Homo sapiens
tgagtctgtccagataagtt

SEQ ID NO: 5950962 - DNA, 13 bp, Homo sapiens
tgagtctgtggac

SEQ ID NO: 5950963 - DNA, 17 bp, Homo sapiens
tgagtctgttctggtaa

SEQ ID NO: 5950964 - DNA, 13 bp, Homo sapiens
tgagtctgtttcc

SEQ ID NO: 5950965 - DNA, 19 bp, Homo sapiens
tgagtctgtttcccaagct

SEQ ID NO: 5950966 - DNA, 20 bp, Homo sapiens
tgagtctgtttcccaagcta

SEQ ID NO: 5950967 - DNA, 18 bp, Homo sapiens
tgagtctgttttgtaaag

SEQ ID NO: 5950968 - DNA, 13 bp, Homo sapiens
tgagtcttaactg

SEQ ID NO: 5950969 - DNA, 20 bp, Homo sapiens
tgagtcttaactgtatttca

SEQ ID NO: 5950970 - DNA, 16 bp, Homo sapiens
tgagtcttcacattta

SEQ ID NO: 5950971 - DNA, 20 bp, Homo sapiens
tgagtcttggttctaaaggt

SEQ ID NO: 5950972 - DNA, 19 bp, Homo sapiens
tgagtctttgaagatagtt

SEQ ID NO: 5950973 - DNA, 18 bp, Homo sapiens
tgagtctttggttctaag

SEQ ID NO: 5950974 - DNA, 12 bp, Homo sapiens
tgagtctttttt

SEQ ID NO: 5950975 - DNA, 15 bp, Homo sapiens
tgagtgaaatattac

SEQ ID NO: 5950976 - DNA, 12 bp, Homo sapiens
tgagtgaacacc

SEQ ID NO: 5950977 - DNA, 15 bp, Homo sapiens
tgagtgaaggaaatg

SEQ ID NO: 5950978 - DNA, 20 bp, Homo sapiens
tgagtgaagtattgctgaaa

SEQ ID NO: 5950979 - DNA, 22 bp, Homo sapiens
tgagtgaagtattgctgaaaag

SEQ ID NO: 5950980 - DNA, 17 bp, Homo sapiens
tgagtgaatcaaagtgt

SEQ ID NO: 5950981 - DNA, 20 bp, Homo sapiens
tgagtgaattgtacctattt

SEQ ID NO: 5950982 - DNA, 14 bp, Homo sapiens
tgagtgacagcttt

SEQ ID NO: 5950983 - DNA, 16 bp, Homo sapiens
tgagtgacagctttct

SEQ ID NO: 5950984 - DNA, 23 bp, Homo sapiens
tgagtgacagctttctgggatgt

SEQ ID NO: 5950985 - DNA, 18 bp, Homo sapiens
tgagtgacatgcggctgc

SEQ ID NO: 5950986 - DNA, 22 bp, Homo sapiens
tgagtgaccgggggctgctggg

SEQ ID NO: 5950987 - DNA, 18 bp, Homo sapiens
tgagtgacctccttctgc

SEQ ID NO: 5950988 - DNA, 17 bp, Homo sapiens
tgagtgagaagagcttg

SEQ ID NO: 5950989 - DNA, 13 bp, Homo sapiens
tgagtgagaatat

SEQ ID NO: 5950990 - DNA, 14 bp, Homo sapiens
tgagtgagcatgcc

SEQ ID NO: 5950991 - DNA, 18 bp, Homo sapiens
tgagtgagccacagacca

SEQ ID NO: 5950992 - DNA, 14 bp, Homo sapiens
tgagtgagccggga

SEQ ID NO: 5950993 - DNA, 16 bp, Homo sapiens
tgagtgagcctggctc

SEQ ID NO: 5950994 - DNA, 20 bp, Homo sapiens
tgagtgaggagtggacgctg

SEQ ID NO: 5950995 - DNA, 15 bp, Homo sapiens
tgagtgagtgtgtgt

SEQ ID NO: 5950996 - DNA, 19 bp, Homo sapiens
tgagtgagttcaactacat

SEQ ID NO: 5950997 - DNA, 20 bp, Homo sapiens
tgagtgatcctccaacttca

SEQ ID NO: 5950998 - DNA, 22 bp, Homo sapiens
tgagtgattgacacacagcact

SEQ ID NO: 5950999 - DNA, 22 bp, Homo sapiens
tgagtgcaaacttcagagttct

SEQ ID NO: 5951000 - DNA, 22 bp, Homo sapiens
tgagtgcaaatccatagcacaa

SEQ ID NO: 5951001 - DNA, 14 bp, Homo sapiens
tgatactgctgctt

SEQ ID NO: 5951002 - DNA, 20 bp, Homo sapiens
tgatactgggtacaagagcc

SEQ ID NO: 5951003 - DNA, 14 bp, Homo sapiens
tgatactgtctaag

SEQ ID NO: 5951004 - DNA, 13 bp, Homo sapiens
tgatactgtctct

SEQ ID NO: 5951005 - DNA, 13 bp, Homo sapiens
tgatactgtcttt

SEQ ID NO: 5951006 - DNA, 13 bp, Homo sapiens
tgatactgtttct

SEQ ID NO: 5951007 - DNA, 22 bp, Homo sapiens
tgatactgtttcttgcactgaa

SEQ ID NO: 5951008 - DNA, 23 bp, Homo sapiens
tgatactgtttcttgcactgaat

SEQ ID NO: 5951009 - DNA, 14 bp, Homo sapiens
tgatacttatattt

SEQ ID NO: 5951010 - DNA, 16 bp, Homo sapiens
tgatacttatattttc

SEQ ID NO: 5951011 - DNA, 21 bp, Homo sapiens
tgatacttatttataacattg

SEQ ID NO: 5951012 - DNA, 16 bp, Homo sapiens
tgatacttcatttaaa

SEQ ID NO: 5951013 - DNA, 19 bp, Homo sapiens
tgatacttccaagtgataa

SEQ ID NO: 5951014 - DNA, 20 bp, Homo sapiens
tgatacttgaattttttgaa

SEQ ID NO: 5951015 - DNA, 15 bp, Homo sapiens
tgatacttttaagag

SEQ ID NO: 5951016 - DNA, 15 bp, Homo sapiens
tgatacttttgacaa

SEQ ID NO: 5951017 - DNA, 16 bp, Homo sapiens
tgatacttttttgaaa

SEQ ID NO: 5951018 - DNA, 17 bp, Homo sapiens
tgatacttttttgaaat

SEQ ID NO: 5951019 - DNA, 14 bp, Homo sapiens
tgatagaaaagtgt

SEQ ID NO: 5951020 - DNA, 18 bp, Homo sapiens
tgatagaaagaataaaat

SEQ ID NO: 5951021 - DNA, 19 bp, Homo sapiens
tgatagaaatgccaagcac

SEQ ID NO: 5951022 - DNA, 13 bp, Homo sapiens
tgatagaactgta

SEQ ID NO: 5951023 - DNA, 16 bp, Homo sapiens
tgatagaactgtactg

SEQ ID NO: 5951024 - DNA, 17 bp, Homo sapiens
tgatagaactgtactgt

SEQ ID NO: 5951025 - DNA, 24 bp, Homo sapiens
tgatagaagaaggactgaagaaaa

SEQ ID NO: 5951026 - DNA, 21 bp, Homo sapiens
tgatagaatgatgttttaaaa

SEQ ID NO: 5951027 - DNA, 20 bp, Homo sapiens
tgatagacaagtagttaaga

SEQ ID NO: 5951028 - DNA, 19 bp, Homo sapiens
tgatagacacatatgaggg

SEQ ID NO: 5951029 - DNA, 15 bp, Homo sapiens
tgatagatgtttgac

SEQ ID NO: 5951030 - DNA, 17 bp, Homo sapiens
tgatagatttgacctcc

SEQ ID NO: 5951031 - DNA, 17 bp, Homo sapiens
tgatagcaaaatcaaga

SEQ ID NO: 5951032 - DNA, 17 bp, Homo sapiens
tgatagcacagaccctg

SEQ ID NO: 5951033 - DNA, 13 bp, Homo sapiens
tgatagcactttc

SEQ ID NO: 5951034 - DNA, 21 bp, Homo sapiens
tgatagcactttctacaatgt

SEQ ID NO: 5951035 - DNA, 24 bp, Homo sapiens
tgatagcagaagaaaaagttgcag

SEQ ID NO: 5951036 - DNA, 20 bp, Homo sapiens
tgatagcagacattgttaca

SEQ ID NO: 5951037 - DNA, 21 bp, Homo sapiens
tgatagcagacattgttacaa

SEQ ID NO: 5951038 - DNA, 20 bp, Homo sapiens
tgatagcaggtgtaataaga

SEQ ID NO: 5951039 - DNA, 23 bp, Homo sapiens
tgatagcatatgacaaatgtttc

SEQ ID NO: 5951040 - DNA, 20 bp, Homo sapiens
tgatagcatggggcccctgg

SEQ ID NO: 5951041 - DNA, 16 bp, Homo sapiens
tgatagctaaataact

SEQ ID NO: 5951042 - DNA, 16 bp, Homo sapiens
tgatagctactgtaga

SEQ ID NO: 5951043 - DNA, 22 bp, Homo sapiens
tgatagctctttggcagtctat

SEQ ID NO: 5951044 - DNA, 20 bp, Homo sapiens
tgatagcttacactgaggac

SEQ ID NO: 5951045 - DNA, 23 bp, Homo sapiens
tgatagctttattttttaagtat

SEQ ID NO: 5951046 - DNA, 13 bp, Homo sapiens
tgataggaaaaga

SEQ ID NO: 5951047 - DNA, 22 bp, Homo sapiens
tgataggaagaggggaagcaga

SEQ ID NO: 5951048 - DNA, 21 bp, Homo sapiens
tgataggaagcgtctggcaga

SEQ ID NO: 5951049 - DNA, 16 bp, Homo sapiens
tgataggaattcatct

SEQ ID NO: 5951050 - DNA, 23 bp, Homo sapiens
tgatagggtctaccaatacaaaa

SEQ ID NO: 5951051 - DNA, 13 bp, Homo sapiens
tgatagtaaatgt

SEQ ID NO: 5951052 - DNA, 21 bp, Homo sapiens
tgatagtagtaaaattagaaa

SEQ ID NO: 5951053 - DNA, 16 bp, Homo sapiens
tgatagtcttttgctt

SEQ ID NO: 5951054 - DNA, 12 bp, Homo sapiens
tgatagtgcttc

SEQ ID NO: 5951055 - DNA, 16 bp, Homo sapiens
tgatagtgcttcttgt

SEQ ID NO: 5951056 - DNA, 12 bp, Homo sapiens
tgatagtgtaaa

SEQ ID NO: 5951057 - DNA, 19 bp, Homo sapiens
tgatagtgttttgtacttg

SEQ ID NO: 5951058 - DNA, 20 bp, Homo sapiens
tgatagttactgttgtgacc

SEQ ID NO: 5951059 - DNA, 17 bp, Homo sapiens
tgatagttgaatgttgc

SEQ ID NO: 5951060 - DNA, 15 bp, Homo sapiens
tgatagtttacaaac

SEQ ID NO: 5951061 - DNA, 17 bp, Homo sapiens
tgatagtttacaaacaa

SEQ ID NO: 5951062 - DNA, 14 bp, Homo sapiens
tgatataaaatatt

SEQ ID NO: 5951063 - DNA, 17 bp, Homo sapiens
tgatataaagaatgaaa

SEQ ID NO: 5951064 - DNA, 14 bp, Homo sapiens
tgatataaattctg

SEQ ID NO: 5951065 - DNA, 17 bp, Homo sapiens
tgatataaattctgtgg

SEQ ID NO: 5951066 - DNA, 14 bp, Homo sapiens
tgatataacacaaa

SEQ ID NO: 5951067 - DNA, 22 bp, Homo sapiens
tgatataataattacttaatgt

SEQ ID NO: 5951068 - DNA, 22 bp, Homo sapiens
tgatataatcttggcttcttaa

SEQ ID NO: 5951069 - DNA, 18 bp, Homo sapiens
tgatataattacttaatg

SEQ ID NO: 5951070 - DNA, 15 bp, Homo sapiens
tgatatacacagtgg

SEQ ID NO: 5951071 - DNA, 19 bp, Homo sapiens
tgatatacacagtggcaaa

SEQ ID NO: 5951072 - DNA, 14 bp, Homo sapiens
tgatatacattgtg

SEQ ID NO: 5951073 - DNA, 17 bp, Homo sapiens
tgatatacattgtgtga

SEQ ID NO: 5951074 - DNA, 15 bp, Homo sapiens
tgatataccaaatta

SEQ ID NO: 5951075 - DNA, 23 bp, Homo sapiens
tgatatactccaggacttagaat

SEQ ID NO: 5951076 - DNA, 19 bp, Homo sapiens
tgatatacttgagtgtgca

SEQ ID NO: 5951077 - DNA, 22 bp, Homo sapiens
tgatatacttttttcttattta

SEQ ID NO: 5951078 - DNA, 17 bp, Homo sapiens
tgatatagaaagctgtt

SEQ ID NO: 5951079 - DNA, 21 bp, Homo sapiens
tgatatagaagtataaagaat

SEQ ID NO: 5951080 - DNA, 23 bp, Homo sapiens
tgatatagcagaggtttaaatgt

SEQ ID NO: 5951081 - DNA, 17 bp, Homo sapiens
tgatataggaaaataca

SEQ ID NO: 5951082 - DNA, 23 bp, Homo sapiens
tgatataggaaaatacattgtgt

SEQ ID NO: 5951083 - DNA, 12 bp, Homo sapiens
tgatatagtgct

SEQ ID NO: 5951084 - DNA, 14 bp, Homo sapiens
tgatatagtgctgt

SEQ ID NO: 5951085 - DNA, 23 bp, Homo sapiens
tgatatataaaccttaaatgaaa

SEQ ID NO: 5951086 - DNA, 18 bp, Homo sapiens
tgatatataagtgtacat

SEQ ID NO: 5951087 - DNA, 14 bp, Homo sapiens
tgatatataatggt

SEQ ID NO: 5951088 - DNA, 13 bp, Homo sapiens
tgatatatatgta

SEQ ID NO: 5951089 - DNA, 16 bp, Homo sapiens
tgatatatattataaa

SEQ ID NO: 5951090 - DNA, 18 bp, Homo sapiens
tgatatatattatcttat

SEQ ID NO: 5951091 - DNA, 15 bp, Homo sapiens
tgatatatctcaaat

SEQ ID NO: 5951092 - DNA, 16 bp, Homo sapiens
tgatatatctcaaatt

SEQ ID NO: 5951093 - DNA, 13 bp, Homo sapiens
tgatatatgtatc

SEQ ID NO: 5951094 - DNA, 15 bp, Homo sapiens
tgatatatgtattta

SEQ ID NO: 5951095 - DNA, 13 bp, Homo sapiens
tgatatattcttt

SEQ ID NO: 5951096 - DNA, 15 bp, Homo sapiens
tgatatattctttcc

SEQ ID NO: 5951097 - DNA, 14 bp, Homo sapiens
tgatatatttaaaa

SEQ ID NO: 5951098 - DNA, 17 bp, Homo sapiens
tgatatatttaaaaaca

SEQ ID NO: 5951099 - DNA, 19 bp, Homo sapiens
tgatatatttaaaaatatt

SEQ ID NO: 5951100 - DNA, 18 bp, Homo sapiens
tgatatatttataaatat

SEQ ID NO: 5951101 - DNA, 14 bp, Homo sapiens
tgatatattttaca

SEQ ID NO: 5951102 - DNA, 15 bp, Homo sapiens
tgatatattttacaa

SEQ ID NO: 5951103 - DNA, 13 bp, Homo sapiens
tgatatcaacagc

SEQ ID NO: 5951104 - DNA, 14 bp, Homo sapiens
tgatatcacctctc

SEQ ID NO: 5951105 - DNA, 16 bp, Homo sapiens
tgatatcacctctctt

SEQ ID NO: 5951106 - DNA, 13 bp, Homo sapiens
tgatatcagcact

SEQ ID NO: 5951107 - DNA, 17 bp, Homo sapiens
tgatatcagcactggat

SEQ ID NO: 5951108 - DNA, 21 bp, Homo sapiens
tgatatcatgcccctgtactc

SEQ ID NO: 5951109 - DNA, 22 bp, Homo sapiens
tgatatcattgttggtgttaat

SEQ ID NO: 5951110 - DNA, 20 bp, Homo sapiens
tgatatccacaaatgctatt

SEQ ID NO: 5951111 - DNA, 16 bp, Homo sapiens
tgatatccatatgaaa

SEQ ID NO: 5951112 - DNA, 19 bp, Homo sapiens
tgatatcggtgctatgtgt

SEQ ID NO: 5951113 - DNA, 17 bp, Homo sapiens
tgatatcgtgaaatcct

SEQ ID NO: 5951114 - DNA, 18 bp, Homo sapiens
tgatatctataaaataga

SEQ ID NO: 5951115 - DNA, 14 bp, Homo sapiens
tgatatctatatat

SEQ ID NO: 5951116 - DNA, 17 bp, Homo sapiens
tgatatctgaacacata

SEQ ID NO: 5951117 - DNA, 15 bp, Homo sapiens
tgatatctgaatgtt

SEQ ID NO: 5951118 - DNA, 14 bp, Homo sapiens
tgatatctttctca

SEQ ID NO: 5951119 - DNA, 15 bp, Homo sapiens
tgatatgaccaaaat

SEQ ID NO: 5951120 - DNA, 18 bp, Homo sapiens
tgatatgagtatacaata

SEQ ID NO: 5951121 - DNA, 18 bp, Homo sapiens
tgatatgattgtaacata

SEQ ID NO: 5951122 - DNA, 15 bp, Homo sapiens
tgatatgatttaaaa

SEQ ID NO: 5951123 - DNA, 21 bp, Homo sapiens
tgatatgcagagtatttctgc

SEQ ID NO: 5951124 - DNA, 19 bp, Homo sapiens
tgatatgcagttttcctta

SEQ ID NO: 5951125 - DNA, 19 bp, Homo sapiens
tgatatgcatatttgttta

SEQ ID NO: 5951126 - DNA, 12 bp, Homo sapiens
tgatatgcatgt

SEQ ID NO: 5951127 - DNA, 16 bp, Homo sapiens
tgatatgcatgtagca

SEQ ID NO: 5951128 - DNA, 19 bp, Homo sapiens
tgatatgcatttcctgctg

SEQ ID NO: 5951129 - DNA, 17 bp, Homo sapiens
tgatatgctgagaaatt

SEQ ID NO: 5951130 - DNA, 19 bp, Homo sapiens
tgatatgctgcttgtgacc

SEQ ID NO: 5951131 - DNA, 20 bp, Homo sapiens
tgatatggcagaagacacca

SEQ ID NO: 5951132 - DNA, 22 bp, Homo sapiens
tgatatgggtttataattttct

SEQ ID NO: 5951133 - DNA, 18 bp, Homo sapiens
tgatatggtgaagggaag

SEQ ID NO: 5951134 - DNA, 22 bp, Homo sapiens
tgatatgtaaattaaatgaaga

SEQ ID NO: 5951135 - DNA, 20 bp, Homo sapiens
tgatatgtatccatcaggat

SEQ ID NO: 5951136 - DNA, 20 bp, Homo sapiens
tgatatgtctttaaaatgat

SEQ ID NO: 5951137 - DNA, 15 bp, Homo sapiens
tgatatgtgaacagt

SEQ ID NO: 5951138 - DNA, 16 bp, Homo sapiens
tgatatgtgaacagtt

SEQ ID NO: 5951139 - DNA, 12 bp, Homo sapiens
tgatatgtgctt

SEQ ID NO: 5951140 - DNA, 15 bp, Homo sapiens
tgatatgtgcttgtg

SEQ ID NO: 5951141 - DNA, 22 bp, Homo sapiens
tgatatgtgcttgtgtgtatgt

SEQ ID NO: 5951142 - DNA, 14 bp, Homo sapiens
tgatatgtgtaata

SEQ ID NO: 5951143 - DNA, 20 bp, Homo sapiens
tgatatgtgtaatatcattt

SEQ ID NO: 5951144 - DNA, 22 bp, Homo sapiens
tgatatgtgtaatatcatttca

SEQ ID NO: 5951145 - DNA, 23 bp, Homo sapiens
tgatatgtgtaatatcatttcat

SEQ ID NO: 5951146 - DNA, 16 bp, Homo sapiens
tgatatgttgatgaaa

SEQ ID NO: 5951147 - DNA, 13 bp, Homo sapiens
tgatatgttttaa

SEQ ID NO: 5951148 - DNA, 21 bp, Homo sapiens
tgatattaaagcgcaaatgaa

SEQ ID NO: 5951149 - DNA, 16 bp, Homo sapiens
tgatattaaaggagtt

SEQ ID NO: 5951150 - DNA, 23 bp, Homo sapiens
tgatattaaaggagttaagagta

SEQ ID NO: 5951151 - DNA, 13 bp, Homo sapiens
tgatattaaattt

SEQ ID NO: 5951152 - DNA, 14 bp, Homo sapiens
tgatattaatcaaa

SEQ ID NO: 5951153 - DNA, 15 bp, Homo sapiens
tgatattaatcaaaa

SEQ ID NO: 5951154 - DNA, 22 bp, Homo sapiens
tgatattacatttatttatcca

SEQ ID NO: 5951155 - DNA, 19 bp, Homo sapiens
tgatattatttcttctctt

SEQ ID NO: 5951156 - DNA, 19 bp, Homo sapiens
tgatattcaaacacacagt

SEQ ID NO: 5951157 - DNA, 18 bp, Homo sapiens
tgatattcaaggctttaa

SEQ ID NO: 5951158 - DNA, 22 bp, Homo sapiens
tgatattcaaggctttaaaagt

SEQ ID NO: 5951159 - DNA, 13 bp, Homo sapiens
tgatattcaataa

SEQ ID NO: 5951160 - DNA, 12 bp, Homo sapiens
tgatattcagaa

SEQ ID NO: 5951161 - DNA, 18 bp, Homo sapiens
tgatattccccatttcct

SEQ ID NO: 5951162 - DNA, 19 bp, Homo sapiens
tgatattcctacaaagaaa

SEQ ID NO: 5951163 - DNA, 20 bp, Homo sapiens
tgatattctaaaatataaca

SEQ ID NO: 5951164 - DNA, 20 bp, Homo sapiens
tgatattctcattatttcat

SEQ ID NO: 5951165 - DNA, 16 bp, Homo sapiens
tgatattctgttgctt

SEQ ID NO: 5951166 - DNA, 20 bp, Homo sapiens
tgatattctgttgctttaca

SEQ ID NO: 5951167 - DNA, 17 bp, Homo sapiens
tgatattctttgttaat

SEQ ID NO: 5951168 - DNA, 18 bp, Homo sapiens
tgatattgacactgtccc

SEQ ID NO: 5951169 - DNA, 17 bp, Homo sapiens
tgatattgaccatgtga

SEQ ID NO: 5951170 - DNA, 19 bp, Homo sapiens
tgatattgaccatgtgatt

SEQ ID NO: 5951171 - DNA, 18 bp, Homo sapiens
tgatattgaggtgtttga

SEQ ID NO: 5951172 - DNA, 17 bp, Homo sapiens
tgatattgcatatgcat

SEQ ID NO: 5951173 - DNA, 16 bp, Homo sapiens
tgatattgctgaagaa

SEQ ID NO: 5951174 - DNA, 16 bp, Homo sapiens
tgatattggaggaata

SEQ ID NO: 5951175 - DNA, 14 bp, Homo sapiens
tgatattggtgtga

SEQ ID NO: 5951176 - DNA, 17 bp, Homo sapiens
tgatattgtatgtacct

SEQ ID NO: 5951177 - DNA, 21 bp, Homo sapiens
tgatattgtgaacatttgtga

SEQ ID NO: 5951178 - DNA, 17 bp, Homo sapiens
tgatattgttatataca

SEQ ID NO: 5951179 - DNA, 21 bp, Homo sapiens
tgatgccttccgacaccactg

SEQ ID NO: 5951180 - DNA, 23 bp, Homo sapiens
tgatgccttccgacaccactggg

SEQ ID NO: 5951181 - DNA, 23 bp, Homo sapiens
tgatgcctttataaatctttctc

SEQ ID NO: 5951182 - DNA, 18 bp, Homo sapiens
tgatgccttttttttcat

SEQ ID NO: 5951183 - DNA, 20 bp, Homo sapiens
tgatgccttttttttcatga

SEQ ID NO: 5951184 - DNA, 20 bp, Homo sapiens
tgatgctaaaacctgaaatt

SEQ ID NO: 5951185 - DNA, 15 bp, Homo sapiens
tgatgctagttctta

SEQ ID NO: 5951186 - DNA, 16 bp, Homo sapiens
tgatgctatttatgca

SEQ ID NO: 5951187 - DNA, 18 bp, Homo sapiens
tgatgctatttatgcaag

SEQ ID NO: 5951188 - DNA, 12 bp, Homo sapiens
tgatgctcagtt

SEQ ID NO: 5951189 - DNA, 14 bp, Homo sapiens
tgatgctccctccc

SEQ ID NO: 5951190 - DNA, 22 bp, Homo sapiens
tgatgctccctcccctgccctg

SEQ ID NO: 5951191 - DNA, 22 bp, Homo sapiens
tgatgctctggcttgccccagg

SEQ ID NO: 5951192 - DNA, 13 bp, Homo sapiens
tgatgctgacacc

SEQ ID NO: 5951193 - DNA, 14 bp, Homo sapiens
tgatgctgagattc

SEQ ID NO: 5951194 - DNA, 21 bp, Homo sapiens
tgatgctgagattcttcaggc

SEQ ID NO: 5951195 - DNA, 19 bp, Homo sapiens
tgatgctgaggatgattga

SEQ ID NO: 5951196 - DNA, 11 bp, Homo sapiens
tgatgctgccc

SEQ ID NO: 5951197 - DNA, 15 bp, Homo sapiens
tgatgctgcccctca

SEQ ID NO: 5951198 - DNA, 18 bp, Homo sapiens
tgatgctgccggcacagc

SEQ ID NO: 5951199 - DNA, 18 bp, Homo sapiens
tgatgctggaactcttga

SEQ ID NO: 5951200 - DNA, 14 bp, Homo sapiens
tgatgctggagagg

SEQ ID NO: 5951201 - DNA, 15 bp, Homo sapiens
tgatgctggagaggt

SEQ ID NO: 5951202 - DNA, 17 bp, Homo sapiens
tgatgctggagaggtta

SEQ ID NO: 5951203 - DNA, 15 bp, Homo sapiens
tgatgctggatgctc

SEQ ID NO: 5951204 - DNA, 20 bp, Homo sapiens
tgatgctgggagttctaaca

SEQ ID NO: 5951205 - DNA, 12 bp, Homo sapiens
tgatgctgggat

SEQ ID NO: 5951206 - DNA, 15 bp, Homo sapiens
tgatgctgggcaatg

SEQ ID NO: 5951207 - DNA, 14 bp, Homo sapiens
tgatgctgggctgg

SEQ ID NO: 5951208 - DNA, 16 bp, Homo sapiens
tgatgctgggctgggt

SEQ ID NO: 5951209 - DNA, 20 bp, Homo sapiens
tgatgctgggctgggtgcga

SEQ ID NO: 5951210 - DNA, 14 bp, Homo sapiens
tgatgctgtgacaa

SEQ ID NO: 5951211 - DNA, 22 bp, Homo sapiens
tgatgcttcttcagagactcct

SEQ ID NO: 5951212 - DNA, 23 bp, Homo sapiens
tgatgcttcttcagagactcctg

SEQ ID NO: 5951213 - DNA, 21 bp, Homo sapiens
tgatgctttgaacatctcttt

SEQ ID NO: 5951214 - DNA, 19 bp, Homo sapiens
tgatgctttggaagatgca

SEQ ID NO: 5951215 - DNA, 13 bp, Homo sapiens
tgatgcttttctc

SEQ ID NO: 5951216 - DNA, 19 bp, Homo sapiens
tgatgcttttgctgctgct

SEQ ID NO: 5951217 - DNA, 15 bp, Homo sapiens
tgatggaaaaatcac

SEQ ID NO: 5951218 - DNA, 14 bp, Homo sapiens
tgatggaaaataaa

SEQ ID NO: 5951219 - DNA, 19 bp, Homo sapiens
tgatggaaaataccagtgt

SEQ ID NO: 5951220 - DNA, 14 bp, Homo sapiens
tgatggaaacaaag

SEQ ID NO: 5951221 - DNA, 15 bp, Homo sapiens
tgatggaaacaaagt

SEQ ID NO: 5951222 - DNA, 13 bp, Homo sapiens
tgatggaacacac

SEQ ID NO: 5951223 - DNA, 14 bp, Homo sapiens
tgatggaacacaca

SEQ ID NO: 5951224 - DNA, 20 bp, Homo sapiens
tgatggaacacacacacacg

SEQ ID NO: 5951225 - DNA, 17 bp, Homo sapiens
tgatggaacagtaatta

SEQ ID NO: 5951226 - DNA, 19 bp, Homo sapiens
tgatggaacagtgaaagtc

SEQ ID NO: 5951227 - DNA, 21 bp, Homo sapiens
tgatggaagatggtccgtgcc

SEQ ID NO: 5951228 - DNA, 22 bp, Homo sapiens
tgatggaagtaaagcctcaacc

SEQ ID NO: 5951229 - DNA, 21 bp, Homo sapiens
tgatggaagtgggccagtcct

SEQ ID NO: 5951230 - DNA, 17 bp, Homo sapiens
tgatggaagtgttcaga

SEQ ID NO: 5951231 - DNA, 17 bp, Homo sapiens
tgatggaattaaatgtg

SEQ ID NO: 5951232 - DNA, 15 bp, Homo sapiens
tgatggacaaaggcc

SEQ ID NO: 5951233 - DNA, 16 bp, Homo sapiens
tgatggacactccagg

SEQ ID NO: 5951234 - DNA, 19 bp, Homo sapiens
tgatggacactccagggac

SEQ ID NO: 5951235 - DNA, 12 bp, Homo sapiens
tgatggaccaaa

SEQ ID NO: 5951236 - DNA, 15 bp, Homo sapiens
tgatggaccaaagcc

SEQ ID NO: 5951237 - DNA, 20 bp, Homo sapiens
tgatggaccaaagccacctg

SEQ ID NO: 5951238 - DNA, 23 bp, Homo sapiens
tgatggaccaaagccacctgctg

SEQ ID NO: 5951239 - DNA, 18 bp, Homo sapiens
tgatggaccgggtgggcc

SEQ ID NO: 5951240 - DNA, 16 bp, Homo sapiens
tgatggacctgccccg

SEQ ID NO: 5951241 - DNA, 15 bp, Homo sapiens
tgatggactggggag

SEQ ID NO: 5951242 - DNA, 15 bp, Homo sapiens
tgatggagaggacag

SEQ ID NO: 5951243 - DNA, 15 bp, Homo sapiens
tgatggagaggagaa

SEQ ID NO: 5951244 - DNA, 15 bp, Homo sapiens
tgatggagagggatg

SEQ ID NO: 5951245 - DNA, 16 bp, Homo sapiens
tgatggagattaagat

SEQ ID NO: 5951246 - DNA, 11 bp, Homo sapiens
tgatggagccc

SEQ ID NO: 5951247 - DNA, 22 bp, Homo sapiens
tgatggagccccaccttgtctg

SEQ ID NO: 5951248 - DNA, 17 bp, Homo sapiens
tgatggagccccagggt

SEQ ID NO: 5951249 - DNA, 15 bp, Homo sapiens
tgatggagcctgaac

SEQ ID NO: 5951250 - DNA, 23 bp, Homo sapiens
tgatggagcctgaaccgtgtgct

SEQ ID NO: 5951251 - DNA, 13 bp, Homo sapiens
tgatggagctgat

SEQ ID NO: 5951252 - DNA, 16 bp, Homo sapiens
tgatggagggaagggg

SEQ ID NO: 5951253 - DNA, 21 bp, Homo sapiens
tgatggaggggagaggggtca

SEQ ID NO: 5951254 - DNA, 17 bp, Homo sapiens
tgatggagggtggaaat

SEQ ID NO: 5951255 - DNA, 21 bp, Homo sapiens
tgatggagggtggaaataatt

SEQ ID NO: 5951256 - DNA, 14 bp, Homo sapiens
tgatggagtgctgt

SEQ ID NO: 5951257 - DNA, 21 bp, Homo sapiens
tgatggagtgtgcagacagcc

SEQ ID NO: 5951258 - DNA, 14 bp, Homo sapiens
tgatggagttcctt

SEQ ID NO: 5951259 - DNA, 22 bp, Homo sapiens
tgatggagtttctctagaagct

SEQ ID NO: 5951260 - DNA, 16 bp, Homo sapiens
tgatggatatttttga

SEQ ID NO: 5951261 - DNA, 15 bp, Homo sapiens
tgatggatcaccatt

SEQ ID NO: 5951262 - DNA, 13 bp, Homo sapiens
tgatggatgtctt

SEQ ID NO: 5951263 - DNA, 22 bp, Homo sapiens
tgatggatgtcttctagctgca

SEQ ID NO: 5951264 - DNA, 15 bp, Homo sapiens
tgatggattccaaac

SEQ ID NO: 5951265 - DNA, 20 bp, Homo sapiens
tgatggattccaaaccagga

SEQ ID NO: 5951266 - DNA, 14 bp, Homo sapiens
tgatggatttaaca

SEQ ID NO: 5951267 - DNA, 15 bp, Homo sapiens
tgatggatttaacag

SEQ ID NO: 5951268 - DNA, 14 bp, Homo sapiens
tgatggcaaaaaaa

SEQ ID NO: 5951269 - DNA, 23 bp, Homo sapiens
tgatggcaaaaaaaaaaaagcga

SEQ ID NO: 5951270 - DNA, 21 bp, Homo sapiens
tgatggcaacagaaaccaaga

SEQ ID NO: 5951271 - DNA, 16 bp, Homo sapiens
tgatggcaacagatct

SEQ ID NO: 5951272 - DNA, 15 bp, Homo sapiens
tgatggcaattttgt

SEQ ID NO: 5951273 - DNA, 17 bp, Homo sapiens
tgatggcaattttgtaa

SEQ ID NO: 5951274 - DNA, 21 bp, Homo sapiens
tgatggcagaacgatgcctgc

SEQ ID NO: 5951275 - DNA, 14 bp, Homo sapiens
tgatggcagagcca

SEQ ID NO: 5951276 - DNA, 15 bp, Homo sapiens
tgatggcagagccag

SEQ ID NO: 5951277 - DNA, 12 bp, Homo sapiens
tgatggcagagg

SEQ ID NO: 5951278 - DNA, 14 bp, Homo sapiens
tgatggcagaggag

SEQ ID NO: 5951279 - DNA, 20 bp, Homo sapiens
tgatggcagccatagtgcat

SEQ ID NO: 5951280 - DNA, 13 bp, Homo sapiens
tgatggcagctgg

SEQ ID NO: 5951281 - DNA, 20 bp, Homo sapiens
tgatggcaggatggcctggc

SEQ ID NO: 5951282 - DNA, 15 bp, Homo sapiens
tgatggccaaggggg

SEQ ID NO: 5951283 - DNA, 16 bp, Homo sapiens
tgatggccaggccagg

SEQ ID NO: 5951284 - DNA, 19 bp, Homo sapiens
tgatggccaggccagggga

SEQ ID NO: 5951285 - DNA, 17 bp, Homo sapiens
tgatggcccattctact

SEQ ID NO: 5951286 - DNA, 17 bp, Homo sapiens
tgatggcccctccagca

SEQ ID NO: 5951287 - DNA, 20 bp, Homo sapiens
tgatggccctcatctccagc

SEQ ID NO: 5951288 - DNA, 18 bp, Homo sapiens
tgatggccggctggttgt

SEQ ID NO: 5951289 - DNA, 14 bp, Homo sapiens
tgatggcctttgga

SEQ ID NO: 5951290 - DNA, 22 bp, Homo sapiens
tgatggcgattccctctcaccc

SEQ ID NO: 5951291 - DNA, 15 bp, Homo sapiens
tgatggctgcccctg

SEQ ID NO: 5951292 - DNA, 13 bp, Homo sapiens
tgatggctgctgg

SEQ ID NO: 5951293 - DNA, 11 bp, Homo sapiens
tgatggctggg

SEQ ID NO: 5951294 - DNA, 17 bp, Homo sapiens
tgatggcttatgatagc

SEQ ID NO: 5951295 - DNA, 13 bp, Homo sapiens
tgatgggaaaact

SEQ ID NO: 5951296 - DNA, 13 bp, Homo sapiens
tgatgggaaaata

SEQ ID NO: 5951297 - DNA, 20 bp, Homo sapiens
tgatgggaaaatatttcctg

SEQ ID NO: 5951298 - DNA, 23 bp, Homo sapiens
tgatgggaaagaccctaggtgct

SEQ ID NO: 5951299 - DNA, 14 bp, Homo sapiens
tgatgggaaagcat

SEQ ID NO: 5951300 - DNA, 16 bp, Homo sapiens
tgatgggaaggagggg

SEQ ID NO: 5951301 - DNA, 20 bp, Homo sapiens
tgatgggagtaggctccaga

SEQ ID NO: 5951302 - DNA, 21 bp, Homo sapiens
tgatgggcaacccccagcctg

SEQ ID NO: 5951303 - DNA, 14 bp, Homo sapiens
tgatgggcaagggg

SEQ ID NO: 5951304 - DNA, 16 bp, Homo sapiens
tgatgggcaaggggcc

SEQ ID NO: 5951305 - DNA, 20 bp, Homo sapiens
tgatgggcagatcttttctt

SEQ ID NO: 5951306 - DNA, 22 bp, Homo sapiens
tgatgggcagatcttttcttta

SEQ ID NO: 5951307 - DNA, 18 bp, Homo sapiens
tgatgggccaccggggca

SEQ ID NO: 5951308 - DNA, 13 bp, Homo sapiens
tgatgggcccgcc

SEQ ID NO: 5951309 - DNA, 16 bp, Homo sapiens
tgatgggctccccagg

SEQ ID NO: 5951310 - DNA, 16 bp, Homo sapiens
tgatgggctggagcag

SEQ ID NO: 5951311 - DNA, 21 bp, Homo sapiens
tgatgggctggggcaggggcc

SEQ ID NO: 5951312 - DNA, 23 bp, Homo sapiens
tgatgggcttctgttctctgctg

SEQ ID NO: 5951313 - DNA, 23 bp, Homo sapiens
tgatgggcttttgttctgagggg

SEQ ID NO: 5951314 - DNA, 13 bp, Homo sapiens
tgatggggagaaa

SEQ ID NO: 5951315 - DNA, 14 bp, Homo sapiens
tgatggggagaaag

SEQ ID NO: 5951316 - DNA, 13 bp, Homo sapiens
tgatggggccctg

SEQ ID NO: 5951317 - DNA, 16 bp, Homo sapiens
tgatggggccctgcct

SEQ ID NO: 5951318 - DNA, 22 bp, Homo sapiens
tgatggggccctgcctcctttg

SEQ ID NO: 5951319 - DNA, 16 bp, Homo sapiens
tgatggggctcagatg

SEQ ID NO: 5951320 - DNA, 17 bp, Homo sapiens
tgatggggctcagatgg

SEQ ID NO: 5951321 - DNA, 19 bp, Homo sapiens
tgatgggggacgagggcca

SEQ ID NO: 5951322 - DNA, 23 bp, Homo sapiens
tgatgggggacgagggccaggca

SEQ ID NO: 5951323 - DNA, 17 bp, Homo sapiens
tgatgggggagagggtg

SEQ ID NO: 5951324 - DNA, 15 bp, Homo sapiens
tgatggggtcagcag

SEQ ID NO: 5951325 - DNA, 20 bp, Homo sapiens
tgatggggtccagagagcct

SEQ ID NO: 5951326 - DNA, 20 bp, Homo sapiens
tgatggggtgggcagggctg

SEQ ID NO: 5951327 - DNA, 21 bp, Homo sapiens
tgatggggtgggcagggctgg

SEQ ID NO: 5951328 - DNA, 17 bp, Homo sapiens
tgatgggtcccaaaagc

SEQ ID NO: 5951329 - DNA, 13 bp, Homo sapiens
tgatgggtcctgc

SEQ ID NO: 5951330 - DNA, 19 bp, Homo sapiens
tgatgggttagtggatgga

SEQ ID NO: 5951331 - DNA, 22 bp, Homo sapiens
tgatggtaggtagcacagtgga

SEQ ID NO: 5951332 - DNA, 18 bp, Homo sapiens
tgatggtcaatcagtgtt

SEQ ID NO: 5951333 - DNA, 23 bp, Homo sapiens
tgatggtcacttaaaatgtgcag

SEQ ID NO: 5951334 - DNA, 15 bp, Homo sapiens
tgatggtcagacaca

SEQ ID NO: 5951335 - DNA, 14 bp, Homo sapiens
tgatggtcagaggg

SEQ ID NO: 5951336 - DNA, 14 bp, Homo sapiens
tgatggtgagctgg

SEQ ID NO: 5951337 - DNA, 16 bp, Homo sapiens
tgatggtgagctggga

SEQ ID NO: 5951338 - DNA, 16 bp, Homo sapiens
tgatggtgatgaaatg

SEQ ID NO: 5951339 - DNA, 17 bp, Homo sapiens
tgatggtgatgaaatgt

SEQ ID NO: 5951340 - DNA, 20 bp, Homo sapiens
tgatggtggactaagcaatt

SEQ ID NO: 5951341 - DNA, 13 bp, Homo sapiens
tgatggtggggcc

SEQ ID NO: 5951342 - DNA, 22 bp, Homo sapiens
tgatggtgtcattctgcctgct

SEQ ID NO: 5951343 - DNA, 16 bp, Homo sapiens
tgatggtgtccttccc

SEQ ID NO: 5951344 - DNA, 19 bp, Homo sapiens
tgatggtgtccttccctgc

SEQ ID NO: 5951345 - DNA, 20 bp, Homo sapiens
tgatggtgtggcctgtggct

SEQ ID NO: 5951346 - DNA, 19 bp, Homo sapiens
tgatggtgttaaagctgta

SEQ ID NO: 5951347 - DNA, 14 bp, Homo sapiens
tgatggttcccctg

SEQ ID NO: 5951348 - DNA, 17 bp, Homo sapiens
tgatggttcgttctgtt

SEQ ID NO: 5951349 - DNA, 13 bp, Homo sapiens
tgatggttgcttt

SEQ ID NO: 5951350 - DNA, 18 bp, Homo sapiens
tgatggtttccaatttca

SEQ ID NO: 5951351 - DNA, 16 bp, Homo sapiens
tgatggtttggaaaat

SEQ ID NO: 5951352 - DNA, 18 bp, Homo sapiens
tgatggttttgctccccc

SEQ ID NO: 5951353 - DNA, 19 bp, Homo sapiens
tgatgtaaaaaatattaaa

SEQ ID NO: 5951354 - DNA, 14 bp, Homo sapiens
tgatgtaaaaatat

SEQ ID NO: 5951355 - DNA, 13 bp, Homo sapiens
tgatgtaaaaatg

SEQ ID NO: 5951356 - DNA, 16 bp, Homo sapiens
tgatgtaaaatcttgt

SEQ ID NO: 5951357 - DNA, 15 bp, Homo sapiens
tgatgtaaatagtga

SEQ ID NO: 5951358 - DNA, 18 bp, Homo sapiens
tgattcctacccctcttc

SEQ ID NO: 5951359 - DNA, 14 bp, Homo sapiens
tgattcctcccagg

SEQ ID NO: 5951360 - DNA, 15 bp, Homo sapiens
tgattcctggctcta

SEQ ID NO: 5951361 - DNA, 14 bp, Homo sapiens
tgattccttcctgt

SEQ ID NO: 5951362 - DNA, 18 bp, Homo sapiens
tgattccttcctgttctg

SEQ ID NO: 5951363 - DNA, 18 bp, Homo sapiens
tgattccttgagcatttt

SEQ ID NO: 5951364 - DNA, 18 bp, Homo sapiens
tgattccttgagtttcat

SEQ ID NO: 5951365 - DNA, 14 bp, Homo sapiens
tgattcctttaaca

SEQ ID NO: 5951366 - DNA, 14 bp, Homo sapiens
tgattccttttgat

SEQ ID NO: 5951367 - DNA, 15 bp, Homo sapiens
tgattccttttgatg

SEQ ID NO: 5951368 - DNA, 21 bp, Homo sapiens
tgattcgaggtcctcctggcc

SEQ ID NO: 5951369 - DNA, 23 bp, Homo sapiens
tgattcgaggtcctcctggcctg

SEQ ID NO: 5951370 - DNA, 17 bp, Homo sapiens
tgattcgtctgcgattt

SEQ ID NO: 5951371 - DNA, 15 bp, Homo sapiens
tgattctaaagggga

SEQ ID NO: 5951372 - DNA, 16 bp, Homo sapiens
tgattctaaaggggac

SEQ ID NO: 5951373 - DNA, 17 bp, Homo sapiens
tgattctaatgtcttca

SEQ ID NO: 5951374 - DNA, 23 bp, Homo sapiens
tgattctagtacataattgatta

SEQ ID NO: 5951375 - DNA, 22 bp, Homo sapiens
tgattctatgcctgtatttcca

SEQ ID NO: 5951376 - DNA, 17 bp, Homo sapiens
tgattctatgtaacttg

SEQ ID NO: 5951377 - DNA, 18 bp, Homo sapiens
tgattctatgtaacttgt

SEQ ID NO: 5951378 - DNA, 15 bp, Homo sapiens
tgattctattatata

SEQ ID NO: 5951379 - DNA, 11 bp, Homo sapiens
tgattctcagg

SEQ ID NO: 5951380 - DNA, 20 bp, Homo sapiens
tgattctcagggtctctgct

SEQ ID NO: 5951381 - DNA, 21 bp, Homo sapiens
tgattctcagggtctctgctg

SEQ ID NO: 5951382 - DNA, 14 bp, Homo sapiens
tgattctcatgcct

SEQ ID NO: 5951383 - DNA, 11 bp, Homo sapiens
tgattctcctc

SEQ ID NO: 5951384 - DNA, 13 bp, Homo sapiens
tgattctcctctc

SEQ ID NO: 5951385 - DNA, 14 bp, Homo sapiens
tgattctcctgcct

SEQ ID NO: 5951386 - DNA, 20 bp, Homo sapiens
tgattctcctgcctcagcct

SEQ ID NO: 5951387 - DNA, 21 bp, Homo sapiens
tgattctcctgcctcagcctc

SEQ ID NO: 5951388 - DNA, 12 bp, Homo sapiens
tgattctccttc

SEQ ID NO: 5951389 - DNA, 16 bp, Homo sapiens
tgattctccttcagcc

SEQ ID NO: 5951390 - DNA, 18 bp, Homo sapiens
tgattctccttcagccct

SEQ ID NO: 5951391 - DNA, 17 bp, Homo sapiens
tgattctcgactgcttt

SEQ ID NO: 5951392 - DNA, 21 bp, Homo sapiens
tgattctctaccaacaataaa

SEQ ID NO: 5951393 - DNA, 20 bp, Homo sapiens
tgattctctatgacatgaaa

SEQ ID NO: 5951394 - DNA, 11 bp, Homo sapiens
tgattctctcc

SEQ ID NO: 5951395 - DNA, 16 bp, Homo sapiens
tgattctgaaattttt

SEQ ID NO: 5951396 - DNA, 22 bp, Homo sapiens
tgattctgaaatttttttccta

SEQ ID NO: 5951397 - DNA, 23 bp, Homo sapiens
tgattctgaaatttttttcctaa

SEQ ID NO: 5951398 - DNA, 23 bp, Homo sapiens
tgattctgaagcttatgtttctt

SEQ ID NO: 5951399 - DNA, 11 bp, Homo sapiens
tgattctgatt

SEQ ID NO: 5951400 - DNA, 14 bp, Homo sapiens
tgattctgattgct

SEQ ID NO: 5951401 - DNA, 13 bp, Homo sapiens
tgattctgatttc

SEQ ID NO: 5951402 - DNA, 15 bp, Homo sapiens
tgattctgatttcag

SEQ ID NO: 5951403 - DNA, 18 bp, Homo sapiens
tgattctgatttcagttt

SEQ ID NO: 5951404 - DNA, 21 bp, Homo sapiens
tgattctggctttaagccttc

SEQ ID NO: 5951405 - DNA, 19 bp, Homo sapiens
tgattctgggatggaccct

SEQ ID NO: 5951406 - DNA, 22 bp, Homo sapiens
tgattctgggatggaccctcgc

SEQ ID NO: 5951407 - DNA, 22 bp, Homo sapiens
tgattctgttgtgttcaccaga

SEQ ID NO: 5951408 - DNA, 21 bp, Homo sapiens
tgattcttagcaaaaaatgaa

SEQ ID NO: 5951409 - DNA, 22 bp, Homo sapiens
tgattcttagcaaaaaatgaac

SEQ ID NO: 5951410 - DNA, 21 bp, Homo sapiens
tgattcttgattcctggctct

SEQ ID NO: 5951411 - DNA, 12 bp, Homo sapiens
tgattcttgtaa

SEQ ID NO: 5951412 - DNA, 18 bp, Homo sapiens
tgattcttgtaaatcttt

SEQ ID NO: 5951413 - DNA, 20 bp, Homo sapiens
tgattcttgtaaatcttttt

SEQ ID NO: 5951414 - DNA, 21 bp, Homo sapiens
tgattcttgtaaatctttttg

SEQ ID NO: 5951415 - DNA, 14 bp, Homo sapiens
tgattctttgttac

SEQ ID NO: 5951416 - DNA, 23 bp, Homo sapiens
tgattgaaaccaagttgaaaaat

SEQ ID NO: 5951417 - DNA, 11 bp, Homo sapiens
tgattgaaaga

SEQ ID NO: 5951418 - DNA, 16 bp, Homo sapiens
tgattgaaagaaaaaa

SEQ ID NO: 5951419 - DNA, 14 bp, Homo sapiens
tgattgaaccagct

SEQ ID NO: 5951420 - DNA, 20 bp, Homo sapiens
tgattgaacgttctcaaacc

SEQ ID NO: 5951421 - DNA, 22 bp, Homo sapiens
tgattgaatctgattggacatt

SEQ ID NO: 5951422 - DNA, 21 bp, Homo sapiens
tgattgaatttttaagcaaat

SEQ ID NO: 5951423 - DNA, 15 bp, Homo sapiens
tgattgacacacagc

SEQ ID NO: 5951424 - DNA, 19 bp, Homo sapiens
tgattgacagctttgctgc

SEQ ID NO: 5951425 - DNA, 22 bp, Homo sapiens
tgattgacattttgtagctagt

SEQ ID NO: 5951426 - DNA, 20 bp, Homo sapiens
tgattgagaagttcattgtc

SEQ ID NO: 5951427 - DNA, 17 bp, Homo sapiens
tgattgaggagctgcac

SEQ ID NO: 5951428 - DNA, 15 bp, Homo sapiens
tgattgaggtgggtc

SEQ ID NO: 5951429 - DNA, 19 bp, Homo sapiens
tgattgatcacacagtgtt

SEQ ID NO: 5951430 - DNA, 15 bp, Homo sapiens
tgattgatgaccctt

SEQ ID NO: 5951431 - DNA, 14 bp, Homo sapiens
tgattgatgtacag

SEQ ID NO: 5951432 - DNA, 15 bp, Homo sapiens
tgattgattcagtat

SEQ ID NO: 5951433 - DNA, 17 bp, Homo sapiens
tgattgatttgaagtgg

SEQ ID NO: 5951434 - DNA, 15 bp, Homo sapiens
tgattgcacagaatt

SEQ ID NO: 5951435 - DNA, 10 bp, Homo sapiens
tgattgcact

SEQ ID NO: 5951436 - DNA, 15 bp, Homo sapiens
tgattgcagaaagga

SEQ ID NO: 5951437 - DNA, 17 bp, Homo sapiens
tgattgcagaaaggaga

SEQ ID NO: 5951438 - DNA, 18 bp, Homo sapiens
tgattgcagaaaggagag

SEQ ID NO: 5951439 - DNA, 18 bp, Homo sapiens
tgattgcagccttgacct

SEQ ID NO: 5951440 - DNA, 12 bp, Homo sapiens
tgattgcagctt

SEQ ID NO: 5951441 - DNA, 13 bp, Homo sapiens
tgattgcatattt

SEQ ID NO: 5951442 - DNA, 18 bp, Homo sapiens
tgattgccatttcttccc

SEQ ID NO: 5951443 - DNA, 15 bp, Homo sapiens
tgattgcccaatgga

SEQ ID NO: 5951444 - DNA, 15 bp, Homo sapiens
tgattgcgagaattt

SEQ ID NO: 5951445 - DNA, 13 bp, Homo sapiens
tgattgctaaatg

SEQ ID NO: 5951446 - DNA, 22 bp, Homo sapiens
tgattgctaaatgtaacagtct

SEQ ID NO: 5951447 - DNA, 15 bp, Homo sapiens
tgattgctccagagc

SEQ ID NO: 5951448 - DNA, 22 bp, Homo sapiens
tgattgctctggaagcctgctg

SEQ ID NO: 5951449 - DNA, 15 bp, Homo sapiens
tgattgctgccaggc

SEQ ID NO: 5951450 - DNA, 16 bp, Homo sapiens
tgattgctttgctgca

SEQ ID NO: 5951451 - DNA, 19 bp, Homo sapiens
tgattgctttgctgcacag

SEQ ID NO: 5951452 - DNA, 14 bp, Homo sapiens
tgattgcttttaaa

SEQ ID NO: 5951453 - DNA, 14 bp, Homo sapiens
tgattggaaaataa

SEQ ID NO: 5951454 - DNA, 15 bp, Homo sapiens
tgattggaaaataat

SEQ ID NO: 5951455 - DNA, 17 bp, Homo sapiens
tgattggaaaataataa

SEQ ID NO: 5951456 - DNA, 22 bp, Homo sapiens
tgattggaagggcttttcaaaa

SEQ ID NO: 5951457 - DNA, 23 bp, Homo sapiens
tgattggacattttcttcagaga

SEQ ID NO: 5951458 - DNA, 19 bp, Homo sapiens
tgattggagtgtgtccgga

SEQ ID NO: 5951459 - DNA, 15 bp, Homo sapiens
tgattggattattca

SEQ ID NO: 5951460 - DNA, 16 bp, Homo sapiens
tgattggattattcat

SEQ ID NO: 5951461 - DNA, 21 bp, Homo sapiens
tgattggattattcatttaaa

SEQ ID NO: 5951462 - DNA, 19 bp, Homo sapiens
tgattggcagcttcaaaac

SEQ ID NO: 5951463 - DNA, 12 bp, Homo sapiens
tgattggctgca

SEQ ID NO: 5951464 - DNA, 21 bp, Homo sapiens
tgattggctgcttaaactgga

SEQ ID NO: 5951465 - DNA, 13 bp, Homo sapiens
tgattggctggtt

SEQ ID NO: 5951466 - DNA, 22 bp, Homo sapiens
tgattggcttaaagtgaaggaa

SEQ ID NO: 5951467 - DNA, 21 bp, Homo sapiens
tgattggcttgtagaattgtt

SEQ ID NO: 5951468 - DNA, 15 bp, Homo sapiens
tgattgggaaaacat

SEQ ID NO: 5951469 - DNA, 16 bp, Homo sapiens
tgattgggaaaacatt

SEQ ID NO: 5951470 - DNA, 22 bp, Homo sapiens
tgattgggactggggctgaagg

SEQ ID NO: 5951471 - DNA, 18 bp, Homo sapiens
tgattgggcacatcattt

SEQ ID NO: 5951472 - DNA, 20 bp, Homo sapiens
tgattgggcacatcatttca

SEQ ID NO: 5951473 - DNA, 21 bp, Homo sapiens
tgattgggcacatcatttcaa

SEQ ID NO: 5951474 - DNA, 19 bp, Homo sapiens
tgattggggaattaaaagt

SEQ ID NO: 5951475 - DNA, 20 bp, Homo sapiens
tgattggtccaacagtttga

SEQ ID NO: 5951476 - DNA, 19 bp, Homo sapiens
tgattggtgcaacccttac

SEQ ID NO: 5951477 - DNA, 16 bp, Homo sapiens
tgattggttaaaatgt

SEQ ID NO: 5951478 - DNA, 15 bp, Homo sapiens
tgattggttgtgcct

SEQ ID NO: 5951479 - DNA, 17 bp, Homo sapiens
tgattggtttctcttct

SEQ ID NO: 5951480 - DNA, 23 bp, Homo sapiens
tgattggttttggggaaatgtgg

SEQ ID NO: 5951481 - DNA, 23 bp, Homo sapiens
tgattgtaaaatagcttgtatag

SEQ ID NO: 5951482 - DNA, 16 bp, Homo sapiens
tgattgtaacatattt

SEQ ID NO: 5951483 - DNA, 19 bp, Homo sapiens
tgattgtaacgttgctgtg

SEQ ID NO: 5951484 - DNA, 19 bp, Homo sapiens
tgattgtataatgtgattt

SEQ ID NO: 5951485 - DNA, 15 bp, Homo sapiens
tgattgtatgttgag

SEQ ID NO: 5951486 - DNA, 23 bp, Homo sapiens
tgattgtcaacacaaactggctt

SEQ ID NO: 5951487 - DNA, 14 bp, Homo sapiens
tgattgtcagctac

SEQ ID NO: 5951488 - DNA, 21 bp, Homo sapiens
tgattgtcctttaaaaaagaa

SEQ ID NO: 5951489 - DNA, 22 bp, Homo sapiens
tgattgtctaaccaattgtgag

SEQ ID NO: 5951490 - DNA, 14 bp, Homo sapiens
tgattgtcttaata

SEQ ID NO: 5951491 - DNA, 18 bp, Homo sapiens
tgattgtcttaatattgt

SEQ ID NO: 5951492 - DNA, 14 bp, Homo sapiens
tgattgtctttttc

SEQ ID NO: 5951493 - DNA, 18 bp, Homo sapiens
tgattgtctttttcctat

SEQ ID NO: 5951494 - DNA, 11 bp, Homo sapiens
tgattgtgaag

SEQ ID NO: 5951495 - DNA, 12 bp, Homo sapiens
tgattgtgaagg

SEQ ID NO: 5951496 - DNA, 18 bp, Homo sapiens
tgattgtgaattccttaa

SEQ ID NO: 5951497 - DNA, 16 bp, Homo sapiens
tgattgtgttgaagaa

SEQ ID NO: 5951498 - DNA, 18 bp, Homo sapiens
tgattgttagttaagttt

SEQ ID NO: 5951499 - DNA, 14 bp, Homo sapiens
tgattgttcataat

SEQ ID NO: 5951500 - DNA, 18 bp, Homo sapiens
tgattgttcctccccagc

SEQ ID NO: 5951501 - DNA, 18 bp, Homo sapiens
tgattgttcgggtgtgca

SEQ ID NO: 5951502 - DNA, 15 bp, Homo sapiens
tgattgttcttttgt

SEQ ID NO: 5951503 - DNA, 11 bp, Homo sapiens
tgattgtttac

SEQ ID NO: 5951504 - DNA, 14 bp, Homo sapiens
tgattgtttacagg

SEQ ID NO: 5951505 - DNA, 21 bp, Homo sapiens
tgattgtttatttttctatga

SEQ ID NO: 5951506 - DNA, 20 bp, Homo sapiens
tgattgtttgcacagagggc

SEQ ID NO: 5951507 - DNA, 16 bp, Homo sapiens
tgattgtttgctctga

SEQ ID NO: 5951508 - DNA, 15 bp, Homo sapiens
tgatttaaaaaataa

SEQ ID NO: 5951509 - DNA, 15 bp, Homo sapiens
tgatttaaaaacaac

SEQ ID NO: 5951510 - DNA, 15 bp, Homo sapiens
tgatttaaaaacttg

SEQ ID NO: 5951511 - DNA, 14 bp, Homo sapiens
tgatttaaaacatg

SEQ ID NO: 5951512 - DNA, 15 bp, Homo sapiens
tgatttaaaagtgta

SEQ ID NO: 5951513 - DNA, 12 bp, Homo sapiens
tgatttaaaatt

SEQ ID NO: 5951514 - DNA, 16 bp, Homo sapiens
tgatttaaacacacag

SEQ ID NO: 5951515 - DNA, 15 bp, Homo sapiens
tgatttaaacacatt

SEQ ID NO: 5951516 - DNA, 20 bp, Homo sapiens
tgatttaaagactacaataa

SEQ ID NO: 5951517 - DNA, 22 bp, Homo sapiens
tgatttaaagactacaataaaa

SEQ ID NO: 5951518 - DNA, 22 bp, Homo sapiens
tgatttaaagtgaacacacaca

SEQ ID NO: 5951519 - DNA, 20 bp, Homo sapiens
tgatttaactgacttaacaa

SEQ ID NO: 5951520 - DNA, 20 bp, Homo sapiens
tgatttaataaaataattct

SEQ ID NO: 5951521 - DNA, 22 bp, Homo sapiens
tgatttaataaaataattctaa

SEQ ID NO: 5951522 - DNA, 18 bp, Homo sapiens
tgatttaatagtgttaat

SEQ ID NO: 5951523 - DNA, 22 bp, Homo sapiens
tgatttaatagtgttaatcaat

SEQ ID NO: 5951524 - DNA, 15 bp, Homo sapiens
tgatttaatatgcaa

SEQ ID NO: 5951525 - DNA, 17 bp, Homo sapiens
tgatttaatatgcaaag

SEQ ID NO: 5951526 - DNA, 20 bp, Homo sapiens
tgatttaatccagatctggg

SEQ ID NO: 5951527 - DNA, 13 bp, Homo sapiens
tgatttaatgttt

SEQ ID NO: 5951528 - DNA, 14 bp, Homo sapiens
tgatttaatgtttt

SEQ ID NO: 5951529 - DNA, 15 bp, Homo sapiens
tgatttaatgttttc

SEQ ID NO: 5951530 - DNA, 22 bp, Homo sapiens
tgatttacatatattatttatt

SEQ ID NO: 5951531 - DNA, 14 bp, Homo sapiens
tgatttacatgctg

SEQ ID NO: 5951532 - DNA, 12 bp, Homo sapiens
tgatttacatgt

SEQ ID NO: 5951533 - DNA, 20 bp, Homo sapiens
tgatttacatgtatggttac

SEQ ID NO: 5951534 - DNA, 15 bp, Homo sapiens
tgatttacctttgga

SEQ ID NO: 5951535 - DNA, 21 bp, Homo sapiens
tgatttactaacagtaactgc

SEQ ID NO: 5951536 - DNA, 16 bp, Homo sapiens
tgcaaggaaggaaaca

SEQ ID NO: 5951537 - DNA, 18 bp, Homo sapiens
tgcaaggacattcttgta

SEQ ID NO: 5951538 - DNA, 13 bp, Homo sapiens
tgcaaggaccagg

SEQ ID NO: 5951539 - DNA, 14 bp, Homo sapiens
tgcaaggaccagga

SEQ ID NO: 5951540 - DNA, 21 bp, Homo sapiens
tgcaaggattacagaaactga

SEQ ID NO: 5951541 - DNA, 21 bp, Homo sapiens
tgcaaggattttttaaaaatt

SEQ ID NO: 5951542 - DNA, 16 bp, Homo sapiens
tgcaaggcaaagtaaa

SEQ ID NO: 5951543 - DNA, 16 bp, Homo sapiens
tgcaaggcagccgtgg

SEQ ID NO: 5951544 - DNA, 13 bp, Homo sapiens
tgcaaggcccaca

SEQ ID NO: 5951545 - DNA, 23 bp, Homo sapiens
tgcaaggccgctgttcacccaca

SEQ ID NO: 5951546 - DNA, 21 bp, Homo sapiens
tgcaaggccttgaagacatga

SEQ ID NO: 5951547 - DNA, 14 bp, Homo sapiens
tgcaaggcctttct

SEQ ID NO: 5951548 - DNA, 11 bp, Homo sapiens
tgcaagggaaa

SEQ ID NO: 5951549 - DNA, 23 bp, Homo sapiens
tgcaagggaagagcctttataca

SEQ ID NO: 5951550 - DNA, 20 bp, Homo sapiens
tgcaagggagttagggaaat

SEQ ID NO: 5951551 - DNA, 22 bp, Homo sapiens
tgcaagggcagaacactaacct

SEQ ID NO: 5951552 - DNA, 13 bp, Homo sapiens
tgcaagggcccag

SEQ ID NO: 5951553 - DNA, 14 bp, Homo sapiens
tgcaagggcccaga

SEQ ID NO: 5951554 - DNA, 15 bp, Homo sapiens
tgcaagggcccagag

SEQ ID NO: 5951555 - DNA, 16 bp, Homo sapiens
tgcaagggcccagagt

SEQ ID NO: 5951556 - DNA, 17 bp, Homo sapiens
tgcaagggcccagagtg

SEQ ID NO: 5951557 - DNA, 20 bp, Homo sapiens
tgcaagggctccccactgcc

SEQ ID NO: 5951558 - DNA, 15 bp, Homo sapiens
tgcaaggggctcagc

SEQ ID NO: 5951559 - DNA, 19 bp, Homo sapiens
tgcaaggggctcagcaagg

SEQ ID NO: 5951560 - DNA, 15 bp, Homo sapiens
tgcaagggggacaca

SEQ ID NO: 5951561 - DNA, 15 bp, Homo sapiens
tgcaaggtaaaattt

SEQ ID NO: 5951562 - DNA, 19 bp, Homo sapiens
tgcaaggtatttctccagt

SEQ ID NO: 5951563 - DNA, 19 bp, Homo sapiens
tgcaaggtcttgcatttaa

SEQ ID NO: 5951564 - DNA, 14 bp, Homo sapiens
tgcaaggtgaaacg

SEQ ID NO: 5951565 - DNA, 17 bp, Homo sapiens
tgcaaggtgataggaaa

SEQ ID NO: 5951566 - DNA, 18 bp, Homo sapiens
tgcaaggtgataggaaaa

SEQ ID NO: 5951567 - DNA, 22 bp, Homo sapiens
tgcaaggtggcctctgcctggg

SEQ ID NO: 5951568 - DNA, 14 bp, Homo sapiens
tgcaaggtggcctt

SEQ ID NO: 5951569 - DNA, 23 bp, Homo sapiens
tgcaaggtggcctttgtgctgcg

SEQ ID NO: 5951570 - DNA, 12 bp, Homo sapiens
tgcaaggttcca

SEQ ID NO: 5951571 - DNA, 17 bp, Homo sapiens
tgcaaggttccacagag

SEQ ID NO: 5951572 - DNA, 18 bp, Homo sapiens
tgcaaggttccacagagt

SEQ ID NO: 5951573 - DNA, 17 bp, Homo sapiens
tgcaagtatactaggga

SEQ ID NO: 5951574 - DNA, 18 bp, Homo sapiens
tgcaagtatgtgagtgtg

SEQ ID NO: 5951575 - DNA, 21 bp, Homo sapiens
tgcaagtatgttttagcatgt

SEQ ID NO: 5951576 - DNA, 14 bp, Homo sapiens
tgcaagtattctca

SEQ ID NO: 5951577 - DNA, 15 bp, Homo sapiens
tgcaagtattctcat

SEQ ID NO: 5951578 - DNA, 18 bp, Homo sapiens
tgcaagtcacaaaggaat

SEQ ID NO: 5951579 - DNA, 13 bp, Homo sapiens
tgcaagtcagagg

SEQ ID NO: 5951580 - DNA, 21 bp, Homo sapiens
tgcaagtcagaggatggccag

SEQ ID NO: 5951581 - DNA, 18 bp, Homo sapiens
tgcaagtcatacttagga

SEQ ID NO: 5951582 - DNA, 15 bp, Homo sapiens
tgcaagtcccaggga

SEQ ID NO: 5951583 - DNA, 21 bp, Homo sapiens
tgcaagtctgccgattttgta

SEQ ID NO: 5951584 - DNA, 16 bp, Homo sapiens
tgcaagtgaaataata

SEQ ID NO: 5951585 - DNA, 17 bp, Homo sapiens
tgcaagtgaacttggga

SEQ ID NO: 5951586 - DNA, 16 bp, Homo sapiens
tgcaagtgagaaagac

SEQ ID NO: 5951587 - DNA, 20 bp, Homo sapiens
tgcaagtgagcaaacctgcc

SEQ ID NO: 5951588 - DNA, 22 bp, Homo sapiens
tgcaagtgagcaaacctgcccc

SEQ ID NO: 5951589 - DNA, 23 bp, Homo sapiens
tgcaagtgagcaaacctgcccca

SEQ ID NO: 5951590 - DNA, 23 bp, Homo sapiens
tgcaagtgcccgccctgcccctg

SEQ ID NO: 5951591 - DNA, 15 bp, Homo sapiens
tgcaagtgctggagt

SEQ ID NO: 5951592 - DNA, 21 bp, Homo sapiens
tgcaagtggagctgtctgtct

SEQ ID NO: 5951593 - DNA, 19 bp, Homo sapiens
tgcaagtgggagatgaaaa

SEQ ID NO: 5951594 - DNA, 21 bp, Homo sapiens
tgcaagtgtatgcacgtgtgc

SEQ ID NO: 5951595 - DNA, 20 bp, Homo sapiens
tgcaagtgtctggagcggct

SEQ ID NO: 5951596 - DNA, 15 bp, Homo sapiens
tgcaagtgtgcatgg

SEQ ID NO: 5951597 - DNA, 22 bp, Homo sapiens
tgcaagtgtgtatgtgcgtgtg

SEQ ID NO: 5951598 - DNA, 14 bp, Homo sapiens
tgcaagtgtgtgca

SEQ ID NO: 5951599 - DNA, 21 bp, Homo sapiens
tgcaagtgtgtgcacatgtgt

SEQ ID NO: 5951600 - DNA, 13 bp, Homo sapiens
tgcaagtgtttct

SEQ ID NO: 5951601 - DNA, 15 bp, Homo sapiens
tgcaagttattttat

SEQ ID NO: 5951602 - DNA, 17 bp, Homo sapiens
tgcaagttattttattt

SEQ ID NO: 5951603 - DNA, 18 bp, Homo sapiens
tgcaagttattttatttg

SEQ ID NO: 5951604 - DNA, 18 bp, Homo sapiens
tgcaagttcaagactgaa

SEQ ID NO: 5951605 - DNA, 22 bp, Homo sapiens
tgcaagttcaagggctctttct

SEQ ID NO: 5951606 - DNA, 15 bp, Homo sapiens
tgcaagttgctctga

SEQ ID NO: 5951607 - DNA, 22 bp, Homo sapiens
tgcaagtttctgtttcaaagca

SEQ ID NO: 5951608 - DNA, 20 bp, Homo sapiens
tgcaagttttcagtacaaat

SEQ ID NO: 5951609 - DNA, 16 bp, Homo sapiens
tgcaataaaaaagtga

SEQ ID NO: 5951610 - DNA, 20 bp, Homo sapiens
tgcaataaaattatttgcag

SEQ ID NO: 5951611 - DNA, 14 bp, Homo sapiens
tgcaataaaattta

SEQ ID NO: 5951612 - DNA, 23 bp, Homo sapiens
tgcaataaactcagtcaaatgta

SEQ ID NO: 5951613 - DNA, 22 bp, Homo sapiens
tgcaataaatccgcttctcctg

SEQ ID NO: 5951614 - DNA, 20 bp, Homo sapiens
tgcaataaatctgacccagt

SEQ ID NO: 5951615 - DNA, 14 bp, Homo sapiens
tgcaataacagctg

SEQ ID NO: 5951616 - DNA, 16 bp, Homo sapiens
tgcaataacagctgca

SEQ ID NO: 5951617 - DNA, 18 bp, Homo sapiens
tgcaataacagctgcaat

SEQ ID NO: 5951618 - DNA, 12 bp, Homo sapiens
tgcaataacagt

SEQ ID NO: 5951619 - DNA, 17 bp, Homo sapiens
tgcaataactctgggag

SEQ ID NO: 5951620 - DNA, 17 bp, Homo sapiens
tgcaataacttctatat

SEQ ID NO: 5951621 - DNA, 22 bp, Homo sapiens
tgcaataacttctatattttaa

SEQ ID NO: 5951622 - DNA, 23 bp, Homo sapiens
tgcaataacttgtgtattagata

SEQ ID NO: 5951623 - DNA, 18 bp, Homo sapiens
tgcaataaggatttattc

SEQ ID NO: 5951624 - DNA, 18 bp, Homo sapiens
tgcaataatatcaaaaca

SEQ ID NO: 5951625 - DNA, 19 bp, Homo sapiens
tgcaataatatcaaaacaa

SEQ ID NO: 5951626 - DNA, 19 bp, Homo sapiens
tgcaataatccacccccag

SEQ ID NO: 5951627 - DNA, 22 bp, Homo sapiens
tgcaataatgatcaaagttttg

SEQ ID NO: 5951628 - DNA, 12 bp, Homo sapiens
tgcaataatgca

SEQ ID NO: 5951629 - DNA, 16 bp, Homo sapiens
tgcaataatgcagtat

SEQ ID NO: 5951630 - DNA, 18 bp, Homo sapiens
tgcaataatgcagtatgg

SEQ ID NO: 5951631 - DNA, 11 bp, Homo sapiens
tgcaataattt

SEQ ID NO: 5951632 - DNA, 14 bp, Homo sapiens
tgcaataatttgta

SEQ ID NO: 5951633 - DNA, 15 bp, Homo sapiens
tgcaataatttgtac

SEQ ID NO: 5951634 - DNA, 17 bp, Homo sapiens
tgcaataatttgtacaa

SEQ ID NO: 5951635 - DNA, 14 bp, Homo sapiens
tgcaataattttac

SEQ ID NO: 5951636 - DNA, 16 bp, Homo sapiens
tgcaatacaagtttca

SEQ ID NO: 5951637 - DNA, 23 bp, Homo sapiens
tgcaatacgggagtgacccagct

SEQ ID NO: 5951638 - DNA, 23 bp, Homo sapiens
tgcaatactgcttaattgctgat

SEQ ID NO: 5951639 - DNA, 13 bp, Homo sapiens
tgcaatacttaga

SEQ ID NO: 5951640 - DNA, 21 bp, Homo sapiens
tgcaatagaagtgctcccctc

SEQ ID NO: 5951641 - DNA, 16 bp, Homo sapiens
tgcaatagcagttata

SEQ ID NO: 5951642 - DNA, 21 bp, Homo sapiens
tgcaataggtgagagaatgta

SEQ ID NO: 5951643 - DNA, 17 bp, Homo sapiens
tgcaatagtcagagtgt

SEQ ID NO: 5951644 - DNA, 22 bp, Homo sapiens
tgcaatagtgcaacatctctga

SEQ ID NO: 5951645 - DNA, 18 bp, Homo sapiens
tgcaatataaaaatgtga

SEQ ID NO: 5951646 - DNA, 20 bp, Homo sapiens
tgcaatataagcataaaaga

SEQ ID NO: 5951647 - DNA, 21 bp, Homo sapiens
tgcaatatagagactgtgttc

SEQ ID NO: 5951648 - DNA, 21 bp, Homo sapiens
tgcaatatcttcgttagtaat

SEQ ID NO: 5951649 - DNA, 22 bp, Homo sapiens
tgcaatatgaggggactgcatg

SEQ ID NO: 5951650 - DNA, 13 bp, Homo sapiens
tgcaatatggatt

SEQ ID NO: 5951651 - DNA, 14 bp, Homo sapiens
tgcaatatgtatta

SEQ ID NO: 5951652 - DNA, 18 bp, Homo sapiens
tgcaatattaatgccttt

SEQ ID NO: 5951653 - DNA, 22 bp, Homo sapiens
tgcaatatttcctcatgtgatc

SEQ ID NO: 5951654 - DNA, 14 bp, Homo sapiens
tgcaatatttgaat

SEQ ID NO: 5951655 - DNA, 24 bp, Homo sapiens
tgcaatcacagctcactgcagcct

SEQ ID NO: 5951656 - DNA, 20 bp, Homo sapiens
tgcaatcactgaaaactatg

SEQ ID NO: 5951657 - DNA, 14 bp, Homo sapiens
tgcaatcactgtgc

SEQ ID NO: 5951658 - DNA, 15 bp, Homo sapiens
tgcaatcactttttg

SEQ ID NO: 5951659 - DNA, 17 bp, Homo sapiens
tgcaatcactttttgga

SEQ ID NO: 5951660 - DNA, 18 bp, Homo sapiens
tgcaatcactttttggaa

SEQ ID NO: 5951661 - DNA, 23 bp, Homo sapiens
tgcaatcaggattttaaacatgt

SEQ ID NO: 5951662 - DNA, 20 bp, Homo sapiens
tgcaatcatatgtgatctgt

SEQ ID NO: 5951663 - DNA, 21 bp, Homo sapiens
tgcaatccaggctgttctcag

SEQ ID NO: 5951664 - DNA, 23 bp, Homo sapiens
tgcaatccaggctgttctcagcg

SEQ ID NO: 5951665 - DNA, 20 bp, Homo sapiens
tgcaatccatttatttcatt

SEQ ID NO: 5951666 - DNA, 19 bp, Homo sapiens
tgcaatcccatttgcagga

SEQ ID NO: 5951667 - DNA, 16 bp, Homo sapiens
tgcaatctaatctgaa

SEQ ID NO: 5951668 - DNA, 13 bp, Homo sapiens
tgcaatctactgg

SEQ ID NO: 5951669 - DNA, 18 bp, Homo sapiens
tgcaatctataatatttg

SEQ ID NO: 5951670 - DNA, 16 bp, Homo sapiens
tgcaatctccagggct

SEQ ID NO: 5951671 - DNA, 22 bp, Homo sapiens
tgcaatctccagggctgcccct

SEQ ID NO: 5951672 - DNA, 17 bp, Homo sapiens
tgcaatctctgcctccc

SEQ ID NO: 5951673 - DNA, 11 bp, Homo sapiens
tgcaatctctt

SEQ ID NO: 5951674 - DNA, 13 bp, Homo sapiens
tgcaatctgtcca

SEQ ID NO: 5951675 - DNA, 20 bp, Homo sapiens
tgcaatcttaagcagagata

SEQ ID NO: 5951676 - DNA, 11 bp, Homo sapiens
tgcaatgaaca

SEQ ID NO: 5951677 - DNA, 15 bp, Homo sapiens
tgcaatgaagtctct

SEQ ID NO: 5951678 - DNA, 16 bp, Homo sapiens
tgcaatgacctttcaa

SEQ ID NO: 5951679 - DNA, 17 bp, Homo sapiens
tgcaatgacctttcaat

SEQ ID NO: 5951680 - DNA, 14 bp, Homo sapiens
tgcaatgatcagac

SEQ ID NO: 5951681 - DNA, 15 bp, Homo sapiens
tgcaatgcagaggtt

SEQ ID NO: 5951682 - DNA, 16 bp, Homo sapiens
tgcaatgcatatctgt

SEQ ID NO: 5951683 - DNA, 15 bp, Homo sapiens
tgcaatgcatctgaa

SEQ ID NO: 5951684 - DNA, 17 bp, Homo sapiens
tgcaatgcatctgaaag

SEQ ID NO: 5951685 - DNA, 20 bp, Homo sapiens
tgcaatgcatctgaaagttt

SEQ ID NO: 5951686 - DNA, 15 bp, Homo sapiens
tgcaatgccccctcc

SEQ ID NO: 5951687 - DNA, 16 bp, Homo sapiens
tgcaatgccccctccc

SEQ ID NO: 5951688 - DNA, 13 bp, Homo sapiens
tgcaatgccctca

SEQ ID NO: 5951689 - DNA, 19 bp, Homo sapiens
tgcaatgcgtcttgtgaaa

SEQ ID NO: 5951690 - DNA, 21 bp, Homo sapiens
tgcaatgcgtcttgtgaaatt

SEQ ID NO: 5951691 - DNA, 16 bp, Homo sapiens
tgcaatgcttctgtag

SEQ ID NO: 5951692 - DNA, 15 bp, Homo sapiens
tgcaatgcttgtaga

SEQ ID NO: 5951693 - DNA, 22 bp, Homo sapiens
tgcaatgcttttatatggccca

SEQ ID NO: 5951694 - DNA, 22 bp, Homo sapiens
tgcaatggaatataaatatcac

SEQ ID NO: 5951695 - DNA, 15 bp, Homo sapiens
tgcaatggcagcatt

SEQ ID NO: 5951696 - DNA, 18 bp, Homo sapiens
tgcaatgggatgtatgaa

SEQ ID NO: 5951697 - DNA, 18 bp, Homo sapiens
tgcaatgggggagggagg

SEQ ID NO: 5951698 - DNA, 19 bp, Homo sapiens
tgcaatgggggagggaggg

SEQ ID NO: 5951699 - DNA, 21 bp, Homo sapiens
tgcaatgggtaagggagggaa

SEQ ID NO: 5951700 - DNA, 22 bp, Homo sapiens
tgcaatggtgactgatttcaaa

SEQ ID NO: 5951701 - DNA, 22 bp, Homo sapiens
tgcaatgtaaatattttaaaga

SEQ ID NO: 5951702 - DNA, 20 bp, Homo sapiens
tgcaatgtatggcttttctc

SEQ ID NO: 5951703 - DNA, 19 bp, Homo sapiens
tgcaatgtcacaacctctc

SEQ ID NO: 5951704 - DNA, 20 bp, Homo sapiens
tgcaatgtcacaacctctct

SEQ ID NO: 5951705 - DNA, 20 bp, Homo sapiens
tgcaatgtccagcagtctga

SEQ ID NO: 5951706 - DNA, 19 bp, Homo sapiens
tgcaatgtcccttgcacag

SEQ ID NO: 5951707 - DNA, 22 bp, Homo sapiens
tgcaatgtctgagtgaacctgt

SEQ ID NO: 5951708 - DNA, 22 bp, Homo sapiens
tgcaatgtcttaaataaaacta

SEQ ID NO: 5951709 - DNA, 20 bp, Homo sapiens
tgcaatgtgtgtatatggac

SEQ ID NO: 5951710 - DNA, 15 bp, Homo sapiens
tgcaatgttttcctt

SEQ ID NO: 5951711 - DNA, 18 bp, Homo sapiens
tgcaatgtttttgtgtag

SEQ ID NO: 5951712 - DNA, 16 bp, Homo sapiens
tgcactgaaacctgag

SEQ ID NO: 5951713 - DNA, 17 bp, Homo sapiens
tgcactgaaacctgaga

SEQ ID NO: 5951714 - DNA, 19 bp, Homo sapiens
tgcactgaaacctgagatg

SEQ ID NO: 5951715 - DNA, 18 bp, Homo sapiens
tgcactgaacagaattaa

SEQ ID NO: 5951716 - DNA, 15 bp, Homo sapiens
tgcactgaagagctc

SEQ ID NO: 5951717 - DNA, 20 bp, Homo sapiens
tgcactgaagccggacagct

SEQ ID NO: 5951718 - DNA, 14 bp, Homo sapiens
tgcactgaagtttt

SEQ ID NO: 5951719 - DNA, 18 bp, Homo sapiens
tgcactgaagtttttgaa

SEQ ID NO: 5951720 - DNA, 22 bp, Homo sapiens
tgcactgaatatataaacactc

SEQ ID NO: 5951721 - DNA, 15 bp, Homo sapiens
tgcactgacaagatg

SEQ ID NO: 5951722 - DNA, 21 bp, Homo sapiens
tgcactgacaccctggtcctg

SEQ ID NO: 5951723 - DNA, 18 bp, Homo sapiens
tgcactgacccacagcct

SEQ ID NO: 5951724 - DNA, 12 bp, Homo sapiens
tgcactgaccct

SEQ ID NO: 5951725 - DNA, 17 bp, Homo sapiens
tgcactgacctgtaggt

SEQ ID NO: 5951726 - DNA, 15 bp, Homo sapiens
tgcactgagggccac

SEQ ID NO: 5951727 - DNA, 16 bp, Homo sapiens
tgcactgagggccaca

SEQ ID NO: 5951728 - DNA, 16 bp, Homo sapiens
tgcactgatgctgccc

SEQ ID NO: 5951729 - DNA, 17 bp, Homo sapiens
tgcactgatgtccctcc

SEQ ID NO: 5951730 - DNA, 16 bp, Homo sapiens
tgcactgcaaatactt

SEQ ID NO: 5951731 - DNA, 17 bp, Homo sapiens
tgcactgcacttctgga

SEQ ID NO: 5951732 - DNA, 20 bp, Homo sapiens
tgcactgcagttatttacca

SEQ ID NO: 5951733 - DNA, 16 bp, Homo sapiens
tgcactgcatgcaaac

SEQ ID NO: 5951734 - DNA, 16 bp, Homo sapiens
tgcactgcattagaaa

SEQ ID NO: 5951735 - DNA, 17 bp, Homo sapiens
tgcactgccctccgccc

SEQ ID NO: 5951736 - DNA, 17 bp, Homo sapiens
tgcactgcctgcatgag

SEQ ID NO: 5951737 - DNA, 20 bp, Homo sapiens
tgcactgcctgcatgagctg

SEQ ID NO: 5951738 - DNA, 15 bp, Homo sapiens
tgcactgctcacttt

SEQ ID NO: 5951739 - DNA, 15 bp, Homo sapiens
tgcactgctgtaact

SEQ ID NO: 5951740 - DNA, 20 bp, Homo sapiens
tgcactggagccacaggcag

SEQ ID NO: 5951741 - DNA, 20 bp, Homo sapiens
tgcactggcaggatcacagc

SEQ ID NO: 5951742 - DNA, 16 bp, Homo sapiens
tgcactggccacccaa

SEQ ID NO: 5951743 - DNA, 15 bp, Homo sapiens
tgcactggccccacc

SEQ ID NO: 5951744 - DNA, 20 bp, Homo sapiens
tgcactgggaggctcccctt

SEQ ID NO: 5951745 - DNA, 21 bp, Homo sapiens
tgcactgggaggctccccttc

SEQ ID NO: 5951746 - DNA, 17 bp, Homo sapiens
tgcactgggcaggttcc

SEQ ID NO: 5951747 - DNA, 20 bp, Homo sapiens
tgcactggggagcccgtctc

SEQ ID NO: 5951748 - DNA, 19 bp, Homo sapiens
tgcactggggtaccacatg

SEQ ID NO: 5951749 - DNA, 12 bp, Homo sapiens
tgcactgtaaaa

SEQ ID NO: 5951750 - DNA, 15 bp, Homo sapiens
tgcactgtaaaatgt

SEQ ID NO: 5951751 - DNA, 17 bp, Homo sapiens
tgcactgtaaaatgtgg

SEQ ID NO: 5951752 - DNA, 17 bp, Homo sapiens
tgcactgtaaattgctg

SEQ ID NO: 5951753 - DNA, 21 bp, Homo sapiens
tgcactgtaagacgtatgtaa

SEQ ID NO: 5951754 - DNA, 15 bp, Homo sapiens
tgcactgtatcattt

SEQ ID NO: 5951755 - DNA, 20 bp, Homo sapiens
tgcactgtatcatttcatgc

SEQ ID NO: 5951756 - DNA, 16 bp, Homo sapiens
tgcactgtatgctgga

SEQ ID NO: 5951757 - DNA, 16 bp, Homo sapiens
tgcactgtcaagatga

SEQ ID NO: 5951758 - DNA, 13 bp, Homo sapiens
tgcactgtccagc

SEQ ID NO: 5951759 - DNA, 15 bp, Homo sapiens
tgcactgtcctgctc

SEQ ID NO: 5951760 - DNA, 16 bp, Homo sapiens
tgcactgtcctgctcc

SEQ ID NO: 5951761 - DNA, 20 bp, Homo sapiens
tgcactgtcctgctccacag

SEQ ID NO: 5951762 - DNA, 18 bp, Homo sapiens
tgcactgtgaaggaccct

SEQ ID NO: 5951763 - DNA, 19 bp, Homo sapiens
tgcactgtgaatcctggca

SEQ ID NO: 5951764 - DNA, 12 bp, Homo sapiens
tgcactgtgaca

SEQ ID NO: 5951765 - DNA, 21 bp, Homo sapiens
tgcactgtgacaccagaataa

SEQ ID NO: 5951766 - DNA, 12 bp, Homo sapiens
tgcactgtgccc

SEQ ID NO: 5951767 - DNA, 19 bp, Homo sapiens
tgcactgtgtcatcttttc

SEQ ID NO: 5951768 - DNA, 22 bp, Homo sapiens
tgcactgtgtgctgactgaaca

SEQ ID NO: 5951769 - DNA, 22 bp, Homo sapiens
tgcactgttactcttaatttta

SEQ ID NO: 5951770 - DNA, 16 bp, Homo sapiens
tgcactgttacttttt

SEQ ID NO: 5951771 - DNA, 19 bp, Homo sapiens
tgcactgttcaggagtcca

SEQ ID NO: 5951772 - DNA, 19 bp, Homo sapiens
tgcactgttccccctgtgc

SEQ ID NO: 5951773 - DNA, 12 bp, Homo sapiens
tgcactgtttaa

SEQ ID NO: 5951774 - DNA, 15 bp, Homo sapiens
tgcactgtttgcatg

SEQ ID NO: 5951775 - DNA, 19 bp, Homo sapiens
tgcactgtttgcatgcgcc

SEQ ID NO: 5951776 - DNA, 14 bp, Homo sapiens
tgcactgtttttaa

SEQ ID NO: 5951777 - DNA, 23 bp, Homo sapiens
tgcacttaacaagctcccaggcc

SEQ ID NO: 5951778 - DNA, 16 bp, Homo sapiens
tgcacttaaggcactc

SEQ ID NO: 5951779 - DNA, 21 bp, Homo sapiens
tgcacttaaggcactctgtta

SEQ ID NO: 5951780 - DNA, 14 bp, Homo sapiens
tgcacttagccatg

SEQ ID NO: 5951781 - DNA, 17 bp, Homo sapiens
tgcacttagtagttttt

SEQ ID NO: 5951782 - DNA, 21 bp, Homo sapiens
tgcacttatatagcacctttc

SEQ ID NO: 5951783 - DNA, 23 bp, Homo sapiens
tgcacttatctcgaatttgaaga

SEQ ID NO: 5951784 - DNA, 19 bp, Homo sapiens
tgcacttatgatttcatgt

SEQ ID NO: 5951785 - DNA, 16 bp, Homo sapiens
tgcacttatgtacttg

SEQ ID NO: 5951786 - DNA, 19 bp, Homo sapiens
tgcacttattgaccatttt

SEQ ID NO: 5951787 - DNA, 21 bp, Homo sapiens
tgcacttattgtccccttttt

SEQ ID NO: 5951788 - DNA, 22 bp, Homo sapiens
tgcacttattttttaatgtgag

SEQ ID NO: 5951789 - DNA, 23 bp, Homo sapiens
tgcacttattttttaatgtgaga

SEQ ID NO: 5951790 - DNA, 20 bp, Homo sapiens
tgcacttcaaataattaaat

SEQ ID NO: 5951791 - DNA, 21 bp, Homo sapiens
tgcacttcaaataattaaatc

SEQ ID NO: 5951792 - DNA, 14 bp, Homo sapiens
tgcacttcatatct

SEQ ID NO: 5951793 - DNA, 16 bp, Homo sapiens
tgcacttcatatctag

SEQ ID NO: 5951794 - DNA, 14 bp, Homo sapiens
tgcacttcatgtca

SEQ ID NO: 5951795 - DNA, 14 bp, Homo sapiens
tgcacttctattta

SEQ ID NO: 5951796 - DNA, 15 bp, Homo sapiens
tgcacttctgtaaac

SEQ ID NO: 5951797 - DNA, 15 bp, Homo sapiens
tgcacttctgttatc

SEQ ID NO: 5951798 - DNA, 14 bp, Homo sapiens
tgcacttcttacaa

SEQ ID NO: 5951799 - DNA, 15 bp, Homo sapiens
tgcacttggcctcag

SEQ ID NO: 5951800 - DNA, 21 bp, Homo sapiens
tgcacttggggcacagggaga

SEQ ID NO: 5951801 - DNA, 17 bp, Homo sapiens
tgcacttggtgctgctt

SEQ ID NO: 5951802 - DNA, 18 bp, Homo sapiens
tgcacttgtgatcctaaa

SEQ ID NO: 5951803 - DNA, 11 bp, Homo sapiens
tgcactttaga

SEQ ID NO: 5951804 - DNA, 21 bp, Homo sapiens
tgcactttagtgtattttctg

SEQ ID NO: 5951805 - DNA, 22 bp, Homo sapiens
tgcactttagtgtattttctgt

SEQ ID NO: 5951806 - DNA, 20 bp, Homo sapiens
tgcactttccaatgccacag

SEQ ID NO: 5951807 - DNA, 16 bp, Homo sapiens
tgcactttcccccttc

SEQ ID NO: 5951808 - DNA, 18 bp, Homo sapiens
tgcactttcccccttccc

SEQ ID NO: 5951809 - DNA, 20 bp, Homo sapiens
tgcactttcctttcaataaa

SEQ ID NO: 5951810 - DNA, 20 bp, Homo sapiens
tgcactttctatcctctgta

SEQ ID NO: 5951811 - DNA, 20 bp, Homo sapiens
tgcactttgatgtcatgtgt

SEQ ID NO: 5951812 - DNA, 12 bp, Homo sapiens
tgcactttgctt

SEQ ID NO: 5951813 - DNA, 16 bp, Homo sapiens
tgcactttgctttaat

SEQ ID NO: 5951814 - DNA, 18 bp, Homo sapiens
tgcactttgggtttttaa

SEQ ID NO: 5951815 - DNA, 21 bp, Homo sapiens
tgcactttgggtttttaactc

SEQ ID NO: 5951816 - DNA, 13 bp, Homo sapiens
tgcactttgtaaa

SEQ ID NO: 5951817 - DNA, 16 bp, Homo sapiens
tgcactttgtaaattc

SEQ ID NO: 5951818 - DNA, 17 bp, Homo sapiens
tgcactttgtaaattcc

SEQ ID NO: 5951819 - DNA, 13 bp, Homo sapiens
tgcactttgtagt

SEQ ID NO: 5951820 - DNA, 15 bp, Homo sapiens
tgcactttgtagtgt

SEQ ID NO: 5951821 - DNA, 22 bp, Homo sapiens
tgcactttgtgagtattctatg

SEQ ID NO: 5951822 - DNA, 20 bp, Homo sapiens
tgcactttgttctggctctt

SEQ ID NO: 5951823 - DNA, 17 bp, Homo sapiens
tgcactttgtttagaaa

SEQ ID NO: 5951824 - DNA, 19 bp, Homo sapiens
tgcactttgtttagaaaaa

SEQ ID NO: 5951825 - DNA, 23 bp, Homo sapiens
tgcacttttagccagagatgcaa

SEQ ID NO: 5951826 - DNA, 15 bp, Homo sapiens
tgcacttttctgtgt

SEQ ID NO: 5951827 - DNA, 16 bp, Homo sapiens
tgcacttttgaatgtc

SEQ ID NO: 5951828 - DNA, 15 bp, Homo sapiens
tgcactttttaagtt

SEQ ID NO: 5951829 - DNA, 16 bp, Homo sapiens
tgcacttttttatgaa

SEQ ID NO: 5951830 - DNA, 22 bp, Homo sapiens
tgcagaaaaaaaagaaaaaagt

SEQ ID NO: 5951831 - DNA, 17 bp, Homo sapiens
tgcagaaaaagaaaaaa

SEQ ID NO: 5951832 - DNA, 12 bp, Homo sapiens
tgcagaaaacat

SEQ ID NO: 5951833 - DNA, 18 bp, Homo sapiens
tgcagaaaagcacctgcc

SEQ ID NO: 5951834 - DNA, 20 bp, Homo sapiens
tgcagaaaagcacctgccga

SEQ ID NO: 5951835 - DNA, 16 bp, Homo sapiens
tgcagaaaatatttaa

SEQ ID NO: 5951836 - DNA, 15 bp, Homo sapiens
tgcagaaactactga

SEQ ID NO: 5951837 - DNA, 13 bp, Homo sapiens
tgcagaaagcatc

SEQ ID NO: 5951838 - DNA, 20 bp, Homo sapiens
tgcagaaagggccacccatg

SEQ ID NO: 5951839 - DNA, 16 bp, Homo sapiens
tgcagaaatagacaaa

SEQ ID NO: 5951840 - DNA, 19 bp, Homo sapiens
tgcagaaatagacaaaaag

SEQ ID NO: 5951841 - DNA, 16 bp, Homo sapiens
tgcagaaatgaaatag

SEQ ID NO: 5951842 - DNA, 21 bp, Homo sapiens
tgcagaaatgtggatgctctt

SEQ ID NO: 5951843 - DNA, 14 bp, Homo sapiens
tgcagaacaaatga

SEQ ID NO: 5951844 - DNA, 14 bp, Homo sapiens
tgcagaacacattt

SEQ ID NO: 5951845 - DNA, 13 bp, Homo sapiens
tgcagaacacctg

SEQ ID NO: 5951846 - DNA, 19 bp, Homo sapiens
tgcagaacaggcagaaata

SEQ ID NO: 5951847 - DNA, 23 bp, Homo sapiens
tgcagaacaggcagaaatataaa

SEQ ID NO: 5951848 - DNA, 18 bp, Homo sapiens
tgcagaacaggggcaccc

SEQ ID NO: 5951849 - DNA, 15 bp, Homo sapiens
tgcagaacagtgaaa

SEQ ID NO: 5951850 - DNA, 18 bp, Homo sapiens
tgcagaacagtgaaaggt

SEQ ID NO: 5951851 - DNA, 24 bp, Homo sapiens
tgcagaacatcgatatgtatatca

SEQ ID NO: 5951852 - DNA, 19 bp, Homo sapiens
tgcagaacatgagtgctga

SEQ ID NO: 5951853 - DNA, 20 bp, Homo sapiens
tgcagaaccagtgacaatct

SEQ ID NO: 5951854 - DNA, 14 bp, Homo sapiens
tgcagaacccccag

SEQ ID NO: 5951855 - DNA, 15 bp, Homo sapiens
tgcagaacccccagg

SEQ ID NO: 5951856 - DNA, 20 bp, Homo sapiens
tgcagaacccccaggtggcc

SEQ ID NO: 5951857 - DNA, 13 bp, Homo sapiens
tgcagaactgcca

SEQ ID NO: 5951858 - DNA, 20 bp, Homo sapiens
tgcagaactgccattatttt

SEQ ID NO: 5951859 - DNA, 21 bp, Homo sapiens
tgcagaactgccattattttc

SEQ ID NO: 5951860 - DNA, 23 bp, Homo sapiens
tgcagaactgccattattttctg

SEQ ID NO: 5951861 - DNA, 19 bp, Homo sapiens
tgcagaacttaatctggac

SEQ ID NO: 5951862 - DNA, 21 bp, Homo sapiens
tgcagaacttgaagcctgctc

SEQ ID NO: 5951863 - DNA, 23 bp, Homo sapiens
tgcagaacttgaagcctgctcct

SEQ ID NO: 5951864 - DNA, 14 bp, Homo sapiens
tgcagaagaagctg

SEQ ID NO: 5951865 - DNA, 22 bp, Homo sapiens
tgcagaagacagtatggcagct

SEQ ID NO: 5951866 - DNA, 20 bp, Homo sapiens
tgcagaagcatattttgctg

SEQ ID NO: 5951867 - DNA, 22 bp, Homo sapiens
tgcagaagcatattttgctggt

SEQ ID NO: 5951868 - DNA, 19 bp, Homo sapiens
tgcagaagccaagggaaga

SEQ ID NO: 5951869 - DNA, 14 bp, Homo sapiens
tgcagaagccagaa

SEQ ID NO: 5951870 - DNA, 18 bp, Homo sapiens
tgcagaagctatgttttt

SEQ ID NO: 5951871 - DNA, 19 bp, Homo sapiens
tgcagaaggaaaaatgtgt

SEQ ID NO: 5951872 - DNA, 21 bp, Homo sapiens
tgcagaaggaaaaatgtgtaa

SEQ ID NO: 5951873 - DNA, 18 bp, Homo sapiens
tgcagaaggaaatgatgg

SEQ ID NO: 5951874 - DNA, 23 bp, Homo sapiens
tgcagaaggcaatcttaaaacag

SEQ ID NO: 5951875 - DNA, 14 bp, Homo sapiens
tgcagaagggagga

SEQ ID NO: 5951876 - DNA, 23 bp, Homo sapiens
tgcagaagtattcttttcaatta

SEQ ID NO: 5951877 - DNA, 13 bp, Homo sapiens
tgcagaataatgg

SEQ ID NO: 5951878 - DNA, 21 bp, Homo sapiens
tgcagaatacagtaagctgct

SEQ ID NO: 5951879 - DNA, 12 bp, Homo sapiens
tgcagaatctct

SEQ ID NO: 5951880 - DNA, 15 bp, Homo sapiens
tgcagaatgaagcca

SEQ ID NO: 5951881 - DNA, 17 bp, Homo sapiens
tgcagaatgactccacc

SEQ ID NO: 5951882 - DNA, 21 bp, Homo sapiens
tgcagaatggcatttgcaata

SEQ ID NO: 5951883 - DNA, 20 bp, Homo sapiens
tgcagaatgtaagtgggccc

SEQ ID NO: 5951884 - DNA, 19 bp, Homo sapiens
tgcagacaacaccttcctc

SEQ ID NO: 5951885 - DNA, 18 bp, Homo sapiens
tgcagacaagtcttgctg

SEQ ID NO: 5951886 - DNA, 15 bp, Homo sapiens
tgcagacacctaacc

SEQ ID NO: 5951887 - DNA, 20 bp, Homo sapiens
tgcagacacctaaccccagg

SEQ ID NO: 5951888 - DNA, 23 bp, Homo sapiens
tgcagacacctaaccccagggca

SEQ ID NO: 5951889 - DNA, 18 bp, Homo sapiens
tgcagcttcctgtcaaca

SEQ ID NO: 5951890 - DNA, 22 bp, Homo sapiens
tgcagcttccttttgagggaca

SEQ ID NO: 5951891 - DNA, 15 bp, Homo sapiens
tgcagcttcgaggac

SEQ ID NO: 5951892 - DNA, 19 bp, Homo sapiens
tgcagcttcgaggacagga

SEQ ID NO: 5951893 - DNA, 14 bp, Homo sapiens
tgcagcttgcagtc

SEQ ID NO: 5951894 - DNA, 17 bp, Homo sapiens
tgcagcttggagacagg

SEQ ID NO: 5951895 - DNA, 16 bp, Homo sapiens
tgcagcttgggagagc

SEQ ID NO: 5951896 - DNA, 22 bp, Homo sapiens
tgcagcttgggagagcccctgg

SEQ ID NO: 5951897 - DNA, 23 bp, Homo sapiens
tgcagcttgggagagcccctggg

SEQ ID NO: 5951898 - DNA, 14 bp, Homo sapiens
tgcagcttgtagcc

SEQ ID NO: 5951899 - DNA, 18 bp, Homo sapiens
tgcagcttgtagccagcc

SEQ ID NO: 5951900 - DNA, 19 bp, Homo sapiens
tgcagcttgtagccagccg

SEQ ID NO: 5951901 - DNA, 21 bp, Homo sapiens
tgcagcttgtagccagccggg

SEQ ID NO: 5951902 - DNA, 22 bp, Homo sapiens
tgcagcttgtagccagccgggg

SEQ ID NO: 5951903 - DNA, 18 bp, Homo sapiens
tgcagcttgtccttgctc

SEQ ID NO: 5951904 - DNA, 20 bp, Homo sapiens
tgcagcttgtccttgctcct

SEQ ID NO: 5951905 - DNA, 21 bp, Homo sapiens
tgcagcttgtgctgagcctgc

SEQ ID NO: 5951906 - DNA, 23 bp, Homo sapiens
tgcagcttgtgtgcaaaagcagt

SEQ ID NO: 5951907 - DNA, 16 bp, Homo sapiens
tgcagctttggctgca

SEQ ID NO: 5951908 - DNA, 17 bp, Homo sapiens
tgcagctttgggaaagc

SEQ ID NO: 5951909 - DNA, 21 bp, Homo sapiens
tgcagcttttggttaatatgt

SEQ ID NO: 5951910 - DNA, 19 bp, Homo sapiens
tgcaggaaaaggctgcagc

SEQ ID NO: 5951911 - DNA, 19 bp, Homo sapiens
tgcaggaaatataaactta

SEQ ID NO: 5951912 - DNA, 18 bp, Homo sapiens
tgcaggaaatcagagctg

SEQ ID NO: 5951913 - DNA, 21 bp, Homo sapiens
tgcaggaacgagcactggcca

SEQ ID NO: 5951914 - DNA, 20 bp, Homo sapiens
tgcaggaagaaaagcccctc

SEQ ID NO: 5951915 - DNA, 12 bp, Homo sapiens
tgcaggaaggag

SEQ ID NO: 5951916 - DNA, 16 bp, Homo sapiens
tgcaggaataaggcct

SEQ ID NO: 5951917 - DNA, 17 bp, Homo sapiens
tgcaggaataaggcctt

SEQ ID NO: 5951918 - DNA, 20 bp, Homo sapiens
tgcaggaatcaaaaattgaa

SEQ ID NO: 5951919 - DNA, 18 bp, Homo sapiens
tgcaggacagctcttgat

SEQ ID NO: 5951920 - DNA, 15 bp, Homo sapiens
tgcaggacaggaggc

SEQ ID NO: 5951921 - DNA, 20 bp, Homo sapiens
tgcaggacaggaggcggccc

SEQ ID NO: 5951922 - DNA, 14 bp, Homo sapiens
tgcaggacattaat

SEQ ID NO: 5951923 - DNA, 15 bp, Homo sapiens
tgcaggacctgcctg

SEQ ID NO: 5951924 - DNA, 17 bp, Homo sapiens
tgcaggacctgcctgta

SEQ ID NO: 5951925 - DNA, 15 bp, Homo sapiens
tgcaggaccttgggc

SEQ ID NO: 5951926 - DNA, 22 bp, Homo sapiens
tgcaggactctatccctggctt

SEQ ID NO: 5951927 - DNA, 16 bp, Homo sapiens
tgcaggacttctgcct

SEQ ID NO: 5951928 - DNA, 13 bp, Homo sapiens
tgcaggacttgag

SEQ ID NO: 5951929 - DNA, 18 bp, Homo sapiens
tgcaggacttgagaagac

SEQ ID NO: 5951930 - DNA, 11 bp, Homo sapiens
tgcaggagaaa

SEQ ID NO: 5951931 - DNA, 17 bp, Homo sapiens
tgcaggagagagcagca

SEQ ID NO: 5951932 - DNA, 21 bp, Homo sapiens
tgcaggagagagcagcactcc

SEQ ID NO: 5951933 - DNA, 14 bp, Homo sapiens
tgcaggagcctccc

SEQ ID NO: 5951934 - DNA, 17 bp, Homo sapiens
tgcaggagcctccctgc

SEQ ID NO: 5951935 - DNA, 21 bp, Homo sapiens
tgcaggagcgtgaaggactta

SEQ ID NO: 5951936 - DNA, 14 bp, Homo sapiens
tgcaggagctagtt

SEQ ID NO: 5951937 - DNA, 13 bp, Homo sapiens
tgcaggaggccaa

SEQ ID NO: 5951938 - DNA, 23 bp, Homo sapiens
tgcaggaggccaaactgtccctc

SEQ ID NO: 5951939 - DNA, 12 bp, Homo sapiens
tgcaggaggcct

SEQ ID NO: 5951940 - DNA, 14 bp, Homo sapiens
tgcaggagtttgtg

SEQ ID NO: 5951941 - DNA, 17 bp, Homo sapiens
tgcaggagtttgtggta

SEQ ID NO: 5951942 - DNA, 17 bp, Homo sapiens
tgcaggatctcaccagg

SEQ ID NO: 5951943 - DNA, 19 bp, Homo sapiens
tgcaggatgattgtacaga

SEQ ID NO: 5951944 - DNA, 16 bp, Homo sapiens
tgcaggattcccttct

SEQ ID NO: 5951945 - DNA, 18 bp, Homo sapiens
tgcaggattcccttctgg

SEQ ID NO: 5951946 - DNA, 22 bp, Homo sapiens
tgcaggattcccttctgggctt

SEQ ID NO: 5951947 - DNA, 20 bp, Homo sapiens
tgcaggatttttagagcatt

SEQ ID NO: 5951948 - DNA, 21 bp, Homo sapiens
tgcaggatttttagagcatta

SEQ ID NO: 5951949 - DNA, 22 bp, Homo sapiens
tgcaggatttttagagcattaa

SEQ ID NO: 5951950 - DNA, 23 bp, Homo sapiens
tgcaggatttttagagcattaaa

SEQ ID NO: 5951951 - DNA, 11 bp, Homo sapiens
tgcaggcaagc

SEQ ID NO: 5951952 - DNA, 19 bp, Homo sapiens
tgcaggcacacacgccttc

SEQ ID NO: 5951953 - DNA, 15 bp, Homo sapiens
tgcaggcaccgctgg

SEQ ID NO: 5951954 - DNA, 16 bp, Homo sapiens
tgcaggcaccttagtg

SEQ ID NO: 5951955 - DNA, 21 bp, Homo sapiens
tgcaggcaccttagtggcttt

SEQ ID NO: 5951956 - DNA, 14 bp, Homo sapiens
tgcaggcagacacg

SEQ ID NO: 5951957 - DNA, 14 bp, Homo sapiens
tgcaggcagcaaaa

SEQ ID NO: 5951958 - DNA, 14 bp, Homo sapiens
tgcaggcagcacag

SEQ ID NO: 5951959 - DNA, 14 bp, Homo sapiens
tgcaggcagccagg

SEQ ID NO: 5951960 - DNA, 14 bp, Homo sapiens
tgcaggcagcctgc

SEQ ID NO: 5951961 - DNA, 15 bp, Homo sapiens
tgcaggcagcctgca

SEQ ID NO: 5951962 - DNA, 13 bp, Homo sapiens
tgcaggcagcctt

SEQ ID NO: 5951963 - DNA, 11 bp, Homo sapiens
tgcaggcaggc

SEQ ID NO: 5951964 - DNA, 13 bp, Homo sapiens
tgcaggcaggcag

SEQ ID NO: 5951965 - DNA, 14 bp, Homo sapiens
tgcaggcaggcaga

SEQ ID NO: 5951966 - DNA, 23 bp, Homo sapiens
tgcaggcaggcggctcctcctca

SEQ ID NO: 5951967 - DNA, 13 bp, Homo sapiens
tgcaggcaggctg

SEQ ID NO: 5951968 - DNA, 20 bp, Homo sapiens
tgcaggcaggtgggggctgc

SEQ ID NO: 5951969 - DNA, 12 bp, Homo sapiens
tgcaggcagtgt

SEQ ID NO: 5951970 - DNA, 16 bp, Homo sapiens
tgcaggcatcacagct

SEQ ID NO: 5951971 - DNA, 20 bp, Homo sapiens
tgcaggccaagagcagaggc

SEQ ID NO: 5951972 - DNA, 21 bp, Homo sapiens
tgcaggccaagagcagaggca

SEQ ID NO: 5951973 - DNA, 14 bp, Homo sapiens
tgcaggccaccagc

SEQ ID NO: 5951974 - DNA, 22 bp, Homo sapiens
tgcaggccaccagctgctggat

SEQ ID NO: 5951975 - DNA, 15 bp, Homo sapiens
tgcaggccaggccag

SEQ ID NO: 5951976 - DNA, 16 bp, Homo sapiens
tgcaggccaggccagc

SEQ ID NO: 5951977 - DNA, 22 bp, Homo sapiens
tgcaggccaggccagcttcccc

SEQ ID NO: 5951978 - DNA, 23 bp, Homo sapiens
tgcaggccaggccagcttcccct

SEQ ID NO: 5951979 - DNA, 23 bp, Homo sapiens
tgcaggccaggttatgcctcatg

SEQ ID NO: 5951980 - DNA, 14 bp, Homo sapiens
tgcaggccagtccc

SEQ ID NO: 5951981 - DNA, 20 bp, Homo sapiens
tgcaggccagtcccacggct

SEQ ID NO: 5951982 - DNA, 20 bp, Homo sapiens
tgcaggccagtggacagagg

SEQ ID NO: 5951983 - DNA, 15 bp, Homo sapiens
tgcaggcccaccctg

SEQ ID NO: 5951984 - DNA, 14 bp, Homo sapiens
tgcaggcccagcag

SEQ ID NO: 5951985 - DNA, 16 bp, Homo sapiens
tgcaggcccagcagac

SEQ ID NO: 5951986 - DNA, 18 bp, Homo sapiens
tgcaggcccaggcaggcc

SEQ ID NO: 5951987 - DNA, 18 bp, Homo sapiens
tgcaggccccagccaagt

SEQ ID NO: 5951988 - DNA, 21 bp, Homo sapiens
tgcaggccccagccaagtgcc

SEQ ID NO: 5951989 - DNA, 19 bp, Homo sapiens
tgcaggccccgcttgtcca

SEQ ID NO: 5951990 - DNA, 13 bp, Homo sapiens
tgcaggccctccc

SEQ ID NO: 5951991 - DNA, 20 bp, Homo sapiens
tgcaggccctggcctcccct

SEQ ID NO: 5951992 - DNA, 22 bp, Homo sapiens
tgcaggcctaggtgcagctcct

SEQ ID NO: 5951993 - DNA, 16 bp, Homo sapiens
tgcaggcctgctcagg

SEQ ID NO: 5951994 - DNA, 17 bp, Homo sapiens
tgcaggcctgtccctgg

SEQ ID NO: 5951995 - DNA, 20 bp, Homo sapiens
tgcaggcctgtccctgggag

SEQ ID NO: 5951996 - DNA, 19 bp, Homo sapiens
tgcaggcgactggaggcag

SEQ ID NO: 5951997 - DNA, 21 bp, Homo sapiens
tgcaggcgatggggcaagaca

SEQ ID NO: 5951998 - DNA, 18 bp, Homo sapiens
tgcaggcgcgcaccgccc

SEQ ID NO: 5951999 - DNA, 19 bp, Homo sapiens
tgcaggcgcgcaccgccca

SEQ ID NO: 5952000 - DNA, 14 bp, Homo sapiens
tgcaggcggggctc

SEQ ID NO: 5952001 - DNA, 15 bp, Homo sapiens
tgcaggcggggctcc

SEQ ID NO: 5952002 - DNA, 16 bp, Homo sapiens
tgcaggcggggctcct

SEQ ID NO: 5952003 - DNA, 17 bp, Homo sapiens
tgcaggcggggctcctc

SEQ ID NO: 5952004 - DNA, 19 bp, Homo sapiens
tgcaggcggggctcctcct

SEQ ID NO: 5952005 - DNA, 19 bp, Homo sapiens
tgcaggcggtatccagagg

SEQ ID NO: 5952006 - DNA, 20 bp, Homo sapiens
tgcaggcggtatccagaggt

SEQ ID NO: 5952007 - DNA, 23 bp, Homo sapiens
tgcaggctaaagtgattccttct

SEQ ID NO: 5952008 - DNA, 15 bp, Homo sapiens
tgcaggctccatgca

SEQ ID NO: 5952009 - DNA, 17 bp, Homo sapiens
tgcaggctcccctgagg

SEQ ID NO: 5952010 - DNA, 18 bp, Homo sapiens
tgcaggctcccctgagga

SEQ ID NO: 5952011 - DNA, 12 bp, Homo sapiens
tgcaggctctgg

SEQ ID NO: 5952012 - DNA, 14 bp, Homo sapiens
tgcaggctctgggc

SEQ ID NO: 5952013 - DNA, 15 bp, Homo sapiens
tgcaggctctgggct

SEQ ID NO: 5952014 - DNA, 20 bp, Homo sapiens
tgcaggctctgggctcaggg

SEQ ID NO: 5952015 - DNA, 15 bp, Homo sapiens
tgcaggctggccagc

SEQ ID NO: 5952016 - DNA, 16 bp, Homo sapiens
tgcaggctggccagcc

SEQ ID NO: 5952017 - DNA, 19 bp, Homo sapiens
tgcaggctggggaggtgct

SEQ ID NO: 5952018 - DNA, 16 bp, Homo sapiens
tgcaggcttaataaaa

SEQ ID NO: 5952019 - DNA, 15 bp, Homo sapiens
tgcagggaagagggc

SEQ ID NO: 5952020 - DNA, 17 bp, Homo sapiens
tgcagggaagagggcag

SEQ ID NO: 5952021 - DNA, 20 bp, Homo sapiens
tgcagggaagagggcagtac

SEQ ID NO: 5952022 - DNA, 12 bp, Homo sapiens
tgcagggaagtg

SEQ ID NO: 5952023 - DNA, 15 bp, Homo sapiens
tgcagggacaaagag

SEQ ID NO: 5952024 - DNA, 16 bp, Homo sapiens
tgcagggacaaagagg

SEQ ID NO: 5952025 - DNA, 16 bp, Homo sapiens
tgcagggacagagcat

SEQ ID NO: 5952026 - DNA, 14 bp, Homo sapiens
tgcagggacagcct

SEQ ID NO: 5952027 - DNA, 16 bp, Homo sapiens
tgcagggacagcctgc

SEQ ID NO: 5952028 - DNA, 17 bp, Homo sapiens
tgcagggacagcctgca

SEQ ID NO: 5952029 - DNA, 21 bp, Homo sapiens
tgcagggagacatctgcaccc

SEQ ID NO: 5952030 - DNA, 19 bp, Homo sapiens
tgcagggagccttctgcca

SEQ ID NO: 5952031 - DNA, 21 bp, Homo sapiens
tgcagggagccttctgccacc

SEQ ID NO: 5952032 - DNA, 15 bp, Homo sapiens
tgcagggaggagtgg

SEQ ID NO: 5952033 - DNA, 18 bp, Homo sapiens
tgcagggaggccacgtcc

SEQ ID NO: 5952034 - DNA, 13 bp, Homo sapiens
tgcagggagggga

SEQ ID NO: 5952035 - DNA, 18 bp, Homo sapiens
tgcagggaggggaggcag

SEQ ID NO: 5952036 - DNA, 15 bp, Homo sapiens
tgcagggatgtgggt

SEQ ID NO: 5952037 - DNA, 23 bp, Homo sapiens
tgcagggatgtgggttccacaga

SEQ ID NO: 5952038 - DNA, 19 bp, Homo sapiens
tgcagggcacggggacctg

SEQ ID NO: 5952039 - DNA, 20 bp, Homo sapiens
tgcagggcacggggacctgg

SEQ ID NO: 5952040 - DNA, 13 bp, Homo sapiens
tgcagggcagtca

SEQ ID NO: 5952041 - DNA, 15 bp, Homo sapiens
tgcagggccactgga

SEQ ID NO: 5952042 - DNA, 23 bp, Homo sapiens
tgcagggccatctgactgccaag

SEQ ID NO: 5952043 - DNA, 13 bp, Homo sapiens
tgcagggccgggc

SEQ ID NO: 5952044 - DNA, 18 bp, Homo sapiens
tgcagggccgggcagggg

SEQ ID NO: 5952045 - DNA, 14 bp, Homo sapiens
tgcagggcctccat

SEQ ID NO: 5952046 - DNA, 14 bp, Homo sapiens
tgcagggcctggca

SEQ ID NO: 5952047 - DNA, 18 bp, Homo sapiens
tgcagggcgcccctggga

SEQ ID NO: 5952048 - DNA, 20 bp, Homo sapiens
tgcagggctgctgtggccca

SEQ ID NO: 5952049 - DNA, 22 bp, Homo sapiens
tgcagggctgctgtggcccagt

SEQ ID NO: 5952050 - DNA, 12 bp, Homo sapiens
tgcagggctggg

SEQ ID NO: 5952051 - DNA, 14 bp, Homo sapiens
tgcagggctgggtc

SEQ ID NO: 5952052 - DNA, 18 bp, Homo sapiens
tgcagggctggtttgttc

SEQ ID NO: 5952053 - DNA, 15 bp, Homo sapiens
tgcaggggaagtact

SEQ ID NO: 5952054 - DNA, 18 bp, Homo sapiens
tgcaggggactgggccat

SEQ ID NO: 5952055 - DNA, 14 bp, Homo sapiens
tgcaggggagggtc

SEQ ID NO: 5952056 - DNA, 18 bp, Homo sapiens
tgcaggggatggggtggg

SEQ ID NO: 5952057 - DNA, 20 bp, Homo sapiens
tgcaggggattgaagccctc

SEQ ID NO: 5952058 - DNA, 21 bp, Homo sapiens
tgcaggggattgaagccctcc

SEQ ID NO: 5952059 - DNA, 23 bp, Homo sapiens
tgcaggggcaaggggctggctgg

SEQ ID NO: 5952060 - DNA, 17 bp, Homo sapiens
tgcaggggccactccaa

SEQ ID NO: 5952061 - DNA, 15 bp, Homo sapiens
tgcaggggcctggag

SEQ ID NO: 5952062 - DNA, 16 bp, Homo sapiens
tgcaggggcctggagg

SEQ ID NO: 5952063 - DNA, 14 bp, Homo sapiens
tgcaggggctctgg

SEQ ID NO: 5952064 - DNA, 15 bp, Homo sapiens
tgcaggggtctggga

SEQ ID NO: 5952065 - DNA, 14 bp, Homo sapiens
tgcaggggtgacgg

SEQ ID NO: 5952066 - DNA, 19 bp, Homo sapiens
tgcagggtcctccggggct

SEQ ID NO: 5952067 - DNA, 22 bp, Homo sapiens
tgcatggtttcagcactagcca

SEQ ID NO: 5952068 - DNA, 18 bp, Homo sapiens
tgcatgtaaaatcttcag

SEQ ID NO: 5952069 - DNA, 23 bp, Homo sapiens
tgcatgtaaaatcttcagctggt

SEQ ID NO: 5952070 - DNA, 20 bp, Homo sapiens
tgcatgtaaaatgcagtcca

SEQ ID NO: 5952071 - DNA, 20 bp, Homo sapiens
tgcatgtaaacacgcctgca

SEQ ID NO: 5952072 - DNA, 12 bp, Homo sapiens
tgcatgtaatca

SEQ ID NO: 5952073 - DNA, 21 bp, Homo sapiens
tgcatgtaatcaacatggcta

SEQ ID NO: 5952074 - DNA, 24 bp, Homo sapiens
tgcatgtactagtcctctagaaat

SEQ ID NO: 5952075 - DNA, 16 bp, Homo sapiens
tgcatgtactatctta

SEQ ID NO: 5952076 - DNA, 14 bp, Homo sapiens
tgcatgtacttgaa

SEQ ID NO: 5952077 - DNA, 15 bp, Homo sapiens
tgcatgtagcatata

SEQ ID NO: 5952078 - DNA, 16 bp, Homo sapiens
tgcatgtagcatataa

SEQ ID NO: 5952079 - DNA, 12 bp, Homo sapiens
tgcatgtagtaa

SEQ ID NO: 5952080 - DNA, 14 bp, Homo sapiens
tgcatgtagtaaca

SEQ ID NO: 5952081 - DNA, 17 bp, Homo sapiens
tgcatgtatattactga

SEQ ID NO: 5952082 - DNA, 13 bp, Homo sapiens
tgcatgtatgtct

SEQ ID NO: 5952083 - DNA, 13 bp, Homo sapiens
tgcatgtatgtgt

SEQ ID NO: 5952084 - DNA, 12 bp, Homo sapiens
tgcatgtattca

SEQ ID NO: 5952085 - DNA, 21 bp, Homo sapiens
tgcatgtattcactaaaataa

SEQ ID NO: 5952086 - DNA, 16 bp, Homo sapiens
tgcatgtcacatgaca

SEQ ID NO: 5952087 - DNA, 16 bp, Homo sapiens
tgcatgtcgcacaatg

SEQ ID NO: 5952088 - DNA, 16 bp, Homo sapiens
tgcatgtctgttcttc

SEQ ID NO: 5952089 - DNA, 15 bp, Homo sapiens
tgcatgtgaagcatg

SEQ ID NO: 5952090 - DNA, 20 bp, Homo sapiens
tgcatgtgactctgaagctg

SEQ ID NO: 5952091 - DNA, 19 bp, Homo sapiens
tgcatgtgagcacatgcgt

SEQ ID NO: 5952092 - DNA, 17 bp, Homo sapiens
tgcatgtgcatgcatac

SEQ ID NO: 5952093 - DNA, 13 bp, Homo sapiens
tgcatgtgctgtc

SEQ ID NO: 5952094 - DNA, 21 bp, Homo sapiens
tgcatgtgctgtctccatgct

SEQ ID NO: 5952095 - DNA, 23 bp, Homo sapiens
tgcatgtggcttctctgtctctg

SEQ ID NO: 5952096 - DNA, 13 bp, Homo sapiens
tgcatgtgtatat

SEQ ID NO: 5952097 - DNA, 16 bp, Homo sapiens
tgcatgtgtgaagatt

SEQ ID NO: 5952098 - DNA, 13 bp, Homo sapiens
tgcatgtgtgtat

SEQ ID NO: 5952099 - DNA, 19 bp, Homo sapiens
tgcatgtgtgtataagtgc

SEQ ID NO: 5952100 - DNA, 14 bp, Homo sapiens
tgcatgtgtgtgtg

SEQ ID NO: 5952101 - DNA, 17 bp, Homo sapiens
tgcatgtgttgtacaat

SEQ ID NO: 5952102 - DNA, 23 bp, Homo sapiens
tgcatgtgttgtacaataccaga

SEQ ID NO: 5952103 - DNA, 13 bp, Homo sapiens
tgcatgttaaaat

SEQ ID NO: 5952104 - DNA, 22 bp, Homo sapiens
tgcatgttaggaaaatttcaca

SEQ ID NO: 5952105 - DNA, 16 bp, Homo sapiens
tgcatgttctcctcta

SEQ ID NO: 5952106 - DNA, 21 bp, Homo sapiens
tgcatgttcttgttttgttat

SEQ ID NO: 5952107 - DNA, 21 bp, Homo sapiens
tgcatgttcttttctggaaaa

SEQ ID NO: 5952108 - DNA, 18 bp, Homo sapiens
tgcatgttgaccatgtct

SEQ ID NO: 5952109 - DNA, 19 bp, Homo sapiens
tgcatgttgtctaagaaat

SEQ ID NO: 5952110 - DNA, 12 bp, Homo sapiens
tgcatgtttact

SEQ ID NO: 5952111 - DNA, 12 bp, Homo sapiens
tgcattaaaaaa

SEQ ID NO: 5952112 - DNA, 14 bp, Homo sapiens
tgcattaaaagaaa

SEQ ID NO: 5952113 - DNA, 16 bp, Homo sapiens
tgcattaaaagaaaat

SEQ ID NO: 5952114 - DNA, 14 bp, Homo sapiens
tgcattaaaattaa

SEQ ID NO: 5952115 - DNA, 16 bp, Homo sapiens
tgcattaaacctgtct

SEQ ID NO: 5952116 - DNA, 17 bp, Homo sapiens
tgcattaaattacagaa

SEQ ID NO: 5952117 - DNA, 14 bp, Homo sapiens
tgcattaaattcac

SEQ ID NO: 5952118 - DNA, 19 bp, Homo sapiens
tgcattaaattcacaaact

SEQ ID NO: 5952119 - DNA, 17 bp, Homo sapiens
tgcattaacttaaaaga

SEQ ID NO: 5952120 - DNA, 17 bp, Homo sapiens
tgcattaacttttgtaa

SEQ ID NO: 5952121 - DNA, 17 bp, Homo sapiens
tgcattaataatagtta

SEQ ID NO: 5952122 - DNA, 19 bp, Homo sapiens
tgcattaataatccttcca

SEQ ID NO: 5952123 - DNA, 11 bp, Homo sapiens
tgcattacaga

SEQ ID NO: 5952124 - DNA, 22 bp, Homo sapiens
tgcattaccgcgttgtaaaata

SEQ ID NO: 5952125 - DNA, 22 bp, Homo sapiens
tgcattactattaactctgcat

SEQ ID NO: 5952126 - DNA, 15 bp, Homo sapiens
tgcattactgcatgc

SEQ ID NO: 5952127 - DNA, 18 bp, Homo sapiens
tgcattactgcatgcact

SEQ ID NO: 5952128 - DNA, 16 bp, Homo sapiens
tgcattacttactgtt

SEQ ID NO: 5952129 - DNA, 22 bp, Homo sapiens
tgcattagaaatagacagtata

SEQ ID NO: 5952130 - DNA, 16 bp, Homo sapiens
tgcattagcacagatt

SEQ ID NO: 5952131 - DNA, 15 bp, Homo sapiens
tgcattagtatcaca

SEQ ID NO: 5952132 - DNA, 21 bp, Homo sapiens
tgcattataattttttaaaca

SEQ ID NO: 5952133 - DNA, 22 bp, Homo sapiens
tgcattatatcaaatctaccac

SEQ ID NO: 5952134 - DNA, 15 bp, Homo sapiens
tgcattatatttatt

SEQ ID NO: 5952135 - DNA, 12 bp, Homo sapiens
tgcattatctag

SEQ ID NO: 5952136 - DNA, 22 bp, Homo sapiens
tgcattatcttgctcattcttc

SEQ ID NO: 5952137 - DNA, 16 bp, Homo sapiens
tgcattatgagtaaaa

SEQ ID NO: 5952138 - DNA, 18 bp, Homo sapiens
tgcattatgcaattttta

SEQ ID NO: 5952139 - DNA, 14 bp, Homo sapiens
tgcattattaaatt

SEQ ID NO: 5952140 - DNA, 15 bp, Homo sapiens
tgcattattctcttt

SEQ ID NO: 5952141 - DNA, 16 bp, Homo sapiens
tgcattatttgagaag

SEQ ID NO: 5952142 - DNA, 12 bp, Homo sapiens
tgcattcaaatt

SEQ ID NO: 5952143 - DNA, 14 bp, Homo sapiens
tgcattcaaattaa

SEQ ID NO: 5952144 - DNA, 18 bp, Homo sapiens
tgcattcaaccttaccaa

SEQ ID NO: 5952145 - DNA, 20 bp, Homo sapiens
tgcattcaaccttaccaaaa

SEQ ID NO: 5952146 - DNA, 13 bp, Homo sapiens
tgcattcaagaga

SEQ ID NO: 5952147 - DNA, 20 bp, Homo sapiens
tgcattcacagcgcctcctg

SEQ ID NO: 5952148 - DNA, 23 bp, Homo sapiens
tgcattcacaggggttggctggg

SEQ ID NO: 5952149 - DNA, 20 bp, Homo sapiens
tgcattcacccagacagctc

SEQ ID NO: 5952150 - DNA, 20 bp, Homo sapiens
tgcattcaccttagtgcaac

SEQ ID NO: 5952151 - DNA, 17 bp, Homo sapiens
tgcattcagatctgaag

SEQ ID NO: 5952152 - DNA, 18 bp, Homo sapiens
tgcattcagatctgaagt

SEQ ID NO: 5952153 - DNA, 21 bp, Homo sapiens
tgcattcatctctcaaactta

SEQ ID NO: 5952154 - DNA, 11 bp, Homo sapiens
tgcattcattt

SEQ ID NO: 5952155 - DNA, 12 bp, Homo sapiens
tgcattcatttt

SEQ ID NO: 5952156 - DNA, 23 bp, Homo sapiens
tgcattcattttctgacatgcat

SEQ ID NO: 5952157 - DNA, 14 bp, Homo sapiens
tgcattcattttta

SEQ ID NO: 5952158 - DNA, 15 bp, Homo sapiens
tgcattcatttttat

SEQ ID NO: 5952159 - DNA, 16 bp, Homo sapiens
tgcattccactttttg

SEQ ID NO: 5952160 - DNA, 17 bp, Homo sapiens
tgcattccagaatcttg

SEQ ID NO: 5952161 - DNA, 24 bp, Homo sapiens
tgcattccagaatcttgactttct

SEQ ID NO: 5952162 - DNA, 23 bp, Homo sapiens
tgcattccagagttaaaatgttt

SEQ ID NO: 5952163 - DNA, 22 bp, Homo sapiens
tgcattccagcgtctgctgttg

SEQ ID NO: 5952164 - DNA, 17 bp, Homo sapiens
tgcattccatgatttta

SEQ ID NO: 5952165 - DNA, 14 bp, Homo sapiens
tgcattcccagtgg

SEQ ID NO: 5952166 - DNA, 19 bp, Homo sapiens
tgcattccccgctgcccaa

SEQ ID NO: 5952167 - DNA, 16 bp, Homo sapiens
tgcattccctgaatct

SEQ ID NO: 5952168 - DNA, 20 bp, Homo sapiens
tgcattccctgaatctgtgc

SEQ ID NO: 5952169 - DNA, 23 bp, Homo sapiens
tgcattcctgatatgatttaaaa

SEQ ID NO: 5952170 - DNA, 23 bp, Homo sapiens
tgcattcctgtaacttttaatcc

SEQ ID NO: 5952171 - DNA, 23 bp, Homo sapiens
tgcattcctgtgccctagatgca

SEQ ID NO: 5952172 - DNA, 20 bp, Homo sapiens
tgcattccttacttgcactg

SEQ ID NO: 5952173 - DNA, 18 bp, Homo sapiens
tgcattcgttgctccagt

SEQ ID NO: 5952174 - DNA, 19 bp, Homo sapiens
tgcattctagataaccttg

SEQ ID NO: 5952175 - DNA, 12 bp, Homo sapiens
tgcattctagta

SEQ ID NO: 5952176 - DNA, 13 bp, Homo sapiens
tgcattctattgc

SEQ ID NO: 5952177 - DNA, 16 bp, Homo sapiens
tgcattctattgcctt

SEQ ID NO: 5952178 - DNA, 17 bp, Homo sapiens
tgcattctattgccttc

SEQ ID NO: 5952179 - DNA, 21 bp, Homo sapiens
tgcattctctcccatcctggg

SEQ ID NO: 5952180 - DNA, 17 bp, Homo sapiens
tgcattctgaatgaata

SEQ ID NO: 5952181 - DNA, 16 bp, Homo sapiens
tgcattctgagctgga

SEQ ID NO: 5952182 - DNA, 19 bp, Homo sapiens
tgcattctgataggagggg

SEQ ID NO: 5952183 - DNA, 18 bp, Homo sapiens
tgcattctgcacgctgcc

SEQ ID NO: 5952184 - DNA, 20 bp, Homo sapiens
tgcattctgcctctctagga

SEQ ID NO: 5952185 - DNA, 15 bp, Homo sapiens
tgcattctggagaca

SEQ ID NO: 5952186 - DNA, 17 bp, Homo sapiens
tgcattctggagacaga

SEQ ID NO: 5952187 - DNA, 17 bp, Homo sapiens
tgcattctgtttcctct

SEQ ID NO: 5952188 - DNA, 20 bp, Homo sapiens
tgcattctgtttcctcttga

SEQ ID NO: 5952189 - DNA, 14 bp, Homo sapiens
tgcattcttaacaa

SEQ ID NO: 5952190 - DNA, 22 bp, Homo sapiens
tgcattcttaacaaactcttca

SEQ ID NO: 5952191 - DNA, 17 bp, Homo sapiens
tgcattcttattcatca

SEQ ID NO: 5952192 - DNA, 16 bp, Homo sapiens
tgcattcttctctgtt

SEQ ID NO: 5952193 - DNA, 20 bp, Homo sapiens
tgcattcttctgagcactgt

SEQ ID NO: 5952194 - DNA, 20 bp, Homo sapiens
tgcattctttcttctcttta

SEQ ID NO: 5952195 - DNA, 14 bp, Homo sapiens
tgcattctttggta

SEQ ID NO: 5952196 - DNA, 21 bp, Homo sapiens
tgcattcttttaaaagacaag

SEQ ID NO: 5952197 - DNA, 20 bp, Homo sapiens
tgcattcttttggcagttct

SEQ ID NO: 5952198 - DNA, 18 bp, Homo sapiens
tgcattgaaaagagctga

SEQ ID NO: 5952199 - DNA, 13 bp, Homo sapiens
tgcattgaatata

SEQ ID NO: 5952200 - DNA, 16 bp, Homo sapiens
tgcattgaatatatta

SEQ ID NO: 5952201 - DNA, 14 bp, Homo sapiens
tgcattgacattat

SEQ ID NO: 5952202 - DNA, 15 bp, Homo sapiens
tgcattgacctggag

SEQ ID NO: 5952203 - DNA, 16 bp, Homo sapiens
tgcattgacctggagg

SEQ ID NO: 5952204 - DNA, 20 bp, Homo sapiens
tgcattgacctggaggggag

SEQ ID NO: 5952205 - DNA, 15 bp, Homo sapiens
tgcattgagaactgc

SEQ ID NO: 5952206 - DNA, 17 bp, Homo sapiens
tgcattgagaactgcat

SEQ ID NO: 5952207 - DNA, 17 bp, Homo sapiens
tgcattgagcatatttt

SEQ ID NO: 5952208 - DNA, 22 bp, Homo sapiens
tgcattgagctgcctccagcct

SEQ ID NO: 5952209 - DNA, 17 bp, Homo sapiens
tgcattgaggaaatatt

SEQ ID NO: 5952210 - DNA, 16 bp, Homo sapiens
tgcattgatggttttt

SEQ ID NO: 5952211 - DNA, 20 bp, Homo sapiens
tgcattgcccagtctttcat

SEQ ID NO: 5952212 - DNA, 17 bp, Homo sapiens
tgcattgccgaagtcca

SEQ ID NO: 5952213 - DNA, 23 bp, Homo sapiens
tgcattgcctgcggtcaaggcca

SEQ ID NO: 5952214 - DNA, 19 bp, Homo sapiens
tgcattgctgtgaattagc

SEQ ID NO: 5952215 - DNA, 13 bp, Homo sapiens
tgcattgctgtgt

SEQ ID NO: 5952216 - DNA, 22 bp, Homo sapiens
tgcattggaactggaggcaggg

SEQ ID NO: 5952217 - DNA, 20 bp, Homo sapiens
tgcattggaagaccccaccc

SEQ ID NO: 5952218 - DNA, 15 bp, Homo sapiens
tgcattggcctctgt

SEQ ID NO: 5952219 - DNA, 17 bp, Homo sapiens
tgcattgggtgatcatt

SEQ ID NO: 5952220 - DNA, 18 bp, Homo sapiens
tgcattggttttccatga

SEQ ID NO: 5952221 - DNA, 16 bp, Homo sapiens
tgcattgtcttgtgga

SEQ ID NO: 5952222 - DNA, 17 bp, Homo sapiens
tgcattgtcttgtggag

SEQ ID NO: 5952223 - DNA, 16 bp, Homo sapiens
tgcattgtgaattgcc

SEQ ID NO: 5952224 - DNA, 23 bp, Homo sapiens
tgcattgtgaattgcctgccatg

SEQ ID NO: 5952225 - DNA, 16 bp, Homo sapiens
tgcattgtgacaagaa

SEQ ID NO: 5952226 - DNA, 16 bp, Homo sapiens
tgcattgtgtgagctt

SEQ ID NO: 5952227 - DNA, 15 bp, Homo sapiens
tgcattgtgtgtcac

SEQ ID NO: 5952228 - DNA, 17 bp, Homo sapiens
tgcattgttattgtgga

SEQ ID NO: 5952229 - DNA, 18 bp, Homo sapiens
tgcattgttattgtggaa

SEQ ID NO: 5952230 - DNA, 14 bp, Homo sapiens
tgcattgttggcta

SEQ ID NO: 5952231 - DNA, 22 bp, Homo sapiens
tgcattgttggctatttgaaat

SEQ ID NO: 5952232 - DNA, 16 bp, Homo sapiens
tgcattgttgtaaagt

SEQ ID NO: 5952233 - DNA, 18 bp, Homo sapiens
tgcattgttgtaaagtat

SEQ ID NO: 5952234 - DNA, 14 bp, Homo sapiens
tgcattgtttctgt

SEQ ID NO: 5952235 - DNA, 15 bp, Homo sapiens
tgcatttaaaacaga

SEQ ID NO: 5952236 - DNA, 19 bp, Homo sapiens
tgcatttaaaacagacact

SEQ ID NO: 5952237 - DNA, 16 bp, Homo sapiens
tgcatttaaaagatac

SEQ ID NO: 5952238 - DNA, 13 bp, Homo sapiens
tgcatttaaaata

SEQ ID NO: 5952239 - DNA, 15 bp, Homo sapiens
tgcatttaaaatgga

SEQ ID NO: 5952240 - DNA, 16 bp, Homo sapiens
tgcatttaaaatggac

SEQ ID NO: 5952241 - DNA, 19 bp, Homo sapiens
tgcatttaaacatgtttaa

SEQ ID NO: 5952242 - DNA, 13 bp, Homo sapiens
tgcatttaaactc

SEQ ID NO: 5952243 - DNA, 16 bp, Homo sapiens
tgcatttaaactctgc

SEQ ID NO: 5952244 - DNA, 22 bp, Homo sapiens
tgcatttaaatacagtcttcca

SEQ ID NO: 5952245 - DNA, 20 bp, Homo sapiens
tgccactttgactcagaggc

SEQ ID NO: 5952246 - DNA, 20 bp, Homo sapiens
tgccactttggcttctcctg

SEQ ID NO: 5952247 - DNA, 22 bp, Homo sapiens
tgccactttggcttctcctgtg

SEQ ID NO: 5952248 - DNA, 23 bp, Homo sapiens
tgccactttggtacatggccagt

SEQ ID NO: 5952249 - DNA, 21 bp, Homo sapiens
tgccagaaaaaaataactatt

SEQ ID NO: 5952250 - DNA, 18 bp, Homo sapiens
tgccagaaacagtgggag

SEQ ID NO: 5952251 - DNA, 19 bp, Homo sapiens
tgccagaaacagtgggagc

SEQ ID NO: 5952252 - DNA, 15 bp, Homo sapiens
tgccagaaagtcccc

SEQ ID NO: 5952253 - DNA, 19 bp, Homo sapiens
tgccagaaagtcccccctc

SEQ ID NO: 5952254 - DNA, 20 bp, Homo sapiens
tgccagaacagtttgtacag

SEQ ID NO: 5952255 - DNA, 13 bp, Homo sapiens
tgccagaagagaa

SEQ ID NO: 5952256 - DNA, 21 bp, Homo sapiens
tgccagaagagaattcagtat

SEQ ID NO: 5952257 - DNA, 17 bp, Homo sapiens
tgccagaaggataatat

SEQ ID NO: 5952258 - DNA, 18 bp, Homo sapiens
tgccagaagtgtgttttg

SEQ ID NO: 5952259 - DNA, 17 bp, Homo sapiens
tgccagaagttggggga

SEQ ID NO: 5952260 - DNA, 17 bp, Homo sapiens
tgccagaattttaggaa

SEQ ID NO: 5952261 - DNA, 23 bp, Homo sapiens
tgccagacactgagcttctgaga

SEQ ID NO: 5952262 - DNA, 15 bp, Homo sapiens
tgccagacagagatc

SEQ ID NO: 5952263 - DNA, 20 bp, Homo sapiens
tgccagacagagatcagaat

SEQ ID NO: 5952264 - DNA, 20 bp, Homo sapiens
tgccagaccgcagagaggct

SEQ ID NO: 5952265 - DNA, 21 bp, Homo sapiens
tgccagaccgcagagaggctc

SEQ ID NO: 5952266 - DNA, 21 bp, Homo sapiens
tgccagacggcacccacccag

SEQ ID NO: 5952267 - DNA, 23 bp, Homo sapiens
tgccagactctaggttatacaat

SEQ ID NO: 5952268 - DNA, 19 bp, Homo sapiens
tgccagactggagtgcagt

SEQ ID NO: 5952269 - DNA, 20 bp, Homo sapiens
tgccagactggagtgcagtg

SEQ ID NO: 5952270 - DNA, 19 bp, Homo sapiens
tgccagacttctaaaataa

SEQ ID NO: 5952271 - DNA, 23 bp, Homo sapiens
tgccagacttctaaaataaatgt

SEQ ID NO: 5952272 - DNA, 13 bp, Homo sapiens
tgccagagaaact

SEQ ID NO: 5952273 - DNA, 23 bp, Homo sapiens
tgccagagaaactaacttggtgg

SEQ ID NO: 5952274 - DNA, 22 bp, Homo sapiens
tgccagagaaagttggtgctgc

SEQ ID NO: 5952275 - DNA, 13 bp, Homo sapiens
tgccagagaaccc

SEQ ID NO: 5952276 - DNA, 18 bp, Homo sapiens
tgccagagaggtggggat

SEQ ID NO: 5952277 - DNA, 22 bp, Homo sapiens
tgccagagaggtggggatcctg

SEQ ID NO: 5952278 - DNA, 15 bp, Homo sapiens
tgccagagatggagg

SEQ ID NO: 5952279 - DNA, 20 bp, Homo sapiens
tgccagagcaaagggccagg

SEQ ID NO: 5952280 - DNA, 23 bp, Homo sapiens
tgccagagcaaagggccaggaag

SEQ ID NO: 5952281 - DNA, 12 bp, Homo sapiens
tgccagagcagg

SEQ ID NO: 5952282 - DNA, 13 bp, Homo sapiens
tgccagagcagga

SEQ ID NO: 5952283 - DNA, 16 bp, Homo sapiens
tgccagagcaggagcc

SEQ ID NO: 5952284 - DNA, 19 bp, Homo sapiens
tgccagagcaggagcccct

SEQ ID NO: 5952285 - DNA, 11 bp, Homo sapiens
tgccagagcca

SEQ ID NO: 5952286 - DNA, 13 bp, Homo sapiens
tgccagagccaac

SEQ ID NO: 5952287 - DNA, 17 bp, Homo sapiens
tgccagagccaacctgg

SEQ ID NO: 5952288 - DNA, 21 bp, Homo sapiens
tgccagagccaacctggactt

SEQ ID NO: 5952289 - DNA, 15 bp, Homo sapiens
tgccagagcctgggg

SEQ ID NO: 5952290 - DNA, 16 bp, Homo sapiens
tgccagagcctggggc

SEQ ID NO: 5952291 - DNA, 18 bp, Homo sapiens
tgccagagcctggggctc

SEQ ID NO: 5952292 - DNA, 20 bp, Homo sapiens
tgccagagctttgttttata

SEQ ID NO: 5952293 - DNA, 20 bp, Homo sapiens
tgccagaggccctggaggga

SEQ ID NO: 5952294 - DNA, 23 bp, Homo sapiens
tgccagaggcctggtgccctggc

SEQ ID NO: 5952295 - DNA, 13 bp, Homo sapiens
tgccagagggcca

SEQ ID NO: 5952296 - DNA, 16 bp, Homo sapiens
tgccagagggccagca

SEQ ID NO: 5952297 - DNA, 18 bp, Homo sapiens
tgccagagggccagcagg

SEQ ID NO: 5952298 - DNA, 22 bp, Homo sapiens
tgccagagggccagcaggctcc

SEQ ID NO: 5952299 - DNA, 16 bp, Homo sapiens
tgccagaggtgggcag

SEQ ID NO: 5952300 - DNA, 18 bp, Homo sapiens
tgccagaggtgggcaggt

SEQ ID NO: 5952301 - DNA, 11 bp, Homo sapiens
tgccagatgct

SEQ ID NO: 5952302 - DNA, 14 bp, Homo sapiens
tgccagatgctgat

SEQ ID NO: 5952303 - DNA, 16 bp, Homo sapiens
tgccagatgctgatgt

SEQ ID NO: 5952304 - DNA, 22 bp, Homo sapiens
tgccagatgctgatgttcagtg

SEQ ID NO: 5952305 - DNA, 21 bp, Homo sapiens
tgccagatgtcctaatggtga

SEQ ID NO: 5952306 - DNA, 22 bp, Homo sapiens
tgccagatgtgggctcagatcc

SEQ ID NO: 5952307 - DNA, 19 bp, Homo sapiens
tgccagattctgcctctct

SEQ ID NO: 5952308 - DNA, 15 bp, Homo sapiens
tgccagcaaagcccc

SEQ ID NO: 5952309 - DNA, 16 bp, Homo sapiens
tgccagcaaagcccca

SEQ ID NO: 5952310 - DNA, 24 bp, Homo sapiens
tgccagcaaagccccatgctggag

SEQ ID NO: 5952311 - DNA, 12 bp, Homo sapiens
tgccagcaaata

SEQ ID NO: 5952312 - DNA, 18 bp, Homo sapiens
tgccagcaactgaataaa

SEQ ID NO: 5952313 - DNA, 14 bp, Homo sapiens
tgccagcacagggg

SEQ ID NO: 5952314 - DNA, 16 bp, Homo sapiens
tgccagcacaggggcc

SEQ ID NO: 5952315 - DNA, 18 bp, Homo sapiens
tgccagcacaggggcccc

SEQ ID NO: 5952316 - DNA, 14 bp, Homo sapiens
tgccagcaccacag

SEQ ID NO: 5952317 - DNA, 15 bp, Homo sapiens
tgccagcagagccag

SEQ ID NO: 5952318 - DNA, 17 bp, Homo sapiens
tgccagcagagccaggg

SEQ ID NO: 5952319 - DNA, 21 bp, Homo sapiens
tgccagcagagccagggcagg

SEQ ID NO: 5952320 - DNA, 16 bp, Homo sapiens
tgccagcagcagcagg

SEQ ID NO: 5952321 - DNA, 21 bp, Homo sapiens
tgccagcagccccgtctgccc

SEQ ID NO: 5952322 - DNA, 23 bp, Homo sapiens
tgccagcagccccgtctgcccac

SEQ ID NO: 5952323 - DNA, 16 bp, Homo sapiens
tgccagcagcctcgca

SEQ ID NO: 5952324 - DNA, 14 bp, Homo sapiens
tgccagcaggaata

SEQ ID NO: 5952325 - DNA, 19 bp, Homo sapiens
tgccagcaggaataaagac

SEQ ID NO: 5952326 - DNA, 20 bp, Homo sapiens
tgccagcatacattttctgg

SEQ ID NO: 5952327 - DNA, 15 bp, Homo sapiens
tgccagcatatactg

SEQ ID NO: 5952328 - DNA, 19 bp, Homo sapiens
tgccagcatggttgcagat

SEQ ID NO: 5952329 - DNA, 21 bp, Homo sapiens
tgccagccaagctctgcagtc

SEQ ID NO: 5952330 - DNA, 11 bp, Homo sapiens
tgccagccaga

SEQ ID NO: 5952331 - DNA, 16 bp, Homo sapiens
tgccagccagcagcca

SEQ ID NO: 5952332 - DNA, 13 bp, Homo sapiens
tgccagccaggag

SEQ ID NO: 5952333 - DNA, 11 bp, Homo sapiens
tgccagccatc

SEQ ID NO: 5952334 - DNA, 11 bp, Homo sapiens
tgccagcccaa

SEQ ID NO: 5952335 - DNA, 15 bp, Homo sapiens
tgccagcccagaaca

SEQ ID NO: 5952336 - DNA, 15 bp, Homo sapiens
tgccagcccagctgg

SEQ ID NO: 5952337 - DNA, 18 bp, Homo sapiens
tgccagccccacacagct

SEQ ID NO: 5952338 - DNA, 11 bp, Homo sapiens
tgccagcccct

SEQ ID NO: 5952339 - DNA, 22 bp, Homo sapiens
tgccagcccctcggctctgccg

SEQ ID NO: 5952340 - DNA, 18 bp, Homo sapiens
tgccagcccctgcctggg

SEQ ID NO: 5952341 - DNA, 23 bp, Homo sapiens
tgccagcccctgctggctggtgc

SEQ ID NO: 5952342 - DNA, 23 bp, Homo sapiens
tgccagcccggctcggcccagca

SEQ ID NO: 5952343 - DNA, 15 bp, Homo sapiens
tgccagcccttcagg

SEQ ID NO: 5952344 - DNA, 20 bp, Homo sapiens
tgccagccgaccctcctggc

SEQ ID NO: 5952345 - DNA, 21 bp, Homo sapiens
tgccagccgaccctcctggcc

SEQ ID NO: 5952346 - DNA, 22 bp, Homo sapiens
tgccagccgaccctcctggcct

SEQ ID NO: 5952347 - DNA, 23 bp, Homo sapiens
tgccagccgaccctcctggcctt

SEQ ID NO: 5952348 - DNA, 17 bp, Homo sapiens
tgccagccgagatagcc

SEQ ID NO: 5952349 - DNA, 20 bp, Homo sapiens
tgccagccgtgatgctcagg

SEQ ID NO: 5952350 - DNA, 11 bp, Homo sapiens
tgccagcctcc

SEQ ID NO: 5952351 - DNA, 13 bp, Homo sapiens
tgccagcctcctt

SEQ ID NO: 5952352 - DNA, 20 bp, Homo sapiens
tgccagcctccttgctgacc

SEQ ID NO: 5952353 - DNA, 11 bp, Homo sapiens
tgccagcctga

SEQ ID NO: 5952354 - DNA, 17 bp, Homo sapiens
tgccagcctgagcggag

SEQ ID NO: 5952355 - DNA, 22 bp, Homo sapiens
tgccagcctgaggcagccactt

SEQ ID NO: 5952356 - DNA, 20 bp, Homo sapiens
tgccagcctggcttctggag

SEQ ID NO: 5952357 - DNA, 17 bp, Homo sapiens
tgccagccttgagccct

SEQ ID NO: 5952358 - DNA, 23 bp, Homo sapiens
tgccagccttgagccctggctgt

SEQ ID NO: 5952359 - DNA, 19 bp, Homo sapiens
tgccagcgcagcgccaggg

SEQ ID NO: 5952360 - DNA, 21 bp, Homo sapiens
tgccagcgcagcgccagggct

SEQ ID NO: 5952361 - DNA, 15 bp, Homo sapiens
tgccagcgtccccgg

SEQ ID NO: 5952362 - DNA, 17 bp, Homo sapiens
tgccagcgtctgttgtg

SEQ ID NO: 5952363 - DNA, 10 bp, Homo sapiens
tgccagctca

SEQ ID NO: 5952364 - DNA, 17 bp, Homo sapiens
tgccagctcagtcccat

SEQ ID NO: 5952365 - DNA, 22 bp, Homo sapiens
tgccagctctgtatcaggaccc

SEQ ID NO: 5952366 - DNA, 19 bp, Homo sapiens
tgccagctctgtcaccctg

SEQ ID NO: 5952367 - DNA, 21 bp, Homo sapiens
tgccagctctgtcaccctggc

SEQ ID NO: 5952368 - DNA, 15 bp, Homo sapiens
tgccagctcttccta

SEQ ID NO: 5952369 - DNA, 20 bp, Homo sapiens
tgccagctcttcctagctgg

SEQ ID NO: 5952370 - DNA, 23 bp, Homo sapiens
tgccagctcttcctagctggaga

SEQ ID NO: 5952371 - DNA, 23 bp, Homo sapiens
tgccagctgacatcttgaatcct

SEQ ID NO: 5952372 - DNA, 14 bp, Homo sapiens
tgccagctgccctt

SEQ ID NO: 5952373 - DNA, 20 bp, Homo sapiens
tgccagctgcccttgcaggg

SEQ ID NO: 5952374 - DNA, 23 bp, Homo sapiens
tgccagctgcccttgcagggtgg

SEQ ID NO: 5952375 - DNA, 14 bp, Homo sapiens
tgccagctgccttc

SEQ ID NO: 5952376 - DNA, 19 bp, Homo sapiens
tgccagctgctgagccgca

SEQ ID NO: 5952377 - DNA, 15 bp, Homo sapiens
tgccagctgcttctg

SEQ ID NO: 5952378 - DNA, 20 bp, Homo sapiens
tgccagctgcttctgcccac

SEQ ID NO: 5952379 - DNA, 12 bp, Homo sapiens
tgccagctggcc

SEQ ID NO: 5952380 - DNA, 16 bp, Homo sapiens
tgccagctgggcccag

SEQ ID NO: 5952381 - DNA, 18 bp, Homo sapiens
tgccagctgggcccagca

SEQ ID NO: 5952382 - DNA, 21 bp, Homo sapiens
tgccagctgggcccagcacct

SEQ ID NO: 5952383 - DNA, 16 bp, Homo sapiens
tgccagctggtgaatc

SEQ ID NO: 5952384 - DNA, 12 bp, Homo sapiens
tgccagctgtgt

SEQ ID NO: 5952385 - DNA, 14 bp, Homo sapiens
tgccagctgtgtcc

SEQ ID NO: 5952386 - DNA, 13 bp, Homo sapiens
tgccagcttctct

SEQ ID NO: 5952387 - DNA, 18 bp, Homo sapiens
tgccagcttctctctcca

SEQ ID NO: 5952388 - DNA, 21 bp, Homo sapiens
tgccagcttctctctccaggg

SEQ ID NO: 5952389 - DNA, 15 bp, Homo sapiens
tgccagcttgtgagc

SEQ ID NO: 5952390 - DNA, 16 bp, Homo sapiens
tgccagcttgtgagct

SEQ ID NO: 5952391 - DNA, 19 bp, Homo sapiens
tgccagcttttcctccctt

SEQ ID NO: 5952392 - DNA, 20 bp, Homo sapiens
tgccagcttttcctcccttg

SEQ ID NO: 5952393 - DNA, 17 bp, Homo sapiens
tgccaggaaaagaaaaa

SEQ ID NO: 5952394 - DNA, 20 bp, Homo sapiens
tgccaggaaactcttgctat

SEQ ID NO: 5952395 - DNA, 14 bp, Homo sapiens
tgccaggaaagagt

SEQ ID NO: 5952396 - DNA, 12 bp, Homo sapiens
tgccaggaagcc

SEQ ID NO: 5952397 - DNA, 19 bp, Homo sapiens
tgccaggaagccagcaggc

SEQ ID NO: 5952398 - DNA, 23 bp, Homo sapiens
tgccaggaaggggtgagcacaga

SEQ ID NO: 5952399 - DNA, 11 bp, Homo sapiens
tgccaggacaa

SEQ ID NO: 5952400 - DNA, 11 bp, Homo sapiens
tgccaggacac

SEQ ID NO: 5952401 - DNA, 18 bp, Homo sapiens
tgccaggacacctgcccc

SEQ ID NO: 5952402 - DNA, 20 bp, Homo sapiens
tgccaggacacctgccccag

SEQ ID NO: 5952403 - DNA, 21 bp, Homo sapiens
tgccaggacacctgccccagc

SEQ ID NO: 5952404 - DNA, 22 bp, Homo sapiens
tgccaggacacctgccccagcg

SEQ ID NO: 5952405 - DNA, 14 bp, Homo sapiens
tgccaggacagctg

SEQ ID NO: 5952406 - DNA, 20 bp, Homo sapiens
tgccaggacagctgcaggtg

SEQ ID NO: 5952407 - DNA, 15 bp, Homo sapiens
tgccaggaccagcct

SEQ ID NO: 5952408 - DNA, 16 bp, Homo sapiens
tgccaggaccagcctg

SEQ ID NO: 5952409 - DNA, 15 bp, Homo sapiens
tgccaggaccccagg

SEQ ID NO: 5952410 - DNA, 23 bp, Homo sapiens
tgccaggacccgccagccccgct

SEQ ID NO: 5952411 - DNA, 22 bp, Homo sapiens
tgccaggactccccaggccagg

SEQ ID NO: 5952412 - DNA, 23 bp, Homo sapiens
tgccaggactccccaggccaggc

SEQ ID NO: 5952413 - DNA, 18 bp, Homo sapiens
tgccaggactctctttct

SEQ ID NO: 5952414 - DNA, 16 bp, Homo sapiens
tgccaggagcaatggg

SEQ ID NO: 5952415 - DNA, 20 bp, Homo sapiens
tgccaggagcaatgggactg

SEQ ID NO: 5952416 - DNA, 14 bp, Homo sapiens
tgccaggagcagcc

SEQ ID NO: 5952417 - DNA, 18 bp, Homo sapiens
tgccaggagcagcctcca

SEQ ID NO: 5952418 - DNA, 20 bp, Homo sapiens
tgccaggagcagcctccaag

SEQ ID NO: 5952419 - DNA, 22 bp, Homo sapiens
tgccaggagcagcctccaagaa

SEQ ID NO: 5952420 - DNA, 14 bp, Homo sapiens
tgccaggagcctgg

SEQ ID NO: 5952421 - DNA, 23 bp, Homo sapiens
tgcccaaaagaggtgtcatgctt

SEQ ID NO: 5952422 - DNA, 19 bp, Homo sapiens
tgcccaaacccttaactga

SEQ ID NO: 5952423 - DNA, 21 bp, Homo sapiens
tgcccaaacccttaactgaca

SEQ ID NO: 5952424 - DNA, 16 bp, Homo sapiens
tgcccaaagagcacaa

SEQ ID NO: 5952425 - DNA, 19 bp, Homo sapiens
tgcccaaagagcacaaaca

SEQ ID NO: 5952426 - DNA, 17 bp, Homo sapiens
tgcccaaagatgcagcc

SEQ ID NO: 5952427 - DNA, 16 bp, Homo sapiens
tgcccaaataggagga

SEQ ID NO: 5952428 - DNA, 15 bp, Homo sapiens
tgcccaaatctgcct

SEQ ID NO: 5952429 - DNA, 18 bp, Homo sapiens
tgcccaaattatgtgaaa

SEQ ID NO: 5952430 - DNA, 14 bp, Homo sapiens
tgcccaacaccagc

SEQ ID NO: 5952431 - DNA, 23 bp, Homo sapiens
tgcccaacaccagcccctgcccc

SEQ ID NO: 5952432 - DNA, 17 bp, Homo sapiens
tgcccaacctcagcaac

SEQ ID NO: 5952433 - DNA, 24 bp, Homo sapiens
tgcccaacctgctctcctcttgcc

SEQ ID NO: 5952434 - DNA, 22 bp, Homo sapiens
tgcccaactactatctcagaga

SEQ ID NO: 5952435 - DNA, 13 bp, Homo sapiens
tgcccaactccca

SEQ ID NO: 5952436 - DNA, 19 bp, Homo sapiens
tgcccaactcccagccacc

SEQ ID NO: 5952437 - DNA, 21 bp, Homo sapiens
tgcccaactcccagccaccac

SEQ ID NO: 5952438 - DNA, 23 bp, Homo sapiens
tgcccaactcccagccaccacca

SEQ ID NO: 5952439 - DNA, 18 bp, Homo sapiens
tgcccaactttcattggt

SEQ ID NO: 5952440 - DNA, 23 bp, Homo sapiens
tgcccaagaatagatgctgactg

SEQ ID NO: 5952441 - DNA, 11 bp, Homo sapiens
tgcccaagcca

SEQ ID NO: 5952442 - DNA, 16 bp, Homo sapiens
tgcccaagccagaggc

SEQ ID NO: 5952443 - DNA, 17 bp, Homo sapiens
tgcccaagggcctccca

SEQ ID NO: 5952444 - DNA, 18 bp, Homo sapiens
tgcccaagggcctcccac

SEQ ID NO: 5952445 - DNA, 18 bp, Homo sapiens
tgcccaaggttgcacagc

SEQ ID NO: 5952446 - DNA, 16 bp, Homo sapiens
tgcccaagtcacacag

SEQ ID NO: 5952447 - DNA, 18 bp, Homo sapiens
tgcccaagtcacacagct

SEQ ID NO: 5952448 - DNA, 22 bp, Homo sapiens
tgcccaagtcacacagctagtg

SEQ ID NO: 5952449 - DNA, 15 bp, Homo sapiens
tgcccaagtgggcag

SEQ ID NO: 5952450 - DNA, 22 bp, Homo sapiens
tgcccaagttgtggtgctgaca

SEQ ID NO: 5952451 - DNA, 20 bp, Homo sapiens
tgcccaatatgcagttctgc

SEQ ID NO: 5952452 - DNA, 15 bp, Homo sapiens
tgcccaatccaggcc

SEQ ID NO: 5952453 - DNA, 16 bp, Homo sapiens
tgcccaatccaggccc

SEQ ID NO: 5952454 - DNA, 21 bp, Homo sapiens
tgcccaatcctccctggagaa

SEQ ID NO: 5952455 - DNA, 15 bp, Homo sapiens
tgcccaatgaataat

SEQ ID NO: 5952456 - DNA, 16 bp, Homo sapiens
tgcccaatgctttggg

SEQ ID NO: 5952457 - DNA, 22 bp, Homo sapiens
tgcccaatgctttgggaggcca

SEQ ID NO: 5952458 - DNA, 15 bp, Homo sapiens
tgcccaattggagga

SEQ ID NO: 5952459 - DNA, 17 bp, Homo sapiens
tgcccaatttcacagag

SEQ ID NO: 5952460 - DNA, 23 bp, Homo sapiens
tgcccacaacgtcccctcaagcc

SEQ ID NO: 5952461 - DNA, 17 bp, Homo sapiens
tgcccacacactttcca

SEQ ID NO: 5952462 - DNA, 13 bp, Homo sapiens
tgcccacaccacc

SEQ ID NO: 5952463 - DNA, 17 bp, Homo sapiens
tgcccacacctgcctct

SEQ ID NO: 5952464 - DNA, 18 bp, Homo sapiens
tgcccacacctgcctctg

SEQ ID NO: 5952465 - DNA, 14 bp, Homo sapiens
tgcccacaggccgc

SEQ ID NO: 5952466 - DNA, 13 bp, Homo sapiens
tgcccacataccc

SEQ ID NO: 5952467 - DNA, 16 bp, Homo sapiens
tgcccacatcccaggc

SEQ ID NO: 5952468 - DNA, 17 bp, Homo sapiens
tgcccacatgggacctg

SEQ ID NO: 5952469 - DNA, 19 bp, Homo sapiens
tgcccacatgggacctggc

SEQ ID NO: 5952470 - DNA, 17 bp, Homo sapiens
tgcccacattaagcact

SEQ ID NO: 5952471 - DNA, 17 bp, Homo sapiens
tgcccacatttgggctc

SEQ ID NO: 5952472 - DNA, 18 bp, Homo sapiens
tgcccacatttgggctca

SEQ ID NO: 5952473 - DNA, 19 bp, Homo sapiens
tgcccacatttgggctcag

SEQ ID NO: 5952474 - DNA, 21 bp, Homo sapiens
tgcccacatttgggctcaggg

SEQ ID NO: 5952475 - DNA, 18 bp, Homo sapiens
tgcccaccattcccggcc

SEQ ID NO: 5952476 - DNA, 15 bp, Homo sapiens
tgcccacccagggcc

SEQ ID NO: 5952477 - DNA, 16 bp, Homo sapiens
tgcccacccagggccc

SEQ ID NO: 5952478 - DNA, 17 bp, Homo sapiens
tgcccacccagggcccg

SEQ ID NO: 5952479 - DNA, 21 bp, Homo sapiens
tgcccacccagggcccggcac

SEQ ID NO: 5952480 - DNA, 16 bp, Homo sapiens
tgcccaccccaccccc

SEQ ID NO: 5952481 - DNA, 17 bp, Homo sapiens
tgcccaccccaccccca

SEQ ID NO: 5952482 - DNA, 12 bp, Homo sapiens
tgcccaccccat

SEQ ID NO: 5952483 - DNA, 21 bp, Homo sapiens
tgcccaccccatccctggctg

SEQ ID NO: 5952484 - DNA, 22 bp, Homo sapiens
tgcccacccccaccatgcagcc

SEQ ID NO: 5952485 - DNA, 12 bp, Homo sapiens
tgcccacccccg

SEQ ID NO: 5952486 - DNA, 15 bp, Homo sapiens
tgcccacccccggga

SEQ ID NO: 5952487 - DNA, 15 bp, Homo sapiens
tgcccaccccctgcc

SEQ ID NO: 5952488 - DNA, 16 bp, Homo sapiens
tgcccaccccgcctct

SEQ ID NO: 5952489 - DNA, 17 bp, Homo sapiens
tgcccaccccgcctctg

SEQ ID NO: 5952490 - DNA, 15 bp, Homo sapiens
tgcccacccctgctg

SEQ ID NO: 5952491 - DNA, 22 bp, Homo sapiens
tgcccacccgtgttctcctcca

SEQ ID NO: 5952492 - DNA, 17 bp, Homo sapiens
tgcccaccctccactct

SEQ ID NO: 5952493 - DNA, 14 bp, Homo sapiens
tgcccaccctgggc

SEQ ID NO: 5952494 - DNA, 15 bp, Homo sapiens
tgcccaccctgggcc

SEQ ID NO: 5952495 - DNA, 16 bp, Homo sapiens
tgcccaccgaccccct

SEQ ID NO: 5952496 - DNA, 21 bp, Homo sapiens
tgcccaccgaggagccccagc

SEQ ID NO: 5952497 - DNA, 19 bp, Homo sapiens
tgcccaccgcccctggaca

SEQ ID NO: 5952498 - DNA, 19 bp, Homo sapiens
tgcccaccgccctcctcca

SEQ ID NO: 5952499 - DNA, 21 bp, Homo sapiens
tgcccaccgccctcctccact

SEQ ID NO: 5952500 - DNA, 22 bp, Homo sapiens
tgcccaccgttaggattcaggc

SEQ ID NO: 5952501 - DNA, 22 bp, Homo sapiens
tgcccacctccttccagcactg

SEQ ID NO: 5952502 - DNA, 15 bp, Homo sapiens
tgcccacctcggcct

SEQ ID NO: 5952503 - DNA, 15 bp, Homo sapiens
tgcccacctctccct

SEQ ID NO: 5952504 - DNA, 16 bp, Homo sapiens
tgcccacctctccctg

SEQ ID NO: 5952505 - DNA, 16 bp, Homo sapiens
tgcccacctcttctgc

SEQ ID NO: 5952506 - DNA, 14 bp, Homo sapiens
tgcccacctgccag

SEQ ID NO: 5952507 - DNA, 15 bp, Homo sapiens
tgcccacctgccagg

SEQ ID NO: 5952508 - DNA, 16 bp, Homo sapiens
tgcccacctgccaggc

SEQ ID NO: 5952509 - DNA, 18 bp, Homo sapiens
tgcccacctgccaggctg

SEQ ID NO: 5952510 - DNA, 16 bp, Homo sapiens
tgcccacctgccggcc

SEQ ID NO: 5952511 - DNA, 19 bp, Homo sapiens
tgcccacctgcctggccgg

SEQ ID NO: 5952512 - DNA, 21 bp, Homo sapiens
tgcccacctgcctggccggcc

SEQ ID NO: 5952513 - DNA, 23 bp, Homo sapiens
tgcccacctgcctggccggccag

SEQ ID NO: 5952514 - DNA, 15 bp, Homo sapiens
tgcccacctggcctc

SEQ ID NO: 5952515 - DNA, 16 bp, Homo sapiens
tgcccacgatcccctc

SEQ ID NO: 5952516 - DNA, 21 bp, Homo sapiens
tgcccacgatcccctccccca

SEQ ID NO: 5952517 - DNA, 19 bp, Homo sapiens
tgcccacgcccctccccag

SEQ ID NO: 5952518 - DNA, 22 bp, Homo sapiens
tgcccacgcccttggagccttc

SEQ ID NO: 5952519 - DNA, 13 bp, Homo sapiens
tgcccacggccac

SEQ ID NO: 5952520 - DNA, 14 bp, Homo sapiens
tgcccacgggagga

SEQ ID NO: 5952521 - DNA, 20 bp, Homo sapiens
tgcccacggtctgagctagc

SEQ ID NO: 5952522 - DNA, 17 bp, Homo sapiens
tgcccacgtcccgggca

SEQ ID NO: 5952523 - DNA, 19 bp, Homo sapiens
tgcccacgtcccgggcact

SEQ ID NO: 5952524 - DNA, 21 bp, Homo sapiens
tgcccactacctatgcttcta

SEQ ID NO: 5952525 - DNA, 21 bp, Homo sapiens
tgcccactcccccaggagcag

SEQ ID NO: 5952526 - DNA, 24 bp, Homo sapiens
tgcccactcccccaggagcagctg

SEQ ID NO: 5952527 - DNA, 21 bp, Homo sapiens
tgcccactccctatctccttc

SEQ ID NO: 5952528 - DNA, 14 bp, Homo sapiens
tgcccactccctgc

SEQ ID NO: 5952529 - DNA, 21 bp, Homo sapiens
tgcccactccctgcaacctga

SEQ ID NO: 5952530 - DNA, 14 bp, Homo sapiens
tgcccactccgcca

SEQ ID NO: 5952531 - DNA, 17 bp, Homo sapiens
tgcccactccgccagcc

SEQ ID NO: 5952532 - DNA, 18 bp, Homo sapiens
tgcccactccgccagcca

SEQ ID NO: 5952533 - DNA, 19 bp, Homo sapiens
tgcccactccgccagccac

SEQ ID NO: 5952534 - DNA, 18 bp, Homo sapiens
tgcccactcctgctctgc

SEQ ID NO: 5952535 - DNA, 19 bp, Homo sapiens
tgcccactctccatcagat

SEQ ID NO: 5952536 - DNA, 15 bp, Homo sapiens
tgcccactctgaccg

SEQ ID NO: 5952537 - DNA, 16 bp, Homo sapiens
tgcccactctgcaaga

SEQ ID NO: 5952538 - DNA, 16 bp, Homo sapiens
tgcccactctggggac

SEQ ID NO: 5952539 - DNA, 17 bp, Homo sapiens
tgcccactgaacatgct

SEQ ID NO: 5952540 - DNA, 19 bp, Homo sapiens
tgcccactgccgatgccca

SEQ ID NO: 5952541 - DNA, 17 bp, Homo sapiens
tgcccactgcctgcctc

SEQ ID NO: 5952542 - DNA, 17 bp, Homo sapiens
tgcccactgctggtgcc

SEQ ID NO: 5952543 - DNA, 20 bp, Homo sapiens
tgcccactggccgctgagcg

SEQ ID NO: 5952544 - DNA, 17 bp, Homo sapiens
tgcccactgtctctcct

SEQ ID NO: 5952545 - DNA, 21 bp, Homo sapiens
tgcccactgtttctcttgagc

SEQ ID NO: 5952546 - DNA, 22 bp, Homo sapiens
tgcccacttaccctgggctgga

SEQ ID NO: 5952547 - DNA, 11 bp, Homo sapiens
tgcccacttct

SEQ ID NO: 5952548 - DNA, 19 bp, Homo sapiens
tgcccacttgattgagaaa

SEQ ID NO: 5952549 - DNA, 22 bp, Homo sapiens
tgcccacttgattgagaaagat

SEQ ID NO: 5952550 - DNA, 13 bp, Homo sapiens
tgcccacttgtca

SEQ ID NO: 5952551 - DNA, 16 bp, Homo sapiens
tgcccagaaagtgggg

SEQ ID NO: 5952552 - DNA, 17 bp, Homo sapiens
tgcccagaataagttat

SEQ ID NO: 5952553 - DNA, 19 bp, Homo sapiens
tgcccagaatgaggctgct

SEQ ID NO: 5952554 - DNA, 22 bp, Homo sapiens
tgcccagaattcccagctgtct

SEQ ID NO: 5952555 - DNA, 23 bp, Homo sapiens
tgcccagaattcccagctgtctg

SEQ ID NO: 5952556 - DNA, 17 bp, Homo sapiens
tgcccagaatttaccat

SEQ ID NO: 5952557 - DNA, 10 bp, Homo sapiens
tgcccagaca

SEQ ID NO: 5952558 - DNA, 22 bp, Homo sapiens
tgcccagacacagactggcaat

SEQ ID NO: 5952559 - DNA, 13 bp, Homo sapiens
tgcccagacacat

SEQ ID NO: 5952560 - DNA, 17 bp, Homo sapiens
tgcccagactacagggc

SEQ ID NO: 5952561 - DNA, 20 bp, Homo sapiens
tgcccagactgatgagcaca

SEQ ID NO: 5952562 - DNA, 16 bp, Homo sapiens
tgcccagagaatcagg

SEQ ID NO: 5952563 - DNA, 23 bp, Homo sapiens
tgcccagagaatcagggcaggct

SEQ ID NO: 5952564 - DNA, 11 bp, Homo sapiens
tgcccagagat

SEQ ID NO: 5952565 - DNA, 12 bp, Homo sapiens
tgcccagagatg

SEQ ID NO: 5952566 - DNA, 21 bp, Homo sapiens
tgcccagagatgcctccaccg

SEQ ID NO: 5952567 - DNA, 22 bp, Homo sapiens
tgcccagagccaagctggggca

SEQ ID NO: 5952568 - DNA, 14 bp, Homo sapiens
tgcccagagctgag

SEQ ID NO: 5952569 - DNA, 16 bp, Homo sapiens
tgcccagagctgctgg

SEQ ID NO: 5952570 - DNA, 14 bp, Homo sapiens
tgcccagagctggg

SEQ ID NO: 5952571 - DNA, 17 bp, Homo sapiens
tgcccagagctgggtga

SEQ ID NO: 5952572 - DNA, 18 bp, Homo sapiens
tgcccagagggcccaggc

SEQ ID NO: 5952573 - DNA, 23 bp, Homo sapiens
tgcccagagggcccaggcaggcc

SEQ ID NO: 5952574 - DNA, 17 bp, Homo sapiens
tgcccagatcagccaga

SEQ ID NO: 5952575 - DNA, 21 bp, Homo sapiens
tgcccagatcgttctgccact

SEQ ID NO: 5952576 - DNA, 19 bp, Homo sapiens
tgcccagcaacatggagga

SEQ ID NO: 5952577 - DNA, 14 bp, Homo sapiens
tgcccagcacctgg

SEQ ID NO: 5952578 - DNA, 13 bp, Homo sapiens
tgcccagcagagg

SEQ ID NO: 5952579 - DNA, 12 bp, Homo sapiens
tgcccagcaggg

SEQ ID NO: 5952580 - DNA, 18 bp, Homo sapiens
tgcccagcagtttcccag

SEQ ID NO: 5952581 - DNA, 19 bp, Homo sapiens
tgcccagcagtttcccaga

SEQ ID NO: 5952582 - DNA, 20 bp, Homo sapiens
tgcccagcagtttcccagaa

SEQ ID NO: 5952583 - DNA, 16 bp, Homo sapiens
tgcccagccacccctc

SEQ ID NO: 5952584 - DNA, 14 bp, Homo sapiens
tgcccagccactcc

SEQ ID NO: 5952585 - DNA, 19 bp, Homo sapiens
tgcccagccactccaagcc

SEQ ID NO: 5952586 - DNA, 17 bp, Homo sapiens
tgcccagccactccagg

SEQ ID NO: 5952587 - DNA, 12 bp, Homo sapiens
tgcccagccagc

SEQ ID NO: 5952588 - DNA, 15 bp, Homo sapiens
tgcccagccagccac

SEQ ID NO: 5952589 - DNA, 23 bp, Homo sapiens
tgcccagccagccacccctgcca

SEQ ID NO: 5952590 - DNA, 15 bp, Homo sapiens
tgcccagccagggaa

SEQ ID NO: 5952591 - DNA, 18 bp, Homo sapiens
tgcccagccagggaaggc

SEQ ID NO: 5952592 - DNA, 19 bp, Homo sapiens
tgcccagccccgctcaggc

SEQ ID NO: 5952593 - DNA, 20 bp, Homo sapiens
tgcccagcccctcctccctg

SEQ ID NO: 5952594 - DNA, 13 bp, Homo sapiens
tgcccagcccctt

SEQ ID NO: 5952595 - DNA, 20 bp, Homo sapiens
tgcccagccccttctgaccc

SEQ ID NO: 5952596 - DNA, 16 bp, Homo sapiens
tgcccagccccttttc

SEQ ID NO: 5952597 - DNA, 21 bp, Homo sapiens
tgcccagccccttttctctgc

SEQ ID NO: 5952598 - DNA, 17 bp, Homo sapiens
tgcccggggagctgcag

SEQ ID NO: 5952599 - DNA, 18 bp, Homo sapiens
tgcccggggagctgcaga

SEQ ID NO: 5952600 - DNA, 20 bp, Homo sapiens
tgcccggggagctgcagagc

SEQ ID NO: 5952601 - DNA, 20 bp, Homo sapiens
tgcccggggcagctgccaga

SEQ ID NO: 5952602 - DNA, 20 bp, Homo sapiens
tgcccggggtggggtgcact

SEQ ID NO: 5952603 - DNA, 22 bp, Homo sapiens
tgcccggtgcagggcctggcat

SEQ ID NO: 5952604 - DNA, 15 bp, Homo sapiens
tgcccggtgccatct

SEQ ID NO: 5952605 - DNA, 20 bp, Homo sapiens
tgcccgtaaacacgcctgca

SEQ ID NO: 5952606 - DNA, 16 bp, Homo sapiens
tgcccgtaatcccagc

SEQ ID NO: 5952607 - DNA, 20 bp, Homo sapiens
tgcccgtaatcccagctact

SEQ ID NO: 5952608 - DNA, 16 bp, Homo sapiens
tgcccgtcggccctgc

SEQ ID NO: 5952609 - DNA, 20 bp, Homo sapiens
tgcccgtctctctcccatgg

SEQ ID NO: 5952610 - DNA, 23 bp, Homo sapiens
tgcccgtctctctcccatggagc

SEQ ID NO: 5952611 - DNA, 18 bp, Homo sapiens
tgcccgtcttcagcctag

SEQ ID NO: 5952612 - DNA, 17 bp, Homo sapiens
tgcccgtgaggaggggg

SEQ ID NO: 5952613 - DNA, 12 bp, Homo sapiens
tgcccgtgcctc

SEQ ID NO: 5952614 - DNA, 23 bp, Homo sapiens
tgcccgtggtgaggttgtgctgc

SEQ ID NO: 5952615 - DNA, 16 bp, Homo sapiens
tgcccgtgtggcctgg

SEQ ID NO: 5952616 - DNA, 20 bp, Homo sapiens
tgcccgtgtggcctgggtcc

SEQ ID NO: 5952617 - DNA, 17 bp, Homo sapiens
tgccctaaagtgtattt

SEQ ID NO: 5952618 - DNA, 20 bp, Homo sapiens
tgccctaaagtgtatttttt

SEQ ID NO: 5952619 - DNA, 19 bp, Homo sapiens
tgccctaaataacccttca

SEQ ID NO: 5952620 - DNA, 22 bp, Homo sapiens
tgccctaactctgcccaccctc

SEQ ID NO: 5952621 - DNA, 13 bp, Homo sapiens
tgccctaagcaga

SEQ ID NO: 5952622 - DNA, 20 bp, Homo sapiens
tgccctaagcagaaagtgcc

SEQ ID NO: 5952623 - DNA, 22 bp, Homo sapiens
tgccctaagcagaaagtgcctt

SEQ ID NO: 5952624 - DNA, 18 bp, Homo sapiens
tgccctaagcccccaggg

SEQ ID NO: 5952625 - DNA, 19 bp, Homo sapiens
tgccctaagcccccagggc

SEQ ID NO: 5952626 - DNA, 21 bp, Homo sapiens
tgccctaagcccccagggcct

SEQ ID NO: 5952627 - DNA, 23 bp, Homo sapiens
tgccctaagcccccagggcctcc

SEQ ID NO: 5952628 - DNA, 13 bp, Homo sapiens
tgccctaataaaa

SEQ ID NO: 5952629 - DNA, 23 bp, Homo sapiens
tgccctaatgcgcaggctggccc

SEQ ID NO: 5952630 - DNA, 15 bp, Homo sapiens
tgccctaattcatct

SEQ ID NO: 5952631 - DNA, 22 bp, Homo sapiens
tgccctacctgcctgttctcca

SEQ ID NO: 5952632 - DNA, 16 bp, Homo sapiens
tgccctaccttctgtt

SEQ ID NO: 5952633 - DNA, 22 bp, Homo sapiens
tgccctactatagcagttttta

SEQ ID NO: 5952634 - DNA, 15 bp, Homo sapiens
tgccctagaccctcc

SEQ ID NO: 5952635 - DNA, 17 bp, Homo sapiens
tgccctagaccctcccc

SEQ ID NO: 5952636 - DNA, 16 bp, Homo sapiens
tgccctagatgagccc

SEQ ID NO: 5952637 - DNA, 20 bp, Homo sapiens
tgccctagcagtttgcctct

SEQ ID NO: 5952638 - DNA, 22 bp, Homo sapiens
tgccctagcagtttgcctctgc

SEQ ID NO: 5952639 - DNA, 13 bp, Homo sapiens
tgccctagctcca

SEQ ID NO: 5952640 - DNA, 14 bp, Homo sapiens
tgccctagctccac

SEQ ID NO: 5952641 - DNA, 14 bp, Homo sapiens
tgccctagctgacc

SEQ ID NO: 5952642 - DNA, 18 bp, Homo sapiens
tgccctaggctccgtcag

SEQ ID NO: 5952643 - DNA, 19 bp, Homo sapiens
tgccctagggctcagaggg

SEQ ID NO: 5952644 - DNA, 21 bp, Homo sapiens
tgccctataacccctgcctgg

SEQ ID NO: 5952645 - DNA, 19 bp, Homo sapiens
tgccctatcacccaacgct

SEQ ID NO: 5952646 - DNA, 23 bp, Homo sapiens
tgccctatcttttctcccacctc

SEQ ID NO: 5952647 - DNA, 16 bp, Homo sapiens
tgccctatggatttga

SEQ ID NO: 5952648 - DNA, 15 bp, Homo sapiens
tgccctatgggcctg

SEQ ID NO: 5952649 - DNA, 16 bp, Homo sapiens
tgccctatgggcctgc

SEQ ID NO: 5952650 - DNA, 21 bp, Homo sapiens
tgccctcaagtaaaagaaaag

SEQ ID NO: 5952651 - DNA, 16 bp, Homo sapiens
tgccctcaatcccagc

SEQ ID NO: 5952652 - DNA, 13 bp, Homo sapiens
tgccctcaccacc

SEQ ID NO: 5952653 - DNA, 19 bp, Homo sapiens
tgccctcaccaccacacta

SEQ ID NO: 5952654 - DNA, 22 bp, Homo sapiens
tgccctcaccccaatccctgcc

SEQ ID NO: 5952655 - DNA, 14 bp, Homo sapiens
tgccctcacctccc

SEQ ID NO: 5952656 - DNA, 17 bp, Homo sapiens
tgccctcacgctctcca

SEQ ID NO: 5952657 - DNA, 16 bp, Homo sapiens
tgccctcactccactc

SEQ ID NO: 5952658 - DNA, 22 bp, Homo sapiens
tgccctcactccactcccctca

SEQ ID NO: 5952659 - DNA, 14 bp, Homo sapiens
tgccctcactccct

SEQ ID NO: 5952660 - DNA, 18 bp, Homo sapiens
tgccctcagatggagaca

SEQ ID NO: 5952661 - DNA, 21 bp, Homo sapiens
tgccctcagcctgttgcccct

SEQ ID NO: 5952662 - DNA, 14 bp, Homo sapiens
tgccctcaggaaag

SEQ ID NO: 5952663 - DNA, 13 bp, Homo sapiens
tgccctcaggctt

SEQ ID NO: 5952664 - DNA, 17 bp, Homo sapiens
tgccctcaggcttgggg

SEQ ID NO: 5952665 - DNA, 12 bp, Homo sapiens
tgccctcaggga

SEQ ID NO: 5952666 - DNA, 19 bp, Homo sapiens
tgccctcagggactgcacc

SEQ ID NO: 5952667 - DNA, 21 bp, Homo sapiens
tgccctcatggcccctctgac

SEQ ID NO: 5952668 - DNA, 23 bp, Homo sapiens
tgccctcattactgggccttagt

SEQ ID NO: 5952669 - DNA, 22 bp, Homo sapiens
tgccctccaagaccttctcctt

SEQ ID NO: 5952670 - DNA, 23 bp, Homo sapiens
tgccctccaagaggctccctcct

SEQ ID NO: 5952671 - DNA, 17 bp, Homo sapiens
tgccctccactgccctc

SEQ ID NO: 5952672 - DNA, 21 bp, Homo sapiens
tgccctccactgccctctgtt

SEQ ID NO: 5952673 - DNA, 18 bp, Homo sapiens
tgccctccagggccagga

SEQ ID NO: 5952674 - DNA, 17 bp, Homo sapiens
tgccctccatcccgaca

SEQ ID NO: 5952675 - DNA, 14 bp, Homo sapiens
tgccctcccacagc

SEQ ID NO: 5952676 - DNA, 17 bp, Homo sapiens
tgccctcccaccccctc

SEQ ID NO: 5952677 - DNA, 19 bp, Homo sapiens
tgccctcccacctccgctg

SEQ ID NO: 5952678 - DNA, 13 bp, Homo sapiens
tgccctcccagga

SEQ ID NO: 5952679 - DNA, 16 bp, Homo sapiens
tgccctcccaggaccc

SEQ ID NO: 5952680 - DNA, 12 bp, Homo sapiens
tgccctcccatc

SEQ ID NO: 5952681 - DNA, 17 bp, Homo sapiens
tgccctcccctctctgc

SEQ ID NO: 5952682 - DNA, 17 bp, Homo sapiens
tgccctcccctgctccc

SEQ ID NO: 5952683 - DNA, 22 bp, Homo sapiens
tgccctcccctgctcccaggtt

SEQ ID NO: 5952684 - DNA, 18 bp, Homo sapiens
tgccctccccttcccctt

SEQ ID NO: 5952685 - DNA, 23 bp, Homo sapiens
tgccctccctcagccgtcagcca

SEQ ID NO: 5952686 - DNA, 20 bp, Homo sapiens
tgccctccctgctgccaggc

SEQ ID NO: 5952687 - DNA, 12 bp, Homo sapiens
tgccctccctgg

SEQ ID NO: 5952688 - DNA, 16 bp, Homo sapiens
tgccctccctggcctc

SEQ ID NO: 5952689 - DNA, 23 bp, Homo sapiens
tgccctccctggcctcacgccca

SEQ ID NO: 5952690 - DNA, 13 bp, Homo sapiens
tgccctccctggg

SEQ ID NO: 5952691 - DNA, 17 bp, Homo sapiens
tgccctccgccccgtcc

SEQ ID NO: 5952692 - DNA, 13 bp, Homo sapiens
tgccctccggagg

SEQ ID NO: 5952693 - DNA, 14 bp, Homo sapiens
tgccctcctcactc

SEQ ID NO: 5952694 - DNA, 16 bp, Homo sapiens
tgccctcctctcccat

SEQ ID NO: 5952695 - DNA, 15 bp, Homo sapiens
tgccctcctctcccg

SEQ ID NO: 5952696 - DNA, 19 bp, Homo sapiens
tgccctcctctcccgtctc

SEQ ID NO: 5952697 - DNA, 15 bp, Homo sapiens
tgccctcctctccct

SEQ ID NO: 5952698 - DNA, 21 bp, Homo sapiens
tgccctcctctccctcccact

SEQ ID NO: 5952699 - DNA, 16 bp, Homo sapiens
tgccctcctgagcctc

SEQ ID NO: 5952700 - DNA, 13 bp, Homo sapiens
tgccctcctgccc

SEQ ID NO: 5952701 - DNA, 18 bp, Homo sapiens
tgccctcctgggccctgg

SEQ ID NO: 5952702 - DNA, 19 bp, Homo sapiens
tgccctcctgggccctggg

SEQ ID NO: 5952703 - DNA, 14 bp, Homo sapiens
tgccctcctgtgct

SEQ ID NO: 5952704 - DNA, 21 bp, Homo sapiens
tgccctcctgtgctcagccct

SEQ ID NO: 5952705 - DNA, 23 bp, Homo sapiens
tgccctcctgtgctcagccctga

SEQ ID NO: 5952706 - DNA, 15 bp, Homo sapiens
tgccctccttcccaa

SEQ ID NO: 5952707 - DNA, 16 bp, Homo sapiens
tgccctccttcccaat

SEQ ID NO: 5952708 - DNA, 19 bp, Homo sapiens
tgccctccttgtccaccca

SEQ ID NO: 5952709 - DNA, 22 bp, Homo sapiens
tgccctcgcctcctcctcctgc

SEQ ID NO: 5952710 - DNA, 13 bp, Homo sapiens
tgccctcgctgct

SEQ ID NO: 5952711 - DNA, 17 bp, Homo sapiens
tgccctcgctgcttctg

SEQ ID NO: 5952712 - DNA, 20 bp, Homo sapiens
tgccctcgggcgagtcactg

SEQ ID NO: 5952713 - DNA, 23 bp, Homo sapiens
tgccctcgggcgagtcactgcct

SEQ ID NO: 5952714 - DNA, 14 bp, Homo sapiens
tgccctcgggtctc

SEQ ID NO: 5952715 - DNA, 16 bp, Homo sapiens
tgccctcgggtggggc

SEQ ID NO: 5952716 - DNA, 16 bp, Homo sapiens
tgccctcgtggccagc

SEQ ID NO: 5952717 - DNA, 21 bp, Homo sapiens
tgccctcgtggccagcccggc

SEQ ID NO: 5952718 - DNA, 22 bp, Homo sapiens
tgccctctatttattagccaac

SEQ ID NO: 5952719 - DNA, 13 bp, Homo sapiens
tgccctctcccac

SEQ ID NO: 5952720 - DNA, 15 bp, Homo sapiens
tgccctctcccaccc

SEQ ID NO: 5952721 - DNA, 23 bp, Homo sapiens
tgccctctccctgtgttctgggc

SEQ ID NO: 5952722 - DNA, 13 bp, Homo sapiens
tgccctctcctgg

SEQ ID NO: 5952723 - DNA, 22 bp, Homo sapiens
tgccctctcctgggcagctgcc

SEQ ID NO: 5952724 - DNA, 13 bp, Homo sapiens
tgccctctgcccc

SEQ ID NO: 5952725 - DNA, 18 bp, Homo sapiens
tgccctctgctcaggcct

SEQ ID NO: 5952726 - DNA, 19 bp, Homo sapiens
tgccctctgctcaggcctc

SEQ ID NO: 5952727 - DNA, 14 bp, Homo sapiens
tgccctctgctctg

SEQ ID NO: 5952728 - DNA, 20 bp, Homo sapiens
tgccctctgctctgcctgga

SEQ ID NO: 5952729 - DNA, 22 bp, Homo sapiens
tgccctctgctctgcctggagt

SEQ ID NO: 5952730 - DNA, 15 bp, Homo sapiens
tgccctctgctgctg

SEQ ID NO: 5952731 - DNA, 16 bp, Homo sapiens
tgccctctgctgctgc

SEQ ID NO: 5952732 - DNA, 18 bp, Homo sapiens
tgccctctgctgctgccc

SEQ ID NO: 5952733 - DNA, 22 bp, Homo sapiens
tgccctctggatcctgctgtgg

SEQ ID NO: 5952734 - DNA, 21 bp, Homo sapiens
tgccctctggattctctgggt

SEQ ID NO: 5952735 - DNA, 15 bp, Homo sapiens
tgccctctgggctct

SEQ ID NO: 5952736 - DNA, 15 bp, Homo sapiens
tgccctctgtttccc

SEQ ID NO: 5952737 - DNA, 20 bp, Homo sapiens
tgccctcttaagatctgact

SEQ ID NO: 5952738 - DNA, 21 bp, Homo sapiens
tgccctcttaagatctgactg

SEQ ID NO: 5952739 - DNA, 12 bp, Homo sapiens
tgccctcttcat

SEQ ID NO: 5952740 - DNA, 20 bp, Homo sapiens
tgccctcttctcgtgcctcc

SEQ ID NO: 5952741 - DNA, 14 bp, Homo sapiens
tgccctgaaaatgt

SEQ ID NO: 5952742 - DNA, 17 bp, Homo sapiens
tgccctgaaaatgttac

SEQ ID NO: 5952743 - DNA, 17 bp, Homo sapiens
tgccctgaaactactgt

SEQ ID NO: 5952744 - DNA, 16 bp, Homo sapiens
tgccctgaaagggccc

SEQ ID NO: 5952745 - DNA, 21 bp, Homo sapiens
tgccctgaaagggcccttccc

SEQ ID NO: 5952746 - DNA, 17 bp, Homo sapiens
tgccctgaacctctgat

SEQ ID NO: 5952747 - DNA, 18 bp, Homo sapiens
tgccctgacccctgcacc

SEQ ID NO: 5952748 - DNA, 13 bp, Homo sapiens
tgccctgacctcc

SEQ ID NO: 5952749 - DNA, 14 bp, Homo sapiens
tgccctgacctccc

SEQ ID NO: 5952750 - DNA, 15 bp, Homo sapiens
tgccctgagcactcc

SEQ ID NO: 5952751 - DNA, 17 bp, Homo sapiens
tgccctgagcactcctg

SEQ ID NO: 5952752 - DNA, 22 bp, Homo sapiens
tgccctgagcactcctggtgca

SEQ ID NO: 5952753 - DNA, 23 bp, Homo sapiens
tgccctgagcactcctggtgcag

SEQ ID NO: 5952754 - DNA, 19 bp, Homo sapiens
tgccctgagctttccgggg

SEQ ID NO: 5952755 - DNA, 14 bp, Homo sapiens
tgccctgaggaagg

SEQ ID NO: 5952756 - DNA, 12 bp, Homo sapiens
tgccctgaggag

SEQ ID NO: 5952757 - DNA, 14 bp, Homo sapiens
tgccctgaggctgt

SEQ ID NO: 5952758 - DNA, 17 bp, Homo sapiens
tgccctgaggctgtgag

SEQ ID NO: 5952759 - DNA, 12 bp, Homo sapiens
tgccctgagggg

SEQ ID NO: 5952760 - DNA, 15 bp, Homo sapiens
tgccctgcagagcaa

SEQ ID NO: 5952761 - DNA, 16 bp, Homo sapiens
tgccctgcagagcaat

SEQ ID NO: 5952762 - DNA, 17 bp, Homo sapiens
tgccctgcagagcaata

SEQ ID NO: 5952763 - DNA, 19 bp, Homo sapiens
tgccctgcagagcaataac

SEQ ID NO: 5952764 - DNA, 22 bp, Homo sapiens
tgccctgcagagcaataacact

SEQ ID NO: 5952765 - DNA, 13 bp, Homo sapiens
tgccctgcagcac

SEQ ID NO: 5952766 - DNA, 18 bp, Homo sapiens
tgccctgccaagcctgga

SEQ ID NO: 5952767 - DNA, 14 bp, Homo sapiens
tgccctgccacctg

SEQ ID NO: 5952768 - DNA, 16 bp, Homo sapiens
tgccctgccacctgtc

SEQ ID NO: 5952769 - DNA, 22 bp, Homo sapiens
tgccctgccacctgtctgtctg

SEQ ID NO: 5952770 - DNA, 12 bp, Homo sapiens
tgccctgccagg

SEQ ID NO: 5952771 - DNA, 15 bp, Homo sapiens
tgccctgccaggctg

SEQ ID NO: 5952772 - DNA, 11 bp, Homo sapiens
tgccctgccat

SEQ ID NO: 5952773 - DNA, 12 bp, Homo sapiens
tgccctgccatt

SEQ ID NO: 5952774 - DNA, 11 bp, Homo sapiens
tgccctgccca

SEQ ID NO: 5952775 - DNA, 22 bp, Homo sapiens
tgcctccgcgtgatcaaagcca

SEQ ID NO: 5952776 - DNA, 17 bp, Homo sapiens
tgcctccggccctgccc

SEQ ID NO: 5952777 - DNA, 18 bp, Homo sapiens
tgcctccggccctgcccc

SEQ ID NO: 5952778 - DNA, 21 bp, Homo sapiens
tgcctccggccctgccccaca

SEQ ID NO: 5952779 - DNA, 17 bp, Homo sapiens
tgcctccgggcctcggc

SEQ ID NO: 5952780 - DNA, 20 bp, Homo sapiens
tgcctccgggcctcggcctg

SEQ ID NO: 5952781 - DNA, 23 bp, Homo sapiens
tgcctccgggcctcggcctggct

SEQ ID NO: 5952782 - DNA, 21 bp, Homo sapiens
tgcctcctacaaccaggtctt

SEQ ID NO: 5952783 - DNA, 16 bp, Homo sapiens
tgcctcctactccagt

SEQ ID NO: 5952784 - DNA, 21 bp, Homo sapiens
tgcctcctagacacccgccct

SEQ ID NO: 5952785 - DNA, 17 bp, Homo sapiens
tgcctcctagagtgcag

SEQ ID NO: 5952786 - DNA, 21 bp, Homo sapiens
tgcctcctaggctggaagcca

SEQ ID NO: 5952787 - DNA, 22 bp, Homo sapiens
tgcctcctaggctggaagccat

SEQ ID NO: 5952788 - DNA, 19 bp, Homo sapiens
tgcctcctcaaacccagtc

SEQ ID NO: 5952789 - DNA, 20 bp, Homo sapiens
tgcctcctcaaacccagtct

SEQ ID NO: 5952790 - DNA, 22 bp, Homo sapiens
tgcctcctcaaacccagtctca

SEQ ID NO: 5952791 - DNA, 19 bp, Homo sapiens
tgcctcctcacccccagct

SEQ ID NO: 5952792 - DNA, 13 bp, Homo sapiens
tgcctcctcagga

SEQ ID NO: 5952793 - DNA, 15 bp, Homo sapiens
tgcctcctcccatcc

SEQ ID NO: 5952794 - DNA, 12 bp, Homo sapiens
tgcctcctccct

SEQ ID NO: 5952795 - DNA, 13 bp, Homo sapiens
tgcctcctccctc

SEQ ID NO: 5952796 - DNA, 15 bp, Homo sapiens
tgcctcctccctccc

SEQ ID NO: 5952797 - DNA, 16 bp, Homo sapiens
tgcctcctccctggct

SEQ ID NO: 5952798 - DNA, 21 bp, Homo sapiens
tgcctcctccctggctgcagc

SEQ ID NO: 5952799 - DNA, 15 bp, Homo sapiens
tgcctcctcctgaga

SEQ ID NO: 5952800 - DNA, 14 bp, Homo sapiens
tgcctcctcctgcc

SEQ ID NO: 5952801 - DNA, 12 bp, Homo sapiens
tgcctcctcctt

SEQ ID NO: 5952802 - DNA, 20 bp, Homo sapiens
tgcctcctcgttcctttctc

SEQ ID NO: 5952803 - DNA, 14 bp, Homo sapiens
tgcctcctctctcc

SEQ ID NO: 5952804 - DNA, 19 bp, Homo sapiens
tgcctcctctctccctgcc

SEQ ID NO: 5952805 - DNA, 16 bp, Homo sapiens
tgcctcctcttcaact

SEQ ID NO: 5952806 - DNA, 17 bp, Homo sapiens
tgcctcctgaggctgtt

SEQ ID NO: 5952807 - DNA, 18 bp, Homo sapiens
tgcctcctgaggctgttt

SEQ ID NO: 5952808 - DNA, 12 bp, Homo sapiens
tgcctcctgcag

SEQ ID NO: 5952809 - DNA, 15 bp, Homo sapiens
tgcctcctgcagttt

SEQ ID NO: 5952810 - DNA, 17 bp, Homo sapiens
tgcctcctgcagtttgg

SEQ ID NO: 5952811 - DNA, 17 bp, Homo sapiens
tgcctcctgccacccct

SEQ ID NO: 5952812 - DNA, 16 bp, Homo sapiens
tgcctcctgcctcccg

SEQ ID NO: 5952813 - DNA, 14 bp, Homo sapiens
tgcctcctgcctgc

SEQ ID NO: 5952814 - DNA, 18 bp, Homo sapiens
tgcctcctgcctgcccct

SEQ ID NO: 5952815 - DNA, 14 bp, Homo sapiens
tgcctcctgctttg

SEQ ID NO: 5952816 - DNA, 13 bp, Homo sapiens
tgcctcctggcca

SEQ ID NO: 5952817 - DNA, 12 bp, Homo sapiens
tgcctcctggct

SEQ ID NO: 5952818 - DNA, 13 bp, Homo sapiens
tgcctcctggctc

SEQ ID NO: 5952819 - DNA, 16 bp, Homo sapiens
tgcctcctggctcagg

SEQ ID NO: 5952820 - DNA, 19 bp, Homo sapiens
tgcctcctggctcaggccc

SEQ ID NO: 5952821 - DNA, 12 bp, Homo sapiens
tgcctcctggga

SEQ ID NO: 5952822 - DNA, 15 bp, Homo sapiens
tgcctcctgggacca

SEQ ID NO: 5952823 - DNA, 10 bp, Homo sapiens
tgcctcctgt

SEQ ID NO: 5952824 - DNA, 17 bp, Homo sapiens
tgcctcctgtcttatgg

SEQ ID NO: 5952825 - DNA, 13 bp, Homo sapiens
tgcctcctgtgta

SEQ ID NO: 5952826 - DNA, 17 bp, Homo sapiens
tgcctcctgtgtactgt

SEQ ID NO: 5952827 - DNA, 18 bp, Homo sapiens
tgcctcctgtgtactgtg

SEQ ID NO: 5952828 - DNA, 22 bp, Homo sapiens
tgcctcctgtgtgtctgcagac

SEQ ID NO: 5952829 - DNA, 19 bp, Homo sapiens
tgcctcctgttctgcccac

SEQ ID NO: 5952830 - DNA, 20 bp, Homo sapiens
tgcctcctgttttctccctc

SEQ ID NO: 5952831 - DNA, 21 bp, Homo sapiens
tgcctcctgttttctccctct

SEQ ID NO: 5952832 - DNA, 18 bp, Homo sapiens
tgcctccttatttatcaa

SEQ ID NO: 5952833 - DNA, 18 bp, Homo sapiens
tgcctccttgccagcccc

SEQ ID NO: 5952834 - DNA, 16 bp, Homo sapiens
tgcctccttggccacc

SEQ ID NO: 5952835 - DNA, 21 bp, Homo sapiens
tgcctcgaaacacagaaacct

SEQ ID NO: 5952836 - DNA, 15 bp, Homo sapiens
tgcctcgaaagtgtc

SEQ ID NO: 5952837 - DNA, 16 bp, Homo sapiens
tgcctcgaaagtgtca

SEQ ID NO: 5952838 - DNA, 19 bp, Homo sapiens
tgcctcgaactggctgcaa

SEQ ID NO: 5952839 - DNA, 20 bp, Homo sapiens
tgcctcgaactggctgcaaa

SEQ ID NO: 5952840 - DNA, 24 bp, Homo sapiens
tgcctcgacacgtgggctcccctc

SEQ ID NO: 5952841 - DNA, 17 bp, Homo sapiens
tgcctcgaggcaccggc

SEQ ID NO: 5952842 - DNA, 22 bp, Homo sapiens
tgcctcgaggcaccggcgctgc

SEQ ID NO: 5952843 - DNA, 15 bp, Homo sapiens
tgcctcgagggccgc

SEQ ID NO: 5952844 - DNA, 21 bp, Homo sapiens
tgcctcgagggccgcctgcct

SEQ ID NO: 5952845 - DNA, 17 bp, Homo sapiens
tgcctcgagtcccccca

SEQ ID NO: 5952846 - DNA, 21 bp, Homo sapiens
tgcctcgctccccactctgct

SEQ ID NO: 5952847 - DNA, 17 bp, Homo sapiens
tgcctcggactccatgg

SEQ ID NO: 5952848 - DNA, 13 bp, Homo sapiens
tgcctcggcctcc

SEQ ID NO: 5952849 - DNA, 16 bp, Homo sapiens
tgcctcggctcacaaa

SEQ ID NO: 5952850 - DNA, 16 bp, Homo sapiens
tgcctcggctggctcc

SEQ ID NO: 5952851 - DNA, 20 bp, Homo sapiens
tgcctcggctggctcccctg

SEQ ID NO: 5952852 - DNA, 24 bp, Homo sapiens
tgcctcggcttttctcagctggat

SEQ ID NO: 5952853 - DNA, 22 bp, Homo sapiens
tgcctcggtggccctgactgtc

SEQ ID NO: 5952854 - DNA, 18 bp, Homo sapiens
tgcctctaactccctcct

SEQ ID NO: 5952855 - DNA, 20 bp, Homo sapiens
tgcctctaaggccaaggcct

SEQ ID NO: 5952856 - DNA, 22 bp, Homo sapiens
tgcctctaaggccaaggcctca

SEQ ID NO: 5952857 - DNA, 23 bp, Homo sapiens
tgcctctaaggccaaggcctcag

SEQ ID NO: 5952858 - DNA, 16 bp, Homo sapiens
tgcctctacccaacca

SEQ ID NO: 5952859 - DNA, 15 bp, Homo sapiens
tgcctctatccctgg

SEQ ID NO: 5952860 - DNA, 18 bp, Homo sapiens
tgcctctatccctggcca

SEQ ID NO: 5952861 - DNA, 19 bp, Homo sapiens
tgcctctatccctggccac

SEQ ID NO: 5952862 - DNA, 16 bp, Homo sapiens
tgcctctatgccctgc

SEQ ID NO: 5952863 - DNA, 13 bp, Homo sapiens
tgcctctcacaca

SEQ ID NO: 5952864 - DNA, 14 bp, Homo sapiens
tgcctctcacagct

SEQ ID NO: 5952865 - DNA, 13 bp, Homo sapiens
tgcctctcagcca

SEQ ID NO: 5952866 - DNA, 18 bp, Homo sapiens
tgcctctcatcaactgaa

SEQ ID NO: 5952867 - DNA, 14 bp, Homo sapiens
tgcctctcccatgg

SEQ ID NO: 5952868 - DNA, 19 bp, Homo sapiens
tgcctctcccgcaccaggc

SEQ ID NO: 5952869 - DNA, 12 bp, Homo sapiens
tgcctctccctc

SEQ ID NO: 5952870 - DNA, 15 bp, Homo sapiens
tgcctctccctctgg

SEQ ID NO: 5952871 - DNA, 20 bp, Homo sapiens
tgcctctccgcccctgagcc

SEQ ID NO: 5952872 - DNA, 21 bp, Homo sapiens
tgcctctccgcccctgagccc

SEQ ID NO: 5952873 - DNA, 11 bp, Homo sapiens
tgcctctcctc

SEQ ID NO: 5952874 - DNA, 16 bp, Homo sapiens
tgcctctcctttgtat

SEQ ID NO: 5952875 - DNA, 13 bp, Homo sapiens
tgcctctctcagg

SEQ ID NO: 5952876 - DNA, 15 bp, Homo sapiens
tgcctctctcaggcc

SEQ ID NO: 5952877 - DNA, 12 bp, Homo sapiens
tgcctctctgca

SEQ ID NO: 5952878 - DNA, 19 bp, Homo sapiens
tgcctctctgcaggtccct

SEQ ID NO: 5952879 - DNA, 13 bp, Homo sapiens
tgcctctctgcca

SEQ ID NO: 5952880 - DNA, 16 bp, Homo sapiens
tgcctctctgctccag

SEQ ID NO: 5952881 - DNA, 23 bp, Homo sapiens
tgcctctctggaaagaggctctg

SEQ ID NO: 5952882 - DNA, 12 bp, Homo sapiens
tgcctctctgtt

SEQ ID NO: 5952883 - DNA, 14 bp, Homo sapiens
tgcctctcttctgt

SEQ ID NO: 5952884 - DNA, 13 bp, Homo sapiens
tgcctctcttgcc

SEQ ID NO: 5952885 - DNA, 14 bp, Homo sapiens
tgcctctcttgccc

SEQ ID NO: 5952886 - DNA, 17 bp, Homo sapiens
tgcctctcttgcccctt

SEQ ID NO: 5952887 - DNA, 17 bp, Homo sapiens
tgcctctgaaaatattt

SEQ ID NO: 5952888 - DNA, 16 bp, Homo sapiens
tgcctctgacacacag

SEQ ID NO: 5952889 - DNA, 21 bp, Homo sapiens
tgcctctgacacacagctctg

SEQ ID NO: 5952890 - DNA, 21 bp, Homo sapiens
tgcctctgacagcagcctgtg

SEQ ID NO: 5952891 - DNA, 23 bp, Homo sapiens
tgcctctgacagcagcctgtgag

SEQ ID NO: 5952892 - DNA, 22 bp, Homo sapiens
tgcctctgacagtccacagggg

SEQ ID NO: 5952893 - DNA, 16 bp, Homo sapiens
tgcctctgaccccagc

SEQ ID NO: 5952894 - DNA, 14 bp, Homo sapiens
tgcctctgactcac

SEQ ID NO: 5952895 - DNA, 12 bp, Homo sapiens
tgcctctgagag

SEQ ID NO: 5952896 - DNA, 22 bp, Homo sapiens
tgcctctgagagcatcaggcct

SEQ ID NO: 5952897 - DNA, 15 bp, Homo sapiens
tgcctctgagcttct

SEQ ID NO: 5952898 - DNA, 12 bp, Homo sapiens
tgcctctgaggc

SEQ ID NO: 5952899 - DNA, 13 bp, Homo sapiens
tgcctctgaggcc

SEQ ID NO: 5952900 - DNA, 18 bp, Homo sapiens
tgcctctgaggccagcct

SEQ ID NO: 5952901 - DNA, 19 bp, Homo sapiens
tgcctctgaggccagcctg

SEQ ID NO: 5952902 - DNA, 11 bp, Homo sapiens
tgcctctgagt

SEQ ID NO: 5952903 - DNA, 18 bp, Homo sapiens
tgcctctgatatgggact

SEQ ID NO: 5952904 - DNA, 19 bp, Homo sapiens
tgcctctgatgtattttgt

SEQ ID NO: 5952905 - DNA, 17 bp, Homo sapiens
tgcctctgattttctcc

SEQ ID NO: 5952906 - DNA, 15 bp, Homo sapiens
tgcctctgcacgtgc

SEQ ID NO: 5952907 - DNA, 14 bp, Homo sapiens
tgcctctgcagtct

SEQ ID NO: 5952908 - DNA, 11 bp, Homo sapiens
tgcctctgcca

SEQ ID NO: 5952909 - DNA, 16 bp, Homo sapiens
tgcctctgccacagca

SEQ ID NO: 5952910 - DNA, 15 bp, Homo sapiens
tgcctctgccatgcc

SEQ ID NO: 5952911 - DNA, 13 bp, Homo sapiens
tgcctctgccctg

SEQ ID NO: 5952912 - DNA, 14 bp, Homo sapiens
tgcctctgccctgg

SEQ ID NO: 5952913 - DNA, 16 bp, Homo sapiens
tgcctctgcccttggg

SEQ ID NO: 5952914 - DNA, 17 bp, Homo sapiens
tgcctctgcctcccaaa

SEQ ID NO: 5952915 - DNA, 13 bp, Homo sapiens
tgcctctgcctct

SEQ ID NO: 5952916 - DNA, 20 bp, Homo sapiens
tgcctctgcctctgacacac

SEQ ID NO: 5952917 - DNA, 13 bp, Homo sapiens
tgcctctgcctgt

SEQ ID NO: 5952918 - DNA, 14 bp, Homo sapiens
tgcctctgccttag

SEQ ID NO: 5952919 - DNA, 18 bp, Homo sapiens
tgcctctgccttatctca

SEQ ID NO: 5952920 - DNA, 20 bp, Homo sapiens
tgcctctgccttatctcatt

SEQ ID NO: 5952921 - DNA, 13 bp, Homo sapiens
tgcctctgccttg

SEQ ID NO: 5952922 - DNA, 12 bp, Homo sapiens
tgcctctgctac

SEQ ID NO: 5952923 - DNA, 12 bp, Homo sapiens
tgcctctgctcc

SEQ ID NO: 5952924 - DNA, 14 bp, Homo sapiens
tgcctctgctccct

SEQ ID NO: 5952925 - DNA, 17 bp, Homo sapiens
tgcctctgctccctctg

SEQ ID NO: 5952926 - DNA, 18 bp, Homo sapiens
tgcctctggaaaactatt

SEQ ID NO: 5952927 - DNA, 19 bp, Homo sapiens
tgcctctggaggcctctgg

SEQ ID NO: 5952928 - DNA, 20 bp, Homo sapiens
tgcctctggaggcctctggc

SEQ ID NO: 5952929 - DNA, 14 bp, Homo sapiens
tgcctctgggactg

SEQ ID NO: 5952930 - DNA, 15 bp, Homo sapiens
tgcctctgggcagcc

SEQ ID NO: 5952931 - DNA, 13 bp, Homo sapiens
tgcctctgggcca

SEQ ID NO: 5952932 - DNA, 18 bp, Homo sapiens
tgcctctgggtaggaaaa

SEQ ID NO: 5952933 - DNA, 12 bp, Homo sapiens
tgcctctggttt

SEQ ID NO: 5952934 - DNA, 12 bp, Homo sapiens
tgcctctgtcca

SEQ ID NO: 5952935 - DNA, 13 bp, Homo sapiens
tgcctctgtcccc

SEQ ID NO: 5952936 - DNA, 15 bp, Homo sapiens
tgcctctgtcccctt

SEQ ID NO: 5952937 - DNA, 17 bp, Homo sapiens
tgcctctgtcctagact

SEQ ID NO: 5952938 - DNA, 13 bp, Homo sapiens
tgcctctgtcctc

SEQ ID NO: 5952939 - DNA, 17 bp, Homo sapiens
tgcctctgtcctcccat

SEQ ID NO: 5952940 - DNA, 16 bp, Homo sapiens
tgcctctgtcttctgg

SEQ ID NO: 5952941 - DNA, 19 bp, Homo sapiens
tgcctctgtgcacagtggc

SEQ ID NO: 5952942 - DNA, 13 bp, Homo sapiens
tgcctctgtgctg

SEQ ID NO: 5952943 - DNA, 16 bp, Homo sapiens
tgcctctgtttgacaa

SEQ ID NO: 5952944 - DNA, 23 bp, Homo sapiens
tgcctctgtttgacaaacctcta

SEQ ID NO: 5952945 - DNA, 22 bp, Homo sapiens
tgcctcttaacttaaaagaaca

SEQ ID NO: 5952946 - DNA, 17 bp, Homo sapiens
tgcctcttacggtagtt

SEQ ID NO: 5952947 - DNA, 14 bp, Homo sapiens
tgcctcttcattct

SEQ ID NO: 5952948 - DNA, 12 bp, Homo sapiens
tgcctcttccag

SEQ ID NO: 5952949 - DNA, 17 bp, Homo sapiens
tgcctcttccttgaaga

SEQ ID NO: 5952950 - DNA, 20 bp, Homo sapiens
tgcctcttctgggagggcag

SEQ ID NO: 5952951 - DNA, 14 bp, Homo sapiens
tgcctcttctttgt

SEQ ID NO: 5952952 - DNA, 19 bp, Homo sapiens
tgcctcttctttgtgcctt

SEQ ID NO: 5952953 - DNA, 20 bp, Homo sapiens
tgcctcttctttgtgccttt

SEQ ID NO: 5952954 - DNA, 21 bp, Homo sapiens
tgcctcttctttgtgcctttg

SEQ ID NO: 5952955 - DNA, 17 bp, Homo sapiens
tgcctcttggcttctca

SEQ ID NO: 5952956 - DNA, 19 bp, Homo sapiens
tgccttttgcaaccaggaa

SEQ ID NO: 5952957 - DNA, 18 bp, Homo sapiens
tgccttttgcacccctcc

SEQ ID NO: 5952958 - DNA, 19 bp, Homo sapiens
tgccttttgcacccctccc

SEQ ID NO: 5952959 - DNA, 15 bp, Homo sapiens
tgccttttgcagaag

SEQ ID NO: 5952960 - DNA, 17 bp, Homo sapiens
tgccttttgcagaagag

SEQ ID NO: 5952961 - DNA, 15 bp, Homo sapiens
tgccttttgctgcgc

SEQ ID NO: 5952962 - DNA, 16 bp, Homo sapiens
tgccttttgctgcgca

SEQ ID NO: 5952963 - DNA, 17 bp, Homo sapiens
tgccttttgctgcgcac

SEQ ID NO: 5952964 - DNA, 18 bp, Homo sapiens
tgccttttgctgcgcacc

SEQ ID NO: 5952965 - DNA, 23 bp, Homo sapiens
tgccttttgctgctgctgctgcg

SEQ ID NO: 5952966 - DNA, 23 bp, Homo sapiens
tgccttttgggtttgccttaatt

SEQ ID NO: 5952967 - DNA, 13 bp, Homo sapiens
tgccttttggttt

SEQ ID NO: 5952968 - DNA, 21 bp, Homo sapiens
tgccttttggtttcaccttcc

SEQ ID NO: 5952969 - DNA, 22 bp, Homo sapiens
tgccttttggtttcaccttccc

SEQ ID NO: 5952970 - DNA, 23 bp, Homo sapiens
tgccttttgtaggctgttccctt

SEQ ID NO: 5952971 - DNA, 17 bp, Homo sapiens
tgcctttttacagccaa

SEQ ID NO: 5952972 - DNA, 21 bp, Homo sapiens
tgcctttttagatgtattttt

SEQ ID NO: 5952973 - DNA, 13 bp, Homo sapiens
tgcctttttattt

SEQ ID NO: 5952974 - DNA, 21 bp, Homo sapiens
tgcctttttatttatatgtac

SEQ ID NO: 5952975 - DNA, 22 bp, Homo sapiens
tgcctttttatttttgttttta

SEQ ID NO: 5952976 - DNA, 16 bp, Homo sapiens
tgcctttttcattatt

SEQ ID NO: 5952977 - DNA, 19 bp, Homo sapiens
tgcctttttcattttccaa

SEQ ID NO: 5952978 - DNA, 21 bp, Homo sapiens
tgcctttttcattttccaata

SEQ ID NO: 5952979 - DNA, 20 bp, Homo sapiens
tgcctttttccttatttcaa

SEQ ID NO: 5952980 - DNA, 17 bp, Homo sapiens
tgccttttttagcttca

SEQ ID NO: 5952981 - DNA, 22 bp, Homo sapiens
tgccttttttctatatcaaaaa

SEQ ID NO: 5952982 - DNA, 20 bp, Homo sapiens
tgccttttttctgtataaat

SEQ ID NO: 5952983 - DNA, 17 bp, Homo sapiens
tgcgaaaacgttgaccc

SEQ ID NO: 5952984 - DNA, 18 bp, Homo sapiens
tgcgaaaacgttgacccc

SEQ ID NO: 5952985 - DNA, 19 bp, Homo sapiens
tgcgaaaaggtttttagga

SEQ ID NO: 5952986 - DNA, 14 bp, Homo sapiens
tgcgaaacccagcg

SEQ ID NO: 5952987 - DNA, 22 bp, Homo sapiens
tgcgaaacccagcgttcttcag

SEQ ID NO: 5952988 - DNA, 15 bp, Homo sapiens
tgcgaaatgttctca

SEQ ID NO: 5952989 - DNA, 21 bp, Homo sapiens
tgcgaacacagtgacacgttt

SEQ ID NO: 5952990 - DNA, 20 bp, Homo sapiens
tgcgaagaccctcttgccca

SEQ ID NO: 5952991 - DNA, 15 bp, Homo sapiens
tgcgaagcaagaaga

SEQ ID NO: 5952992 - DNA, 16 bp, Homo sapiens
tgcgaagcaagaagaa

SEQ ID NO: 5952993 - DNA, 19 bp, Homo sapiens
tgcgaagcaagaagaattg

SEQ ID NO: 5952994 - DNA, 22 bp, Homo sapiens
tgcgaatccaagctccctgccc

SEQ ID NO: 5952995 - DNA, 15 bp, Homo sapiens
tgcgaatgagctggg

SEQ ID NO: 5952996 - DNA, 19 bp, Homo sapiens
tgcgaatgagctgggccct

SEQ ID NO: 5952997 - DNA, 22 bp, Homo sapiens
tgcgaatggactttggaagcag

SEQ ID NO: 5952998 - DNA, 22 bp, Homo sapiens
tgcgaatggtagtctaaccaaa

SEQ ID NO: 5952999 - DNA, 23 bp, Homo sapiens
tgcgaatggtagtctaaccaaat

SEQ ID NO: 5953000 - DNA, 19 bp, Homo sapiens
tgcgacactgggaggccag

SEQ ID NO: 5953001 - DNA, 16 bp, Homo sapiens
tgcgacagagagaggg

SEQ ID NO: 5953002 - DNA, 18 bp, Homo sapiens
tgcgacagagagagggga

SEQ ID NO: 5953003 - DNA, 20 bp, Homo sapiens
tgcgaccaccaacacacagg

SEQ ID NO: 5953004 - DNA, 22 bp, Homo sapiens
tgcgaccagaggtgggaggccc

SEQ ID NO: 5953005 - DNA, 20 bp, Homo sapiens
tgcgaccccatctgcccagg

SEQ ID NO: 5953006 - DNA, 14 bp, Homo sapiens
tgcgaccctggggg

SEQ ID NO: 5953007 - DNA, 15 bp, Homo sapiens
tgcgaccctgggggc

SEQ ID NO: 5953008 - DNA, 19 bp, Homo sapiens
tgcgaccctgggggcacag

SEQ ID NO: 5953009 - DNA, 21 bp, Homo sapiens
tgcgaccctgggggcacagga

SEQ ID NO: 5953010 - DNA, 19 bp, Homo sapiens
tgcgaccttaatttaactt

SEQ ID NO: 5953011 - DNA, 23 bp, Homo sapiens
tgcgacggaggcaggaccaggca

SEQ ID NO: 5953012 - DNA, 16 bp, Homo sapiens
tgcgactttctgcctg

SEQ ID NO: 5953013 - DNA, 18 bp, Homo sapiens
tgcgactttctgcctgga

SEQ ID NO: 5953014 - DNA, 21 bp, Homo sapiens
tgcgagaacacaagccacgcc

SEQ ID NO: 5953015 - DNA, 14 bp, Homo sapiens
tgcgagaattttca

SEQ ID NO: 5953016 - DNA, 13 bp, Homo sapiens
tgcgagactctga

SEQ ID NO: 5953017 - DNA, 15 bp, Homo sapiens
tgcgagagatgtgtg

SEQ ID NO: 5953018 - DNA, 17 bp, Homo sapiens
tgcgagcaacagtgccc

SEQ ID NO: 5953019 - DNA, 20 bp, Homo sapiens
tgcgagcatttccctcccgg

SEQ ID NO: 5953020 - DNA, 20 bp, Homo sapiens
tgcgagcttggccttgggcc

SEQ ID NO: 5953021 - DNA, 15 bp, Homo sapiens
tgcgaggctatgagt

SEQ ID NO: 5953022 - DNA, 21 bp, Homo sapiens
tgcgaggctcggagcaccctt

SEQ ID NO: 5953023 - DNA, 22 bp, Homo sapiens
tgcgaggttgttttaaagtcag

SEQ ID NO: 5953024 - DNA, 20 bp, Homo sapiens
tgcgagtgctcatttcagga

SEQ ID NO: 5953025 - DNA, 13 bp, Homo sapiens
tgcgagtgtgtgc

SEQ ID NO: 5953026 - DNA, 17 bp, Homo sapiens
tgcgagtgtgtgcatgt

SEQ ID NO: 5953027 - DNA, 19 bp, Homo sapiens
tgcgagtgtgtgcatgtgt

SEQ ID NO: 5953028 - DNA, 21 bp, Homo sapiens
tgcgagtgtgtgcatgtgtgt

SEQ ID NO: 5953029 - DNA, 21 bp, Homo sapiens
tgcgatcatggctcactgcag

SEQ ID NO: 5953030 - DNA, 16 bp, Homo sapiens
tgcgatcttcagagca

SEQ ID NO: 5953031 - DNA, 18 bp, Homo sapiens
tgcgatcttcagagcagg

SEQ ID NO: 5953032 - DNA, 22 bp, Homo sapiens
tgcgatggcgtgggctgcgtga

SEQ ID NO: 5953033 - DNA, 24 bp, Homo sapiens
tgcgatgtggacgtcacgctccct

SEQ ID NO: 5953034 - DNA, 11 bp, Homo sapiens
tgcgatgtgtt

SEQ ID NO: 5953035 - DNA, 12 bp, Homo sapiens
tgcgattctgga

SEQ ID NO: 5953036 - DNA, 15 bp, Homo sapiens
tgcgattctggataa

SEQ ID NO: 5953037 - DNA, 23 bp, Homo sapiens
tgcgattctggataaagccactg

SEQ ID NO: 5953038 - DNA, 16 bp, Homo sapiens
tgcgattttatctgtt

SEQ ID NO: 5953039 - DNA, 21 bp, Homo sapiens
tgcgcaaactttaacaggttt

SEQ ID NO: 5953040 - DNA, 23 bp, Homo sapiens
tgcgcaaagggcgggcctgtttg

SEQ ID NO: 5953041 - DNA, 17 bp, Homo sapiens
tgcgcaacaacaaggac

SEQ ID NO: 5953042 - DNA, 17 bp, Homo sapiens
tgcgcaagtgcctggga

SEQ ID NO: 5953043 - DNA, 22 bp, Homo sapiens
tgcgcacaaggctgaccaagag

SEQ ID NO: 5953044 - DNA, 19 bp, Homo sapiens
tgcgcacagagggaagcca

SEQ ID NO: 5953045 - DNA, 20 bp, Homo sapiens
tgcgcaccaatgcccagcag

SEQ ID NO: 5953046 - DNA, 21 bp, Homo sapiens
tgcgcaccaatgcccagcagg

SEQ ID NO: 5953047 - DNA, 18 bp, Homo sapiens
tgcgcacttaccgccctg

SEQ ID NO: 5953048 - DNA, 16 bp, Homo sapiens
tgcgcacttacctgct

SEQ ID NO: 5953049 - DNA, 16 bp, Homo sapiens
tgcgcagaaaacaaga

SEQ ID NO: 5953050 - DNA, 20 bp, Homo sapiens
tgcgcagatctgtgcctggg

SEQ ID NO: 5953051 - DNA, 15 bp, Homo sapiens
tgcgcagccccatct

SEQ ID NO: 5953052 - DNA, 21 bp, Homo sapiens
tgcgcagccgcgctctgcccc

SEQ ID NO: 5953053 - DNA, 17 bp, Homo sapiens
tgcgcaggctggccctg

SEQ ID NO: 5953054 - DNA, 23 bp, Homo sapiens
tgcgcagggtggtggtattctgt

SEQ ID NO: 5953055 - DNA, 22 bp, Homo sapiens
tgcgcaggtctcttctgggcgt

SEQ ID NO: 5953056 - DNA, 20 bp, Homo sapiens
tgcgcatcttgcctccaggt

SEQ ID NO: 5953057 - DNA, 22 bp, Homo sapiens
tgcgcatcttgcctccaggtgc

SEQ ID NO: 5953058 - DNA, 17 bp, Homo sapiens
tgcgcattctcatggag

SEQ ID NO: 5953059 - DNA, 16 bp, Homo sapiens
tgcgccaccatgccct

SEQ ID NO: 5953060 - DNA, 13 bp, Homo sapiens
tgcgccacctgct

SEQ ID NO: 5953061 - DNA, 23 bp, Homo sapiens
tgcgccactgccatcggacagga

SEQ ID NO: 5953062 - DNA, 21 bp, Homo sapiens
tgcgccacttcctttgtgttt

SEQ ID NO: 5953063 - DNA, 22 bp, Homo sapiens
tgcgccacttcctttgtgttta

SEQ ID NO: 5953064 - DNA, 12 bp, Homo sapiens
tgcgccaggcag

SEQ ID NO: 5953065 - DNA, 22 bp, Homo sapiens
tgcgccaggcagagctgagggc

SEQ ID NO: 5953066 - DNA, 16 bp, Homo sapiens
tgcgccagtcctgcta

SEQ ID NO: 5953067 - DNA, 21 bp, Homo sapiens
tgcgccattgcactccagcct

SEQ ID NO: 5953068 - DNA, 20 bp, Homo sapiens
tgcgcccaccccgctctgca

SEQ ID NO: 5953069 - DNA, 19 bp, Homo sapiens
tgcgcccagggctgggagg

SEQ ID NO: 5953070 - DNA, 23 bp, Homo sapiens
tgcgcccagggctgggaggaagg

SEQ ID NO: 5953071 - DNA, 14 bp, Homo sapiens
tgcgccccaggccc

SEQ ID NO: 5953072 - DNA, 13 bp, Homo sapiens
tgcgcccccagct

SEQ ID NO: 5953073 - DNA, 15 bp, Homo sapiens
tgcgcccccagcttc

SEQ ID NO: 5953074 - DNA, 16 bp, Homo sapiens
tgcgccccgcccacac

SEQ ID NO: 5953075 - DNA, 13 bp, Homo sapiens
tgcgcccctgccc

SEQ ID NO: 5953076 - DNA, 11 bp, Homo sapiens
tgcgccctccc

SEQ ID NO: 5953077 - DNA, 15 bp, Homo sapiens
tgcgccctccctccc

SEQ ID NO: 5953078 - DNA, 19 bp, Homo sapiens
tgcgccctgacatgctaac

SEQ ID NO: 5953079 - DNA, 15 bp, Homo sapiens
tgcgccctgcactcc

SEQ ID NO: 5953080 - DNA, 17 bp, Homo sapiens
tgcgcccttgtgccctg

SEQ ID NO: 5953081 - DNA, 15 bp, Homo sapiens
tgcgcctaatgtgtt

SEQ ID NO: 5953082 - DNA, 13 bp, Homo sapiens
tgcgcctacagga

SEQ ID NO: 5953083 - DNA, 12 bp, Homo sapiens
tgcgcctcagcc

SEQ ID NO: 5953084 - DNA, 18 bp, Homo sapiens
tgcgcctcagccctcagt

SEQ ID NO: 5953085 - DNA, 17 bp, Homo sapiens
tgcgcctcaggctgctg

SEQ ID NO: 5953086 - DNA, 19 bp, Homo sapiens
tgcgcctccatccatctgt

SEQ ID NO: 5953087 - DNA, 22 bp, Homo sapiens
tgcgcctccatccatctgtccg

SEQ ID NO: 5953088 - DNA, 12 bp, Homo sapiens
tgcgcctcctcc

SEQ ID NO: 5953089 - DNA, 14 bp, Homo sapiens
tgcgcctcctcctg

SEQ ID NO: 5953090 - DNA, 18 bp, Homo sapiens
tgcgcctcggtatctggc

SEQ ID NO: 5953091 - DNA, 20 bp, Homo sapiens
tgcgcctcggtatctggctt

SEQ ID NO: 5953092 - DNA, 22 bp, Homo sapiens
tgcgcctcggtatctggcttcc

SEQ ID NO: 5953093 - DNA, 14 bp, Homo sapiens
tgcgcctgaaaagg

SEQ ID NO: 5953094 - DNA, 16 bp, Homo sapiens
tgcgcctgcaggcaga

SEQ ID NO: 5953095 - DNA, 14 bp, Homo sapiens
tgcgcctgtgacca

SEQ ID NO: 5953096 - DNA, 18 bp, Homo sapiens
tgcgcctgtgatgctggg

SEQ ID NO: 5953097 - DNA, 17 bp, Homo sapiens
tgcgcgcacaatagtaa

SEQ ID NO: 5953098 - DNA, 21 bp, Homo sapiens
tgcgcgcatgtaatcccagct

SEQ ID NO: 5953099 - DNA, 13 bp, Homo sapiens
tgcgcgcccaggc

SEQ ID NO: 5953100 - DNA, 16 bp, Homo sapiens
tgcgcgcgctctctct

SEQ ID NO: 5953101 - DNA, 17 bp, Homo sapiens
tgcgcgcgctctctctc

SEQ ID NO: 5953102 - DNA, 23 bp, Homo sapiens
tgcgcgcgctctctctctttctc

SEQ ID NO: 5953103 - DNA, 20 bp, Homo sapiens
tgcgcggaggagctagcctg

SEQ ID NO: 5953104 - DNA, 23 bp, Homo sapiens
tgcgcgtgcacgtggagagctgg

SEQ ID NO: 5953105 - DNA, 20 bp, Homo sapiens
tgcgcgtgtgggtctctggg

SEQ ID NO: 5953106 - DNA, 19 bp, Homo sapiens
tgcgctaaacttttctgat

SEQ ID NO: 5953107 - DNA, 20 bp, Homo sapiens
tgcgctaaacttttctgata

SEQ ID NO: 5953108 - DNA, 21 bp, Homo sapiens
tgcgctaaacttttctgatag

SEQ ID NO: 5953109 - DNA, 20 bp, Homo sapiens
tgcgctaacactgtcctgtc

SEQ ID NO: 5953110 - DNA, 22 bp, Homo sapiens
tgcgctaacccccagcccacag

SEQ ID NO: 5953111 - DNA, 22 bp, Homo sapiens
tgcgctagagcattctggggtg

SEQ ID NO: 5953112 - DNA, 18 bp, Homo sapiens
tgcgctcacctcagagca

SEQ ID NO: 5953113 - DNA, 20 bp, Homo sapiens
tgcgctcacctgcagcccct

SEQ ID NO: 5953114 - DNA, 11 bp, Homo sapiens
tgcgctcaggg

SEQ ID NO: 5953115 - DNA, 22 bp, Homo sapiens
tgcgctcagggccatgctgagg

SEQ ID NO: 5953116 - DNA, 23 bp, Homo sapiens
tgcgctcagggccatgctgaggc

SEQ ID NO: 5953117 - DNA, 13 bp, Homo sapiens
tgcgctcctctgc

SEQ ID NO: 5953118 - DNA, 15 bp, Homo sapiens
tgcgctcctctgcag

SEQ ID NO: 5953119 - DNA, 20 bp, Homo sapiens
tgcgctcctggcccagcctt

SEQ ID NO: 5953120 - DNA, 14 bp, Homo sapiens
tgcgctcctggctt

SEQ ID NO: 5953121 - DNA, 18 bp, Homo sapiens
tgcgctcggcaggaagga

SEQ ID NO: 5953122 - DNA, 20 bp, Homo sapiens
tgcgctctagcctgggcaac

SEQ ID NO: 5953123 - DNA, 17 bp, Homo sapiens
tgcgctctctttgcaac

SEQ ID NO: 5953124 - DNA, 22 bp, Homo sapiens
tgcgctcttgggaccccagaga

SEQ ID NO: 5953125 - DNA, 12 bp, Homo sapiens
tgcgctcttggt

SEQ ID NO: 5953126 - DNA, 23 bp, Homo sapiens
tgcgctgacaaccaccgctcccc

SEQ ID NO: 5953127 - DNA, 12 bp, Homo sapiens
tgcgctgccctg

SEQ ID NO: 5953128 - DNA, 13 bp, Homo sapiens
tgcgctgccctgc

SEQ ID NO: 5953129 - DNA, 17 bp, Homo sapiens
tgcgctgccctgcaaac

SEQ ID NO: 5953130 - DNA, 21 bp, Homo sapiens
tgcgctgctctgcaggctggg

SEQ ID NO: 5953131 - DNA, 15 bp, Homo sapiens
tgcgtggtatacatg

SEQ ID NO: 5953132 - DNA, 20 bp, Homo sapiens
tgcgtggtatacatgtgtac

SEQ ID NO: 5953133 - DNA, 18 bp, Homo sapiens
tgcgtggtggtccctggg

SEQ ID NO: 5953134 - DNA, 23 bp, Homo sapiens
tgcgtggtgtggagtgtgtgtct

SEQ ID NO: 5953135 - DNA, 14 bp, Homo sapiens
tgcgtgtatatgtg

SEQ ID NO: 5953136 - DNA, 18 bp, Homo sapiens
tgcgtgtatatgtgcttg

SEQ ID NO: 5953137 - DNA, 23 bp, Homo sapiens
tgcgtgtatatgtgcttgtgctc

SEQ ID NO: 5953138 - DNA, 19 bp, Homo sapiens
tgcgtgtcaatttccctca

SEQ ID NO: 5953139 - DNA, 13 bp, Homo sapiens
tgcgtgtcgtggg

SEQ ID NO: 5953140 - DNA, 16 bp, Homo sapiens
tgcgtgtgcccactga

SEQ ID NO: 5953141 - DNA, 21 bp, Homo sapiens
tgcgtgtggccctgtgggagt

SEQ ID NO: 5953142 - DNA, 21 bp, Homo sapiens
tgcgtgtgtctctgtctctcc

SEQ ID NO: 5953143 - DNA, 20 bp, Homo sapiens
tgcgtgtgtgcatgtatgtg

SEQ ID NO: 5953144 - DNA, 14 bp, Homo sapiens
tgcgtgtgtgtatg

SEQ ID NO: 5953145 - DNA, 19 bp, Homo sapiens
tgcgtgtgtgtatgtgtga

SEQ ID NO: 5953146 - DNA, 22 bp, Homo sapiens
tgcgtgttagtgtgtgtgcatg

SEQ ID NO: 5953147 - DNA, 20 bp, Homo sapiens
tgcgtgttcagcagaacctg

SEQ ID NO: 5953148 - DNA, 23 bp, Homo sapiens
tgcgtgttccagccaaagcatgc

SEQ ID NO: 5953149 - DNA, 14 bp, Homo sapiens
tgcgtgttcctttg

SEQ ID NO: 5953150 - DNA, 14 bp, Homo sapiens
tgcgtgtttgcacg

SEQ ID NO: 5953151 - DNA, 16 bp, Homo sapiens
tgcgtgtttgcacgtt

SEQ ID NO: 5953152 - DNA, 22 bp, Homo sapiens
tgcgtgtttgggtttttttcct

SEQ ID NO: 5953153 - DNA, 20 bp, Homo sapiens
tgcgttattttctttttcct

SEQ ID NO: 5953154 - DNA, 14 bp, Homo sapiens
tgcgttcagcccct

SEQ ID NO: 5953155 - DNA, 17 bp, Homo sapiens
tgcgttccatgatgctg

SEQ ID NO: 5953156 - DNA, 13 bp, Homo sapiens
tgcgttcccttca

SEQ ID NO: 5953157 - DNA, 15 bp, Homo sapiens
tgcgttcgcctctgg

SEQ ID NO: 5953158 - DNA, 12 bp, Homo sapiens
tgcgttctccca

SEQ ID NO: 5953159 - DNA, 13 bp, Homo sapiens
tgcgttctcccag

SEQ ID NO: 5953160 - DNA, 16 bp, Homo sapiens
tgcgttctcccagcac

SEQ ID NO: 5953161 - DNA, 16 bp, Homo sapiens
tgcgttctgcaagcat

SEQ ID NO: 5953162 - DNA, 19 bp, Homo sapiens
tgcgttgggttttcccttg

SEQ ID NO: 5953163 - DNA, 18 bp, Homo sapiens
tgcgtttggaggcccctg

SEQ ID NO: 5953164 - DNA, 17 bp, Homo sapiens
tgcgtttggtttacttg

SEQ ID NO: 5953165 - DNA, 20 bp, Homo sapiens
tgcgttttagagtatgcaag

SEQ ID NO: 5953166 - DNA, 12 bp, Homo sapiens
tgcgtttttcct

SEQ ID NO: 5953167 - DNA, 14 bp, Homo sapiens
tgcgtttttccttg

SEQ ID NO: 5953168 - DNA, 18 bp, Homo sapiens
tgctaaaaaaagtgcatg

SEQ ID NO: 5953169 - DNA, 19 bp, Homo sapiens
tgctaaaaaaagtgcatga

SEQ ID NO: 5953170 - DNA, 12 bp, Homo sapiens
tgctaaaaatgg

SEQ ID NO: 5953171 - DNA, 12 bp, Homo sapiens
tgctaaaaggaa

SEQ ID NO: 5953172 - DNA, 13 bp, Homo sapiens
tgctaaaaggaat

SEQ ID NO: 5953173 - DNA, 15 bp, Homo sapiens
tgctaaaaggaatag

SEQ ID NO: 5953174 - DNA, 13 bp, Homo sapiens
tgctaaaatagaa

SEQ ID NO: 5953175 - DNA, 17 bp, Homo sapiens
tgctaaaatagaatata

SEQ ID NO: 5953176 - DNA, 21 bp, Homo sapiens
tgctaaaatattttagatgtt

SEQ ID NO: 5953177 - DNA, 11 bp, Homo sapiens
tgctaaaattc

SEQ ID NO: 5953178 - DNA, 17 bp, Homo sapiens
tgctaaaattctataga

SEQ ID NO: 5953179 - DNA, 14 bp, Homo sapiens
tgctaaaattcttc

SEQ ID NO: 5953180 - DNA, 18 bp, Homo sapiens
tgctaaacaagtaagaaa

SEQ ID NO: 5953181 - DNA, 22 bp, Homo sapiens
tgctaaacactgcgctttattt

SEQ ID NO: 5953182 - DNA, 22 bp, Homo sapiens
tgctaaacatttgctggagaaa

SEQ ID NO: 5953183 - DNA, 23 bp, Homo sapiens
tgctaaaccaagttaagtcccat

SEQ ID NO: 5953184 - DNA, 17 bp, Homo sapiens
tgctaaacctatctgta

SEQ ID NO: 5953185 - DNA, 20 bp, Homo sapiens
tgctaaacctatctgtattg

SEQ ID NO: 5953186 - DNA, 19 bp, Homo sapiens
tgctaaaccttagtactga

SEQ ID NO: 5953187 - DNA, 17 bp, Homo sapiens
tgctaaacgtgtatgtt

SEQ ID NO: 5953188 - DNA, 21 bp, Homo sapiens
tgctaaactactgattacttg

SEQ ID NO: 5953189 - DNA, 21 bp, Homo sapiens
tgctaaagaaaaagtcatcca

SEQ ID NO: 5953190 - DNA, 12 bp, Homo sapiens
tgctaaagacat

SEQ ID NO: 5953191 - DNA, 19 bp, Homo sapiens
tgctaaagattgttaaatt

SEQ ID NO: 5953192 - DNA, 22 bp, Homo sapiens
tgctaaagattgttaaattcaa

SEQ ID NO: 5953193 - DNA, 19 bp, Homo sapiens
tgctaaagccaaccagcct

SEQ ID NO: 5953194 - DNA, 20 bp, Homo sapiens
tgctaaagccaaccagcctt

SEQ ID NO: 5953195 - DNA, 16 bp, Homo sapiens
tgctaaaggaggccat

SEQ ID NO: 5953196 - DNA, 21 bp, Homo sapiens
tgctaaagtcaggccattcag

SEQ ID NO: 5953197 - DNA, 22 bp, Homo sapiens
tgctaaagtcaggccattcagt

SEQ ID NO: 5953198 - DNA, 15 bp, Homo sapiens
tgctaaataactata

SEQ ID NO: 5953199 - DNA, 16 bp, Homo sapiens
tgctaaatacaacact

SEQ ID NO: 5953200 - DNA, 19 bp, Homo sapiens
tgctaaatactgtacatag

SEQ ID NO: 5953201 - DNA, 12 bp, Homo sapiens
tgctaaatctcc

SEQ ID NO: 5953202 - DNA, 16 bp, Homo sapiens
tgctaaatctcctatt

SEQ ID NO: 5953203 - DNA, 16 bp, Homo sapiens
tgctaaatgaagagac

SEQ ID NO: 5953204 - DNA, 19 bp, Homo sapiens
tgctaaatgacttattgat

SEQ ID NO: 5953205 - DNA, 19 bp, Homo sapiens
tgctaaatgccatgtttat

SEQ ID NO: 5953206 - DNA, 22 bp, Homo sapiens
tgctaaatggtcgcccaggaga

SEQ ID NO: 5953207 - DNA, 11 bp, Homo sapiens
tgctaaatgta

SEQ ID NO: 5953208 - DNA, 14 bp, Homo sapiens
tgctaaatgtaaca

SEQ ID NO: 5953209 - DNA, 20 bp, Homo sapiens
tgctaaatgtaacagtctga

SEQ ID NO: 5953210 - DNA, 24 bp, Homo sapiens
tgctaaatgtaagaatcattgtaa

SEQ ID NO: 5953211 - DNA, 21 bp, Homo sapiens
tgctaaatgtgagtatttctg

SEQ ID NO: 5953212 - DNA, 14 bp, Homo sapiens
tgctaaattataaa

SEQ ID NO: 5953213 - DNA, 16 bp, Homo sapiens
tgctaaattataaaat

SEQ ID NO: 5953214 - DNA, 23 bp, Homo sapiens
tgctaaattataaaattgaaaac

SEQ ID NO: 5953215 - DNA, 16 bp, Homo sapiens
tgctaaattctatgtt

SEQ ID NO: 5953216 - DNA, 18 bp, Homo sapiens
tgctaaattgatgttgat

SEQ ID NO: 5953217 - DNA, 19 bp, Homo sapiens
tgctaaattgattgaatta

SEQ ID NO: 5953218 - DNA, 19 bp, Homo sapiens
tgctaaatttacgtatatt

SEQ ID NO: 5953219 - DNA, 19 bp, Homo sapiens
tgctaaatttttaactgcc

SEQ ID NO: 5953220 - DNA, 19 bp, Homo sapiens
tgctaacaaactgaaaaat

SEQ ID NO: 5953221 - DNA, 13 bp, Homo sapiens
tgctaacaaagac

SEQ ID NO: 5953222 - DNA, 23 bp, Homo sapiens
tgctaacaaagacaaaagtctgt

SEQ ID NO: 5953223 - DNA, 15 bp, Homo sapiens
tgctaacccccaaat

SEQ ID NO: 5953224 - DNA, 15 bp, Homo sapiens
tgctaacctaaaaga

SEQ ID NO: 5953225 - DNA, 22 bp, Homo sapiens
tgctaacctagtttgttacttt

SEQ ID NO: 5953226 - DNA, 17 bp, Homo sapiens
tgctaacctcactgcct

SEQ ID NO: 5953227 - DNA, 18 bp, Homo sapiens
tgctaacctcactgcctc

SEQ ID NO: 5953228 - DNA, 19 bp, Homo sapiens
tgctaacctcactgcctca

SEQ ID NO: 5953229 - DNA, 16 bp, Homo sapiens
tgctaaccttgtagca

SEQ ID NO: 5953230 - DNA, 17 bp, Homo sapiens
tgctaaccttgtagcat

SEQ ID NO: 5953231 - DNA, 13 bp, Homo sapiens
tgctaaccttttc

SEQ ID NO: 5953232 - DNA, 22 bp, Homo sapiens
tgctaacggccgtctgctctca

SEQ ID NO: 5953233 - DNA, 18 bp, Homo sapiens
tgctaacggtgctcaggg

SEQ ID NO: 5953234 - DNA, 10 bp, Homo sapiens
tgctaactgg

SEQ ID NO: 5953235 - DNA, 17 bp, Homo sapiens
tgctaactgggaagaac

SEQ ID NO: 5953236 - DNA, 18 bp, Homo sapiens
tgctaactgggaagaaca

SEQ ID NO: 5953237 - DNA, 22 bp, Homo sapiens
tgctaactgggaagaacaaggc

SEQ ID NO: 5953238 - DNA, 14 bp, Homo sapiens
tgctaactgggtta

SEQ ID NO: 5953239 - DNA, 18 bp, Homo sapiens
tgctaactgggttaaata

SEQ ID NO: 5953240 - DNA, 20 bp, Homo sapiens
tgctaactgggttaaatatt

SEQ ID NO: 5953241 - DNA, 14 bp, Homo sapiens
tgctaactggttaa

SEQ ID NO: 5953242 - DNA, 17 bp, Homo sapiens
tgctaactggttaaaca

SEQ ID NO: 5953243 - DNA, 18 bp, Homo sapiens
tgctaactggttaaacat

SEQ ID NO: 5953244 - DNA, 19 bp, Homo sapiens
tgctaacttggagccccag

SEQ ID NO: 5953245 - DNA, 22 bp, Homo sapiens
tgctaagaaatgctgaaaatca

SEQ ID NO: 5953246 - DNA, 18 bp, Homo sapiens
tgctaagaagctaaagtc

SEQ ID NO: 5953247 - DNA, 17 bp, Homo sapiens
tgctaagaatatttgaa

SEQ ID NO: 5953248 - DNA, 21 bp, Homo sapiens
tgctaagaatatttgaatgta

SEQ ID NO: 5953249 - DNA, 22 bp, Homo sapiens
tgctaagaatatttgaatgtat

SEQ ID NO: 5953250 - DNA, 20 bp, Homo sapiens
tgctaagaattttttatttt

SEQ ID NO: 5953251 - DNA, 13 bp, Homo sapiens
tgctaagactaac

SEQ ID NO: 5953252 - DNA, 22 bp, Homo sapiens
tgctaagactcagtggggaggg

SEQ ID NO: 5953253 - DNA, 19 bp, Homo sapiens
tgctaagagaaaaaaaaga

SEQ ID NO: 5953254 - DNA, 22 bp, Homo sapiens
tgctaagagaagtagaaatcat

SEQ ID NO: 5953255 - DNA, 13 bp, Homo sapiens
tgctaagagcctc

SEQ ID NO: 5953256 - DNA, 17 bp, Homo sapiens
tgctaagagcctctgga

SEQ ID NO: 5953257 - DNA, 18 bp, Homo sapiens
tgctaagagcctctggaa

SEQ ID NO: 5953258 - DNA, 19 bp, Homo sapiens
tgctaagagggcccaaaga

SEQ ID NO: 5953259 - DNA, 13 bp, Homo sapiens
tgctaagatgctc

SEQ ID NO: 5953260 - DNA, 16 bp, Homo sapiens
tgctaagcattagctt

SEQ ID NO: 5953261 - DNA, 23 bp, Homo sapiens
tgctaagcgggcccgggtcccac

SEQ ID NO: 5953262 - DNA, 16 bp, Homo sapiens
tgctaagctaaagaaa

SEQ ID NO: 5953263 - DNA, 17 bp, Homo sapiens
tgctaaggagaagctaa

SEQ ID NO: 5953264 - DNA, 15 bp, Homo sapiens
tgctaaggcagctga

SEQ ID NO: 5953265 - DNA, 13 bp, Homo sapiens
tgctaaggctgct

SEQ ID NO: 5953266 - DNA, 16 bp, Homo sapiens
tgctaaggctgctggc

SEQ ID NO: 5953267 - DNA, 20 bp, Homo sapiens
tgctaaggctgctggcttca

SEQ ID NO: 5953268 - DNA, 12 bp, Homo sapiens
tgctaaggttct

SEQ ID NO: 5953269 - DNA, 18 bp, Homo sapiens
tgctaagtaaatctcttc

SEQ ID NO: 5953270 - DNA, 18 bp, Homo sapiens
tgctaagtaaattagtaa

SEQ ID NO: 5953271 - DNA, 16 bp, Homo sapiens
tgctaagtatttccca

SEQ ID NO: 5953272 - DNA, 18 bp, Homo sapiens
tgctaagtatttcccagc

SEQ ID NO: 5953273 - DNA, 16 bp, Homo sapiens
tgctaagtccatcacc

SEQ ID NO: 5953274 - DNA, 15 bp, Homo sapiens
tgctaagtctttccc

SEQ ID NO: 5953275 - DNA, 17 bp, Homo sapiens
tgctaagtggaagacag

SEQ ID NO: 5953276 - DNA, 13 bp, Homo sapiens
tgctaagtgtgaa

SEQ ID NO: 5953277 - DNA, 14 bp, Homo sapiens
tgctaagtgtgaac

SEQ ID NO: 5953278 - DNA, 19 bp, Homo sapiens
tgctaagtgtgcttagttt

SEQ ID NO: 5953279 - DNA, 13 bp, Homo sapiens
tgctaagttctcc

SEQ ID NO: 5953280 - DNA, 14 bp, Homo sapiens
tgctaagttctccc

SEQ ID NO: 5953281 - DNA, 15 bp, Homo sapiens
tgctaagttctccca

SEQ ID NO: 5953282 - DNA, 15 bp, Homo sapiens
tgctaataaactgtt

SEQ ID NO: 5953283 - DNA, 22 bp, Homo sapiens
tgctaataaagttaaattgcac

SEQ ID NO: 5953284 - DNA, 13 bp, Homo sapiens
tgctaataaatga

SEQ ID NO: 5953285 - DNA, 20 bp, Homo sapiens
tgctaataaatgaccagttt

SEQ ID NO: 5953286 - DNA, 23 bp, Homo sapiens
tgctaatacctcttactttgctt

SEQ ID NO: 5953287 - DNA, 16 bp, Homo sapiens
tgctaatagaaaactg

SEQ ID NO: 5953288 - DNA, 15 bp, Homo sapiens
tgctaatattaaaag

SEQ ID NO: 5953289 - DNA, 16 bp, Homo sapiens
tgctaatattttattt

SEQ ID NO: 5953290 - DNA, 20 bp, Homo sapiens
tgctaatattttatttgaaa

SEQ ID NO: 5953291 - DNA, 16 bp, Homo sapiens
tgctaatcaaagccag

SEQ ID NO: 5953292 - DNA, 21 bp, Homo sapiens
tgctaatcaaagccagggtct

SEQ ID NO: 5953293 - DNA, 23 bp, Homo sapiens
tgctaatcagggaggtcattttg

SEQ ID NO: 5953294 - DNA, 22 bp, Homo sapiens
tgctaatcatgtgggtgagcca

SEQ ID NO: 5953295 - DNA, 23 bp, Homo sapiens
tgctaatgaattttaaaagcata

SEQ ID NO: 5953296 - DNA, 13 bp, Homo sapiens
tgctaatgcattt

SEQ ID NO: 5953297 - DNA, 17 bp, Homo sapiens
tgctaatgcattttgca

SEQ ID NO: 5953298 - DNA, 19 bp, Homo sapiens
tgctaatgcattttgcact

SEQ ID NO: 5953299 - DNA, 18 bp, Homo sapiens
tgctaatgcctttcatct

SEQ ID NO: 5953300 - DNA, 15 bp, Homo sapiens
tgctaatgctatgca

SEQ ID NO: 5953301 - DNA, 19 bp, Homo sapiens
tgctaatgggctgctgtca

SEQ ID NO: 5953302 - DNA, 22 bp, Homo sapiens
tgctaatgggctgctgtcattt

SEQ ID NO: 5953303 - DNA, 14 bp, Homo sapiens
tgctaatgtaaact

SEQ ID NO: 5953304 - DNA, 19 bp, Homo sapiens
tgctaatgttgatcagcaa

SEQ ID NO: 5953305 - DNA, 15 bp, Homo sapiens
tgctaattaaaaagt

SEQ ID NO: 5953306 - DNA, 16 bp, Homo sapiens
tgctaattaaataata

SEQ ID NO: 5953307 - DNA, 13 bp, Homo sapiens
tgctaattacaca

SEQ ID NO: 5953308 - DNA, 23 bp, Homo sapiens
tgctccacccttggcctgtctca

SEQ ID NO: 5953309 - DNA, 22 bp, Homo sapiens
tgctccacctttcagcccacgt

SEQ ID NO: 5953310 - DNA, 16 bp, Homo sapiens
tgctccacgaagcctt

SEQ ID NO: 5953311 - DNA, 18 bp, Homo sapiens
tgctccacgaagccttaa

SEQ ID NO: 5953312 - DNA, 18 bp, Homo sapiens
tgctccacgcgcttcgac

SEQ ID NO: 5953313 - DNA, 14 bp, Homo sapiens
tgctccagaatttg

SEQ ID NO: 5953314 - DNA, 19 bp, Homo sapiens
tgctccagaatttggaaat

SEQ ID NO: 5953315 - DNA, 22 bp, Homo sapiens
tgctccagaatttggaaatcct

SEQ ID NO: 5953316 - DNA, 13 bp, Homo sapiens
tgctccagacagg

SEQ ID NO: 5953317 - DNA, 17 bp, Homo sapiens
tgctccagacagggaat

SEQ ID NO: 5953318 - DNA, 10 bp, Homo sapiens
tgctccagag

SEQ ID NO: 5953319 - DNA, 23 bp, Homo sapiens
tgctccagagagaggatgcagag

SEQ ID NO: 5953320 - DNA, 22 bp, Homo sapiens
tgctccagataactctctttcc

SEQ ID NO: 5953321 - DNA, 13 bp, Homo sapiens
tgctccagatcct

SEQ ID NO: 5953322 - DNA, 16 bp, Homo sapiens
tgctccagattctgat

SEQ ID NO: 5953323 - DNA, 15 bp, Homo sapiens
tgctccagcaacaca

SEQ ID NO: 5953324 - DNA, 19 bp, Homo sapiens
tgctccagcaacacagcct

SEQ ID NO: 5953325 - DNA, 11 bp, Homo sapiens
tgctccagcac

SEQ ID NO: 5953326 - DNA, 16 bp, Homo sapiens
tgctccagcagtgctg

SEQ ID NO: 5953327 - DNA, 20 bp, Homo sapiens
tgctccagcagtgctgggcc

SEQ ID NO: 5953328 - DNA, 22 bp, Homo sapiens
tgctccagcagtgctgggccca

SEQ ID NO: 5953329 - DNA, 17 bp, Homo sapiens
tgctccagccaacccct

SEQ ID NO: 5953330 - DNA, 20 bp, Homo sapiens
tgctccagccaacccctgtg

SEQ ID NO: 5953331 - DNA, 23 bp, Homo sapiens
tgctccagccaacccctgtggag

SEQ ID NO: 5953332 - DNA, 15 bp, Homo sapiens
tgctccagccccttt

SEQ ID NO: 5953333 - DNA, 14 bp, Homo sapiens
tgctccagcctggc

SEQ ID NO: 5953334 - DNA, 15 bp, Homo sapiens
tgctccagcctggct

SEQ ID NO: 5953335 - DNA, 20 bp, Homo sapiens
tgctccagctgtcgtctgac

SEQ ID NO: 5953336 - DNA, 16 bp, Homo sapiens
tgctccagctgttcag

SEQ ID NO: 5953337 - DNA, 19 bp, Homo sapiens
tgctccagctgttcagctg

SEQ ID NO: 5953338 - DNA, 18 bp, Homo sapiens
tgctccaggcatcactga

SEQ ID NO: 5953339 - DNA, 14 bp, Homo sapiens
tgctccaggcttcc

SEQ ID NO: 5953340 - DNA, 19 bp, Homo sapiens
tgctccaggcttcctgccc

SEQ ID NO: 5953341 - DNA, 16 bp, Homo sapiens
tgctccagggagattt

SEQ ID NO: 5953342 - DNA, 19 bp, Homo sapiens
tgctccagggtcaggcgga

SEQ ID NO: 5953343 - DNA, 13 bp, Homo sapiens
tgctccagggtct

SEQ ID NO: 5953344 - DNA, 19 bp, Homo sapiens
tgctccagggtcttgggct

SEQ ID NO: 5953345 - DNA, 17 bp, Homo sapiens
tgctccagtataaatta

SEQ ID NO: 5953346 - DNA, 16 bp, Homo sapiens
tgctccagtgttttct

SEQ ID NO: 5953347 - DNA, 20 bp, Homo sapiens
tgctccagtgttttcttgtg

SEQ ID NO: 5953348 - DNA, 23 bp, Homo sapiens
tgctccatagagcagtgcacatc

SEQ ID NO: 5953349 - DNA, 18 bp, Homo sapiens
tgctccatagtttggcat

SEQ ID NO: 5953350 - DNA, 15 bp, Homo sapiens
tgctccatcctcctg

SEQ ID NO: 5953351 - DNA, 14 bp, Homo sapiens
tgctccatgcacag

SEQ ID NO: 5953352 - DNA, 21 bp, Homo sapiens
tgctccatgcagatctagcca

SEQ ID NO: 5953353 - DNA, 16 bp, Homo sapiens
tgctccatgggcacct

SEQ ID NO: 5953354 - DNA, 14 bp, Homo sapiens
tgctccattcactc

SEQ ID NO: 5953355 - DNA, 19 bp, Homo sapiens
tgctccattcatacacaac

SEQ ID NO: 5953356 - DNA, 22 bp, Homo sapiens
tgctccattcatacacaacgta

SEQ ID NO: 5953357 - DNA, 22 bp, Homo sapiens
tgctccatttataaccccagcc

SEQ ID NO: 5953358 - DNA, 22 bp, Homo sapiens
tgctccatttcaattgctttgt

SEQ ID NO: 5953359 - DNA, 20 bp, Homo sapiens
tgctccatttttaaccactt

SEQ ID NO: 5953360 - DNA, 19 bp, Homo sapiens
tgctccattttttcttccc

SEQ ID NO: 5953361 - DNA, 12 bp, Homo sapiens
tgctcccaactc

SEQ ID NO: 5953362 - DNA, 22 bp, Homo sapiens
tgctcccaactcccttctgctt

SEQ ID NO: 5953363 - DNA, 23 bp, Homo sapiens
tgctcccaactcccttctgcttg

SEQ ID NO: 5953364 - DNA, 20 bp, Homo sapiens
tgctcccaagcccctgaccc

SEQ ID NO: 5953365 - DNA, 22 bp, Homo sapiens
tgctcccacacttgtgccagcc

SEQ ID NO: 5953366 - DNA, 12 bp, Homo sapiens
tgctcccacccc

SEQ ID NO: 5953367 - DNA, 20 bp, Homo sapiens
tgctcccaccccagaaatca

SEQ ID NO: 5953368 - DNA, 12 bp, Homo sapiens
tgctcccacctc

SEQ ID NO: 5953369 - DNA, 16 bp, Homo sapiens
tgctcccacctggctc

SEQ ID NO: 5953370 - DNA, 14 bp, Homo sapiens
tgctcccacgcctg

SEQ ID NO: 5953371 - DNA, 17 bp, Homo sapiens
tgctcccagatgccttc

SEQ ID NO: 5953372 - DNA, 13 bp, Homo sapiens
tgctcccagcagc

SEQ ID NO: 5953373 - DNA, 14 bp, Homo sapiens
tgctcccagcagcc

SEQ ID NO: 5953374 - DNA, 16 bp, Homo sapiens
tgctcccagcatttgt

SEQ ID NO: 5953375 - DNA, 21 bp, Homo sapiens
tgctcccagcatttgtccacc

SEQ ID NO: 5953376 - DNA, 11 bp, Homo sapiens
tgctcccagcc

SEQ ID NO: 5953377 - DNA, 23 bp, Homo sapiens
tgctcccagcccctaccttgaga

SEQ ID NO: 5953378 - DNA, 15 bp, Homo sapiens
tgctcccagcctgct

SEQ ID NO: 5953379 - DNA, 16 bp, Homo sapiens
tgctcccagcctgctg

SEQ ID NO: 5953380 - DNA, 22 bp, Homo sapiens
tgctcccagcctgctgagagcc

SEQ ID NO: 5953381 - DNA, 22 bp, Homo sapiens
tgctcccagctctctctcctgg

SEQ ID NO: 5953382 - DNA, 16 bp, Homo sapiens
tgctcccagctgtgct

SEQ ID NO: 5953383 - DNA, 22 bp, Homo sapiens
tgctcccaggagggctttgtgt

SEQ ID NO: 5953384 - DNA, 20 bp, Homo sapiens
tgctcccaggccccaggcct

SEQ ID NO: 5953385 - DNA, 19 bp, Homo sapiens
tgctcccagggactgacac

SEQ ID NO: 5953386 - DNA, 21 bp, Homo sapiens
tgctcccagtgggagcttccc

SEQ ID NO: 5953387 - DNA, 21 bp, Homo sapiens
tgctcccatctcctgatttct

SEQ ID NO: 5953388 - DNA, 17 bp, Homo sapiens
tgctccccaacacctgc

SEQ ID NO: 5953389 - DNA, 13 bp, Homo sapiens
tgctccccacacg

SEQ ID NO: 5953390 - DNA, 21 bp, Homo sapiens
tgctccccacagcgtccctgg

SEQ ID NO: 5953391 - DNA, 23 bp, Homo sapiens
tgctccccacagcgtccctggcg

SEQ ID NO: 5953392 - DNA, 18 bp, Homo sapiens
tgctccccacccctaccg

SEQ ID NO: 5953393 - DNA, 13 bp, Homo sapiens
tgctccccacgtc

SEQ ID NO: 5953394 - DNA, 16 bp, Homo sapiens
tgctccccagccctgg

SEQ ID NO: 5953395 - DNA, 23 bp, Homo sapiens
tgctccccagccctggctctgca

SEQ ID NO: 5953396 - DNA, 14 bp, Homo sapiens
tgctccccaggcca

SEQ ID NO: 5953397 - DNA, 15 bp, Homo sapiens
tgctccccaggccac

SEQ ID NO: 5953398 - DNA, 18 bp, Homo sapiens
tgctccccaggccacccc

SEQ ID NO: 5953399 - DNA, 14 bp, Homo sapiens
tgctcccccacccc

SEQ ID NO: 5953400 - DNA, 13 bp, Homo sapiens
tgctcccccatcc

SEQ ID NO: 5953401 - DNA, 18 bp, Homo sapiens
tgctcccccatcctcccc

SEQ ID NO: 5953402 - DNA, 17 bp, Homo sapiens
tgctcccccgccctgcc

SEQ ID NO: 5953403 - DNA, 12 bp, Homo sapiens
tgctcccctaaa

SEQ ID NO: 5953404 - DNA, 16 bp, Homo sapiens
tgctcccctaaagcca

SEQ ID NO: 5953405 - DNA, 20 bp, Homo sapiens
tgctcccctaaagccaggct

SEQ ID NO: 5953406 - DNA, 14 bp, Homo sapiens
tgctcccctccctc

SEQ ID NO: 5953407 - DNA, 17 bp, Homo sapiens
tgctcccgccccagggt

SEQ ID NO: 5953408 - DNA, 22 bp, Homo sapiens
tgctcccgccccagggtctgaa

SEQ ID NO: 5953409 - DNA, 23 bp, Homo sapiens
tgctcccggcaagcgcttctgct

SEQ ID NO: 5953410 - DNA, 16 bp, Homo sapiens
tgctcccggcccgcct

SEQ ID NO: 5953411 - DNA, 17 bp, Homo sapiens
tgctcccggcccgcctg

SEQ ID NO: 5953412 - DNA, 19 bp, Homo sapiens
tgctcccggctctgaggct

SEQ ID NO: 5953413 - DNA, 19 bp, Homo sapiens
tgctccctaagccagcctg

SEQ ID NO: 5953414 - DNA, 16 bp, Homo sapiens
tgctccctaccacctc

SEQ ID NO: 5953415 - DNA, 13 bp, Homo sapiens
tgctccctcagac

SEQ ID NO: 5953416 - DNA, 13 bp, Homo sapiens
tgctccctcagcc

SEQ ID NO: 5953417 - DNA, 16 bp, Homo sapiens
tgctccctcagcctca

SEQ ID NO: 5953418 - DNA, 13 bp, Homo sapiens
tgctccctcatgc

SEQ ID NO: 5953419 - DNA, 21 bp, Homo sapiens
tgctccctcccatcctccagc

SEQ ID NO: 5953420 - DNA, 13 bp, Homo sapiens
tgctccctcccct

SEQ ID NO: 5953421 - DNA, 15 bp, Homo sapiens
tgctccctcccctgc

SEQ ID NO: 5953422 - DNA, 21 bp, Homo sapiens
tgctccctcctctcctaccca

SEQ ID NO: 5953423 - DNA, 15 bp, Homo sapiens
tgctccctctccccc

SEQ ID NO: 5953424 - DNA, 11 bp, Homo sapiens
tgctccctctg

SEQ ID NO: 5953425 - DNA, 12 bp, Homo sapiens
tgctccctctgt

SEQ ID NO: 5953426 - DNA, 18 bp, Homo sapiens
tgctccctgaagccagcc

SEQ ID NO: 5953427 - DNA, 17 bp, Homo sapiens
tgctccctgagggcgga

SEQ ID NO: 5953428 - DNA, 18 bp, Homo sapiens
tgctccctgcaagctccg

SEQ ID NO: 5953429 - DNA, 14 bp, Homo sapiens
tgctccctgctccc

SEQ ID NO: 5953430 - DNA, 18 bp, Homo sapiens
tgctccctgctcccaggg

SEQ ID NO: 5953431 - DNA, 15 bp, Homo sapiens
tgctccctgctttgg

SEQ ID NO: 5953432 - DNA, 13 bp, Homo sapiens
tgctccctggagg

SEQ ID NO: 5953433 - DNA, 22 bp, Homo sapiens
tgctccctggggttctctacag

SEQ ID NO: 5953434 - DNA, 16 bp, Homo sapiens
tgctccctgtctgtgt

SEQ ID NO: 5953435 - DNA, 15 bp, Homo sapiens
tgctcccttcagccc

SEQ ID NO: 5953436 - DNA, 16 bp, Homo sapiens
tgctcccttcagcccc

SEQ ID NO: 5953437 - DNA, 22 bp, Homo sapiens
tgctcccttttacattctgtgt

SEQ ID NO: 5953438 - DNA, 20 bp, Homo sapiens
tgctccgaggactggactgt

SEQ ID NO: 5953439 - DNA, 22 bp, Homo sapiens
tgctccgcagggcgcccagcgc

SEQ ID NO: 5953440 - DNA, 15 bp, Homo sapiens
tgctccgccaggaaa

SEQ ID NO: 5953441 - DNA, 14 bp, Homo sapiens
tgctccgcctggcc

SEQ ID NO: 5953442 - DNA, 16 bp, Homo sapiens
tgctccgcctggcctg

SEQ ID NO: 5953443 - DNA, 14 bp, Homo sapiens
tgctccgctcccac

SEQ ID NO: 5953444 - DNA, 18 bp, Homo sapiens
tgctccgctcccaccgcc

SEQ ID NO: 5953445 - DNA, 15 bp, Homo sapiens
tgctccgctgcctgg

SEQ ID NO: 5953446 - DNA, 15 bp, Homo sapiens
tgctccgctgctcct

SEQ ID NO: 5953447 - DNA, 21 bp, Homo sapiens
tgctccgctgctccttggctt

SEQ ID NO: 5953448 - DNA, 23 bp, Homo sapiens
tgctccggagatgaatatgagct

SEQ ID NO: 5953449 - DNA, 17 bp, Homo sapiens
tgctccggcctgcgtct

SEQ ID NO: 5953450 - DNA, 17 bp, Homo sapiens
tgctccgtagctctgct

SEQ ID NO: 5953451 - DNA, 19 bp, Homo sapiens
tgctccgtagctctgctgc

SEQ ID NO: 5953452 - DNA, 21 bp, Homo sapiens
tgctccgtagctctgctgctg

SEQ ID NO: 5953453 - DNA, 15 bp, Homo sapiens
tgctccgtcatttga

SEQ ID NO: 5953454 - DNA, 15 bp, Homo sapiens
tgctccgtgcctcca

SEQ ID NO: 5953455 - DNA, 18 bp, Homo sapiens
tgctccgtgcctccacca

SEQ ID NO: 5953456 - DNA, 19 bp, Homo sapiens
tgctccgtgcctccaccac

SEQ ID NO: 5953457 - DNA, 20 bp, Homo sapiens
tgctccgtgcctccaccacc

SEQ ID NO: 5953458 - DNA, 19 bp, Homo sapiens
tgctccgtggactgcagtc

SEQ ID NO: 5953459 - DNA, 16 bp, Homo sapiens
tgctccgttggtcagc

SEQ ID NO: 5953460 - DNA, 14 bp, Homo sapiens
tgctcctagaggga

SEQ ID NO: 5953461 - DNA, 20 bp, Homo sapiens
tgctcctagagggaggggcc

SEQ ID NO: 5953462 - DNA, 16 bp, Homo sapiens
tgctcctagcaccctg

SEQ ID NO: 5953463 - DNA, 18 bp, Homo sapiens
tgctcctagcaccctgga

SEQ ID NO: 5953464 - DNA, 17 bp, Homo sapiens
tgctcctagcagacaga

SEQ ID NO: 5953465 - DNA, 16 bp, Homo sapiens
tgctcctagcccagca

SEQ ID NO: 5953466 - DNA, 17 bp, Homo sapiens
tgctcctagcccagcag

SEQ ID NO: 5953467 - DNA, 22 bp, Homo sapiens
tgctcctaggacccgtctccag

SEQ ID NO: 5953468 - DNA, 14 bp, Homo sapiens
tgctcctcacctgt

SEQ ID NO: 5953469 - DNA, 22 bp, Homo sapiens
tgctcctcactggaggagcagc

SEQ ID NO: 5953470 - DNA, 15 bp, Homo sapiens
tgctcctcatctgcc

SEQ ID NO: 5953471 - DNA, 20 bp, Homo sapiens
tgctcctcatctgcctggaa

SEQ ID NO: 5953472 - DNA, 14 bp, Homo sapiens
tgctcctccagccc

SEQ ID NO: 5953473 - DNA, 15 bp, Homo sapiens
tgctcctccagccct

SEQ ID NO: 5953474 - DNA, 16 bp, Homo sapiens
tgctcctccagggcca

SEQ ID NO: 5953475 - DNA, 19 bp, Homo sapiens
tgctcctcccacttctcaa

SEQ ID NO: 5953476 - DNA, 18 bp, Homo sapiens
tgctcctccctctgaccc

SEQ ID NO: 5953477 - DNA, 16 bp, Homo sapiens
tgctcctccctgcccc

SEQ ID NO: 5953478 - DNA, 17 bp, Homo sapiens
tgctcctccctgccccc

SEQ ID NO: 5953479 - DNA, 20 bp, Homo sapiens
tgctcctccctggctgccct

SEQ ID NO: 5953480 - DNA, 13 bp, Homo sapiens
tgctcctccgggt

SEQ ID NO: 5953481 - DNA, 15 bp, Homo sapiens
tgctcctcctgccct

SEQ ID NO: 5953482 - DNA, 19 bp, Homo sapiens
tgctcctcctgccctgtcc

SEQ ID NO: 5953483 - DNA, 13 bp, Homo sapiens
tgctcctcggcca

SEQ ID NO: 5953484 - DNA, 15 bp, Homo sapiens
tgctcctcggccaga

SEQ ID NO: 5953485 - DNA, 14 bp, Homo sapiens
tgctcctctccagg

SEQ ID NO: 5953486 - DNA, 16 bp, Homo sapiens
tgctgcaaggtggcct

SEQ ID NO: 5953487 - DNA, 18 bp, Homo sapiens
tgctgcaaggtggcctct

SEQ ID NO: 5953488 - DNA, 14 bp, Homo sapiens
tgctgcaatacatt

SEQ ID NO: 5953489 - DNA, 16 bp, Homo sapiens
tgctgcaatacattaa

SEQ ID NO: 5953490 - DNA, 19 bp, Homo sapiens
tgctgcaatacattaaaat

SEQ ID NO: 5953491 - DNA, 14 bp, Homo sapiens
tgctgcaatgggaa

SEQ ID NO: 5953492 - DNA, 18 bp, Homo sapiens
tgctgcacaaaagcagat

SEQ ID NO: 5953493 - DNA, 21 bp, Homo sapiens
tgctgcacacactcacctcta

SEQ ID NO: 5953494 - DNA, 21 bp, Homo sapiens
tgctgcacaccaaggccctgc

SEQ ID NO: 5953495 - DNA, 15 bp, Homo sapiens
tgctgcacagtagtg

SEQ ID NO: 5953496 - DNA, 17 bp, Homo sapiens
tgctgcaccaacccagc

SEQ ID NO: 5953497 - DNA, 20 bp, Homo sapiens
tgctgcaccaacccagccgc

SEQ ID NO: 5953498 - DNA, 14 bp, Homo sapiens
tgctgcaccagagt

SEQ ID NO: 5953499 - DNA, 16 bp, Homo sapiens
tgctgcaccagagtga

SEQ ID NO: 5953500 - DNA, 19 bp, Homo sapiens
tgctgcacccaactactga

SEQ ID NO: 5953501 - DNA, 24 bp, Homo sapiens
tgctgcacccaactactgagctga

SEQ ID NO: 5953502 - DNA, 18 bp, Homo sapiens
tgctgcacccctggtgtc

SEQ ID NO: 5953503 - DNA, 12 bp, Homo sapiens
tgctgcacctct

SEQ ID NO: 5953504 - DNA, 17 bp, Homo sapiens
tgctgcacctgaggccc

SEQ ID NO: 5953505 - DNA, 17 bp, Homo sapiens
tgctgcaccttgtaaat

SEQ ID NO: 5953506 - DNA, 22 bp, Homo sapiens
tgctgcaccttgtaaatgctct

SEQ ID NO: 5953507 - DNA, 14 bp, Homo sapiens
tgctgcactaattg

SEQ ID NO: 5953508 - DNA, 14 bp, Homo sapiens
tgctgcactctgta

SEQ ID NO: 5953509 - DNA, 21 bp, Homo sapiens
tgctgcactctgtagcaaatt

SEQ ID NO: 5953510 - DNA, 15 bp, Homo sapiens
tgctgcacttcctgt

SEQ ID NO: 5953511 - DNA, 18 bp, Homo sapiens
tgctgcagacaaaaagaa

SEQ ID NO: 5953512 - DNA, 12 bp, Homo sapiens
tgctgcagcaga

SEQ ID NO: 5953513 - DNA, 17 bp, Homo sapiens
tgctgcagccaaagaca

SEQ ID NO: 5953514 - DNA, 19 bp, Homo sapiens
tgctgcagcccctgggacc

SEQ ID NO: 5953515 - DNA, 20 bp, Homo sapiens
tgctgcagcctgcccctaga

SEQ ID NO: 5953516 - DNA, 19 bp, Homo sapiens
tgctgcagctccctggctt

SEQ ID NO: 5953517 - DNA, 12 bp, Homo sapiens
tgctgcagcttt

SEQ ID NO: 5953518 - DNA, 17 bp, Homo sapiens
tgctgcaggacattaat

SEQ ID NO: 5953519 - DNA, 12 bp, Homo sapiens
tgctgcaggccc

SEQ ID NO: 5953520 - DNA, 18 bp, Homo sapiens
tgctgcaggggctctgga

SEQ ID NO: 5953521 - DNA, 21 bp, Homo sapiens
tgctgcagtcacatcacaata

SEQ ID NO: 5953522 - DNA, 20 bp, Homo sapiens
tgctgcagtcagcacagaga

SEQ ID NO: 5953523 - DNA, 18 bp, Homo sapiens
tgctgcagttgccagtca

SEQ ID NO: 5953524 - DNA, 15 bp, Homo sapiens
tgctgcataaatttg

SEQ ID NO: 5953525 - DNA, 21 bp, Homo sapiens
tgctgcataaatttgtaatat

SEQ ID NO: 5953526 - DNA, 14 bp, Homo sapiens
tgctgcatacattc

SEQ ID NO: 5953527 - DNA, 15 bp, Homo sapiens
tgctgcatactttga

SEQ ID NO: 5953528 - DNA, 23 bp, Homo sapiens
tgctgcatactttgacaaggaaa

SEQ ID NO: 5953529 - DNA, 15 bp, Homo sapiens
tgctgcatagctcta

SEQ ID NO: 5953530 - DNA, 16 bp, Homo sapiens
tgctgcatcccaccag

SEQ ID NO: 5953531 - DNA, 18 bp, Homo sapiens
tgctgcatgccctctcag

SEQ ID NO: 5953532 - DNA, 20 bp, Homo sapiens
tgctgcatgcgacagcgtcc

SEQ ID NO: 5953533 - DNA, 16 bp, Homo sapiens
tgctgcatggcagggg

SEQ ID NO: 5953534 - DNA, 23 bp, Homo sapiens
tgctgcatggcagggggctgctg

SEQ ID NO: 5953535 - DNA, 13 bp, Homo sapiens
tgctgcattcctt

SEQ ID NO: 5953536 - DNA, 18 bp, Homo sapiens
tgctgcattgatccagga

SEQ ID NO: 5953537 - DNA, 18 bp, Homo sapiens
tgctgcatttaaaagata

SEQ ID NO: 5953538 - DNA, 19 bp, Homo sapiens
tgctgcatttgtgtcatct

SEQ ID NO: 5953539 - DNA, 17 bp, Homo sapiens
tgctgcattttaagcat

SEQ ID NO: 5953540 - DNA, 22 bp, Homo sapiens
tgctgcattttaagcataatta

SEQ ID NO: 5953541 - DNA, 16 bp, Homo sapiens
tgctgccaaaaccaca

SEQ ID NO: 5953542 - DNA, 19 bp, Homo sapiens
tgctgccaaaaccacatgg

SEQ ID NO: 5953543 - DNA, 17 bp, Homo sapiens
tgctgccaagtcctgcc

SEQ ID NO: 5953544 - DNA, 18 bp, Homo sapiens
tgctgccaatatcctaat

SEQ ID NO: 5953545 - DNA, 22 bp, Homo sapiens
tgctgccaatatcctaataaaa

SEQ ID NO: 5953546 - DNA, 23 bp, Homo sapiens
tgctgccaatatcctaataaaaa

SEQ ID NO: 5953547 - DNA, 20 bp, Homo sapiens
tgctgccacaaccagccagg

SEQ ID NO: 5953548 - DNA, 21 bp, Homo sapiens
tgctgccacactgtctcatct

SEQ ID NO: 5953549 - DNA, 21 bp, Homo sapiens
tgctgccaccaaatctgtcta

SEQ ID NO: 5953550 - DNA, 21 bp, Homo sapiens
tgctgccaccccttggcactg

SEQ ID NO: 5953551 - DNA, 15 bp, Homo sapiens
tgctgccactctgct

SEQ ID NO: 5953552 - DNA, 20 bp, Homo sapiens
tgctgccactctgctgcctg

SEQ ID NO: 5953553 - DNA, 23 bp, Homo sapiens
tgctgccagagaagtctggtcag

SEQ ID NO: 5953554 - DNA, 13 bp, Homo sapiens
tgctgccagctgc

SEQ ID NO: 5953555 - DNA, 15 bp, Homo sapiens
tgctgccagctgctc

SEQ ID NO: 5953556 - DNA, 13 bp, Homo sapiens
tgctgccaggcac

SEQ ID NO: 5953557 - DNA, 19 bp, Homo sapiens
tgctgccaggcactgttca

SEQ ID NO: 5953558 - DNA, 13 bp, Homo sapiens
tgctgccaggccc

SEQ ID NO: 5953559 - DNA, 14 bp, Homo sapiens
tgctgccaggcccg

SEQ ID NO: 5953560 - DNA, 24 bp, Homo sapiens
tgctgccaggcccggcatgaggcc

SEQ ID NO: 5953561 - DNA, 18 bp, Homo sapiens
tgctgccaggctcccact

SEQ ID NO: 5953562 - DNA, 15 bp, Homo sapiens
tgctgccatccaggt

SEQ ID NO: 5953563 - DNA, 18 bp, Homo sapiens
tgctgccatgccactgcc

SEQ ID NO: 5953564 - DNA, 21 bp, Homo sapiens
tgctgccatgccactgccagg

SEQ ID NO: 5953565 - DNA, 20 bp, Homo sapiens
tgctgccatttgatttttct

SEQ ID NO: 5953566 - DNA, 10 bp, Homo sapiens
tgctgcccac

SEQ ID NO: 5953567 - DNA, 11 bp, Homo sapiens
tgctgcccacg

SEQ ID NO: 5953568 - DNA, 14 bp, Homo sapiens
tgctgcccacggcc

SEQ ID NO: 5953569 - DNA, 18 bp, Homo sapiens
tgctgcccacggccaccc

SEQ ID NO: 5953570 - DNA, 21 bp, Homo sapiens
tgctgcccacggccacccacc

SEQ ID NO: 5953571 - DNA, 14 bp, Homo sapiens
tgctgcccagcctc

SEQ ID NO: 5953572 - DNA, 12 bp, Homo sapiens
tgctgcccaggc

SEQ ID NO: 5953573 - DNA, 14 bp, Homo sapiens
tgctgcccaggcca

SEQ ID NO: 5953574 - DNA, 17 bp, Homo sapiens
tgctgcccaggccacag

SEQ ID NO: 5953575 - DNA, 18 bp, Homo sapiens
tgctgcccaggccacagc

SEQ ID NO: 5953576 - DNA, 13 bp, Homo sapiens
tgctgcccatgag

SEQ ID NO: 5953577 - DNA, 14 bp, Homo sapiens
tgctgcccatgagc

SEQ ID NO: 5953578 - DNA, 21 bp, Homo sapiens
tgctgcccatgccaccgcttc

SEQ ID NO: 5953579 - DNA, 19 bp, Homo sapiens
tgctgccccactacaggcc

SEQ ID NO: 5953580 - DNA, 21 bp, Homo sapiens
tgctgccccatcagtgctccc

SEQ ID NO: 5953581 - DNA, 17 bp, Homo sapiens
tgctgccccatgaagcc

SEQ ID NO: 5953582 - DNA, 20 bp, Homo sapiens
tgctgccccatgaagccaca

SEQ ID NO: 5953583 - DNA, 10 bp, Homo sapiens
tgctgccccc

SEQ ID NO: 5953584 - DNA, 21 bp, Homo sapiens
tgctgcccccagaccccatcc

SEQ ID NO: 5953585 - DNA, 14 bp, Homo sapiens
tgctgccccctggc

SEQ ID NO: 5953586 - DNA, 22 bp, Homo sapiens
tgctgcccccttccccagccct

SEQ ID NO: 5953587 - DNA, 23 bp, Homo sapiens
tgctgccccgcttccccacagaa

SEQ ID NO: 5953588 - DNA, 22 bp, Homo sapiens
tgctgccccgttccctgtcaga

SEQ ID NO: 5953589 - DNA, 12 bp, Homo sapiens
tgctgcccctcc

SEQ ID NO: 5953590 - DNA, 22 bp, Homo sapiens
tgctgcccctgcacagcaggct

SEQ ID NO: 5953591 - DNA, 14 bp, Homo sapiens
tgctgcccctgcag

SEQ ID NO: 5953592 - DNA, 21 bp, Homo sapiens
tgctgcccctgcagttggcag

SEQ ID NO: 5953593 - DNA, 18 bp, Homo sapiens
tgctgcccctgtctggaa

SEQ ID NO: 5953594 - DNA, 20 bp, Homo sapiens
tgctgcccctgtctggaaga

SEQ ID NO: 5953595 - DNA, 20 bp, Homo sapiens
tgctgcccgcgggagacagc

SEQ ID NO: 5953596 - DNA, 23 bp, Homo sapiens
tgctgcccggttgccatggagat

SEQ ID NO: 5953597 - DNA, 17 bp, Homo sapiens
tgctgcccgtcttcagc

SEQ ID NO: 5953598 - DNA, 20 bp, Homo sapiens
tgctgcccgtcttcagccta

SEQ ID NO: 5953599 - DNA, 22 bp, Homo sapiens
tgctgcccgtcttcagcctagc

SEQ ID NO: 5953600 - DNA, 19 bp, Homo sapiens
tgctgcccgtgaggagggg

SEQ ID NO: 5953601 - DNA, 14 bp, Homo sapiens
tgctgccctaggct

SEQ ID NO: 5953602 - DNA, 14 bp, Homo sapiens
tgctgccctcttaa

SEQ ID NO: 5953603 - DNA, 16 bp, Homo sapiens
tgctgccctcttaaga

SEQ ID NO: 5953604 - DNA, 10 bp, Homo sapiens
tgctgccctg

SEQ ID NO: 5953605 - DNA, 15 bp, Homo sapiens
tgctgccctgaagaa

SEQ ID NO: 5953606 - DNA, 11 bp, Homo sapiens
tgctgccctgc

SEQ ID NO: 5953607 - DNA, 12 bp, Homo sapiens
tgctgccctgcc

SEQ ID NO: 5953608 - DNA, 16 bp, Homo sapiens
tgctgccctgcccacc

SEQ ID NO: 5953609 - DNA, 21 bp, Homo sapiens
tgctgccctgcccacctggcc

SEQ ID NO: 5953610 - DNA, 14 bp, Homo sapiens
tgctgccctgcccc

SEQ ID NO: 5953611 - DNA, 13 bp, Homo sapiens
tgctgccctgcgg

SEQ ID NO: 5953612 - DNA, 18 bp, Homo sapiens
tgctgccctgctctgggg

SEQ ID NO: 5953613 - DNA, 14 bp, Homo sapiens
tgctgccctgtgag

SEQ ID NO: 5953614 - DNA, 20 bp, Homo sapiens
tgctgcccttggtttctggg

SEQ ID NO: 5953615 - DNA, 23 bp, Homo sapiens
tgctgcccttggtttctgggggc

SEQ ID NO: 5953616 - DNA, 12 bp, Homo sapiens
tgctgccgccgc

SEQ ID NO: 5953617 - DNA, 17 bp, Homo sapiens
tgctgccgcctcccagc

SEQ ID NO: 5953618 - DNA, 20 bp, Homo sapiens
tgctgccgcctcccagcctg

SEQ ID NO: 5953619 - DNA, 16 bp, Homo sapiens
tgctgccggcacagct

SEQ ID NO: 5953620 - DNA, 18 bp, Homo sapiens
tgctgccggcacagctgg

SEQ ID NO: 5953621 - DNA, 13 bp, Homo sapiens
tgctgccggctct

SEQ ID NO: 5953622 - DNA, 20 bp, Homo sapiens
tgctgccggctctgggcctg

SEQ ID NO: 5953623 - DNA, 14 bp, Homo sapiens
tgctgcctagaaac

SEQ ID NO: 5953624 - DNA, 12 bp, Homo sapiens
tgctgcctcagc

SEQ ID NO: 5953625 - DNA, 15 bp, Homo sapiens
tgctgcctcagctca

SEQ ID NO: 5953626 - DNA, 20 bp, Homo sapiens
tgctgcctcagctcagcttc

SEQ ID NO: 5953627 - DNA, 22 bp, Homo sapiens
tgctgcctcaggacccatccct

SEQ ID NO: 5953628 - DNA, 23 bp, Homo sapiens
tgctgcctcaggacccatccctg

SEQ ID NO: 5953629 - DNA, 17 bp, Homo sapiens
tgctgcctccccaaccc

SEQ ID NO: 5953630 - DNA, 22 bp, Homo sapiens
tgctgcctccccaaccctgccc

SEQ ID NO: 5953631 - DNA, 16 bp, Homo sapiens
tgctgcctccctctgc

SEQ ID NO: 5953632 - DNA, 23 bp, Homo sapiens
tgctgcctctacacaggggccct

SEQ ID NO: 5953633 - DNA, 16 bp, Homo sapiens
tgctgcctctcacaca

SEQ ID NO: 5953634 - DNA, 16 bp, Homo sapiens
tgctgcctctctttca

SEQ ID NO: 5953635 - DNA, 15 bp, Homo sapiens
tgctgcctctgaaaa

SEQ ID NO: 5953636 - DNA, 17 bp, Homo sapiens
tgctgcctctgtggaag

SEQ ID NO: 5953637 - DNA, 11 bp, Homo sapiens
tgctgcctgcc

SEQ ID NO: 5953638 - DNA, 13 bp, Homo sapiens
tgctgcctgccat

SEQ ID NO: 5953639 - DNA, 23 bp, Homo sapiens
tgctgcctgcccgcacagcagcc

SEQ ID NO: 5953640 - DNA, 12 bp, Homo sapiens
tgctgcctgccg

SEQ ID NO: 5953641 - DNA, 14 bp, Homo sapiens
tgctgcctgcctcc

SEQ ID NO: 5953642 - DNA, 15 bp, Homo sapiens
tgctgcctgcttttt

SEQ ID NO: 5953643 - DNA, 17 bp, Homo sapiens
tgctgcctgctttttat

SEQ ID NO: 5953644 - DNA, 21 bp, Homo sapiens
tgctgcctggagtcagtagcc

SEQ ID NO: 5953645 - DNA, 13 bp, Homo sapiens
tgctgcctggcac

SEQ ID NO: 5953646 - DNA, 20 bp, Homo sapiens
tgctgcctggccctccccac

SEQ ID NO: 5953647 - DNA, 10 bp, Homo sapiens
tgctgcctgt

SEQ ID NO: 5953648 - DNA, 18 bp, Homo sapiens
tgctgccttattcaggga

SEQ ID NO: 5953649 - DNA, 20 bp, Homo sapiens
tgctgccttattcagggaag

SEQ ID NO: 5953650 - DNA, 13 bp, Homo sapiens
tgctgccttcaca

SEQ ID NO: 5953651 - DNA, 17 bp, Homo sapiens
tgctgccttcaccctga

SEQ ID NO: 5953652 - DNA, 12 bp, Homo sapiens
tgctgccttcag

SEQ ID NO: 5953653 - DNA, 12 bp, Homo sapiens
tgctgccttctg

SEQ ID NO: 5953654 - DNA, 15 bp, Homo sapiens
tgctgccttctgtct

SEQ ID NO: 5953655 - DNA, 16 bp, Homo sapiens
tgctgccttctgtctc

SEQ ID NO: 5953656 - DNA, 14 bp, Homo sapiens
tgctgccttgagac

SEQ ID NO: 5953657 - DNA, 15 bp, Homo sapiens
tgctgccttgcttct

SEQ ID NO: 5953658 - DNA, 17 bp, Homo sapiens
tgctgccttttctggag

SEQ ID NO: 5953659 - DNA, 22 bp, Homo sapiens
tgctgcgcaccaatgcccagca

SEQ ID NO: 5953660 - DNA, 20 bp, Homo sapiens
tgctgcgcatgttttcttca

SEQ ID NO: 5953661 - DNA, 17 bp, Homo sapiens
tgctgcgccccaggccc

SEQ ID NO: 5953662 - DNA, 17 bp, Homo sapiens
tgctgcgccctgggctc

SEQ ID NO: 5953663 - DNA, 15 bp, Homo sapiens
tgctgcgcccttccc

SEQ ID NO: 5953664 - DNA, 21 bp, Homo sapiens
tgctgcgcgtgtgggtctctg

SEQ ID NO: 5953665 - DNA, 15 bp, Homo sapiens
tgctgtgtgcttttt

SEQ ID NO: 5953666 - DNA, 21 bp, Homo sapiens
tgctgtgtgtcccaggcaggg

SEQ ID NO: 5953667 - DNA, 23 bp, Homo sapiens
tgctgtgtgtcccaggcagggag

SEQ ID NO: 5953668 - DNA, 14 bp, Homo sapiens
tgctgtgtgtgccc

SEQ ID NO: 5953669 - DNA, 21 bp, Homo sapiens
tgctgtgtgttgcctgggaca

SEQ ID NO: 5953670 - DNA, 15 bp, Homo sapiens
tgctgttaaagacat

SEQ ID NO: 5953671 - DNA, 22 bp, Homo sapiens
tgctgttaactgcaaccttgtt

SEQ ID NO: 5953672 - DNA, 20 bp, Homo sapiens
tgctgttaatatttctaaaa

SEQ ID NO: 5953673 - DNA, 23 bp, Homo sapiens
tgctgttaatctgatgtataatg

SEQ ID NO: 5953674 - DNA, 17 bp, Homo sapiens
tgctgttacgacaaaga

SEQ ID NO: 5953675 - DNA, 20 bp, Homo sapiens
tgctgttactgttaaccatt

SEQ ID NO: 5953676 - DNA, 14 bp, Homo sapiens
tgctgttagaatat

SEQ ID NO: 5953677 - DNA, 16 bp, Homo sapiens
tgctgttatccctgcc

SEQ ID NO: 5953678 - DNA, 17 bp, Homo sapiens
tgctgttatgtccagaa

SEQ ID NO: 5953679 - DNA, 19 bp, Homo sapiens
tgctgttatgtctgtttaa

SEQ ID NO: 5953680 - DNA, 15 bp, Homo sapiens
tgctgttcacagctt

SEQ ID NO: 5953681 - DNA, 21 bp, Homo sapiens
tgctgttcactggacacttca

SEQ ID NO: 5953682 - DNA, 18 bp, Homo sapiens
tgctgttcagtgcttttt

SEQ ID NO: 5953683 - DNA, 20 bp, Homo sapiens
tgctgttcatcttgtacaaa

SEQ ID NO: 5953684 - DNA, 14 bp, Homo sapiens
tgctgttccagtgg

SEQ ID NO: 5953685 - DNA, 15 bp, Homo sapiens
tgctgttccttactt

SEQ ID NO: 5953686 - DNA, 20 bp, Homo sapiens
tgctgttcgttcaaaagtgg

SEQ ID NO: 5953687 - DNA, 22 bp, Homo sapiens
tgctgttctagcacttcatctg

SEQ ID NO: 5953688 - DNA, 15 bp, Homo sapiens
tgctgttctcaatca

SEQ ID NO: 5953689 - DNA, 14 bp, Homo sapiens
tgctgttctcagga

SEQ ID NO: 5953690 - DNA, 17 bp, Homo sapiens
tgctgttctctttgctg

SEQ ID NO: 5953691 - DNA, 15 bp, Homo sapiens
tgctgttctggagct

SEQ ID NO: 5953692 - DNA, 21 bp, Homo sapiens
tgctgttcttcacttctggga

SEQ ID NO: 5953693 - DNA, 22 bp, Homo sapiens
tgctgttcttcacttctgggaa

SEQ ID NO: 5953694 - DNA, 14 bp, Homo sapiens
tgctgttgaaagca

SEQ ID NO: 5953695 - DNA, 21 bp, Homo sapiens
tgctgttgaaagcaaaaatgc

SEQ ID NO: 5953696 - DNA, 18 bp, Homo sapiens
tgctgttgaactttttaa

SEQ ID NO: 5953697 - DNA, 22 bp, Homo sapiens
tgctgttgaactttttaaagaa

SEQ ID NO: 5953698 - DNA, 15 bp, Homo sapiens
tgctgttgacatatt

SEQ ID NO: 5953699 - DNA, 18 bp, Homo sapiens
tgctgttgacatatttaa

SEQ ID NO: 5953700 - DNA, 16 bp, Homo sapiens
tgctgttgaggtggct

SEQ ID NO: 5953701 - DNA, 20 bp, Homo sapiens
tgctgttgattgctaaatgt

SEQ ID NO: 5953702 - DNA, 17 bp, Homo sapiens
tgctgttgccatagccc

SEQ ID NO: 5953703 - DNA, 14 bp, Homo sapiens
tgctgttgcctcat

SEQ ID NO: 5953704 - DNA, 17 bp, Homo sapiens
tgctgttgctgatttta

SEQ ID NO: 5953705 - DNA, 16 bp, Homo sapiens
tgctgttgctgttgct

SEQ ID NO: 5953706 - DNA, 12 bp, Homo sapiens
tgctgttgctta

SEQ ID NO: 5953707 - DNA, 18 bp, Homo sapiens
tgctgttgcttgaatagc

SEQ ID NO: 5953708 - DNA, 21 bp, Homo sapiens
tgctgttggcatcttgctgct

SEQ ID NO: 5953709 - DNA, 23 bp, Homo sapiens
tgctgttgtcattgctttactgg

SEQ ID NO: 5953710 - DNA, 23 bp, Homo sapiens
tgctgttgtccaactatttattg

SEQ ID NO: 5953711 - DNA, 16 bp, Homo sapiens
tgctgttgttatgatg

SEQ ID NO: 5953712 - DNA, 19 bp, Homo sapiens
tgctgttgttatgatgtgc

SEQ ID NO: 5953713 - DNA, 18 bp, Homo sapiens
tgctgttgttcagaagtt

SEQ ID NO: 5953714 - DNA, 18 bp, Homo sapiens
tgctgttgttccttcaca

SEQ ID NO: 5953715 - DNA, 22 bp, Homo sapiens
tgctgttgtttctataaatgac

SEQ ID NO: 5953716 - DNA, 21 bp, Homo sapiens
tgctgtttaccgcccacccag

SEQ ID NO: 5953717 - DNA, 11 bp, Homo sapiens
tgctgtttaga

SEQ ID NO: 5953718 - DNA, 23 bp, Homo sapiens
tgctgtttagagtaaataaactg

SEQ ID NO: 5953719 - DNA, 21 bp, Homo sapiens
tgctgtttagcttcctccaga

SEQ ID NO: 5953720 - DNA, 22 bp, Homo sapiens
tgctgtttagcttcctccagag

SEQ ID NO: 5953721 - DNA, 15 bp, Homo sapiens
tgctgtttatacttg

SEQ ID NO: 5953722 - DNA, 14 bp, Homo sapiens
tgctgtttattaat

SEQ ID NO: 5953723 - DNA, 15 bp, Homo sapiens
tgctgtttcccctgc

SEQ ID NO: 5953724 - DNA, 23 bp, Homo sapiens
tgctgtttcccggggaggaaaca

SEQ ID NO: 5953725 - DNA, 11 bp, Homo sapiens
tgctgtttcct

SEQ ID NO: 5953726 - DNA, 14 bp, Homo sapiens
tgctgtttcctttt

SEQ ID NO: 5953727 - DNA, 16 bp, Homo sapiens
tgctgtttctaagaaa

SEQ ID NO: 5953728 - DNA, 13 bp, Homo sapiens
tgctgtttgagat

SEQ ID NO: 5953729 - DNA, 14 bp, Homo sapiens
tgctgtttgggcag

SEQ ID NO: 5953730 - DNA, 17 bp, Homo sapiens
tgctgtttggtttggag

SEQ ID NO: 5953731 - DNA, 12 bp, Homo sapiens
tgctgtttgtac

SEQ ID NO: 5953732 - DNA, 17 bp, Homo sapiens
tgctgtttgtacaaact

SEQ ID NO: 5953733 - DNA, 19 bp, Homo sapiens
tgctgtttgtttgacaaag

SEQ ID NO: 5953734 - DNA, 22 bp, Homo sapiens
tgctgttttaaattgcatttct

SEQ ID NO: 5953735 - DNA, 21 bp, Homo sapiens
tgctgttttattactgtttct

SEQ ID NO: 5953736 - DNA, 15 bp, Homo sapiens
tgctgttttcctccc

SEQ ID NO: 5953737 - DNA, 21 bp, Homo sapiens
tgctgttttcctcccttctgc

SEQ ID NO: 5953738 - DNA, 13 bp, Homo sapiens
tgctgttttctag

SEQ ID NO: 5953739 - DNA, 13 bp, Homo sapiens
tgctgttttctgt

SEQ ID NO: 5953740 - DNA, 15 bp, Homo sapiens
tgctgttttctgtaa

SEQ ID NO: 5953741 - DNA, 16 bp, Homo sapiens
tgctgttttgccagcc

SEQ ID NO: 5953742 - DNA, 13 bp, Homo sapiens
tgctgttttgtta

SEQ ID NO: 5953743 - DNA, 16 bp, Homo sapiens
tgctgtttttcttgtc

SEQ ID NO: 5953744 - DNA, 15 bp, Homo sapiens
tgcttaaaaatactt

SEQ ID NO: 5953745 - DNA, 18 bp, Homo sapiens
tgcttaaaaatcattgat

SEQ ID NO: 5953746 - DNA, 18 bp, Homo sapiens
tgcttaaaaatgtagcag

SEQ ID NO: 5953747 - DNA, 12 bp, Homo sapiens
tgcttaaaacaa

SEQ ID NO: 5953748 - DNA, 12 bp, Homo sapiens
tgcttaaaagac

SEQ ID NO: 5953749 - DNA, 14 bp, Homo sapiens
tgcttaaaataagc

SEQ ID NO: 5953750 - DNA, 15 bp, Homo sapiens
tgcttaaaataagca

SEQ ID NO: 5953751 - DNA, 16 bp, Homo sapiens
tgcttaaaatatgtga

SEQ ID NO: 5953752 - DNA, 15 bp, Homo sapiens
tgcttaaaatgcaag

SEQ ID NO: 5953753 - DNA, 15 bp, Homo sapiens
tgcttaaaattttac

SEQ ID NO: 5953754 - DNA, 12 bp, Homo sapiens
tgcttaaacaaa

SEQ ID NO: 5953755 - DNA, 13 bp, Homo sapiens
tgcttaaacaaaa

SEQ ID NO: 5953756 - DNA, 15 bp, Homo sapiens
tgcttaaacaaagca

SEQ ID NO: 5953757 - DNA, 21 bp, Homo sapiens
tgcttaaaccacttaaacgaa

SEQ ID NO: 5953758 - DNA, 13 bp, Homo sapiens
tgcttaaactaaa

SEQ ID NO: 5953759 - DNA, 18 bp, Homo sapiens
tgcttaaactaaataatg

SEQ ID NO: 5953760 - DNA, 14 bp, Homo sapiens
tgcttaaactggaa

SEQ ID NO: 5953761 - DNA, 19 bp, Homo sapiens
tgcttaaagaattcaaatt

SEQ ID NO: 5953762 - DNA, 20 bp, Homo sapiens
tgcttaaagaattcaaattt

SEQ ID NO: 5953763 - DNA, 15 bp, Homo sapiens
tgcttaaagttgtaa

SEQ ID NO: 5953764 - DNA, 17 bp, Homo sapiens
tgcttaaagttgtaaca

SEQ ID NO: 5953765 - DNA, 12 bp, Homo sapiens
tgcttaaatatt

SEQ ID NO: 5953766 - DNA, 15 bp, Homo sapiens
tgcttaaatgtgaat

SEQ ID NO: 5953767 - DNA, 16 bp, Homo sapiens
tgcttaaatgtgaatt

SEQ ID NO: 5953768 - DNA, 17 bp, Homo sapiens
tgcttaaatgtgaatta

SEQ ID NO: 5953769 - DNA, 12 bp, Homo sapiens
tgcttaaattat

SEQ ID NO: 5953770 - DNA, 16 bp, Homo sapiens
tgcttaaattttaact

SEQ ID NO: 5953771 - DNA, 22 bp, Homo sapiens
tgcttaacagggaacgtgatta

SEQ ID NO: 5953772 - DNA, 14 bp, Homo sapiens
tgcttaacataccc

SEQ ID NO: 5953773 - DNA, 22 bp, Homo sapiens
tgcttaacattagatgtcatga

SEQ ID NO: 5953774 - DNA, 17 bp, Homo sapiens
tgcttaacatttgttga

SEQ ID NO: 5953775 - DNA, 13 bp, Homo sapiens
tgcttaactggct

SEQ ID NO: 5953776 - DNA, 14 bp, Homo sapiens
tgcttaactggctg

SEQ ID NO: 5953777 - DNA, 13 bp, Homo sapiens
tgcttaacttcac

SEQ ID NO: 5953778 - DNA, 13 bp, Homo sapiens
tgcttaaggaaaa

SEQ ID NO: 5953779 - DNA, 18 bp, Homo sapiens
tgcttaagggagtttaat

SEQ ID NO: 5953780 - DNA, 19 bp, Homo sapiens
tgcttaagggagtttaata

SEQ ID NO: 5953781 - DNA, 19 bp, Homo sapiens
tgcttaagggggtgtaatg

SEQ ID NO: 5953782 - DNA, 22 bp, Homo sapiens
tgcttaagggggtgtaatgaaa

SEQ ID NO: 5953783 - DNA, 22 bp, Homo sapiens
tgcttaaggtttgttttcatta

SEQ ID NO: 5953784 - DNA, 22 bp, Homo sapiens
tgcttaataataattgaagaat

SEQ ID NO: 5953785 - DNA, 20 bp, Homo sapiens
tgcttaatcttcaaagcctt

SEQ ID NO: 5953786 - DNA, 21 bp, Homo sapiens
tgcttaatgtcagtctacagg

SEQ ID NO: 5953787 - DNA, 20 bp, Homo sapiens
tgcttaattacaatatttct

SEQ ID NO: 5953788 - DNA, 17 bp, Homo sapiens
tgcttaattcaaataat

SEQ ID NO: 5953789 - DNA, 18 bp, Homo sapiens
tgcttaattcaaataata

SEQ ID NO: 5953790 - DNA, 15 bp, Homo sapiens
tgcttaatttctgcc

SEQ ID NO: 5953791 - DNA, 16 bp, Homo sapiens
tgcttaatttctgcct

SEQ ID NO: 5953792 - DNA, 23 bp, Homo sapiens
tgcttacaaagaaagcacttctt

SEQ ID NO: 5953793 - DNA, 13 bp, Homo sapiens
tgcttacaatttt

SEQ ID NO: 5953794 - DNA, 23 bp, Homo sapiens
tgcttacaatttttttaattttg

SEQ ID NO: 5953795 - DNA, 15 bp, Homo sapiens
tgcttacacatctca

SEQ ID NO: 5953796 - DNA, 16 bp, Homo sapiens
tgcttacacatctcag

SEQ ID NO: 5953797 - DNA, 20 bp, Homo sapiens
tgcttacacatctcagaccc

SEQ ID NO: 5953798 - DNA, 11 bp, Homo sapiens
tgcttacagta

SEQ ID NO: 5953799 - DNA, 14 bp, Homo sapiens
tgcttacagtgact

SEQ ID NO: 5953800 - DNA, 22 bp, Homo sapiens
tgcttacagtttattttctgtg

SEQ ID NO: 5953801 - DNA, 22 bp, Homo sapiens
tgcttacatctggaatctgagg

SEQ ID NO: 5953802 - DNA, 12 bp, Homo sapiens
tgcttacatttt

SEQ ID NO: 5953803 - DNA, 15 bp, Homo sapiens
tgcttaccaaaacat

SEQ ID NO: 5953804 - DNA, 16 bp, Homo sapiens
tgcttaccaaaacata

SEQ ID NO: 5953805 - DNA, 21 bp, Homo sapiens
tgcttaccaaaagctcagggc

SEQ ID NO: 5953806 - DNA, 23 bp, Homo sapiens
tgcttaccaaaagctcagggccc

SEQ ID NO: 5953807 - DNA, 17 bp, Homo sapiens
tgcttacccttcacctt

SEQ ID NO: 5953808 - DNA, 17 bp, Homo sapiens
tgcttacctactttctt

SEQ ID NO: 5953809 - DNA, 13 bp, Homo sapiens
tgcttacctgacg

SEQ ID NO: 5953810 - DNA, 15 bp, Homo sapiens
tgcttacctgtgaca

SEQ ID NO: 5953811 - DNA, 16 bp, Homo sapiens
tgcttaccttctgctg

SEQ ID NO: 5953812 - DNA, 16 bp, Homo sapiens
tgcttaccttgactgt

SEQ ID NO: 5953813 - DNA, 13 bp, Homo sapiens
tgcttaccttgtt

SEQ ID NO: 5953814 - DNA, 16 bp, Homo sapiens
tgcttaccttgttttg

SEQ ID NO: 5953815 - DNA, 21 bp, Homo sapiens
tgcttaccttgttttgccagt

SEQ ID NO: 5953816 - DNA, 14 bp, Homo sapiens
tgcttactacagaa

SEQ ID NO: 5953817 - DNA, 15 bp, Homo sapiens
tgcttactatgacct

SEQ ID NO: 5953818 - DNA, 14 bp, Homo sapiens
tgcttactgatata

SEQ ID NO: 5953819 - DNA, 15 bp, Homo sapiens
tgcttactgtgcacc

SEQ ID NO: 5953820 - DNA, 16 bp, Homo sapiens
tgcttagaaagttatt

SEQ ID NO: 5953821 - DNA, 18 bp, Homo sapiens
tgcttagaacccttctgc

SEQ ID NO: 5953822 - DNA, 23 bp, Homo sapiens
tgcttagaacccttctgctttct

SEQ ID NO: 5953823 - DNA, 16 bp, Homo sapiens
tgcttagatgttccaa

SEQ ID NO: 5953824 - DNA, 14 bp, Homo sapiens
tgcttagcctcctg

SEQ ID NO: 5953825 - DNA, 13 bp, Homo sapiens
tgcttagcctgtg

SEQ ID NO: 5953826 - DNA, 14 bp, Homo sapiens
tgcttagcctgtgc

SEQ ID NO: 5953827 - DNA, 16 bp, Homo sapiens
tgcttagctgccttga

SEQ ID NO: 5953828 - DNA, 14 bp, Homo sapiens
tgcttagcttatct

SEQ ID NO: 5953829 - DNA, 23 bp, Homo sapiens
tgcttagcttatctttctttcca

SEQ ID NO: 5953830 - DNA, 20 bp, Homo sapiens
tgcttaggaaacctcacgac

SEQ ID NO: 5953831 - DNA, 22 bp, Homo sapiens
tgcttaggagacagatcactcc

SEQ ID NO: 5953832 - DNA, 16 bp, Homo sapiens
tgcttaggatgtgtgc

SEQ ID NO: 5953833 - DNA, 21 bp, Homo sapiens
tgcttagtaagtatttccata

SEQ ID NO: 5953834 - DNA, 15 bp, Homo sapiens
tgcttagtaatgcta

SEQ ID NO: 5953835 - DNA, 18 bp, Homo sapiens
tgcttagtaatgctacgt

SEQ ID NO: 5953836 - DNA, 23 bp, Homo sapiens
tgcttagtatctaataatgaagt

SEQ ID NO: 5953837 - DNA, 21 bp, Homo sapiens
tgcttagtatctcatcaacaa

SEQ ID NO: 5953838 - DNA, 20 bp, Homo sapiens
tgcttagtatggttctcaga

SEQ ID NO: 5953839 - DNA, 21 bp, Homo sapiens
tgcttagtatggttctcagat

SEQ ID NO: 5953840 - DNA, 20 bp, Homo sapiens
tgcttagtccaattccttgc

SEQ ID NO: 5953841 - DNA, 13 bp, Homo sapiens
tgcttagtgaaaa

SEQ ID NO: 5953842 - DNA, 15 bp, Homo sapiens
tgcttagtgaaaata

SEQ ID NO: 5953843 - DNA, 16 bp, Homo sapiens
tgcttagtgaaaatac

SEQ ID NO: 5953844 - DNA, 13 bp, Homo sapiens
tgctttgcctcta

SEQ ID NO: 5953845 - DNA, 19 bp, Homo sapiens
tgctttgcggcatctccat

SEQ ID NO: 5953846 - DNA, 22 bp, Homo sapiens
tgctttgcgtgcccggggcagc

SEQ ID NO: 5953847 - DNA, 12 bp, Homo sapiens
tgctttgctgca

SEQ ID NO: 5953848 - DNA, 13 bp, Homo sapiens
tgctttgctgcac

SEQ ID NO: 5953849 - DNA, 12 bp, Homo sapiens
tgctttgctgct

SEQ ID NO: 5953850 - DNA, 12 bp, Homo sapiens
tgctttgctgtt

SEQ ID NO: 5953851 - DNA, 19 bp, Homo sapiens
tgctttgctttctgctcag

SEQ ID NO: 5953852 - DNA, 18 bp, Homo sapiens
tgctttgctttgtctgga

SEQ ID NO: 5953853 - DNA, 12 bp, Homo sapiens
tgctttggaaac

SEQ ID NO: 5953854 - DNA, 19 bp, Homo sapiens
tgctttggaacaatcacag

SEQ ID NO: 5953855 - DNA, 21 bp, Homo sapiens
tgctttggacctaaatggcct

SEQ ID NO: 5953856 - DNA, 23 bp, Homo sapiens
tgctttggatagtctcctacgca

SEQ ID NO: 5953857 - DNA, 15 bp, Homo sapiens
tgctttggctgactg

SEQ ID NO: 5953858 - DNA, 15 bp, Homo sapiens
tgctttgggaagccg

SEQ ID NO: 5953859 - DNA, 21 bp, Homo sapiens
tgctttgggctgccctggtgc

SEQ ID NO: 5953860 - DNA, 23 bp, Homo sapiens
tgctttgggctttgcaggctctg

SEQ ID NO: 5953861 - DNA, 19 bp, Homo sapiens
tgctttggggggtgtgctg

SEQ ID NO: 5953862 - DNA, 15 bp, Homo sapiens
tgctttgggtttgtg

SEQ ID NO: 5953863 - DNA, 22 bp, Homo sapiens
tgctttgtaaattgtgttgtct

SEQ ID NO: 5953864 - DNA, 23 bp, Homo sapiens
tgctttgtaagtgaaaaacatga

SEQ ID NO: 5953865 - DNA, 16 bp, Homo sapiens
tgctttgtagcttaaa

SEQ ID NO: 5953866 - DNA, 12 bp, Homo sapiens
tgctttgtattg

SEQ ID NO: 5953867 - DNA, 15 bp, Homo sapiens
tgctttgtcatccat

SEQ ID NO: 5953868 - DNA, 12 bp, Homo sapiens
tgctttgtctcc

SEQ ID NO: 5953869 - DNA, 20 bp, Homo sapiens
tgctttgtctggcctcacgt

SEQ ID NO: 5953870 - DNA, 16 bp, Homo sapiens
tgctttgtgacttctt

SEQ ID NO: 5953871 - DNA, 12 bp, Homo sapiens
tgctttgtgatt

SEQ ID NO: 5953872 - DNA, 22 bp, Homo sapiens
tgctttgtgatttttgtaattt

SEQ ID NO: 5953873 - DNA, 19 bp, Homo sapiens
tgctttgtgcatatgttaa

SEQ ID NO: 5953874 - DNA, 16 bp, Homo sapiens
tgctttgtgtgattga

SEQ ID NO: 5953875 - DNA, 21 bp, Homo sapiens
tgctttgtgttcagttttgtg

SEQ ID NO: 5953876 - DNA, 12 bp, Homo sapiens
tgctttgtttac

SEQ ID NO: 5953877 - DNA, 16 bp, Homo sapiens
tgctttgtttccttct

SEQ ID NO: 5953878 - DNA, 19 bp, Homo sapiens
tgctttgttttggctgctc

SEQ ID NO: 5953879 - DNA, 20 bp, Homo sapiens
tgctttgttttggctgctct

SEQ ID NO: 5953880 - DNA, 10 bp, Homo sapiens
tgcttttaaa

SEQ ID NO: 5953881 - DNA, 19 bp, Homo sapiens
tgcttttaaaaattttgtc

SEQ ID NO: 5953882 - DNA, 17 bp, Homo sapiens
tgcttttaaaactactt

SEQ ID NO: 5953883 - DNA, 13 bp, Homo sapiens
tgcttttaaaatt

SEQ ID NO: 5953884 - DNA, 17 bp, Homo sapiens
tgcttttaaaattttaa

SEQ ID NO: 5953885 - DNA, 16 bp, Homo sapiens
tgcttttaactctaga

SEQ ID NO: 5953886 - DNA, 12 bp, Homo sapiens
tgcttttaatta

SEQ ID NO: 5953887 - DNA, 13 bp, Homo sapiens
tgcttttaattaa

SEQ ID NO: 5953888 - DNA, 20 bp, Homo sapiens
tgcttttacggtgatattgt

SEQ ID NO: 5953889 - DNA, 20 bp, Homo sapiens
tgcttttatatctgtatgta

SEQ ID NO: 5953890 - DNA, 14 bp, Homo sapiens
tgcttttatattct

SEQ ID NO: 5953891 - DNA, 15 bp, Homo sapiens
tgcttttatattcta

SEQ ID NO: 5953892 - DNA, 15 bp, Homo sapiens
tgcttttatcagtgt

SEQ ID NO: 5953893 - DNA, 14 bp, Homo sapiens
tgcttttattttga

SEQ ID NO: 5953894 - DNA, 16 bp, Homo sapiens
tgcttttattttgaaa

SEQ ID NO: 5953895 - DNA, 15 bp, Homo sapiens
tgcttttcaaaccag

SEQ ID NO: 5953896 - DNA, 23 bp, Homo sapiens
tgcttttcaaatgtttgaaaaca

SEQ ID NO: 5953897 - DNA, 23 bp, Homo sapiens
tgcttttcaccaaaatttctaca

SEQ ID NO: 5953898 - DNA, 15 bp, Homo sapiens
tgcttttcactactt

SEQ ID NO: 5953899 - DNA, 16 bp, Homo sapiens
tgcttttcactgctgc

SEQ ID NO: 5953900 - DNA, 15 bp, Homo sapiens
tgcttttcactggca

SEQ ID NO: 5953901 - DNA, 17 bp, Homo sapiens
tgcttttcactggcata

SEQ ID NO: 5953902 - DNA, 14 bp, Homo sapiens
tgcttttcagctga

SEQ ID NO: 5953903 - DNA, 19 bp, Homo sapiens
tgcttttcatgtagaactc

SEQ ID NO: 5953904 - DNA, 18 bp, Homo sapiens
tgcttttcattagcagtt

SEQ ID NO: 5953905 - DNA, 12 bp, Homo sapiens
tgcttttccagg

SEQ ID NO: 5953906 - DNA, 21 bp, Homo sapiens
tgcttttccaggatcctgcag

SEQ ID NO: 5953907 - DNA, 23 bp, Homo sapiens
tgcttttccaggatcctgcagga

SEQ ID NO: 5953908 - DNA, 16 bp, Homo sapiens
tgcttttccattctgg

SEQ ID NO: 5953909 - DNA, 19 bp, Homo sapiens
tgcttttccctcttttctt

SEQ ID NO: 5953910 - DNA, 16 bp, Homo sapiens
tgcttttcctcaagca

SEQ ID NO: 5953911 - DNA, 18 bp, Homo sapiens
tgcttttctaagatacat

SEQ ID NO: 5953912 - DNA, 14 bp, Homo sapiens
tgcttttctaatta

SEQ ID NO: 5953913 - DNA, 14 bp, Homo sapiens
tgcttttctcatgg

SEQ ID NO: 5953914 - DNA, 18 bp, Homo sapiens
tgcttttctcccagaagg

SEQ ID NO: 5953915 - DNA, 11 bp, Homo sapiens
tgcttttctct

SEQ ID NO: 5953916 - DNA, 14 bp, Homo sapiens
tgcttttctgtcag

SEQ ID NO: 5953917 - DNA, 13 bp, Homo sapiens
tgcttttctgtct

SEQ ID NO: 5953918 - DNA, 21 bp, Homo sapiens
tgcttttgaaaagttgaaatg

SEQ ID NO: 5953919 - DNA, 15 bp, Homo sapiens
tgcttttgagcctca

SEQ ID NO: 5953920 - DNA, 16 bp, Homo sapiens
tgcttttgatggctat

SEQ ID NO: 5953921 - DNA, 19 bp, Homo sapiens
tgcttttgatggctatgtt

SEQ ID NO: 5953922 - DNA, 20 bp, Homo sapiens
tgcttttgatggctatgttt

SEQ ID NO: 5953923 - DNA, 12 bp, Homo sapiens
tgcttttgatgt

SEQ ID NO: 5953924 - DNA, 14 bp, Homo sapiens
tgcttttgatgtga

SEQ ID NO: 5953925 - DNA, 12 bp, Homo sapiens
tgcttttgcaaa

SEQ ID NO: 5953926 - DNA, 16 bp, Homo sapiens
tgcttttgcaaacaga

SEQ ID NO: 5953927 - DNA, 17 bp, Homo sapiens
tgcttttgcatttctct

SEQ ID NO: 5953928 - DNA, 14 bp, Homo sapiens
tgcttttgccactt

SEQ ID NO: 5953929 - DNA, 14 bp, Homo sapiens
tgcttttgcccatt

SEQ ID NO: 5953930 - DNA, 12 bp, Homo sapiens
tgcttttgctgc

SEQ ID NO: 5953931 - DNA, 17 bp, Homo sapiens
tgcttttgctgctgctt

SEQ ID NO: 5953932 - DNA, 13 bp, Homo sapiens
tgcttttggcctg

SEQ ID NO: 5953933 - DNA, 14 bp, Homo sapiens
tgcttttggtctgt

SEQ ID NO: 5953934 - DNA, 20 bp, Homo sapiens
tgcttttgtctatgggactc

SEQ ID NO: 5953935 - DNA, 14 bp, Homo sapiens
tgcttttgtgtccc

SEQ ID NO: 5953936 - DNA, 10 bp, Homo sapiens
tgcttttgtt

SEQ ID NO: 5953937 - DNA, 21 bp, Homo sapiens
tgcttttgttttcctgctggt

SEQ ID NO: 5953938 - DNA, 20 bp, Homo sapiens
tgcttttgtttttttcctca

SEQ ID NO: 5953939 - DNA, 23 bp, Homo sapiens
tgctttttaaagagattatttgt

SEQ ID NO: 5953940 - DNA, 12 bp, Homo sapiens
tgctttttagaa

SEQ ID NO: 5953941 - DNA, 15 bp, Homo sapiens
tgctttttataaaaa

SEQ ID NO: 5953942 - DNA, 16 bp, Homo sapiens
tgctttttatggcctg

SEQ ID NO: 5953943 - DNA, 18 bp, Homo sapiens
tgctttttatttctgcat

SEQ ID NO: 5953944 - DNA, 19 bp, Homo sapiens
tgctttttatttctgcata

SEQ ID NO: 5953945 - DNA, 14 bp, Homo sapiens
tgctttttcactgt

SEQ ID NO: 5953946 - DNA, 14 bp, Homo sapiens
tgctttttccagat

SEQ ID NO: 5953947 - DNA, 12 bp, Homo sapiens
tgctttttctga

SEQ ID NO: 5953948 - DNA, 13 bp, Homo sapiens
tgctttttctgta

SEQ ID NO: 5953949 - DNA, 13 bp, Homo sapiens
tgctttttgaaat

SEQ ID NO: 5953950 - DNA, 15 bp, Homo sapiens
tgctttttgaaatga

SEQ ID NO: 5953951 - DNA, 17 bp, Homo sapiens
tgctttttgaggtggca

SEQ ID NO: 5953952 - DNA, 21 bp, Homo sapiens
tgctttttgaggtggcacttt

SEQ ID NO: 5953953 - DNA, 14 bp, Homo sapiens
tgctttttggaaag

SEQ ID NO: 5953954 - DNA, 15 bp, Homo sapiens
tgctttttggcacag

SEQ ID NO: 5953955 - DNA, 13 bp, Homo sapiens
tgctttttggtga

SEQ ID NO: 5953956 - DNA, 13 bp, Homo sapiens
tgctttttgtcat

SEQ ID NO: 5953957 - DNA, 15 bp, Homo sapiens
tgctttttgtcatgt

SEQ ID NO: 5953958 - DNA, 16 bp, Homo sapiens
tgctttttgtgttttt

SEQ ID NO: 5953959 - DNA, 17 bp, Homo sapiens
tgcttttttaaatatta

SEQ ID NO: 5953960 - DNA, 23 bp, Homo sapiens
tgcttttttaaccaaggaggggc

SEQ ID NO: 5953961 - DNA, 19 bp, Homo sapiens
tgcttttttgattttgctg

SEQ ID NO: 5953962 - DNA, 17 bp, Homo sapiens
tgcttttttgcaataag

SEQ ID NO: 5953963 - DNA, 15 bp, Homo sapiens
tgctttttttgaaac

SEQ ID NO: 5953964 - DNA, 23 bp, Homo sapiens
tgctttttttgtgtgtatttgct

SEQ ID NO: 5953965 - DNA, 17 bp, Homo sapiens
tgcttttttttccttct

SEQ ID NO: 5953966 - DNA, 22 bp, Homo sapiens
tgcttttttttttccagcaagt

SEQ ID NO: 5953967 - DNA, 22 bp, Homo sapiens
tgcttttttttttttgctttgt

SEQ ID NO: 5953968 - DNA, 16 bp, Homo sapiens
tggaaaaaaaaaacaa

SEQ ID NO: 5953969 - DNA, 15 bp, Homo sapiens
tggaaaaaaaaatca

SEQ ID NO: 5953970 - DNA, 12 bp, Homo sapiens
tggaaaaaaaca

SEQ ID NO: 5953971 - DNA, 21 bp, Homo sapiens
tggaaaaaaacataaaaagca

SEQ ID NO: 5953972 - DNA, 20 bp, Homo sapiens
tggaaaaaaattacaaggca

SEQ ID NO: 5953973 - DNA, 14 bp, Homo sapiens
tggaaaaaacattt

SEQ ID NO: 5953974 - DNA, 22 bp, Homo sapiens
tggaaaaaactctgaaggagag

SEQ ID NO: 5953975 - DNA, 16 bp, Homo sapiens
tggaaaaaatatttta

SEQ ID NO: 5953976 - DNA, 16 bp, Homo sapiens
tggaaaaacagcatgt

SEQ ID NO: 5953977 - DNA, 23 bp, Homo sapiens
tggaaaaacatctgaaagccacg

SEQ ID NO: 5953978 - DNA, 13 bp, Homo sapiens
tggaaaaactgag

SEQ ID NO: 5953979 - DNA, 15 bp, Homo sapiens
tggaaaaagaaagaa

SEQ ID NO: 5953980 - DNA, 18 bp, Homo sapiens
tggaaaaagaaattctgt

SEQ ID NO: 5953981 - DNA, 20 bp, Homo sapiens
tggaaaaagaaattctgtta

SEQ ID NO: 5953982 - DNA, 13 bp, Homo sapiens
tggaaaaataaaa

SEQ ID NO: 5953983 - DNA, 17 bp, Homo sapiens
tggaaaaataaaactgt

SEQ ID NO: 5953984 - DNA, 18 bp, Homo sapiens
tggaaaaataaaggaaat

SEQ ID NO: 5953985 - DNA, 14 bp, Homo sapiens
tggaaaaatagctc

SEQ ID NO: 5953986 - DNA, 23 bp, Homo sapiens
tggaaaaatcacaatttttaatg

SEQ ID NO: 5953987 - DNA, 20 bp, Homo sapiens
tggaaaaatcagaagcacaa

SEQ ID NO: 5953988 - DNA, 15 bp, Homo sapiens
tggaaaaatccttga

SEQ ID NO: 5953989 - DNA, 15 bp, Homo sapiens
tggaaaaatgcccat

SEQ ID NO: 5953990 - DNA, 21 bp, Homo sapiens
tggaaaaatgggtcttttata

SEQ ID NO: 5953991 - DNA, 22 bp, Homo sapiens
tggaaaaatgggtcttttatag

SEQ ID NO: 5953992 - DNA, 19 bp, Homo sapiens
tggaaaaatggttgatgga

SEQ ID NO: 5953993 - DNA, 22 bp, Homo sapiens
tggaaaaatggttgatggaaaa

SEQ ID NO: 5953994 - DNA, 23 bp, Homo sapiens
tggaaaaatggttgatggaaaat

SEQ ID NO: 5953995 - DNA, 16 bp, Homo sapiens
tggaaaacagaacact

SEQ ID NO: 5953996 - DNA, 20 bp, Homo sapiens
tggaaaacagaacacttatg

SEQ ID NO: 5953997 - DNA, 13 bp, Homo sapiens
tggaaaaccagga

SEQ ID NO: 5953998 - DNA, 20 bp, Homo sapiens
tggaaaactattgagccttg

SEQ ID NO: 5953999 - DNA, 21 bp, Homo sapiens
tggaaaactattgagccttgc

SEQ ID NO: 5954000 - DNA, 22 bp, Homo sapiens
tggaaaactgccacaagcacaa

SEQ ID NO: 5954001 - DNA, 14 bp, Homo sapiens
tggaaaactgttaa

SEQ ID NO: 5954002 - DNA, 14 bp, Homo sapiens
tggaaaagaaatca

SEQ ID NO: 5954003 - DNA, 18 bp, Homo sapiens
tggaaaagaagaaacttt

SEQ ID NO: 5954004 - DNA, 16 bp, Homo sapiens
tggaaaagagctggga

SEQ ID NO: 5954005 - DNA, 16 bp, Homo sapiens
tggaaaagaggagttt

SEQ ID NO: 5954006 - DNA, 16 bp, Homo sapiens
tggaaaagccaagagg

SEQ ID NO: 5954007 - DNA, 14 bp, Homo sapiens
tggaaaagcccagt

SEQ ID NO: 5954008 - DNA, 15 bp, Homo sapiens
tggaaaagcccagtg

SEQ ID NO: 5954009 - DNA, 22 bp, Homo sapiens
tggaaaaggaaaaaaatccact

SEQ ID NO: 5954010 - DNA, 20 bp, Homo sapiens
tggaaaaggaacccaatttt

SEQ ID NO: 5954011 - DNA, 15 bp, Homo sapiens
tggaaaaggaagact

SEQ ID NO: 5954012 - DNA, 14 bp, Homo sapiens
tggaaaaggcatat

SEQ ID NO: 5954013 - DNA, 22 bp, Homo sapiens
tggaaaagggtcttgggaaata

SEQ ID NO: 5954014 - DNA, 18 bp, Homo sapiens
tggaaaagtcacacagac

SEQ ID NO: 5954015 - DNA, 16 bp, Homo sapiens
tggaaaagtgttcctt

SEQ ID NO: 5954016 - DNA, 22 bp, Homo sapiens
tggaaaagttagtattaaaatc

SEQ ID NO: 5954017 - DNA, 17 bp, Homo sapiens
tggaaaataaaaggtct

SEQ ID NO: 5954018 - DNA, 14 bp, Homo sapiens
tggaaaataaacat

SEQ ID NO: 5954019 - DNA, 15 bp, Homo sapiens
tggaaaataaatcaa

SEQ ID NO: 5954020 - DNA, 15 bp, Homo sapiens
tggaaaataaatttt

SEQ ID NO: 5954021 - DNA, 22 bp, Homo sapiens
tggaaaataagacaatagtatt

SEQ ID NO: 5954022 - DNA, 13 bp, Homo sapiens
tggaaaataataa

SEQ ID NO: 5954023 - DNA, 18 bp, Homo sapiens
tggaaaataataaaagaa

SEQ ID NO: 5954024 - DNA, 23 bp, Homo sapiens
tggaatcaggaatattttccaaa

SEQ ID NO: 5954025 - DNA, 15 bp, Homo sapiens
tggaatccatctgtc

SEQ ID NO: 5954026 - DNA, 18 bp, Homo sapiens
tggaatcccacttatcaa

SEQ ID NO: 5954027 - DNA, 16 bp, Homo sapiens
tggaatcgaggctgtg

SEQ ID NO: 5954028 - DNA, 15 bp, Homo sapiens
tggaatcgtttcttt

SEQ ID NO: 5954029 - DNA, 16 bp, Homo sapiens
tggaatctaacgggca

SEQ ID NO: 5954030 - DNA, 16 bp, Homo sapiens
tggaatctacaagcca

SEQ ID NO: 5954031 - DNA, 19 bp, Homo sapiens
tggaatctaccaactgttt

SEQ ID NO: 5954032 - DNA, 17 bp, Homo sapiens
tggaatctagaagaaat

SEQ ID NO: 5954033 - DNA, 18 bp, Homo sapiens
tggaatctagaagaaatg

SEQ ID NO: 5954034 - DNA, 18 bp, Homo sapiens
tggaatctagccgatgga

SEQ ID NO: 5954035 - DNA, 12 bp, Homo sapiens
tggaatctcatg

SEQ ID NO: 5954036 - DNA, 20 bp, Homo sapiens
tggaatctgaggcatcctct

SEQ ID NO: 5954037 - DNA, 22 bp, Homo sapiens
tggaatctgaggcatcctctga

SEQ ID NO: 5954038 - DNA, 15 bp, Homo sapiens
tggaatctggagagc

SEQ ID NO: 5954039 - DNA, 22 bp, Homo sapiens
tggaatcttcacctcagagtgg

SEQ ID NO: 5954040 - DNA, 21 bp, Homo sapiens
tggaatcttccatctgcatct

SEQ ID NO: 5954041 - DNA, 20 bp, Homo sapiens
tggaatcttctctttgacaa

SEQ ID NO: 5954042 - DNA, 19 bp, Homo sapiens
tggaatcttttataatgat

SEQ ID NO: 5954043 - DNA, 18 bp, Homo sapiens
tggaatgaaattcctcct

SEQ ID NO: 5954044 - DNA, 14 bp, Homo sapiens
tggaatgaagcatg

SEQ ID NO: 5954045 - DNA, 15 bp, Homo sapiens
tggaatgaagcatgt

SEQ ID NO: 5954046 - DNA, 18 bp, Homo sapiens
tggaatgaattaaataaa

SEQ ID NO: 5954047 - DNA, 19 bp, Homo sapiens
tggaatgactataaacatt

SEQ ID NO: 5954048 - DNA, 22 bp, Homo sapiens
tggaatgactataaacattaaa

SEQ ID NO: 5954049 - DNA, 15 bp, Homo sapiens
tggaatgactgaaga

SEQ ID NO: 5954050 - DNA, 13 bp, Homo sapiens
tggaatgagggag

SEQ ID NO: 5954051 - DNA, 13 bp, Homo sapiens
tggaatgagggtt

SEQ ID NO: 5954052 - DNA, 17 bp, Homo sapiens
tggaatgagtgtgcatg

SEQ ID NO: 5954053 - DNA, 15 bp, Homo sapiens
tggaatgatgtatat

SEQ ID NO: 5954054 - DNA, 20 bp, Homo sapiens
tggaatgcacacagcggctg

SEQ ID NO: 5954055 - DNA, 18 bp, Homo sapiens
tggaatgcagggaagagg

SEQ ID NO: 5954056 - DNA, 14 bp, Homo sapiens
tggaatgcagtggt

SEQ ID NO: 5954057 - DNA, 18 bp, Homo sapiens
tggaatgccgctgtctct

SEQ ID NO: 5954058 - DNA, 14 bp, Homo sapiens
tggaatgcggggga

SEQ ID NO: 5954059 - DNA, 16 bp, Homo sapiens
tggaatgctgtgttaa

SEQ ID NO: 5954060 - DNA, 24 bp, Homo sapiens
tggaatgcttcctagaagttactg

SEQ ID NO: 5954061 - DNA, 23 bp, Homo sapiens
tggaatgcttctgcatcaaagga

SEQ ID NO: 5954062 - DNA, 18 bp, Homo sapiens
tggaatgcttcttctcag

SEQ ID NO: 5954063 - DNA, 20 bp, Homo sapiens
tggaatgcttcttctcaggc

SEQ ID NO: 5954064 - DNA, 13 bp, Homo sapiens
tggaatggaaaag

SEQ ID NO: 5954065 - DNA, 17 bp, Homo sapiens
tggaatggaattggaca

SEQ ID NO: 5954066 - DNA, 19 bp, Homo sapiens
tggaatgggagtctgaaat

SEQ ID NO: 5954067 - DNA, 13 bp, Homo sapiens
tggaatggtgttt

SEQ ID NO: 5954068 - DNA, 18 bp, Homo sapiens
tggaatggttataaaagt

SEQ ID NO: 5954069 - DNA, 15 bp, Homo sapiens
tggaatgtaaaataa

SEQ ID NO: 5954070 - DNA, 14 bp, Homo sapiens
tggaatgtaatcaa

SEQ ID NO: 5954071 - DNA, 13 bp, Homo sapiens
tggaatgtgccac

SEQ ID NO: 5954072 - DNA, 14 bp, Homo sapiens
tggaatgtgccaca

SEQ ID NO: 5954073 - DNA, 16 bp, Homo sapiens
tggaatgtgccacaga

SEQ ID NO: 5954074 - DNA, 21 bp, Homo sapiens
tggaatgtgccacagaggccc

SEQ ID NO: 5954075 - DNA, 14 bp, Homo sapiens
tggaatgtgcccct

SEQ ID NO: 5954076 - DNA, 20 bp, Homo sapiens
tggaatgtgcccctggccca

SEQ ID NO: 5954077 - DNA, 21 bp, Homo sapiens
tggaatgtggcccctgaacaa

SEQ ID NO: 5954078 - DNA, 19 bp, Homo sapiens
tggaatgttacatctgtct

SEQ ID NO: 5954079 - DNA, 15 bp, Homo sapiens
tggaatgttggataa

SEQ ID NO: 5954080 - DNA, 18 bp, Homo sapiens
tggaatgttgttaaatgc

SEQ ID NO: 5954081 - DNA, 20 bp, Homo sapiens
tggaatgttgttaaatgcta

SEQ ID NO: 5954082 - DNA, 17 bp, Homo sapiens
tggaatgtttttccctc

SEQ ID NO: 5954083 - DNA, 22 bp, Homo sapiens
tggaatgtttttccctccccag

SEQ ID NO: 5954084 - DNA, 18 bp, Homo sapiens
tggaattaaaacaaaaca

SEQ ID NO: 5954085 - DNA, 21 bp, Homo sapiens
tggaattaaaaggatagtatt

SEQ ID NO: 5954086 - DNA, 20 bp, Homo sapiens
tggaattaaccatttaataa

SEQ ID NO: 5954087 - DNA, 17 bp, Homo sapiens
tggaattaacctggtgc

SEQ ID NO: 5954088 - DNA, 20 bp, Homo sapiens
tggaattaacctggtgctgg

SEQ ID NO: 5954089 - DNA, 21 bp, Homo sapiens
tggaattaacctggtgctgga

SEQ ID NO: 5954090 - DNA, 21 bp, Homo sapiens
tggaattacataacaggcatt

SEQ ID NO: 5954091 - DNA, 22 bp, Homo sapiens
tggaattacctgataagggaga

SEQ ID NO: 5954092 - DNA, 16 bp, Homo sapiens
tggaattagagggcct

SEQ ID NO: 5954093 - DNA, 21 bp, Homo sapiens
tggaattagagggccttgctt

SEQ ID NO: 5954094 - DNA, 17 bp, Homo sapiens
tggaattagatgtttat

SEQ ID NO: 5954095 - DNA, 22 bp, Homo sapiens
tggaattagcttggggccaggg

SEQ ID NO: 5954096 - DNA, 13 bp, Homo sapiens
tggaattataaat

SEQ ID NO: 5954097 - DNA, 16 bp, Homo sapiens
tggaattataaatatt

SEQ ID NO: 5954098 - DNA, 21 bp, Homo sapiens
tggaattatgctggcttctga

SEQ ID NO: 5954099 - DNA, 19 bp, Homo sapiens
tggaattattagcaccagc

SEQ ID NO: 5954100 - DNA, 21 bp, Homo sapiens
tggaattcaatgggtaaataa

SEQ ID NO: 5954101 - DNA, 23 bp, Homo sapiens
tggaattcaccctctcatgtttc

SEQ ID NO: 5954102 - DNA, 13 bp, Homo sapiens
tggaattcagcac

SEQ ID NO: 5954103 - DNA, 18 bp, Homo sapiens
tggaattcagcaccctgg

SEQ ID NO: 5954104 - DNA, 19 bp, Homo sapiens
tggaattcagcaccctggg

SEQ ID NO: 5954105 - DNA, 18 bp, Homo sapiens
tggaattcagcagtttta

SEQ ID NO: 5954106 - DNA, 17 bp, Homo sapiens
tggaattccaacttgaa

SEQ ID NO: 5954107 - DNA, 18 bp, Homo sapiens
tggaattccaacttgaag

SEQ ID NO: 5954108 - DNA, 20 bp, Homo sapiens
tggaattccaacttgaagga

SEQ ID NO: 5954109 - DNA, 19 bp, Homo sapiens
tggaattccatttgaggat

SEQ ID NO: 5954110 - DNA, 15 bp, Homo sapiens
tggaattccctcctg

SEQ ID NO: 5954111 - DNA, 16 bp, Homo sapiens
tggaattcctctttaa

SEQ ID NO: 5954112 - DNA, 14 bp, Homo sapiens
tggaattctgcttc

SEQ ID NO: 5954113 - DNA, 15 bp, Homo sapiens
tggaattctgttcat

SEQ ID NO: 5954114 - DNA, 13 bp, Homo sapiens
tggaattcttcct

SEQ ID NO: 5954115 - DNA, 14 bp, Homo sapiens
tggaattcttcctc

SEQ ID NO: 5954116 - DNA, 18 bp, Homo sapiens
tggaattcttcctcctct

SEQ ID NO: 5954117 - DNA, 12 bp, Homo sapiens
tggaattgattt

SEQ ID NO: 5954118 - DNA, 14 bp, Homo sapiens
tggaattgccacat

SEQ ID NO: 5954119 - DNA, 19 bp, Homo sapiens
tggaattgctgctctctga

SEQ ID NO: 5954120 - DNA, 18 bp, Homo sapiens
tggaattgcttaccaaag

SEQ ID NO: 5954121 - DNA, 15 bp, Homo sapiens
tggaattggagaaaa

SEQ ID NO: 5954122 - DNA, 22 bp, Homo sapiens
tggaattggagaaaagcacaat

SEQ ID NO: 5954123 - DNA, 18 bp, Homo sapiens
tggaattggagctcgtgg

SEQ ID NO: 5954124 - DNA, 13 bp, Homo sapiens
tggaattggtgta

SEQ ID NO: 5954125 - DNA, 14 bp, Homo sapiens
tggaattgtggcta

SEQ ID NO: 5954126 - DNA, 22 bp, Homo sapiens
tggaattgtggctatcctgatt

SEQ ID NO: 5954127 - DNA, 18 bp, Homo sapiens
tggaattgttgaatgtat

SEQ ID NO: 5954128 - DNA, 17 bp, Homo sapiens
tggaatttaattcaaag

SEQ ID NO: 5954129 - DNA, 16 bp, Homo sapiens
tggaatttaatttatg

SEQ ID NO: 5954130 - DNA, 18 bp, Homo sapiens
tggaatttaatttatgtg

SEQ ID NO: 5954131 - DNA, 19 bp, Homo sapiens
tggaatttaccagttaatt

SEQ ID NO: 5954132 - DNA, 23 bp, Homo sapiens
tggaatttacctccccttttcta

SEQ ID NO: 5954133 - DNA, 16 bp, Homo sapiens
tggaatttatgaatgg

SEQ ID NO: 5954134 - DNA, 17 bp, Homo sapiens
tggaatttctggcctcc

SEQ ID NO: 5954135 - DNA, 22 bp, Homo sapiens
tggaatttcttgtttctccaga

SEQ ID NO: 5954136 - DNA, 14 bp, Homo sapiens
tggaatttgaaaca

SEQ ID NO: 5954137 - DNA, 16 bp, Homo sapiens
tggaatttgcctgctg

SEQ ID NO: 5954138 - DNA, 17 bp, Homo sapiens
tggaatttgggcagata

SEQ ID NO: 5954139 - DNA, 15 bp, Homo sapiens
tggaatttgttcaag

SEQ ID NO: 5954140 - DNA, 12 bp, Homo sapiens
tggaattttaag

SEQ ID NO: 5954141 - DNA, 17 bp, Homo sapiens
tggaattttaagttcta

SEQ ID NO: 5954142 - DNA, 20 bp, Homo sapiens
tggaattttaagttctatca

SEQ ID NO: 5954143 - DNA, 21 bp, Homo sapiens
tggaattttcctcctttctct

SEQ ID NO: 5954144 - DNA, 12 bp, Homo sapiens
tggaattttctg

SEQ ID NO: 5954145 - DNA, 13 bp, Homo sapiens
tggaattttctgt

SEQ ID NO: 5954146 - DNA, 20 bp, Homo sapiens
tggaattttctttcatacat

SEQ ID NO: 5954147 - DNA, 21 bp, Homo sapiens
tggaattttgtaaaaagaaat

SEQ ID NO: 5954148 - DNA, 24 bp, Homo sapiens
tggaatttttattatgcataactg

SEQ ID NO: 5954149 - DNA, 12 bp, Homo sapiens
tggaatttttca

SEQ ID NO: 5954150 - DNA, 23 bp, Homo sapiens
tggaatttttcattgatatgaaa

SEQ ID NO: 5954151 - DNA, 16 bp, Homo sapiens
tggaatttttctgtac

SEQ ID NO: 5954152 - DNA, 15 bp, Homo sapiens
tggaattttttgaat

SEQ ID NO: 5954153 - DNA, 23 bp, Homo sapiens
tggaatttttttttcctggaatt

SEQ ID NO: 5954154 - DNA, 17 bp, Homo sapiens
tggacaaaaaaaaaaga

SEQ ID NO: 5954155 - DNA, 19 bp, Homo sapiens
tggacaaaacaagaaagac

SEQ ID NO: 5954156 - DNA, 13 bp, Homo sapiens
tggacaaaatgga

SEQ ID NO: 5954157 - DNA, 18 bp, Homo sapiens
tggacaaaattaatacat

SEQ ID NO: 5954158 - DNA, 19 bp, Homo sapiens
tggacaaaattaatacatt

SEQ ID NO: 5954159 - DNA, 20 bp, Homo sapiens
tggacaaactggagtctgga

SEQ ID NO: 5954160 - DNA, 22 bp, Homo sapiens
tggacaaactggagtctggagt

SEQ ID NO: 5954161 - DNA, 15 bp, Homo sapiens
tggacaaagaacctt

SEQ ID NO: 5954162 - DNA, 13 bp, Homo sapiens
tggacaaaggaat

SEQ ID NO: 5954163 - DNA, 17 bp, Homo sapiens
tggacaaatgcatttag

SEQ ID NO: 5954164 - DNA, 15 bp, Homo sapiens
tggacaaatgtgaag

SEQ ID NO: 5954165 - DNA, 18 bp, Homo sapiens
tggacaaatgtgaagatg

SEQ ID NO: 5954166 - DNA, 13 bp, Homo sapiens
tggacaacactga

SEQ ID NO: 5954167 - DNA, 15 bp, Homo sapiens
tggacaacagctctc

SEQ ID NO: 5954168 - DNA, 20 bp, Homo sapiens
tggacaacagctctcgttct

SEQ ID NO: 5954169 - DNA, 13 bp, Homo sapiens
tggacaacccaga

SEQ ID NO: 5954170 - DNA, 23 bp, Homo sapiens
tggacaacttatttaaaaatatt

SEQ ID NO: 5954171 - DNA, 17 bp, Homo sapiens
tggacaagaagctgcta

SEQ ID NO: 5954172 - DNA, 13 bp, Homo sapiens
tggacaagacatg

SEQ ID NO: 5954173 - DNA, 21 bp, Homo sapiens
tggacaagctgaatttgaaat

SEQ ID NO: 5954174 - DNA, 19 bp, Homo sapiens
tggacaagcttctgagacg

SEQ ID NO: 5954175 - DNA, 22 bp, Homo sapiens
tggacaaggagctgtgttcacc

SEQ ID NO: 5954176 - DNA, 16 bp, Homo sapiens
tggacaaggaggtctg

SEQ ID NO: 5954177 - DNA, 18 bp, Homo sapiens
tggacaatacccccaggc

SEQ ID NO: 5954178 - DNA, 21 bp, Homo sapiens
tggacacaacagcagtctcct

SEQ ID NO: 5954179 - DNA, 23 bp, Homo sapiens
tggacacaataggtctttctctc

SEQ ID NO: 5954180 - DNA, 16 bp, Homo sapiens
tggacacacacagact

SEQ ID NO: 5954181 - DNA, 20 bp, Homo sapiens
tggacacacacagactattt

SEQ ID NO: 5954182 - DNA, 21 bp, Homo sapiens
tggacacacactcaccagtgg

SEQ ID NO: 5954183 - DNA, 23 bp, Homo sapiens
tggacacacactcaccagtggcc

SEQ ID NO: 5954184 - DNA, 12 bp, Homo sapiens
tggacacactgt

SEQ ID NO: 5954185 - DNA, 22 bp, Homo sapiens
tggacacactgtaaacccctgg

SEQ ID NO: 5954186 - DNA, 16 bp, Homo sapiens
tggacacagcccaccc

SEQ ID NO: 5954187 - DNA, 22 bp, Homo sapiens
tggacacagctcttctccaggc

SEQ ID NO: 5954188 - DNA, 15 bp, Homo sapiens
tggacacagggtgac

SEQ ID NO: 5954189 - DNA, 13 bp, Homo sapiens
tggacacagtgtt

SEQ ID NO: 5954190 - DNA, 21 bp, Homo sapiens
tggacacattggaatgccttg

SEQ ID NO: 5954191 - DNA, 22 bp, Homo sapiens
tggacacattggaatgccttgg

SEQ ID NO: 5954192 - DNA, 20 bp, Homo sapiens
tggacacattttctcctagg

SEQ ID NO: 5954193 - DNA, 21 bp, Homo sapiens
tggacacattttctcctagga

SEQ ID NO: 5954194 - DNA, 22 bp, Homo sapiens
tggacacattttctcctaggag

SEQ ID NO: 5954195 - DNA, 21 bp, Homo sapiens
tggacaccaggagtccctggt

SEQ ID NO: 5954196 - DNA, 20 bp, Homo sapiens
tggacaccccttatccagga

SEQ ID NO: 5954197 - DNA, 21 bp, Homo sapiens
tggacaccccttatccaggac

SEQ ID NO: 5954198 - DNA, 23 bp, Homo sapiens
tggacaccccttatccaggactc

SEQ ID NO: 5954199 - DNA, 16 bp, Homo sapiens
tggacaccctctgccg

SEQ ID NO: 5954200 - DNA, 23 bp, Homo sapiens
tggactgaccaaagactgcagaa

SEQ ID NO: 5954201 - DNA, 17 bp, Homo sapiens
tggactgacctggtcca

SEQ ID NO: 5954202 - DNA, 19 bp, Homo sapiens
tggactgagccaaggaggc

SEQ ID NO: 5954203 - DNA, 22 bp, Homo sapiens
tggactgagccaaggaggcctg

SEQ ID NO: 5954204 - DNA, 16 bp, Homo sapiens
tggactgaggcctgag

SEQ ID NO: 5954205 - DNA, 18 bp, Homo sapiens
tggactgatggttgcttt

SEQ ID NO: 5954206 - DNA, 21 bp, Homo sapiens
tggactgatttgtggaaagga

SEQ ID NO: 5954207 - DNA, 14 bp, Homo sapiens
tggactgcagaagc

SEQ ID NO: 5954208 - DNA, 19 bp, Homo sapiens
tggactgcagaagcaaggg

SEQ ID NO: 5954209 - DNA, 23 bp, Homo sapiens
tggactgcatggggaggcagcag

SEQ ID NO: 5954210 - DNA, 13 bp, Homo sapiens
tggactgcattta

SEQ ID NO: 5954211 - DNA, 16 bp, Homo sapiens
tggactgcgctggacg

SEQ ID NO: 5954212 - DNA, 17 bp, Homo sapiens
tggactgctattctaga

SEQ ID NO: 5954213 - DNA, 18 bp, Homo sapiens
tggactggaaaatctctt

SEQ ID NO: 5954214 - DNA, 22 bp, Homo sapiens
tggactggaaagcacaagactg

SEQ ID NO: 5954215 - DNA, 14 bp, Homo sapiens
tggactggaagggg

SEQ ID NO: 5954216 - DNA, 23 bp, Homo sapiens
tggactggacatgagagcccctt

SEQ ID NO: 5954217 - DNA, 18 bp, Homo sapiens
tggactggaccagacaat

SEQ ID NO: 5954218 - DNA, 21 bp, Homo sapiens
tggactggaggctgggtggcc

SEQ ID NO: 5954219 - DNA, 18 bp, Homo sapiens
tggactggaggtgggcat

SEQ ID NO: 5954220 - DNA, 22 bp, Homo sapiens
tggactggaggtgggcatgcca

SEQ ID NO: 5954221 - DNA, 17 bp, Homo sapiens
tggactggagtggagca

SEQ ID NO: 5954222 - DNA, 12 bp, Homo sapiens
tggactggccat

SEQ ID NO: 5954223 - DNA, 20 bp, Homo sapiens
tggactggccatttttctgg

SEQ ID NO: 5954224 - DNA, 21 bp, Homo sapiens
tggactggcccttgcccaact

SEQ ID NO: 5954225 - DNA, 12 bp, Homo sapiens
tggactggcctg

SEQ ID NO: 5954226 - DNA, 13 bp, Homo sapiens
tggactggctaga

SEQ ID NO: 5954227 - DNA, 22 bp, Homo sapiens
tggactggctagagtcctcact

SEQ ID NO: 5954228 - DNA, 23 bp, Homo sapiens
tggactggctgtcctttccagtg

SEQ ID NO: 5954229 - DNA, 21 bp, Homo sapiens
tggactgggaagggggcaggc

SEQ ID NO: 5954230 - DNA, 15 bp, Homo sapiens
tggactgggaggagg

SEQ ID NO: 5954231 - DNA, 17 bp, Homo sapiens
tggactggggagcacag

SEQ ID NO: 5954232 - DNA, 20 bp, Homo sapiens
tggactgggtgggccccaca

SEQ ID NO: 5954233 - DNA, 16 bp, Homo sapiens
tggactggtggcccct

SEQ ID NO: 5954234 - DNA, 17 bp, Homo sapiens
tggactggtggcccctg

SEQ ID NO: 5954235 - DNA, 20 bp, Homo sapiens
tggactggttatcttgttat

SEQ ID NO: 5954236 - DNA, 17 bp, Homo sapiens
tggactggttggttttg

SEQ ID NO: 5954237 - DNA, 17 bp, Homo sapiens
tggactgtgaatttcaa

SEQ ID NO: 5954238 - DNA, 18 bp, Homo sapiens
tggactgtgaatttcaaa

SEQ ID NO: 5954239 - DNA, 14 bp, Homo sapiens
tggactgtgcctgg

SEQ ID NO: 5954240 - DNA, 13 bp, Homo sapiens
tggactgtggcac

SEQ ID NO: 5954241 - DNA, 21 bp, Homo sapiens
tggactgtggcctcaggaggc

SEQ ID NO: 5954242 - DNA, 19 bp, Homo sapiens
tggactgttcatttgaaac

SEQ ID NO: 5954243 - DNA, 18 bp, Homo sapiens
tggactgttccaggccct

SEQ ID NO: 5954244 - DNA, 22 bp, Homo sapiens
tggactgtttcaaggtccatgg

SEQ ID NO: 5954245 - DNA, 12 bp, Homo sapiens
tggactgttttc

SEQ ID NO: 5954246 - DNA, 22 bp, Homo sapiens
tggactgttttcaataacaaag

SEQ ID NO: 5954247 - DNA, 19 bp, Homo sapiens
tggacttaagcatctggct

SEQ ID NO: 5954248 - DNA, 17 bp, Homo sapiens
tggacttacaaaatgcc

SEQ ID NO: 5954249 - DNA, 19 bp, Homo sapiens
tggacttacaaaatgccaa

SEQ ID NO: 5954250 - DNA, 21 bp, Homo sapiens
tggacttagaaagcaggggct

SEQ ID NO: 5954251 - DNA, 17 bp, Homo sapiens
tggacttatttcttcaa

SEQ ID NO: 5954252 - DNA, 11 bp, Homo sapiens
tggacttcaaa

SEQ ID NO: 5954253 - DNA, 18 bp, Homo sapiens
tggacttcaaagcaagct

SEQ ID NO: 5954254 - DNA, 16 bp, Homo sapiens
tggacttctgaagaga

SEQ ID NO: 5954255 - DNA, 11 bp, Homo sapiens
tggacttctgg

SEQ ID NO: 5954256 - DNA, 15 bp, Homo sapiens
tggacttctgggaga

SEQ ID NO: 5954257 - DNA, 18 bp, Homo sapiens
tggacttctgtgggcccc

SEQ ID NO: 5954258 - DNA, 22 bp, Homo sapiens
tggacttgaaggtttgatgcca

SEQ ID NO: 5954259 - DNA, 16 bp, Homo sapiens
tggacttggggcctct

SEQ ID NO: 5954260 - DNA, 13 bp, Homo sapiens
tggacttgtatat

SEQ ID NO: 5954261 - DNA, 20 bp, Homo sapiens
tggacttgtatatttgtaca

SEQ ID NO: 5954262 - DNA, 19 bp, Homo sapiens
tggacttgtatgctgccca

SEQ ID NO: 5954263 - DNA, 16 bp, Homo sapiens
tggacttgtctcccag

SEQ ID NO: 5954264 - DNA, 19 bp, Homo sapiens
tggacttgtgattggctgc

SEQ ID NO: 5954265 - DNA, 23 bp, Homo sapiens
tggacttgtgattggctgcagga

SEQ ID NO: 5954266 - DNA, 17 bp, Homo sapiens
tggacttgttcgtgccc

SEQ ID NO: 5954267 - DNA, 14 bp, Homo sapiens
tggacttgttttaa

SEQ ID NO: 5954268 - DNA, 16 bp, Homo sapiens
tggactttaaaaaaac

SEQ ID NO: 5954269 - DNA, 16 bp, Homo sapiens
tggactttatttaatt

SEQ ID NO: 5954270 - DNA, 21 bp, Homo sapiens
tggactttatttaatttcata

SEQ ID NO: 5954271 - DNA, 12 bp, Homo sapiens
tggactttcaaa

SEQ ID NO: 5954272 - DNA, 20 bp, Homo sapiens
tggactttccaccccctccc

SEQ ID NO: 5954273 - DNA, 18 bp, Homo sapiens
tggactttcctgcaactc

SEQ ID NO: 5954274 - DNA, 19 bp, Homo sapiens
tggactttcctgcaactca

SEQ ID NO: 5954275 - DNA, 14 bp, Homo sapiens
tggactttgttaca

SEQ ID NO: 5954276 - DNA, 20 bp, Homo sapiens
tggacttttcgttaacattg

SEQ ID NO: 5954277 - DNA, 21 bp, Homo sapiens
tggacttttcgttaacattga

SEQ ID NO: 5954278 - DNA, 22 bp, Homo sapiens
tggacttttcgttaacattgac

SEQ ID NO: 5954279 - DNA, 19 bp, Homo sapiens
tggacttttgggggttgga

SEQ ID NO: 5954280 - DNA, 18 bp, Homo sapiens
tggacttttttttttctt

SEQ ID NO: 5954281 - DNA, 17 bp, Homo sapiens
tggagaaaaaaattgct

SEQ ID NO: 5954282 - DNA, 18 bp, Homo sapiens
tggagaaaaaggtgccat

SEQ ID NO: 5954283 - DNA, 18 bp, Homo sapiens
tggagaaaagcacaatca

SEQ ID NO: 5954284 - DNA, 14 bp, Homo sapiens
tggagaaaagcact

SEQ ID NO: 5954285 - DNA, 16 bp, Homo sapiens
tggagaaaagcactta

SEQ ID NO: 5954286 - DNA, 17 bp, Homo sapiens
tggagaaaagcacttaa

SEQ ID NO: 5954287 - DNA, 15 bp, Homo sapiens
tggagaaaatgaaga

SEQ ID NO: 5954288 - DNA, 13 bp, Homo sapiens
tggagaaaatggg

SEQ ID NO: 5954289 - DNA, 21 bp, Homo sapiens
tggagaaacaggctctgagat

SEQ ID NO: 5954290 - DNA, 13 bp, Homo sapiens
tggagaaaccttc

SEQ ID NO: 5954291 - DNA, 17 bp, Homo sapiens
tggagaaagaagtggag

SEQ ID NO: 5954292 - DNA, 20 bp, Homo sapiens
tggagaaagagctgcctgga

SEQ ID NO: 5954293 - DNA, 20 bp, Homo sapiens
tggagaaagatgcagtcctc

SEQ ID NO: 5954294 - DNA, 19 bp, Homo sapiens
tggagaaagccacgccctc

SEQ ID NO: 5954295 - DNA, 20 bp, Homo sapiens
tggagaaagccacgccctcc

SEQ ID NO: 5954296 - DNA, 18 bp, Homo sapiens
tggagaaagctgacttgg

SEQ ID NO: 5954297 - DNA, 15 bp, Homo sapiens
tggagaaaggatggc

SEQ ID NO: 5954298 - DNA, 21 bp, Homo sapiens
tggagaaagggccctgggcct

SEQ ID NO: 5954299 - DNA, 14 bp, Homo sapiens
tggagaaatgaaaa

SEQ ID NO: 5954300 - DNA, 15 bp, Homo sapiens
tggagaaatgaaaac

SEQ ID NO: 5954301 - DNA, 21 bp, Homo sapiens
tggagaaatgaagcagaggaa

SEQ ID NO: 5954302 - DNA, 16 bp, Homo sapiens
tggagaaatgggagct

SEQ ID NO: 5954303 - DNA, 16 bp, Homo sapiens
tggagaaatgtcataa

SEQ ID NO: 5954304 - DNA, 22 bp, Homo sapiens
tggagaacattcaatcttgccg

SEQ ID NO: 5954305 - DNA, 23 bp, Homo sapiens
tggagaaccagggctcttctcag

SEQ ID NO: 5954306 - DNA, 22 bp, Homo sapiens
tggagaacccaggggacagctg

SEQ ID NO: 5954307 - DNA, 18 bp, Homo sapiens
tggagaactagaacctgg

SEQ ID NO: 5954308 - DNA, 20 bp, Homo sapiens
tggagaactagaacctggag

SEQ ID NO: 5954309 - DNA, 20 bp, Homo sapiens
tggagaactccgctggatgg

SEQ ID NO: 5954310 - DNA, 14 bp, Homo sapiens
tggagaactcggtt

SEQ ID NO: 5954311 - DNA, 15 bp, Homo sapiens
tggagaactctggct

SEQ ID NO: 5954312 - DNA, 19 bp, Homo sapiens
tggagaactttccatctgc

SEQ ID NO: 5954313 - DNA, 13 bp, Homo sapiens
tggagaagaactg

SEQ ID NO: 5954314 - DNA, 11 bp, Homo sapiens
tggagaagaat

SEQ ID NO: 5954315 - DNA, 16 bp, Homo sapiens
tggagaagaatggctt

SEQ ID NO: 5954316 - DNA, 17 bp, Homo sapiens
tggagaagaccctcccc

SEQ ID NO: 5954317 - DNA, 14 bp, Homo sapiens
tggagaagagagga

SEQ ID NO: 5954318 - DNA, 13 bp, Homo sapiens
tggagaagattta

SEQ ID NO: 5954319 - DNA, 11 bp, Homo sapiens
tggagaagcac

SEQ ID NO: 5954320 - DNA, 14 bp, Homo sapiens
tggagaagcacact

SEQ ID NO: 5954321 - DNA, 11 bp, Homo sapiens
tggagaagcca

SEQ ID NO: 5954322 - DNA, 12 bp, Homo sapiens
tggagaagccat

SEQ ID NO: 5954323 - DNA, 17 bp, Homo sapiens
tggagaagccattgtct

SEQ ID NO: 5954324 - DNA, 22 bp, Homo sapiens
tggagaagcctattagctggga

SEQ ID NO: 5954325 - DNA, 22 bp, Homo sapiens
tggagaagcggctggcagccca

SEQ ID NO: 5954326 - DNA, 13 bp, Homo sapiens
tggagaaggaaaa

SEQ ID NO: 5954327 - DNA, 20 bp, Homo sapiens
tggagaaggaaaaggctggc

SEQ ID NO: 5954328 - DNA, 23 bp, Homo sapiens
tggagaaggaaaaggctggcaag

SEQ ID NO: 5954329 - DNA, 21 bp, Homo sapiens
tggagaaggatagcctcagcc

SEQ ID NO: 5954330 - DNA, 22 bp, Homo sapiens
tggagaaggatagcctcagcca

SEQ ID NO: 5954331 - DNA, 18 bp, Homo sapiens
tggagaaggcctggaaga

SEQ ID NO: 5954332 - DNA, 21 bp, Homo sapiens
tggagaagggttctgccctgc

SEQ ID NO: 5954333 - DNA, 21 bp, Homo sapiens
tggagaaggtattagcaaagc

SEQ ID NO: 5954334 - DNA, 17 bp, Homo sapiens
tggagaaggtctgtggt

SEQ ID NO: 5954335 - DNA, 18 bp, Homo sapiens
tggagaaggtctgtggtg

SEQ ID NO: 5954336 - DNA, 17 bp, Homo sapiens
tggagaagtctcagcta

SEQ ID NO: 5954337 - DNA, 23 bp, Homo sapiens
tggagaagtctcagctaagctca

SEQ ID NO: 5954338 - DNA, 22 bp, Homo sapiens
tggagaagtcttagacttgaaa

SEQ ID NO: 5954339 - DNA, 21 bp, Homo sapiens
tggagaagtgggtggggacag

SEQ ID NO: 5954340 - DNA, 15 bp, Homo sapiens
tggagaataaattat

SEQ ID NO: 5954341 - DNA, 18 bp, Homo sapiens
tggagaataattctttga

SEQ ID NO: 5954342 - DNA, 16 bp, Homo sapiens
tggagaatactgccaa

SEQ ID NO: 5954343 - DNA, 18 bp, Homo sapiens
tggagaatactgccaaaa

SEQ ID NO: 5954344 - DNA, 22 bp, Homo sapiens
tggagaatactgccaaaacatt

SEQ ID NO: 5954345 - DNA, 15 bp, Homo sapiens
tggagaatcacaggc

SEQ ID NO: 5954346 - DNA, 22 bp, Homo sapiens
tggagaatcacaggctgggctg

SEQ ID NO: 5954347 - DNA, 20 bp, Homo sapiens
tggagaatgggacgaggaca

SEQ ID NO: 5954348 - DNA, 15 bp, Homo sapiens
tggagaatggtgttc

SEQ ID NO: 5954349 - DNA, 19 bp, Homo sapiens
tggagaatgtatcagccag

SEQ ID NO: 5954350 - DNA, 14 bp, Homo sapiens
tggagaattatata

SEQ ID NO: 5954351 - DNA, 23 bp, Homo sapiens
tggagaattccagttgtatttga

SEQ ID NO: 5954352 - DNA, 17 bp, Homo sapiens
tggagaattgctgaagg

SEQ ID NO: 5954353 - DNA, 22 bp, Homo sapiens
tggagaattgctgaagggcatt

SEQ ID NO: 5954354 - DNA, 23 bp, Homo sapiens
tggagaatttagaatcagaagtt

SEQ ID NO: 5954355 - DNA, 17 bp, Homo sapiens
tggagacaaggtgctaa

SEQ ID NO: 5954356 - DNA, 13 bp, Homo sapiens
tggagacaatgca

SEQ ID NO: 5954357 - DNA, 18 bp, Homo sapiens
tggagacaatgtctgcag

SEQ ID NO: 5954358 - DNA, 21 bp, Homo sapiens
tggagacaatgtctgcagccc

SEQ ID NO: 5954359 - DNA, 24 bp, Homo sapiens
tggagacaatgtctgcagccctga

SEQ ID NO: 5954360 - DNA, 15 bp, Homo sapiens
tggagacaattacaa

SEQ ID NO: 5954361 - DNA, 22 bp, Homo sapiens
tggagacaattacaagacgggg

SEQ ID NO: 5954362 - DNA, 18 bp, Homo sapiens
tggagacaccaccaccct

SEQ ID NO: 5954363 - DNA, 14 bp, Homo sapiens
tggagacacggggc

SEQ ID NO: 5954364 - DNA, 21 bp, Homo sapiens
tggagacagcaattgtagaca

SEQ ID NO: 5954365 - DNA, 13 bp, Homo sapiens
tggagacagcagt

SEQ ID NO: 5954366 - DNA, 17 bp, Homo sapiens
tggagacagccccagag

SEQ ID NO: 5954367 - DNA, 20 bp, Homo sapiens
tggagacagccccagagcag

SEQ ID NO: 5954368 - DNA, 14 bp, Homo sapiens
tggagacagccctg

SEQ ID NO: 5954369 - DNA, 16 bp, Homo sapiens
tggagacagccctgcc

SEQ ID NO: 5954370 - DNA, 18 bp, Homo sapiens
tggagacagccctgccta

SEQ ID NO: 5954371 - DNA, 15 bp, Homo sapiens
tggagacagcgaact

SEQ ID NO: 5954372 - DNA, 20 bp, Homo sapiens
tggagaccccaccagcctca

SEQ ID NO: 5954373 - DNA, 14 bp, Homo sapiens
tggagaccctgcca

SEQ ID NO: 5954374 - DNA, 20 bp, Homo sapiens
tggagaccctgccacagcca

SEQ ID NO: 5954375 - DNA, 23 bp, Homo sapiens
tggagaccctgccacagccagag

SEQ ID NO: 5954376 - DNA, 14 bp, Homo sapiens
tggaggtgtgggcc

SEQ ID NO: 5954377 - DNA, 17 bp, Homo sapiens
tggaggtgttgtgggga

SEQ ID NO: 5954378 - DNA, 17 bp, Homo sapiens
tggaggttaaggctgag

SEQ ID NO: 5954379 - DNA, 23 bp, Homo sapiens
tggaggttacagtgagctgagag

SEQ ID NO: 5954380 - DNA, 23 bp, Homo sapiens
tggaggttcctaggttttgagat

SEQ ID NO: 5954381 - DNA, 15 bp, Homo sapiens
tggaggttctaaggc

SEQ ID NO: 5954382 - DNA, 18 bp, Homo sapiens
tggaggttctcagagcca

SEQ ID NO: 5954383 - DNA, 18 bp, Homo sapiens
tggaggttgaagccaagt

SEQ ID NO: 5954384 - DNA, 14 bp, Homo sapiens
tggaggttgataac

SEQ ID NO: 5954385 - DNA, 22 bp, Homo sapiens
tggaggttgcagtgagctgaga

SEQ ID NO: 5954386 - DNA, 22 bp, Homo sapiens
tggaggttgggaggtccaaggt

SEQ ID NO: 5954387 - DNA, 19 bp, Homo sapiens
tggaggtttcacttgcaca

SEQ ID NO: 5954388 - DNA, 21 bp, Homo sapiens
tggaggtttcacttgcacatc

SEQ ID NO: 5954389 - DNA, 22 bp, Homo sapiens
tggagtaaaaaaggagacagtt

SEQ ID NO: 5954390 - DNA, 22 bp, Homo sapiens
tggagtaaaccatgtattccct

SEQ ID NO: 5954391 - DNA, 15 bp, Homo sapiens
tggagtactatattt

SEQ ID NO: 5954392 - DNA, 13 bp, Homo sapiens
tggagtagaatgt

SEQ ID NO: 5954393 - DNA, 21 bp, Homo sapiens
tggagtagacaaaaggaaagg

SEQ ID NO: 5954394 - DNA, 20 bp, Homo sapiens
tggagtagacccctggctgg

SEQ ID NO: 5954395 - DNA, 14 bp, Homo sapiens
tggagtagagtcag

SEQ ID NO: 5954396 - DNA, 13 bp, Homo sapiens
tggagtagcctgg

SEQ ID NO: 5954397 - DNA, 23 bp, Homo sapiens
tggagtagcctggactgtttcat

SEQ ID NO: 5954398 - DNA, 15 bp, Homo sapiens
tggagtatgatttac

SEQ ID NO: 5954399 - DNA, 14 bp, Homo sapiens
tggagtatgtctga

SEQ ID NO: 5954400 - DNA, 11 bp, Homo sapiens
tggagtattta

SEQ ID NO: 5954401 - DNA, 16 bp, Homo sapiens
tggagtatttttataa

SEQ ID NO: 5954402 - DNA, 16 bp, Homo sapiens
tggagtcaaaaagaac

SEQ ID NO: 5954403 - DNA, 19 bp, Homo sapiens
tggagtcacatcagtgagg

SEQ ID NO: 5954404 - DNA, 14 bp, Homo sapiens
tggagtcaggcttc

SEQ ID NO: 5954405 - DNA, 14 bp, Homo sapiens
tggagtcagggctg

SEQ ID NO: 5954406 - DNA, 20 bp, Homo sapiens
tggagtcagtagccagagtt

SEQ ID NO: 5954407 - DNA, 22 bp, Homo sapiens
tggagtcagtaggtccaagggc

SEQ ID NO: 5954408 - DNA, 22 bp, Homo sapiens
tggagtcagtttttttaaaaag

SEQ ID NO: 5954409 - DNA, 13 bp, Homo sapiens
tggagtcatcttg

SEQ ID NO: 5954410 - DNA, 22 bp, Homo sapiens
tggagtcatggtccggtgtcct

SEQ ID NO: 5954411 - DNA, 16 bp, Homo sapiens
tggagtccagacctgg

SEQ ID NO: 5954412 - DNA, 19 bp, Homo sapiens
tggagtccagacctgggcc

SEQ ID NO: 5954413 - DNA, 20 bp, Homo sapiens
tggagtccagatggcaggct

SEQ ID NO: 5954414 - DNA, 18 bp, Homo sapiens
tggagtccagctctacta

SEQ ID NO: 5954415 - DNA, 15 bp, Homo sapiens
tggagtccagtgctt

SEQ ID NO: 5954416 - DNA, 17 bp, Homo sapiens
tggagtcccaggggcag

SEQ ID NO: 5954417 - DNA, 18 bp, Homo sapiens
tggagtcccaggggcagc

SEQ ID NO: 5954418 - DNA, 19 bp, Homo sapiens
tggagtcccctcacctcct

SEQ ID NO: 5954419 - DNA, 21 bp, Homo sapiens
tggagtcccctcacctcctct

SEQ ID NO: 5954420 - DNA, 19 bp, Homo sapiens
tggagtccgccaaaggccc

SEQ ID NO: 5954421 - DNA, 14 bp, Homo sapiens
tggagtcctgttct

SEQ ID NO: 5954422 - DNA, 15 bp, Homo sapiens
tggagtcctgttctc

SEQ ID NO: 5954423 - DNA, 18 bp, Homo sapiens
tggagtcctgttctcaga

SEQ ID NO: 5954424 - DNA, 15 bp, Homo sapiens
tggagtcgagctggc

SEQ ID NO: 5954425 - DNA, 18 bp, Homo sapiens
tggagtcggagtggacac

SEQ ID NO: 5954426 - DNA, 20 bp, Homo sapiens
tggagtctccagatgttaat

SEQ ID NO: 5954427 - DNA, 14 bp, Homo sapiens
tggagtctcctgag

SEQ ID NO: 5954428 - DNA, 14 bp, Homo sapiens
tggagtctgaagcc

SEQ ID NO: 5954429 - DNA, 17 bp, Homo sapiens
tggagtctgaagcctgc

SEQ ID NO: 5954430 - DNA, 21 bp, Homo sapiens
tggagtctgagtctgagtcct

SEQ ID NO: 5954431 - DNA, 17 bp, Homo sapiens
tggagtctggagtgggc

SEQ ID NO: 5954432 - DNA, 14 bp, Homo sapiens
tggagtctgggctc

SEQ ID NO: 5954433 - DNA, 23 bp, Homo sapiens
tggagtctgtctctttcagtgct

SEQ ID NO: 5954434 - DNA, 21 bp, Homo sapiens
tggagtcttttctgttattgt

SEQ ID NO: 5954435 - DNA, 17 bp, Homo sapiens
tggagtgaagcatttaa

SEQ ID NO: 5954436 - DNA, 17 bp, Homo sapiens
tggagtgaagtggtgtg

SEQ ID NO: 5954437 - DNA, 12 bp, Homo sapiens
tggagtgaccaa

SEQ ID NO: 5954438 - DNA, 22 bp, Homo sapiens
tggagtgagagcctttgccttt

SEQ ID NO: 5954439 - DNA, 12 bp, Homo sapiens
tggagtgagcag

SEQ ID NO: 5954440 - DNA, 21 bp, Homo sapiens
tggagtgaggcttccaggctc

SEQ ID NO: 5954441 - DNA, 18 bp, Homo sapiens
tggagtgagggcctcaga

SEQ ID NO: 5954442 - DNA, 20 bp, Homo sapiens
tggagtgatggtgtccttcc

SEQ ID NO: 5954443 - DNA, 18 bp, Homo sapiens
tggagtgcaccaaagaga

SEQ ID NO: 5954444 - DNA, 18 bp, Homo sapiens
tggagtgcactgagaaca

SEQ ID NO: 5954445 - DNA, 18 bp, Homo sapiens
tggagtgcagtggcacaa

SEQ ID NO: 5954446 - DNA, 15 bp, Homo sapiens
tggagtgcagtggct

SEQ ID NO: 5954447 - DNA, 18 bp, Homo sapiens
tggagtgccacatggccg

SEQ ID NO: 5954448 - DNA, 21 bp, Homo sapiens
tggagtgccacatggccgctg

SEQ ID NO: 5954449 - DNA, 15 bp, Homo sapiens
tggagtgccatggct

SEQ ID NO: 5954450 - DNA, 18 bp, Homo sapiens
tggagtgcccaccctggg

SEQ ID NO: 5954451 - DNA, 18 bp, Homo sapiens
tggagtgccccaaggagg

SEQ ID NO: 5954452 - DNA, 14 bp, Homo sapiens
tggagtgccctgca

SEQ ID NO: 5954453 - DNA, 16 bp, Homo sapiens
tggagtgccctgcagg

SEQ ID NO: 5954454 - DNA, 23 bp, Homo sapiens
tggagtgcgctcttggtccctgg

SEQ ID NO: 5954455 - DNA, 22 bp, Homo sapiens
tggagtgctgcttgtgcctccc

SEQ ID NO: 5954456 - DNA, 15 bp, Homo sapiens
tggagtgctggctcc

SEQ ID NO: 5954457 - DNA, 16 bp, Homo sapiens
tggagtgctggctcca

SEQ ID NO: 5954458 - DNA, 23 bp, Homo sapiens
tggagtgctggctccacgccctg

SEQ ID NO: 5954459 - DNA, 16 bp, Homo sapiens
tggagtgcttaaaaat

SEQ ID NO: 5954460 - DNA, 20 bp, Homo sapiens
tggagtggaaggtctattgg

SEQ ID NO: 5954461 - DNA, 11 bp, Homo sapiens
tggagtggagg

SEQ ID NO: 5954462 - DNA, 13 bp, Homo sapiens
tggagtggaggca

SEQ ID NO: 5954463 - DNA, 15 bp, Homo sapiens
tggagtggaggcatt

SEQ ID NO: 5954464 - DNA, 16 bp, Homo sapiens
tggagtggaggcattg

SEQ ID NO: 5954465 - DNA, 17 bp, Homo sapiens
tggagtggaggcattgt

SEQ ID NO: 5954466 - DNA, 13 bp, Homo sapiens
tggagtggatgcc

SEQ ID NO: 5954467 - DNA, 13 bp, Homo sapiens
tggagtggcagcc

SEQ ID NO: 5954468 - DNA, 17 bp, Homo sapiens
tggagtggcagcccagc

SEQ ID NO: 5954469 - DNA, 20 bp, Homo sapiens
tggagtggcagcccagccag

SEQ ID NO: 5954470 - DNA, 13 bp, Homo sapiens
tggagtggcatgg

SEQ ID NO: 5954471 - DNA, 19 bp, Homo sapiens
tggagtggcatggtcctgt

SEQ ID NO: 5954472 - DNA, 23 bp, Homo sapiens
tggagtggcatggtcctgtgccc

SEQ ID NO: 5954473 - DNA, 15 bp, Homo sapiens
tggagtggccactgg

SEQ ID NO: 5954474 - DNA, 16 bp, Homo sapiens
tggagtggctcgccag

SEQ ID NO: 5954475 - DNA, 22 bp, Homo sapiens
tggagtgggaagggagcattgc

SEQ ID NO: 5954476 - DNA, 20 bp, Homo sapiens
tggagtgggttggcttgctg

SEQ ID NO: 5954477 - DNA, 14 bp, Homo sapiens
tggagtgtatgact

SEQ ID NO: 5954478 - DNA, 18 bp, Homo sapiens
tggagtgtcggatcctgt

SEQ ID NO: 5954479 - DNA, 21 bp, Homo sapiens
tggagtgtgcagacagccatg

SEQ ID NO: 5954480 - DNA, 19 bp, Homo sapiens
tggagtgtgcgtgtgtgca

SEQ ID NO: 5954481 - DNA, 17 bp, Homo sapiens
tggagtgtggctgagga

SEQ ID NO: 5954482 - DNA, 12 bp, Homo sapiens
tggagtgtgtaa

SEQ ID NO: 5954483 - DNA, 19 bp, Homo sapiens
tggagtgtgtattgttccc

SEQ ID NO: 5954484 - DNA, 20 bp, Homo sapiens
tggagtgtgtattgttccca

SEQ ID NO: 5954485 - DNA, 22 bp, Homo sapiens
tggagtgtgtcagagcccaggg

SEQ ID NO: 5954486 - DNA, 22 bp, Homo sapiens
tggagtgttccccttccactga

SEQ ID NO: 5954487 - DNA, 20 bp, Homo sapiens
tggagtgtttctaataaact

SEQ ID NO: 5954488 - DNA, 16 bp, Homo sapiens
tggagtgtttgaaaac

SEQ ID NO: 5954489 - DNA, 21 bp, Homo sapiens
tggagtgtttgaaaactgaca

SEQ ID NO: 5954490 - DNA, 18 bp, Homo sapiens
tggagttacattaatgtt

SEQ ID NO: 5954491 - DNA, 22 bp, Homo sapiens
tggagttcactttcaattgctt

SEQ ID NO: 5954492 - DNA, 20 bp, Homo sapiens
tggagttcattcatattaca

SEQ ID NO: 5954493 - DNA, 15 bp, Homo sapiens
tggagttcccgtgca

SEQ ID NO: 5954494 - DNA, 20 bp, Homo sapiens
tggagttcccgtgcacctac

SEQ ID NO: 5954495 - DNA, 14 bp, Homo sapiens
tggagttcctcatc

SEQ ID NO: 5954496 - DNA, 15 bp, Homo sapiens
tggagttcctgctcc

SEQ ID NO: 5954497 - DNA, 13 bp, Homo sapiens
tggagttccttat

SEQ ID NO: 5954498 - DNA, 22 bp, Homo sapiens
tggagttcgtaccgcttcctta

SEQ ID NO: 5954499 - DNA, 19 bp, Homo sapiens
tggagttctcaaagacctg

SEQ ID NO: 5954500 - DNA, 14 bp, Homo sapiens
tggagttcttgtgc

SEQ ID NO: 5954501 - DNA, 16 bp, Homo sapiens
tggagttcttgtgcca

SEQ ID NO: 5954502 - DNA, 15 bp, Homo sapiens
tggagttgatctgga

SEQ ID NO: 5954503 - DNA, 14 bp, Homo sapiens
tggagttggagccg

SEQ ID NO: 5954504 - DNA, 14 bp, Homo sapiens
tggagttgggctgg

SEQ ID NO: 5954505 - DNA, 19 bp, Homo sapiens
tggagttggggcagaggag

SEQ ID NO: 5954506 - DNA, 14 bp, Homo sapiens
tggagttggggctg

SEQ ID NO: 5954507 - DNA, 16 bp, Homo sapiens
tggagttggtggtgct

SEQ ID NO: 5954508 - DNA, 17 bp, Homo sapiens
tggagttggtggtgctg

SEQ ID NO: 5954509 - DNA, 16 bp, Homo sapiens
tggagttgttttaaca

SEQ ID NO: 5954510 - DNA, 23 bp, Homo sapiens
tggagtttaatacagtgagctct

SEQ ID NO: 5954511 - DNA, 23 bp, Homo sapiens
tggagtttaggaattggaggctg

SEQ ID NO: 5954512 - DNA, 15 bp, Homo sapiens
tggagtttgacacct

SEQ ID NO: 5954513 - DNA, 15 bp, Homo sapiens
tggagtttgggctgg

SEQ ID NO: 5954514 - DNA, 17 bp, Homo sapiens
tggagtttgggctggag

SEQ ID NO: 5954515 - DNA, 18 bp, Homo sapiens
tggagtttgggctggagc

SEQ ID NO: 5954516 - DNA, 21 bp, Homo sapiens
tggagtttgggctggagctcc

SEQ ID NO: 5954517 - DNA, 23 bp, Homo sapiens
tggagtttgtaaaattgttcctg

SEQ ID NO: 5954518 - DNA, 14 bp, Homo sapiens
tggagtttgtattt

SEQ ID NO: 5954519 - DNA, 17 bp, Homo sapiens
tggagtttgtgtctgtt

SEQ ID NO: 5954520 - DNA, 20 bp, Homo sapiens
tggagtttgtgtctgttgct

SEQ ID NO: 5954521 - DNA, 21 bp, Homo sapiens
tggagttttataaattaaaag

SEQ ID NO: 5954522 - DNA, 16 bp, Homo sapiens
tggagttttgtttcct

SEQ ID NO: 5954523 - DNA, 21 bp, Homo sapiens
tggagtttttgtttggagagc

SEQ ID NO: 5954524 - DNA, 17 bp, Homo sapiens
tggagttttttgtacca

SEQ ID NO: 5954525 - DNA, 15 bp, Homo sapiens
tggataaaaaagaaa

SEQ ID NO: 5954526 - DNA, 16 bp, Homo sapiens
tggataaaaaagaaaa

SEQ ID NO: 5954527 - DNA, 20 bp, Homo sapiens
tggataaaaaagaaaacatt

SEQ ID NO: 5954528 - DNA, 16 bp, Homo sapiens
tggataaaactgtgta

SEQ ID NO: 5954529 - DNA, 17 bp, Homo sapiens
tggataaaataatgctg

SEQ ID NO: 5954530 - DNA, 22 bp, Homo sapiens
tggataaaccaccctctgggga

SEQ ID NO: 5954531 - DNA, 16 bp, Homo sapiens
tggataaactgagcct

SEQ ID NO: 5954532 - DNA, 15 bp, Homo sapiens
tggataaagccactg

SEQ ID NO: 5954533 - DNA, 20 bp, Homo sapiens
tggataaatcatttcagtat

SEQ ID NO: 5954534 - DNA, 21 bp, Homo sapiens
tggataaattgtatgaagatc

SEQ ID NO: 5954535 - DNA, 16 bp, Homo sapiens
tggataacaaagatat

SEQ ID NO: 5954536 - DNA, 18 bp, Homo sapiens
tggataacaaagatatct

SEQ ID NO: 5954537 - DNA, 20 bp, Homo sapiens
tggataacaaagatatcttt

SEQ ID NO: 5954538 - DNA, 16 bp, Homo sapiens
tggataactagccaga

SEQ ID NO: 5954539 - DNA, 15 bp, Homo sapiens
tggataataaaaatt

SEQ ID NO: 5954540 - DNA, 20 bp, Homo sapiens
tggataataaggaaaagttt

SEQ ID NO: 5954541 - DNA, 19 bp, Homo sapiens
tggataatatccactgcaa

SEQ ID NO: 5954542 - DNA, 17 bp, Homo sapiens
tggataatattcattgg

SEQ ID NO: 5954543 - DNA, 20 bp, Homo sapiens
tggataatcaggaaaaatga

SEQ ID NO: 5954544 - DNA, 19 bp, Homo sapiens
tggataatcttaaattttg

SEQ ID NO: 5954545 - DNA, 22 bp, Homo sapiens
tggatacaaggatcagaatgga

SEQ ID NO: 5954546 - DNA, 21 bp, Homo sapiens
tggatacacacatagtttctt

SEQ ID NO: 5954547 - DNA, 15 bp, Homo sapiens
tggatacagctgctt

SEQ ID NO: 5954548 - DNA, 13 bp, Homo sapiens
tggatacataaag

SEQ ID NO: 5954549 - DNA, 14 bp, Homo sapiens
tggatacataaaga

SEQ ID NO: 5954550 - DNA, 13 bp, Homo sapiens
tggatacatctgc

SEQ ID NO: 5954551 - DNA, 15 bp, Homo sapiens
tggatacatctgctg

SEQ ID NO: 5954552 - DNA, 17 bp, Homo sapiens
tggataccagctcaggg

SEQ ID NO: 5954553 - DNA, 19 bp, Homo sapiens
tggcactattataagtgct

SEQ ID NO: 5954554 - DNA, 21 bp, Homo sapiens
tggcactcaacaatggttgaa

SEQ ID NO: 5954555 - DNA, 15 bp, Homo sapiens
tggcactcaactctg

SEQ ID NO: 5954556 - DNA, 19 bp, Homo sapiens
tggcactcacagacctgga

SEQ ID NO: 5954557 - DNA, 22 bp, Homo sapiens
tggcactcacagacctggagcc

SEQ ID NO: 5954558 - DNA, 17 bp, Homo sapiens
tggcactcaggtgctga

SEQ ID NO: 5954559 - DNA, 18 bp, Homo sapiens
tggcactcaggtgctgaa

SEQ ID NO: 5954560 - DNA, 15 bp, Homo sapiens
tggcactccctccag

SEQ ID NO: 5954561 - DNA, 17 bp, Homo sapiens
tggcactccctccagca

SEQ ID NO: 5954562 - DNA, 14 bp, Homo sapiens
tggcactcgctgta

SEQ ID NO: 5954563 - DNA, 14 bp, Homo sapiens
tggcactgaagtgg

SEQ ID NO: 5954564 - DNA, 11 bp, Homo sapiens
tggcactgaca

SEQ ID NO: 5954565 - DNA, 22 bp, Homo sapiens
tggcactgaccgccgcttccag

SEQ ID NO: 5954566 - DNA, 19 bp, Homo sapiens
tggcactgactgggcatag

SEQ ID NO: 5954567 - DNA, 15 bp, Homo sapiens
tggcactgagccccc

SEQ ID NO: 5954568 - DNA, 23 bp, Homo sapiens
tggcactgccaccagcaatgccc

SEQ ID NO: 5954569 - DNA, 13 bp, Homo sapiens
tggcactgccatg

SEQ ID NO: 5954570 - DNA, 18 bp, Homo sapiens
tggcactgcttccagtga

SEQ ID NO: 5954571 - DNA, 19 bp, Homo sapiens
tggcactgcttccagtgag

SEQ ID NO: 5954572 - DNA, 22 bp, Homo sapiens
tggcactgcttccagtgaggct

SEQ ID NO: 5954573 - DNA, 23 bp, Homo sapiens
tggcactgcttgaggaggggcac

SEQ ID NO: 5954574 - DNA, 13 bp, Homo sapiens
tggcactggcaaa

SEQ ID NO: 5954575 - DNA, 13 bp, Homo sapiens
tggcactggccac

SEQ ID NO: 5954576 - DNA, 19 bp, Homo sapiens
tggcactggggaaacataa

SEQ ID NO: 5954577 - DNA, 20 bp, Homo sapiens
tggcactggggcacttggca

SEQ ID NO: 5954578 - DNA, 21 bp, Homo sapiens
tggcactggtaggttgggaca

SEQ ID NO: 5954579 - DNA, 12 bp, Homo sapiens
tggcactgtcca

SEQ ID NO: 5954580 - DNA, 14 bp, Homo sapiens
tggcactgtccagg

SEQ ID NO: 5954581 - DNA, 15 bp, Homo sapiens
tggcactgtccaggg

SEQ ID NO: 5954582 - DNA, 19 bp, Homo sapiens
tggcactgtccagggccca

SEQ ID NO: 5954583 - DNA, 13 bp, Homo sapiens
tggcacttaagtg

SEQ ID NO: 5954584 - DNA, 20 bp, Homo sapiens
tggcacttaagtgcactttt

SEQ ID NO: 5954585 - DNA, 23 bp, Homo sapiens
tggcacttactggtccttaccag

SEQ ID NO: 5954586 - DNA, 23 bp, Homo sapiens
tggcacttagcccaagaggtctg

SEQ ID NO: 5954587 - DNA, 18 bp, Homo sapiens
tggcacttccacctccag

SEQ ID NO: 5954588 - DNA, 20 bp, Homo sapiens
tggcacttccacctccagcc

SEQ ID NO: 5954589 - DNA, 15 bp, Homo sapiens
tggcacttctgcctt

SEQ ID NO: 5954590 - DNA, 17 bp, Homo sapiens
tggcacttgcatctgtg

SEQ ID NO: 5954591 - DNA, 14 bp, Homo sapiens
tggcacttgcctgg

SEQ ID NO: 5954592 - DNA, 15 bp, Homo sapiens
tggcacttgcctggg

SEQ ID NO: 5954593 - DNA, 16 bp, Homo sapiens
tggcacttgcctgggt

SEQ ID NO: 5954594 - DNA, 17 bp, Homo sapiens
tggcacttgcctgggtc

SEQ ID NO: 5954595 - DNA, 19 bp, Homo sapiens
tggcacttgcctgtagtct

SEQ ID NO: 5954596 - DNA, 16 bp, Homo sapiens
tggcacttgggggact

SEQ ID NO: 5954597 - DNA, 11 bp, Homo sapiens
tggcacttgta

SEQ ID NO: 5954598 - DNA, 20 bp, Homo sapiens
tggcactttgttttcaagat

SEQ ID NO: 5954599 - DNA, 19 bp, Homo sapiens
tggcactttttcgtgtgga

SEQ ID NO: 5954600 - DNA, 13 bp, Homo sapiens
tggcagaaaagag

SEQ ID NO: 5954601 - DNA, 17 bp, Homo sapiens
tggcagaaaagaggaga

SEQ ID NO: 5954602 - DNA, 19 bp, Homo sapiens
tggcagaaaagaggagacc

SEQ ID NO: 5954603 - DNA, 22 bp, Homo sapiens
tggcagaaaagaggagaccctg

SEQ ID NO: 5954604 - DNA, 23 bp, Homo sapiens
tggcagaaaagaggagaccctgg

SEQ ID NO: 5954605 - DNA, 24 bp, Homo sapiens
tggcagaaaagaggagaccctgga

SEQ ID NO: 5954606 - DNA, 18 bp, Homo sapiens
tggcagaaacaggaggct

SEQ ID NO: 5954607 - DNA, 19 bp, Homo sapiens
tggcagaaagatggagagg

SEQ ID NO: 5954608 - DNA, 21 bp, Homo sapiens
tggcagaaagatggagaggca

SEQ ID NO: 5954609 - DNA, 20 bp, Homo sapiens
tggcagaaatcccagttcat

SEQ ID NO: 5954610 - DNA, 17 bp, Homo sapiens
tggcagaactcccacaa

SEQ ID NO: 5954611 - DNA, 20 bp, Homo sapiens
tggcagaactgagctcctct

SEQ ID NO: 5954612 - DNA, 15 bp, Homo sapiens
tggcagaactgctgg

SEQ ID NO: 5954613 - DNA, 19 bp, Homo sapiens
tggcagaagcagttgcaat

SEQ ID NO: 5954614 - DNA, 21 bp, Homo sapiens
tggcagaagggaattgctcag

SEQ ID NO: 5954615 - DNA, 18 bp, Homo sapiens
tggcagaagggagcagca

SEQ ID NO: 5954616 - DNA, 15 bp, Homo sapiens
tggcagaatgaaaat

SEQ ID NO: 5954617 - DNA, 22 bp, Homo sapiens
tggcagaatggggtgcatgaag

SEQ ID NO: 5954618 - DNA, 22 bp, Homo sapiens
tggcagacaaacagaccataaa

SEQ ID NO: 5954619 - DNA, 12 bp, Homo sapiens
tggcagacagac

SEQ ID NO: 5954620 - DNA, 15 bp, Homo sapiens
tggcagacagccgtt

SEQ ID NO: 5954621 - DNA, 18 bp, Homo sapiens
tggcagaccatctccagc

SEQ ID NO: 5954622 - DNA, 19 bp, Homo sapiens
tggcagaccgggggccaga

SEQ ID NO: 5954623 - DNA, 20 bp, Homo sapiens
tggcagactcaaggggctgg

SEQ ID NO: 5954624 - DNA, 21 bp, Homo sapiens
tggcagactcaaggggctgga

SEQ ID NO: 5954625 - DNA, 22 bp, Homo sapiens
tggcagactcaaggggctggaa

SEQ ID NO: 5954626 - DNA, 22 bp, Homo sapiens
tggcagactctttaataaattg

SEQ ID NO: 5954627 - DNA, 14 bp, Homo sapiens
tggcagagaagaga

SEQ ID NO: 5954628 - DNA, 19 bp, Homo sapiens
tggcagagaagatgaaatt

SEQ ID NO: 5954629 - DNA, 12 bp, Homo sapiens
tggcagagaagg

SEQ ID NO: 5954630 - DNA, 19 bp, Homo sapiens
tggcagagaaggcctcttg

SEQ ID NO: 5954631 - DNA, 18 bp, Homo sapiens
tggcagagacagtgggca

SEQ ID NO: 5954632 - DNA, 21 bp, Homo sapiens
tggcagagaccataagagaaa

SEQ ID NO: 5954633 - DNA, 18 bp, Homo sapiens
tggcagagagagagaaag

SEQ ID NO: 5954634 - DNA, 19 bp, Homo sapiens
tggcagagagcacagtgat

SEQ ID NO: 5954635 - DNA, 18 bp, Homo sapiens
tggcagagatgcctccct

SEQ ID NO: 5954636 - DNA, 19 bp, Homo sapiens
tggcagagatgcctccctg

SEQ ID NO: 5954637 - DNA, 17 bp, Homo sapiens
tggcagagcacagccca

SEQ ID NO: 5954638 - DNA, 21 bp, Homo sapiens
tggcagagcagtctaaacaga

SEQ ID NO: 5954639 - DNA, 20 bp, Homo sapiens
tggcagagcttttgcatttc

SEQ ID NO: 5954640 - DNA, 12 bp, Homo sapiens
tggcagagggga

SEQ ID NO: 5954641 - DNA, 15 bp, Homo sapiens
tggcagaggtgcaag

SEQ ID NO: 5954642 - DNA, 15 bp, Homo sapiens
tggcagagtcctgga

SEQ ID NO: 5954643 - DNA, 16 bp, Homo sapiens
tggcagagttgtaaat

SEQ ID NO: 5954644 - DNA, 23 bp, Homo sapiens
tggcagagttgtaaatatataaa

SEQ ID NO: 5954645 - DNA, 17 bp, Homo sapiens
tggcagagtttgtgtgt

SEQ ID NO: 5954646 - DNA, 20 bp, Homo sapiens
tggcagatactccttttgcc

SEQ ID NO: 5954647 - DNA, 13 bp, Homo sapiens
tggcagatgagct

SEQ ID NO: 5954648 - DNA, 11 bp, Homo sapiens
tggcagatgat

SEQ ID NO: 5954649 - DNA, 13 bp, Homo sapiens
tggcagatgattt

SEQ ID NO: 5954650 - DNA, 20 bp, Homo sapiens
tggcagatgatttgggcaga

SEQ ID NO: 5954651 - DNA, 16 bp, Homo sapiens
tggcagatgcacatgt

SEQ ID NO: 5954652 - DNA, 22 bp, Homo sapiens
tggcagatgggggcctctctgg

SEQ ID NO: 5954653 - DNA, 20 bp, Homo sapiens
tggcagatgtcttccctggg

SEQ ID NO: 5954654 - DNA, 20 bp, Homo sapiens
tggcagattcccactgccgc

SEQ ID NO: 5954655 - DNA, 14 bp, Homo sapiens
tggcagcaaaggaa

SEQ ID NO: 5954656 - DNA, 20 bp, Homo sapiens
tggcagcaacggcacagcta

SEQ ID NO: 5954657 - DNA, 12 bp, Homo sapiens
tggcagcaagca

SEQ ID NO: 5954658 - DNA, 20 bp, Homo sapiens
tggcagcaatggcgctgtgc

SEQ ID NO: 5954659 - DNA, 16 bp, Homo sapiens
tggcagcacagcccag

SEQ ID NO: 5954660 - DNA, 22 bp, Homo sapiens
tggcagcacagctactcagatc

SEQ ID NO: 5954661 - DNA, 17 bp, Homo sapiens
tggcagcacccactcag

SEQ ID NO: 5954662 - DNA, 20 bp, Homo sapiens
tggcagcaccgcctcttccc

SEQ ID NO: 5954663 - DNA, 18 bp, Homo sapiens
tggcagcacgcaggcggg

SEQ ID NO: 5954664 - DNA, 23 bp, Homo sapiens
tggcagcacggcccggcccctca

SEQ ID NO: 5954665 - DNA, 20 bp, Homo sapiens
tggcagcagagtgtggcctt

SEQ ID NO: 5954666 - DNA, 13 bp, Homo sapiens
tggcagcagccag

SEQ ID NO: 5954667 - DNA, 15 bp, Homo sapiens
tggcagcagccaggg

SEQ ID NO: 5954668 - DNA, 12 bp, Homo sapiens
tggcagcagccc

SEQ ID NO: 5954669 - DNA, 21 bp, Homo sapiens
tggcagcaggagggactctgt

SEQ ID NO: 5954670 - DNA, 17 bp, Homo sapiens
tggcagcaggtgctgct

SEQ ID NO: 5954671 - DNA, 14 bp, Homo sapiens
tggcagcagtgaag

SEQ ID NO: 5954672 - DNA, 18 bp, Homo sapiens
tggcagcagttccatgaa

SEQ ID NO: 5954673 - DNA, 13 bp, Homo sapiens
tggcagcataaag

SEQ ID NO: 5954674 - DNA, 20 bp, Homo sapiens
tggcagcattcagaacttca

SEQ ID NO: 5954675 - DNA, 14 bp, Homo sapiens
tggcagccaaggaa

SEQ ID NO: 5954676 - DNA, 15 bp, Homo sapiens
tggcagccacacgca

SEQ ID NO: 5954677 - DNA, 22 bp, Homo sapiens
tggcagccacacgcaggcggcc

SEQ ID NO: 5954678 - DNA, 18 bp, Homo sapiens
tggcagccacacttctca

SEQ ID NO: 5954679 - DNA, 16 bp, Homo sapiens
tggcagccaccccctc

SEQ ID NO: 5954680 - DNA, 16 bp, Homo sapiens
tggcagccatgataat

SEQ ID NO: 5954681 - DNA, 12 bp, Homo sapiens
tggcagccatgc

SEQ ID NO: 5954682 - DNA, 21 bp, Homo sapiens
tggcagccatgcctcatgcca

SEQ ID NO: 5954683 - DNA, 11 bp, Homo sapiens
tggcagcccag

SEQ ID NO: 5954684 - DNA, 12 bp, Homo sapiens
tggcagcccagc

SEQ ID NO: 5954685 - DNA, 15 bp, Homo sapiens
tggcagcccagccag

SEQ ID NO: 5954686 - DNA, 14 bp, Homo sapiens
tggcagccccagca

SEQ ID NO: 5954687 - DNA, 12 bp, Homo sapiens
tggcagcccctg

SEQ ID NO: 5954688 - DNA, 22 bp, Homo sapiens
tggcagcccctgttttctgctg

SEQ ID NO: 5954689 - DNA, 20 bp, Homo sapiens
tggcagcccgcatcagctgc

SEQ ID NO: 5954690 - DNA, 15 bp, Homo sapiens
tggcagcccggctgc

SEQ ID NO: 5954691 - DNA, 11 bp, Homo sapiens
tggcagccctg

SEQ ID NO: 5954692 - DNA, 12 bp, Homo sapiens
tggcagccctgt

SEQ ID NO: 5954693 - DNA, 18 bp, Homo sapiens
tggcagccgtgccttcag

SEQ ID NO: 5954694 - DNA, 20 bp, Homo sapiens
tggcagccgtgccttcagct

SEQ ID NO: 5954695 - DNA, 22 bp, Homo sapiens
tggcagccgtgccttcagctct

SEQ ID NO: 5954696 - DNA, 12 bp, Homo sapiens
tggcagcctcag

SEQ ID NO: 5954697 - DNA, 13 bp, Homo sapiens
tggcagcctcaga

SEQ ID NO: 5954698 - DNA, 17 bp, Homo sapiens
tggcagcctcagggctt

SEQ ID NO: 5954699 - DNA, 22 bp, Homo sapiens
tggcagcctcagggcttcctta

SEQ ID NO: 5954700 - DNA, 21 bp, Homo sapiens
tggcagcctcccatccagggc

SEQ ID NO: 5954701 - DNA, 15 bp, Homo sapiens
tggcagcctcttcaa

SEQ ID NO: 5954702 - DNA, 17 bp, Homo sapiens
tggcagcctgcacctgg

SEQ ID NO: 5954703 - DNA, 14 bp, Homo sapiens
tggcagcctgctgc

SEQ ID NO: 5954704 - DNA, 11 bp, Homo sapiens
tggcagccttg

SEQ ID NO: 5954705 - DNA, 17 bp, Homo sapiens
tggcagccttggcaaac

SEQ ID NO: 5954706 - DNA, 12 bp, Homo sapiens
tggcagccttgt

SEQ ID NO: 5954707 - DNA, 14 bp, Homo sapiens
tggcagcgcctccc

SEQ ID NO: 5954708 - DNA, 15 bp, Homo sapiens
tggcagctagactgg

SEQ ID NO: 5954709 - DNA, 17 bp, Homo sapiens
tggcagctagactggag

SEQ ID NO: 5954710 - DNA, 21 bp, Homo sapiens
tggcagctcacctctcccttg

SEQ ID NO: 5954711 - DNA, 15 bp, Homo sapiens
tggcagctcagagag

SEQ ID NO: 5954712 - DNA, 18 bp, Homo sapiens
tggcagctcagagagggt

SEQ ID NO: 5954713 - DNA, 16 bp, Homo sapiens
tggcagctcctctcct

SEQ ID NO: 5954714 - DNA, 13 bp, Homo sapiens
tggcagctctagc

SEQ ID NO: 5954715 - DNA, 12 bp, Homo sapiens
tggcagctgccc

SEQ ID NO: 5954716 - DNA, 16 bp, Homo sapiens
tggcagctgccccagg

SEQ ID NO: 5954717 - DNA, 14 bp, Homo sapiens
tggcagctgcccct

SEQ ID NO: 5954718 - DNA, 18 bp, Homo sapiens
tggcagctgcccctcctg

SEQ ID NO: 5954719 - DNA, 18 bp, Homo sapiens
tggcagctgcccctggca

SEQ ID NO: 5954720 - DNA, 19 bp, Homo sapiens
tggcagctgcccctggcac

SEQ ID NO: 5954721 - DNA, 20 bp, Homo sapiens
tggcagctgcccctggcacc

SEQ ID NO: 5954722 - DNA, 22 bp, Homo sapiens
tggcagctgcggtccacccagg

SEQ ID NO: 5954723 - DNA, 23 bp, Homo sapiens
tggcagctgcggtccacccagga

SEQ ID NO: 5954724 - DNA, 14 bp, Homo sapiens
tggcagctgctgtg

SEQ ID NO: 5954725 - DNA, 11 bp, Homo sapiens
tggcagctgga

SEQ ID NO: 5954726 - DNA, 18 bp, Homo sapiens
tggcagctggaccatctc

SEQ ID NO: 5954727 - DNA, 21 bp, Homo sapiens
tggcagctggaccatctctgt

SEQ ID NO: 5954728 - DNA, 12 bp, Homo sapiens
tggcagctgggc

SEQ ID NO: 5954729 - DNA, 15 bp, Homo sapiens
tggcagctgggccca

SEQ ID NO: 5954730 - DNA, 16 bp, Homo sapiens
tggcagctgggcccac

SEQ ID NO: 5954731 - DNA, 18 bp, Homo sapiens
tggccctctcccttaccc

SEQ ID NO: 5954732 - DNA, 12 bp, Homo sapiens
tggccctctggt

SEQ ID NO: 5954733 - DNA, 15 bp, Homo sapiens
tggccctctggtaga

SEQ ID NO: 5954734 - DNA, 13 bp, Homo sapiens
tggccctcttctt

SEQ ID NO: 5954735 - DNA, 21 bp, Homo sapiens
tggccctgacaaaaaggtgct

SEQ ID NO: 5954736 - DNA, 17 bp, Homo sapiens
tggccctgacttctgga

SEQ ID NO: 5954737 - DNA, 18 bp, Homo sapiens
tggccctgaggtgtgggg

SEQ ID NO: 5954738 - DNA, 15 bp, Homo sapiens
tggccctgcaaaagg

SEQ ID NO: 5954739 - DNA, 21 bp, Homo sapiens
tggccctgccatcttcccagc

SEQ ID NO: 5954740 - DNA, 17 bp, Homo sapiens
tggccctgcccagccca

SEQ ID NO: 5954741 - DNA, 13 bp, Homo sapiens
tggccctgcccct

SEQ ID NO: 5954742 - DNA, 17 bp, Homo sapiens
tggccctgcccctcccc

SEQ ID NO: 5954743 - DNA, 12 bp, Homo sapiens
tggccctgccct

SEQ ID NO: 5954744 - DNA, 15 bp, Homo sapiens
tggccctgccctccc

SEQ ID NO: 5954745 - DNA, 22 bp, Homo sapiens
tggccctgccctcccccacggc

SEQ ID NO: 5954746 - DNA, 18 bp, Homo sapiens
tggccctgccctctcctt

SEQ ID NO: 5954747 - DNA, 21 bp, Homo sapiens
tggccctgccctctccttcct

SEQ ID NO: 5954748 - DNA, 13 bp, Homo sapiens
tggccctgccctg

SEQ ID NO: 5954749 - DNA, 14 bp, Homo sapiens
tggccctgccctgg

SEQ ID NO: 5954750 - DNA, 13 bp, Homo sapiens
tggccctgccctt

SEQ ID NO: 5954751 - DNA, 11 bp, Homo sapiens
tggccctgcct

SEQ ID NO: 5954752 - DNA, 12 bp, Homo sapiens
tggccctgcctt

SEQ ID NO: 5954753 - DNA, 16 bp, Homo sapiens
tggccctgccttcttc

SEQ ID NO: 5954754 - DNA, 17 bp, Homo sapiens
tggccctgcgccctgtg

SEQ ID NO: 5954755 - DNA, 13 bp, Homo sapiens
tggccctgctgcc

SEQ ID NO: 5954756 - DNA, 14 bp, Homo sapiens
tggccctgcttcct

SEQ ID NO: 5954757 - DNA, 13 bp, Homo sapiens
tggccctgctttc

SEQ ID NO: 5954758 - DNA, 20 bp, Homo sapiens
tggccctgctttctacgcca

SEQ ID NO: 5954759 - DNA, 19 bp, Homo sapiens
tggccctggacacagccca

SEQ ID NO: 5954760 - DNA, 12 bp, Homo sapiens
tggccctggagc

SEQ ID NO: 5954761 - DNA, 15 bp, Homo sapiens
tggccctggagccag

SEQ ID NO: 5954762 - DNA, 17 bp, Homo sapiens
tggccctggagccaggg

SEQ ID NO: 5954763 - DNA, 19 bp, Homo sapiens
tggccctggagccagggca

SEQ ID NO: 5954764 - DNA, 15 bp, Homo sapiens
tggccctggcctgct

SEQ ID NO: 5954765 - DNA, 16 bp, Homo sapiens
tggccctggcctgctg

SEQ ID NO: 5954766 - DNA, 20 bp, Homo sapiens
tggccctggcgggtggctgc

SEQ ID NO: 5954767 - DNA, 22 bp, Homo sapiens
tggccctgggagaatcgctcct

SEQ ID NO: 5954768 - DNA, 23 bp, Homo sapiens
tggccctgggagaatcgctcctg

SEQ ID NO: 5954769 - DNA, 12 bp, Homo sapiens
tggccctgggcg

SEQ ID NO: 5954770 - DNA, 22 bp, Homo sapiens
tggccctggggaagaggccttg

SEQ ID NO: 5954771 - DNA, 13 bp, Homo sapiens
tggccctggggat

SEQ ID NO: 5954772 - DNA, 23 bp, Homo sapiens
tggccctggggatcttcccacag

SEQ ID NO: 5954773 - DNA, 15 bp, Homo sapiens
tggccctggggcctg

SEQ ID NO: 5954774 - DNA, 12 bp, Homo sapiens
tggccctggggg

SEQ ID NO: 5954775 - DNA, 18 bp, Homo sapiens
tggccctggggtgtgtct

SEQ ID NO: 5954776 - DNA, 20 bp, Homo sapiens
tggccctgtagttaggcctg

SEQ ID NO: 5954777 - DNA, 16 bp, Homo sapiens
tggccctgtcccaggc

SEQ ID NO: 5954778 - DNA, 20 bp, Homo sapiens
tggccctgtccctcccacct

SEQ ID NO: 5954779 - DNA, 23 bp, Homo sapiens
tggccctgtccctcccacctctg

SEQ ID NO: 5954780 - DNA, 16 bp, Homo sapiens
tggccctgtctggagg

SEQ ID NO: 5954781 - DNA, 12 bp, Homo sapiens
tggccctgtgca

SEQ ID NO: 5954782 - DNA, 13 bp, Homo sapiens
tggccctgtgcct

SEQ ID NO: 5954783 - DNA, 15 bp, Homo sapiens
tggccctgtgcctgg

SEQ ID NO: 5954784 - DNA, 13 bp, Homo sapiens
tggccctgtggga

SEQ ID NO: 5954785 - DNA, 16 bp, Homo sapiens
tggccctgtgggagtc

SEQ ID NO: 5954786 - DNA, 21 bp, Homo sapiens
tggccctgtgggagtccactt

SEQ ID NO: 5954787 - DNA, 22 bp, Homo sapiens
tggccctgtgggagtccacttt

SEQ ID NO: 5954788 - DNA, 12 bp, Homo sapiens
tggccctgtgta

SEQ ID NO: 5954789 - DNA, 19 bp, Homo sapiens
tggccctgttctcctcccc

SEQ ID NO: 5954790 - DNA, 19 bp, Homo sapiens
tggcccttaaacaactgca

SEQ ID NO: 5954791 - DNA, 15 bp, Homo sapiens
tggcccttacacact

SEQ ID NO: 5954792 - DNA, 17 bp, Homo sapiens
tggcccttacacactca

SEQ ID NO: 5954793 - DNA, 23 bp, Homo sapiens
tggcccttacacactcaggcctg

SEQ ID NO: 5954794 - DNA, 21 bp, Homo sapiens
tggcccttatgactgccaaga

SEQ ID NO: 5954795 - DNA, 16 bp, Homo sapiens
tggcccttcagtctgc

SEQ ID NO: 5954796 - DNA, 21 bp, Homo sapiens
tggcccttcctcctccaccac

SEQ ID NO: 5954797 - DNA, 21 bp, Homo sapiens
tggcccttcctggacagctgt

SEQ ID NO: 5954798 - DNA, 21 bp, Homo sapiens
tggcccttcctggactggccc

SEQ ID NO: 5954799 - DNA, 22 bp, Homo sapiens
tggcccttcctggactggccct

SEQ ID NO: 5954800 - DNA, 15 bp, Homo sapiens
tggcccttctgccct

SEQ ID NO: 5954801 - DNA, 19 bp, Homo sapiens
tggcccttctgtccaccag

SEQ ID NO: 5954802 - DNA, 16 bp, Homo sapiens
tggcccttgatgccca

SEQ ID NO: 5954803 - DNA, 16 bp, Homo sapiens
tggcccttgccggggc

SEQ ID NO: 5954804 - DNA, 22 bp, Homo sapiens
tggcccttgcctttgtggcctt

SEQ ID NO: 5954805 - DNA, 12 bp, Homo sapiens
tggcccttggaa

SEQ ID NO: 5954806 - DNA, 15 bp, Homo sapiens
tggcccttgtttaca

SEQ ID NO: 5954807 - DNA, 22 bp, Homo sapiens
tggccctttcacccctcttccc

SEQ ID NO: 5954808 - DNA, 23 bp, Homo sapiens
tggccctttcacccctcttccca

SEQ ID NO: 5954809 - DNA, 18 bp, Homo sapiens
tggccctttccccttccc

SEQ ID NO: 5954810 - DNA, 18 bp, Homo sapiens
tggccctttccttccaga

SEQ ID NO: 5954811 - DNA, 13 bp, Homo sapiens
tggcccttttata

SEQ ID NO: 5954812 - DNA, 18 bp, Homo sapiens
tggccgaagccccttgga

SEQ ID NO: 5954813 - DNA, 20 bp, Homo sapiens
tggccgacggcggcggccct

SEQ ID NO: 5954814 - DNA, 21 bp, Homo sapiens
tggccgacggcggcggccctc

SEQ ID NO: 5954815 - DNA, 17 bp, Homo sapiens
tggccgactcagggacc

SEQ ID NO: 5954816 - DNA, 15 bp, Homo sapiens
tggccgagctcctgg

SEQ ID NO: 5954817 - DNA, 22 bp, Homo sapiens
tggccgagctcctggggagctc

SEQ ID NO: 5954818 - DNA, 19 bp, Homo sapiens
tggccgagtccaagctggg

SEQ ID NO: 5954819 - DNA, 14 bp, Homo sapiens
tggccgatgagctg

SEQ ID NO: 5954820 - DNA, 16 bp, Homo sapiens
tggccgcaacttccca

SEQ ID NO: 5954821 - DNA, 20 bp, Homo sapiens
tggccgcaacttcccaggcc

SEQ ID NO: 5954822 - DNA, 17 bp, Homo sapiens
tggccgcaagcgcaggg

SEQ ID NO: 5954823 - DNA, 19 bp, Homo sapiens
tggccgcaagcgcagggag

SEQ ID NO: 5954824 - DNA, 22 bp, Homo sapiens
tggccgcaagcgcagggaggat

SEQ ID NO: 5954825 - DNA, 18 bp, Homo sapiens
tggccgcaagtccccagc

SEQ ID NO: 5954826 - DNA, 19 bp, Homo sapiens
tggccgcaagtccccagcc

SEQ ID NO: 5954827 - DNA, 22 bp, Homo sapiens
tggccgcaagtccccagcccct

SEQ ID NO: 5954828 - DNA, 21 bp, Homo sapiens
tggccgcacctaaagcagcca

SEQ ID NO: 5954829 - DNA, 12 bp, Homo sapiens
tggccgccaccc

SEQ ID NO: 5954830 - DNA, 18 bp, Homo sapiens
tggccgccatctgcgcag

SEQ ID NO: 5954831 - DNA, 20 bp, Homo sapiens
tggccgccatctgcgcaggg

SEQ ID NO: 5954832 - DNA, 13 bp, Homo sapiens
tggccgccatgct

SEQ ID NO: 5954833 - DNA, 13 bp, Homo sapiens
tggccgccccctg

SEQ ID NO: 5954834 - DNA, 12 bp, Homo sapiens
tggccgcctcac

SEQ ID NO: 5954835 - DNA, 13 bp, Homo sapiens
tggccgcctccag

SEQ ID NO: 5954836 - DNA, 17 bp, Homo sapiens
tggccgcctggcaggtg

SEQ ID NO: 5954837 - DNA, 19 bp, Homo sapiens
tggccgcgtttagaccaag

SEQ ID NO: 5954838 - DNA, 15 bp, Homo sapiens
tggccgctcctccct

SEQ ID NO: 5954839 - DNA, 19 bp, Homo sapiens
tggccgctgagtggcaggg

SEQ ID NO: 5954840 - DNA, 21 bp, Homo sapiens
tggccgctgcagtcagcacag

SEQ ID NO: 5954841 - DNA, 18 bp, Homo sapiens
tggccgctgctgtgacag

SEQ ID NO: 5954842 - DNA, 20 bp, Homo sapiens
tggccgctgctgtgacaggc

SEQ ID NO: 5954843 - DNA, 23 bp, Homo sapiens
tggccgctgggagaaaagccaga

SEQ ID NO: 5954844 - DNA, 22 bp, Homo sapiens
tggccgcttccctacccacagg

SEQ ID NO: 5954845 - DNA, 22 bp, Homo sapiens
tggccgcttctccccagagctg

SEQ ID NO: 5954846 - DNA, 19 bp, Homo sapiens
tggccggaaaacaagcctg

SEQ ID NO: 5954847 - DNA, 16 bp, Homo sapiens
tggccggacacccgac

SEQ ID NO: 5954848 - DNA, 13 bp, Homo sapiens
tggccggccagcc

SEQ ID NO: 5954849 - DNA, 14 bp, Homo sapiens
tggccggccagcca

SEQ ID NO: 5954850 - DNA, 19 bp, Homo sapiens
tggccggccagccagccac

SEQ ID NO: 5954851 - DNA, 20 bp, Homo sapiens
tggccggccagccagccact

SEQ ID NO: 5954852 - DNA, 23 bp, Homo sapiens
tggccggcccacgtcctgggtgc

SEQ ID NO: 5954853 - DNA, 17 bp, Homo sapiens
tggccggccgcccacat

SEQ ID NO: 5954854 - DNA, 12 bp, Homo sapiens
tggccggcctcc

SEQ ID NO: 5954855 - DNA, 13 bp, Homo sapiens
tggccggctctgg

SEQ ID NO: 5954856 - DNA, 15 bp, Homo sapiens
tggccggctgtgctc

SEQ ID NO: 5954857 - DNA, 17 bp, Homo sapiens
tggccggctgtgctcag

SEQ ID NO: 5954858 - DNA, 17 bp, Homo sapiens
tggccgggaccccgagc

SEQ ID NO: 5954859 - DNA, 16 bp, Homo sapiens
tggccgggactgctgc

SEQ ID NO: 5954860 - DNA, 17 bp, Homo sapiens
tggccgggactgctgct

SEQ ID NO: 5954861 - DNA, 14 bp, Homo sapiens
tggccgggcaggcg

SEQ ID NO: 5954862 - DNA, 17 bp, Homo sapiens
tggccgggctgctgctg

SEQ ID NO: 5954863 - DNA, 19 bp, Homo sapiens
tggccgggctgctgctgat

SEQ ID NO: 5954864 - DNA, 17 bp, Homo sapiens
tggccggggctgaagcc

SEQ ID NO: 5954865 - DNA, 17 bp, Homo sapiens
tggccggggtccaggca

SEQ ID NO: 5954866 - DNA, 19 bp, Homo sapiens
tggccgggtaaagcaaggg

SEQ ID NO: 5954867 - DNA, 17 bp, Homo sapiens
tggccgggtgcggtggc

SEQ ID NO: 5954868 - DNA, 21 bp, Homo sapiens
tggccgggttggaggcctcac

SEQ ID NO: 5954869 - DNA, 22 bp, Homo sapiens
tggccggtaggctgctggcgcc

SEQ ID NO: 5954870 - DNA, 21 bp, Homo sapiens
tggccggtgccagctgccctt

SEQ ID NO: 5954871 - DNA, 12 bp, Homo sapiens
tggccggtgctg

SEQ ID NO: 5954872 - DNA, 14 bp, Homo sapiens
tggccggtgctggg

SEQ ID NO: 5954873 - DNA, 23 bp, Homo sapiens
tggccggtgctgggttcccactc

SEQ ID NO: 5954874 - DNA, 21 bp, Homo sapiens
tggccggttgccactctcctc

SEQ ID NO: 5954875 - DNA, 19 bp, Homo sapiens
tggccgtatctgagggctg

SEQ ID NO: 5954876 - DNA, 16 bp, Homo sapiens
tggccgtcctgagggg

SEQ ID NO: 5954877 - DNA, 14 bp, Homo sapiens
tggccgtctcctcc

SEQ ID NO: 5954878 - DNA, 15 bp, Homo sapiens
tggccgtctcctccc

SEQ ID NO: 5954879 - DNA, 21 bp, Homo sapiens
tggccgtgaatgggtgcccac

SEQ ID NO: 5954880 - DNA, 20 bp, Homo sapiens
tggccgtggagtcgagctgg

SEQ ID NO: 5954881 - DNA, 17 bp, Homo sapiens
tggccgtggatgcgcag

SEQ ID NO: 5954882 - DNA, 15 bp, Homo sapiens
tggccgtggctccag

SEQ ID NO: 5954883 - DNA, 16 bp, Homo sapiens
tggccgtggctccaga

SEQ ID NO: 5954884 - DNA, 19 bp, Homo sapiens
tggccgtgggcctggggta

SEQ ID NO: 5954885 - DNA, 16 bp, Homo sapiens
tggccgtggtccagct

SEQ ID NO: 5954886 - DNA, 19 bp, Homo sapiens
tggccgtggtccagctctt

SEQ ID NO: 5954887 - DNA, 22 bp, Homo sapiens
tggccgtggtccagctcttggc

SEQ ID NO: 5954888 - DNA, 14 bp, Homo sapiens
tggccgttatctgg

SEQ ID NO: 5954889 - DNA, 16 bp, Homo sapiens
tggccgttcagcctgt

SEQ ID NO: 5954890 - DNA, 19 bp, Homo sapiens
tggccgttcagcctgtctc

SEQ ID NO: 5954891 - DNA, 19 bp, Homo sapiens
tggccgttgatgttggctg

SEQ ID NO: 5954892 - DNA, 21 bp, Homo sapiens
tggccgttgatgttggctggg

SEQ ID NO: 5954893 - DNA, 17 bp, Homo sapiens
tggccgttgcctctctg

SEQ ID NO: 5954894 - DNA, 15 bp, Homo sapiens
tggcctaaaatcttg

SEQ ID NO: 5954895 - DNA, 16 bp, Homo sapiens
tggcctaacctgccga

SEQ ID NO: 5954896 - DNA, 21 bp, Homo sapiens
tggcctaagaggctgccctcc

SEQ ID NO: 5954897 - DNA, 17 bp, Homo sapiens
tggcctaagtgcctctt

SEQ ID NO: 5954898 - DNA, 19 bp, Homo sapiens
tggcctaagtgcctcttct

SEQ ID NO: 5954899 - DNA, 18 bp, Homo sapiens
tggcctaatattgaaaat

SEQ ID NO: 5954900 - DNA, 21 bp, Homo sapiens
tggcctaatattgaaaatgtc

SEQ ID NO: 5954901 - DNA, 15 bp, Homo sapiens
tggcctaatcacctt

SEQ ID NO: 5954902 - DNA, 15 bp, Homo sapiens
tggcctaatccacct

SEQ ID NO: 5954903 - DNA, 16 bp, Homo sapiens
tggcctaatccacctg

SEQ ID NO: 5954904 - DNA, 16 bp, Homo sapiens
tggcctaatttacaag

SEQ ID NO: 5954905 - DNA, 17 bp, Homo sapiens
tggcctacattctttat

SEQ ID NO: 5954906 - DNA, 12 bp, Homo sapiens
tggcctaccaca

SEQ ID NO: 5954907 - DNA, 17 bp, Homo sapiens
tggcctaccacagctgc

SEQ ID NO: 5954908 - DNA, 14 bp, Homo sapiens
tggcctagaaaggg

SEQ ID NO: 5954909 - DNA, 15 bp, Homo sapiens
tggctccaggccaaa

SEQ ID NO: 5954910 - DNA, 18 bp, Homo sapiens
tggctccaggctccaggc

SEQ ID NO: 5954911 - DNA, 22 bp, Homo sapiens
tggctccaggctcctcatgagg

SEQ ID NO: 5954912 - DNA, 19 bp, Homo sapiens
tggctccagtctgctgccc

SEQ ID NO: 5954913 - DNA, 21 bp, Homo sapiens
tggctccatgattctctgagt

SEQ ID NO: 5954914 - DNA, 14 bp, Homo sapiens
tggctcccaaggga

SEQ ID NO: 5954915 - DNA, 22 bp, Homo sapiens
tggctcccaagggaggcccatg

SEQ ID NO: 5954916 - DNA, 16 bp, Homo sapiens
tggctcccagcagagg

SEQ ID NO: 5954917 - DNA, 14 bp, Homo sapiens
tggctcccatctcc

SEQ ID NO: 5954918 - DNA, 14 bp, Homo sapiens
tggctcccatgacc

SEQ ID NO: 5954919 - DNA, 20 bp, Homo sapiens
tggctcccatgaccatactg

SEQ ID NO: 5954920 - DNA, 16 bp, Homo sapiens
tggctccccaaggctg

SEQ ID NO: 5954921 - DNA, 14 bp, Homo sapiens
tggctccccacctg

SEQ ID NO: 5954922 - DNA, 22 bp, Homo sapiens
tggctccccacgagtcacctgc

SEQ ID NO: 5954923 - DNA, 18 bp, Homo sapiens
tggctccccctccccagg

SEQ ID NO: 5954924 - DNA, 23 bp, Homo sapiens
tggctccccctccccaggctgga

SEQ ID NO: 5954925 - DNA, 15 bp, Homo sapiens
tggctcccctgaggc

SEQ ID NO: 5954926 - DNA, 14 bp, Homo sapiens
tggctcccctgcag

SEQ ID NO: 5954927 - DNA, 15 bp, Homo sapiens
tggctcccctgcagc

SEQ ID NO: 5954928 - DNA, 14 bp, Homo sapiens
tggctcccctgggg

SEQ ID NO: 5954929 - DNA, 15 bp, Homo sapiens
tggctccctcctcca

SEQ ID NO: 5954930 - DNA, 19 bp, Homo sapiens
tggctccctctctcctgga

SEQ ID NO: 5954931 - DNA, 17 bp, Homo sapiens
tggctccctgggctggc

SEQ ID NO: 5954932 - DNA, 18 bp, Homo sapiens
tggctccctgggctggca

SEQ ID NO: 5954933 - DNA, 16 bp, Homo sapiens
tggctccgctgtgtgg

SEQ ID NO: 5954934 - DNA, 19 bp, Homo sapiens
tggctccggcctctgcctt

SEQ ID NO: 5954935 - DNA, 17 bp, Homo sapiens
tggctcctaccagcaaa

SEQ ID NO: 5954936 - DNA, 16 bp, Homo sapiens
tggctcctatctgtgt

SEQ ID NO: 5954937 - DNA, 14 bp, Homo sapiens
tggctcctccagca

SEQ ID NO: 5954938 - DNA, 14 bp, Homo sapiens
tggctcctcccagc

SEQ ID NO: 5954939 - DNA, 15 bp, Homo sapiens
tggctcctcccgaaa

SEQ ID NO: 5954940 - DNA, 18 bp, Homo sapiens
tggctcctcccggtgccc

SEQ ID NO: 5954941 - DNA, 18 bp, Homo sapiens
tggctcctccgtctgacc

SEQ ID NO: 5954942 - DNA, 19 bp, Homo sapiens
tggctcctccgtctgaccc

SEQ ID NO: 5954943 - DNA, 12 bp, Homo sapiens
tggctcctccta

SEQ ID NO: 5954944 - DNA, 18 bp, Homo sapiens
tggctcctccttcccctg

SEQ ID NO: 5954945 - DNA, 14 bp, Homo sapiens
tggctcctctcagt

SEQ ID NO: 5954946 - DNA, 15 bp, Homo sapiens
tggctcctctgtggt

SEQ ID NO: 5954947 - DNA, 21 bp, Homo sapiens
tggctcctctgtggtgtctgc

SEQ ID NO: 5954948 - DNA, 22 bp, Homo sapiens
tggctcctctgtggtgtctgcc

SEQ ID NO: 5954949 - DNA, 23 bp, Homo sapiens
tggctcctgaggggcatctgccc

SEQ ID NO: 5954950 - DNA, 13 bp, Homo sapiens
tggctcctgggcc

SEQ ID NO: 5954951 - DNA, 20 bp, Homo sapiens
tggctcctgggccggctgag

SEQ ID NO: 5954952 - DNA, 21 bp, Homo sapiens
tggctcctggggatggccagg

SEQ ID NO: 5954953 - DNA, 17 bp, Homo sapiens
tggctcctgtctggctc

SEQ ID NO: 5954954 - DNA, 18 bp, Homo sapiens
tggctccttgcagcaggg

SEQ ID NO: 5954955 - DNA, 21 bp, Homo sapiens
tggctccttgcagcagggctg

SEQ ID NO: 5954956 - DNA, 21 bp, Homo sapiens
tggctccttgggatgaagagg

SEQ ID NO: 5954957 - DNA, 16 bp, Homo sapiens
tggctcctttacaaaa

SEQ ID NO: 5954958 - DNA, 13 bp, Homo sapiens
tggctcctttccc

SEQ ID NO: 5954959 - DNA, 19 bp, Homo sapiens
tggctcctttcccacagtc

SEQ ID NO: 5954960 - DNA, 18 bp, Homo sapiens
tggctcctttgcctctgc

SEQ ID NO: 5954961 - DNA, 23 bp, Homo sapiens
tggctcctttgcctctgctactg

SEQ ID NO: 5954962 - DNA, 20 bp, Homo sapiens
tggctcgaatctctgtgcct

SEQ ID NO: 5954963 - DNA, 19 bp, Homo sapiens
tggctcgatgtttgccatg

SEQ ID NO: 5954964 - DNA, 18 bp, Homo sapiens
tggctcgcacccccactt

SEQ ID NO: 5954965 - DNA, 20 bp, Homo sapiens
tggctcgcagggtgcaggag

SEQ ID NO: 5954966 - DNA, 15 bp, Homo sapiens
tggctcgctccctgt

SEQ ID NO: 5954967 - DNA, 19 bp, Homo sapiens
tggctcggacccaccccaa

SEQ ID NO: 5954968 - DNA, 20 bp, Homo sapiens
tggctcggacccaccccaac

SEQ ID NO: 5954969 - DNA, 21 bp, Homo sapiens
tggctcggacccaccccaact

SEQ ID NO: 5954970 - DNA, 15 bp, Homo sapiens
tggctcgggacttca

SEQ ID NO: 5954971 - DNA, 13 bp, Homo sapiens
tggctcgtgggct

SEQ ID NO: 5954972 - DNA, 14 bp, Homo sapiens
tggctcgtgggctc

SEQ ID NO: 5954973 - DNA, 19 bp, Homo sapiens
tggctcgtgggctctggct

SEQ ID NO: 5954974 - DNA, 19 bp, Homo sapiens
tggctctaattcacagtgc

SEQ ID NO: 5954975 - DNA, 17 bp, Homo sapiens
tggctctaccctgtctg

SEQ ID NO: 5954976 - DNA, 22 bp, Homo sapiens
tggctctaccctgtctgtccct

SEQ ID NO: 5954977 - DNA, 14 bp, Homo sapiens
tggctctacttccc

SEQ ID NO: 5954978 - DNA, 16 bp, Homo sapiens
tggctctcaagtgaaa

SEQ ID NO: 5954979 - DNA, 14 bp, Homo sapiens
tggctctcagagga

SEQ ID NO: 5954980 - DNA, 19 bp, Homo sapiens
tggctctcattgacttcct

SEQ ID NO: 5954981 - DNA, 19 bp, Homo sapiens
tggctctccaagtgccaga

SEQ ID NO: 5954982 - DNA, 20 bp, Homo sapiens
tggctctccaagtgccagag

SEQ ID NO: 5954983 - DNA, 12 bp, Homo sapiens
tggctctcccac

SEQ ID NO: 5954984 - DNA, 14 bp, Homo sapiens
tggctctcccaccc

SEQ ID NO: 5954985 - DNA, 16 bp, Homo sapiens
tggctctctaattcca

SEQ ID NO: 5954986 - DNA, 16 bp, Homo sapiens
tggctctctattccct

SEQ ID NO: 5954987 - DNA, 13 bp, Homo sapiens
tggctctgaagaa

SEQ ID NO: 5954988 - DNA, 13 bp, Homo sapiens
tggctctgagaag

SEQ ID NO: 5954989 - DNA, 14 bp, Homo sapiens
tggctctgagaatc

SEQ ID NO: 5954990 - DNA, 21 bp, Homo sapiens
tggctctgaggtgcctgtccc

SEQ ID NO: 5954991 - DNA, 14 bp, Homo sapiens
tggctctgcaatgg

SEQ ID NO: 5954992 - DNA, 13 bp, Homo sapiens
tggctctgcacta

SEQ ID NO: 5954993 - DNA, 14 bp, Homo sapiens
tggctctgcactaa

SEQ ID NO: 5954994 - DNA, 13 bp, Homo sapiens
tggctctgcagca

SEQ ID NO: 5954995 - DNA, 17 bp, Homo sapiens
tggctctgccagtcctg

SEQ ID NO: 5954996 - DNA, 13 bp, Homo sapiens
tggctctgccccc

SEQ ID NO: 5954997 - DNA, 18 bp, Homo sapiens
tggctctgccccctcccc

SEQ ID NO: 5954998 - DNA, 17 bp, Homo sapiens
tggctctgcccctcagg

SEQ ID NO: 5954999 - DNA, 14 bp, Homo sapiens
tggctctgcctcag

SEQ ID NO: 5955000 - DNA, 19 bp, Homo sapiens
tggctctggacagcagcag

SEQ ID NO: 5955001 - DNA, 11 bp, Homo sapiens
tggctctggga

SEQ ID NO: 5955002 - DNA, 13 bp, Homo sapiens
tggctctgggact

SEQ ID NO: 5955003 - DNA, 13 bp, Homo sapiens
tggctctgggaga

SEQ ID NO: 5955004 - DNA, 19 bp, Homo sapiens
tggctctgggagagccagc

SEQ ID NO: 5955005 - DNA, 18 bp, Homo sapiens
tggctctgggatcctggg

SEQ ID NO: 5955006 - DNA, 17 bp, Homo sapiens
tggctctgggggaccca

SEQ ID NO: 5955007 - DNA, 24 bp, Homo sapiens
tggctctgggggacccaggtggga

SEQ ID NO: 5955008 - DNA, 12 bp, Homo sapiens
tggctctggggt

SEQ ID NO: 5955009 - DNA, 13 bp, Homo sapiens
tggctctggggtc

SEQ ID NO: 5955010 - DNA, 22 bp, Homo sapiens
tggctctgggtacctgcaagca

SEQ ID NO: 5955011 - DNA, 13 bp, Homo sapiens
tggctctgggtgg

SEQ ID NO: 5955012 - DNA, 14 bp, Homo sapiens
tggctctgggtggg

SEQ ID NO: 5955013 - DNA, 18 bp, Homo sapiens
tggctctgtggcttgcta

SEQ ID NO: 5955014 - DNA, 15 bp, Homo sapiens
tggctcttagaaact

SEQ ID NO: 5955015 - DNA, 17 bp, Homo sapiens
tggctcttagaaactca

SEQ ID NO: 5955016 - DNA, 18 bp, Homo sapiens
tggctcttagaaactcag

SEQ ID NO: 5955017 - DNA, 19 bp, Homo sapiens
tggctcttatttctgaatt

SEQ ID NO: 5955018 - DNA, 16 bp, Homo sapiens
tggctcttgaactgag

SEQ ID NO: 5955019 - DNA, 19 bp, Homo sapiens
tggctcttgatacccccct

SEQ ID NO: 5955020 - DNA, 23 bp, Homo sapiens
tggctcttgccttatctgttcct

SEQ ID NO: 5955021 - DNA, 23 bp, Homo sapiens
tggctcttgggacaacgtgctgc

SEQ ID NO: 5955022 - DNA, 23 bp, Homo sapiens
tggctctttgtgtgtctccaggt

SEQ ID NO: 5955023 - DNA, 15 bp, Homo sapiens
tggctgaaaaaggcc

SEQ ID NO: 5955024 - DNA, 15 bp, Homo sapiens
tggctgaaaatcact

SEQ ID NO: 5955025 - DNA, 18 bp, Homo sapiens
tggctgaaaatcactata

SEQ ID NO: 5955026 - DNA, 16 bp, Homo sapiens
tggctgaaaatgcaaa

SEQ ID NO: 5955027 - DNA, 17 bp, Homo sapiens
tggctgaaaatgcaaag

SEQ ID NO: 5955028 - DNA, 23 bp, Homo sapiens
tggctgaaaatgcaaagctgaag

SEQ ID NO: 5955029 - DNA, 20 bp, Homo sapiens
tggctgaaataaaagcctct

SEQ ID NO: 5955030 - DNA, 23 bp, Homo sapiens
tggctgaaataaaagcctctggt

SEQ ID NO: 5955031 - DNA, 14 bp, Homo sapiens
tggctgaaattatg

SEQ ID NO: 5955032 - DNA, 19 bp, Homo sapiens
tggctgaaattctcctgga

SEQ ID NO: 5955033 - DNA, 21 bp, Homo sapiens
tggctgaaattctcctggagg

SEQ ID NO: 5955034 - DNA, 22 bp, Homo sapiens
tggctgaaattctcctggaggt

SEQ ID NO: 5955035 - DNA, 21 bp, Homo sapiens
tggctgaacagtgctctgcct

SEQ ID NO: 5955036 - DNA, 23 bp, Homo sapiens
tggctgaacagtgctctgcctct

SEQ ID NO: 5955037 - DNA, 15 bp, Homo sapiens
tggctgaactacaag

SEQ ID NO: 5955038 - DNA, 19 bp, Homo sapiens
tggctgaagaaacacagca

SEQ ID NO: 5955039 - DNA, 18 bp, Homo sapiens
tggctgaagaatgaagac

SEQ ID NO: 5955040 - DNA, 13 bp, Homo sapiens
tggctgaagacat

SEQ ID NO: 5955041 - DNA, 20 bp, Homo sapiens
tggctgaagaggaccagagg

SEQ ID NO: 5955042 - DNA, 20 bp, Homo sapiens
tggctgaagctggagcagcg

SEQ ID NO: 5955043 - DNA, 11 bp, Homo sapiens
tggctgaagga

SEQ ID NO: 5955044 - DNA, 12 bp, Homo sapiens
tggctgaaggac

SEQ ID NO: 5955045 - DNA, 15 bp, Homo sapiens
tggctgaaggactgt

SEQ ID NO: 5955046 - DNA, 20 bp, Homo sapiens
tggctgaagtgcatgggtca

SEQ ID NO: 5955047 - DNA, 19 bp, Homo sapiens
tggctgaattaaaatggtt

SEQ ID NO: 5955048 - DNA, 22 bp, Homo sapiens
tggctgacagagcaggtctgca

SEQ ID NO: 5955049 - DNA, 17 bp, Homo sapiens
tggctgaccaggccctg

SEQ ID NO: 5955050 - DNA, 21 bp, Homo sapiens
tggctgacccagtccctgggg

SEQ ID NO: 5955051 - DNA, 21 bp, Homo sapiens
tggctgaccccaaagagcctg

SEQ ID NO: 5955052 - DNA, 22 bp, Homo sapiens
tggctgaccccaaagagcctgg

SEQ ID NO: 5955053 - DNA, 14 bp, Homo sapiens
tggctgacccctct

SEQ ID NO: 5955054 - DNA, 16 bp, Homo sapiens
tggctgacccctctgg

SEQ ID NO: 5955055 - DNA, 15 bp, Homo sapiens
tggctgacctgacct

SEQ ID NO: 5955056 - DNA, 15 bp, Homo sapiens
tggctgacctgggcc

SEQ ID NO: 5955057 - DNA, 22 bp, Homo sapiens
tggctgactaagccccgtctga

SEQ ID NO: 5955058 - DNA, 14 bp, Homo sapiens
tggctgactggcca

SEQ ID NO: 5955059 - DNA, 19 bp, Homo sapiens
tggctgactggggctgggg

SEQ ID NO: 5955060 - DNA, 14 bp, Homo sapiens
tggctgagacctgg

SEQ ID NO: 5955061 - DNA, 21 bp, Homo sapiens
tggctgagacctgggatttga

SEQ ID NO: 5955062 - DNA, 18 bp, Homo sapiens
tggctgagatagcagagg

SEQ ID NO: 5955063 - DNA, 16 bp, Homo sapiens
tggctgagcagttccc

SEQ ID NO: 5955064 - DNA, 23 bp, Homo sapiens
tggctgagcagttcccctggagc

SEQ ID NO: 5955065 - DNA, 18 bp, Homo sapiens
tggctgagccccctctcc

SEQ ID NO: 5955066 - DNA, 13 bp, Homo sapiens
tggctgagcccct

SEQ ID NO: 5955067 - DNA, 15 bp, Homo sapiens
tggctgagcccctgg

SEQ ID NO: 5955068 - DNA, 19 bp, Homo sapiens
tggctgagcctcgtgtcca

SEQ ID NO: 5955069 - DNA, 16 bp, Homo sapiens
tggctgagcctggctg

SEQ ID NO: 5955070 - DNA, 20 bp, Homo sapiens
tggctgaggatttcaagcct

SEQ ID NO: 5955071 - DNA, 17 bp, Homo sapiens
tggctgaggccacccag

SEQ ID NO: 5955072 - DNA, 13 bp, Homo sapiens
tggctgaggcttg

SEQ ID NO: 5955073 - DNA, 17 bp, Homo sapiens
tggctgagggattctat

SEQ ID NO: 5955074 - DNA, 23 bp, Homo sapiens
tggctgagggcagctgcgcgggc

SEQ ID NO: 5955075 - DNA, 14 bp, Homo sapiens
tggctgaggggctt

SEQ ID NO: 5955076 - DNA, 20 bp, Homo sapiens
tggctgaggttcctctgcct

SEQ ID NO: 5955077 - DNA, 22 bp, Homo sapiens
tggctgaggttcctctgcctgc

SEQ ID NO: 5955078 - DNA, 23 bp, Homo sapiens
tggctgaggttcctctgcctgcc

SEQ ID NO: 5955079 - DNA, 16 bp, Homo sapiens
tggctgagtactggaa

SEQ ID NO: 5955080 - DNA, 19 bp, Homo sapiens
tggctgagtagctctgcct

SEQ ID NO: 5955081 - DNA, 20 bp, Homo sapiens
tggctgagtggaatgcaggg

SEQ ID NO: 5955082 - DNA, 21 bp, Homo sapiens
tggctgagtggaatgcaggga

SEQ ID NO: 5955083 - DNA, 14 bp, Homo sapiens
tggctgataatttt

SEQ ID NO: 5955084 - DNA, 19 bp, Homo sapiens
tggctgataattttaaatt

SEQ ID NO: 5955085 - DNA, 21 bp, Homo sapiens
tggctgatgatccagaacagt

SEQ ID NO: 5955086 - DNA, 20 bp, Homo sapiens
tggctgatgggtggacctgt

SEQ ID NO: 5955087 - DNA, 20 bp, Homo sapiens
tgggactcctggtgcccctc

SEQ ID NO: 5955088 - DNA, 18 bp, Homo sapiens
tgggactcggagactatg

SEQ ID NO: 5955089 - DNA, 18 bp, Homo sapiens
tgggactcgtggctgtca

SEQ ID NO: 5955090 - DNA, 22 bp, Homo sapiens
tgggactctcctcctcccctcc

SEQ ID NO: 5955091 - DNA, 16 bp, Homo sapiens
tgggactgagccagtc

SEQ ID NO: 5955092 - DNA, 20 bp, Homo sapiens
tgggactgagcctggcccat

SEQ ID NO: 5955093 - DNA, 16 bp, Homo sapiens
tgggactgattctgtt

SEQ ID NO: 5955094 - DNA, 21 bp, Homo sapiens
tgggactgctcaggctcccca

SEQ ID NO: 5955095 - DNA, 15 bp, Homo sapiens
tgggactgctgtgaa

SEQ ID NO: 5955096 - DNA, 21 bp, Homo sapiens
tgggactgctgtgaacatgcc

SEQ ID NO: 5955097 - DNA, 23 bp, Homo sapiens
tgggactgctgtgaacatgcctc

SEQ ID NO: 5955098 - DNA, 13 bp, Homo sapiens
tgggactggacag

SEQ ID NO: 5955099 - DNA, 22 bp, Homo sapiens
tgggactggacagctttgctcc

SEQ ID NO: 5955100 - DNA, 12 bp, Homo sapiens
tgggactggccc

SEQ ID NO: 5955101 - DNA, 17 bp, Homo sapiens
tgggactggcccacccc

SEQ ID NO: 5955102 - DNA, 13 bp, Homo sapiens
tgggactggcctc

SEQ ID NO: 5955103 - DNA, 20 bp, Homo sapiens
tgggactgggaacagaactc

SEQ ID NO: 5955104 - DNA, 15 bp, Homo sapiens
tgggactgggagggc

SEQ ID NO: 5955105 - DNA, 20 bp, Homo sapiens
tgggactgtgcctggctccc

SEQ ID NO: 5955106 - DNA, 17 bp, Homo sapiens
tgggactgtgcctttgg

SEQ ID NO: 5955107 - DNA, 18 bp, Homo sapiens
tgggacttccatgcctta

SEQ ID NO: 5955108 - DNA, 19 bp, Homo sapiens
tgggacttccttgctctcc

SEQ ID NO: 5955109 - DNA, 14 bp, Homo sapiens
tgggacttctaccc

SEQ ID NO: 5955110 - DNA, 23 bp, Homo sapiens
tgggacttctacccagatggaaa

SEQ ID NO: 5955111 - DNA, 18 bp, Homo sapiens
tgggacttcttttcacat

SEQ ID NO: 5955112 - DNA, 16 bp, Homo sapiens
tgggacttggagagca

SEQ ID NO: 5955113 - DNA, 22 bp, Homo sapiens
tgggacttggagagcaaaggcc

SEQ ID NO: 5955114 - DNA, 23 bp, Homo sapiens
tgggactttccttccctctcctg

SEQ ID NO: 5955115 - DNA, 16 bp, Homo sapiens
tgggagaaaagccaga

SEQ ID NO: 5955116 - DNA, 17 bp, Homo sapiens
tgggagaaaagccagat

SEQ ID NO: 5955117 - DNA, 19 bp, Homo sapiens
tgggagaaatacttgaact

SEQ ID NO: 5955118 - DNA, 19 bp, Homo sapiens
tgggagaaatctggcttct

SEQ ID NO: 5955119 - DNA, 19 bp, Homo sapiens
tgggagaaattgacagatc

SEQ ID NO: 5955120 - DNA, 14 bp, Homo sapiens
tgggagaacctcag

SEQ ID NO: 5955121 - DNA, 23 bp, Homo sapiens
tgggagaactaagtaagaaacac

SEQ ID NO: 5955122 - DNA, 12 bp, Homo sapiens
tgggagaagaga

SEQ ID NO: 5955123 - DNA, 13 bp, Homo sapiens
tgggagaagagaa

SEQ ID NO: 5955124 - DNA, 15 bp, Homo sapiens
tgggagaagggacag

SEQ ID NO: 5955125 - DNA, 16 bp, Homo sapiens
tgggagaagggcagag

SEQ ID NO: 5955126 - DNA, 22 bp, Homo sapiens
tgggagaagggggtcaaagcaa

SEQ ID NO: 5955127 - DNA, 23 bp, Homo sapiens
tgggagaagggggtcaaagcaag

SEQ ID NO: 5955128 - DNA, 15 bp, Homo sapiens
tgggagaagtggccc

SEQ ID NO: 5955129 - DNA, 19 bp, Homo sapiens
tgggagaagtgggggcagc

SEQ ID NO: 5955130 - DNA, 16 bp, Homo sapiens
tgggagaatcagcaga

SEQ ID NO: 5955131 - DNA, 17 bp, Homo sapiens
tgggagaatcagcagaa

SEQ ID NO: 5955132 - DNA, 17 bp, Homo sapiens
tgggagaattgcttgag

SEQ ID NO: 5955133 - DNA, 13 bp, Homo sapiens
tgggagacagacc

SEQ ID NO: 5955134 - DNA, 13 bp, Homo sapiens
tgggagacagcag

SEQ ID NO: 5955135 - DNA, 14 bp, Homo sapiens
tgggagacagcagc

SEQ ID NO: 5955136 - DNA, 16 bp, Homo sapiens
tgggagacatggacca

SEQ ID NO: 5955137 - DNA, 18 bp, Homo sapiens
tgggagacatggaccagc

SEQ ID NO: 5955138 - DNA, 19 bp, Homo sapiens
tgggagacatggaccagca

SEQ ID NO: 5955139 - DNA, 16 bp, Homo sapiens
tgggagacatgtgaca

SEQ ID NO: 5955140 - DNA, 22 bp, Homo sapiens
tgggagaccggcctgccaggag

SEQ ID NO: 5955141 - DNA, 22 bp, Homo sapiens
tgggagacctgttggcctgtgg

SEQ ID NO: 5955142 - DNA, 22 bp, Homo sapiens
tgggagacgaacggaagggttg

SEQ ID NO: 5955143 - DNA, 20 bp, Homo sapiens
tgggagagacttggatgagg

SEQ ID NO: 5955144 - DNA, 23 bp, Homo sapiens
tgggagagacttggatgaggagt

SEQ ID NO: 5955145 - DNA, 13 bp, Homo sapiens
tgggagagccagc

SEQ ID NO: 5955146 - DNA, 14 bp, Homo sapiens
tgggagagccagct

SEQ ID NO: 5955147 - DNA, 17 bp, Homo sapiens
tgggagagccagctctc

SEQ ID NO: 5955148 - DNA, 17 bp, Homo sapiens
tgggagagccagctttg

SEQ ID NO: 5955149 - DNA, 14 bp, Homo sapiens
tgggagagcccagc

SEQ ID NO: 5955150 - DNA, 16 bp, Homo sapiens
tgggagagcccctggg

SEQ ID NO: 5955151 - DNA, 19 bp, Homo sapiens
tgggagagcccctggggcc

SEQ ID NO: 5955152 - DNA, 14 bp, Homo sapiens
tgggagagcctggc

SEQ ID NO: 5955153 - DNA, 19 bp, Homo sapiens
tgggagagctagaaagttg

SEQ ID NO: 5955154 - DNA, 15 bp, Homo sapiens
tgggagaggaagcca

SEQ ID NO: 5955155 - DNA, 15 bp, Homo sapiens
tgggagaggagaggc

SEQ ID NO: 5955156 - DNA, 23 bp, Homo sapiens
tgggagaggatttttttctgagc

SEQ ID NO: 5955157 - DNA, 16 bp, Homo sapiens
tgggagaggcagagtg

SEQ ID NO: 5955158 - DNA, 14 bp, Homo sapiens
tgggagaggcagcc

SEQ ID NO: 5955159 - DNA, 18 bp, Homo sapiens
tgggagaggcagcccagg

SEQ ID NO: 5955160 - DNA, 22 bp, Homo sapiens
tgggagaggcagcccaggaagt

SEQ ID NO: 5955161 - DNA, 16 bp, Homo sapiens
tgggagaggctgggag

SEQ ID NO: 5955162 - DNA, 13 bp, Homo sapiens
tgggagagggagc

SEQ ID NO: 5955163 - DNA, 12 bp, Homo sapiens
tgggagagggcg

SEQ ID NO: 5955164 - DNA, 13 bp, Homo sapiens
tgggagagggcgc

SEQ ID NO: 5955165 - DNA, 14 bp, Homo sapiens
tgggagagggcgca

SEQ ID NO: 5955166 - DNA, 15 bp, Homo sapiens
tgggagagggcgcag

SEQ ID NO: 5955167 - DNA, 19 bp, Homo sapiens
tgggagagtacctgtgtgt

SEQ ID NO: 5955168 - DNA, 17 bp, Homo sapiens
tgggagagtccaggcct

SEQ ID NO: 5955169 - DNA, 22 bp, Homo sapiens
tgggagagtgtcaaccagacag

SEQ ID NO: 5955170 - DNA, 23 bp, Homo sapiens
tgggagatatatttttaagataa

SEQ ID NO: 5955171 - DNA, 15 bp, Homo sapiens
tgggagatgcagctg

SEQ ID NO: 5955172 - DNA, 16 bp, Homo sapiens
tgggagatgcagctgg

SEQ ID NO: 5955173 - DNA, 17 bp, Homo sapiens
tgggagatgctctctga

SEQ ID NO: 5955174 - DNA, 16 bp, Homo sapiens
tgggagatggaggtag

SEQ ID NO: 5955175 - DNA, 15 bp, Homo sapiens
tgggagatggcagca

SEQ ID NO: 5955176 - DNA, 14 bp, Homo sapiens
tgggagatgtggaa

SEQ ID NO: 5955177 - DNA, 15 bp, Homo sapiens
tgggagattggcttt

SEQ ID NO: 5955178 - DNA, 19 bp, Homo sapiens
tgggagcaaactgcatgcc

SEQ ID NO: 5955179 - DNA, 20 bp, Homo sapiens
tgggagcaaactgcatgccc

SEQ ID NO: 5955180 - DNA, 19 bp, Homo sapiens
tgggagcaagttgcagtct

SEQ ID NO: 5955181 - DNA, 17 bp, Homo sapiens
tgggagcaatctggaaa

SEQ ID NO: 5955182 - DNA, 18 bp, Homo sapiens
tgggagcaatctggaaaa

SEQ ID NO: 5955183 - DNA, 17 bp, Homo sapiens
tgggagcacatagccct

SEQ ID NO: 5955184 - DNA, 18 bp, Homo sapiens
tgggagcacatagccctg

SEQ ID NO: 5955185 - DNA, 14 bp, Homo sapiens
tgggagcagaaaca

SEQ ID NO: 5955186 - DNA, 23 bp, Homo sapiens
tgggagcagcgcggatttctctt

SEQ ID NO: 5955187 - DNA, 21 bp, Homo sapiens
tgggagcagcggtttggggag

SEQ ID NO: 5955188 - DNA, 11 bp, Homo sapiens
tgggagcagct

SEQ ID NO: 5955189 - DNA, 14 bp, Homo sapiens
tgggagcagcttct

SEQ ID NO: 5955190 - DNA, 15 bp, Homo sapiens
tgggagcaggatttt

SEQ ID NO: 5955191 - DNA, 23 bp, Homo sapiens
tgggagcagtcctatgtctcagt

SEQ ID NO: 5955192 - DNA, 21 bp, Homo sapiens
tgggagcatagcagaggggcc

SEQ ID NO: 5955193 - DNA, 23 bp, Homo sapiens
tgggagcatagcagaggggccag

SEQ ID NO: 5955194 - DNA, 19 bp, Homo sapiens
tgggagccaccactcctgc

SEQ ID NO: 5955195 - DNA, 23 bp, Homo sapiens
tgggagccaccactcctgcctgc

SEQ ID NO: 5955196 - DNA, 14 bp, Homo sapiens
tgggagccaggact

SEQ ID NO: 5955197 - DNA, 23 bp, Homo sapiens
tgggagccaggactcccagaacc

SEQ ID NO: 5955198 - DNA, 13 bp, Homo sapiens
tgggagccaggag

SEQ ID NO: 5955199 - DNA, 20 bp, Homo sapiens
tgggagccatgccgtctgcc

SEQ ID NO: 5955200 - DNA, 16 bp, Homo sapiens
tgggagccccagggtc

SEQ ID NO: 5955201 - DNA, 17 bp, Homo sapiens
tgggagcccccagcctg

SEQ ID NO: 5955202 - DNA, 15 bp, Homo sapiens
tgggagccctttgga

SEQ ID NO: 5955203 - DNA, 16 bp, Homo sapiens
tgggagccgcagagcc

SEQ ID NO: 5955204 - DNA, 22 bp, Homo sapiens
tgggagccgggaccctcaggtg

SEQ ID NO: 5955205 - DNA, 18 bp, Homo sapiens
tgggagcctcgcccctcc

SEQ ID NO: 5955206 - DNA, 20 bp, Homo sapiens
tgggagcctcgcccctccag

SEQ ID NO: 5955207 - DNA, 11 bp, Homo sapiens
tgggagcctga

SEQ ID NO: 5955208 - DNA, 20 bp, Homo sapiens
tgggagcctgaggcaggaga

SEQ ID NO: 5955209 - DNA, 19 bp, Homo sapiens
tgggagcctgaggcatgag

SEQ ID NO: 5955210 - DNA, 20 bp, Homo sapiens
tgggagcctgcaaactcact

SEQ ID NO: 5955211 - DNA, 22 bp, Homo sapiens
tgggagcctgcaaactcactgc

SEQ ID NO: 5955212 - DNA, 12 bp, Homo sapiens
tgggagctcagc

SEQ ID NO: 5955213 - DNA, 13 bp, Homo sapiens
tgggagctcagct

SEQ ID NO: 5955214 - DNA, 22 bp, Homo sapiens
tgggagctccactctgcttctc

SEQ ID NO: 5955215 - DNA, 18 bp, Homo sapiens
tgggagctcctccgcaga

SEQ ID NO: 5955216 - DNA, 23 bp, Homo sapiens
tgggagctcctccgcagaaggtt

SEQ ID NO: 5955217 - DNA, 15 bp, Homo sapiens
tgggagctcctctcc

SEQ ID NO: 5955218 - DNA, 20 bp, Homo sapiens
tgggagctcctctcctggag

SEQ ID NO: 5955219 - DNA, 21 bp, Homo sapiens
tgggagctcctctcctggagg

SEQ ID NO: 5955220 - DNA, 20 bp, Homo sapiens
tgggagctgaaccacagaaa

SEQ ID NO: 5955221 - DNA, 22 bp, Homo sapiens
tgggagctgaggccacactcag

SEQ ID NO: 5955222 - DNA, 13 bp, Homo sapiens
tgggagctgcctg

SEQ ID NO: 5955223 - DNA, 22 bp, Homo sapiens
tgggagctgcctgttcagctcc

SEQ ID NO: 5955224 - DNA, 20 bp, Homo sapiens
tgggagctgcgccggacaga

SEQ ID NO: 5955225 - DNA, 22 bp, Homo sapiens
tgggagctgcgccggacagagt

SEQ ID NO: 5955226 - DNA, 16 bp, Homo sapiens
tgggagctgctgggct

SEQ ID NO: 5955227 - DNA, 17 bp, Homo sapiens
tgggagctgctgggcta

SEQ ID NO: 5955228 - DNA, 19 bp, Homo sapiens
tgggagctggttgaattgt

SEQ ID NO: 5955229 - DNA, 22 bp, Homo sapiens
tgggagcttcccacacctgcct

SEQ ID NO: 5955230 - DNA, 18 bp, Homo sapiens
tgggagcttccgctttga

SEQ ID NO: 5955231 - DNA, 16 bp, Homo sapiens
tgggagcttgggaatg

SEQ ID NO: 5955232 - DNA, 16 bp, Homo sapiens
tgggagcttggggaga

SEQ ID NO: 5955233 - DNA, 12 bp, Homo sapiens
tgggaggaaaag

SEQ ID NO: 5955234 - DNA, 20 bp, Homo sapiens
tgggaggaaaagaaaagagg

SEQ ID NO: 5955235 - DNA, 16 bp, Homo sapiens
tgggaggaaacctgag

SEQ ID NO: 5955236 - DNA, 13 bp, Homo sapiens
tgggaggaaagta

SEQ ID NO: 5955237 - DNA, 17 bp, Homo sapiens
tgggaggaacaaagaca

SEQ ID NO: 5955238 - DNA, 23 bp, Homo sapiens
tgggaggaagcagaataaagcaa

SEQ ID NO: 5955239 - DNA, 19 bp, Homo sapiens
tgggaggaaggcccagggg

SEQ ID NO: 5955240 - DNA, 14 bp, Homo sapiens
tgggaggacagagc

SEQ ID NO: 5955241 - DNA, 14 bp, Homo sapiens
tgggaggacaggca

SEQ ID NO: 5955242 - DNA, 15 bp, Homo sapiens
tgggaggacaggcag

SEQ ID NO: 5955243 - DNA, 18 bp, Homo sapiens
tgggaggacatgcgtgtg

SEQ ID NO: 5955244 - DNA, 21 bp, Homo sapiens
tgggaggagagccactgggcc

SEQ ID NO: 5955245 - DNA, 22 bp, Homo sapiens
tgggaggagagccactgggccc

SEQ ID NO: 5955246 - DNA, 16 bp, Homo sapiens
tgggaggagagggcag

SEQ ID NO: 5955247 - DNA, 18 bp, Homo sapiens
tgggaggagagggcagag

SEQ ID NO: 5955248 - DNA, 15 bp, Homo sapiens
tgggaggagatgaaa

SEQ ID NO: 5955249 - DNA, 18 bp, Homo sapiens
tgggaggaggaaaagaaa

SEQ ID NO: 5955250 - DNA, 15 bp, Homo sapiens
tgggaggagggagag

SEQ ID NO: 5955251 - DNA, 14 bp, Homo sapiens
tgggaggaggggga

SEQ ID NO: 5955252 - DNA, 16 bp, Homo sapiens
tgggaggagggggccc

SEQ ID NO: 5955253 - DNA, 16 bp, Homo sapiens
tgggaggatctcttga

SEQ ID NO: 5955254 - DNA, 18 bp, Homo sapiens
tgggaggatctcttgagc

SEQ ID NO: 5955255 - DNA, 15 bp, Homo sapiens
tgggaggatgtgaat

SEQ ID NO: 5955256 - DNA, 20 bp, Homo sapiens
tgggaggattctatgaggca

SEQ ID NO: 5955257 - DNA, 18 bp, Homo sapiens
tgggaggattgcttgagc

SEQ ID NO: 5955258 - DNA, 22 bp, Homo sapiens
tgggaggattgcttgagctcag

SEQ ID NO: 5955259 - DNA, 14 bp, Homo sapiens
tgggaggatttgat

SEQ ID NO: 5955260 - DNA, 13 bp, Homo sapiens
tgggaggcaagaa

SEQ ID NO: 5955261 - DNA, 14 bp, Homo sapiens
tgggaggcaagaaa

SEQ ID NO: 5955262 - DNA, 21 bp, Homo sapiens
tgggaggcaagaaaaggacaa

SEQ ID NO: 5955263 - DNA, 23 bp, Homo sapiens
tgggaggcaagaaaaggacaaat

SEQ ID NO: 5955264 - DNA, 13 bp, Homo sapiens
tgggcccatctcc

SEQ ID NO: 5955265 - DNA, 22 bp, Homo sapiens
tgggcccatctctccctgcgca

SEQ ID NO: 5955266 - DNA, 23 bp, Homo sapiens
tgggcccatctctccctgcgcac

SEQ ID NO: 5955267 - DNA, 17 bp, Homo sapiens
tgggccccacatggctt

SEQ ID NO: 5955268 - DNA, 18 bp, Homo sapiens
tgggccccaccacctagg

SEQ ID NO: 5955269 - DNA, 17 bp, Homo sapiens
tgggccccaccatttat

SEQ ID NO: 5955270 - DNA, 16 bp, Homo sapiens
tgggccccaccctcgg

SEQ ID NO: 5955271 - DNA, 22 bp, Homo sapiens
tgggccccagaaagcctcagag

SEQ ID NO: 5955272 - DNA, 18 bp, Homo sapiens
tgggccccagaccccagg

SEQ ID NO: 5955273 - DNA, 22 bp, Homo sapiens
tgggccccagaccccagggcag

SEQ ID NO: 5955274 - DNA, 15 bp, Homo sapiens
tgggccccagcccac

SEQ ID NO: 5955275 - DNA, 18 bp, Homo sapiens
tgggccccagcccaccct

SEQ ID NO: 5955276 - DNA, 12 bp, Homo sapiens
tgggccccagct

SEQ ID NO: 5955277 - DNA, 14 bp, Homo sapiens
tgggccccagggaa

SEQ ID NO: 5955278 - DNA, 16 bp, Homo sapiens
tgggccccagggaact

SEQ ID NO: 5955279 - DNA, 14 bp, Homo sapiens
tgggccccatgctc

SEQ ID NO: 5955280 - DNA, 21 bp, Homo sapiens
tgggcccccaaatggaaatgg

SEQ ID NO: 5955281 - DNA, 14 bp, Homo sapiens
tgggcccccagcct

SEQ ID NO: 5955282 - DNA, 13 bp, Homo sapiens
tgggccccgcctc

SEQ ID NO: 5955283 - DNA, 17 bp, Homo sapiens
tgggccccgccttcctg

SEQ ID NO: 5955284 - DNA, 17 bp, Homo sapiens
tgggccccgggctggag

SEQ ID NO: 5955285 - DNA, 23 bp, Homo sapiens
tgggccccgggctggagaaagag

SEQ ID NO: 5955286 - DNA, 22 bp, Homo sapiens
tgggcccctcaacagccaagtg

SEQ ID NO: 5955287 - DNA, 13 bp, Homo sapiens
tgggcccctcagc

SEQ ID NO: 5955288 - DNA, 23 bp, Homo sapiens
tgggcccctcatctgctcagcag

SEQ ID NO: 5955289 - DNA, 17 bp, Homo sapiens
tgggcccctccacgcct

SEQ ID NO: 5955290 - DNA, 18 bp, Homo sapiens
tgggcccctccacgcctc

SEQ ID NO: 5955291 - DNA, 22 bp, Homo sapiens
tgggcccctccacgcctcctgg

SEQ ID NO: 5955292 - DNA, 12 bp, Homo sapiens
tgggcccctccc

SEQ ID NO: 5955293 - DNA, 14 bp, Homo sapiens
tgggcccctcccct

SEQ ID NO: 5955294 - DNA, 16 bp, Homo sapiens
tgggcccctcccctca

SEQ ID NO: 5955295 - DNA, 18 bp, Homo sapiens
tgggcccctcccctcaga

SEQ ID NO: 5955296 - DNA, 13 bp, Homo sapiens
tgggcccctccct

SEQ ID NO: 5955297 - DNA, 18 bp, Homo sapiens
tgggcccctccctacctc

SEQ ID NO: 5955298 - DNA, 13 bp, Homo sapiens
tgggcccctggga

SEQ ID NO: 5955299 - DNA, 16 bp, Homo sapiens
tgggcccctggggaca

SEQ ID NO: 5955300 - DNA, 20 bp, Homo sapiens
tgggcccctggggacagagc

SEQ ID NO: 5955301 - DNA, 22 bp, Homo sapiens
tgggcccctggggacagagcca

SEQ ID NO: 5955302 - DNA, 13 bp, Homo sapiens
tgggcccctgtcc

SEQ ID NO: 5955303 - DNA, 17 bp, Homo sapiens
tgggcccctgtccccag

SEQ ID NO: 5955304 - DNA, 15 bp, Homo sapiens
tgggccccttccaaa

SEQ ID NO: 5955305 - DNA, 21 bp, Homo sapiens
tgggcccgctgcctcttggct

SEQ ID NO: 5955306 - DNA, 17 bp, Homo sapiens
tgggcccgctttgcctg

SEQ ID NO: 5955307 - DNA, 17 bp, Homo sapiens
tgggcccggtccacagg

SEQ ID NO: 5955308 - DNA, 15 bp, Homo sapiens
tgggccctaccctcc

SEQ ID NO: 5955309 - DNA, 16 bp, Homo sapiens
tgggccctaccctcct

SEQ ID NO: 5955310 - DNA, 19 bp, Homo sapiens
tgggccctaccctcctgct

SEQ ID NO: 5955311 - DNA, 14 bp, Homo sapiens
tgggccctaggcat

SEQ ID NO: 5955312 - DNA, 23 bp, Homo sapiens
tgggccctatgtctcaggagtgg

SEQ ID NO: 5955313 - DNA, 13 bp, Homo sapiens
tgggccctctctc

SEQ ID NO: 5955314 - DNA, 16 bp, Homo sapiens
tgggccctctctctgg

SEQ ID NO: 5955315 - DNA, 18 bp, Homo sapiens
tgggccctctctgctctg

SEQ ID NO: 5955316 - DNA, 15 bp, Homo sapiens
tgggccctcttatct

SEQ ID NO: 5955317 - DNA, 13 bp, Homo sapiens
tgggccctgagcc

SEQ ID NO: 5955318 - DNA, 18 bp, Homo sapiens
tgggccctgagtcctggt

SEQ ID NO: 5955319 - DNA, 22 bp, Homo sapiens
tgggccctgagtctgggcagct

SEQ ID NO: 5955320 - DNA, 20 bp, Homo sapiens
tgggccctgcaagacacagg

SEQ ID NO: 5955321 - DNA, 15 bp, Homo sapiens
tgggccctgcacaga

SEQ ID NO: 5955322 - DNA, 18 bp, Homo sapiens
tgggccctgcaggaggcc

SEQ ID NO: 5955323 - DNA, 13 bp, Homo sapiens
tgggccctgcatg

SEQ ID NO: 5955324 - DNA, 20 bp, Homo sapiens
tgggccctgcattggcctgg

SEQ ID NO: 5955325 - DNA, 17 bp, Homo sapiens
tgggccctgcccgggga

SEQ ID NO: 5955326 - DNA, 18 bp, Homo sapiens
tgggccctgcctgcagcc

SEQ ID NO: 5955327 - DNA, 20 bp, Homo sapiens
tgggccctgcctgcagccag

SEQ ID NO: 5955328 - DNA, 23 bp, Homo sapiens
tgggccctgcctgcagccagggc

SEQ ID NO: 5955329 - DNA, 11 bp, Homo sapiens
tgggccctgga

SEQ ID NO: 5955330 - DNA, 14 bp, Homo sapiens
tgggccctggaggg

SEQ ID NO: 5955331 - DNA, 17 bp, Homo sapiens
tgggccctggctctgtc

SEQ ID NO: 5955332 - DNA, 14 bp, Homo sapiens
tgggccctgggctg

SEQ ID NO: 5955333 - DNA, 15 bp, Homo sapiens
tgggccctgggctgg

SEQ ID NO: 5955334 - DNA, 17 bp, Homo sapiens
tgggccctgggctggaa

SEQ ID NO: 5955335 - DNA, 21 bp, Homo sapiens
tgggccctgggctggcacagc

SEQ ID NO: 5955336 - DNA, 12 bp, Homo sapiens
tgggccctgggg

SEQ ID NO: 5955337 - DNA, 19 bp, Homo sapiens
tgggccctggggctgccct

SEQ ID NO: 5955338 - DNA, 14 bp, Homo sapiens
tgggccctggttcc

SEQ ID NO: 5955339 - DNA, 17 bp, Homo sapiens
tgggcccttagaatgtg

SEQ ID NO: 5955340 - DNA, 21 bp, Homo sapiens
tgggcccttagaatgtgaaaa

SEQ ID NO: 5955341 - DNA, 16 bp, Homo sapiens
tgggcccttcctggct

SEQ ID NO: 5955342 - DNA, 20 bp, Homo sapiens
tgggcccttcctggctagga

SEQ ID NO: 5955343 - DNA, 16 bp, Homo sapiens
tgggcccttgtgctcc

SEQ ID NO: 5955344 - DNA, 23 bp, Homo sapiens
tgggccctttttcccttccctcc

SEQ ID NO: 5955345 - DNA, 18 bp, Homo sapiens
tgggccgaatcccccagg

SEQ ID NO: 5955346 - DNA, 19 bp, Homo sapiens
tgggccgaatcccccaggg

SEQ ID NO: 5955347 - DNA, 20 bp, Homo sapiens
tgggccgaatcccccaggga

SEQ ID NO: 5955348 - DNA, 20 bp, Homo sapiens
tgggccgcgtgccgggcccc

SEQ ID NO: 5955349 - DNA, 14 bp, Homo sapiens
tgggccgctgccac

SEQ ID NO: 5955350 - DNA, 21 bp, Homo sapiens
tgggccgctgctttgcgctgg

SEQ ID NO: 5955351 - DNA, 15 bp, Homo sapiens
tgggccggccccagg

SEQ ID NO: 5955352 - DNA, 16 bp, Homo sapiens
tgggccggcccccttc

SEQ ID NO: 5955353 - DNA, 22 bp, Homo sapiens
tgggccggcccccttcctggcc

SEQ ID NO: 5955354 - DNA, 14 bp, Homo sapiens
tgggccgggaggca

SEQ ID NO: 5955355 - DNA, 22 bp, Homo sapiens
tgggccgggcccagggcctctg

SEQ ID NO: 5955356 - DNA, 15 bp, Homo sapiens
tgggccgggctgtag

SEQ ID NO: 5955357 - DNA, 18 bp, Homo sapiens
tgggccgtagcttgtctg

SEQ ID NO: 5955358 - DNA, 20 bp, Homo sapiens
tgggccgtatctccggctcc

SEQ ID NO: 5955359 - DNA, 23 bp, Homo sapiens
tgggcctaaaacagtattctgta

SEQ ID NO: 5955360 - DNA, 14 bp, Homo sapiens
tgggcctaaataaa

SEQ ID NO: 5955361 - DNA, 17 bp, Homo sapiens
tgggcctaggccaggag

SEQ ID NO: 5955362 - DNA, 15 bp, Homo sapiens
tgggcctatggagag

SEQ ID NO: 5955363 - DNA, 18 bp, Homo sapiens
tgggcctatggagagccc

SEQ ID NO: 5955364 - DNA, 20 bp, Homo sapiens
tgggcctatggagagccctg

SEQ ID NO: 5955365 - DNA, 11 bp, Homo sapiens
tgggcctcagg

SEQ ID NO: 5955366 - DNA, 13 bp, Homo sapiens
tgggcctcaggcg

SEQ ID NO: 5955367 - DNA, 18 bp, Homo sapiens
tgggcctcaggctctgca

SEQ ID NO: 5955368 - DNA, 17 bp, Homo sapiens
tgggcctcatcacagca

SEQ ID NO: 5955369 - DNA, 16 bp, Homo sapiens
tgggcctcatgaataa

SEQ ID NO: 5955370 - DNA, 17 bp, Homo sapiens
tgggcctcatgaataaa

SEQ ID NO: 5955371 - DNA, 19 bp, Homo sapiens
tgggcctcatgaataaatg

SEQ ID NO: 5955372 - DNA, 17 bp, Homo sapiens
tgggcctccacctctgt

SEQ ID NO: 5955373 - DNA, 18 bp, Homo sapiens
tgggcctccatgccccag

SEQ ID NO: 5955374 - DNA, 15 bp, Homo sapiens
tgggcctcccactcc

SEQ ID NO: 5955375 - DNA, 21 bp, Homo sapiens
tgggcctcccactcccatggc

SEQ ID NO: 5955376 - DNA, 20 bp, Homo sapiens
tgggcctcccatagtgctgg

SEQ ID NO: 5955377 - DNA, 16 bp, Homo sapiens
tgggcctcccttgggc

SEQ ID NO: 5955378 - DNA, 20 bp, Homo sapiens
tgggcctcctctccctgcac

SEQ ID NO: 5955379 - DNA, 20 bp, Homo sapiens
tgggcctcctctgtccaggg

SEQ ID NO: 5955380 - DNA, 16 bp, Homo sapiens
tgggcctcctgtgtgt

SEQ ID NO: 5955381 - DNA, 17 bp, Homo sapiens
tgggcctccttcccatg

SEQ ID NO: 5955382 - DNA, 14 bp, Homo sapiens
tgggcctctcctgc

SEQ ID NO: 5955383 - DNA, 15 bp, Homo sapiens
tgggcctctctgggg

SEQ ID NO: 5955384 - DNA, 16 bp, Homo sapiens
tgggcctctggtttgg

SEQ ID NO: 5955385 - DNA, 21 bp, Homo sapiens
tgggcctctggtttggggcga

SEQ ID NO: 5955386 - DNA, 21 bp, Homo sapiens
tgggcctcttggaaaaagtga

SEQ ID NO: 5955387 - DNA, 21 bp, Homo sapiens
tgggcctctttttgcccttta

SEQ ID NO: 5955388 - DNA, 13 bp, Homo sapiens
tgggcctgaactc

SEQ ID NO: 5955389 - DNA, 23 bp, Homo sapiens
tgggcctgaactcattctcttct

SEQ ID NO: 5955390 - DNA, 19 bp, Homo sapiens
tgggcctgactgttgcccc

SEQ ID NO: 5955391 - DNA, 13 bp, Homo sapiens
tgggcctgagtga

SEQ ID NO: 5955392 - DNA, 18 bp, Homo sapiens
tgggcctgatggagagga

SEQ ID NO: 5955393 - DNA, 19 bp, Homo sapiens
tgggcctgatggagaggag

SEQ ID NO: 5955394 - DNA, 21 bp, Homo sapiens
tgggcctgatggagaggagaa

SEQ ID NO: 5955395 - DNA, 20 bp, Homo sapiens
tgggcctgatggtggggcca

SEQ ID NO: 5955396 - DNA, 16 bp, Homo sapiens
tgggcctgcctgcctc

SEQ ID NO: 5955397 - DNA, 17 bp, Homo sapiens
tgggcctgcgagaccca

SEQ ID NO: 5955398 - DNA, 18 bp, Homo sapiens
tgggcctgctccagacct

SEQ ID NO: 5955399 - DNA, 14 bp, Homo sapiens
tgggcctgctgagg

SEQ ID NO: 5955400 - DNA, 15 bp, Homo sapiens
tgggcctgctgaggc

SEQ ID NO: 5955401 - DNA, 13 bp, Homo sapiens
tgggcctgctgcg

SEQ ID NO: 5955402 - DNA, 14 bp, Homo sapiens
tgggcctgctgctg

SEQ ID NO: 5955403 - DNA, 17 bp, Homo sapiens
tgggcctgcttcctgtc

SEQ ID NO: 5955404 - DNA, 21 bp, Homo sapiens
tgggcctgcttttccaggatc

SEQ ID NO: 5955405 - DNA, 23 bp, Homo sapiens
tgggcctgcttttccaggatcct

SEQ ID NO: 5955406 - DNA, 13 bp, Homo sapiens
tgggcctggagcc

SEQ ID NO: 5955407 - DNA, 23 bp, Homo sapiens
tgggcctggagccctgggcggag

SEQ ID NO: 5955408 - DNA, 23 bp, Homo sapiens
tgggcctggccagtcttcctctt

SEQ ID NO: 5955409 - DNA, 17 bp, Homo sapiens
tgggcctggccctgctt

SEQ ID NO: 5955410 - DNA, 20 bp, Homo sapiens
tgggcctggccctgctttct

SEQ ID NO: 5955411 - DNA, 15 bp, Homo sapiens
tgggcctggcctgag

SEQ ID NO: 5955412 - DNA, 20 bp, Homo sapiens
tgggcctggcctgagctggg

SEQ ID NO: 5955413 - DNA, 12 bp, Homo sapiens
tgggcctgggcc

SEQ ID NO: 5955414 - DNA, 13 bp, Homo sapiens
tgggcctgggcct

SEQ ID NO: 5955415 - DNA, 15 bp, Homo sapiens
tgggcctgggcctct

SEQ ID NO: 5955416 - DNA, 15 bp, Homo sapiens
tgggcctgggcctgc

SEQ ID NO: 5955417 - DNA, 17 bp, Homo sapiens
tgggcctgggcctgctt

SEQ ID NO: 5955418 - DNA, 18 bp, Homo sapiens
tgggcctgggctagggga

SEQ ID NO: 5955419 - DNA, 16 bp, Homo sapiens
tgggcctgggctcctg

SEQ ID NO: 5955420 - DNA, 18 bp, Homo sapiens
tgggcctgggctcctgga

SEQ ID NO: 5955421 - DNA, 21 bp, Homo sapiens
tgggcctggtctcaccctgga

SEQ ID NO: 5955422 - DNA, 23 bp, Homo sapiens
tgggcctggttaaataaggcagg

SEQ ID NO: 5955423 - DNA, 13 bp, Homo sapiens
tgggcctgtatga

SEQ ID NO: 5955424 - DNA, 18 bp, Homo sapiens
tgggcctgtatgagacag

SEQ ID NO: 5955425 - DNA, 17 bp, Homo sapiens
tgggcctgtcgtgccag

SEQ ID NO: 5955426 - DNA, 21 bp, Homo sapiens
tgggcctgtcgtgccagtcct

SEQ ID NO: 5955427 - DNA, 22 bp, Homo sapiens
tgggcctgtcgtgccagtcctg

SEQ ID NO: 5955428 - DNA, 14 bp, Homo sapiens
tgggcctgtctcag

SEQ ID NO: 5955429 - DNA, 15 bp, Homo sapiens
tgggcctgtgcactg

SEQ ID NO: 5955430 - DNA, 20 bp, Homo sapiens
tgggcctgtgcactgggcag

SEQ ID NO: 5955431 - DNA, 15 bp, Homo sapiens
tgggcctgtgcagca

SEQ ID NO: 5955432 - DNA, 20 bp, Homo sapiens
tgggcctgtgcagcagccca

SEQ ID NO: 5955433 - DNA, 23 bp, Homo sapiens
tgggcctgtgcagcagcccagct

SEQ ID NO: 5955434 - DNA, 15 bp, Homo sapiens
tgggcctgtgtgtgg

SEQ ID NO: 5955435 - DNA, 14 bp, Homo sapiens
tgggcctgttcctt

SEQ ID NO: 5955436 - DNA, 19 bp, Homo sapiens
tgggccttacctcccctgc

SEQ ID NO: 5955437 - DNA, 22 bp, Homo sapiens
tgggccttacctcccctgccag

SEQ ID NO: 5955438 - DNA, 16 bp, Homo sapiens
tgggccttagtgggcc

SEQ ID NO: 5955439 - DNA, 23 bp, Homo sapiens
tgggccttagtgggccagggctg

SEQ ID NO: 5955440 - DNA, 15 bp, Homo sapiens
tgggccttcaccaag

SEQ ID NO: 5955441 - DNA, 11 bp, Homo sapiens
tgggccttcag

SEQ ID NO: 5955442 - DNA, 20 bp, Homo sapiens
tggggaccccctcaggattg

SEQ ID NO: 5955443 - DNA, 22 bp, Homo sapiens
tggggacccctcgcaaccctgc

SEQ ID NO: 5955444 - DNA, 17 bp, Homo sapiens
tggggacccgctggggg

SEQ ID NO: 5955445 - DNA, 19 bp, Homo sapiens
tggggaccggttcccacaa

SEQ ID NO: 5955446 - DNA, 14 bp, Homo sapiens
tggggacctcagcc

SEQ ID NO: 5955447 - DNA, 16 bp, Homo sapiens
tggggacctcagcctg

SEQ ID NO: 5955448 - DNA, 18 bp, Homo sapiens
tggggacctcagcctgca

SEQ ID NO: 5955449 - DNA, 18 bp, Homo sapiens
tggggacctgatggagag

SEQ ID NO: 5955450 - DNA, 18 bp, Homo sapiens
tggggacgaattccactc

SEQ ID NO: 5955451 - DNA, 14 bp, Homo sapiens
tggggacgcagatg

SEQ ID NO: 5955452 - DNA, 16 bp, Homo sapiens
tggggacgcagatgag

SEQ ID NO: 5955453 - DNA, 21 bp, Homo sapiens
tggggacgccaaggaggtggg

SEQ ID NO: 5955454 - DNA, 20 bp, Homo sapiens
tggggacgggggctgcttct

SEQ ID NO: 5955455 - DNA, 19 bp, Homo sapiens
tggggacggggggccccag

SEQ ID NO: 5955456 - DNA, 20 bp, Homo sapiens
tggggacggggggccccagt

SEQ ID NO: 5955457 - DNA, 21 bp, Homo sapiens
tggggacgtgaacgttttaat

SEQ ID NO: 5955458 - DNA, 20 bp, Homo sapiens
tggggacgtgtgtcctttgg

SEQ ID NO: 5955459 - DNA, 17 bp, Homo sapiens
tggggactaagggaaga

SEQ ID NO: 5955460 - DNA, 23 bp, Homo sapiens
tggggactccggctgtgctggga

SEQ ID NO: 5955461 - DNA, 16 bp, Homo sapiens
tggggactctccaggc

SEQ ID NO: 5955462 - DNA, 19 bp, Homo sapiens
tggggactctccaggcacc

SEQ ID NO: 5955463 - DNA, 14 bp, Homo sapiens
tggggactctgccg

SEQ ID NO: 5955464 - DNA, 14 bp, Homo sapiens
tggggactctggca

SEQ ID NO: 5955465 - DNA, 12 bp, Homo sapiens
tggggactgggc

SEQ ID NO: 5955466 - DNA, 21 bp, Homo sapiens
tggggactgttccaaagccag

SEQ ID NO: 5955467 - DNA, 20 bp, Homo sapiens
tggggacttcaactgcccag

SEQ ID NO: 5955468 - DNA, 16 bp, Homo sapiens
tggggacttcccggga

SEQ ID NO: 5955469 - DNA, 14 bp, Homo sapiens
tggggacttggcct

SEQ ID NO: 5955470 - DNA, 21 bp, Homo sapiens
tggggagaagaaacaagaaaa

SEQ ID NO: 5955471 - DNA, 20 bp, Homo sapiens
tggggagaagtgagggctgg

SEQ ID NO: 5955472 - DNA, 23 bp, Homo sapiens
tggggagacataaccactgcttc

SEQ ID NO: 5955473 - DNA, 15 bp, Homo sapiens
tggggagagagccct

SEQ ID NO: 5955474 - DNA, 15 bp, Homo sapiens
tggggagagatggca

SEQ ID NO: 5955475 - DNA, 19 bp, Homo sapiens
tggggagagcggctggaga

SEQ ID NO: 5955476 - DNA, 23 bp, Homo sapiens
tggggagatcggggccagaggca

SEQ ID NO: 5955477 - DNA, 14 bp, Homo sapiens
tggggagatttgcc

SEQ ID NO: 5955478 - DNA, 12 bp, Homo sapiens
tggggagcagag

SEQ ID NO: 5955479 - DNA, 15 bp, Homo sapiens
tggggagcagagaca

SEQ ID NO: 5955480 - DNA, 23 bp, Homo sapiens
tggggagcaggaggccaataaaa

SEQ ID NO: 5955481 - DNA, 22 bp, Homo sapiens
tggggagccaacagaagcttcc

SEQ ID NO: 5955482 - DNA, 22 bp, Homo sapiens
tggggagcccaggcctggcctc

SEQ ID NO: 5955483 - DNA, 17 bp, Homo sapiens
tggggagccctcaggct

SEQ ID NO: 5955484 - DNA, 24 bp, Homo sapiens
tggggagccctcaggctccccaga

SEQ ID NO: 5955485 - DNA, 22 bp, Homo sapiens
tggggagcggagcttggccctg

SEQ ID NO: 5955486 - DNA, 12 bp, Homo sapiens
tggggagctaag

SEQ ID NO: 5955487 - DNA, 14 bp, Homo sapiens
tggggagctcctgg

SEQ ID NO: 5955488 - DNA, 18 bp, Homo sapiens
tggggagctcctggccag

SEQ ID NO: 5955489 - DNA, 14 bp, Homo sapiens
tggggagctggcct

SEQ ID NO: 5955490 - DNA, 16 bp, Homo sapiens
tggggaggaaatagaa

SEQ ID NO: 5955491 - DNA, 17 bp, Homo sapiens
tggggaggaagggccag

SEQ ID NO: 5955492 - DNA, 21 bp, Homo sapiens
tggggaggaagggccaggaga

SEQ ID NO: 5955493 - DNA, 19 bp, Homo sapiens
tggggaggaatcctggacc

SEQ ID NO: 5955494 - DNA, 15 bp, Homo sapiens
tggggaggacaaaac

SEQ ID NO: 5955495 - DNA, 18 bp, Homo sapiens
tggggaggacaaaacttc

SEQ ID NO: 5955496 - DNA, 15 bp, Homo sapiens
tggggaggaccaggg

SEQ ID NO: 5955497 - DNA, 14 bp, Homo sapiens
tggggaggacccct

SEQ ID NO: 5955498 - DNA, 20 bp, Homo sapiens
tggggaggacccctgccctc

SEQ ID NO: 5955499 - DNA, 19 bp, Homo sapiens
tggggaggagactcaggcc

SEQ ID NO: 5955500 - DNA, 16 bp, Homo sapiens
tggggaggaggaagcc

SEQ ID NO: 5955501 - DNA, 15 bp, Homo sapiens
tggggaggaggagag

SEQ ID NO: 5955502 - DNA, 19 bp, Homo sapiens
tggggaggcactcgctgtt

SEQ ID NO: 5955503 - DNA, 12 bp, Homo sapiens
tggggaggcagc

SEQ ID NO: 5955504 - DNA, 16 bp, Homo sapiens
tggggaggcagcagag

SEQ ID NO: 5955505 - DNA, 15 bp, Homo sapiens
tggggaggcagctcc

SEQ ID NO: 5955506 - DNA, 20 bp, Homo sapiens
tggggaggccatttgctgcc

SEQ ID NO: 5955507 - DNA, 23 bp, Homo sapiens
tggggaggccatttgctgccctg

SEQ ID NO: 5955508 - DNA, 13 bp, Homo sapiens
tggggaggccctg

SEQ ID NO: 5955509 - DNA, 15 bp, Homo sapiens
tggggaggccctgcc

SEQ ID NO: 5955510 - DNA, 12 bp, Homo sapiens
tggggaggctga

SEQ ID NO: 5955511 - DNA, 17 bp, Homo sapiens
tggggaggctgagactg

SEQ ID NO: 5955512 - DNA, 16 bp, Homo sapiens
tggggagggagcctcg

SEQ ID NO: 5955513 - DNA, 16 bp, Homo sapiens
tggggagggagtctgg

SEQ ID NO: 5955514 - DNA, 18 bp, Homo sapiens
tggggagggattctggtt

SEQ ID NO: 5955515 - DNA, 16 bp, Homo sapiens
tggggagggcaggtcc

SEQ ID NO: 5955516 - DNA, 23 bp, Homo sapiens
tggggagggcaggtccagctctg

SEQ ID NO: 5955517 - DNA, 17 bp, Homo sapiens
tggggagggcgcttttg

SEQ ID NO: 5955518 - DNA, 16 bp, Homo sapiens
tggggaggggaatata

SEQ ID NO: 5955519 - DNA, 21 bp, Homo sapiens
tggggaggggaatatacacat

SEQ ID NO: 5955520 - DNA, 13 bp, Homo sapiens
tggggaggggaga

SEQ ID NO: 5955521 - DNA, 20 bp, Homo sapiens
tggggaggggcctggcctgg

SEQ ID NO: 5955522 - DNA, 12 bp, Homo sapiens
tggggaggggcg

SEQ ID NO: 5955523 - DNA, 19 bp, Homo sapiens
tggggaggggcggcaggag

SEQ ID NO: 5955524 - DNA, 15 bp, Homo sapiens
tggggaggggctctg

SEQ ID NO: 5955525 - DNA, 16 bp, Homo sapiens
tggggaggggctgagg

SEQ ID NO: 5955526 - DNA, 21 bp, Homo sapiens
tggggaggggggcgggtgacg

SEQ ID NO: 5955527 - DNA, 21 bp, Homo sapiens
tggggaggggggtaatagtga

SEQ ID NO: 5955528 - DNA, 19 bp, Homo sapiens
tggggaggggtcagctctg

SEQ ID NO: 5955529 - DNA, 20 bp, Homo sapiens
tggggaggggtcagctctgg

SEQ ID NO: 5955530 - DNA, 11 bp, Homo sapiens
tggggagggtc

SEQ ID NO: 5955531 - DNA, 19 bp, Homo sapiens
tggggaggtgctgggggag

SEQ ID NO: 5955532 - DNA, 16 bp, Homo sapiens
tggggaggtgtcacat

SEQ ID NO: 5955533 - DNA, 16 bp, Homo sapiens
tggggaggtgttcact

SEQ ID NO: 5955534 - DNA, 16 bp, Homo sapiens
tggggaggttgtgggg

SEQ ID NO: 5955535 - DNA, 19 bp, Homo sapiens
tggggagtaaacggcccag

SEQ ID NO: 5955536 - DNA, 20 bp, Homo sapiens
tggggagtaaacggcccagg

SEQ ID NO: 5955537 - DNA, 19 bp, Homo sapiens
tggggagtaggacatacca

SEQ ID NO: 5955538 - DNA, 21 bp, Homo sapiens
tggggagtcggttagtcattg

SEQ ID NO: 5955539 - DNA, 19 bp, Homo sapiens
tggggagtgagcttggtgc

SEQ ID NO: 5955540 - DNA, 14 bp, Homo sapiens
tggggagtgctgga

SEQ ID NO: 5955541 - DNA, 13 bp, Homo sapiens
tggggagtgggac

SEQ ID NO: 5955542 - DNA, 19 bp, Homo sapiens
tggggagttaagacctggc

SEQ ID NO: 5955543 - DNA, 16 bp, Homo sapiens
tggggagttataaaaa

SEQ ID NO: 5955544 - DNA, 20 bp, Homo sapiens
tggggataaaatgactactt

SEQ ID NO: 5955545 - DNA, 21 bp, Homo sapiens
tggggataaaatgactactta

SEQ ID NO: 5955546 - DNA, 19 bp, Homo sapiens
tggggatacatgaacttca

SEQ ID NO: 5955547 - DNA, 18 bp, Homo sapiens
tggggataggccagccgc

SEQ ID NO: 5955548 - DNA, 18 bp, Homo sapiens
tggggatagtctggaaag

SEQ ID NO: 5955549 - DNA, 16 bp, Homo sapiens
tggggatagtctgggt

SEQ ID NO: 5955550 - DNA, 19 bp, Homo sapiens
tggggatagtctgggtcag

SEQ ID NO: 5955551 - DNA, 17 bp, Homo sapiens
tggggatcaattttcat

SEQ ID NO: 5955552 - DNA, 20 bp, Homo sapiens
tggggatcccgtgctggaag

SEQ ID NO: 5955553 - DNA, 14 bp, Homo sapiens
tggggatcgatgtg

SEQ ID NO: 5955554 - DNA, 23 bp, Homo sapiens
tggggatgagaaaggttgaagca

SEQ ID NO: 5955555 - DNA, 14 bp, Homo sapiens
tggggatgcccttc

SEQ ID NO: 5955556 - DNA, 23 bp, Homo sapiens
tggggatggagaatgccagccca

SEQ ID NO: 5955557 - DNA, 21 bp, Homo sapiens
tggggatggggcctccctcct

SEQ ID NO: 5955558 - DNA, 22 bp, Homo sapiens
tggggatggtagttttttcatc

SEQ ID NO: 5955559 - DNA, 14 bp, Homo sapiens
tggggatggtggca

SEQ ID NO: 5955560 - DNA, 14 bp, Homo sapiens
tggggatgtaacca

SEQ ID NO: 5955561 - DNA, 18 bp, Homo sapiens
tggggatgtttgtgctgc

SEQ ID NO: 5955562 - DNA, 19 bp, Homo sapiens
tggggatgtttgtgctgca

SEQ ID NO: 5955563 - DNA, 21 bp, Homo sapiens
tggggattcaggggctttggg

SEQ ID NO: 5955564 - DNA, 22 bp, Homo sapiens
tggggattcaggggctttgggc

SEQ ID NO: 5955565 - DNA, 12 bp, Homo sapiens
tggggattctta

SEQ ID NO: 5955566 - DNA, 19 bp, Homo sapiens
tggggattgagttgtaaag

SEQ ID NO: 5955567 - DNA, 22 bp, Homo sapiens
tggggattgagttgtaaagaaa

SEQ ID NO: 5955568 - DNA, 15 bp, Homo sapiens
tggggattgccacta

SEQ ID NO: 5955569 - DNA, 20 bp, Homo sapiens
tggggattgggcccctgcca

SEQ ID NO: 5955570 - DNA, 23 bp, Homo sapiens
tggggattgggtgggcaggaaaa

SEQ ID NO: 5955571 - DNA, 15 bp, Homo sapiens
tggggattgtacacg

SEQ ID NO: 5955572 - DNA, 16 bp, Homo sapiens
tggggcaaagcctcct

SEQ ID NO: 5955573 - DNA, 21 bp, Homo sapiens
tggggcaagactgcaaacttt

SEQ ID NO: 5955574 - DNA, 13 bp, Homo sapiens
tggggcaagccag

SEQ ID NO: 5955575 - DNA, 17 bp, Homo sapiens
tggggcaagccagggcc

SEQ ID NO: 5955576 - DNA, 19 bp, Homo sapiens
tggggcaagccagggccca

SEQ ID NO: 5955577 - DNA, 21 bp, Homo sapiens
tggggcaagccagggcccaga

SEQ ID NO: 5955578 - DNA, 22 bp, Homo sapiens
tggggcaagccagggcccagag

SEQ ID NO: 5955579 - DNA, 23 bp, Homo sapiens
tggggcaatgactttcctagaca

SEQ ID NO: 5955580 - DNA, 19 bp, Homo sapiens
tggggcaatggggagaggc

SEQ ID NO: 5955581 - DNA, 11 bp, Homo sapiens
tggggcacagt

SEQ ID NO: 5955582 - DNA, 17 bp, Homo sapiens
tggggcacggctctggg

SEQ ID NO: 5955583 - DNA, 16 bp, Homo sapiens
tggggcactgggcgtc

SEQ ID NO: 5955584 - DNA, 20 bp, Homo sapiens
tggggcactgtttcttctca

SEQ ID NO: 5955585 - DNA, 13 bp, Homo sapiens
tggggcagaagag

SEQ ID NO: 5955586 - DNA, 11 bp, Homo sapiens
tggggcagagc

SEQ ID NO: 5955587 - DNA, 19 bp, Homo sapiens
tggggcagagcttctcctg

SEQ ID NO: 5955588 - DNA, 16 bp, Homo sapiens
tggggcagaggaagcc

SEQ ID NO: 5955589 - DNA, 17 bp, Homo sapiens
tggggcagaggagaact

SEQ ID NO: 5955590 - DNA, 17 bp, Homo sapiens
tggggcagagtggagcc

SEQ ID NO: 5955591 - DNA, 20 bp, Homo sapiens
tggggcagagtggagcccag

SEQ ID NO: 5955592 - DNA, 22 bp, Homo sapiens
tggggcagagtggagcccaggg

SEQ ID NO: 5955593 - DNA, 22 bp, Homo sapiens
tggggcagatggcagggctgag

SEQ ID NO: 5955594 - DNA, 10 bp, Homo sapiens
tggggcagca

SEQ ID NO: 5955595 - DNA, 13 bp, Homo sapiens
tggggcagcacag

SEQ ID NO: 5955596 - DNA, 13 bp, Homo sapiens
tggggcagcactc

SEQ ID NO: 5955597 - DNA, 23 bp, Homo sapiens
tggggcagcccccatgggctcct

SEQ ID NO: 5955598 - DNA, 20 bp, Homo sapiens
tggggcagcctccttgcctg

SEQ ID NO: 5955599 - DNA, 15 bp, Homo sapiens
tggggcaggaccact

SEQ ID NO: 5955600 - DNA, 12 bp, Homo sapiens
tggggcaggagt

SEQ ID NO: 5955601 - DNA, 15 bp, Homo sapiens
tggggcaggagtagc

SEQ ID NO: 5955602 - DNA, 18 bp, Homo sapiens
tggggcaggagtagctga

SEQ ID NO: 5955603 - DNA, 20 bp, Homo sapiens
tggggcaggagtagctgagc

SEQ ID NO: 5955604 - DNA, 23 bp, Homo sapiens
tggggcaggagtgccaggaccag

SEQ ID NO: 5955605 - DNA, 24 bp, Homo sapiens
tggggcaggagtgccaggaccagc

SEQ ID NO: 5955606 - DNA, 14 bp, Homo sapiens
tggggcaggcagtg

SEQ ID NO: 5955607 - DNA, 21 bp, Homo sapiens
tggggcaggccacctggctct

SEQ ID NO: 5955608 - DNA, 23 bp, Homo sapiens
tggggcaggctctctcctctctc

SEQ ID NO: 5955609 - DNA, 15 bp, Homo sapiens
tggggcaggctgggc

SEQ ID NO: 5955610 - DNA, 16 bp, Homo sapiens
tggggcaggctgggcc

SEQ ID NO: 5955611 - DNA, 15 bp, Homo sapiens
tggggcagggcccag

SEQ ID NO: 5955612 - DNA, 16 bp, Homo sapiens
tggggcagggcccagg

SEQ ID NO: 5955613 - DNA, 16 bp, Homo sapiens
tggggcagggcctggg

SEQ ID NO: 5955614 - DNA, 13 bp, Homo sapiens
tggggcaggggcc

SEQ ID NO: 5955615 - DNA, 16 bp, Homo sapiens
tggggcaggggccggg

SEQ ID NO: 5955616 - DNA, 18 bp, Homo sapiens
tggggcaggggccggggg

SEQ ID NO: 5955617 - DNA, 23 bp, Homo sapiens
tggggcaggggtgcttcctcctc

SEQ ID NO: 5955618 - DNA, 18 bp, Homo sapiens
tggggcagtgcttggccc

SEQ ID NO: 5955619 - DNA, 15 bp, Homo sapiens
tggggttctctacag

SEQ ID NO: 5955620 - DNA, 23 bp, Homo sapiens
tggggttcttgtccacggggctc

SEQ ID NO: 5955621 - DNA, 14 bp, Homo sapiens
tggggttgccagag

SEQ ID NO: 5955622 - DNA, 16 bp, Homo sapiens
tggggttgccagaggc

SEQ ID NO: 5955623 - DNA, 17 bp, Homo sapiens
tggggttgccagaggcc

SEQ ID NO: 5955624 - DNA, 19 bp, Homo sapiens
tggggttgccagaggccct

SEQ ID NO: 5955625 - DNA, 18 bp, Homo sapiens
tggggttgcccagcctgg

SEQ ID NO: 5955626 - DNA, 21 bp, Homo sapiens
tggggttggcaacaggacaga

SEQ ID NO: 5955627 - DNA, 18 bp, Homo sapiens
tggggttggctgggccca

SEQ ID NO: 5955628 - DNA, 18 bp, Homo sapiens
tggggttggggcaaagcc

SEQ ID NO: 5955629 - DNA, 22 bp, Homo sapiens
tggggttgggggacagccttca

SEQ ID NO: 5955630 - DNA, 16 bp, Homo sapiens
tggggtttagaacccc

SEQ ID NO: 5955631 - DNA, 23 bp, Homo sapiens
tggggtttagaaccccaggtgag

SEQ ID NO: 5955632 - DNA, 15 bp, Homo sapiens
tggggtttcctgcat

SEQ ID NO: 5955633 - DNA, 22 bp, Homo sapiens
tggggtttcctgcatggacagt

SEQ ID NO: 5955634 - DNA, 13 bp, Homo sapiens
tggggtttcctgg

SEQ ID NO: 5955635 - DNA, 14 bp, Homo sapiens
tggggtttcctggc

SEQ ID NO: 5955636 - DNA, 15 bp, Homo sapiens
tggggtttcgcagcc

SEQ ID NO: 5955637 - DNA, 18 bp, Homo sapiens
tggggtttcgcagcctga

SEQ ID NO: 5955638 - DNA, 16 bp, Homo sapiens
tggggtttgaagctga

SEQ ID NO: 5955639 - DNA, 18 bp, Homo sapiens
tggggtttgaccacccac

SEQ ID NO: 5955640 - DNA, 23 bp, Homo sapiens
tggggtttgtgtttgattggctt

SEQ ID NO: 5955641 - DNA, 22 bp, Homo sapiens
tggggttttgacttgccactgc

SEQ ID NO: 5955642 - DNA, 20 bp, Homo sapiens
tggggtttttgccctggagc

SEQ ID NO: 5955643 - DNA, 21 bp, Homo sapiens
tggggttttttttttctgaat

SEQ ID NO: 5955644 - DNA, 23 bp, Homo sapiens
tggggttttttttttctgaataa

SEQ ID NO: 5955645 - DNA, 18 bp, Homo sapiens
tgggtaaaagcagggcag

SEQ ID NO: 5955646 - DNA, 23 bp, Homo sapiens
tgggtaaaatacttttactctgc

SEQ ID NO: 5955647 - DNA, 14 bp, Homo sapiens
tgggtaaataaatg

SEQ ID NO: 5955648 - DNA, 18 bp, Homo sapiens
tgggtaaataaatgctgc

SEQ ID NO: 5955649 - DNA, 20 bp, Homo sapiens
tgggtaaataaatgctgctt

SEQ ID NO: 5955650 - DNA, 23 bp, Homo sapiens
tgggtaaataaatgctgctttgg

SEQ ID NO: 5955651 - DNA, 13 bp, Homo sapiens
tgggtaaatatac

SEQ ID NO: 5955652 - DNA, 18 bp, Homo sapiens
tgggtaaatcagggacag

SEQ ID NO: 5955653 - DNA, 19 bp, Homo sapiens
tgggtaaatcagggacagg

SEQ ID NO: 5955654 - DNA, 15 bp, Homo sapiens
tgggtaaatgcaaag

SEQ ID NO: 5955655 - DNA, 15 bp, Homo sapiens
tgggtaaatgcagcg

SEQ ID NO: 5955656 - DNA, 16 bp, Homo sapiens
tgggtaactagggaag

SEQ ID NO: 5955657 - DNA, 12 bp, Homo sapiens
tgggtaagaaga

SEQ ID NO: 5955658 - DNA, 14 bp, Homo sapiens
tgggtaagaagaaa

SEQ ID NO: 5955659 - DNA, 14 bp, Homo sapiens
tgggtaagggaggg

SEQ ID NO: 5955660 - DNA, 18 bp, Homo sapiens
tgggtaattgtacaataa

SEQ ID NO: 5955661 - DNA, 16 bp, Homo sapiens
tgggtaatttataaag

SEQ ID NO: 5955662 - DNA, 22 bp, Homo sapiens
tgggtacatcaagtccatctga

SEQ ID NO: 5955663 - DNA, 16 bp, Homo sapiens
tgggtacatgtgagga

SEQ ID NO: 5955664 - DNA, 15 bp, Homo sapiens
tgggtacccccagga

SEQ ID NO: 5955665 - DNA, 21 bp, Homo sapiens
tgggtacctattttcattgta

SEQ ID NO: 5955666 - DNA, 22 bp, Homo sapiens
tgggtacctgcaagcagaactt

SEQ ID NO: 5955667 - DNA, 22 bp, Homo sapiens
tgggtactactgctgcaaagtg

SEQ ID NO: 5955668 - DNA, 17 bp, Homo sapiens
tgggtactccagcaggt

SEQ ID NO: 5955669 - DNA, 14 bp, Homo sapiens
tgggtactgtctcg

SEQ ID NO: 5955670 - DNA, 19 bp, Homo sapiens
tgggtactgtctcggcaga

SEQ ID NO: 5955671 - DNA, 17 bp, Homo sapiens
tgggtacttgtggacac

SEQ ID NO: 5955672 - DNA, 18 bp, Homo sapiens
tgggtacttgtggacaca

SEQ ID NO: 5955673 - DNA, 17 bp, Homo sapiens
tgggtactttctgaaaa

SEQ ID NO: 5955674 - DNA, 18 bp, Homo sapiens
tgggtactttctgaaaat

SEQ ID NO: 5955675 - DNA, 23 bp, Homo sapiens
tgggtactttctgaaaatttata

SEQ ID NO: 5955676 - DNA, 21 bp, Homo sapiens
tgggtagaaaaattattagaa

SEQ ID NO: 5955677 - DNA, 12 bp, Homo sapiens
tgggtagaagcc

SEQ ID NO: 5955678 - DNA, 15 bp, Homo sapiens
tgggtagaagccacc

SEQ ID NO: 5955679 - DNA, 19 bp, Homo sapiens
tgggtagaagccacccttc

SEQ ID NO: 5955680 - DNA, 22 bp, Homo sapiens
tgggtagaagccacccttccct

SEQ ID NO: 5955681 - DNA, 14 bp, Homo sapiens
tgggtagacacaca

SEQ ID NO: 5955682 - DNA, 15 bp, Homo sapiens
tgggtagatgggtgg

SEQ ID NO: 5955683 - DNA, 18 bp, Homo sapiens
tgggtagatgggtggggg

SEQ ID NO: 5955684 - DNA, 13 bp, Homo sapiens
tgggtagctgtaa

SEQ ID NO: 5955685 - DNA, 23 bp, Homo sapiens
tgggtaggaaagaggaagcaaat

SEQ ID NO: 5955686 - DNA, 21 bp, Homo sapiens
tgggtaggagcccttctcttt

SEQ ID NO: 5955687 - DNA, 22 bp, Homo sapiens
tgggtaggagcccttctctttg

SEQ ID NO: 5955688 - DNA, 21 bp, Homo sapiens
tgggtaggccccacaaggcct

SEQ ID NO: 5955689 - DNA, 17 bp, Homo sapiens
tgggtagggcagacatg

SEQ ID NO: 5955690 - DNA, 17 bp, Homo sapiens
tgggtagggctctgaca

SEQ ID NO: 5955691 - DNA, 18 bp, Homo sapiens
tgggtagggtaaatcagt

SEQ ID NO: 5955692 - DNA, 22 bp, Homo sapiens
tgggtagggtagtggctggggt

SEQ ID NO: 5955693 - DNA, 21 bp, Homo sapiens
tgggtaggtgttgaaaatgag

SEQ ID NO: 5955694 - DNA, 18 bp, Homo sapiens
tgggtataagcagagagg

SEQ ID NO: 5955695 - DNA, 23 bp, Homo sapiens
tgggtatcaggactgtgaccaaa

SEQ ID NO: 5955696 - DNA, 19 bp, Homo sapiens
tgggtatcccacctccagc

SEQ ID NO: 5955697 - DNA, 14 bp, Homo sapiens
tgggtatcccctgc

SEQ ID NO: 5955698 - DNA, 18 bp, Homo sapiens
tgggtatcccctgcctcc

SEQ ID NO: 5955699 - DNA, 23 bp, Homo sapiens
tgggtatcccctgcctcctgcca

SEQ ID NO: 5955700 - DNA, 16 bp, Homo sapiens
tgggtatgaactaaaa

SEQ ID NO: 5955701 - DNA, 16 bp, Homo sapiens
tgggtatgctctgtga

SEQ ID NO: 5955702 - DNA, 18 bp, Homo sapiens
tgggtatgtagaactgta

SEQ ID NO: 5955703 - DNA, 21 bp, Homo sapiens
tgggtatgttaacctaggcag

SEQ ID NO: 5955704 - DNA, 13 bp, Homo sapiens
tgggtattaaact

SEQ ID NO: 5955705 - DNA, 15 bp, Homo sapiens
tgggtattaccatgt

SEQ ID NO: 5955706 - DNA, 16 bp, Homo sapiens
tgggtatttcctgcta

SEQ ID NO: 5955707 - DNA, 20 bp, Homo sapiens
tgggtatttcttatttgaaa

SEQ ID NO: 5955708 - DNA, 21 bp, Homo sapiens
tgggtatttgcaatattcctt

SEQ ID NO: 5955709 - DNA, 21 bp, Homo sapiens
tgggtatttttataacaatat

SEQ ID NO: 5955710 - DNA, 22 bp, Homo sapiens
tgggtatttttataacaatata

SEQ ID NO: 5955711 - DNA, 17 bp, Homo sapiens
tgggtcaaaaaaaagaa

SEQ ID NO: 5955712 - DNA, 19 bp, Homo sapiens
tgggtcaaaagagccctgg

SEQ ID NO: 5955713 - DNA, 16 bp, Homo sapiens
tgggtcaactccaagg

SEQ ID NO: 5955714 - DNA, 14 bp, Homo sapiens
tgggtcaaggacag

SEQ ID NO: 5955715 - DNA, 14 bp, Homo sapiens
tgggtcaccagaaa

SEQ ID NO: 5955716 - DNA, 16 bp, Homo sapiens
tgggtcagaaccagag

SEQ ID NO: 5955717 - DNA, 16 bp, Homo sapiens
tgggtcagcccagcac

SEQ ID NO: 5955718 - DNA, 13 bp, Homo sapiens
tgggtcaggcagg

SEQ ID NO: 5955719 - DNA, 14 bp, Homo sapiens
tgggtcaggccacc

SEQ ID NO: 5955720 - DNA, 19 bp, Homo sapiens
tgggtcaggttcttgcctt

SEQ ID NO: 5955721 - DNA, 23 bp, Homo sapiens
tgggtcagtgtccaaagcagggt

SEQ ID NO: 5955722 - DNA, 14 bp, Homo sapiens
tgggtcatagaaat

SEQ ID NO: 5955723 - DNA, 19 bp, Homo sapiens
tgggtcatatgtttattca

SEQ ID NO: 5955724 - DNA, 23 bp, Homo sapiens
tgggtcatatgtttattcaaaat

SEQ ID NO: 5955725 - DNA, 23 bp, Homo sapiens
tgggtcatcccagcacctgccag

SEQ ID NO: 5955726 - DNA, 18 bp, Homo sapiens
tgggtcatgcactgaggt

SEQ ID NO: 5955727 - DNA, 13 bp, Homo sapiens
tgggtccaaataa

SEQ ID NO: 5955728 - DNA, 14 bp, Homo sapiens
tgggtccaaataaa

SEQ ID NO: 5955729 - DNA, 17 bp, Homo sapiens
tgggtccaccctgtcct

SEQ ID NO: 5955730 - DNA, 23 bp, Homo sapiens
tgggtccaggaaggcagctgctc

SEQ ID NO: 5955731 - DNA, 17 bp, Homo sapiens
tgggtccaggcctactc

SEQ ID NO: 5955732 - DNA, 12 bp, Homo sapiens
tgggtccaggga

SEQ ID NO: 5955733 - DNA, 13 bp, Homo sapiens
tgggtccagggcc

SEQ ID NO: 5955734 - DNA, 14 bp, Homo sapiens
tgggtccagggcct

SEQ ID NO: 5955735 - DNA, 13 bp, Homo sapiens
tgggtccagggga

SEQ ID NO: 5955736 - DNA, 15 bp, Homo sapiens
tgggtccaggggatg

SEQ ID NO: 5955737 - DNA, 17 bp, Homo sapiens
tgggtccattcagatga

SEQ ID NO: 5955738 - DNA, 22 bp, Homo sapiens
tgggtcccagagacctcatcag

SEQ ID NO: 5955739 - DNA, 12 bp, Homo sapiens
tgggtcccagct

SEQ ID NO: 5955740 - DNA, 21 bp, Homo sapiens
tgggtcccagggctggcccta

SEQ ID NO: 5955741 - DNA, 22 bp, Homo sapiens
tgggtcccagggctggccctag

SEQ ID NO: 5955742 - DNA, 23 bp, Homo sapiens
tgggtccccccgagtctccggga

SEQ ID NO: 5955743 - DNA, 18 bp, Homo sapiens
tgggtccccctcagcaag

SEQ ID NO: 5955744 - DNA, 15 bp, Homo sapiens
tgggtccctctgccc

SEQ ID NO: 5955745 - DNA, 20 bp, Homo sapiens
tgggtccctgcgtctcctgc

SEQ ID NO: 5955746 - DNA, 14 bp, Homo sapiens
tgggtccctgctcc

SEQ ID NO: 5955747 - DNA, 15 bp, Homo sapiens
tgggtccctgctccc

SEQ ID NO: 5955748 - DNA, 18 bp, Homo sapiens
tgggtcccttgaaggaag

SEQ ID NO: 5955749 - DNA, 23 bp, Homo sapiens
tgggtccgagagggaagctggct

SEQ ID NO: 5955750 - DNA, 16 bp, Homo sapiens
tgggtccgataatatc

SEQ ID NO: 5955751 - DNA, 22 bp, Homo sapiens
tgggtccgccttaatctggaag

SEQ ID NO: 5955752 - DNA, 16 bp, Homo sapiens
tgggtcctactcctgg

SEQ ID NO: 5955753 - DNA, 15 bp, Homo sapiens
tgggtcctagccctt

SEQ ID NO: 5955754 - DNA, 21 bp, Homo sapiens
tgggtcctcccagctgacggc

SEQ ID NO: 5955755 - DNA, 19 bp, Homo sapiens
tgggtcctcggcccatctg

SEQ ID NO: 5955756 - DNA, 18 bp, Homo sapiens
tgggtcctcgggcccctg

SEQ ID NO: 5955757 - DNA, 20 bp, Homo sapiens
tgggtcctcgggcccctgag

SEQ ID NO: 5955758 - DNA, 20 bp, Homo sapiens
tgggtcctctgcttcctgag

SEQ ID NO: 5955759 - DNA, 19 bp, Homo sapiens
tgggtcctgcaatctccag

SEQ ID NO: 5955760 - DNA, 21 bp, Homo sapiens
tgggtcctgcaatctccaggg

SEQ ID NO: 5955761 - DNA, 14 bp, Homo sapiens
tgggtcctgcaatt

SEQ ID NO: 5955762 - DNA, 20 bp, Homo sapiens
tgggtcctgcaattctacag

SEQ ID NO: 5955763 - DNA, 13 bp, Homo sapiens
tgggtcctgccag

SEQ ID NO: 5955764 - DNA, 18 bp, Homo sapiens
tgggtcctgccagctgga

SEQ ID NO: 5955765 - DNA, 15 bp, Homo sapiens
tgggtcctgcctgca

SEQ ID NO: 5955766 - DNA, 17 bp, Homo sapiens
tgggtcctgcctggtcc

SEQ ID NO: 5955767 - DNA, 16 bp, Homo sapiens
tgggtcctgctgctcg

SEQ ID NO: 5955768 - DNA, 18 bp, Homo sapiens
tgggtccttgatgccaga

SEQ ID NO: 5955769 - DNA, 13 bp, Homo sapiens
tgggtcgcccctc

SEQ ID NO: 5955770 - DNA, 18 bp, Homo sapiens
tgggtcgccctggactgt

SEQ ID NO: 5955771 - DNA, 15 bp, Homo sapiens
tgggtcggccctgcc

SEQ ID NO: 5955772 - DNA, 18 bp, Homo sapiens
tgggtcggccctgcccaa

SEQ ID NO: 5955773 - DNA, 19 bp, Homo sapiens
tgggtcgggacagaccagc

SEQ ID NO: 5955774 - DNA, 22 bp, Homo sapiens
tgggtcgtagagccttgacaat

SEQ ID NO: 5955775 - DNA, 23 bp, Homo sapiens
tgggtctaaggggttggttgagg

SEQ ID NO: 5955776 - DNA, 21 bp, Homo sapiens
tgggtctacctcatctctgaa

SEQ ID NO: 5955777 - DNA, 21 bp, Homo sapiens
tgggtctaggacacagttcct

SEQ ID NO: 5955778 - DNA, 22 bp, Homo sapiens
tgggtctaggacacagttcctg

SEQ ID NO: 5955779 - DNA, 16 bp, Homo sapiens
tgggtctattccagct

SEQ ID NO: 5955780 - DNA, 18 bp, Homo sapiens
tgggtctattccagctca

SEQ ID NO: 5955781 - DNA, 19 bp, Homo sapiens
tgggtctcagctgctgaca

SEQ ID NO: 5955782 - DNA, 13 bp, Homo sapiens
tgggtctctctcc

SEQ ID NO: 5955783 - DNA, 17 bp, Homo sapiens
tgggtctctctcggccc

SEQ ID NO: 5955784 - DNA, 21 bp, Homo sapiens
tgggtctctctcggcccctgt

SEQ ID NO: 5955785 - DNA, 23 bp, Homo sapiens
tgggtctctgaagggaccccccc

SEQ ID NO: 5955786 - DNA, 21 bp, Homo sapiens
tgggtctctggattcctgtca

SEQ ID NO: 5955787 - DNA, 15 bp, Homo sapiens
tgggtctgacctggt

SEQ ID NO: 5955788 - DNA, 22 bp, Homo sapiens
tgggtctgaggcccctgcctcc

SEQ ID NO: 5955789 - DNA, 19 bp, Homo sapiens
tgggtctgagtcatggccg

SEQ ID NO: 5955790 - DNA, 18 bp, Homo sapiens
tgggtctgattttctcac

SEQ ID NO: 5955791 - DNA, 12 bp, Homo sapiens
tgggtctgccct

SEQ ID NO: 5955792 - DNA, 18 bp, Homo sapiens
tgggtctgccctgcccat

SEQ ID NO: 5955793 - DNA, 13 bp, Homo sapiens
tgggtctggctag

SEQ ID NO: 5955794 - DNA, 18 bp, Homo sapiens
tgggtctggggagggaga

SEQ ID NO: 5955795 - DNA, 22 bp, Homo sapiens
tggtcaacatttctcatgttga

SEQ ID NO: 5955796 - DNA, 18 bp, Homo sapiens
tggtcaacccgctgcttc

SEQ ID NO: 5955797 - DNA, 18 bp, Homo sapiens
tggtcaacttgagcatgt

SEQ ID NO: 5955798 - DNA, 22 bp, Homo sapiens
tggtcaagaagcatcgtgtctg

SEQ ID NO: 5955799 - DNA, 20 bp, Homo sapiens
tggtcaagccccctttgatt

SEQ ID NO: 5955800 - DNA, 23 bp, Homo sapiens
tggtcaagggctgtcattgcaca

SEQ ID NO: 5955801 - DNA, 15 bp, Homo sapiens
tggtcaagttcccaa

SEQ ID NO: 5955802 - DNA, 16 bp, Homo sapiens
tggtcaagttcccaac

SEQ ID NO: 5955803 - DNA, 20 bp, Homo sapiens
tggtcaagttgagattttta

SEQ ID NO: 5955804 - DNA, 15 bp, Homo sapiens
tggtcaatcaacact

SEQ ID NO: 5955805 - DNA, 22 bp, Homo sapiens
tggtcaatccgaagtatgaggg

SEQ ID NO: 5955806 - DNA, 16 bp, Homo sapiens
tggtcacaaagctatt

SEQ ID NO: 5955807 - DNA, 18 bp, Homo sapiens
tggtcacaaagctattta

SEQ ID NO: 5955808 - DNA, 18 bp, Homo sapiens
tggtcacaagtaggagac

SEQ ID NO: 5955809 - DNA, 14 bp, Homo sapiens
tggtcacacaagga

SEQ ID NO: 5955810 - DNA, 15 bp, Homo sapiens
tggtcacacactgat

SEQ ID NO: 5955811 - DNA, 15 bp, Homo sapiens
tggtcacagacccct

SEQ ID NO: 5955812 - DNA, 17 bp, Homo sapiens
tggtcacagacccctgg

SEQ ID NO: 5955813 - DNA, 14 bp, Homo sapiens
tggtcacagagaac

SEQ ID NO: 5955814 - DNA, 15 bp, Homo sapiens
tggtcacagccaggc

SEQ ID NO: 5955815 - DNA, 14 bp, Homo sapiens
tggtcacagcctcc

SEQ ID NO: 5955816 - DNA, 20 bp, Homo sapiens
tggtcacaggactctgcctc

SEQ ID NO: 5955817 - DNA, 22 bp, Homo sapiens
tggtcacaggcaaagtccagct

SEQ ID NO: 5955818 - DNA, 10 bp, Homo sapiens
tggtcacatg

SEQ ID NO: 5955819 - DNA, 13 bp, Homo sapiens
tggtcacatggag

SEQ ID NO: 5955820 - DNA, 20 bp, Homo sapiens
tggtcaccaaatcagctgct

SEQ ID NO: 5955821 - DNA, 21 bp, Homo sapiens
tggtcaccaaatcagctgcta

SEQ ID NO: 5955822 - DNA, 14 bp, Homo sapiens
tggtcaccaaggca

SEQ ID NO: 5955823 - DNA, 19 bp, Homo sapiens
tggtcaccaaggcagtgca

SEQ ID NO: 5955824 - DNA, 20 bp, Homo sapiens
tggtcaccaaggcagtgcat

SEQ ID NO: 5955825 - DNA, 21 bp, Homo sapiens
tggtcaccacaattagagctt

SEQ ID NO: 5955826 - DNA, 14 bp, Homo sapiens
tggtcacccatgca

SEQ ID NO: 5955827 - DNA, 15 bp, Homo sapiens
tggtcacccccaccc

SEQ ID NO: 5955828 - DNA, 19 bp, Homo sapiens
tggtcacccgactttggaa

SEQ ID NO: 5955829 - DNA, 24 bp, Homo sapiens
tggtcaccgagactcagcctctgc

SEQ ID NO: 5955830 - DNA, 23 bp, Homo sapiens
tggtcacctaggaagcctcagat

SEQ ID NO: 5955831 - DNA, 21 bp, Homo sapiens
tggtcaccttcctctgccttt

SEQ ID NO: 5955832 - DNA, 15 bp, Homo sapiens
tggtcaccttcgagt

SEQ ID NO: 5955833 - DNA, 17 bp, Homo sapiens
tggtcactctgccctct

SEQ ID NO: 5955834 - DNA, 13 bp, Homo sapiens
tggtcactgccat

SEQ ID NO: 5955835 - DNA, 15 bp, Homo sapiens
tggtcactgctgtca

SEQ ID NO: 5955836 - DNA, 18 bp, Homo sapiens
tggtcactgtgcactgcc

SEQ ID NO: 5955837 - DNA, 20 bp, Homo sapiens
tggtcacttcaaacatgccc

SEQ ID NO: 5955838 - DNA, 15 bp, Homo sapiens
tggtcacttcttctg

SEQ ID NO: 5955839 - DNA, 16 bp, Homo sapiens
tggtcacttcttctgt

SEQ ID NO: 5955840 - DNA, 21 bp, Homo sapiens
tggtcagacattttatttttg

SEQ ID NO: 5955841 - DNA, 22 bp, Homo sapiens
tggtcagagagacctcatcctg

SEQ ID NO: 5955842 - DNA, 15 bp, Homo sapiens
tggtcagagccacag

SEQ ID NO: 5955843 - DNA, 18 bp, Homo sapiens
tggtcagagccacagggt

SEQ ID NO: 5955844 - DNA, 15 bp, Homo sapiens
tggtcagagccactc

SEQ ID NO: 5955845 - DNA, 12 bp, Homo sapiens
tggtcagagtgc

SEQ ID NO: 5955846 - DNA, 15 bp, Homo sapiens
tggtcagatttgaac

SEQ ID NO: 5955847 - DNA, 13 bp, Homo sapiens
tggtcagcagatg

SEQ ID NO: 5955848 - DNA, 16 bp, Homo sapiens
tggtcagcaggtgtct

SEQ ID NO: 5955849 - DNA, 10 bp, Homo sapiens
tggtcagccc

SEQ ID NO: 5955850 - DNA, 19 bp, Homo sapiens
tggtcagcgattcctgcca

SEQ ID NO: 5955851 - DNA, 23 bp, Homo sapiens
tggtcagcgattcctgccaagta

SEQ ID NO: 5955852 - DNA, 17 bp, Homo sapiens
tggtcagcgttgcatgt

SEQ ID NO: 5955853 - DNA, 16 bp, Homo sapiens
tggtcaggcccagcct

SEQ ID NO: 5955854 - DNA, 16 bp, Homo sapiens
tggtcaggcccagttc

SEQ ID NO: 5955855 - DNA, 15 bp, Homo sapiens
tggtcaggctggtct

SEQ ID NO: 5955856 - DNA, 17 bp, Homo sapiens
tggtcaggctggtctca

SEQ ID NO: 5955857 - DNA, 19 bp, Homo sapiens
tggtcaggggtgagacctg

SEQ ID NO: 5955858 - DNA, 21 bp, Homo sapiens
tggtcaggttatactcctcct

SEQ ID NO: 5955859 - DNA, 18 bp, Homo sapiens
tggtcagtcctcatctct

SEQ ID NO: 5955860 - DNA, 24 bp, Homo sapiens
tggtcagtgaagcccaggaggacc

SEQ ID NO: 5955861 - DNA, 17 bp, Homo sapiens
tggtcagtgtggagagg

SEQ ID NO: 5955862 - DNA, 18 bp, Homo sapiens
tggtcagttttcacagag

SEQ ID NO: 5955863 - DNA, 15 bp, Homo sapiens
tggtcataaaataga

SEQ ID NO: 5955864 - DNA, 21 bp, Homo sapiens
tggtcataaaatagaataatt

SEQ ID NO: 5955865 - DNA, 16 bp, Homo sapiens
tggtcatatacatatt

SEQ ID NO: 5955866 - DNA, 16 bp, Homo sapiens
tggtcatcaccaccct

SEQ ID NO: 5955867 - DNA, 15 bp, Homo sapiens
tggtcatcctgggca

SEQ ID NO: 5955868 - DNA, 18 bp, Homo sapiens
tggtcatcgtgacagcag

SEQ ID NO: 5955869 - DNA, 20 bp, Homo sapiens
tggtcatctctcctgtgtct

SEQ ID NO: 5955870 - DNA, 16 bp, Homo sapiens
tggtcatctttttctc

SEQ ID NO: 5955871 - DNA, 16 bp, Homo sapiens
tggtcatgctcagcct

SEQ ID NO: 5955872 - DNA, 21 bp, Homo sapiens
tggtcatgggtctgcccttga

SEQ ID NO: 5955873 - DNA, 20 bp, Homo sapiens
tggtcatgtgggtcttccag

SEQ ID NO: 5955874 - DNA, 14 bp, Homo sapiens
tggtcattaaatac

SEQ ID NO: 5955875 - DNA, 19 bp, Homo sapiens
tggtcatttggtggctcta

SEQ ID NO: 5955876 - DNA, 21 bp, Homo sapiens
tggtccaaaagattgctgaaa

SEQ ID NO: 5955877 - DNA, 16 bp, Homo sapiens
tggtccaaaggacaaa

SEQ ID NO: 5955878 - DNA, 23 bp, Homo sapiens
tggtccacaagcttctgtcctgc

SEQ ID NO: 5955879 - DNA, 14 bp, Homo sapiens
tggtccacacacca

SEQ ID NO: 5955880 - DNA, 15 bp, Homo sapiens
tggtccacattctgc

SEQ ID NO: 5955881 - DNA, 15 bp, Homo sapiens
tggtccactcagggc

SEQ ID NO: 5955882 - DNA, 15 bp, Homo sapiens
tggtccacttttcca

SEQ ID NO: 5955883 - DNA, 12 bp, Homo sapiens
tggtccagagcg

SEQ ID NO: 5955884 - DNA, 13 bp, Homo sapiens
tggtccagattgt

SEQ ID NO: 5955885 - DNA, 21 bp, Homo sapiens
tggtccagcgtcactccagtg

SEQ ID NO: 5955886 - DNA, 23 bp, Homo sapiens
tggtccagcgtcactccagtgct

SEQ ID NO: 5955887 - DNA, 21 bp, Homo sapiens
tggtccagctctgacatccct

SEQ ID NO: 5955888 - DNA, 23 bp, Homo sapiens
tggtccagctctgacatcccttc

SEQ ID NO: 5955889 - DNA, 22 bp, Homo sapiens
tggtccagctcttggcccctgt

SEQ ID NO: 5955890 - DNA, 15 bp, Homo sapiens
tggtccagcttgctc

SEQ ID NO: 5955891 - DNA, 19 bp, Homo sapiens
tggtccagggaagctggcc

SEQ ID NO: 5955892 - DNA, 13 bp, Homo sapiens
tggtccagggcta

SEQ ID NO: 5955893 - DNA, 19 bp, Homo sapiens
tggtccagggtccagccct

SEQ ID NO: 5955894 - DNA, 20 bp, Homo sapiens
tggtccagtttctagagggc

SEQ ID NO: 5955895 - DNA, 16 bp, Homo sapiens
tggtccatagagagca

SEQ ID NO: 5955896 - DNA, 17 bp, Homo sapiens
tggtccatatttacatt

SEQ ID NO: 5955897 - DNA, 22 bp, Homo sapiens
tggtccatctctgaaaacaaga

SEQ ID NO: 5955898 - DNA, 15 bp, Homo sapiens
tggtccatgcccact

SEQ ID NO: 5955899 - DNA, 20 bp, Homo sapiens
tggtccatggaatgcttgaa

SEQ ID NO: 5955900 - DNA, 23 bp, Homo sapiens
tggtccatgtaaatactttccat

SEQ ID NO: 5955901 - DNA, 18 bp, Homo sapiens
tggtccatttgttcctgc

SEQ ID NO: 5955902 - DNA, 14 bp, Homo sapiens
tggtcccaagcctg

SEQ ID NO: 5955903 - DNA, 23 bp, Homo sapiens
tggtcccaagtagtagtgtcttc

SEQ ID NO: 5955904 - DNA, 17 bp, Homo sapiens
tggtcccacatccctgg

SEQ ID NO: 5955905 - DNA, 19 bp, Homo sapiens
tggtcccacatccctgggc

SEQ ID NO: 5955906 - DNA, 21 bp, Homo sapiens
tggtcccacatccctgggcct

SEQ ID NO: 5955907 - DNA, 19 bp, Homo sapiens
tggtcccacccaggaaggg

SEQ ID NO: 5955908 - DNA, 20 bp, Homo sapiens
tggtcccacccaggaaggga

SEQ ID NO: 5955909 - DNA, 15 bp, Homo sapiens
tggtcccaccccaca

SEQ ID NO: 5955910 - DNA, 20 bp, Homo sapiens
tggtcccacttcacagctgg

SEQ ID NO: 5955911 - DNA, 21 bp, Homo sapiens
tggtcccacttcacagctgga

SEQ ID NO: 5955912 - DNA, 22 bp, Homo sapiens
tggtcccacttccccatctgtg

SEQ ID NO: 5955913 - DNA, 20 bp, Homo sapiens
tggtcccagacagctggacc

SEQ ID NO: 5955914 - DNA, 14 bp, Homo sapiens
tggtcccaggaagc

SEQ ID NO: 5955915 - DNA, 21 bp, Homo sapiens
tggtcccaggaagcagggaga

SEQ ID NO: 5955916 - DNA, 17 bp, Homo sapiens
tggtcccataggagcag

SEQ ID NO: 5955917 - DNA, 19 bp, Homo sapiens
tggtcccatggctgaagct

SEQ ID NO: 5955918 - DNA, 19 bp, Homo sapiens
tggtccccaaaacactgtc

SEQ ID NO: 5955919 - DNA, 14 bp, Homo sapiens
tggtccccaagacc

SEQ ID NO: 5955920 - DNA, 20 bp, Homo sapiens
tggtccccactgctgagctg

SEQ ID NO: 5955921 - DNA, 16 bp, Homo sapiens
tggtcccccttccatg

SEQ ID NO: 5955922 - DNA, 18 bp, Homo sapiens
tggtcccccttccatgga

SEQ ID NO: 5955923 - DNA, 23 bp, Homo sapiens
tggtcccccttccatggactttg

SEQ ID NO: 5955924 - DNA, 13 bp, Homo sapiens
tggtccccgagac

SEQ ID NO: 5955925 - DNA, 23 bp, Homo sapiens
tggtcccctccctcgtgggcttg

SEQ ID NO: 5955926 - DNA, 16 bp, Homo sapiens
tggtcccctcctcagt

SEQ ID NO: 5955927 - DNA, 12 bp, Homo sapiens
tggtcccctgtg

SEQ ID NO: 5955928 - DNA, 13 bp, Homo sapiens
tggtccctcaccc

SEQ ID NO: 5955929 - DNA, 14 bp, Homo sapiens
tggtccctcgtcca

SEQ ID NO: 5955930 - DNA, 23 bp, Homo sapiens
tggtccctcgtccacaggggcag

SEQ ID NO: 5955931 - DNA, 15 bp, Homo sapiens
tggtccctctgaggc

SEQ ID NO: 5955932 - DNA, 18 bp, Homo sapiens
tggtccctctgaggcagt

SEQ ID NO: 5955933 - DNA, 22 bp, Homo sapiens
tggtccctctgtgtctgctctc

SEQ ID NO: 5955934 - DNA, 22 bp, Homo sapiens
tggtccctcttctctcctcagt

SEQ ID NO: 5955935 - DNA, 13 bp, Homo sapiens
tggtccctgagga

SEQ ID NO: 5955936 - DNA, 13 bp, Homo sapiens
tggtccctgggag

SEQ ID NO: 5955937 - DNA, 12 bp, Homo sapiens
tggtccctgggt

SEQ ID NO: 5955938 - DNA, 13 bp, Homo sapiens
tggtcccttaagg

SEQ ID NO: 5955939 - DNA, 22 bp, Homo sapiens
tggtcccttgtatcccctgcag

SEQ ID NO: 5955940 - DNA, 17 bp, Homo sapiens
tggtccgctttcctgga

SEQ ID NO: 5955941 - DNA, 18 bp, Homo sapiens
tggtccgctttcctggag

SEQ ID NO: 5955942 - DNA, 15 bp, Homo sapiens
tggtccggtgtcctt

SEQ ID NO: 5955943 - DNA, 18 bp, Homo sapiens
tggtccgtgcccaggccc

SEQ ID NO: 5955944 - DNA, 20 bp, Homo sapiens
tggtccgtgcccaggccctt

SEQ ID NO: 5955945 - DNA, 17 bp, Homo sapiens
tggtccgtgctaaggac

SEQ ID NO: 5955946 - DNA, 19 bp, Homo sapiens
tggtccgtgctaaggactt

SEQ ID NO: 5955947 - DNA, 20 bp, Homo sapiens
tggtccgtgctaaggacttg

SEQ ID NO: 5955948 - DNA, 20 bp, Homo sapiens
tggtccgtgggacggtgccc

SEQ ID NO: 5955949 - DNA, 21 bp, Homo sapiens
tggtcctaaaagcaaaataaa

SEQ ID NO: 5955950 - DNA, 23 bp, Homo sapiens
tggtcctaaaagcaaaataaaaa

SEQ ID NO: 5955951 - DNA, 14 bp, Homo sapiens
tggtcctaagtccc

SEQ ID NO: 5955952 - DNA, 22 bp, Homo sapiens
tggtcctagaggccctttgctg

SEQ ID NO: 5955953 - DNA, 22 bp, Homo sapiens
tggtcctaggtcctctgaggca

SEQ ID NO: 5955954 - DNA, 17 bp, Homo sapiens
tggtcctagtaagaaga

SEQ ID NO: 5955955 - DNA, 16 bp, Homo sapiens
tggtcctatggcctca

SEQ ID NO: 5955956 - DNA, 20 bp, Homo sapiens
tggtcctatttttgtgaaga

SEQ ID NO: 5955957 - DNA, 19 bp, Homo sapiens
tggtcctcattcaaaggga

SEQ ID NO: 5955958 - DNA, 12 bp, Homo sapiens
tggtcctccact

SEQ ID NO: 5955959 - DNA, 21 bp, Homo sapiens
tggtcctccactttgctggtt

SEQ ID NO: 5955960 - DNA, 15 bp, Homo sapiens
tggtcctcccatttc

SEQ ID NO: 5955961 - DNA, 16 bp, Homo sapiens
tggtcctccgcctact

SEQ ID NO: 5955962 - DNA, 15 bp, Homo sapiens
tggtcctctctctgt

SEQ ID NO: 5955963 - DNA, 22 bp, Homo sapiens
tggtcctctctctgtggggctg

SEQ ID NO: 5955964 - DNA, 14 bp, Homo sapiens
tggtcctcttgcca

SEQ ID NO: 5955965 - DNA, 15 bp, Homo sapiens
tggtcctcttgccat

SEQ ID NO: 5955966 - DNA, 17 bp, Homo sapiens
tggtcctgaccaggatg

SEQ ID NO: 5955967 - DNA, 21 bp, Homo sapiens
tggtcctgagtcttggcctgc

SEQ ID NO: 5955968 - DNA, 12 bp, Homo sapiens
tggtcctgcctc

SEQ ID NO: 5955969 - DNA, 13 bp, Homo sapiens
tggtcctgcctct

SEQ ID NO: 5955970 - DNA, 16 bp, Homo sapiens
tggtcctgcctctttg

SEQ ID NO: 5955971 - DNA, 19 bp, Homo sapiens
tggtcctgcctctttgagt

SEQ ID NO: 5955972 - DNA, 13 bp, Homo sapiens
tggtggaggagct

SEQ ID NO: 5955973 - DNA, 20 bp, Homo sapiens
tggtggaggagctgagggag

SEQ ID NO: 5955974 - DNA, 22 bp, Homo sapiens
tggtggaggagctgagggaggg

SEQ ID NO: 5955975 - DNA, 13 bp, Homo sapiens
tggtggaggagga

SEQ ID NO: 5955976 - DNA, 19 bp, Homo sapiens
tggtggaggattgctgcca

SEQ ID NO: 5955977 - DNA, 18 bp, Homo sapiens
tggtggaggcttcttgcc

SEQ ID NO: 5955978 - DNA, 14 bp, Homo sapiens
tggtggagggcact

SEQ ID NO: 5955979 - DNA, 17 bp, Homo sapiens
tggtggagggcacttca

SEQ ID NO: 5955980 - DNA, 13 bp, Homo sapiens
tggtggaggggcg

SEQ ID NO: 5955981 - DNA, 17 bp, Homo sapiens
tggtggagggggagggg

SEQ ID NO: 5955982 - DNA, 19 bp, Homo sapiens
tggtggagggggctgggct

SEQ ID NO: 5955983 - DNA, 13 bp, Homo sapiens
tggtggagtgaga

SEQ ID NO: 5955984 - DNA, 20 bp, Homo sapiens
tggtggagtgagagcctttg

SEQ ID NO: 5955985 - DNA, 22 bp, Homo sapiens
tggtggatgaggcttcttcctg

SEQ ID NO: 5955986 - DNA, 21 bp, Homo sapiens
tggtggatgatccccacgcca

SEQ ID NO: 5955987 - DNA, 14 bp, Homo sapiens
tggtggatggtgac

SEQ ID NO: 5955988 - DNA, 12 bp, Homo sapiens
tggtggatgtga

SEQ ID NO: 5955989 - DNA, 16 bp, Homo sapiens
tggtggcaataaatgt

SEQ ID NO: 5955990 - DNA, 13 bp, Homo sapiens
tggtggcacaggc

SEQ ID NO: 5955991 - DNA, 16 bp, Homo sapiens
tggtggcacaggcact

SEQ ID NO: 5955992 - DNA, 15 bp, Homo sapiens
tggtggcacattcct

SEQ ID NO: 5955993 - DNA, 21 bp, Homo sapiens
tggtggcacattcctttgggt

SEQ ID NO: 5955994 - DNA, 16 bp, Homo sapiens
tggtggcaccagatgc

SEQ ID NO: 5955995 - DNA, 16 bp, Homo sapiens
tggtggcactgagccc

SEQ ID NO: 5955996 - DNA, 16 bp, Homo sapiens
tggtggcagctcacct

SEQ ID NO: 5955997 - DNA, 12 bp, Homo sapiens
tggtggcagctg

SEQ ID NO: 5955998 - DNA, 14 bp, Homo sapiens
tggtggcagctgcg

SEQ ID NO: 5955999 - DNA, 15 bp, Homo sapiens
tggtggcagctgcgg

SEQ ID NO: 5956000 - DNA, 10 bp, Homo sapiens
tggtggcatg

SEQ ID NO: 5956001 - DNA, 17 bp, Homo sapiens
tggtggcatgtgcctgt

SEQ ID NO: 5956002 - DNA, 13 bp, Homo sapiens
tggtggcattttt

SEQ ID NO: 5956003 - DNA, 17 bp, Homo sapiens
tggtggccaagcctggc

SEQ ID NO: 5956004 - DNA, 14 bp, Homo sapiens
tggtggccaggctg

SEQ ID NO: 5956005 - DNA, 15 bp, Homo sapiens
tggtggccatgctcc

SEQ ID NO: 5956006 - DNA, 15 bp, Homo sapiens
tggtggcccagctcc

SEQ ID NO: 5956007 - DNA, 12 bp, Homo sapiens
tggtggccccag

SEQ ID NO: 5956008 - DNA, 22 bp, Homo sapiens
tggtggccccagctgtgactga

SEQ ID NO: 5956009 - DNA, 14 bp, Homo sapiens
tggtggccctctcc

SEQ ID NO: 5956010 - DNA, 19 bp, Homo sapiens
tggtggccctctcccctgc

SEQ ID NO: 5956011 - DNA, 23 bp, Homo sapiens
tggtggccctctcccctgccccc

SEQ ID NO: 5956012 - DNA, 16 bp, Homo sapiens
tggtggccctgcgggg

SEQ ID NO: 5956013 - DNA, 12 bp, Homo sapiens
tggtggccctgt

SEQ ID NO: 5956014 - DNA, 21 bp, Homo sapiens
tggtggcctctgccccgtctc

SEQ ID NO: 5956015 - DNA, 23 bp, Homo sapiens
tggtggccttctgctgcccaggc

SEQ ID NO: 5956016 - DNA, 14 bp, Homo sapiens
tggtggccttgggc

SEQ ID NO: 5956017 - DNA, 16 bp, Homo sapiens
tggtggcgcaagcctg

SEQ ID NO: 5956018 - DNA, 23 bp, Homo sapiens
tggtggcgctttctcctgtgccc

SEQ ID NO: 5956019 - DNA, 18 bp, Homo sapiens
tggtggcgttatggcagc

SEQ ID NO: 5956020 - DNA, 17 bp, Homo sapiens
tggtggctcatgcctgt

SEQ ID NO: 5956021 - DNA, 22 bp, Homo sapiens
tggtggctccccctctgcttct

SEQ ID NO: 5956022 - DNA, 15 bp, Homo sapiens
tggtggctcccgcct

SEQ ID NO: 5956023 - DNA, 15 bp, Homo sapiens
tggtggctgcaggca

SEQ ID NO: 5956024 - DNA, 21 bp, Homo sapiens
tggtggctgggcccagcaggg

SEQ ID NO: 5956025 - DNA, 17 bp, Homo sapiens
tggtggctgtctctgtc

SEQ ID NO: 5956026 - DNA, 13 bp, Homo sapiens
tggtggctgtgtc

SEQ ID NO: 5956027 - DNA, 13 bp, Homo sapiens
tggtggctttgca

SEQ ID NO: 5956028 - DNA, 23 bp, Homo sapiens
tggtgggaaaatgtcccccacct

SEQ ID NO: 5956029 - DNA, 13 bp, Homo sapiens
tggtgggatagga

SEQ ID NO: 5956030 - DNA, 16 bp, Homo sapiens
tggtgggctccagagt

SEQ ID NO: 5956031 - DNA, 19 bp, Homo sapiens
tggtgggctccagagtagg

SEQ ID NO: 5956032 - DNA, 23 bp, Homo sapiens
tggtgggcttgtcatagccagtg

SEQ ID NO: 5956033 - DNA, 12 bp, Homo sapiens
tggtggggacag

SEQ ID NO: 5956034 - DNA, 16 bp, Homo sapiens
tggtggggagaggcat

SEQ ID NO: 5956035 - DNA, 13 bp, Homo sapiens
tggtggggagggg

SEQ ID NO: 5956036 - DNA, 15 bp, Homo sapiens
tggtggggaggggcg

SEQ ID NO: 5956037 - DNA, 20 bp, Homo sapiens
tggtggggaggggcgctggc

SEQ ID NO: 5956038 - DNA, 21 bp, Homo sapiens
tggtggggaggggcgctggcc

SEQ ID NO: 5956039 - DNA, 15 bp, Homo sapiens
tggtggggccaggcc

SEQ ID NO: 5956040 - DNA, 16 bp, Homo sapiens
tggtggggccaggcca

SEQ ID NO: 5956041 - DNA, 23 bp, Homo sapiens
tggtggggccaggccaggaccac

SEQ ID NO: 5956042 - DNA, 20 bp, Homo sapiens
tggtggggctgccaggggag

SEQ ID NO: 5956043 - DNA, 23 bp, Homo sapiens
tggtgggggaggagcctctggct

SEQ ID NO: 5956044 - DNA, 15 bp, Homo sapiens
tggtggggggcaggg

SEQ ID NO: 5956045 - DNA, 19 bp, Homo sapiens
tggtggggggtccagtctg

SEQ ID NO: 5956046 - DNA, 20 bp, Homo sapiens
tggtgggggttctggcagga

SEQ ID NO: 5956047 - DNA, 18 bp, Homo sapiens
tggtggggtaccagccac

SEQ ID NO: 5956048 - DNA, 14 bp, Homo sapiens
tggtggggtagagg

SEQ ID NO: 5956049 - DNA, 17 bp, Homo sapiens
tggtggggttggcttcc

SEQ ID NO: 5956050 - DNA, 21 bp, Homo sapiens
tggtgggtaattgtacaataa

SEQ ID NO: 5956051 - DNA, 18 bp, Homo sapiens
tggtgggtcagcccagca

SEQ ID NO: 5956052 - DNA, 20 bp, Homo sapiens
tggtgggtcagcccagcacc

SEQ ID NO: 5956053 - DNA, 21 bp, Homo sapiens
tggtgggtcagcccagcacct

SEQ ID NO: 5956054 - DNA, 16 bp, Homo sapiens
tggtgggtccatgggc

SEQ ID NO: 5956055 - DNA, 18 bp, Homo sapiens
tggtgggtccatgggcag

SEQ ID NO: 5956056 - DNA, 22 bp, Homo sapiens
tggtgggtctatgttccccagg

SEQ ID NO: 5956057 - DNA, 18 bp, Homo sapiens
tggtgggtctgagctgga

SEQ ID NO: 5956058 - DNA, 15 bp, Homo sapiens
tggtgggtgaaagaa

SEQ ID NO: 5956059 - DNA, 23 bp, Homo sapiens
tggtgggtgcctaggcctgggca

SEQ ID NO: 5956060 - DNA, 17 bp, Homo sapiens
tggtgggtggtgtcctg

SEQ ID NO: 5956061 - DNA, 16 bp, Homo sapiens
tggtgggtgtggccag

SEQ ID NO: 5956062 - DNA, 15 bp, Homo sapiens
tggtgggttagctaa

SEQ ID NO: 5956063 - DNA, 23 bp, Homo sapiens
tggtgggttgaatatagcctgcc

SEQ ID NO: 5956064 - DNA, 17 bp, Homo sapiens
tggtggtagaaatgatt

SEQ ID NO: 5956065 - DNA, 16 bp, Homo sapiens
tggtggtattttcaat

SEQ ID NO: 5956066 - DNA, 13 bp, Homo sapiens
tggtggtattttt

SEQ ID NO: 5956067 - DNA, 19 bp, Homo sapiens
tggtggtcacaggctgtgc

SEQ ID NO: 5956068 - DNA, 15 bp, Homo sapiens
tggtggtctgttggc

SEQ ID NO: 5956069 - DNA, 15 bp, Homo sapiens
tggtggtgaaattga

SEQ ID NO: 5956070 - DNA, 16 bp, Homo sapiens
tggtggttcctttgca

SEQ ID NO: 5956071 - DNA, 19 bp, Homo sapiens
tggtggttcctttgcaccc

SEQ ID NO: 5956072 - DNA, 20 bp, Homo sapiens
tggtggttgggacccagtgg

SEQ ID NO: 5956073 - DNA, 14 bp, Homo sapiens
tggtggtttcagaa

SEQ ID NO: 5956074 - DNA, 17 bp, Homo sapiens
tggtggtttcagaaagg

SEQ ID NO: 5956075 - DNA, 19 bp, Homo sapiens
tggtggttttcagagcagg

SEQ ID NO: 5956076 - DNA, 14 bp, Homo sapiens
tggtgtaaaaaaca

SEQ ID NO: 5956077 - DNA, 15 bp, Homo sapiens
tggtgtaaagctggc

SEQ ID NO: 5956078 - DNA, 17 bp, Homo sapiens
tggtgtaaagctggccc

SEQ ID NO: 5956079 - DNA, 23 bp, Homo sapiens
tggtgtaaagctggccctgcctc

SEQ ID NO: 5956080 - DNA, 17 bp, Homo sapiens
tggtgtaatgcacaatt

SEQ ID NO: 5956081 - DNA, 19 bp, Homo sapiens
tggtgtaatgcacaattta

SEQ ID NO: 5956082 - DNA, 22 bp, Homo sapiens
tggtgtaatgcacaatttagaa

SEQ ID NO: 5956083 - DNA, 23 bp, Homo sapiens
tggtgtaatgcacaatttagaaa

SEQ ID NO: 5956084 - DNA, 15 bp, Homo sapiens
tggtgtaatttgaag

SEQ ID NO: 5956085 - DNA, 17 bp, Homo sapiens
tggtgtactctaggact

SEQ ID NO: 5956086 - DNA, 18 bp, Homo sapiens
tggtgtagctcctctgct

SEQ ID NO: 5956087 - DNA, 23 bp, Homo sapiens
tggtgtatatcatgaagccttgc

SEQ ID NO: 5956088 - DNA, 21 bp, Homo sapiens
tggtgtatatggtccactggt

SEQ ID NO: 5956089 - DNA, 23 bp, Homo sapiens
tggtgtatcccccccctgtatag

SEQ ID NO: 5956090 - DNA, 17 bp, Homo sapiens
tggtgtatctcagaagg

SEQ ID NO: 5956091 - DNA, 14 bp, Homo sapiens
tggtgtatttgaga

SEQ ID NO: 5956092 - DNA, 11 bp, Homo sapiens
tggtgtatttt

SEQ ID NO: 5956093 - DNA, 19 bp, Homo sapiens
tggtgtcaacatgaaacac

SEQ ID NO: 5956094 - DNA, 18 bp, Homo sapiens
tggtgtcaccccagagcc

SEQ ID NO: 5956095 - DNA, 18 bp, Homo sapiens
tggtgtcactctgcctct

SEQ ID NO: 5956096 - DNA, 14 bp, Homo sapiens
tggtgtcactgtcc

SEQ ID NO: 5956097 - DNA, 20 bp, Homo sapiens
tggtgtcactgtccctcctg

SEQ ID NO: 5956098 - DNA, 18 bp, Homo sapiens
tggtgtcacttactgttt

SEQ ID NO: 5956099 - DNA, 17 bp, Homo sapiens
tggtgtcagcccctctt

SEQ ID NO: 5956100 - DNA, 17 bp, Homo sapiens
tggtgtcatagaatagc

SEQ ID NO: 5956101 - DNA, 15 bp, Homo sapiens
tggtgtcatgaggaa

SEQ ID NO: 5956102 - DNA, 16 bp, Homo sapiens
tggtgtcatgaggaaa

SEQ ID NO: 5956103 - DNA, 11 bp, Homo sapiens
tggtgtcatgg

SEQ ID NO: 5956104 - DNA, 15 bp, Homo sapiens
tggtgtcatggctga

SEQ ID NO: 5956105 - DNA, 17 bp, Homo sapiens
tggtgtcattctgcctg

SEQ ID NO: 5956106 - DNA, 13 bp, Homo sapiens
tggtgtcatttag

SEQ ID NO: 5956107 - DNA, 14 bp, Homo sapiens
tggtgtcatttagt

SEQ ID NO: 5956108 - DNA, 14 bp, Homo sapiens
tggtgtcattttct

SEQ ID NO: 5956109 - DNA, 21 bp, Homo sapiens
tggtgtcccctatcctcccct

SEQ ID NO: 5956110 - DNA, 21 bp, Homo sapiens
tggtgtccccttcccctgctg

SEQ ID NO: 5956111 - DNA, 22 bp, Homo sapiens
tggtgtccccttcccctgctga

SEQ ID NO: 5956112 - DNA, 20 bp, Homo sapiens
tggtgtccctgcctggccct

SEQ ID NO: 5956113 - DNA, 12 bp, Homo sapiens
tggtgtcctctg

SEQ ID NO: 5956114 - DNA, 13 bp, Homo sapiens
tggtgtcctctgt

SEQ ID NO: 5956115 - DNA, 16 bp, Homo sapiens
tggtgtccttctcctc

SEQ ID NO: 5956116 - DNA, 18 bp, Homo sapiens
tggtgtcgcgccttctcc

SEQ ID NO: 5956117 - DNA, 21 bp, Homo sapiens
tggtgtcgcgccttctccccc

SEQ ID NO: 5956118 - DNA, 18 bp, Homo sapiens
tggtgtcgggcatgacac

SEQ ID NO: 5956119 - DNA, 15 bp, Homo sapiens
tggtgtcgtctgtga

SEQ ID NO: 5956120 - DNA, 19 bp, Homo sapiens
tggtgtctccaacccccca

SEQ ID NO: 5956121 - DNA, 11 bp, Homo sapiens
tggtgtctccc

SEQ ID NO: 5956122 - DNA, 22 bp, Homo sapiens
tggtgtctgatgtgtgcccaga

SEQ ID NO: 5956123 - DNA, 15 bp, Homo sapiens
tggtgtctggtttct

SEQ ID NO: 5956124 - DNA, 16 bp, Homo sapiens
tggtgtcttgagacca

SEQ ID NO: 5956125 - DNA, 16 bp, Homo sapiens
tggtgtcttggcactg

SEQ ID NO: 5956126 - DNA, 18 bp, Homo sapiens
tggtgtctttgatcagga

SEQ ID NO: 5956127 - DNA, 21 bp, Homo sapiens
tggtgtcttttatatttgaat

SEQ ID NO: 5956128 - DNA, 16 bp, Homo sapiens
tggtgtgaacccggga

SEQ ID NO: 5956129 - DNA, 17 bp, Homo sapiens
tggtgtgaacccgggag

SEQ ID NO: 5956130 - DNA, 13 bp, Homo sapiens
tggtgtgaagact

SEQ ID NO: 5956131 - DNA, 11 bp, Homo sapiens
tggtgtgaagg

SEQ ID NO: 5956132 - DNA, 15 bp, Homo sapiens
tggtgtgaatttgcc

SEQ ID NO: 5956133 - DNA, 16 bp, Homo sapiens
tggtgtgaatttgcca

SEQ ID NO: 5956134 - DNA, 19 bp, Homo sapiens
tggtgtgaccatgttcatt

SEQ ID NO: 5956135 - DNA, 16 bp, Homo sapiens
tggtgtgacctgaggg

SEQ ID NO: 5956136 - DNA, 17 bp, Homo sapiens
tggtgtgacctgagggc

SEQ ID NO: 5956137 - DNA, 16 bp, Homo sapiens
tggtgtgatcgtctga

SEQ ID NO: 5956138 - DNA, 12 bp, Homo sapiens
tggtgtgatctt

SEQ ID NO: 5956139 - DNA, 12 bp, Homo sapiens
tggtgtgcatct

SEQ ID NO: 5956140 - DNA, 20 bp, Homo sapiens
tggtgtgccaagacattaat

SEQ ID NO: 5956141 - DNA, 13 bp, Homo sapiens
tggtgtgccctgt

SEQ ID NO: 5956142 - DNA, 17 bp, Homo sapiens
tggtgtgcggaggcagg

SEQ ID NO: 5956143 - DNA, 20 bp, Homo sapiens
tggtgtgcggaggcaggagc

SEQ ID NO: 5956144 - DNA, 16 bp, Homo sapiens
tggtgtggattttcta

SEQ ID NO: 5956145 - DNA, 23 bp, Homo sapiens
tggtgtggctgtattcagatcgt

SEQ ID NO: 5956146 - DNA, 22 bp, Homo sapiens
tggtgtgggtgtcctgcctgtc

SEQ ID NO: 5956147 - DNA, 23 bp, Homo sapiens
tggtgtgggtgtcctgcctgtct

SEQ ID NO: 5956148 - DNA, 15 bp, Homo sapiens
tggtgtggtacagag

SEQ ID NO: 5956149 - DNA, 17 bp, Homo sapiens
tggtgtggtacagagaa

SEQ ID NO: 5956150 - DNA, 18 bp, Homo sapiens
tggtgtggtacagagaag

SEQ ID NO: 5956151 - DNA, 13 bp, Homo sapiens
tgtaaagaaaaat

SEQ ID NO: 5956152 - DNA, 16 bp, Homo sapiens
tgtaaagaaaaatatt

SEQ ID NO: 5956153 - DNA, 13 bp, Homo sapiens
tgtaaagaaagag

SEQ ID NO: 5956154 - DNA, 15 bp, Homo sapiens
tgtaaagaaagagag

SEQ ID NO: 5956155 - DNA, 19 bp, Homo sapiens
tgtaaagaaagagagaaaa

SEQ ID NO: 5956156 - DNA, 20 bp, Homo sapiens
tgtaaagaataaatgaatct

SEQ ID NO: 5956157 - DNA, 12 bp, Homo sapiens
tgtaaagactgg

SEQ ID NO: 5956158 - DNA, 22 bp, Homo sapiens
tgtaaagagaatcaactaggta

SEQ ID NO: 5956159 - DNA, 17 bp, Homo sapiens
tgtaaagagaccatctt

SEQ ID NO: 5956160 - DNA, 21 bp, Homo sapiens
tgtaaagagacctacctcagg

SEQ ID NO: 5956161 - DNA, 22 bp, Homo sapiens
tgtaaagagacctacctcaggt

SEQ ID NO: 5956162 - DNA, 20 bp, Homo sapiens
tgtaaagagtggagcaaatg

SEQ ID NO: 5956163 - DNA, 18 bp, Homo sapiens
tgtaaagatattgtatct

SEQ ID NO: 5956164 - DNA, 19 bp, Homo sapiens
tgtaaagatctacatgaat

SEQ ID NO: 5956165 - DNA, 15 bp, Homo sapiens
tgtaaagatgaatgt

SEQ ID NO: 5956166 - DNA, 19 bp, Homo sapiens
tgtaaagatgaatgtcagt

SEQ ID NO: 5956167 - DNA, 15 bp, Homo sapiens
tgtaaagatttctgt

SEQ ID NO: 5956168 - DNA, 12 bp, Homo sapiens
tgtaaagcaaat

SEQ ID NO: 5956169 - DNA, 19 bp, Homo sapiens
tgtaaagcgggaaggacat

SEQ ID NO: 5956170 - DNA, 13 bp, Homo sapiens
tgtaaagctggcc

SEQ ID NO: 5956171 - DNA, 16 bp, Homo sapiens
tgtaaagctggccctg

SEQ ID NO: 5956172 - DNA, 17 bp, Homo sapiens
tgtaaagctgttaaaat

SEQ ID NO: 5956173 - DNA, 20 bp, Homo sapiens
tgtaaagctgttaaaataca

SEQ ID NO: 5956174 - DNA, 17 bp, Homo sapiens
tgtaaaggactatttat

SEQ ID NO: 5956175 - DNA, 19 bp, Homo sapiens
tgtaaaggactatttataa

SEQ ID NO: 5956176 - DNA, 13 bp, Homo sapiens
tgtaaaggaggga

SEQ ID NO: 5956177 - DNA, 14 bp, Homo sapiens
tgtaaaggagggag

SEQ ID NO: 5956178 - DNA, 15 bp, Homo sapiens
tgtaaaggagggaga

SEQ ID NO: 5956179 - DNA, 22 bp, Homo sapiens
tgtaaaggcaagccagcatgtg

SEQ ID NO: 5956180 - DNA, 15 bp, Homo sapiens
tgtaaaggggcagct

SEQ ID NO: 5956181 - DNA, 22 bp, Homo sapiens
tgtaaaggtaggtgcatgcctt

SEQ ID NO: 5956182 - DNA, 18 bp, Homo sapiens
tgtaaaggtcacttttca

SEQ ID NO: 5956183 - DNA, 21 bp, Homo sapiens
tgtaaaggtcacttttcacat

SEQ ID NO: 5956184 - DNA, 12 bp, Homo sapiens
tgtaaagtaaaa

SEQ ID NO: 5956185 - DNA, 15 bp, Homo sapiens
tgtaaagtaaaatat

SEQ ID NO: 5956186 - DNA, 16 bp, Homo sapiens
tgtaaagtaagacatc

SEQ ID NO: 5956187 - DNA, 19 bp, Homo sapiens
tgtaaagtaggaaaaataa

SEQ ID NO: 5956188 - DNA, 19 bp, Homo sapiens
tgtaaagtatgtattattt

SEQ ID NO: 5956189 - DNA, 15 bp, Homo sapiens
tgtaaagtatgtttt

SEQ ID NO: 5956190 - DNA, 20 bp, Homo sapiens
tgtaaagtatgtttttacat

SEQ ID NO: 5956191 - DNA, 12 bp, Homo sapiens
tgtaaagtattt

SEQ ID NO: 5956192 - DNA, 19 bp, Homo sapiens
tgtaaagtatttgatgtac

SEQ ID NO: 5956193 - DNA, 20 bp, Homo sapiens
tgtaaagtcggtgattatat

SEQ ID NO: 5956194 - DNA, 21 bp, Homo sapiens
tgtaaagtgaagaatcctttt

SEQ ID NO: 5956195 - DNA, 13 bp, Homo sapiens
tgtaaagtgtggt

SEQ ID NO: 5956196 - DNA, 22 bp, Homo sapiens
tgtaaagttaatcagaaagaaa

SEQ ID NO: 5956197 - DNA, 14 bp, Homo sapiens
tgtaaataaaaaga

SEQ ID NO: 5956198 - DNA, 17 bp, Homo sapiens
tgtaaataaaaatagct

SEQ ID NO: 5956199 - DNA, 19 bp, Homo sapiens
tgtaaataaaactatttat

SEQ ID NO: 5956200 - DNA, 12 bp, Homo sapiens
tgtaaataaact

SEQ ID NO: 5956201 - DNA, 18 bp, Homo sapiens
tgtaaataaactatttat

SEQ ID NO: 5956202 - DNA, 14 bp, Homo sapiens
tgtaaataaagtct

SEQ ID NO: 5956203 - DNA, 18 bp, Homo sapiens
tgtaaataaatagatttg

SEQ ID NO: 5956204 - DNA, 19 bp, Homo sapiens
tgtaaataaattttgtgca

SEQ ID NO: 5956205 - DNA, 16 bp, Homo sapiens
tgtaaataatctgtga

SEQ ID NO: 5956206 - DNA, 14 bp, Homo sapiens
tgtaaataattctt

SEQ ID NO: 5956207 - DNA, 23 bp, Homo sapiens
tgtaaataattcttttttattaa

SEQ ID NO: 5956208 - DNA, 18 bp, Homo sapiens
tgtaaataatttattaca

SEQ ID NO: 5956209 - DNA, 19 bp, Homo sapiens
tgtaaataatttgcactga

SEQ ID NO: 5956210 - DNA, 13 bp, Homo sapiens
tgtaaatacaaaa

SEQ ID NO: 5956211 - DNA, 17 bp, Homo sapiens
tgtaaatacaattcaaa

SEQ ID NO: 5956212 - DNA, 15 bp, Homo sapiens
tgtaaatacaatttt

SEQ ID NO: 5956213 - DNA, 16 bp, Homo sapiens
tgtaaatacaggaaga

SEQ ID NO: 5956214 - DNA, 16 bp, Homo sapiens
tgtaaatacatgtgtg

SEQ ID NO: 5956215 - DNA, 19 bp, Homo sapiens
tgtaaatacatgtgtggat

SEQ ID NO: 5956216 - DNA, 11 bp, Homo sapiens
tgtaaatacca

SEQ ID NO: 5956217 - DNA, 15 bp, Homo sapiens
tgtaaataccaggat

SEQ ID NO: 5956218 - DNA, 15 bp, Homo sapiens
tgtaaataccattga

SEQ ID NO: 5956219 - DNA, 19 bp, Homo sapiens
tgtaaataccattgacaca

SEQ ID NO: 5956220 - DNA, 19 bp, Homo sapiens
tgtaaatactcatgaatga

SEQ ID NO: 5956221 - DNA, 20 bp, Homo sapiens
tgtaaatactcatgaatgaa

SEQ ID NO: 5956222 - DNA, 24 bp, Homo sapiens
tgtaaatactggactcaggaactt

SEQ ID NO: 5956223 - DNA, 21 bp, Homo sapiens
tgtaaatactgtttttaacaa

SEQ ID NO: 5956224 - DNA, 19 bp, Homo sapiens
tgtaaatagaagagtttaa

SEQ ID NO: 5956225 - DNA, 18 bp, Homo sapiens
tgtaaataggatttttag

SEQ ID NO: 5956226 - DNA, 12 bp, Homo sapiens
tgtaaataggtt

SEQ ID NO: 5956227 - DNA, 18 bp, Homo sapiens
tgtaaataggttcttctt

SEQ ID NO: 5956228 - DNA, 13 bp, Homo sapiens
tgtaaataggttt

SEQ ID NO: 5956229 - DNA, 19 bp, Homo sapiens
tgtaaatagtttaacactt

SEQ ID NO: 5956230 - DNA, 22 bp, Homo sapiens
tgtaaatagtttaacactttct

SEQ ID NO: 5956231 - DNA, 22 bp, Homo sapiens
tgtaaatagttttaaatatgaa

SEQ ID NO: 5956232 - DNA, 17 bp, Homo sapiens
tgtaaatataatcagac

SEQ ID NO: 5956233 - DNA, 14 bp, Homo sapiens
tgtaaatatacata

SEQ ID NO: 5956234 - DNA, 13 bp, Homo sapiens
tgtaaatatataa

SEQ ID NO: 5956235 - DNA, 17 bp, Homo sapiens
tgtaaatatataaatat

SEQ ID NO: 5956236 - DNA, 11 bp, Homo sapiens
tgtaaatatcc

SEQ ID NO: 5956237 - DNA, 18 bp, Homo sapiens
tgtaaatatgtacatttc

SEQ ID NO: 5956238 - DNA, 15 bp, Homo sapiens
tgtaaatatgtttgt

SEQ ID NO: 5956239 - DNA, 20 bp, Homo sapiens
tgtaaatatgtttgtgcctt

SEQ ID NO: 5956240 - DNA, 12 bp, Homo sapiens
tgtaaatattct

SEQ ID NO: 5956241 - DNA, 16 bp, Homo sapiens
tgtaaatattctatat

SEQ ID NO: 5956242 - DNA, 20 bp, Homo sapiens
tgtaaatattctatatgaat

SEQ ID NO: 5956243 - DNA, 15 bp, Homo sapiens
tgtaaatattcttgt

SEQ ID NO: 5956244 - DNA, 22 bp, Homo sapiens
tgtaaatattcttgtccacatt

SEQ ID NO: 5956245 - DNA, 16 bp, Homo sapiens
tgtaaatattgctaaa

SEQ ID NO: 5956246 - DNA, 19 bp, Homo sapiens
tgtaaatattgctgtctga

SEQ ID NO: 5956247 - DNA, 22 bp, Homo sapiens
tgtaaatattgctgtctgaaaa

SEQ ID NO: 5956248 - DNA, 14 bp, Homo sapiens
tgtaaatattgtgt

SEQ ID NO: 5956249 - DNA, 19 bp, Homo sapiens
tgtaaatatttcataaatt

SEQ ID NO: 5956250 - DNA, 17 bp, Homo sapiens
tgtaaatattttaaaga

SEQ ID NO: 5956251 - DNA, 18 bp, Homo sapiens
tgtaaatattttaaagaa

SEQ ID NO: 5956252 - DNA, 20 bp, Homo sapiens
tgtaaatattttaaagaatt

SEQ ID NO: 5956253 - DNA, 14 bp, Homo sapiens
tgtaaatattttga

SEQ ID NO: 5956254 - DNA, 15 bp, Homo sapiens
tgtaaatatttttcc

SEQ ID NO: 5956255 - DNA, 19 bp, Homo sapiens
tgtaaatcaagaccaaaga

SEQ ID NO: 5956256 - DNA, 14 bp, Homo sapiens
tgtaaatcacttgt

SEQ ID NO: 5956257 - DNA, 18 bp, Homo sapiens
tgtaaatcacttgtaaat

SEQ ID NO: 5956258 - DNA, 20 bp, Homo sapiens
tgtaaatcacttgtaaataa

SEQ ID NO: 5956259 - DNA, 13 bp, Homo sapiens
tgtaaatcataat

SEQ ID NO: 5956260 - DNA, 17 bp, Homo sapiens
tgtaaatccaacacaag

SEQ ID NO: 5956261 - DNA, 16 bp, Homo sapiens
tgtaaatcccattatt

SEQ ID NO: 5956262 - DNA, 19 bp, Homo sapiens
tgtaaatcccattattcaa

SEQ ID NO: 5956263 - DNA, 20 bp, Homo sapiens
tgtaaatcccattattcaaa

SEQ ID NO: 5956264 - DNA, 22 bp, Homo sapiens
tgtaaatcccattattcaaagt

SEQ ID NO: 5956265 - DNA, 15 bp, Homo sapiens
tgtaaatcctgtgtt

SEQ ID NO: 5956266 - DNA, 19 bp, Homo sapiens
tgtaaatcctttttcttta

SEQ ID NO: 5956267 - DNA, 22 bp, Homo sapiens
tgtaaatcgggaaggatgggaa

SEQ ID NO: 5956268 - DNA, 13 bp, Homo sapiens
tgtaaatctgcca

SEQ ID NO: 5956269 - DNA, 13 bp, Homo sapiens
tgtaaatctgctc

SEQ ID NO: 5956270 - DNA, 12 bp, Homo sapiens
tgtaaatctgta

SEQ ID NO: 5956271 - DNA, 16 bp, Homo sapiens
tgtaaatctgtacttt

SEQ ID NO: 5956272 - DNA, 23 bp, Homo sapiens
tgtaaatctgtacttttttcaaa

SEQ ID NO: 5956273 - DNA, 16 bp, Homo sapiens
tgtaaatctttttgct

SEQ ID NO: 5956274 - DNA, 22 bp, Homo sapiens
tgtaaatctttttgcttctact

SEQ ID NO: 5956275 - DNA, 14 bp, Homo sapiens
tgtaaatgaaactt

SEQ ID NO: 5956276 - DNA, 19 bp, Homo sapiens
tgtaaatgaacataatgaa

SEQ ID NO: 5956277 - DNA, 20 bp, Homo sapiens
tgtaaatgaagatctttata

SEQ ID NO: 5956278 - DNA, 22 bp, Homo sapiens
tgtaaatgactttcataataaa

SEQ ID NO: 5956279 - DNA, 18 bp, Homo sapiens
tgtaaatgagtaaaacat

SEQ ID NO: 5956280 - DNA, 17 bp, Homo sapiens
tgtaaatgcatattaaa

SEQ ID NO: 5956281 - DNA, 15 bp, Homo sapiens
tgtaaatgcatctgt

SEQ ID NO: 5956282 - DNA, 17 bp, Homo sapiens
tgtaaatgctattatac

SEQ ID NO: 5956283 - DNA, 13 bp, Homo sapiens
tgtaaatgctcaa

SEQ ID NO: 5956284 - DNA, 16 bp, Homo sapiens
tgtaaatgctgtaaat

SEQ ID NO: 5956285 - DNA, 19 bp, Homo sapiens
tgtaaatgcttaaatttca

SEQ ID NO: 5956286 - DNA, 18 bp, Homo sapiens
tgtaaatgcttgatggaa

SEQ ID NO: 5956287 - DNA, 15 bp, Homo sapiens
tgtaaatggcattga

SEQ ID NO: 5956288 - DNA, 16 bp, Homo sapiens
tgtaaatgggaaaata

SEQ ID NO: 5956289 - DNA, 14 bp, Homo sapiens
tgtaaatgtaaact

SEQ ID NO: 5956290 - DNA, 18 bp, Homo sapiens
tgtaaatgtattcattct

SEQ ID NO: 5956291 - DNA, 19 bp, Homo sapiens
tgtaaatgtattcattctt

SEQ ID NO: 5956292 - DNA, 17 bp, Homo sapiens
tgtaaatgtctcactga

SEQ ID NO: 5956293 - DNA, 14 bp, Homo sapiens
tgtaaatgtgacaa

SEQ ID NO: 5956294 - DNA, 22 bp, Homo sapiens
tgtaaatgtgttagcactgata

SEQ ID NO: 5956295 - DNA, 15 bp, Homo sapiens
tgtaaatgtgttgga

SEQ ID NO: 5956296 - DNA, 14 bp, Homo sapiens
tgtaaatgttagtt

SEQ ID NO: 5956297 - DNA, 17 bp, Homo sapiens
tgtaaatgttagtttct

SEQ ID NO: 5956298 - DNA, 22 bp, Homo sapiens
tgtaaatgttagtttcttggta

SEQ ID NO: 5956299 - DNA, 22 bp, Homo sapiens
tgtaaatgttatttctgcaaac

SEQ ID NO: 5956300 - DNA, 19 bp, Homo sapiens
tgtaaatgtttaatatctg

SEQ ID NO: 5956301 - DNA, 22 bp, Homo sapiens
tgtaaatgtttgttaaaaataa

SEQ ID NO: 5956302 - DNA, 14 bp, Homo sapiens
tgtaaattaagtgt

SEQ ID NO: 5956303 - DNA, 21 bp, Homo sapiens
tgtaaattaagtgtgtgtata

SEQ ID NO: 5956304 - DNA, 23 bp, Homo sapiens
tgtaaattaggaggctcaacaat

SEQ ID NO: 5956305 - DNA, 14 bp, Homo sapiens
tgtaaattagtttg

SEQ ID NO: 5956306 - DNA, 15 bp, Homo sapiens
tgtaaattagtttga

SEQ ID NO: 5956307 - DNA, 21 bp, Homo sapiens
tgtaaattagtttgacactgc

SEQ ID NO: 5956308 - DNA, 13 bp, Homo sapiens
tgtaaattatatt

SEQ ID NO: 5956309 - DNA, 22 bp, Homo sapiens
tgtaaattatatttgtgctata

SEQ ID NO: 5956310 - DNA, 14 bp, Homo sapiens
tgtaaattatcagg

SEQ ID NO: 5956311 - DNA, 20 bp, Homo sapiens
tgtaaattatgtaatgcaaa

SEQ ID NO: 5956312 - DNA, 11 bp, Homo sapiens
tgtaaattatt

SEQ ID NO: 5956313 - DNA, 17 bp, Homo sapiens
tgtaaattattgatgat

SEQ ID NO: 5956314 - DNA, 15 bp, Homo sapiens
tgtaaattatttcat

SEQ ID NO: 5956315 - DNA, 14 bp, Homo sapiens
tgtaaattatttgc

SEQ ID NO: 5956316 - DNA, 17 bp, Homo sapiens
tgtaaattatttgctaa

SEQ ID NO: 5956317 - DNA, 18 bp, Homo sapiens
tgtaaattatttgctaag

SEQ ID NO: 5956318 - DNA, 14 bp, Homo sapiens
tgtaaattatttta

SEQ ID NO: 5956319 - DNA, 18 bp, Homo sapiens
tgtaaattattttaaatt

SEQ ID NO: 5956320 - DNA, 21 bp, Homo sapiens
tgtaaattattttatgtcata

SEQ ID NO: 5956321 - DNA, 15 bp, Homo sapiens
tgtaaattcagtctt

SEQ ID NO: 5956322 - DNA, 15 bp, Homo sapiens
tgtaaattccccttc

SEQ ID NO: 5956323 - DNA, 16 bp, Homo sapiens
tgtaaattcctgttgt

SEQ ID NO: 5956324 - DNA, 12 bp, Homo sapiens
tgtaaattctga

SEQ ID NO: 5956325 - DNA, 18 bp, Homo sapiens
tgtaaattctgatttctt

SEQ ID NO: 5956326 - DNA, 17 bp, Homo sapiens
tgtaaattgaacttccc

SEQ ID NO: 5956327 - DNA, 15 bp, Homo sapiens
tgtaaattgaataag

SEQ ID NO: 5956328 - DNA, 16 bp, Homo sapiens
tgtaaattgaataagt

SEQ ID NO: 5956329 - DNA, 17 bp, Homo sapiens
tgtaaattgaatcagta

SEQ ID NO: 5956330 - DNA, 14 bp, Homo sapiens
tgtaatgacagaga

SEQ ID NO: 5956331 - DNA, 14 bp, Homo sapiens
tgtaatgaggaaaa

SEQ ID NO: 5956332 - DNA, 16 bp, Homo sapiens
tgtaatgaggaaaaaa

SEQ ID NO: 5956333 - DNA, 13 bp, Homo sapiens
tgtaatgatcata

SEQ ID NO: 5956334 - DNA, 23 bp, Homo sapiens
tgtaatgattttggaactgtgtt

SEQ ID NO: 5956335 - DNA, 18 bp, Homo sapiens
tgtaatgcaaaaggctga

SEQ ID NO: 5956336 - DNA, 22 bp, Homo sapiens
tgtaatgcacaatttagaaaac

SEQ ID NO: 5956337 - DNA, 19 bp, Homo sapiens
tgtaatgcactgtttttaa

SEQ ID NO: 5956338 - DNA, 17 bp, Homo sapiens
tgtaatgcattaataaa

SEQ ID NO: 5956339 - DNA, 17 bp, Homo sapiens
tgtaatgcgattttatt

SEQ ID NO: 5956340 - DNA, 19 bp, Homo sapiens
tgtaatgctgcacttcctg

SEQ ID NO: 5956341 - DNA, 20 bp, Homo sapiens
tgtaatgctgcctcaggacc

SEQ ID NO: 5956342 - DNA, 18 bp, Homo sapiens
tgtaatgggatctatttt

SEQ ID NO: 5956343 - DNA, 18 bp, Homo sapiens
tgtaatgggtaattctga

SEQ ID NO: 5956344 - DNA, 18 bp, Homo sapiens
tgtaatggtctctgaaaa

SEQ ID NO: 5956345 - DNA, 12 bp, Homo sapiens
tgtaatggtgct

SEQ ID NO: 5956346 - DNA, 12 bp, Homo sapiens
tgtaatgtaact

SEQ ID NO: 5956347 - DNA, 13 bp, Homo sapiens
tgtaatgtaactg

SEQ ID NO: 5956348 - DNA, 15 bp, Homo sapiens
tgtaatgtacaattt

SEQ ID NO: 5956349 - DNA, 20 bp, Homo sapiens
tgtaatgtaggcacttttat

SEQ ID NO: 5956350 - DNA, 21 bp, Homo sapiens
tgtaatgtaggcacttttatt

SEQ ID NO: 5956351 - DNA, 23 bp, Homo sapiens
tgtaatgtatcaaatacatttaa

SEQ ID NO: 5956352 - DNA, 13 bp, Homo sapiens
tgtaatgtcacca

SEQ ID NO: 5956353 - DNA, 23 bp, Homo sapiens
tgtaatgtcaccaccttcccagc

SEQ ID NO: 5956354 - DNA, 15 bp, Homo sapiens
tgtaatgtcttgagc

SEQ ID NO: 5956355 - DNA, 20 bp, Homo sapiens
tgtaatgtgaatctatgctg

SEQ ID NO: 5956356 - DNA, 14 bp, Homo sapiens
tgtaatgttaatat

SEQ ID NO: 5956357 - DNA, 15 bp, Homo sapiens
tgtaatgttgtgaat

SEQ ID NO: 5956358 - DNA, 18 bp, Homo sapiens
tgtaatgttttctttgca

SEQ ID NO: 5956359 - DNA, 19 bp, Homo sapiens
tgtaatgttttctttgcaa

SEQ ID NO: 5956360 - DNA, 20 bp, Homo sapiens
tgtaatgtttttatttcaat

SEQ ID NO: 5956361 - DNA, 19 bp, Homo sapiens
tgtaattaaaagcaaatca

SEQ ID NO: 5956362 - DNA, 15 bp, Homo sapiens
tgtaattaaactagt

SEQ ID NO: 5956363 - DNA, 12 bp, Homo sapiens
tgtaattaaatt

SEQ ID NO: 5956364 - DNA, 17 bp, Homo sapiens
tgtaattaaattatggt

SEQ ID NO: 5956365 - DNA, 23 bp, Homo sapiens
tgtaattaagtactatgtatcaa

SEQ ID NO: 5956366 - DNA, 20 bp, Homo sapiens
tgtaattaagtgcaatttcc

SEQ ID NO: 5956367 - DNA, 16 bp, Homo sapiens
tgtaattaatatcttg

SEQ ID NO: 5956368 - DNA, 12 bp, Homo sapiens
tgtaattacagg

SEQ ID NO: 5956369 - DNA, 14 bp, Homo sapiens
tgtaattacatatt

SEQ ID NO: 5956370 - DNA, 15 bp, Homo sapiens
tgtaattagctctgg

SEQ ID NO: 5956371 - DNA, 16 bp, Homo sapiens
tgtaattagctctggg

SEQ ID NO: 5956372 - DNA, 19 bp, Homo sapiens
tgtaattagctctgggggg

SEQ ID NO: 5956373 - DNA, 23 bp, Homo sapiens
tgtaattagtgccacttaatgta

SEQ ID NO: 5956374 - DNA, 14 bp, Homo sapiens
tgtaattagtttaa

SEQ ID NO: 5956375 - DNA, 23 bp, Homo sapiens
tgtaattatggttagtagaggta

SEQ ID NO: 5956376 - DNA, 15 bp, Homo sapiens
tgtaattatgtaaat

SEQ ID NO: 5956377 - DNA, 20 bp, Homo sapiens
tgtaattatgtaaatacaat

SEQ ID NO: 5956378 - DNA, 14 bp, Homo sapiens
tgtaattattgtga

SEQ ID NO: 5956379 - DNA, 13 bp, Homo sapiens
tgtaattatttga

SEQ ID NO: 5956380 - DNA, 14 bp, Homo sapiens
tgtaattatttgaa

SEQ ID NO: 5956381 - DNA, 15 bp, Homo sapiens
tgtaattcaaaagat

SEQ ID NO: 5956382 - DNA, 16 bp, Homo sapiens
tgtaattcagaatcat

SEQ ID NO: 5956383 - DNA, 23 bp, Homo sapiens
tgtaattccacatcatgttactt

SEQ ID NO: 5956384 - DNA, 13 bp, Homo sapiens
tgtaattctaaat

SEQ ID NO: 5956385 - DNA, 16 bp, Homo sapiens
tgtaattctaaatgaa

SEQ ID NO: 5956386 - DNA, 15 bp, Homo sapiens
tgtaattcttatgac

SEQ ID NO: 5956387 - DNA, 14 bp, Homo sapiens
tgtaattcttcagt

SEQ ID NO: 5956388 - DNA, 19 bp, Homo sapiens
tgtaattcttctcctttgt

SEQ ID NO: 5956389 - DNA, 23 bp, Homo sapiens
tgtaattgacggttttttattat

SEQ ID NO: 5956390 - DNA, 12 bp, Homo sapiens
tgtaattgctgc

SEQ ID NO: 5956391 - DNA, 16 bp, Homo sapiens
tgtaattgcttacatt

SEQ ID NO: 5956392 - DNA, 18 bp, Homo sapiens
tgtaattgcttacatttt

SEQ ID NO: 5956393 - DNA, 16 bp, Homo sapiens
tgtaattgctttttta

SEQ ID NO: 5956394 - DNA, 14 bp, Homo sapiens
tgtaattggaatct

SEQ ID NO: 5956395 - DNA, 15 bp, Homo sapiens
tgtaattggaatctt

SEQ ID NO: 5956396 - DNA, 16 bp, Homo sapiens
tgtaattggtgacaat

SEQ ID NO: 5956397 - DNA, 19 bp, Homo sapiens
tgtaattgttccttttatt

SEQ ID NO: 5956398 - DNA, 15 bp, Homo sapiens
tgtaattgtttgtct

SEQ ID NO: 5956399 - DNA, 18 bp, Homo sapiens
tgtaattgttttggaata

SEQ ID NO: 5956400 - DNA, 15 bp, Homo sapiens
tgtaatttaaaactt

SEQ ID NO: 5956401 - DNA, 14 bp, Homo sapiens
tgtaatttaaacag

SEQ ID NO: 5956402 - DNA, 16 bp, Homo sapiens
tgtaatttaaacaggc

SEQ ID NO: 5956403 - DNA, 20 bp, Homo sapiens
tgtaatttaaacaggcccag

SEQ ID NO: 5956404 - DNA, 22 bp, Homo sapiens
tgtaatttaaacaggcccagca

SEQ ID NO: 5956405 - DNA, 15 bp, Homo sapiens
tgtaatttaaatgaa

SEQ ID NO: 5956406 - DNA, 19 bp, Homo sapiens
tgtaatttaaggtctgttt

SEQ ID NO: 5956407 - DNA, 18 bp, Homo sapiens
tgtaatttaagtgacaca

SEQ ID NO: 5956408 - DNA, 23 bp, Homo sapiens
tgtaatttagggtactaaattta

SEQ ID NO: 5956409 - DNA, 20 bp, Homo sapiens
tgtaatttagttaataaaat

SEQ ID NO: 5956410 - DNA, 19 bp, Homo sapiens
tgtaatttcagctagttaa

SEQ ID NO: 5956411 - DNA, 19 bp, Homo sapiens
tgtaatttcaggaggaata

SEQ ID NO: 5956412 - DNA, 23 bp, Homo sapiens
tgtaatttcaggaggaatactga

SEQ ID NO: 5956413 - DNA, 22 bp, Homo sapiens
tgtaatttcgccttaaactctg

SEQ ID NO: 5956414 - DNA, 18 bp, Homo sapiens
tgtaatttctttaaatgt

SEQ ID NO: 5956415 - DNA, 19 bp, Homo sapiens
tgtaatttctttaaatgtg

SEQ ID NO: 5956416 - DNA, 19 bp, Homo sapiens
tgtaatttgatgaggtatt

SEQ ID NO: 5956417 - DNA, 16 bp, Homo sapiens
tgtaatttgtgataca

SEQ ID NO: 5956418 - DNA, 20 bp, Homo sapiens
tgtaatttgtgtaataaagt

SEQ ID NO: 5956419 - DNA, 23 bp, Homo sapiens
tgtaattttaaaagtctatttta

SEQ ID NO: 5956420 - DNA, 23 bp, Homo sapiens
tgtaattttacacgcttttgtga

SEQ ID NO: 5956421 - DNA, 16 bp, Homo sapiens
tgtaattttatatgaa

SEQ ID NO: 5956422 - DNA, 17 bp, Homo sapiens
tgtaattttattttaaa

SEQ ID NO: 5956423 - DNA, 12 bp, Homo sapiens
tgtaattttctt

SEQ ID NO: 5956424 - DNA, 14 bp, Homo sapiens
tgtaattttcttga

SEQ ID NO: 5956425 - DNA, 17 bp, Homo sapiens
tgtaattttgtttgtaa

SEQ ID NO: 5956426 - DNA, 17 bp, Homo sapiens
tgtaatttttaaagcaa

SEQ ID NO: 5956427 - DNA, 16 bp, Homo sapiens
tgtaattttttaaatg

SEQ ID NO: 5956428 - DNA, 20 bp, Homo sapiens
tgtaatttttttgaaaaaag

SEQ ID NO: 5956429 - DNA, 21 bp, Homo sapiens
tgtacaaaaattatgcaattc

SEQ ID NO: 5956430 - DNA, 18 bp, Homo sapiens
tgtacaaaactgtaaata

SEQ ID NO: 5956431 - DNA, 20 bp, Homo sapiens
tgtacaaaactgtaaataaa

SEQ ID NO: 5956432 - DNA, 13 bp, Homo sapiens
tgtacaaaataaa

SEQ ID NO: 5956433 - DNA, 17 bp, Homo sapiens
tgtacaaaataaagtta

SEQ ID NO: 5956434 - DNA, 18 bp, Homo sapiens
tgtacaaaatatccaagc

SEQ ID NO: 5956435 - DNA, 20 bp, Homo sapiens
tgtacaaaatgaattgcctt

SEQ ID NO: 5956436 - DNA, 13 bp, Homo sapiens
tgtacaaaattaa

SEQ ID NO: 5956437 - DNA, 15 bp, Homo sapiens
tgtacaaacagtatt

SEQ ID NO: 5956438 - DNA, 19 bp, Homo sapiens
tgtacaaaccaagagcttt

SEQ ID NO: 5956439 - DNA, 21 bp, Homo sapiens
tgtacaaaccaagagctttta

SEQ ID NO: 5956440 - DNA, 15 bp, Homo sapiens
tgtacaaactatttc

SEQ ID NO: 5956441 - DNA, 18 bp, Homo sapiens
tgtacaaactatttcaga

SEQ ID NO: 5956442 - DNA, 23 bp, Homo sapiens
tgtacaaactatttcagaatatt

SEQ ID NO: 5956443 - DNA, 14 bp, Homo sapiens
tgtacaaactcatc

SEQ ID NO: 5956444 - DNA, 18 bp, Homo sapiens
tgtacaaagatatgctaa

SEQ ID NO: 5956445 - DNA, 22 bp, Homo sapiens
tgtacaaagggaagcagagcct

SEQ ID NO: 5956446 - DNA, 14 bp, Homo sapiens
tgtacaaagtaaaa

SEQ ID NO: 5956447 - DNA, 17 bp, Homo sapiens
tgtacaaagtagagaag

SEQ ID NO: 5956448 - DNA, 18 bp, Homo sapiens
tgtacaaagtagagaagt

SEQ ID NO: 5956449 - DNA, 19 bp, Homo sapiens
tgtacaaagtagagaagta

SEQ ID NO: 5956450 - DNA, 14 bp, Homo sapiens
tgtacaaagtatta

SEQ ID NO: 5956451 - DNA, 18 bp, Homo sapiens
tgtacaaagtattaagca

SEQ ID NO: 5956452 - DNA, 19 bp, Homo sapiens
tgtacaaataaagtcccag

SEQ ID NO: 5956453 - DNA, 18 bp, Homo sapiens
tgtacaaataatattgcc

SEQ ID NO: 5956454 - DNA, 21 bp, Homo sapiens
tgtacaaatacatgtgtatat

SEQ ID NO: 5956455 - DNA, 12 bp, Homo sapiens
tgtacaaatact

SEQ ID NO: 5956456 - DNA, 21 bp, Homo sapiens
tgtacaaatataagaataaaa

SEQ ID NO: 5956457 - DNA, 14 bp, Homo sapiens
tgtacaaatcctct

SEQ ID NO: 5956458 - DNA, 13 bp, Homo sapiens
tgtacaaatgtat

SEQ ID NO: 5956459 - DNA, 14 bp, Homo sapiens
tgtacaaatgtatt

SEQ ID NO: 5956460 - DNA, 15 bp, Homo sapiens
tgtacaaatgtattt

SEQ ID NO: 5956461 - DNA, 18 bp, Homo sapiens
tgtacaaatgtattttga

SEQ ID NO: 5956462 - DNA, 16 bp, Homo sapiens
tgtacaacaatgcttt

SEQ ID NO: 5956463 - DNA, 20 bp, Homo sapiens
tgtacaacaatgctttgata

SEQ ID NO: 5956464 - DNA, 22 bp, Homo sapiens
tgtacaacaccagcaacattat

SEQ ID NO: 5956465 - DNA, 15 bp, Homo sapiens
tgtacaaccctgacc

SEQ ID NO: 5956466 - DNA, 13 bp, Homo sapiens
tgtacaacttttt

SEQ ID NO: 5956467 - DNA, 16 bp, Homo sapiens
tgtacaaggacagccc

SEQ ID NO: 5956468 - DNA, 21 bp, Homo sapiens
tgtacaaggtatttacacata

SEQ ID NO: 5956469 - DNA, 21 bp, Homo sapiens
tgtacaagtgctcagttccaa

SEQ ID NO: 5956470 - DNA, 16 bp, Homo sapiens
tgtacaagttgctttg

SEQ ID NO: 5956471 - DNA, 21 bp, Homo sapiens
tgtacaagttgctttgttaca

SEQ ID NO: 5956472 - DNA, 22 bp, Homo sapiens
tgtacaagttgttattgttgaa

SEQ ID NO: 5956473 - DNA, 20 bp, Homo sapiens
tgtacaataaaaacattgcc

SEQ ID NO: 5956474 - DNA, 19 bp, Homo sapiens
tgtacaatacaatgtacaa

SEQ ID NO: 5956475 - DNA, 19 bp, Homo sapiens
tgtacaatacataactagt

SEQ ID NO: 5956476 - DNA, 15 bp, Homo sapiens
tgtacaatatttaaa

SEQ ID NO: 5956477 - DNA, 17 bp, Homo sapiens
tgtacaatatttaaaat

SEQ ID NO: 5956478 - DNA, 21 bp, Homo sapiens
tgtacaatattttaagcatta

SEQ ID NO: 5956479 - DNA, 22 bp, Homo sapiens
tgtacaatcatgaacagctctg

SEQ ID NO: 5956480 - DNA, 20 bp, Homo sapiens
tgtacaatggggacttcccg

SEQ ID NO: 5956481 - DNA, 23 bp, Homo sapiens
tgtacaatggggacttcccggga

SEQ ID NO: 5956482 - DNA, 14 bp, Homo sapiens
tgtacaattaagtt

SEQ ID NO: 5956483 - DNA, 22 bp, Homo sapiens
tgtacaattactaaattgtata

SEQ ID NO: 5956484 - DNA, 21 bp, Homo sapiens
tgtacaattactgtgagaact

SEQ ID NO: 5956485 - DNA, 21 bp, Homo sapiens
tgtacaattatgtctcttgag

SEQ ID NO: 5956486 - DNA, 22 bp, Homo sapiens
tgtacaattgaacttaaataaa

SEQ ID NO: 5956487 - DNA, 23 bp, Homo sapiens
tgtacaattgaacttaaataaat

SEQ ID NO: 5956488 - DNA, 23 bp, Homo sapiens
tgtacacaaaggatttgatgctt

SEQ ID NO: 5956489 - DNA, 15 bp, Homo sapiens
tgtacacaactcact

SEQ ID NO: 5956490 - DNA, 13 bp, Homo sapiens
tgtacacacacag

SEQ ID NO: 5956491 - DNA, 19 bp, Homo sapiens
tgtacacacacagacacac

SEQ ID NO: 5956492 - DNA, 19 bp, Homo sapiens
tgtacacactttatttact

SEQ ID NO: 5956493 - DNA, 16 bp, Homo sapiens
tgtacacagtctgttt

SEQ ID NO: 5956494 - DNA, 21 bp, Homo sapiens
tgtacacatttcttaaaacac

SEQ ID NO: 5956495 - DNA, 16 bp, Homo sapiens
tgtacaccacatgcta

SEQ ID NO: 5956496 - DNA, 19 bp, Homo sapiens
tgtacaccacatgctattg

SEQ ID NO: 5956497 - DNA, 14 bp, Homo sapiens
tgtacactgaatat

SEQ ID NO: 5956498 - DNA, 15 bp, Homo sapiens
tgtacactgaatatt

SEQ ID NO: 5956499 - DNA, 19 bp, Homo sapiens
tgtacactttttacagcag

SEQ ID NO: 5956500 - DNA, 22 bp, Homo sapiens
tgtacactttttacagcagcaa

SEQ ID NO: 5956501 - DNA, 22 bp, Homo sapiens
tgtacagaacacatttctctga

SEQ ID NO: 5956502 - DNA, 23 bp, Homo sapiens
tgtacagaaccagcactcccagg

SEQ ID NO: 5956503 - DNA, 24 bp, Homo sapiens
tgtacagaaccagcactcccaggg

SEQ ID NO: 5956504 - DNA, 15 bp, Homo sapiens
tgtacagaagagcaa

SEQ ID NO: 5956505 - DNA, 15 bp, Homo sapiens
tgtacagaatttcca

SEQ ID NO: 5956506 - DNA, 15 bp, Homo sapiens
tgtagctatttttct

SEQ ID NO: 5956507 - DNA, 22 bp, Homo sapiens
tgtagctcccctgctgaggcag

SEQ ID NO: 5956508 - DNA, 19 bp, Homo sapiens
tgtagctccctcctcccat

SEQ ID NO: 5956509 - DNA, 22 bp, Homo sapiens
tgtagctccctcctcccatctc

SEQ ID NO: 5956510 - DNA, 11 bp, Homo sapiens
tgtagctccta

SEQ ID NO: 5956511 - DNA, 11 bp, Homo sapiens
tgtagctcctc

SEQ ID NO: 5956512 - DNA, 16 bp, Homo sapiens
tgtagctcctctgctg

SEQ ID NO: 5956513 - DNA, 17 bp, Homo sapiens
tgtagctctaaaatctg

SEQ ID NO: 5956514 - DNA, 13 bp, Homo sapiens
tgtagctgaagca

SEQ ID NO: 5956515 - DNA, 16 bp, Homo sapiens
tgtagctgaagcagga

SEQ ID NO: 5956516 - DNA, 15 bp, Homo sapiens
tgtagctgagctgtg

SEQ ID NO: 5956517 - DNA, 13 bp, Homo sapiens
tgtagctgatgaa

SEQ ID NO: 5956518 - DNA, 14 bp, Homo sapiens
tgtagctgatgaaa

SEQ ID NO: 5956519 - DNA, 17 bp, Homo sapiens
tgtagctgccacattga

SEQ ID NO: 5956520 - DNA, 18 bp, Homo sapiens
tgtagctgcgtcataagg

SEQ ID NO: 5956521 - DNA, 13 bp, Homo sapiens
tgtagctggcaag

SEQ ID NO: 5956522 - DNA, 15 bp, Homo sapiens
tgtagctggcaagct

SEQ ID NO: 5956523 - DNA, 19 bp, Homo sapiens
tgtagctggcaagctgcaa

SEQ ID NO: 5956524 - DNA, 14 bp, Homo sapiens
tgtagctggtttcc

SEQ ID NO: 5956525 - DNA, 14 bp, Homo sapiens
tgtagctgtaaaac

SEQ ID NO: 5956526 - DNA, 21 bp, Homo sapiens
tgtagctgtaagggcagtgcc

SEQ ID NO: 5956527 - DNA, 14 bp, Homo sapiens
tgtagctgtcatgg

SEQ ID NO: 5956528 - DNA, 21 bp, Homo sapiens
tgtagctgtccaaaataataa

SEQ ID NO: 5956529 - DNA, 13 bp, Homo sapiens
tgtagctgtgaaa

SEQ ID NO: 5956530 - DNA, 19 bp, Homo sapiens
tgtagctgtgacctgctga

SEQ ID NO: 5956531 - DNA, 20 bp, Homo sapiens
tgtagctgtgacctgctgag

SEQ ID NO: 5956532 - DNA, 22 bp, Homo sapiens
tgtagctgtgacctgctgagct

SEQ ID NO: 5956533 - DNA, 21 bp, Homo sapiens
tgtagcttaaaaaaaggaaaa

SEQ ID NO: 5956534 - DNA, 19 bp, Homo sapiens
tgtagcttcagtcattaaa

SEQ ID NO: 5956535 - DNA, 13 bp, Homo sapiens
tgtagcttccacc

SEQ ID NO: 5956536 - DNA, 15 bp, Homo sapiens
tgtagcttccacctc

SEQ ID NO: 5956537 - DNA, 21 bp, Homo sapiens
tgtagcttctgaaaggtgctt

SEQ ID NO: 5956538 - DNA, 16 bp, Homo sapiens
tgtagcttcttctgaa

SEQ ID NO: 5956539 - DNA, 19 bp, Homo sapiens
tgtagcttcttctgaaaga

SEQ ID NO: 5956540 - DNA, 20 bp, Homo sapiens
tgtagctttaaaaccacagc

SEQ ID NO: 5956541 - DNA, 14 bp, Homo sapiens
tgtagctttatcaa

SEQ ID NO: 5956542 - DNA, 14 bp, Homo sapiens
tgtagctttcctgg

SEQ ID NO: 5956543 - DNA, 15 bp, Homo sapiens
tgtagctttcctggt

SEQ ID NO: 5956544 - DNA, 17 bp, Homo sapiens
tgtagctttcctggtcc

SEQ ID NO: 5956545 - DNA, 20 bp, Homo sapiens
tgtagctttcctggtccctc

SEQ ID NO: 5956546 - DNA, 12 bp, Homo sapiens
tgtagctttgct

SEQ ID NO: 5956547 - DNA, 20 bp, Homo sapiens
tgtagctttgggcagatttg

SEQ ID NO: 5956548 - DNA, 13 bp, Homo sapiens
tgtagcttttcac

SEQ ID NO: 5956549 - DNA, 16 bp, Homo sapiens
tgtagcttttcacctt

SEQ ID NO: 5956550 - DNA, 15 bp, Homo sapiens
tgtagcttttgggga

SEQ ID NO: 5956551 - DNA, 12 bp, Homo sapiens
tgtaggaaacag

SEQ ID NO: 5956552 - DNA, 22 bp, Homo sapiens
tgtaggaaacagaaaagagaag

SEQ ID NO: 5956553 - DNA, 21 bp, Homo sapiens
tgtaggaaatctgaagccttt

SEQ ID NO: 5956554 - DNA, 21 bp, Homo sapiens
tgtaggaaccgtggtatgtct

SEQ ID NO: 5956555 - DNA, 23 bp, Homo sapiens
tgtaggaagagtagcatttcatt

SEQ ID NO: 5956556 - DNA, 22 bp, Homo sapiens
tgtaggaaggtactgtatgatc

SEQ ID NO: 5956557 - DNA, 18 bp, Homo sapiens
tgtaggaaggttaatgtt

SEQ ID NO: 5956558 - DNA, 20 bp, Homo sapiens
tgtaggaaggttaatgttca

SEQ ID NO: 5956559 - DNA, 19 bp, Homo sapiens
tgtaggaatcctttgagaa

SEQ ID NO: 5956560 - DNA, 18 bp, Homo sapiens
tgtaggaatctgccttcc

SEQ ID NO: 5956561 - DNA, 16 bp, Homo sapiens
tgtaggacttttaaac

SEQ ID NO: 5956562 - DNA, 13 bp, Homo sapiens
tgtaggagacttg

SEQ ID NO: 5956563 - DNA, 14 bp, Homo sapiens
tgtaggagcaaggg

SEQ ID NO: 5956564 - DNA, 19 bp, Homo sapiens
tgtaggagggactgtcgct

SEQ ID NO: 5956565 - DNA, 17 bp, Homo sapiens
tgtaggataattagcag

SEQ ID NO: 5956566 - DNA, 18 bp, Homo sapiens
tgtaggatcgtaaaaaaa

SEQ ID NO: 5956567 - DNA, 18 bp, Homo sapiens
tgtaggatttttttcctc

SEQ ID NO: 5956568 - DNA, 13 bp, Homo sapiens
tgtaggcaccacc

SEQ ID NO: 5956569 - DNA, 22 bp, Homo sapiens
tgtaggcacttttattttcatt

SEQ ID NO: 5956570 - DNA, 12 bp, Homo sapiens
tgtaggcagaca

SEQ ID NO: 5956571 - DNA, 13 bp, Homo sapiens
tgtaggcagacac

SEQ ID NO: 5956572 - DNA, 16 bp, Homo sapiens
tgtaggcagaggctgc

SEQ ID NO: 5956573 - DNA, 14 bp, Homo sapiens
tgtaggcagggaac

SEQ ID NO: 5956574 - DNA, 22 bp, Homo sapiens
tgtaggccagtagttctcaaag

SEQ ID NO: 5956575 - DNA, 17 bp, Homo sapiens
tgtaggctgctgtggta

SEQ ID NO: 5956576 - DNA, 21 bp, Homo sapiens
tgtaggctggtccctatgtca

SEQ ID NO: 5956577 - DNA, 23 bp, Homo sapiens
tgtaggctgttccctttgcctta

SEQ ID NO: 5956578 - DNA, 17 bp, Homo sapiens
tgtaggctttacttagc

SEQ ID NO: 5956579 - DNA, 21 bp, Homo sapiens
tgtagggaaaaaaatgcttct

SEQ ID NO: 5956580 - DNA, 18 bp, Homo sapiens
tgtagggaaaccttggag

SEQ ID NO: 5956581 - DNA, 19 bp, Homo sapiens
tgtagggaaaccttggaga

SEQ ID NO: 5956582 - DNA, 13 bp, Homo sapiens
tgtagggagggcg

SEQ ID NO: 5956583 - DNA, 13 bp, Homo sapiens
tgtagggcaaggg

SEQ ID NO: 5956584 - DNA, 20 bp, Homo sapiens
tgtagggcaagggtgcctca

SEQ ID NO: 5956585 - DNA, 23 bp, Homo sapiens
tgtagggcaagggtgcctcagga

SEQ ID NO: 5956586 - DNA, 21 bp, Homo sapiens
tgtaggggaggggctcctttc

SEQ ID NO: 5956587 - DNA, 22 bp, Homo sapiens
tgtaggggaggggctcctttcc

SEQ ID NO: 5956588 - DNA, 15 bp, Homo sapiens
tgtaggggccacctc

SEQ ID NO: 5956589 - DNA, 18 bp, Homo sapiens
tgtaggggccacctcctc

SEQ ID NO: 5956590 - DNA, 19 bp, Homo sapiens
tgtaggggccacctcctcc

SEQ ID NO: 5956591 - DNA, 20 bp, Homo sapiens
tgtaggggccacctcctccc

SEQ ID NO: 5956592 - DNA, 23 bp, Homo sapiens
tgtagggggccttgcggaagcca

SEQ ID NO: 5956593 - DNA, 15 bp, Homo sapiens
tgtaggggttaactt

SEQ ID NO: 5956594 - DNA, 21 bp, Homo sapiens
tgtagggtccaaccagacctg

SEQ ID NO: 5956595 - DNA, 19 bp, Homo sapiens
tgtaggtaaaatgtatttt

SEQ ID NO: 5956596 - DNA, 14 bp, Homo sapiens
tgtaggtaaatcta

SEQ ID NO: 5956597 - DNA, 16 bp, Homo sapiens
tgtaggtaaattctta

SEQ ID NO: 5956598 - DNA, 20 bp, Homo sapiens
tgtaggtatactatgtaagg

SEQ ID NO: 5956599 - DNA, 20 bp, Homo sapiens
tgtaggtattaaagatgtgt

SEQ ID NO: 5956600 - DNA, 22 bp, Homo sapiens
tgtaggtcactctccagcagtt

SEQ ID NO: 5956601 - DNA, 16 bp, Homo sapiens
tgtaggtgaacagtca

SEQ ID NO: 5956602 - DNA, 18 bp, Homo sapiens
tgtaggtgagcctgggca

SEQ ID NO: 5956603 - DNA, 16 bp, Homo sapiens
tgtaggtgatgtttcc

SEQ ID NO: 5956604 - DNA, 16 bp, Homo sapiens
tgtaggtggtatgtga

SEQ ID NO: 5956605 - DNA, 23 bp, Homo sapiens
tgtaggtggtctggagctgtccg

SEQ ID NO: 5956606 - DNA, 14 bp, Homo sapiens
tgtaggtgtctctg

SEQ ID NO: 5956607 - DNA, 16 bp, Homo sapiens
tgtaggtgtctctggg

SEQ ID NO: 5956608 - DNA, 17 bp, Homo sapiens
tgtaggtgtctctgggc

SEQ ID NO: 5956609 - DNA, 13 bp, Homo sapiens
tgtaggttgctta

SEQ ID NO: 5956610 - DNA, 22 bp, Homo sapiens
tgtaggtttctctcttcccttc

SEQ ID NO: 5956611 - DNA, 22 bp, Homo sapiens
tgtaggtttctctgcctccagg

SEQ ID NO: 5956612 - DNA, 18 bp, Homo sapiens
tgtagtaaactattctta

SEQ ID NO: 5956613 - DNA, 16 bp, Homo sapiens
tgtagtaaataatgct

SEQ ID NO: 5956614 - DNA, 18 bp, Homo sapiens
tgtagtaaataatgcttt

SEQ ID NO: 5956615 - DNA, 17 bp, Homo sapiens
tgtagtaaatattatga

SEQ ID NO: 5956616 - DNA, 19 bp, Homo sapiens
tgtagtaaatattatgatt

SEQ ID NO: 5956617 - DNA, 22 bp, Homo sapiens
tgtagtaacacagattattcat

SEQ ID NO: 5956618 - DNA, 16 bp, Homo sapiens
tgtagtaattgacatg

SEQ ID NO: 5956619 - DNA, 18 bp, Homo sapiens
tgtagtaattgacatgtg

SEQ ID NO: 5956620 - DNA, 14 bp, Homo sapiens
tgtagtaatttatt

SEQ ID NO: 5956621 - DNA, 18 bp, Homo sapiens
tgtagtagccctttctgt

SEQ ID NO: 5956622 - DNA, 20 bp, Homo sapiens
tgtagtagcctttcctgatg

SEQ ID NO: 5956623 - DNA, 16 bp, Homo sapiens
tgtagtagcgtttttt

SEQ ID NO: 5956624 - DNA, 21 bp, Homo sapiens
tgtagtagcgttttttaaatg

SEQ ID NO: 5956625 - DNA, 20 bp, Homo sapiens
tgtagtaggcatttttacca

SEQ ID NO: 5956626 - DNA, 18 bp, Homo sapiens
tgtagtagtgcatagaat

SEQ ID NO: 5956627 - DNA, 15 bp, Homo sapiens
tgtagtataaagaaa

SEQ ID NO: 5956628 - DNA, 21 bp, Homo sapiens
tgtagtatactttcatctaaa

SEQ ID NO: 5956629 - DNA, 14 bp, Homo sapiens
tgtagtatcaaata

SEQ ID NO: 5956630 - DNA, 19 bp, Homo sapiens
tgtagtatcaaatattaga

SEQ ID NO: 5956631 - DNA, 15 bp, Homo sapiens
tgtagtatcttgaaa

SEQ ID NO: 5956632 - DNA, 21 bp, Homo sapiens
tgtagtatggcctgacagctc

SEQ ID NO: 5956633 - DNA, 13 bp, Homo sapiens
tgtagtatttagt

SEQ ID NO: 5956634 - DNA, 19 bp, Homo sapiens
tgtagtattttttgtataa

SEQ ID NO: 5956635 - DNA, 20 bp, Homo sapiens
tgtagtattttttgtataat

SEQ ID NO: 5956636 - DNA, 15 bp, Homo sapiens
tgtagtcagttgcat

SEQ ID NO: 5956637 - DNA, 12 bp, Homo sapiens
tgtagtcccagc

SEQ ID NO: 5956638 - DNA, 15 bp, Homo sapiens
tgtagtcccagccac

SEQ ID NO: 5956639 - DNA, 17 bp, Homo sapiens
tgtagtcccagctactc

SEQ ID NO: 5956640 - DNA, 23 bp, Homo sapiens
tgtagtcccagctacttgggagg

SEQ ID NO: 5956641 - DNA, 17 bp, Homo sapiens
tgtagtcctttctgcct

SEQ ID NO: 5956642 - DNA, 19 bp, Homo sapiens
tgtagtcctttctgccttg

SEQ ID NO: 5956643 - DNA, 13 bp, Homo sapiens
tgtagtctcagct

SEQ ID NO: 5956644 - DNA, 12 bp, Homo sapiens
tgtagtctctga

SEQ ID NO: 5956645 - DNA, 18 bp, Homo sapiens
tgtagtcttatgaataga

SEQ ID NO: 5956646 - DNA, 17 bp, Homo sapiens
tgtagtcttgacgaata

SEQ ID NO: 5956647 - DNA, 21 bp, Homo sapiens
tgtagtgagatagcattgtga

SEQ ID NO: 5956648 - DNA, 13 bp, Homo sapiens
tgtagtgagccaa

SEQ ID NO: 5956649 - DNA, 14 bp, Homo sapiens
tgtagtgagccaag

SEQ ID NO: 5956650 - DNA, 15 bp, Homo sapiens
tgtagtgagccgaga

SEQ ID NO: 5956651 - DNA, 13 bp, Homo sapiens
tgtagtgagcgag

SEQ ID NO: 5956652 - DNA, 19 bp, Homo sapiens
tgtagtgatggagttcctt

SEQ ID NO: 5956653 - DNA, 17 bp, Homo sapiens
tgtagtgattaaatata

SEQ ID NO: 5956654 - DNA, 13 bp, Homo sapiens
tgtagtgcaaaat

SEQ ID NO: 5956655 - DNA, 22 bp, Homo sapiens
tgtagtgctttgagagagaaag

SEQ ID NO: 5956656 - DNA, 18 bp, Homo sapiens
tgtagtggaagagcagcc

SEQ ID NO: 5956657 - DNA, 19 bp, Homo sapiens
tgtagtggcaaaaaagaac

SEQ ID NO: 5956658 - DNA, 20 bp, Homo sapiens
tgtagtggcaaaaaagaaca

SEQ ID NO: 5956659 - DNA, 16 bp, Homo sapiens
tgtagtgttggagaag

SEQ ID NO: 5956660 - DNA, 18 bp, Homo sapiens
tgtagtgttggagaagaa

SEQ ID NO: 5956661 - DNA, 19 bp, Homo sapiens
tgtagtgttggagaagaac

SEQ ID NO: 5956662 - DNA, 22 bp, Homo sapiens
tgtagtgttggagaagaactga

SEQ ID NO: 5956663 - DNA, 18 bp, Homo sapiens
tgtagttaaagggcagaa

SEQ ID NO: 5956664 - DNA, 17 bp, Homo sapiens
tgtagttaaggagccta

SEQ ID NO: 5956665 - DNA, 17 bp, Homo sapiens
tgtagttaatttatcta

SEQ ID NO: 5956666 - DNA, 14 bp, Homo sapiens
tgtagttagacaat

SEQ ID NO: 5956667 - DNA, 18 bp, Homo sapiens
tgtagttcaatttcatgt

SEQ ID NO: 5956668 - DNA, 14 bp, Homo sapiens
tgtagttcatgtaa

SEQ ID NO: 5956669 - DNA, 15 bp, Homo sapiens
tgtagttctaagact

SEQ ID NO: 5956670 - DNA, 19 bp, Homo sapiens
tgtagttcttgtgcatgtt

SEQ ID NO: 5956671 - DNA, 14 bp, Homo sapiens
tgtagttctttaaa

SEQ ID NO: 5956672 - DNA, 18 bp, Homo sapiens
tgtagttctttgttcctg

SEQ ID NO: 5956673 - DNA, 21 bp, Homo sapiens
tgtagttctttgttcctgctt

SEQ ID NO: 5956674 - DNA, 15 bp, Homo sapiens
tgtagttgacataaa

SEQ ID NO: 5956675 - DNA, 15 bp, Homo sapiens
tgtagttgcgtggac

SEQ ID NO: 5956676 - DNA, 21 bp, Homo sapiens
tgtagttgcgtggactctgca

SEQ ID NO: 5956677 - DNA, 23 bp, Homo sapiens
tgtagttgggcctaaataaatga

SEQ ID NO: 5956678 - DNA, 15 bp, Homo sapiens
tgtagttgtcacact

SEQ ID NO: 5956679 - DNA, 16 bp, Homo sapiens
tgtagtttacagaaaa

SEQ ID NO: 5956680 - DNA, 21 bp, Homo sapiens
tgtagtttgaaagttgtacat

SEQ ID NO: 5956681 - DNA, 16 bp, Homo sapiens
tgtagtttgcccagag

SEQ ID NO: 5956682 - DNA, 16 bp, Homo sapiens
tgtagtttggagacaa

SEQ ID NO: 5956683 - DNA, 15 bp, Homo sapiens
tgtagttttaaataa

SEQ ID NO: 5956684 - DNA, 19 bp, Homo sapiens
tgtattttggctttctccc

SEQ ID NO: 5956685 - DNA, 20 bp, Homo sapiens
tgtattttggctttctccct

SEQ ID NO: 5956686 - DNA, 14 bp, Homo sapiens
tgtattttgtccaa

SEQ ID NO: 5956687 - DNA, 19 bp, Homo sapiens
tgtattttgtccaagttca

SEQ ID NO: 5956688 - DNA, 21 bp, Homo sapiens
tgtattttgtccaagttcaca

SEQ ID NO: 5956689 - DNA, 15 bp, Homo sapiens
tgtattttgtgagtt

SEQ ID NO: 5956690 - DNA, 16 bp, Homo sapiens
tgtattttgtgtgacc

SEQ ID NO: 5956691 - DNA, 14 bp, Homo sapiens
tgtatttttagaga

SEQ ID NO: 5956692 - DNA, 23 bp, Homo sapiens
tgtatttttagagattaatttgt

SEQ ID NO: 5956693 - DNA, 19 bp, Homo sapiens
tgtatttttagtagagaca

SEQ ID NO: 5956694 - DNA, 19 bp, Homo sapiens
tgtatttttatttttgcac

SEQ ID NO: 5956695 - DNA, 13 bp, Homo sapiens
tgtatttttcaga

SEQ ID NO: 5956696 - DNA, 20 bp, Homo sapiens
tgtatttttcttgctgttca

SEQ ID NO: 5956697 - DNA, 17 bp, Homo sapiens
tgtatttttgaataaaa

SEQ ID NO: 5956698 - DNA, 17 bp, Homo sapiens
tgtatttttgattgtta

SEQ ID NO: 5956699 - DNA, 12 bp, Homo sapiens
tgtatttttgta

SEQ ID NO: 5956700 - DNA, 14 bp, Homo sapiens
tgtatttttgtaat

SEQ ID NO: 5956701 - DNA, 16 bp, Homo sapiens
tgtatttttgtcaatt

SEQ ID NO: 5956702 - DNA, 15 bp, Homo sapiens
tgtatttttgtttaa

SEQ ID NO: 5956703 - DNA, 16 bp, Homo sapiens
tgtattttttaaaaca

SEQ ID NO: 5956704 - DNA, 19 bp, Homo sapiens
tgtattttttaaaacacta

SEQ ID NO: 5956705 - DNA, 22 bp, Homo sapiens
tgtattttttaaaacactaaaa

SEQ ID NO: 5956706 - DNA, 15 bp, Homo sapiens
tgtattttttaaaat

SEQ ID NO: 5956707 - DNA, 17 bp, Homo sapiens
tgtattttttaaagcta

SEQ ID NO: 5956708 - DNA, 20 bp, Homo sapiens
tgtattttttaattgatttt

SEQ ID NO: 5956709 - DNA, 21 bp, Homo sapiens
tgtattttttaattgattttt

SEQ ID NO: 5956710 - DNA, 17 bp, Homo sapiens
tgtattttttatttaca

SEQ ID NO: 5956711 - DNA, 18 bp, Homo sapiens
tgtattttttatttacat

SEQ ID NO: 5956712 - DNA, 22 bp, Homo sapiens
tgtattttttcctgtaagacaa

SEQ ID NO: 5956713 - DNA, 21 bp, Homo sapiens
tgtattttttccttaagagct

SEQ ID NO: 5956714 - DNA, 20 bp, Homo sapiens
tgtattttttcttgcattga

SEQ ID NO: 5956715 - DNA, 14 bp, Homo sapiens
tgtatttttttaac

SEQ ID NO: 5956716 - DNA, 16 bp, Homo sapiens
tgtatttttttactaa

SEQ ID NO: 5956717 - DNA, 13 bp, Homo sapiens
tgtatttttttcc

SEQ ID NO: 5956718 - DNA, 16 bp, Homo sapiens
tgtatttttttccaag

SEQ ID NO: 5956719 - DNA, 22 bp, Homo sapiens
tgtatttttttccaagtgtata

SEQ ID NO: 5956720 - DNA, 23 bp, Homo sapiens
tgtatttttttccaagtgtataa

SEQ ID NO: 5956721 - DNA, 14 bp, Homo sapiens
tgtcaaaaaaaaaa

SEQ ID NO: 5956722 - DNA, 23 bp, Homo sapiens
tgtcaaaaaagaatctgtattca

SEQ ID NO: 5956723 - DNA, 19 bp, Homo sapiens
tgtcaaaaattttgaatgt

SEQ ID NO: 5956724 - DNA, 16 bp, Homo sapiens
tgtcaaaacactgtgg

SEQ ID NO: 5956725 - DNA, 19 bp, Homo sapiens
tgtcaaaactccactcagc

SEQ ID NO: 5956726 - DNA, 23 bp, Homo sapiens
tgtcaaaagaaataatccctgta

SEQ ID NO: 5956727 - DNA, 16 bp, Homo sapiens
tgtcaaaagttggact

SEQ ID NO: 5956728 - DNA, 20 bp, Homo sapiens
tgtcaaaagttggactaaat

SEQ ID NO: 5956729 - DNA, 22 bp, Homo sapiens
tgtcaaaagttggactaaatgc

SEQ ID NO: 5956730 - DNA, 16 bp, Homo sapiens
tgtcaaacaaagccag

SEQ ID NO: 5956731 - DNA, 15 bp, Homo sapiens
tgtcaaacagtgcca

SEQ ID NO: 5956732 - DNA, 16 bp, Homo sapiens
tgtcaaactgtagaaa

SEQ ID NO: 5956733 - DNA, 14 bp, Homo sapiens
tgtcaaagaaggtt

SEQ ID NO: 5956734 - DNA, 14 bp, Homo sapiens
tgtcaaagaatcaa

SEQ ID NO: 5956735 - DNA, 12 bp, Homo sapiens
tgtcaaagcagg

SEQ ID NO: 5956736 - DNA, 18 bp, Homo sapiens
tgtcaaagtgaaagacat

SEQ ID NO: 5956737 - DNA, 23 bp, Homo sapiens
tgtcaaagtgaaagacatttcaa

SEQ ID NO: 5956738 - DNA, 14 bp, Homo sapiens
tgtcaaagtggtga

SEQ ID NO: 5956739 - DNA, 15 bp, Homo sapiens
tgtcaaagtggtgag

SEQ ID NO: 5956740 - DNA, 19 bp, Homo sapiens
tgtcaaagtggtgagaggc

SEQ ID NO: 5956741 - DNA, 19 bp, Homo sapiens
tgtcaaatagcaaggccag

SEQ ID NO: 5956742 - DNA, 21 bp, Homo sapiens
tgtcaaatatatttaactatt

SEQ ID NO: 5956743 - DNA, 15 bp, Homo sapiens
tgtcaaatcatggcc

SEQ ID NO: 5956744 - DNA, 16 bp, Homo sapiens
tgtcaaatccatgtgt

SEQ ID NO: 5956745 - DNA, 12 bp, Homo sapiens
tgtcaaatgaac

SEQ ID NO: 5956746 - DNA, 14 bp, Homo sapiens
tgtcaaatgaactt

SEQ ID NO: 5956747 - DNA, 19 bp, Homo sapiens
tgtcaaatggatgtaatat

SEQ ID NO: 5956748 - DNA, 22 bp, Homo sapiens
tgtcaaatgtcattatgtagaa

SEQ ID NO: 5956749 - DNA, 14 bp, Homo sapiens
tgtcaacaaaaaga

SEQ ID NO: 5956750 - DNA, 20 bp, Homo sapiens
tgtcaacaaaaagacatgga

SEQ ID NO: 5956751 - DNA, 22 bp, Homo sapiens
tgtcaacaaaccaagcatcagg

SEQ ID NO: 5956752 - DNA, 23 bp, Homo sapiens
tgtcaacaaaccaagcatcaggg

SEQ ID NO: 5956753 - DNA, 16 bp, Homo sapiens
tgtcaacacaaagaca

SEQ ID NO: 5956754 - DNA, 23 bp, Homo sapiens
tgtcaacacaaagacacaggaag

SEQ ID NO: 5956755 - DNA, 23 bp, Homo sapiens
tgtcaacacaaagacatggaagg

SEQ ID NO: 5956756 - DNA, 19 bp, Homo sapiens
tgtcaacagatttaaagaa

SEQ ID NO: 5956757 - DNA, 15 bp, Homo sapiens
tgtcaacagtataag

SEQ ID NO: 5956758 - DNA, 13 bp, Homo sapiens
tgtcaacattgtg

SEQ ID NO: 5956759 - DNA, 17 bp, Homo sapiens
tgtcaacatttggaggc

SEQ ID NO: 5956760 - DNA, 14 bp, Homo sapiens
tgtcaaccagacag

SEQ ID NO: 5956761 - DNA, 20 bp, Homo sapiens
tgtcaaccagacagagggtc

SEQ ID NO: 5956762 - DNA, 22 bp, Homo sapiens
tgtcaaccagacagagggtcac

SEQ ID NO: 5956763 - DNA, 21 bp, Homo sapiens
tgtcaacctgaattaaagtct

SEQ ID NO: 5956764 - DNA, 22 bp, Homo sapiens
tgtcaacctgaattaaagtcta

SEQ ID NO: 5956765 - DNA, 23 bp, Homo sapiens
tgtcaacctgaattaaagtctac

SEQ ID NO: 5956766 - DNA, 19 bp, Homo sapiens
tgtcaaccttgtgtgagtg

SEQ ID NO: 5956767 - DNA, 21 bp, Homo sapiens
tgtcaaccttgtgtgagtgtg

SEQ ID NO: 5956768 - DNA, 14 bp, Homo sapiens
tgtcaactccagga

SEQ ID NO: 5956769 - DNA, 15 bp, Homo sapiens
tgtcaactgacctaa

SEQ ID NO: 5956770 - DNA, 14 bp, Homo sapiens
tgtcaacttcagtt

SEQ ID NO: 5956771 - DNA, 20 bp, Homo sapiens
tgtcaacttctggctcctca

SEQ ID NO: 5956772 - DNA, 18 bp, Homo sapiens
tgtcaactttcatttgaa

SEQ ID NO: 5956773 - DNA, 22 bp, Homo sapiens
tgtcaactttcatttgaaagtg

SEQ ID NO: 5956774 - DNA, 13 bp, Homo sapiens
tgtcaacttttga

SEQ ID NO: 5956775 - DNA, 15 bp, Homo sapiens
tgtcaacttttgact

SEQ ID NO: 5956776 - DNA, 19 bp, Homo sapiens
tgtcaagaaattctgctgt

SEQ ID NO: 5956777 - DNA, 20 bp, Homo sapiens
tgtcaagaaattctgctgtt

SEQ ID NO: 5956778 - DNA, 13 bp, Homo sapiens
tgtcaagattttt

SEQ ID NO: 5956779 - DNA, 14 bp, Homo sapiens
tgtcaagcaatggg

SEQ ID NO: 5956780 - DNA, 13 bp, Homo sapiens
tgtcaagcatatt

SEQ ID NO: 5956781 - DNA, 16 bp, Homo sapiens
tgtcaagcatattgga

SEQ ID NO: 5956782 - DNA, 14 bp, Homo sapiens
tgtcaagctgctct

SEQ ID NO: 5956783 - DNA, 18 bp, Homo sapiens
tgtcaagctgctctgagc

SEQ ID NO: 5956784 - DNA, 19 bp, Homo sapiens
tgtcaagctgctctgagcc

SEQ ID NO: 5956785 - DNA, 15 bp, Homo sapiens
tgtcaagctggccgt

SEQ ID NO: 5956786 - DNA, 16 bp, Homo sapiens
tgtcaagctggtgcta

SEQ ID NO: 5956787 - DNA, 17 bp, Homo sapiens
tgtcaagctggtgctac

SEQ ID NO: 5956788 - DNA, 18 bp, Homo sapiens
tgtcaagctggtgctact

SEQ ID NO: 5956789 - DNA, 19 bp, Homo sapiens
tgtcaagctggtgtcttca

SEQ ID NO: 5956790 - DNA, 13 bp, Homo sapiens
tgtcaaggaagaa

SEQ ID NO: 5956791 - DNA, 16 bp, Homo sapiens
tgtcaaggaagacttt

SEQ ID NO: 5956792 - DNA, 20 bp, Homo sapiens
tgtcaaggccgagggccagg

SEQ ID NO: 5956793 - DNA, 19 bp, Homo sapiens
tgtcaaggctgcttagaat

SEQ ID NO: 5956794 - DNA, 18 bp, Homo sapiens
tgtcaagggcagaatgaa

SEQ ID NO: 5956795 - DNA, 22 bp, Homo sapiens
tgtcaagggcagctttgctcat

SEQ ID NO: 5956796 - DNA, 23 bp, Homo sapiens
tgtcaagggcagctttgctcata

SEQ ID NO: 5956797 - DNA, 14 bp, Homo sapiens
tgtcaaggggccct

SEQ ID NO: 5956798 - DNA, 15 bp, Homo sapiens
tgtcaaggtgaagca

SEQ ID NO: 5956799 - DNA, 19 bp, Homo sapiens
tgtcaagtacaagcaagac

SEQ ID NO: 5956800 - DNA, 17 bp, Homo sapiens
tgtcaagtataaagtca

SEQ ID NO: 5956801 - DNA, 19 bp, Homo sapiens
tgtcaagtataaagtcagg

SEQ ID NO: 5956802 - DNA, 20 bp, Homo sapiens
tgtcaagtataaagtcagga

SEQ ID NO: 5956803 - DNA, 15 bp, Homo sapiens
tgtcaagtgcctgca

SEQ ID NO: 5956804 - DNA, 18 bp, Homo sapiens
tgtcaagtgcctgcacca

SEQ ID NO: 5956805 - DNA, 17 bp, Homo sapiens
tgtcaagtggcagctca

SEQ ID NO: 5956806 - DNA, 17 bp, Homo sapiens
tgtcaagtgtcagtaag

SEQ ID NO: 5956807 - DNA, 20 bp, Homo sapiens
tgtcaagtttttatacctgt

SEQ ID NO: 5956808 - DNA, 21 bp, Homo sapiens
tgtcaataaaatccatacatt

SEQ ID NO: 5956809 - DNA, 18 bp, Homo sapiens
tgtcaataaacctgtcat

SEQ ID NO: 5956810 - DNA, 21 bp, Homo sapiens
tgtcaataaatgacacccaga

SEQ ID NO: 5956811 - DNA, 15 bp, Homo sapiens
tgtcaataaatgttg

SEQ ID NO: 5956812 - DNA, 13 bp, Homo sapiens
tgtcaataaattt

SEQ ID NO: 5956813 - DNA, 19 bp, Homo sapiens
tgtcaataactttatatga

SEQ ID NO: 5956814 - DNA, 19 bp, Homo sapiens
tgtcaatatatagagactt

SEQ ID NO: 5956815 - DNA, 17 bp, Homo sapiens
tgtcaatatttaaacat

SEQ ID NO: 5956816 - DNA, 23 bp, Homo sapiens
tgtcaatccaatctgtaatttca

SEQ ID NO: 5956817 - DNA, 18 bp, Homo sapiens
tgtcaatcttaagaggat

SEQ ID NO: 5956818 - DNA, 18 bp, Homo sapiens
tgtcaatgctctaacaaa

SEQ ID NO: 5956819 - DNA, 13 bp, Homo sapiens
tgtcaattatgtt

SEQ ID NO: 5956820 - DNA, 14 bp, Homo sapiens
tgtcaattatgttg

SEQ ID NO: 5956821 - DNA, 19 bp, Homo sapiens
tgtcaattcattaataaaa

SEQ ID NO: 5956822 - DNA, 23 bp, Homo sapiens
tgtcaatttccctgactcctcta

SEQ ID NO: 5956823 - DNA, 15 bp, Homo sapiens
tgtcaatttctgtgt

SEQ ID NO: 5956824 - DNA, 15 bp, Homo sapiens
tgtcaatttgtatat

SEQ ID NO: 5956825 - DNA, 20 bp, Homo sapiens
tgtcaatttttaacttatct

SEQ ID NO: 5956826 - DNA, 15 bp, Homo sapiens
tgtcacaaagctaaa

SEQ ID NO: 5956827 - DNA, 20 bp, Homo sapiens
tgtcacaaagtgagaaatta

SEQ ID NO: 5956828 - DNA, 15 bp, Homo sapiens
tgtcacaaattgatc

SEQ ID NO: 5956829 - DNA, 21 bp, Homo sapiens
tgtcacaaattgatcaagata

SEQ ID NO: 5956830 - DNA, 18 bp, Homo sapiens
tgtcacaacctctctgat

SEQ ID NO: 5956831 - DNA, 16 bp, Homo sapiens
tgtcacaataaagttt

SEQ ID NO: 5956832 - DNA, 17 bp, Homo sapiens
tgtcacaataaagttta

SEQ ID NO: 5956833 - DNA, 19 bp, Homo sapiens
tgtcacaataaagtttatt

SEQ ID NO: 5956834 - DNA, 13 bp, Homo sapiens
tgtcacaataaat

SEQ ID NO: 5956835 - DNA, 20 bp, Homo sapiens
tgtcacaataaatggccagt

SEQ ID NO: 5956836 - DNA, 19 bp, Homo sapiens
tgtcacaatcctaacacat

SEQ ID NO: 5956837 - DNA, 21 bp, Homo sapiens
tgtcacaatcctaacacatta

SEQ ID NO: 5956838 - DNA, 16 bp, Homo sapiens
tgtcacaatgagattg

SEQ ID NO: 5956839 - DNA, 13 bp, Homo sapiens
tgtcacaattctt

SEQ ID NO: 5956840 - DNA, 16 bp, Homo sapiens
tgtcacacaaactgat

SEQ ID NO: 5956841 - DNA, 16 bp, Homo sapiens
tgtcacacaaggctgg

SEQ ID NO: 5956842 - DNA, 15 bp, Homo sapiens
tgtcacacagggcag

SEQ ID NO: 5956843 - DNA, 17 bp, Homo sapiens
tgtcacacccatggcct

SEQ ID NO: 5956844 - DNA, 20 bp, Homo sapiens
tgtcacactgagctgggcac

SEQ ID NO: 5956845 - DNA, 14 bp, Homo sapiens
tgtcacactggcta

SEQ ID NO: 5956846 - DNA, 18 bp, Homo sapiens
tgtcacactggtgctgag

SEQ ID NO: 5956847 - DNA, 13 bp, Homo sapiens
tgtcacacttgtg

SEQ ID NO: 5956848 - DNA, 18 bp, Homo sapiens
tgtcacacttgtttcttg

SEQ ID NO: 5956849 - DNA, 13 bp, Homo sapiens
tgtcacagagagc

SEQ ID NO: 5956850 - DNA, 15 bp, Homo sapiens
tgtcacagaggcagt

SEQ ID NO: 5956851 - DNA, 12 bp, Homo sapiens
tgtcacagctct

SEQ ID NO: 5956852 - DNA, 15 bp, Homo sapiens
tgtcacagctctgta

SEQ ID NO: 5956853 - DNA, 13 bp, Homo sapiens
tgtcacagctctt

SEQ ID NO: 5956854 - DNA, 11 bp, Homo sapiens
tgtcacaggca

SEQ ID NO: 5956855 - DNA, 21 bp, Homo sapiens
tgtcacaggcaggtccagggt

SEQ ID NO: 5956856 - DNA, 12 bp, Homo sapiens
tgtcacaggcat

SEQ ID NO: 5956857 - DNA, 17 bp, Homo sapiens
tgtcacaggctgggtca

SEQ ID NO: 5956858 - DNA, 20 bp, Homo sapiens
tgtcacagggtgttggaaga

SEQ ID NO: 5956859 - DNA, 20 bp, Homo sapiens
tgtcacagtccaaccagaaa

SEQ ID NO: 5956860 - DNA, 12 bp, Homo sapiens
tgtcacagttct

SEQ ID NO: 5956861 - DNA, 18 bp, Homo sapiens
tgtcacataaaagtctgt

SEQ ID NO: 5956862 - DNA, 20 bp, Homo sapiens
tgtcatctgaatttgccctg

SEQ ID NO: 5956863 - DNA, 13 bp, Homo sapiens
tgtcatctgccag

SEQ ID NO: 5956864 - DNA, 14 bp, Homo sapiens
tgtcatctgctcct

SEQ ID NO: 5956865 - DNA, 19 bp, Homo sapiens
tgtcatctgctccttcctg

SEQ ID NO: 5956866 - DNA, 13 bp, Homo sapiens
tgtcatctgggcc

SEQ ID NO: 5956867 - DNA, 14 bp, Homo sapiens
tgtcatctgtcagc

SEQ ID NO: 5956868 - DNA, 18 bp, Homo sapiens
tgtcatctgtcagcttcc

SEQ ID NO: 5956869 - DNA, 13 bp, Homo sapiens
tgtcatctgtgca

SEQ ID NO: 5956870 - DNA, 19 bp, Homo sapiens
tgtcatcttttagagtaaa

SEQ ID NO: 5956871 - DNA, 13 bp, Homo sapiens
tgtcatcttttca

SEQ ID NO: 5956872 - DNA, 12 bp, Homo sapiens
tgtcatgaacat

SEQ ID NO: 5956873 - DNA, 15 bp, Homo sapiens
tgtcatgaagaatgt

SEQ ID NO: 5956874 - DNA, 19 bp, Homo sapiens
tgtcatgacagtgcttgca

SEQ ID NO: 5956875 - DNA, 20 bp, Homo sapiens
tgtcatgacagtgcttgcat

SEQ ID NO: 5956876 - DNA, 20 bp, Homo sapiens
tgtcatgcagagtatttcta

SEQ ID NO: 5956877 - DNA, 16 bp, Homo sapiens
tgtcatgcccccctca

SEQ ID NO: 5956878 - DNA, 21 bp, Homo sapiens
tgtcatgcctcactttcttct

SEQ ID NO: 5956879 - DNA, 13 bp, Homo sapiens
tgtcatgctgcct

SEQ ID NO: 5956880 - DNA, 14 bp, Homo sapiens
tgtcatgctgcctt

SEQ ID NO: 5956881 - DNA, 20 bp, Homo sapiens
tgtcatgctgggatttccaa

SEQ ID NO: 5956882 - DNA, 17 bp, Homo sapiens
tgtcatgcttcatcatt

SEQ ID NO: 5956883 - DNA, 13 bp, Homo sapiens
tgtcatgctttgg

SEQ ID NO: 5956884 - DNA, 19 bp, Homo sapiens
tgtcatggaaaagcccagt

SEQ ID NO: 5956885 - DNA, 17 bp, Homo sapiens
tgtcatggatagatttt

SEQ ID NO: 5956886 - DNA, 15 bp, Homo sapiens
tgtcatggtgaaatt

SEQ ID NO: 5956887 - DNA, 21 bp, Homo sapiens
tgtcatggtgaaattataact

SEQ ID NO: 5956888 - DNA, 22 bp, Homo sapiens
tgtcatggtgaccaccccctgt

SEQ ID NO: 5956889 - DNA, 23 bp, Homo sapiens
tgtcatggtgaccaccccctgtt

SEQ ID NO: 5956890 - DNA, 22 bp, Homo sapiens
tgtcatggtgatgcaagtcact

SEQ ID NO: 5956891 - DNA, 15 bp, Homo sapiens
tgtcatgtaccatca

SEQ ID NO: 5956892 - DNA, 19 bp, Homo sapiens
tgtcatgtacttcctgtgt

SEQ ID NO: 5956893 - DNA, 13 bp, Homo sapiens
tgtcatgtagctg

SEQ ID NO: 5956894 - DNA, 15 bp, Homo sapiens
tgtcatgtagctgtt

SEQ ID NO: 5956895 - DNA, 21 bp, Homo sapiens
tgtcatgtaggttgtctaaaa

SEQ ID NO: 5956896 - DNA, 12 bp, Homo sapiens
tgtcatgtgtat

SEQ ID NO: 5956897 - DNA, 18 bp, Homo sapiens
tgtcatgtgtatgagaag

SEQ ID NO: 5956898 - DNA, 12 bp, Homo sapiens
tgtcatgtgtct

SEQ ID NO: 5956899 - DNA, 22 bp, Homo sapiens
tgtcatgtgttccctttgtctt

SEQ ID NO: 5956900 - DNA, 16 bp, Homo sapiens
tgtcatgttatgcagt

SEQ ID NO: 5956901 - DNA, 18 bp, Homo sapiens
tgtcatgttatgcagtga

SEQ ID NO: 5956902 - DNA, 19 bp, Homo sapiens
tgtcatgttgtaaacattt

SEQ ID NO: 5956903 - DNA, 13 bp, Homo sapiens
tgtcattaaaata

SEQ ID NO: 5956904 - DNA, 15 bp, Homo sapiens
tgtcattaaacatga

SEQ ID NO: 5956905 - DNA, 17 bp, Homo sapiens
tgtcattactgcctttg

SEQ ID NO: 5956906 - DNA, 23 bp, Homo sapiens
tgtcattactgcctttggaagaa

SEQ ID NO: 5956907 - DNA, 20 bp, Homo sapiens
tgtcattagaattgaattat

SEQ ID NO: 5956908 - DNA, 21 bp, Homo sapiens
tgtcattagaattgaattatt

SEQ ID NO: 5956909 - DNA, 17 bp, Homo sapiens
tgtcattagcctgagta

SEQ ID NO: 5956910 - DNA, 14 bp, Homo sapiens
tgtcattatattct

SEQ ID NO: 5956911 - DNA, 15 bp, Homo sapiens
tgtcattatgtagaa

SEQ ID NO: 5956912 - DNA, 21 bp, Homo sapiens
tgtcattattccatcttctcc

SEQ ID NO: 5956913 - DNA, 23 bp, Homo sapiens
tgtcattatttattgttaaatta

SEQ ID NO: 5956914 - DNA, 21 bp, Homo sapiens
tgtcattcaaatgggtgatat

SEQ ID NO: 5956915 - DNA, 16 bp, Homo sapiens
tgtcattcaagcctgt

SEQ ID NO: 5956916 - DNA, 19 bp, Homo sapiens
tgtcattcaagcctgtgaa

SEQ ID NO: 5956917 - DNA, 20 bp, Homo sapiens
tgtcattcaagcctgtgaat

SEQ ID NO: 5956918 - DNA, 23 bp, Homo sapiens
tgtcattcaagcctgtgaataaa

SEQ ID NO: 5956919 - DNA, 22 bp, Homo sapiens
tgtcattcagagtcagccagga

SEQ ID NO: 5956920 - DNA, 23 bp, Homo sapiens
tgtcattcaggaccccaacccct

SEQ ID NO: 5956921 - DNA, 17 bp, Homo sapiens
tgtcattcagttctagg

SEQ ID NO: 5956922 - DNA, 21 bp, Homo sapiens
tgtcattcagttctaggcctt

SEQ ID NO: 5956923 - DNA, 19 bp, Homo sapiens
tgtcattcgtggttgattt

SEQ ID NO: 5956924 - DNA, 17 bp, Homo sapiens
tgtcattctcatccaaa

SEQ ID NO: 5956925 - DNA, 14 bp, Homo sapiens
tgtcattctgctaa

SEQ ID NO: 5956926 - DNA, 17 bp, Homo sapiens
tgtcattgcccacttct

SEQ ID NO: 5956927 - DNA, 14 bp, Homo sapiens
tgtcattgcccctc

SEQ ID NO: 5956928 - DNA, 19 bp, Homo sapiens
tgtcattgctaaaaaataa

SEQ ID NO: 5956929 - DNA, 16 bp, Homo sapiens
tgtcattgctgtagga

SEQ ID NO: 5956930 - DNA, 18 bp, Homo sapiens
tgtcattgctgttgtccc

SEQ ID NO: 5956931 - DNA, 17 bp, Homo sapiens
tgtcattgcttcttctg

SEQ ID NO: 5956932 - DNA, 14 bp, Homo sapiens
tgtcattggaagcc

SEQ ID NO: 5956933 - DNA, 13 bp, Homo sapiens
tgtcattgtccag

SEQ ID NO: 5956934 - DNA, 20 bp, Homo sapiens
tgtcattgtccagctgggac

SEQ ID NO: 5956935 - DNA, 13 bp, Homo sapiens
tgtcattgtccat

SEQ ID NO: 5956936 - DNA, 14 bp, Homo sapiens
tgtcattgttatat

SEQ ID NO: 5956937 - DNA, 21 bp, Homo sapiens
tgtcattgttttcaggtactg

SEQ ID NO: 5956938 - DNA, 16 bp, Homo sapiens
tgtcatttacacacgt

SEQ ID NO: 5956939 - DNA, 17 bp, Homo sapiens
tgtcatttaccctggtg

SEQ ID NO: 5956940 - DNA, 24 bp, Homo sapiens
tgtcatttactcaaaatctgtcat

SEQ ID NO: 5956941 - DNA, 20 bp, Homo sapiens
tgtcatttataacttctgta

SEQ ID NO: 5956942 - DNA, 16 bp, Homo sapiens
tgtcatttatatagat

SEQ ID NO: 5956943 - DNA, 17 bp, Homo sapiens
tgtcatttcatacaaat

SEQ ID NO: 5956944 - DNA, 16 bp, Homo sapiens
tgtcatttcattccat

SEQ ID NO: 5956945 - DNA, 21 bp, Homo sapiens
tgtcatttccaaattcctaga

SEQ ID NO: 5956946 - DNA, 19 bp, Homo sapiens
tgtcatttccaccagcagt

SEQ ID NO: 5956947 - DNA, 18 bp, Homo sapiens
tgtcatttctctttcaaa

SEQ ID NO: 5956948 - DNA, 19 bp, Homo sapiens
tgtcatttgagcagggctc

SEQ ID NO: 5956949 - DNA, 20 bp, Homo sapiens
tgtcatttgagcagggctca

SEQ ID NO: 5956950 - DNA, 15 bp, Homo sapiens
tgtcatttgctaatg

SEQ ID NO: 5956951 - DNA, 23 bp, Homo sapiens
tgtcatttgctggagctctgccc

SEQ ID NO: 5956952 - DNA, 17 bp, Homo sapiens
tgtcatttgttgtgatg

SEQ ID NO: 5956953 - DNA, 18 bp, Homo sapiens
tgtcatttgttgtgatgt

SEQ ID NO: 5956954 - DNA, 14 bp, Homo sapiens
tgtcattttcagat

SEQ ID NO: 5956955 - DNA, 14 bp, Homo sapiens
tgtcattttcatta

SEQ ID NO: 5956956 - DNA, 20 bp, Homo sapiens
tgtcattttcattagcaaaa

SEQ ID NO: 5956957 - DNA, 17 bp, Homo sapiens
tgtcattttgaactgta

SEQ ID NO: 5956958 - DNA, 17 bp, Homo sapiens
tgtcattttgaagctaa

SEQ ID NO: 5956959 - DNA, 22 bp, Homo sapiens
tgtcattttgaagctaattatt

SEQ ID NO: 5956960 - DNA, 16 bp, Homo sapiens
tgtcattttgcactgt

SEQ ID NO: 5956961 - DNA, 23 bp, Homo sapiens
tgtcattttggcatctgcaaagg

SEQ ID NO: 5956962 - DNA, 14 bp, Homo sapiens
tgtcatttttaaaa

SEQ ID NO: 5956963 - DNA, 19 bp, Homo sapiens
tgtcatttttaacagcatg

SEQ ID NO: 5956964 - DNA, 18 bp, Homo sapiens
tgtcatttttaatgtatc

SEQ ID NO: 5956965 - DNA, 17 bp, Homo sapiens
tgtcatttttccttcct

SEQ ID NO: 5956966 - DNA, 15 bp, Homo sapiens
tgtcatttttgaatg

SEQ ID NO: 5956967 - DNA, 16 bp, Homo sapiens
tgtccaaaaccgccag

SEQ ID NO: 5956968 - DNA, 21 bp, Homo sapiens
tgtccaaaaccgccagctctg

SEQ ID NO: 5956969 - DNA, 15 bp, Homo sapiens
tgtccaaaactgcct

SEQ ID NO: 5956970 - DNA, 16 bp, Homo sapiens
tgtccaaaactgcctc

SEQ ID NO: 5956971 - DNA, 18 bp, Homo sapiens
tgtccaaaataataacat

SEQ ID NO: 5956972 - DNA, 13 bp, Homo sapiens
tgtccaaaattta

SEQ ID NO: 5956973 - DNA, 13 bp, Homo sapiens
tgtccaaacaggt

SEQ ID NO: 5956974 - DNA, 20 bp, Homo sapiens
tgtccaaacaggtgctggcc

SEQ ID NO: 5956975 - DNA, 21 bp, Homo sapiens
tgtccaaacaggtgctggccc

SEQ ID NO: 5956976 - DNA, 17 bp, Homo sapiens
tgtccaaacgtcctctt

SEQ ID NO: 5956977 - DNA, 21 bp, Homo sapiens
tgtccaaacgtcctctttagt

SEQ ID NO: 5956978 - DNA, 19 bp, Homo sapiens
tgtccaaagcagggtctgg

SEQ ID NO: 5956979 - DNA, 18 bp, Homo sapiens
tgtccaaagtttatttat

SEQ ID NO: 5956980 - DNA, 18 bp, Homo sapiens
tgtccaaatactctgaaa

SEQ ID NO: 5956981 - DNA, 21 bp, Homo sapiens
tgtccaaatttaatgtagaca

SEQ ID NO: 5956982 - DNA, 21 bp, Homo sapiens
tgtccaacaactccaggaaaa

SEQ ID NO: 5956983 - DNA, 19 bp, Homo sapiens
tgtccaacaactgtcagaa

SEQ ID NO: 5956984 - DNA, 19 bp, Homo sapiens
tgtccaacaataaacagga

SEQ ID NO: 5956985 - DNA, 14 bp, Homo sapiens
tgtccaacagagtg

SEQ ID NO: 5956986 - DNA, 19 bp, Homo sapiens
tgtccaacatggtaattca

SEQ ID NO: 5956987 - DNA, 23 bp, Homo sapiens
tgtccaacatggtgaaaccccca

SEQ ID NO: 5956988 - DNA, 17 bp, Homo sapiens
tgtccaacccctccccc

SEQ ID NO: 5956989 - DNA, 14 bp, Homo sapiens
tgtccaactaaaaa

SEQ ID NO: 5956990 - DNA, 13 bp, Homo sapiens
tgtccaactccag

SEQ ID NO: 5956991 - DNA, 15 bp, Homo sapiens
tgtccaactccagta

SEQ ID NO: 5956992 - DNA, 17 bp, Homo sapiens
tgtccaactctgtattt

SEQ ID NO: 5956993 - DNA, 14 bp, Homo sapiens
tgtccaagaagccc

SEQ ID NO: 5956994 - DNA, 16 bp, Homo sapiens
tgtccaagcatcagca

SEQ ID NO: 5956995 - DNA, 19 bp, Homo sapiens
tgtccaagcatcagcaaga

SEQ ID NO: 5956996 - DNA, 21 bp, Homo sapiens
tgtccaagggccgtgcccttg

SEQ ID NO: 5956997 - DNA, 21 bp, Homo sapiens
tgtccaagttcttcacctcta

SEQ ID NO: 5956998 - DNA, 16 bp, Homo sapiens
tgtccaatcacattca

SEQ ID NO: 5956999 - DNA, 15 bp, Homo sapiens
tgtccaatcagagaa

SEQ ID NO: 5957000 - DNA, 18 bp, Homo sapiens
tgtccaatggctgtaaac

SEQ ID NO: 5957001 - DNA, 13 bp, Homo sapiens
tgtccaattaatg

SEQ ID NO: 5957002 - DNA, 21 bp, Homo sapiens
tgtccaattatgcactggcca

SEQ ID NO: 5957003 - DNA, 19 bp, Homo sapiens
tgtccaattccagagctgt

SEQ ID NO: 5957004 - DNA, 16 bp, Homo sapiens
tgtccaattctcttta

SEQ ID NO: 5957005 - DNA, 21 bp, Homo sapiens
tgtccaatttctattaaaggt

SEQ ID NO: 5957006 - DNA, 12 bp, Homo sapiens
tgtccaatttgt

SEQ ID NO: 5957007 - DNA, 13 bp, Homo sapiens
tgtccacaaatgt

SEQ ID NO: 5957008 - DNA, 15 bp, Homo sapiens
tgtccacaaatgtcc

SEQ ID NO: 5957009 - DNA, 22 bp, Homo sapiens
tgtccacaaatgtcctcagagg

SEQ ID NO: 5957010 - DNA, 18 bp, Homo sapiens
tgtccacacaagacagca

SEQ ID NO: 5957011 - DNA, 20 bp, Homo sapiens
tgtccacagagtttttcagg

SEQ ID NO: 5957012 - DNA, 19 bp, Homo sapiens
tgtccacagtctcccattc

SEQ ID NO: 5957013 - DNA, 20 bp, Homo sapiens
tgtccacagtctcccattct

SEQ ID NO: 5957014 - DNA, 17 bp, Homo sapiens
tgtccacataggtttag

SEQ ID NO: 5957015 - DNA, 21 bp, Homo sapiens
tgtccacatccccagagccca

SEQ ID NO: 5957016 - DNA, 19 bp, Homo sapiens
tgtccacatctgcctcctc

SEQ ID NO: 5957017 - DNA, 21 bp, Homo sapiens
tgtccacattctacttcagct

SEQ ID NO: 5957018 - DNA, 15 bp, Homo sapiens
tgtccaccagaccca

SEQ ID NO: 5957019 - DNA, 20 bp, Homo sapiens
tgtccaccagtttatacaga

SEQ ID NO: 5957020 - DNA, 20 bp, Homo sapiens
tgtccaccatgctctctcac

SEQ ID NO: 5957021 - DNA, 11 bp, Homo sapiens
tgtccacctgg

SEQ ID NO: 5957022 - DNA, 12 bp, Homo sapiens
tgtccacctggc

SEQ ID NO: 5957023 - DNA, 13 bp, Homo sapiens
tgtccacctggcc

SEQ ID NO: 5957024 - DNA, 14 bp, Homo sapiens
tgtccacctggccc

SEQ ID NO: 5957025 - DNA, 13 bp, Homo sapiens
tgtccacctgtgc

SEQ ID NO: 5957026 - DNA, 15 bp, Homo sapiens
tgtccaccttctgcc

SEQ ID NO: 5957027 - DNA, 16 bp, Homo sapiens
tgtccaccttctgcca

SEQ ID NO: 5957028 - DNA, 18 bp, Homo sapiens
tgtccactctcggggccc

SEQ ID NO: 5957029 - DNA, 19 bp, Homo sapiens
tgtccactctcggggccct

SEQ ID NO: 5957030 - DNA, 17 bp, Homo sapiens
tgtccacttaaaataca

SEQ ID NO: 5957031 - DNA, 18 bp, Homo sapiens
tgtccacttaaaatacat

SEQ ID NO: 5957032 - DNA, 16 bp, Homo sapiens
tgtccagaagaatatt

SEQ ID NO: 5957033 - DNA, 17 bp, Homo sapiens
tgtccagaagagtcaaa

SEQ ID NO: 5957034 - DNA, 21 bp, Homo sapiens
tgtccagaagagtcaaagtag

SEQ ID NO: 5957035 - DNA, 18 bp, Homo sapiens
tgtccagacaagccctgc

SEQ ID NO: 5957036 - DNA, 14 bp, Homo sapiens
tgtccagacagcct

SEQ ID NO: 5957037 - DNA, 18 bp, Homo sapiens
tgtccagaccattgtctt

SEQ ID NO: 5957038 - DNA, 20 bp, Homo sapiens
tgtccagagataaaaatcat

SEQ ID NO: 5957039 - DNA, 19 bp, Homo sapiens
tgtgattgggaataaatat

SEQ ID NO: 5957040 - DNA, 17 bp, Homo sapiens
tgtgatttaatagtgtt

SEQ ID NO: 5957041 - DNA, 22 bp, Homo sapiens
tgtgatttaatagtgttaatca

SEQ ID NO: 5957042 - DNA, 17 bp, Homo sapiens
tgtgatttagaactgta

SEQ ID NO: 5957043 - DNA, 13 bp, Homo sapiens
tgtgatttatgca

SEQ ID NO: 5957044 - DNA, 15 bp, Homo sapiens
tgtgatttatgcatt

SEQ ID NO: 5957045 - DNA, 16 bp, Homo sapiens
tgtgatttatgcattt

SEQ ID NO: 5957046 - DNA, 19 bp, Homo sapiens
tgtgatttatgcatttatg

SEQ ID NO: 5957047 - DNA, 15 bp, Homo sapiens
tgtgatttatttgga

SEQ ID NO: 5957048 - DNA, 12 bp, Homo sapiens
tgtgatttccat

SEQ ID NO: 5957049 - DNA, 13 bp, Homo sapiens
tgtgatttccatt

SEQ ID NO: 5957050 - DNA, 24 bp, Homo sapiens
tgtgatttcccgtggccccagcct

SEQ ID NO: 5957051 - DNA, 15 bp, Homo sapiens
tgtgatttcctacag

SEQ ID NO: 5957052 - DNA, 23 bp, Homo sapiens
tgtgatttcctactaacctgttc

SEQ ID NO: 5957053 - DNA, 14 bp, Homo sapiens
tgtgatttctgtgc

SEQ ID NO: 5957054 - DNA, 17 bp, Homo sapiens
tgtgatttcttctccct

SEQ ID NO: 5957055 - DNA, 20 bp, Homo sapiens
tgtgatttcttctccctcct

SEQ ID NO: 5957056 - DNA, 21 bp, Homo sapiens
tgtgatttctttaaaagaatg

SEQ ID NO: 5957057 - DNA, 15 bp, Homo sapiens
tgtgatttgaattct

SEQ ID NO: 5957058 - DNA, 16 bp, Homo sapiens
tgtgatttgaattctg

SEQ ID NO: 5957059 - DNA, 17 bp, Homo sapiens
tgtgatttgactgtttt

SEQ ID NO: 5957060 - DNA, 18 bp, Homo sapiens
tgtgatttggttgcactt

SEQ ID NO: 5957061 - DNA, 16 bp, Homo sapiens
tgtgattttaactctg

SEQ ID NO: 5957062 - DNA, 17 bp, Homo sapiens
tgtgattttaactctgt

SEQ ID NO: 5957063 - DNA, 19 bp, Homo sapiens
tgtgattttaactctgtct

SEQ ID NO: 5957064 - DNA, 13 bp, Homo sapiens
tgtgattttaaga

SEQ ID NO: 5957065 - DNA, 22 bp, Homo sapiens
tgtgattttaagacaagctgta

SEQ ID NO: 5957066 - DNA, 14 bp, Homo sapiens
tgtgattttatgtt

SEQ ID NO: 5957067 - DNA, 16 bp, Homo sapiens
tgtgattttcaaatat

SEQ ID NO: 5957068 - DNA, 19 bp, Homo sapiens
tgtgattttcaaatatgta

SEQ ID NO: 5957069 - DNA, 16 bp, Homo sapiens
tgtgattttgccctcc

SEQ ID NO: 5957070 - DNA, 18 bp, Homo sapiens
tgtgattttgccctcctg

SEQ ID NO: 5957071 - DNA, 21 bp, Homo sapiens
tgtgattttgccctcctgccc

SEQ ID NO: 5957072 - DNA, 18 bp, Homo sapiens
tgtgattttgtacagaat

SEQ ID NO: 5957073 - DNA, 19 bp, Homo sapiens
tgtgatttttggtatttga

SEQ ID NO: 5957074 - DNA, 12 bp, Homo sapiens
tgtgatttttgt

SEQ ID NO: 5957075 - DNA, 18 bp, Homo sapiens
tgtgatttttgtttgcag

SEQ ID NO: 5957076 - DNA, 23 bp, Homo sapiens
tgtgcaaaaaaattaaaatggat

SEQ ID NO: 5957077 - DNA, 17 bp, Homo sapiens
tgtgcaaaaaggactgg

SEQ ID NO: 5957078 - DNA, 19 bp, Homo sapiens
tgtgcaaaaccttttactg

SEQ ID NO: 5957079 - DNA, 16 bp, Homo sapiens
tgtgcaaaataaaatg

SEQ ID NO: 5957080 - DNA, 23 bp, Homo sapiens
tgtgcaaacaaaaggtgtgcctg

SEQ ID NO: 5957081 - DNA, 13 bp, Homo sapiens
tgtgcaaacagtg

SEQ ID NO: 5957082 - DNA, 18 bp, Homo sapiens
tgtgcaaacagtgtaagc

SEQ ID NO: 5957083 - DNA, 13 bp, Homo sapiens
tgtgcaaacataa

SEQ ID NO: 5957084 - DNA, 14 bp, Homo sapiens
tgtgcaaacataat

SEQ ID NO: 5957085 - DNA, 19 bp, Homo sapiens
tgtgcaaagaaaagaactg

SEQ ID NO: 5957086 - DNA, 19 bp, Homo sapiens
tgtgcaaatctgacaatat

SEQ ID NO: 5957087 - DNA, 15 bp, Homo sapiens
tgtgcaacagacaag

SEQ ID NO: 5957088 - DNA, 18 bp, Homo sapiens
tgtgcaacaggtaaacag

SEQ ID NO: 5957089 - DNA, 15 bp, Homo sapiens
tgtgcaacctgtggc

SEQ ID NO: 5957090 - DNA, 20 bp, Homo sapiens
tgtgcaacctgtggctcagg

SEQ ID NO: 5957091 - DNA, 14 bp, Homo sapiens
tgtgcaacggccag

SEQ ID NO: 5957092 - DNA, 14 bp, Homo sapiens
tgtgcaacttttta

SEQ ID NO: 5957093 - DNA, 14 bp, Homo sapiens
tgtgcaagaaaact

SEQ ID NO: 5957094 - DNA, 14 bp, Homo sapiens
tgtgcaagagaggg

SEQ ID NO: 5957095 - DNA, 18 bp, Homo sapiens
tgtgcaagcttttcctaa

SEQ ID NO: 5957096 - DNA, 17 bp, Homo sapiens
tgtgcaaggcagccgtg

SEQ ID NO: 5957097 - DNA, 21 bp, Homo sapiens
tgtgcaaggcagccgtgggcc

SEQ ID NO: 5957098 - DNA, 23 bp, Homo sapiens
tgtgcaagtcttgtcagaattgg

SEQ ID NO: 5957099 - DNA, 20 bp, Homo sapiens
tgtgcaatagacacatacat

SEQ ID NO: 5957100 - DNA, 19 bp, Homo sapiens
tgtgcaatatgtaacatgt

SEQ ID NO: 5957101 - DNA, 18 bp, Homo sapiens
tgtgcaatgtaaatattt

SEQ ID NO: 5957102 - DNA, 11 bp, Homo sapiens
tgtgcaatgtg

SEQ ID NO: 5957103 - DNA, 15 bp, Homo sapiens
tgtgcaatgtgtata

SEQ ID NO: 5957104 - DNA, 21 bp, Homo sapiens
tgtgcaattactgcctgcaga

SEQ ID NO: 5957105 - DNA, 14 bp, Homo sapiens
tgtgcaattgtctt

SEQ ID NO: 5957106 - DNA, 17 bp, Homo sapiens
tgtgcacaaagtggcat

SEQ ID NO: 5957107 - DNA, 20 bp, Homo sapiens
tgtgcacaattctgttttag

SEQ ID NO: 5957108 - DNA, 19 bp, Homo sapiens
tgtgcacacacaccacaca

SEQ ID NO: 5957109 - DNA, 20 bp, Homo sapiens
tgtgcacacgtgtgtatgag

SEQ ID NO: 5957110 - DNA, 17 bp, Homo sapiens
tgtgcacactaagaaat

SEQ ID NO: 5957111 - DNA, 21 bp, Homo sapiens
tgtgcacactcaagtcctgca

SEQ ID NO: 5957112 - DNA, 21 bp, Homo sapiens
tgtgcacactcatacacatgt

SEQ ID NO: 5957113 - DNA, 15 bp, Homo sapiens
tgtgcacagaaaacc

SEQ ID NO: 5957114 - DNA, 12 bp, Homo sapiens
tgtgcacaggca

SEQ ID NO: 5957115 - DNA, 17 bp, Homo sapiens
tgtgcacagtggcttct

SEQ ID NO: 5957116 - DNA, 19 bp, Homo sapiens
tgtgcacagtggcttcttt

SEQ ID NO: 5957117 - DNA, 20 bp, Homo sapiens
tgtgcacatctgtgtcttgt

SEQ ID NO: 5957118 - DNA, 21 bp, Homo sapiens
tgtgcacatctgtgtcttgtt

SEQ ID NO: 5957119 - DNA, 17 bp, Homo sapiens
tgtgcacatctgttttg

SEQ ID NO: 5957120 - DNA, 13 bp, Homo sapiens
tgtgcacatcttc

SEQ ID NO: 5957121 - DNA, 22 bp, Homo sapiens
tgtgcacatgcacgtgtgtgca

SEQ ID NO: 5957122 - DNA, 12 bp, Homo sapiens
tgtgcacatgta

SEQ ID NO: 5957123 - DNA, 18 bp, Homo sapiens
tgtgcacatgtgtgcgtg

SEQ ID NO: 5957124 - DNA, 19 bp, Homo sapiens
tgtgcaccaccacacccgg

SEQ ID NO: 5957125 - DNA, 17 bp, Homo sapiens
tgtgcaccaccatgccc

SEQ ID NO: 5957126 - DNA, 14 bp, Homo sapiens
tgtgcaccagggtt

SEQ ID NO: 5957127 - DNA, 15 bp, Homo sapiens
tgtgcacccggcctg

SEQ ID NO: 5957128 - DNA, 16 bp, Homo sapiens
tgtgcacccggcctgg

SEQ ID NO: 5957129 - DNA, 17 bp, Homo sapiens
tgtgcacccggcctgga

SEQ ID NO: 5957130 - DNA, 18 bp, Homo sapiens
tgtgcaccctctatccca

SEQ ID NO: 5957131 - DNA, 20 bp, Homo sapiens
tgtgcaccgttgggaccaat

SEQ ID NO: 5957132 - DNA, 17 bp, Homo sapiens
tgtgcacctaaaactta

SEQ ID NO: 5957133 - DNA, 20 bp, Homo sapiens
tgtgcacctatggcccagcc

SEQ ID NO: 5957134 - DNA, 18 bp, Homo sapiens
tgtgcacctgactttgga

SEQ ID NO: 5957135 - DNA, 18 bp, Homo sapiens
tgtgcaccttacattcct

SEQ ID NO: 5957136 - DNA, 22 bp, Homo sapiens
tgtgcaccttacattcctagag

SEQ ID NO: 5957137 - DNA, 21 bp, Homo sapiens
tgtgcaccttaccaactttct

SEQ ID NO: 5957138 - DNA, 16 bp, Homo sapiens
tgtgcacggcagcttg

SEQ ID NO: 5957139 - DNA, 16 bp, Homo sapiens
tgtgcactaaggggcc

SEQ ID NO: 5957140 - DNA, 18 bp, Homo sapiens
tgtgcactgcctgcatga

SEQ ID NO: 5957141 - DNA, 16 bp, Homo sapiens
tgtgcactgggcaggt

SEQ ID NO: 5957142 - DNA, 23 bp, Homo sapiens
tgtgcactgggcaggttcctggg

SEQ ID NO: 5957143 - DNA, 15 bp, Homo sapiens
tgtgcagaaaacatt

SEQ ID NO: 5957144 - DNA, 17 bp, Homo sapiens
tgtgcagaataatggaa

SEQ ID NO: 5957145 - DNA, 12 bp, Homo sapiens
tgtgcagacact

SEQ ID NO: 5957146 - DNA, 13 bp, Homo sapiens
tgtgcagacagcc

SEQ ID NO: 5957147 - DNA, 18 bp, Homo sapiens
tgtgcagacagccatgcg

SEQ ID NO: 5957148 - DNA, 14 bp, Homo sapiens
tgtgcagacccagt

SEQ ID NO: 5957149 - DNA, 14 bp, Homo sapiens
tgtgcagacgccac

SEQ ID NO: 5957150 - DNA, 23 bp, Homo sapiens
tgtgcagactcaataaaatcatg

SEQ ID NO: 5957151 - DNA, 13 bp, Homo sapiens
tgtgcagagcaga

SEQ ID NO: 5957152 - DNA, 17 bp, Homo sapiens
tgtgcagagcagacagg

SEQ ID NO: 5957153 - DNA, 19 bp, Homo sapiens
tgtgcagagcagacaggct

SEQ ID NO: 5957154 - DNA, 21 bp, Homo sapiens
tgtgcagagtatacaagtgtt

SEQ ID NO: 5957155 - DNA, 15 bp, Homo sapiens
tgtgcagatgctttg

SEQ ID NO: 5957156 - DNA, 17 bp, Homo sapiens
tgtgcagcagattggaa

SEQ ID NO: 5957157 - DNA, 12 bp, Homo sapiens
tgtgcagcagcc

SEQ ID NO: 5957158 - DNA, 14 bp, Homo sapiens
tgtgcagcagccca

SEQ ID NO: 5957159 - DNA, 16 bp, Homo sapiens
tgtgcagcagcccagc

SEQ ID NO: 5957160 - DNA, 23 bp, Homo sapiens
tgtgcagcagcccagcttcctgg

SEQ ID NO: 5957161 - DNA, 17 bp, Homo sapiens
tgtgcagcatttcactt

SEQ ID NO: 5957162 - DNA, 19 bp, Homo sapiens
tgtgcagccccgccctctg

SEQ ID NO: 5957163 - DNA, 20 bp, Homo sapiens
tgtgcagcgacccttggtgt

SEQ ID NO: 5957164 - DNA, 15 bp, Homo sapiens
tgtgcagcgcagctg

SEQ ID NO: 5957165 - DNA, 20 bp, Homo sapiens
tgtgcagcgcagctggactc

SEQ ID NO: 5957166 - DNA, 15 bp, Homo sapiens
tgtgcagcttcgagg

SEQ ID NO: 5957167 - DNA, 15 bp, Homo sapiens
tgtgcaggagccagt

SEQ ID NO: 5957168 - DNA, 14 bp, Homo sapiens
tgtgcaggagcctc

SEQ ID NO: 5957169 - DNA, 17 bp, Homo sapiens
tgtgcaggagcctccct

SEQ ID NO: 5957170 - DNA, 13 bp, Homo sapiens
tgtgcaggctgca

SEQ ID NO: 5957171 - DNA, 15 bp, Homo sapiens
tgtgcagggagggca

SEQ ID NO: 5957172 - DNA, 15 bp, Homo sapiens
tgtgcagggatattg

SEQ ID NO: 5957173 - DNA, 16 bp, Homo sapiens
tgtgcagggctggttt

SEQ ID NO: 5957174 - DNA, 19 bp, Homo sapiens
tgtgcagggctggtttgtt

SEQ ID NO: 5957175 - DNA, 22 bp, Homo sapiens
tgtgcagggtcctccggggctc

SEQ ID NO: 5957176 - DNA, 16 bp, Homo sapiens
tgtgcaggtggggaga

SEQ ID NO: 5957177 - DNA, 14 bp, Homo sapiens
tgtgcaggttccca

SEQ ID NO: 5957178 - DNA, 17 bp, Homo sapiens
tgtgcaggtttgttaca

SEQ ID NO: 5957179 - DNA, 16 bp, Homo sapiens
tgtgcagtattttatt

SEQ ID NO: 5957180 - DNA, 17 bp, Homo sapiens
tgtgcagtcatcaacaa

SEQ ID NO: 5957181 - DNA, 22 bp, Homo sapiens
tgtgcagtcccgtggagggtag

SEQ ID NO: 5957182 - DNA, 17 bp, Homo sapiens
tgtgcagtcctgggatg

SEQ ID NO: 5957183 - DNA, 15 bp, Homo sapiens
tgtgcagttcagttt

SEQ ID NO: 5957184 - DNA, 14 bp, Homo sapiens
tgtgcagtttggta

SEQ ID NO: 5957185 - DNA, 20 bp, Homo sapiens
tgtgcagtttggtatgaaac

SEQ ID NO: 5957186 - DNA, 20 bp, Homo sapiens
tgtgcataatgataaaataa

SEQ ID NO: 5957187 - DNA, 21 bp, Homo sapiens
tgtgcataatgctttggaaaa

SEQ ID NO: 5957188 - DNA, 19 bp, Homo sapiens
tgtgcatagagccacgtat

SEQ ID NO: 5957189 - DNA, 13 bp, Homo sapiens
tgtgcatattgta

SEQ ID NO: 5957190 - DNA, 15 bp, Homo sapiens
tgtgcatattgtaca

SEQ ID NO: 5957191 - DNA, 18 bp, Homo sapiens
tgtgcatatttgttactt

SEQ ID NO: 5957192 - DNA, 22 bp, Homo sapiens
tgtgcatccgcctgaaagtgtt

SEQ ID NO: 5957193 - DNA, 13 bp, Homo sapiens
tgtgcatcctgtg

SEQ ID NO: 5957194 - DNA, 13 bp, Homo sapiens
tgtgcatctggcc

SEQ ID NO: 5957195 - DNA, 15 bp, Homo sapiens
tgtgcatctggcctg

SEQ ID NO: 5957196 - DNA, 19 bp, Homo sapiens
tgtgcatgcaaaaatgaat

SEQ ID NO: 5957197 - DNA, 22 bp, Homo sapiens
tgtgcatgcaaaaatgaattca

SEQ ID NO: 5957198 - DNA, 20 bp, Homo sapiens
tgtgcatgcaaaccaggagc

SEQ ID NO: 5957199 - DNA, 21 bp, Homo sapiens
tgtgcatgcaaaccaggagca

SEQ ID NO: 5957200 - DNA, 14 bp, Homo sapiens
tgtgcatgcccctg

SEQ ID NO: 5957201 - DNA, 13 bp, Homo sapiens
tgtgcatgggtta

SEQ ID NO: 5957202 - DNA, 15 bp, Homo sapiens
tgtgcatggtggcac

SEQ ID NO: 5957203 - DNA, 12 bp, Homo sapiens
tgtgcatgtatg

SEQ ID NO: 5957204 - DNA, 20 bp, Homo sapiens
tgtgcatgtatgtcttggac

SEQ ID NO: 5957205 - DNA, 14 bp, Homo sapiens
tgtgcatgtatgtg

SEQ ID NO: 5957206 - DNA, 13 bp, Homo sapiens
tgtgcatgtgcag

SEQ ID NO: 5957207 - DNA, 17 bp, Homo sapiens
tgtgcatgtgctgtgtg

SEQ ID NO: 5957208 - DNA, 18 bp, Homo sapiens
tgtgcatgtgtgtataag

SEQ ID NO: 5957209 - DNA, 14 bp, Homo sapiens
tgtgcatgtgtgtg

SEQ ID NO: 5957210 - DNA, 15 bp, Homo sapiens
tgtgcatgtgtgtgc

SEQ ID NO: 5957211 - DNA, 19 bp, Homo sapiens
tgtgcatgtgtgtgtctgt

SEQ ID NO: 5957212 - DNA, 16 bp, Homo sapiens
tgtgcattatctagat

SEQ ID NO: 5957213 - DNA, 20 bp, Homo sapiens
tgtgcattatctagatactg

SEQ ID NO: 5957214 - DNA, 16 bp, Homo sapiens
tgtgcattctttggta

SEQ ID NO: 5957215 - DNA, 17 bp, Homo sapiens
tgtgcattctttggtaa

SEQ ID NO: 5957216 - DNA, 13 bp, Homo sapiens
tgtgcattctttt

SEQ ID NO: 5957217 - DNA, 14 bp, Homo sapiens
tgtgcattgctgtg

SEQ ID NO: 5957218 - DNA, 17 bp, Homo sapiens
tgtgctgccctgaagaa

SEQ ID NO: 5957219 - DNA, 15 bp, Homo sapiens
tgtgctgccctgctc

SEQ ID NO: 5957220 - DNA, 21 bp, Homo sapiens
tgtgctgccctgctctgggga

SEQ ID NO: 5957221 - DNA, 22 bp, Homo sapiens
tgtgctgcgcctgcaggcagag

SEQ ID NO: 5957222 - DNA, 18 bp, Homo sapiens
tgtgctgctcactcaaca

SEQ ID NO: 5957223 - DNA, 15 bp, Homo sapiens
tgtgctgctgctttt

SEQ ID NO: 5957224 - DNA, 18 bp, Homo sapiens
tgtgctgctgtaagaaat

SEQ ID NO: 5957225 - DNA, 13 bp, Homo sapiens
tgtgctgctgttc

SEQ ID NO: 5957226 - DNA, 15 bp, Homo sapiens
tgtgctgctgttctg

SEQ ID NO: 5957227 - DNA, 12 bp, Homo sapiens
tgtgctgctttt

SEQ ID NO: 5957228 - DNA, 18 bp, Homo sapiens
tgtgctggaattctaaca

SEQ ID NO: 5957229 - DNA, 13 bp, Homo sapiens
tgtgctggagatg

SEQ ID NO: 5957230 - DNA, 20 bp, Homo sapiens
tgtgctggagccctgttcct

SEQ ID NO: 5957231 - DNA, 14 bp, Homo sapiens
tgtgctggagctgg

SEQ ID NO: 5957232 - DNA, 21 bp, Homo sapiens
tgtgctggaggggtggcccag

SEQ ID NO: 5957233 - DNA, 13 bp, Homo sapiens
tgtgctggccagc

SEQ ID NO: 5957234 - DNA, 17 bp, Homo sapiens
tgtgctggccatggacg

SEQ ID NO: 5957235 - DNA, 18 bp, Homo sapiens
tgtgctgggaaatgcaga

SEQ ID NO: 5957236 - DNA, 20 bp, Homo sapiens
tgtgctgggaaatgcagaaa

SEQ ID NO: 5957237 - DNA, 22 bp, Homo sapiens
tgtgctgggaaatgcagaaatc

SEQ ID NO: 5957238 - DNA, 17 bp, Homo sapiens
tgtgctgggttattcag

SEQ ID NO: 5957239 - DNA, 18 bp, Homo sapiens
tgtgctggtgaacactgt

SEQ ID NO: 5957240 - DNA, 19 bp, Homo sapiens
tgtgctgtaacctgaagtc

SEQ ID NO: 5957241 - DNA, 12 bp, Homo sapiens
tgtgctgtaatt

SEQ ID NO: 5957242 - DNA, 17 bp, Homo sapiens
tgtgctgtatggcccag

SEQ ID NO: 5957243 - DNA, 20 bp, Homo sapiens
tgtgctgtctccatgctgga

SEQ ID NO: 5957244 - DNA, 13 bp, Homo sapiens
tgtgctgtgcctg

SEQ ID NO: 5957245 - DNA, 18 bp, Homo sapiens
tgtgctgtgcctgctaga

SEQ ID NO: 5957246 - DNA, 16 bp, Homo sapiens
tgtgctgtggccaggc

SEQ ID NO: 5957247 - DNA, 12 bp, Homo sapiens
tgtgctgtgggc

SEQ ID NO: 5957248 - DNA, 13 bp, Homo sapiens
tgtgctgtgggca

SEQ ID NO: 5957249 - DNA, 15 bp, Homo sapiens
tgtgctgtgggcagc

SEQ ID NO: 5957250 - DNA, 16 bp, Homo sapiens
tgtgctgtgggcagca

SEQ ID NO: 5957251 - DNA, 17 bp, Homo sapiens
tgtgctgtgggcagcac

SEQ ID NO: 5957252 - DNA, 19 bp, Homo sapiens
tgtgctgtgggcagcaccc

SEQ ID NO: 5957253 - DNA, 17 bp, Homo sapiens
tgtgctgtggggctggt

SEQ ID NO: 5957254 - DNA, 16 bp, Homo sapiens
tgtgctgtgtaaagtt

SEQ ID NO: 5957255 - DNA, 17 bp, Homo sapiens
tgtgctgtgtctgcacc

SEQ ID NO: 5957256 - DNA, 19 bp, Homo sapiens
tgtgctgtgtttgctcccc

SEQ ID NO: 5957257 - DNA, 21 bp, Homo sapiens
tgtgctgttagaatatgttga

SEQ ID NO: 5957258 - DNA, 17 bp, Homo sapiens
tgtgctgttgattcttt

SEQ ID NO: 5957259 - DNA, 19 bp, Homo sapiens
tgtgctgttgattctttca

SEQ ID NO: 5957260 - DNA, 19 bp, Homo sapiens
tgtgctgttgttatgatgt

SEQ ID NO: 5957261 - DNA, 21 bp, Homo sapiens
tgtgctgttgtttaaaataaa

SEQ ID NO: 5957262 - DNA, 14 bp, Homo sapiens
tgtgctgtttcaaa

SEQ ID NO: 5957263 - DNA, 14 bp, Homo sapiens
tgtgctgttttctg

SEQ ID NO: 5957264 - DNA, 15 bp, Homo sapiens
tgtgcttaacaggga

SEQ ID NO: 5957265 - DNA, 12 bp, Homo sapiens
tgtgcttaataa

SEQ ID NO: 5957266 - DNA, 18 bp, Homo sapiens
tgtgcttatgtcatttct

SEQ ID NO: 5957267 - DNA, 12 bp, Homo sapiens
tgtgcttatgtt

SEQ ID NO: 5957268 - DNA, 15 bp, Homo sapiens
tgtgcttatgttttt

SEQ ID NO: 5957269 - DNA, 22 bp, Homo sapiens
tgtgcttcaaatgatccttcct

SEQ ID NO: 5957270 - DNA, 13 bp, Homo sapiens
tgtgcttcacaca

SEQ ID NO: 5957271 - DNA, 16 bp, Homo sapiens
tgtgcttcacacaaag

SEQ ID NO: 5957272 - DNA, 19 bp, Homo sapiens
tgtgcttcacacaaagtga

SEQ ID NO: 5957273 - DNA, 22 bp, Homo sapiens
tgtgcttcacagtagagccagc

SEQ ID NO: 5957274 - DNA, 12 bp, Homo sapiens
tgtgcttcccta

SEQ ID NO: 5957275 - DNA, 12 bp, Homo sapiens
tgtgcttccgag

SEQ ID NO: 5957276 - DNA, 15 bp, Homo sapiens
tgtgcttcctcctgc

SEQ ID NO: 5957277 - DNA, 19 bp, Homo sapiens
tgtgcttcgggcccttccc

SEQ ID NO: 5957278 - DNA, 21 bp, Homo sapiens
tgtgcttctcagttgcagaaa

SEQ ID NO: 5957279 - DNA, 15 bp, Homo sapiens
tgtgcttctccccag

SEQ ID NO: 5957280 - DNA, 13 bp, Homo sapiens
tgtgcttctctat

SEQ ID NO: 5957281 - DNA, 21 bp, Homo sapiens
tgtgcttctctatgataatta

SEQ ID NO: 5957282 - DNA, 14 bp, Homo sapiens
tgtgcttctttctt

SEQ ID NO: 5957283 - DNA, 15 bp, Homo sapiens
tgtgcttgaaggccc

SEQ ID NO: 5957284 - DNA, 17 bp, Homo sapiens
tgtgcttgaaggccctg

SEQ ID NO: 5957285 - DNA, 21 bp, Homo sapiens
tgtgcttgaaggccctgctga

SEQ ID NO: 5957286 - DNA, 22 bp, Homo sapiens
tgtgcttgaaggccctgctgag

SEQ ID NO: 5957287 - DNA, 18 bp, Homo sapiens
tgtgcttggaggcctcag

SEQ ID NO: 5957288 - DNA, 12 bp, Homo sapiens
tgtgcttgggag

SEQ ID NO: 5957289 - DNA, 14 bp, Homo sapiens
tgtgcttggggcta

SEQ ID NO: 5957290 - DNA, 15 bp, Homo sapiens
tgtgcttggtctgtt

SEQ ID NO: 5957291 - DNA, 18 bp, Homo sapiens
tgtgcttggtctgtttga

SEQ ID NO: 5957292 - DNA, 20 bp, Homo sapiens
tgtgcttgtcatctgccact

SEQ ID NO: 5957293 - DNA, 22 bp, Homo sapiens
tgtgcttgtgtgtatgtctatg

SEQ ID NO: 5957294 - DNA, 14 bp, Homo sapiens
tgtgcttgttaact

SEQ ID NO: 5957295 - DNA, 18 bp, Homo sapiens
tgtgctttaaaaatgcaa

SEQ ID NO: 5957296 - DNA, 17 bp, Homo sapiens
tgtgctttatgctgaaa

SEQ ID NO: 5957297 - DNA, 18 bp, Homo sapiens
tgtgctttatgctgaaac

SEQ ID NO: 5957298 - DNA, 19 bp, Homo sapiens
tgtgctttatgctgaaaca

SEQ ID NO: 5957299 - DNA, 17 bp, Homo sapiens
tgtgctttatttgtgaa

SEQ ID NO: 5957300 - DNA, 19 bp, Homo sapiens
tgtgctttatttgtgaaac

SEQ ID NO: 5957301 - DNA, 14 bp, Homo sapiens
tgtgctttcatgtt

SEQ ID NO: 5957302 - DNA, 14 bp, Homo sapiens
tgtgctttccagct

SEQ ID NO: 5957303 - DNA, 15 bp, Homo sapiens
tgtgctttccagctc

SEQ ID NO: 5957304 - DNA, 12 bp, Homo sapiens
tgtgctttccca

SEQ ID NO: 5957305 - DNA, 22 bp, Homo sapiens
tgtgctttcccatatcttgcct

SEQ ID NO: 5957306 - DNA, 20 bp, Homo sapiens
tgtgctttgactcacctgtt

SEQ ID NO: 5957307 - DNA, 13 bp, Homo sapiens
tgtgctttgcatt

SEQ ID NO: 5957308 - DNA, 18 bp, Homo sapiens
tgtgctttgctcttgtcc

SEQ ID NO: 5957309 - DNA, 23 bp, Homo sapiens
tgtgctttgctcttgtcccacgt

SEQ ID NO: 5957310 - DNA, 13 bp, Homo sapiens
tgtgctttgtagc

SEQ ID NO: 5957311 - DNA, 16 bp, Homo sapiens
tgtgctttgtagctta

SEQ ID NO: 5957312 - DNA, 21 bp, Homo sapiens
tgtgctttgtagcttaaaaaa

SEQ ID NO: 5957313 - DNA, 19 bp, Homo sapiens
tgtgcttttagtaaaaaca

SEQ ID NO: 5957314 - DNA, 18 bp, Homo sapiens
tgtgcttttccatctaaa

SEQ ID NO: 5957315 - DNA, 21 bp, Homo sapiens
tgtgcttttcctgataaagca

SEQ ID NO: 5957316 - DNA, 15 bp, Homo sapiens
tgtgcttttctccaa

SEQ ID NO: 5957317 - DNA, 19 bp, Homo sapiens
tgtgcttttgatctctgct

SEQ ID NO: 5957318 - DNA, 14 bp, Homo sapiens
tgtgctttttgtca

SEQ ID NO: 5957319 - DNA, 16 bp, Homo sapiens
tgtgctttttgtcatg

SEQ ID NO: 5957320 - DNA, 17 bp, Homo sapiens
tgtgctttttttgtgtg

SEQ ID NO: 5957321 - DNA, 19 bp, Homo sapiens
tgtggaaaaataaaggaaa

SEQ ID NO: 5957322 - DNA, 20 bp, Homo sapiens
tgtggaaaaataaaggaaat

SEQ ID NO: 5957323 - DNA, 18 bp, Homo sapiens
tgtggaaaacaatttgca

SEQ ID NO: 5957324 - DNA, 19 bp, Homo sapiens
tgtggaaaaccaggaaaag

SEQ ID NO: 5957325 - DNA, 19 bp, Homo sapiens
tgtggaaaagccaagaggc

SEQ ID NO: 5957326 - DNA, 14 bp, Homo sapiens
tgtggaaacagctg

SEQ ID NO: 5957327 - DNA, 16 bp, Homo sapiens
tgtggaaagcactttt

SEQ ID NO: 5957328 - DNA, 12 bp, Homo sapiens
tgtggaaagcct

SEQ ID NO: 5957329 - DNA, 14 bp, Homo sapiens
tgtggaaagcctct

SEQ ID NO: 5957330 - DNA, 23 bp, Homo sapiens
tgtggaaagtgaatttgaatgaa

SEQ ID NO: 5957331 - DNA, 14 bp, Homo sapiens
tgtggaaagtgtaa

SEQ ID NO: 5957332 - DNA, 17 bp, Homo sapiens
tgtggaaagtgtaaagc

SEQ ID NO: 5957333 - DNA, 19 bp, Homo sapiens
tgtggaaatgacccaaaca

SEQ ID NO: 5957334 - DNA, 13 bp, Homo sapiens
tgtggaaatggga

SEQ ID NO: 5957335 - DNA, 23 bp, Homo sapiens
tgtggaaatgggacggaggtcct

SEQ ID NO: 5957336 - DNA, 21 bp, Homo sapiens
tgtggaacataaaaaggacat

SEQ ID NO: 5957337 - DNA, 21 bp, Homo sapiens
tgtggaaccaaagctggccca

SEQ ID NO: 5957338 - DNA, 21 bp, Homo sapiens
tgtggaacccagcagttctgt

SEQ ID NO: 5957339 - DNA, 16 bp, Homo sapiens
tgtggaactgccacct

SEQ ID NO: 5957340 - DNA, 20 bp, Homo sapiens
tgtggaagaaaatggtttat

SEQ ID NO: 5957341 - DNA, 22 bp, Homo sapiens
tgtggaagaaaatggtttattt

SEQ ID NO: 5957342 - DNA, 16 bp, Homo sapiens
tgtggaagacaagtct

SEQ ID NO: 5957343 - DNA, 17 bp, Homo sapiens
tgtggaagacacttgct

SEQ ID NO: 5957344 - DNA, 14 bp, Homo sapiens
tgtggaagcaaaaa

SEQ ID NO: 5957345 - DNA, 19 bp, Homo sapiens
tgtggaagcatggctgtct

SEQ ID NO: 5957346 - DNA, 20 bp, Homo sapiens
tgtggaagcatggctgtctg

SEQ ID NO: 5957347 - DNA, 21 bp, Homo sapiens
tgtggaaggaaaatatttcat

SEQ ID NO: 5957348 - DNA, 13 bp, Homo sapiens
tgtggaaggcagg

SEQ ID NO: 5957349 - DNA, 17 bp, Homo sapiens
tgtggaagggaccaagc

SEQ ID NO: 5957350 - DNA, 16 bp, Homo sapiens
tgtggaagtccctcag

SEQ ID NO: 5957351 - DNA, 15 bp, Homo sapiens
tgtggaagtgtgggt

SEQ ID NO: 5957352 - DNA, 15 bp, Homo sapiens
tgtggaataaatcct

SEQ ID NO: 5957353 - DNA, 19 bp, Homo sapiens
tgtggaatataaatagctg

SEQ ID NO: 5957354 - DNA, 22 bp, Homo sapiens
tgtggaatggattatagagtat

SEQ ID NO: 5957355 - DNA, 19 bp, Homo sapiens
tgtggaatgtcgcagactc

SEQ ID NO: 5957356 - DNA, 17 bp, Homo sapiens
tgtggaatgttggataa

SEQ ID NO: 5957357 - DNA, 23 bp, Homo sapiens
tgtggaattacataacaggcatt

SEQ ID NO: 5957358 - DNA, 18 bp, Homo sapiens
tgtggacacagctcttct

SEQ ID NO: 5957359 - DNA, 16 bp, Homo sapiens
tgtggacagcccggga

SEQ ID NO: 5957360 - DNA, 20 bp, Homo sapiens
tgtggacatatgtatactta

SEQ ID NO: 5957361 - DNA, 13 bp, Homo sapiens
tgtggacatgcac

SEQ ID NO: 5957362 - DNA, 14 bp, Homo sapiens
tgtggacatgcacc

SEQ ID NO: 5957363 - DNA, 18 bp, Homo sapiens
tgtggaccatattttgta

SEQ ID NO: 5957364 - DNA, 21 bp, Homo sapiens
tgtggaccatggagtggcagc

SEQ ID NO: 5957365 - DNA, 15 bp, Homo sapiens
tgtggacccccaccc

SEQ ID NO: 5957366 - DNA, 16 bp, Homo sapiens
tgtggaccggccgcag

SEQ ID NO: 5957367 - DNA, 17 bp, Homo sapiens
tgtggaccggccgcagc

SEQ ID NO: 5957368 - DNA, 18 bp, Homo sapiens
tgtggaccggccgcagcc

SEQ ID NO: 5957369 - DNA, 22 bp, Homo sapiens
tgtggacctcaccagagaccag

SEQ ID NO: 5957370 - DNA, 19 bp, Homo sapiens
tgtggacgtgcactgacag

SEQ ID NO: 5957371 - DNA, 16 bp, Homo sapiens
tgtggactaaaagata

SEQ ID NO: 5957372 - DNA, 21 bp, Homo sapiens
tgtggactacaggacaagggg

SEQ ID NO: 5957373 - DNA, 18 bp, Homo sapiens
tgtggactctctgcctgc

SEQ ID NO: 5957374 - DNA, 14 bp, Homo sapiens
tgtggactgggacc

SEQ ID NO: 5957375 - DNA, 14 bp, Homo sapiens
tgtggactgtcctg

SEQ ID NO: 5957376 - DNA, 23 bp, Homo sapiens
tgtggagaaactgtagtctcagg

SEQ ID NO: 5957377 - DNA, 13 bp, Homo sapiens
tgtggagaaagga

SEQ ID NO: 5957378 - DNA, 19 bp, Homo sapiens
tgtggagaagccacaggcc

SEQ ID NO: 5957379 - DNA, 15 bp, Homo sapiens
tgtggagaagcccct

SEQ ID NO: 5957380 - DNA, 22 bp, Homo sapiens
tgtggagaagtgtgttctgatg

SEQ ID NO: 5957381 - DNA, 24 bp, Homo sapiens
tgtggagacaatgtctgcagccct

SEQ ID NO: 5957382 - DNA, 17 bp, Homo sapiens
tgtggagacagccctgc

SEQ ID NO: 5957383 - DNA, 15 bp, Homo sapiens
tgtggagactgctcc

SEQ ID NO: 5957384 - DNA, 16 bp, Homo sapiens
tgtggagagaagctga

SEQ ID NO: 5957385 - DNA, 17 bp, Homo sapiens
tgtggagagggaatgtg

SEQ ID NO: 5957386 - DNA, 19 bp, Homo sapiens
tgtggagaggggtgcaccc

SEQ ID NO: 5957387 - DNA, 16 bp, Homo sapiens
tgtggagagtgagaat

SEQ ID NO: 5957388 - DNA, 18 bp, Homo sapiens
tgtggagatcacagcccc

SEQ ID NO: 5957389 - DNA, 13 bp, Homo sapiens
tgtggagattttt

SEQ ID NO: 5957390 - DNA, 18 bp, Homo sapiens
tgtggagcaaaaggcagc

SEQ ID NO: 5957391 - DNA, 20 bp, Homo sapiens
tgtggagcaaaaggcagctc

SEQ ID NO: 5957392 - DNA, 21 bp, Homo sapiens
tgtggagcaaaaggcagctca

SEQ ID NO: 5957393 - DNA, 20 bp, Homo sapiens
tgtggagcacaaaagcctct

SEQ ID NO: 5957394 - DNA, 15 bp, Homo sapiens
tgtggagcagagctc

SEQ ID NO: 5957395 - DNA, 11 bp, Homo sapiens
tgtggagccag

SEQ ID NO: 5957396 - DNA, 16 bp, Homo sapiens
tgtgtagctgtgacct

SEQ ID NO: 5957397 - DNA, 17 bp, Homo sapiens
tgtgtagctttgctctt

SEQ ID NO: 5957398 - DNA, 15 bp, Homo sapiens
tgtgtaggaagaggc

SEQ ID NO: 5957399 - DNA, 21 bp, Homo sapiens
tgtgtaggaagaggccgctgc

SEQ ID NO: 5957400 - DNA, 17 bp, Homo sapiens
tgtgtaggatgtatgct

SEQ ID NO: 5957401 - DNA, 14 bp, Homo sapiens
tgtgtagggaccag

SEQ ID NO: 5957402 - DNA, 22 bp, Homo sapiens
tgtgtagggagatggagaaaat

SEQ ID NO: 5957403 - DNA, 23 bp, Homo sapiens
tgtgtagggagatggagaaaatg

SEQ ID NO: 5957404 - DNA, 21 bp, Homo sapiens
tgtgtaggtattaaagatgtg

SEQ ID NO: 5957405 - DNA, 22 bp, Homo sapiens
tgtgtaggtattaaagatgtgt

SEQ ID NO: 5957406 - DNA, 12 bp, Homo sapiens
tgtgtaggtgaa

SEQ ID NO: 5957407 - DNA, 15 bp, Homo sapiens
tgtgtagtagtgcat

SEQ ID NO: 5957408 - DNA, 20 bp, Homo sapiens
tgtgtagttccctctgcctg

SEQ ID NO: 5957409 - DNA, 21 bp, Homo sapiens
tgtgtagttccctctgcctgg

SEQ ID NO: 5957410 - DNA, 22 bp, Homo sapiens
tgtgtagttgtctctcttcaga

SEQ ID NO: 5957411 - DNA, 22 bp, Homo sapiens
tgtgtataaacaagaaaaataa

SEQ ID NO: 5957412 - DNA, 16 bp, Homo sapiens
tgtgtataatgtgctt

SEQ ID NO: 5957413 - DNA, 16 bp, Homo sapiens
tgtgtataattttaaa

SEQ ID NO: 5957414 - DNA, 16 bp, Homo sapiens
tgtgtatacagccctg

SEQ ID NO: 5957415 - DNA, 20 bp, Homo sapiens
tgtgtatacatatgtatgtg

SEQ ID NO: 5957416 - DNA, 14 bp, Homo sapiens
tgtgtatagcatgt

SEQ ID NO: 5957417 - DNA, 14 bp, Homo sapiens
tgtgtataggaatt

SEQ ID NO: 5957418 - DNA, 19 bp, Homo sapiens
tgtgtatagtgccaccaca

SEQ ID NO: 5957419 - DNA, 17 bp, Homo sapiens
tgtgtatatatcttata

SEQ ID NO: 5957420 - DNA, 22 bp, Homo sapiens
tgtgtatatatgtgtgccctgg

SEQ ID NO: 5957421 - DNA, 23 bp, Homo sapiens
tgtgtatatatgtgtgccctgga

SEQ ID NO: 5957422 - DNA, 19 bp, Homo sapiens
tgtgtatatattatatata

SEQ ID NO: 5957423 - DNA, 23 bp, Homo sapiens
tgtgtatatattatatatacatt

SEQ ID NO: 5957424 - DNA, 17 bp, Homo sapiens
tgtgtatatatttaaaa

SEQ ID NO: 5957425 - DNA, 19 bp, Homo sapiens
tgtgtatatatttaaaaaa

SEQ ID NO: 5957426 - DNA, 22 bp, Homo sapiens
tgtgtatatattttgtgtgaaa

SEQ ID NO: 5957427 - DNA, 13 bp, Homo sapiens
tgtgtatatctct

SEQ ID NO: 5957428 - DNA, 13 bp, Homo sapiens
tgtgtatatggta

SEQ ID NO: 5957429 - DNA, 19 bp, Homo sapiens
tgtgtatatgttggtttaa

SEQ ID NO: 5957430 - DNA, 17 bp, Homo sapiens
tgtgtatattacaccaa

SEQ ID NO: 5957431 - DNA, 19 bp, Homo sapiens
tgtgtatattacaccaatg

SEQ ID NO: 5957432 - DNA, 15 bp, Homo sapiens
tgtgtatattatttg

SEQ ID NO: 5957433 - DNA, 16 bp, Homo sapiens
tgtgtatattatttgg

SEQ ID NO: 5957434 - DNA, 17 bp, Homo sapiens
tgtgtatattatttggc

SEQ ID NO: 5957435 - DNA, 16 bp, Homo sapiens
tgtgtatattgtaacg

SEQ ID NO: 5957436 - DNA, 16 bp, Homo sapiens
tgtgtatatttgtaga

SEQ ID NO: 5957437 - DNA, 18 bp, Homo sapiens
tgtgtatcattaaaatat

SEQ ID NO: 5957438 - DNA, 20 bp, Homo sapiens
tgtgtatccagtatgcacgt

SEQ ID NO: 5957439 - DNA, 18 bp, Homo sapiens
tgtgtatccattatcatg

SEQ ID NO: 5957440 - DNA, 22 bp, Homo sapiens
tgtgtatccattatcatgtgta

SEQ ID NO: 5957441 - DNA, 10 bp, Homo sapiens
tgtgtatccg

SEQ ID NO: 5957442 - DNA, 13 bp, Homo sapiens
tgtgtatccgact

SEQ ID NO: 5957443 - DNA, 21 bp, Homo sapiens
tgtgtatccgactctaagctg

SEQ ID NO: 5957444 - DNA, 21 bp, Homo sapiens
tgtgtatcgtaaccagccaga

SEQ ID NO: 5957445 - DNA, 21 bp, Homo sapiens
tgtgtatctaaaggatggaaa

SEQ ID NO: 5957446 - DNA, 18 bp, Homo sapiens
tgtgtatctgtgcttcta

SEQ ID NO: 5957447 - DNA, 13 bp, Homo sapiens
tgtgtatcttgat

SEQ ID NO: 5957448 - DNA, 22 bp, Homo sapiens
tgtgtatcttgattaatgtact

SEQ ID NO: 5957449 - DNA, 22 bp, Homo sapiens
tgtgtatgagaagtactttgtg

SEQ ID NO: 5957450 - DNA, 15 bp, Homo sapiens
tgtgtatgagtgcgc

SEQ ID NO: 5957451 - DNA, 18 bp, Homo sapiens
tgtgtatgcgtgtgtgtg

SEQ ID NO: 5957452 - DNA, 20 bp, Homo sapiens
tgtgtatgctgatgatcaaa

SEQ ID NO: 5957453 - DNA, 23 bp, Homo sapiens
tgtgtatggaagacaaatacaca

SEQ ID NO: 5957454 - DNA, 19 bp, Homo sapiens
tgtgtatggatatgtgtaa

SEQ ID NO: 5957455 - DNA, 12 bp, Homo sapiens
tgtgtatgggta

SEQ ID NO: 5957456 - DNA, 16 bp, Homo sapiens
tgtgtatgtaaagtta

SEQ ID NO: 5957457 - DNA, 15 bp, Homo sapiens
tgtgtatgtacatat

SEQ ID NO: 5957458 - DNA, 14 bp, Homo sapiens
tgtgtatgtactta

SEQ ID NO: 5957459 - DNA, 17 bp, Homo sapiens
tgtgtatgtacttacat

SEQ ID NO: 5957460 - DNA, 20 bp, Homo sapiens
tgtgtatgtacttagctgta

SEQ ID NO: 5957461 - DNA, 18 bp, Homo sapiens
tgtgtatgtatacacaca

SEQ ID NO: 5957462 - DNA, 14 bp, Homo sapiens
tgtgtatgtatgtg

SEQ ID NO: 5957463 - DNA, 14 bp, Homo sapiens
tgtgtatgtctggt

SEQ ID NO: 5957464 - DNA, 23 bp, Homo sapiens
tgtgtatgtgggggtctgtgtgt

SEQ ID NO: 5957465 - DNA, 13 bp, Homo sapiens
tgtgtatgtgtgt

SEQ ID NO: 5957466 - DNA, 15 bp, Homo sapiens
tgtgtatgttgactt

SEQ ID NO: 5957467 - DNA, 13 bp, Homo sapiens
tgtgtattctggc

SEQ ID NO: 5957468 - DNA, 20 bp, Homo sapiens
tgtgtattctgtggattcta

SEQ ID NO: 5957469 - DNA, 21 bp, Homo sapiens
tgtgtattctgtggattctat

SEQ ID NO: 5957470 - DNA, 23 bp, Homo sapiens
tgtgtattcttaaaatgcaatat

SEQ ID NO: 5957471 - DNA, 12 bp, Homo sapiens
tgtgtattgttc

SEQ ID NO: 5957472 - DNA, 14 bp, Homo sapiens
tgtgtattgttccc

SEQ ID NO: 5957473 - DNA, 21 bp, Homo sapiens
tgtgtatttaaaaaaaagaaa

SEQ ID NO: 5957474 - DNA, 17 bp, Homo sapiens
tgtgtatttaattgtaa

SEQ ID NO: 5957475 - DNA, 18 bp, Homo sapiens
tgtgtatttaattgtaaa

SEQ ID NO: 5957476 - DNA, 21 bp, Homo sapiens
tgtgtatttaattgtaaactg

SEQ ID NO: 5957477 - DNA, 22 bp, Homo sapiens
tgtgtatttaattgtaaactgt

SEQ ID NO: 5957478 - DNA, 23 bp, Homo sapiens
tgtgtatttaattgtaaactgta

SEQ ID NO: 5957479 - DNA, 11 bp, Homo sapiens
tgtgtatttct

SEQ ID NO: 5957480 - DNA, 12 bp, Homo sapiens
tgtgtatttcta

SEQ ID NO: 5957481 - DNA, 21 bp, Homo sapiens
tgtgtatttctaagaaataga

SEQ ID NO: 5957482 - DNA, 16 bp, Homo sapiens
tgtgtatttctctgtg

SEQ ID NO: 5957483 - DNA, 19 bp, Homo sapiens
tgtgtatttctctgtgaat

SEQ ID NO: 5957484 - DNA, 20 bp, Homo sapiens
tgtgtatttctctgtgaatc

SEQ ID NO: 5957485 - DNA, 15 bp, Homo sapiens
tgtgtatttctgtag

SEQ ID NO: 5957486 - DNA, 18 bp, Homo sapiens
tgtgtatttctgtagaat

SEQ ID NO: 5957487 - DNA, 16 bp, Homo sapiens
tgtgtatttcttatac

SEQ ID NO: 5957488 - DNA, 19 bp, Homo sapiens
tgtgtatttgtatgtactg

SEQ ID NO: 5957489 - DNA, 14 bp, Homo sapiens
tgtgtcaaaataaa

SEQ ID NO: 5957490 - DNA, 23 bp, Homo sapiens
tgtgtcaaccactaaagtataga

SEQ ID NO: 5957491 - DNA, 16 bp, Homo sapiens
tgtgtcaataaagtca

SEQ ID NO: 5957492 - DNA, 14 bp, Homo sapiens
tgtgtcaatccaga

SEQ ID NO: 5957493 - DNA, 16 bp, Homo sapiens
tgtgtcaatgggcaat

SEQ ID NO: 5957494 - DNA, 18 bp, Homo sapiens
tgtgtcaatgtaaagcca

SEQ ID NO: 5957495 - DNA, 16 bp, Homo sapiens
tgtgtcacaaagaatt

SEQ ID NO: 5957496 - DNA, 15 bp, Homo sapiens
tgtgtcacaaagcta

SEQ ID NO: 5957497 - DNA, 17 bp, Homo sapiens
tgtgtcacactgagctg

SEQ ID NO: 5957498 - DNA, 20 bp, Homo sapiens
tgtgtcacactgtggcctga

SEQ ID NO: 5957499 - DNA, 14 bp, Homo sapiens
tgtgtcacagctct

SEQ ID NO: 5957500 - DNA, 17 bp, Homo sapiens
tgtgtcacagctctgta

SEQ ID NO: 5957501 - DNA, 16 bp, Homo sapiens
tgtgtcacagtttcag

SEQ ID NO: 5957502 - DNA, 13 bp, Homo sapiens
tgtgtcacgcagg

SEQ ID NO: 5957503 - DNA, 17 bp, Homo sapiens
tgtgtcacgtgaccctg

SEQ ID NO: 5957504 - DNA, 19 bp, Homo sapiens
tgtgtcacgtgaccctgtg

SEQ ID NO: 5957505 - DNA, 23 bp, Homo sapiens
tgtgtcactggctgcctccactc

SEQ ID NO: 5957506 - DNA, 20 bp, Homo sapiens
tgtgtcagaataggaaaaca

SEQ ID NO: 5957507 - DNA, 15 bp, Homo sapiens
tgtgtcagagcccag

SEQ ID NO: 5957508 - DNA, 19 bp, Homo sapiens
tgtgtcagagcccagccca

SEQ ID NO: 5957509 - DNA, 13 bp, Homo sapiens
tgtgtcagagcct

SEQ ID NO: 5957510 - DNA, 17 bp, Homo sapiens
tgtgtcagagcctacct

SEQ ID NO: 5957511 - DNA, 13 bp, Homo sapiens
tgtgtcagcatgc

SEQ ID NO: 5957512 - DNA, 15 bp, Homo sapiens
tgtgtcagctgaggc

SEQ ID NO: 5957513 - DNA, 16 bp, Homo sapiens
tgtgtcagctgtagaa

SEQ ID NO: 5957514 - DNA, 21 bp, Homo sapiens
tgtgtcaggccctctgcctgc

SEQ ID NO: 5957515 - DNA, 22 bp, Homo sapiens
tgtgtcaggccctctgcctgca

SEQ ID NO: 5957516 - DNA, 19 bp, Homo sapiens
tgtgtcaggtggggcagct

SEQ ID NO: 5957517 - DNA, 19 bp, Homo sapiens
tgtgtcagtggggctctct

SEQ ID NO: 5957518 - DNA, 21 bp, Homo sapiens
tgtgtcagtggggctctctga

SEQ ID NO: 5957519 - DNA, 13 bp, Homo sapiens
tgtgtcagtttat

SEQ ID NO: 5957520 - DNA, 19 bp, Homo sapiens
tgtgtcagtttatgttttg

SEQ ID NO: 5957521 - DNA, 14 bp, Homo sapiens
tgtgtcagttttca

SEQ ID NO: 5957522 - DNA, 18 bp, Homo sapiens
tgtgtcagtttttcctcc

SEQ ID NO: 5957523 - DNA, 21 bp, Homo sapiens
tgtgtcatactgtgcaggcct

SEQ ID NO: 5957524 - DNA, 14 bp, Homo sapiens
tgtgtcatgatttc

SEQ ID NO: 5957525 - DNA, 14 bp, Homo sapiens
tgtgtcatggtgat

SEQ ID NO: 5957526 - DNA, 16 bp, Homo sapiens
tgtgtcattagtcctt

SEQ ID NO: 5957527 - DNA, 14 bp, Homo sapiens
tgtgtcatttcaaa

SEQ ID NO: 5957528 - DNA, 17 bp, Homo sapiens
tgtgtcatttcttcact

SEQ ID NO: 5957529 - DNA, 23 bp, Homo sapiens
tgtgtccaaaaccgccagctctg

SEQ ID NO: 5957530 - DNA, 19 bp, Homo sapiens
tgtgtccacctgtgggtgt

SEQ ID NO: 5957531 - DNA, 19 bp, Homo sapiens
tgtgtccacgactgtctcc

SEQ ID NO: 5957532 - DNA, 21 bp, Homo sapiens
tgtgtccactgagactttccc

SEQ ID NO: 5957533 - DNA, 16 bp, Homo sapiens
tgtgtccagcagctgc

SEQ ID NO: 5957534 - DNA, 20 bp, Homo sapiens
tgtgtccagcattgaagaga

SEQ ID NO: 5957535 - DNA, 23 bp, Homo sapiens
tgtgtccagttttggaggctgag

SEQ ID NO: 5957536 - DNA, 16 bp, Homo sapiens
tgtgtccatcccagcg

SEQ ID NO: 5957537 - DNA, 16 bp, Homo sapiens
tgtgtccatgtgaaat

SEQ ID NO: 5957538 - DNA, 13 bp, Homo sapiens
tgtgtccattttg

SEQ ID NO: 5957539 - DNA, 20 bp, Homo sapiens
tgtgtcccaaaatcccctca

SEQ ID NO: 5957540 - DNA, 21 bp, Homo sapiens
tgtgtcccaaaatcccctcag

SEQ ID NO: 5957541 - DNA, 21 bp, Homo sapiens
tgtgtcccagaagatgactga

SEQ ID NO: 5957542 - DNA, 17 bp, Homo sapiens
tgtgtcccagccacgca

SEQ ID NO: 5957543 - DNA, 19 bp, Homo sapiens
tgtgtcccaggcagggaga

SEQ ID NO: 5957544 - DNA, 22 bp, Homo sapiens
tgtgtcccatgacccacccctg

SEQ ID NO: 5957545 - DNA, 21 bp, Homo sapiens
tgtgtcccatgcataacacac

SEQ ID NO: 5957546 - DNA, 22 bp, Homo sapiens
tgtgtcccccccaggccttgtc

SEQ ID NO: 5957547 - DNA, 18 bp, Homo sapiens
tgtgtcccccctgtggtc

SEQ ID NO: 5957548 - DNA, 12 bp, Homo sapiens
tgtgtcccctca

SEQ ID NO: 5957549 - DNA, 13 bp, Homo sapiens
tgtgtcccctcac

SEQ ID NO: 5957550 - DNA, 18 bp, Homo sapiens
tgtgtcccctcactctgt

SEQ ID NO: 5957551 - DNA, 21 bp, Homo sapiens
tgtgtcccctgacctgtccag

SEQ ID NO: 5957552 - DNA, 18 bp, Homo sapiens
tgtgtccccttcatcctt

SEQ ID NO: 5957553 - DNA, 17 bp, Homo sapiens
tgtgtccctggaacctt

SEQ ID NO: 5957554 - DNA, 18 bp, Homo sapiens
tgtgtccctggacacagc

SEQ ID NO: 5957555 - DNA, 19 bp, Homo sapiens
tgtgtccctggacacagct

SEQ ID NO: 5957556 - DNA, 20 bp, Homo sapiens
tgtgtccctggacacagctc

SEQ ID NO: 5957557 - DNA, 19 bp, Homo sapiens
tgtgtccgctctctcatgt

SEQ ID NO: 5957558 - DNA, 22 bp, Homo sapiens
tgtgtccgtgaaagttgtgatc

SEQ ID NO: 5957559 - DNA, 14 bp, Homo sapiens
tgtgtcctagttct

SEQ ID NO: 5957560 - DNA, 15 bp, Homo sapiens
tgtgtcctccaccat

SEQ ID NO: 5957561 - DNA, 21 bp, Homo sapiens
tgtgtcctccaggagcttctt

SEQ ID NO: 5957562 - DNA, 13 bp, Homo sapiens
tgtgtcctcctgc

SEQ ID NO: 5957563 - DNA, 14 bp, Homo sapiens
tgtgtcctcctgct

SEQ ID NO: 5957564 - DNA, 22 bp, Homo sapiens
tgtgtcctcctgctctgcttcc

SEQ ID NO: 5957565 - DNA, 17 bp, Homo sapiens
tgtgtcctgacactgca

SEQ ID NO: 5957566 - DNA, 12 bp, Homo sapiens
tgtgtcctggta

SEQ ID NO: 5957567 - DNA, 18 bp, Homo sapiens
tgtgtcctggtgagaaaa

SEQ ID NO: 5957568 - DNA, 15 bp, Homo sapiens
tgtgtcctggtgctc

SEQ ID NO: 5957569 - DNA, 19 bp, Homo sapiens
tgtgtcctggtgctctctg

SEQ ID NO: 5957570 - DNA, 20 bp, Homo sapiens
tgtgtcctggtgctctctgc

SEQ ID NO: 5957571 - DNA, 22 bp, Homo sapiens
tgtgtcctggtgctctctgcca

SEQ ID NO: 5957572 - DNA, 18 bp, Homo sapiens
tgttaatgtcattgctaa

SEQ ID NO: 5957573 - DNA, 21 bp, Homo sapiens
tgttaatgtcattgctaaaaa

SEQ ID NO: 5957574 - DNA, 17 bp, Homo sapiens
tgttaatgtgatggatg

SEQ ID NO: 5957575 - DNA, 15 bp, Homo sapiens
tgttaattaaactga

SEQ ID NO: 5957576 - DNA, 22 bp, Homo sapiens
tgttaattataaacagcagggt

SEQ ID NO: 5957577 - DNA, 12 bp, Homo sapiens
tgttaattatac

SEQ ID NO: 5957578 - DNA, 16 bp, Homo sapiens
tgttaattatgtacaa

SEQ ID NO: 5957579 - DNA, 15 bp, Homo sapiens
tgttaattcagcact

SEQ ID NO: 5957580 - DNA, 22 bp, Homo sapiens
tgttaattcagcactgatttca

SEQ ID NO: 5957581 - DNA, 14 bp, Homo sapiens
tgttaattctagat

SEQ ID NO: 5957582 - DNA, 22 bp, Homo sapiens
tgttaattctagatcagagagc

SEQ ID NO: 5957583 - DNA, 13 bp, Homo sapiens
tgttaattgaaag

SEQ ID NO: 5957584 - DNA, 20 bp, Homo sapiens
tgttaattgatttggggatg

SEQ ID NO: 5957585 - DNA, 15 bp, Homo sapiens
tgttaatttaagttt

SEQ ID NO: 5957586 - DNA, 16 bp, Homo sapiens
tgttaatttaagtttt

SEQ ID NO: 5957587 - DNA, 22 bp, Homo sapiens
tgttaatttagaaaactttaaa

SEQ ID NO: 5957588 - DNA, 14 bp, Homo sapiens
tgttaatttataat

SEQ ID NO: 5957589 - DNA, 13 bp, Homo sapiens
tgttaatttatct

SEQ ID NO: 5957590 - DNA, 15 bp, Homo sapiens
tgttaatttatttag

SEQ ID NO: 5957591 - DNA, 20 bp, Homo sapiens
tgttaatttattttgctccc

SEQ ID NO: 5957592 - DNA, 24 bp, Homo sapiens
tgttaatttattttgctccctctg

SEQ ID NO: 5957593 - DNA, 13 bp, Homo sapiens
tgttaatttcagt

SEQ ID NO: 5957594 - DNA, 18 bp, Homo sapiens
tgttaatttcttgcaatt

SEQ ID NO: 5957595 - DNA, 22 bp, Homo sapiens
tgttaatttcttgcaatttgaa

SEQ ID NO: 5957596 - DNA, 19 bp, Homo sapiens
tgttaattttcctcatttt

SEQ ID NO: 5957597 - DNA, 15 bp, Homo sapiens
tgttaattttgctaa

SEQ ID NO: 5957598 - DNA, 21 bp, Homo sapiens
tgttaattttgctaactgggt

SEQ ID NO: 5957599 - DNA, 16 bp, Homo sapiens
tgttaatttttgatac

SEQ ID NO: 5957600 - DNA, 22 bp, Homo sapiens
tgttaattttttggtacaaaaa

SEQ ID NO: 5957601 - DNA, 18 bp, Homo sapiens
tgttacaaaagaaaaaag

SEQ ID NO: 5957602 - DNA, 16 bp, Homo sapiens
tgttacaaaatgtaac

SEQ ID NO: 5957603 - DNA, 19 bp, Homo sapiens
tgttacaaaatgtaactgt

SEQ ID NO: 5957604 - DNA, 23 bp, Homo sapiens
tgttacaaaatgtaactgttacc

SEQ ID NO: 5957605 - DNA, 13 bp, Homo sapiens
tgttacaagtgtt

SEQ ID NO: 5957606 - DNA, 15 bp, Homo sapiens
tgttacaagtgttct

SEQ ID NO: 5957607 - DNA, 19 bp, Homo sapiens
tgttacaagtttgctaaaa

SEQ ID NO: 5957608 - DNA, 15 bp, Homo sapiens
tgttacaataaaact

SEQ ID NO: 5957609 - DNA, 22 bp, Homo sapiens
tgttacaataaaactaaatgtg

SEQ ID NO: 5957610 - DNA, 14 bp, Homo sapiens
tgttacaataagtg

SEQ ID NO: 5957611 - DNA, 20 bp, Homo sapiens
tgttacacgtgcctgtagtc

SEQ ID NO: 5957612 - DNA, 21 bp, Homo sapiens
tgttacacgtgcctgtagtcc

SEQ ID NO: 5957613 - DNA, 20 bp, Homo sapiens
tgttacactaatttgaataa

SEQ ID NO: 5957614 - DNA, 17 bp, Homo sapiens
tgttacaggtgtactat

SEQ ID NO: 5957615 - DNA, 21 bp, Homo sapiens
tgttacagtaatgtcataaag

SEQ ID NO: 5957616 - DNA, 23 bp, Homo sapiens
tgttacagtttcttcatgcatta

SEQ ID NO: 5957617 - DNA, 20 bp, Homo sapiens
tgttacataaggatgacttt

SEQ ID NO: 5957618 - DNA, 21 bp, Homo sapiens
tgttacatagaaagagtctga

SEQ ID NO: 5957619 - DNA, 14 bp, Homo sapiens
tgttacatctgtct

SEQ ID NO: 5957620 - DNA, 18 bp, Homo sapiens
tgttacatgtaatatatt

SEQ ID NO: 5957621 - DNA, 22 bp, Homo sapiens
tgttacattaaagccctgtgtt

SEQ ID NO: 5957622 - DNA, 13 bp, Homo sapiens
tgttacattagga

SEQ ID NO: 5957623 - DNA, 12 bp, Homo sapiens
tgttacattatt

SEQ ID NO: 5957624 - DNA, 15 bp, Homo sapiens
tgttacattattatc

SEQ ID NO: 5957625 - DNA, 14 bp, Homo sapiens
tgttacattattcc

SEQ ID NO: 5957626 - DNA, 15 bp, Homo sapiens
tgttacattattcca

SEQ ID NO: 5957627 - DNA, 23 bp, Homo sapiens
tgttaccaaaaataaatatatct

SEQ ID NO: 5957628 - DNA, 14 bp, Homo sapiens
tgttaccaaataca

SEQ ID NO: 5957629 - DNA, 19 bp, Homo sapiens
tgttaccaaatacacattt

SEQ ID NO: 5957630 - DNA, 19 bp, Homo sapiens
tgttaccactggtaacatg

SEQ ID NO: 5957631 - DNA, 20 bp, Homo sapiens
tgttaccatactgtctctgg

SEQ ID NO: 5957632 - DNA, 21 bp, Homo sapiens
tgttaccatactgtctctgga

SEQ ID NO: 5957633 - DNA, 18 bp, Homo sapiens
tgttaccatgtcactgtg

SEQ ID NO: 5957634 - DNA, 16 bp, Homo sapiens
tgttaccattggaaat

SEQ ID NO: 5957635 - DNA, 17 bp, Homo sapiens
tgttaccattggaaatt

SEQ ID NO: 5957636 - DNA, 23 bp, Homo sapiens
tgttaccattggaaatttcacgt

SEQ ID NO: 5957637 - DNA, 20 bp, Homo sapiens
tgttacccagggctctgcag

SEQ ID NO: 5957638 - DNA, 21 bp, Homo sapiens
tgttacccagtaactcatctg

SEQ ID NO: 5957639 - DNA, 15 bp, Homo sapiens
tgttacccatgaaaa

SEQ ID NO: 5957640 - DNA, 16 bp, Homo sapiens
tgttacctaacaatgt

SEQ ID NO: 5957641 - DNA, 20 bp, Homo sapiens
tgttacctaattagagcaga

SEQ ID NO: 5957642 - DNA, 18 bp, Homo sapiens
tgttacctaattattaca

SEQ ID NO: 5957643 - DNA, 18 bp, Homo sapiens
tgttacctctgacatcaa

SEQ ID NO: 5957644 - DNA, 19 bp, Homo sapiens
tgttacctgtcattttgca

SEQ ID NO: 5957645 - DNA, 13 bp, Homo sapiens
tgttacctgtgtg

SEQ ID NO: 5957646 - DNA, 17 bp, Homo sapiens
tgttacctgtgtgcttg

SEQ ID NO: 5957647 - DNA, 15 bp, Homo sapiens
tgttacgtttgaagt

SEQ ID NO: 5957648 - DNA, 21 bp, Homo sapiens
tgttacgtttgaagtctgaca

SEQ ID NO: 5957649 - DNA, 20 bp, Homo sapiens
tgttactaaatccttttgtt

SEQ ID NO: 5957650 - DNA, 13 bp, Homo sapiens
tgttactaactaa

SEQ ID NO: 5957651 - DNA, 14 bp, Homo sapiens
tgttactaactaaa

SEQ ID NO: 5957652 - DNA, 17 bp, Homo sapiens
tgttactaactaaactc

SEQ ID NO: 5957653 - DNA, 23 bp, Homo sapiens
tgttactagagttagatatgtgc

SEQ ID NO: 5957654 - DNA, 21 bp, Homo sapiens
tgttactattatctgtgcttt

SEQ ID NO: 5957655 - DNA, 14 bp, Homo sapiens
tgttactattttct

SEQ ID NO: 5957656 - DNA, 14 bp, Homo sapiens
tgttactccacagc

SEQ ID NO: 5957657 - DNA, 23 bp, Homo sapiens
tgttactccacagcggaggagac

SEQ ID NO: 5957658 - DNA, 20 bp, Homo sapiens
tgttactctggttctttgtt

SEQ ID NO: 5957659 - DNA, 14 bp, Homo sapiens
tgttactcttggga

SEQ ID NO: 5957660 - DNA, 18 bp, Homo sapiens
tgttactcttgggacatc

SEQ ID NO: 5957661 - DNA, 12 bp, Homo sapiens
tgttactgaaat

SEQ ID NO: 5957662 - DNA, 15 bp, Homo sapiens
tgttactgaaatgag

SEQ ID NO: 5957663 - DNA, 23 bp, Homo sapiens
tgttactgaaatgaggagagaag

SEQ ID NO: 5957664 - DNA, 13 bp, Homo sapiens
tgttactgaattt

SEQ ID NO: 5957665 - DNA, 18 bp, Homo sapiens
tgttactgacttggatcc

SEQ ID NO: 5957666 - DNA, 22 bp, Homo sapiens
tgttactgatttggccgttttg

SEQ ID NO: 5957667 - DNA, 19 bp, Homo sapiens
tgttactgcatcatctgtt

SEQ ID NO: 5957668 - DNA, 19 bp, Homo sapiens
tgttactgcctataatctt

SEQ ID NO: 5957669 - DNA, 18 bp, Homo sapiens
tgttactgctgattcttg

SEQ ID NO: 5957670 - DNA, 21 bp, Homo sapiens
tgttactgctgattcttgtaa

SEQ ID NO: 5957671 - DNA, 22 bp, Homo sapiens
tgttactgctgattcttgtaaa

SEQ ID NO: 5957672 - DNA, 21 bp, Homo sapiens
tgttactgcttctctttgtgc

SEQ ID NO: 5957673 - DNA, 17 bp, Homo sapiens
tgttactggtgtccagc

SEQ ID NO: 5957674 - DNA, 9 bp, Homo sapiens
tgttactgt

SEQ ID NO: 5957675 - DNA, 12 bp, Homo sapiens
tgttactgtaat

SEQ ID NO: 5957676 - DNA, 14 bp, Homo sapiens
tgttactgtaattc

SEQ ID NO: 5957677 - DNA, 15 bp, Homo sapiens
tgttactgtaattcc

SEQ ID NO: 5957678 - DNA, 16 bp, Homo sapiens
tgttactgtcttcagt

SEQ ID NO: 5957679 - DNA, 13 bp, Homo sapiens
tgttactgtgtga

SEQ ID NO: 5957680 - DNA, 14 bp, Homo sapiens
tgttactgtgtgaa

SEQ ID NO: 5957681 - DNA, 10 bp, Homo sapiens
tgttactgtt

SEQ ID NO: 5957682 - DNA, 23 bp, Homo sapiens
tgttactgttcttgctgctagaa

SEQ ID NO: 5957683 - DNA, 17 bp, Homo sapiens
tgttactgttgcactga

SEQ ID NO: 5957684 - DNA, 13 bp, Homo sapiens
tgttacttaaata

SEQ ID NO: 5957685 - DNA, 18 bp, Homo sapiens
tgttacttccccacccct

SEQ ID NO: 5957686 - DNA, 14 bp, Homo sapiens
tgttacttcccttt

SEQ ID NO: 5957687 - DNA, 20 bp, Homo sapiens
tgttacttccctttcatatg

SEQ ID NO: 5957688 - DNA, 15 bp, Homo sapiens
tgttacttccttatg

SEQ ID NO: 5957689 - DNA, 12 bp, Homo sapiens
tgttacttgaag

SEQ ID NO: 5957690 - DNA, 13 bp, Homo sapiens
tgttacttgaagt

SEQ ID NO: 5957691 - DNA, 17 bp, Homo sapiens
tgttacttgaagtaact

SEQ ID NO: 5957692 - DNA, 18 bp, Homo sapiens
tgttacttgaagtaacta

SEQ ID NO: 5957693 - DNA, 14 bp, Homo sapiens
tgttacttgagaag

SEQ ID NO: 5957694 - DNA, 21 bp, Homo sapiens
tgttactttctttcagatgtt

SEQ ID NO: 5957695 - DNA, 11 bp, Homo sapiens
tgttactttga

SEQ ID NO: 5957696 - DNA, 12 bp, Homo sapiens
tgttactttgaa

SEQ ID NO: 5957697 - DNA, 13 bp, Homo sapiens
tgttactttgaat

SEQ ID NO: 5957698 - DNA, 14 bp, Homo sapiens
tgttactttgaata

SEQ ID NO: 5957699 - DNA, 16 bp, Homo sapiens
tgttactttggaatga

SEQ ID NO: 5957700 - DNA, 20 bp, Homo sapiens
tgttagaaaaaactggaaac

SEQ ID NO: 5957701 - DNA, 18 bp, Homo sapiens
tgttagaaaatgacttat

SEQ ID NO: 5957702 - DNA, 20 bp, Homo sapiens
tgttagaaaatgacttattt

SEQ ID NO: 5957703 - DNA, 18 bp, Homo sapiens
tgttagaaagtgcttaga

SEQ ID NO: 5957704 - DNA, 15 bp, Homo sapiens
tgttagaacactatt

SEQ ID NO: 5957705 - DNA, 17 bp, Homo sapiens
tgttagaacactatttt

SEQ ID NO: 5957706 - DNA, 18 bp, Homo sapiens
tgttagaacactattttc

SEQ ID NO: 5957707 - DNA, 20 bp, Homo sapiens
tgttagaacactattttcag

SEQ ID NO: 5957708 - DNA, 22 bp, Homo sapiens
tgttagaaccaccaaaattata

SEQ ID NO: 5957709 - DNA, 17 bp, Homo sapiens
tgttagaatatgttgat

SEQ ID NO: 5957710 - DNA, 15 bp, Homo sapiens
tgttagaatcaaata

SEQ ID NO: 5957711 - DNA, 18 bp, Homo sapiens
tgttagaatcaaatactc

SEQ ID NO: 5957712 - DNA, 20 bp, Homo sapiens
tgttagaccagaaagtgtgt

SEQ ID NO: 5957713 - DNA, 17 bp, Homo sapiens
tgttagactagtttctt

SEQ ID NO: 5957714 - DNA, 15 bp, Homo sapiens
tgttagactatagcc

SEQ ID NO: 5957715 - DNA, 13 bp, Homo sapiens
tgttagacttgtg

SEQ ID NO: 5957716 - DNA, 22 bp, Homo sapiens
tgttagacttgtgtgcatggaa

SEQ ID NO: 5957717 - DNA, 18 bp, Homo sapiens
tgttagagtccaacgtgg

SEQ ID NO: 5957718 - DNA, 20 bp, Homo sapiens
tgttagatacacaaaatatt

SEQ ID NO: 5957719 - DNA, 23 bp, Homo sapiens
tgttagatatttttcataaacaa

SEQ ID NO: 5957720 - DNA, 16 bp, Homo sapiens
tgttagatctagttca

SEQ ID NO: 5957721 - DNA, 19 bp, Homo sapiens
tgttagattttgcattttt

SEQ ID NO: 5957722 - DNA, 13 bp, Homo sapiens
tgttagattttta

SEQ ID NO: 5957723 - DNA, 13 bp, Homo sapiens
tgttagcaaagat

SEQ ID NO: 5957724 - DNA, 16 bp, Homo sapiens
tgttagcactgttgat

SEQ ID NO: 5957725 - DNA, 22 bp, Homo sapiens
tgttagcactgttgatgtatct

SEQ ID NO: 5957726 - DNA, 14 bp, Homo sapiens
tgttagcagacagg

SEQ ID NO: 5957727 - DNA, 20 bp, Homo sapiens
tgttagcagacccagcttag

SEQ ID NO: 5957728 - DNA, 22 bp, Homo sapiens
tgttagcattattgccaaataa

SEQ ID NO: 5957729 - DNA, 15 bp, Homo sapiens
tgttagccaggtgga

SEQ ID NO: 5957730 - DNA, 17 bp, Homo sapiens
tgttagccccataattt

SEQ ID NO: 5957731 - DNA, 20 bp, Homo sapiens
tgttagccttttttccccag

SEQ ID NO: 5957732 - DNA, 16 bp, Homo sapiens
tgttagctacacagtg

SEQ ID NO: 5957733 - DNA, 22 bp, Homo sapiens
tgttagctccctgtggggcagg

SEQ ID NO: 5957734 - DNA, 14 bp, Homo sapiens
tgttagctgctcac

SEQ ID NO: 5957735 - DNA, 15 bp, Homo sapiens
tgttagcttccttaa

SEQ ID NO: 5957736 - DNA, 15 bp, Homo sapiens
tgttagcttttacct

SEQ ID NO: 5957737 - DNA, 16 bp, Homo sapiens
tgttaggaaaaaattg

SEQ ID NO: 5957738 - DNA, 16 bp, Homo sapiens
tgttaggaacagcagt

SEQ ID NO: 5957739 - DNA, 22 bp, Homo sapiens
tgttaggaggccacatgatact

SEQ ID NO: 5957740 - DNA, 21 bp, Homo sapiens
tgttaggaggctgcatgctct

SEQ ID NO: 5957741 - DNA, 19 bp, Homo sapiens
tgttaggcttttctgcctg

SEQ ID NO: 5957742 - DNA, 22 bp, Homo sapiens
tgttagggagatgagttgcagt

SEQ ID NO: 5957743 - DNA, 13 bp, Homo sapiens
tgttagggctgct

SEQ ID NO: 5957744 - DNA, 17 bp, Homo sapiens
tgttaggggccaataaa

SEQ ID NO: 5957745 - DNA, 19 bp, Homo sapiens
tgttaggggccaataaaat

SEQ ID NO: 5957746 - DNA, 12 bp, Homo sapiens
tgttagggtcag

SEQ ID NO: 5957747 - DNA, 17 bp, Homo sapiens
tgttagggtcagccatt

SEQ ID NO: 5957748 - DNA, 15 bp, Homo sapiens
tgttaggtccatttt

SEQ ID NO: 5957749 - DNA, 21 bp, Homo sapiens
tgttaggtcggtttagatgaa

SEQ ID NO: 5957750 - DNA, 20 bp, Homo sapiens
tgttctggattttcccctga

SEQ ID NO: 5957751 - DNA, 15 bp, Homo sapiens
tgttctggccctcac

SEQ ID NO: 5957752 - DNA, 12 bp, Homo sapiens
tgttctggcctc

SEQ ID NO: 5957753 - DNA, 14 bp, Homo sapiens
tgttctggcctctg

SEQ ID NO: 5957754 - DNA, 17 bp, Homo sapiens
tgttctggcctctggcc

SEQ ID NO: 5957755 - DNA, 12 bp, Homo sapiens
tgttctggcttt

SEQ ID NO: 5957756 - DNA, 16 bp, Homo sapiens
tgttctggctttacat

SEQ ID NO: 5957757 - DNA, 13 bp, Homo sapiens
tgttctgggacac

SEQ ID NO: 5957758 - DNA, 15 bp, Homo sapiens
tgttctgggacacag

SEQ ID NO: 5957759 - DNA, 18 bp, Homo sapiens
tgttctgggagttgctgt

SEQ ID NO: 5957760 - DNA, 15 bp, Homo sapiens
tgttctgggatttct

SEQ ID NO: 5957761 - DNA, 13 bp, Homo sapiens
tgttctgggctca

SEQ ID NO: 5957762 - DNA, 22 bp, Homo sapiens
tgttctgggctggggccacctt

SEQ ID NO: 5957763 - DNA, 20 bp, Homo sapiens
tgttctgggtgttgaccact

SEQ ID NO: 5957764 - DNA, 17 bp, Homo sapiens
tgttctggtatttcccc

SEQ ID NO: 5957765 - DNA, 20 bp, Homo sapiens
tgttctggtatttcccctgt

SEQ ID NO: 5957766 - DNA, 21 bp, Homo sapiens
tgttctggtgaggccttgctc

SEQ ID NO: 5957767 - DNA, 17 bp, Homo sapiens
tgttctggtggtttgat

SEQ ID NO: 5957768 - DNA, 21 bp, Homo sapiens
tgttctggtggtttgattgtt

SEQ ID NO: 5957769 - DNA, 17 bp, Homo sapiens
tgttctggtttagtgtt

SEQ ID NO: 5957770 - DNA, 21 bp, Homo sapiens
tgttctggtttagtgttctgt

SEQ ID NO: 5957771 - DNA, 20 bp, Homo sapiens
tgttctgtagattcatgcaa

SEQ ID NO: 5957772 - DNA, 20 bp, Homo sapiens
tgttctgtagctttctggaa

SEQ ID NO: 5957773 - DNA, 15 bp, Homo sapiens
tgttctgtattttca

SEQ ID NO: 5957774 - DNA, 13 bp, Homo sapiens
tgttctgtcacca

SEQ ID NO: 5957775 - DNA, 20 bp, Homo sapiens
tgttctgtccagtttccaaa

SEQ ID NO: 5957776 - DNA, 21 bp, Homo sapiens
tgttctgtcccttccacttct

SEQ ID NO: 5957777 - DNA, 18 bp, Homo sapiens
tgttctgtcccttgcccc

SEQ ID NO: 5957778 - DNA, 18 bp, Homo sapiens
tgttctgtcttcccaaac

SEQ ID NO: 5957779 - DNA, 13 bp, Homo sapiens
tgttctgtggaaa

SEQ ID NO: 5957780 - DNA, 17 bp, Homo sapiens
tgttctgtggaaagtgt

SEQ ID NO: 5957781 - DNA, 19 bp, Homo sapiens
tgttctgtggaaagtgtaa

SEQ ID NO: 5957782 - DNA, 11 bp, Homo sapiens
tgttctgtggc

SEQ ID NO: 5957783 - DNA, 18 bp, Homo sapiens
tgttctgtgtctgctgta

SEQ ID NO: 5957784 - DNA, 17 bp, Homo sapiens
tgttctgttaactgaat

SEQ ID NO: 5957785 - DNA, 21 bp, Homo sapiens
tgttctgttaactgaatacca

SEQ ID NO: 5957786 - DNA, 14 bp, Homo sapiens
tgttctgttacaaa

SEQ ID NO: 5957787 - DNA, 13 bp, Homo sapiens
tgttctgttctgg

SEQ ID NO: 5957788 - DNA, 15 bp, Homo sapiens
tgttctgttctgggg

SEQ ID NO: 5957789 - DNA, 15 bp, Homo sapiens
tgttctgttgaaggt

SEQ ID NO: 5957790 - DNA, 13 bp, Homo sapiens
tgttctgttgtct

SEQ ID NO: 5957791 - DNA, 20 bp, Homo sapiens
tgttctgttgtctgcgcctg

SEQ ID NO: 5957792 - DNA, 13 bp, Homo sapiens
tgttctgtttccc

SEQ ID NO: 5957793 - DNA, 16 bp, Homo sapiens
tgttctgtttggcact

SEQ ID NO: 5957794 - DNA, 17 bp, Homo sapiens
tgttctgtttgttaaaa

SEQ ID NO: 5957795 - DNA, 21 bp, Homo sapiens
tgttctgtttgttaaaactgg

SEQ ID NO: 5957796 - DNA, 19 bp, Homo sapiens
tgttctgtttgttattgtt

SEQ ID NO: 5957797 - DNA, 17 bp, Homo sapiens
tgttcttaaaaatgcat

SEQ ID NO: 5957798 - DNA, 15 bp, Homo sapiens
tgttcttaaaatatt

SEQ ID NO: 5957799 - DNA, 16 bp, Homo sapiens
tgttcttaaaatattg

SEQ ID NO: 5957800 - DNA, 20 bp, Homo sapiens
tgttcttaaaatattgtgta

SEQ ID NO: 5957801 - DNA, 16 bp, Homo sapiens
tgttcttaattgcact

SEQ ID NO: 5957802 - DNA, 13 bp, Homo sapiens
tgttcttacacat

SEQ ID NO: 5957803 - DNA, 17 bp, Homo sapiens
tgttcttacctgtatgt

SEQ ID NO: 5957804 - DNA, 16 bp, Homo sapiens
tgttcttagcaataaa

SEQ ID NO: 5957805 - DNA, 20 bp, Homo sapiens
tgttcttagcaataaatgct

SEQ ID NO: 5957806 - DNA, 20 bp, Homo sapiens
tgttcttaggtttactgtga

SEQ ID NO: 5957807 - DNA, 17 bp, Homo sapiens
tgttcttatagaataaa

SEQ ID NO: 5957808 - DNA, 21 bp, Homo sapiens
tgttcttatagaataaaagct

SEQ ID NO: 5957809 - DNA, 18 bp, Homo sapiens
tgttcttcaagccagctc

SEQ ID NO: 5957810 - DNA, 21 bp, Homo sapiens
tgttcttcaagccagctctag

SEQ ID NO: 5957811 - DNA, 13 bp, Homo sapiens
tgttcttcaatgt

SEQ ID NO: 5957812 - DNA, 15 bp, Homo sapiens
tgttcttcaatgtga

SEQ ID NO: 5957813 - DNA, 21 bp, Homo sapiens
tgttcttcaatgtgaaactga

SEQ ID NO: 5957814 - DNA, 11 bp, Homo sapiens
tgttcttcagt

SEQ ID NO: 5957815 - DNA, 16 bp, Homo sapiens
tgttcttcataagctg

SEQ ID NO: 5957816 - DNA, 11 bp, Homo sapiens
tgttcttccaa

SEQ ID NO: 5957817 - DNA, 21 bp, Homo sapiens
tgttcttcctcagccagcctc

SEQ ID NO: 5957818 - DNA, 14 bp, Homo sapiens
tgttcttccttcct

SEQ ID NO: 5957819 - DNA, 15 bp, Homo sapiens
tgttcttcgtaactt

SEQ ID NO: 5957820 - DNA, 20 bp, Homo sapiens
tgttcttgaagcagtagcct

SEQ ID NO: 5957821 - DNA, 20 bp, Homo sapiens
tgttcttgaggtctcttttc

SEQ ID NO: 5957822 - DNA, 21 bp, Homo sapiens
tgttcttgatggagattaaga

SEQ ID NO: 5957823 - DNA, 23 bp, Homo sapiens
tgttcttgatggagattaagatg

SEQ ID NO: 5957824 - DNA, 21 bp, Homo sapiens
tgttcttgcataggctcttaa

SEQ ID NO: 5957825 - DNA, 19 bp, Homo sapiens
tgttcttgccactgcactc

SEQ ID NO: 5957826 - DNA, 15 bp, Homo sapiens
tgttcttgctgctag

SEQ ID NO: 5957827 - DNA, 21 bp, Homo sapiens
tgttcttgctgctagaacttt

SEQ ID NO: 5957828 - DNA, 22 bp, Homo sapiens
tgttcttgctgctagaactttt

SEQ ID NO: 5957829 - DNA, 14 bp, Homo sapiens
tgttcttgggagaa

SEQ ID NO: 5957830 - DNA, 21 bp, Homo sapiens
tgttcttgggggtggggctgc

SEQ ID NO: 5957831 - DNA, 17 bp, Homo sapiens
tgttcttggtttgtaaa

SEQ ID NO: 5957832 - DNA, 19 bp, Homo sapiens
tgttcttggtttgtaaatt

SEQ ID NO: 5957833 - DNA, 10 bp, Homo sapiens
tgttcttgta

SEQ ID NO: 5957834 - DNA, 21 bp, Homo sapiens
tgttcttgtaaaactgtgaca

SEQ ID NO: 5957835 - DNA, 23 bp, Homo sapiens
tgttcttgtaaaactgtgacatt

SEQ ID NO: 5957836 - DNA, 14 bp, Homo sapiens
tgttcttgttttta

SEQ ID NO: 5957837 - DNA, 18 bp, Homo sapiens
tgttcttgtttttaagtt

SEQ ID NO: 5957838 - DNA, 23 bp, Homo sapiens
tgttctttaaccctcactgggac

SEQ ID NO: 5957839 - DNA, 23 bp, Homo sapiens
tgttctttataaaaagtgaaata

SEQ ID NO: 5957840 - DNA, 13 bp, Homo sapiens
tgttctttatata

SEQ ID NO: 5957841 - DNA, 15 bp, Homo sapiens
tgttctttatataca

SEQ ID NO: 5957842 - DNA, 19 bp, Homo sapiens
tgttctttcacccatccta

SEQ ID NO: 5957843 - DNA, 19 bp, Homo sapiens
tgttctttcacccttttct

SEQ ID NO: 5957844 - DNA, 14 bp, Homo sapiens
tgttctttcatatg

SEQ ID NO: 5957845 - DNA, 14 bp, Homo sapiens
tgttctttccatga

SEQ ID NO: 5957846 - DNA, 11 bp, Homo sapiens
tgttctttccc

SEQ ID NO: 5957847 - DNA, 13 bp, Homo sapiens
tgttctttctgct

SEQ ID NO: 5957848 - DNA, 15 bp, Homo sapiens
tgttctttctgctct

SEQ ID NO: 5957849 - DNA, 14 bp, Homo sapiens
tgttctttctggct

SEQ ID NO: 5957850 - DNA, 23 bp, Homo sapiens
tgttctttctggctatgcatttg

SEQ ID NO: 5957851 - DNA, 23 bp, Homo sapiens
tgttctttgcagtgaagatgtgt

SEQ ID NO: 5957852 - DNA, 12 bp, Homo sapiens
tgttctttgcca

SEQ ID NO: 5957853 - DNA, 13 bp, Homo sapiens
tgttctttgggga

SEQ ID NO: 5957854 - DNA, 20 bp, Homo sapiens
tgttcttttctcctttacca

SEQ ID NO: 5957855 - DNA, 18 bp, Homo sapiens
tgttcttttctggaaaat

SEQ ID NO: 5957856 - DNA, 15 bp, Homo sapiens
tgttcttttgataca

SEQ ID NO: 5957857 - DNA, 16 bp, Homo sapiens
tgttcttttgatacat

SEQ ID NO: 5957858 - DNA, 14 bp, Homo sapiens
tgttctttttattg

SEQ ID NO: 5957859 - DNA, 21 bp, Homo sapiens
tgttctttttgactgattgtt

SEQ ID NO: 5957860 - DNA, 23 bp, Homo sapiens
tgttgaaaaaaaagtttcagaga

SEQ ID NO: 5957861 - DNA, 21 bp, Homo sapiens
tgttgaaaaaatttaaaagta

SEQ ID NO: 5957862 - DNA, 15 bp, Homo sapiens
tgttgaaaaagaaaa

SEQ ID NO: 5957863 - DNA, 15 bp, Homo sapiens
tgttgaaaaatatct

SEQ ID NO: 5957864 - DNA, 19 bp, Homo sapiens
tgttgaaaagccatgttta

SEQ ID NO: 5957865 - DNA, 20 bp, Homo sapiens
tgttgaaaagccatgtttaa

SEQ ID NO: 5957866 - DNA, 15 bp, Homo sapiens
tgttgaaaatacttt

SEQ ID NO: 5957867 - DNA, 18 bp, Homo sapiens
tgttgaaaatatttctct

SEQ ID NO: 5957868 - DNA, 21 bp, Homo sapiens
tgttgaaaatgtatttcctga

SEQ ID NO: 5957869 - DNA, 21 bp, Homo sapiens
tgttgaaaattattttaaaca

SEQ ID NO: 5957870 - DNA, 21 bp, Homo sapiens
tgttgaaacggatgatttcta

SEQ ID NO: 5957871 - DNA, 21 bp, Homo sapiens
tgttgaaacttacactgtttc

SEQ ID NO: 5957872 - DNA, 11 bp, Homo sapiens
tgttgaaagat

SEQ ID NO: 5957873 - DNA, 17 bp, Homo sapiens
tgttgaaagcaaaaatg

SEQ ID NO: 5957874 - DNA, 17 bp, Homo sapiens
tgttgaaagctttgaaa

SEQ ID NO: 5957875 - DNA, 20 bp, Homo sapiens
tgttgaaatagctttactgt

SEQ ID NO: 5957876 - DNA, 15 bp, Homo sapiens
tgttgaaatatgcat

SEQ ID NO: 5957877 - DNA, 19 bp, Homo sapiens
tgttgaaatatgcatacta

SEQ ID NO: 5957878 - DNA, 17 bp, Homo sapiens
tgttgaaatcttaaaaa

SEQ ID NO: 5957879 - DNA, 14 bp, Homo sapiens
tgttgaaattaaaa

SEQ ID NO: 5957880 - DNA, 12 bp, Homo sapiens
tgttgaacaaaa

SEQ ID NO: 5957881 - DNA, 15 bp, Homo sapiens
tgttgaacaaaataa

SEQ ID NO: 5957882 - DNA, 19 bp, Homo sapiens
tgttgaacaaaataaattg

SEQ ID NO: 5957883 - DNA, 15 bp, Homo sapiens
tgttgaacatacttc

SEQ ID NO: 5957884 - DNA, 14 bp, Homo sapiens
tgttgaactgttag

SEQ ID NO: 5957885 - DNA, 13 bp, Homo sapiens
tgttgaacttttt

SEQ ID NO: 5957886 - DNA, 20 bp, Homo sapiens
tgttgaactttttaaagaag

SEQ ID NO: 5957887 - DNA, 20 bp, Homo sapiens
tgttgaagaagagtttgcaa

SEQ ID NO: 5957888 - DNA, 14 bp, Homo sapiens
tgttgaagacaggg

SEQ ID NO: 5957889 - DNA, 13 bp, Homo sapiens
tgttgaagagcag

SEQ ID NO: 5957890 - DNA, 18 bp, Homo sapiens
tgttgaagagcagctcct

SEQ ID NO: 5957891 - DNA, 14 bp, Homo sapiens
tgttgaaggaactt

SEQ ID NO: 5957892 - DNA, 18 bp, Homo sapiens
tgttgaaggaacttgtct

SEQ ID NO: 5957893 - DNA, 23 bp, Homo sapiens
tgttgaaggaacttgtctcttca

SEQ ID NO: 5957894 - DNA, 17 bp, Homo sapiens
tgttgaaggtgccattt

SEQ ID NO: 5957895 - DNA, 19 bp, Homo sapiens
tgttgaagtaattcttctg

SEQ ID NO: 5957896 - DNA, 19 bp, Homo sapiens
tgttgaagtgcatgttaaa

SEQ ID NO: 5957897 - DNA, 21 bp, Homo sapiens
tgttgaagtgcatgttaaaat

SEQ ID NO: 5957898 - DNA, 14 bp, Homo sapiens
tgttgaagtttgaa

SEQ ID NO: 5957899 - DNA, 13 bp, Homo sapiens
tgttgaataaatg

SEQ ID NO: 5957900 - DNA, 13 bp, Homo sapiens
tgttgaatacttt

SEQ ID NO: 5957901 - DNA, 18 bp, Homo sapiens
tgttgaatactttttaca

SEQ ID NO: 5957902 - DNA, 14 bp, Homo sapiens
tgttgaataggaaa

SEQ ID NO: 5957903 - DNA, 22 bp, Homo sapiens
tgttgaataggggaaagaaatt

SEQ ID NO: 5957904 - DNA, 24 bp, Homo sapiens
tgttgaatcccacttcagtgcacc

SEQ ID NO: 5957905 - DNA, 22 bp, Homo sapiens
tgttgaatgcttaaagcaaggc

SEQ ID NO: 5957906 - DNA, 18 bp, Homo sapiens
tgttgaattggtgaataa

SEQ ID NO: 5957907 - DNA, 19 bp, Homo sapiens
tgttgaattggtgaataaa

SEQ ID NO: 5957908 - DNA, 21 bp, Homo sapiens
tgttgaattttattgaaagct

SEQ ID NO: 5957909 - DNA, 22 bp, Homo sapiens
tgttgacaaatgacagatcttt

SEQ ID NO: 5957910 - DNA, 19 bp, Homo sapiens
tgttgacacatatgaacac

SEQ ID NO: 5957911 - DNA, 21 bp, Homo sapiens
tgttgacagcaaaatgttgaa

SEQ ID NO: 5957912 - DNA, 20 bp, Homo sapiens
tgttgacatacaaaccatga

SEQ ID NO: 5957913 - DNA, 18 bp, Homo sapiens
tgttgacataccttttat

SEQ ID NO: 5957914 - DNA, 13 bp, Homo sapiens
tgttgacatagcc

SEQ ID NO: 5957915 - DNA, 15 bp, Homo sapiens
tgttgacatagcctt

SEQ ID NO: 5957916 - DNA, 18 bp, Homo sapiens
tgttgacatagcctttgt

SEQ ID NO: 5957917 - DNA, 16 bp, Homo sapiens
tgttgacatatttaat

SEQ ID NO: 5957918 - DNA, 20 bp, Homo sapiens
tgttgacatatttaatgttt

SEQ ID NO: 5957919 - DNA, 17 bp, Homo sapiens
tgttgacatccaagctt

SEQ ID NO: 5957920 - DNA, 19 bp, Homo sapiens
tgttgacatccaagcttcc

SEQ ID NO: 5957921 - DNA, 14 bp, Homo sapiens
tgttgacatgtgct

SEQ ID NO: 5957922 - DNA, 15 bp, Homo sapiens
tgttgacattctgaa

SEQ ID NO: 5957923 - DNA, 16 bp, Homo sapiens
tgttgacattctgaat

SEQ ID NO: 5957924 - DNA, 17 bp, Homo sapiens
tgttgacattctgaatg

SEQ ID NO: 5957925 - DNA, 21 bp, Homo sapiens
tgttgaccaggcacctcccct

SEQ ID NO: 5957926 - DNA, 13 bp, Homo sapiens
tgttgaccaggct

SEQ ID NO: 5957927 - DNA, 20 bp, Homo sapiens
tgttgaccaggctggagtga

SEQ ID NO: 5957928 - DNA, 14 bp, Homo sapiens
tgttgtgtaacagt

SEQ ID NO: 5957929 - DNA, 17 bp, Homo sapiens
tgttgtgtctggagcct

SEQ ID NO: 5957930 - DNA, 13 bp, Homo sapiens
tgttgtgtgcatg

SEQ ID NO: 5957931 - DNA, 15 bp, Homo sapiens
tgttgtgtgcctcta

SEQ ID NO: 5957932 - DNA, 19 bp, Homo sapiens
tgttgtgtgtatatgtatt

SEQ ID NO: 5957933 - DNA, 13 bp, Homo sapiens
tgttgtgtgtgca

SEQ ID NO: 5957934 - DNA, 15 bp, Homo sapiens
tgttgtgtgtgggag

SEQ ID NO: 5957935 - DNA, 17 bp, Homo sapiens
tgttgtgttcctggctg

SEQ ID NO: 5957936 - DNA, 19 bp, Homo sapiens
tgttgtgttcctggctgat

SEQ ID NO: 5957937 - DNA, 15 bp, Homo sapiens
tgttgtgttctttat

SEQ ID NO: 5957938 - DNA, 15 bp, Homo sapiens
tgttgtgtttgtagt

SEQ ID NO: 5957939 - DNA, 14 bp, Homo sapiens
tgttgttaaaatta

SEQ ID NO: 5957940 - DNA, 14 bp, Homo sapiens
tgttgttaaatatc

SEQ ID NO: 5957941 - DNA, 17 bp, Homo sapiens
tgttgttaatgaaaatg

SEQ ID NO: 5957942 - DNA, 18 bp, Homo sapiens
tgttgttaatgaatatca

SEQ ID NO: 5957943 - DNA, 15 bp, Homo sapiens
tgttgttaatgtcat

SEQ ID NO: 5957944 - DNA, 21 bp, Homo sapiens
tgttgttatctgtttgagaaa

SEQ ID NO: 5957945 - DNA, 15 bp, Homo sapiens
tgttgttcagaagtt

SEQ ID NO: 5957946 - DNA, 19 bp, Homo sapiens
tgttgttccattttatgca

SEQ ID NO: 5957947 - DNA, 14 bp, Homo sapiens
tgttgttcccacac

SEQ ID NO: 5957948 - DNA, 14 bp, Homo sapiens
tgttgttccttttg

SEQ ID NO: 5957949 - DNA, 18 bp, Homo sapiens
tgttgttccttttgaaag

SEQ ID NO: 5957950 - DNA, 18 bp, Homo sapiens
tgttgttctgcctggaga

SEQ ID NO: 5957951 - DNA, 13 bp, Homo sapiens
tgttgttctgtgg

SEQ ID NO: 5957952 - DNA, 14 bp, Homo sapiens
tgttgttcttataa

SEQ ID NO: 5957953 - DNA, 16 bp, Homo sapiens
tgttgttctttcagaa

SEQ ID NO: 5957954 - DNA, 23 bp, Homo sapiens
tgttgttgaactaatatatgaaa

SEQ ID NO: 5957955 - DNA, 21 bp, Homo sapiens
tgttgttgataaggaacattt

SEQ ID NO: 5957956 - DNA, 14 bp, Homo sapiens
tgttgttgccaaag

SEQ ID NO: 5957957 - DNA, 13 bp, Homo sapiens
tgttgttgctgct

SEQ ID NO: 5957958 - DNA, 16 bp, Homo sapiens
tgttgttgtgtgtata

SEQ ID NO: 5957959 - DNA, 17 bp, Homo sapiens
tgttgttgtgtgtatat

SEQ ID NO: 5957960 - DNA, 15 bp, Homo sapiens
tgttgttgttctttc

SEQ ID NO: 5957961 - DNA, 11 bp, Homo sapiens
tgttgttgttg

SEQ ID NO: 5957962 - DNA, 16 bp, Homo sapiens
tgttgttgttgttctt

SEQ ID NO: 5957963 - DNA, 14 bp, Homo sapiens
tgttgttgttttgt

SEQ ID NO: 5957964 - DNA, 15 bp, Homo sapiens
tgttgtttaacataa

SEQ ID NO: 5957965 - DNA, 23 bp, Homo sapiens
tgttgtttcaaaatgaacagcga

SEQ ID NO: 5957966 - DNA, 18 bp, Homo sapiens
tgttgtttccatagctct

SEQ ID NO: 5957967 - DNA, 21 bp, Homo sapiens
tgttgtttccatagctcttca

SEQ ID NO: 5957968 - DNA, 23 bp, Homo sapiens
tgttgtttccatagctcttcact

SEQ ID NO: 5957969 - DNA, 19 bp, Homo sapiens
tgttgtttctataaatgac

SEQ ID NO: 5957970 - DNA, 12 bp, Homo sapiens
tgttgtttcttt

SEQ ID NO: 5957971 - DNA, 12 bp, Homo sapiens
tgttgtttgcca

SEQ ID NO: 5957972 - DNA, 14 bp, Homo sapiens
tgttgtttgtaaat

SEQ ID NO: 5957973 - DNA, 19 bp, Homo sapiens
tgttgtttgtttttttgcc

SEQ ID NO: 5957974 - DNA, 13 bp, Homo sapiens
tgttgttttacta

SEQ ID NO: 5957975 - DNA, 14 bp, Homo sapiens
tgttgttttctctg

SEQ ID NO: 5957976 - DNA, 22 bp, Homo sapiens
tgttgttttctgggggaaaaag

SEQ ID NO: 5957977 - DNA, 14 bp, Homo sapiens
tgttgttttgtaca

SEQ ID NO: 5957978 - DNA, 20 bp, Homo sapiens
tgttgttttgttttaaatac

SEQ ID NO: 5957979 - DNA, 15 bp, Homo sapiens
tgttgtttttggatg

SEQ ID NO: 5957980 - DNA, 18 bp, Homo sapiens
tgtttaaaaaaacaaata

SEQ ID NO: 5957981 - DNA, 14 bp, Homo sapiens
tgtttaaaaaaaga

SEQ ID NO: 5957982 - DNA, 22 bp, Homo sapiens
tgtttaaaaaagtttaaaatgt

SEQ ID NO: 5957983 - DNA, 16 bp, Homo sapiens
tgtttaaaaacaggaa

SEQ ID NO: 5957984 - DNA, 21 bp, Homo sapiens
tgtttaaaaaccgaataaatg

SEQ ID NO: 5957985 - DNA, 19 bp, Homo sapiens
tgtttaaaaagtaagttaa

SEQ ID NO: 5957986 - DNA, 21 bp, Homo sapiens
tgtttaaaaagtaagttaata

SEQ ID NO: 5957987 - DNA, 14 bp, Homo sapiens
tgtttaaaaataca

SEQ ID NO: 5957988 - DNA, 22 bp, Homo sapiens
tgtttaaaaatacacatggaaa

SEQ ID NO: 5957989 - DNA, 14 bp, Homo sapiens
tgtttaaaaattta

SEQ ID NO: 5957990 - DNA, 19 bp, Homo sapiens
tgtttaaaaatttataaca

SEQ ID NO: 5957991 - DNA, 12 bp, Homo sapiens
tgtttaaaacat

SEQ ID NO: 5957992 - DNA, 16 bp, Homo sapiens
tgtttaaaacatcatt

SEQ ID NO: 5957993 - DNA, 12 bp, Homo sapiens
tgtttaaaactt

SEQ ID NO: 5957994 - DNA, 13 bp, Homo sapiens
tgtttaaaagcaa

SEQ ID NO: 5957995 - DNA, 17 bp, Homo sapiens
tgtttaaaataaaagta

SEQ ID NO: 5957996 - DNA, 18 bp, Homo sapiens
tgtttaaaataaaagtac

SEQ ID NO: 5957997 - DNA, 21 bp, Homo sapiens
tgtttaaaataaaatgaaaat

SEQ ID NO: 5957998 - DNA, 20 bp, Homo sapiens
tgtttaaaatggcatttagc

SEQ ID NO: 5957999 - DNA, 13 bp, Homo sapiens
tgtttaaaattct

SEQ ID NO: 5958000 - DNA, 16 bp, Homo sapiens
tgtttaaaattctctt

SEQ ID NO: 5958001 - DNA, 21 bp, Homo sapiens
tgtttaaaatttcttagaaaa

SEQ ID NO: 5958002 - DNA, 19 bp, Homo sapiens
tgtttaaactttgtgcctt

SEQ ID NO: 5958003 - DNA, 13 bp, Homo sapiens
tgtttaaagaagg

SEQ ID NO: 5958004 - DNA, 18 bp, Homo sapiens
tgtttaaagaataaagtc

SEQ ID NO: 5958005 - DNA, 12 bp, Homo sapiens
tgtttaaagaga

SEQ ID NO: 5958006 - DNA, 23 bp, Homo sapiens
tgtttaaaggtttctattttctc

SEQ ID NO: 5958007 - DNA, 21 bp, Homo sapiens
tgtttaaagtatatgtgcagt

SEQ ID NO: 5958008 - DNA, 21 bp, Homo sapiens
tgtttaaagtcacatccctgt

SEQ ID NO: 5958009 - DNA, 16 bp, Homo sapiens
tgtttaaataaagacc

SEQ ID NO: 5958010 - DNA, 18 bp, Homo sapiens
tgtttaaataaagaccta

SEQ ID NO: 5958011 - DNA, 21 bp, Homo sapiens
tgtttaaataaagacctatgt

SEQ ID NO: 5958012 - DNA, 15 bp, Homo sapiens
tgtttaaataaagta

SEQ ID NO: 5958013 - DNA, 20 bp, Homo sapiens
tgtttaaataaagtatcatg

SEQ ID NO: 5958014 - DNA, 14 bp, Homo sapiens
tgtttaaatagcct

SEQ ID NO: 5958015 - DNA, 19 bp, Homo sapiens
tgtttaaatcatgtatgtt

SEQ ID NO: 5958016 - DNA, 16 bp, Homo sapiens
tgtttaaatgccaaaa

SEQ ID NO: 5958017 - DNA, 12 bp, Homo sapiens
tgtttaaatgct

SEQ ID NO: 5958018 - DNA, 14 bp, Homo sapiens
tgtttaaattgtaa

SEQ ID NO: 5958019 - DNA, 21 bp, Homo sapiens
tgtttaacaaatctaatctct

SEQ ID NO: 5958020 - DNA, 21 bp, Homo sapiens
tgtttaacacttctgtatgca

SEQ ID NO: 5958021 - DNA, 15 bp, Homo sapiens
tgtttaacatatata

SEQ ID NO: 5958022 - DNA, 13 bp, Homo sapiens
tgtttaactgtgc

SEQ ID NO: 5958023 - DNA, 19 bp, Homo sapiens
tgtttaacttaatcaatta

SEQ ID NO: 5958024 - DNA, 21 bp, Homo sapiens
tgtttaagaaaagtattttga

SEQ ID NO: 5958025 - DNA, 21 bp, Homo sapiens
tgtttaagaaatgagaaattg

SEQ ID NO: 5958026 - DNA, 19 bp, Homo sapiens
tgtttaagacacttccgtc

SEQ ID NO: 5958027 - DNA, 13 bp, Homo sapiens
tgtttaagattta

SEQ ID NO: 5958028 - DNA, 18 bp, Homo sapiens
tgtttaagcatcacatta

SEQ ID NO: 5958029 - DNA, 20 bp, Homo sapiens
tgtttaagccagagtgtatt

SEQ ID NO: 5958030 - DNA, 16 bp, Homo sapiens
tgtttaagctgagcca

SEQ ID NO: 5958031 - DNA, 16 bp, Homo sapiens
tgtttaagtaattgcc

SEQ ID NO: 5958032 - DNA, 17 bp, Homo sapiens
tgtttaagtaattgcca

SEQ ID NO: 5958033 - DNA, 24 bp, Homo sapiens
tgtttaagtcattttttacttgaa

SEQ ID NO: 5958034 - DNA, 16 bp, Homo sapiens
tgtttaataatatgta

SEQ ID NO: 5958035 - DNA, 18 bp, Homo sapiens
tgtttaataatatgtaca

SEQ ID NO: 5958036 - DNA, 15 bp, Homo sapiens
tgtttaataccctgt

SEQ ID NO: 5958037 - DNA, 14 bp, Homo sapiens
tgtttaatagtata

SEQ ID NO: 5958038 - DNA, 17 bp, Homo sapiens
tgtttaatatttaaaca

SEQ ID NO: 5958039 - DNA, 15 bp, Homo sapiens
tgtttaatcatataa

SEQ ID NO: 5958040 - DNA, 16 bp, Homo sapiens
tgtttaatcatataaa

SEQ ID NO: 5958041 - DNA, 12 bp, Homo sapiens
tgtttaatcttt

SEQ ID NO: 5958042 - DNA, 13 bp, Homo sapiens
tgtttaatgtgaa

SEQ ID NO: 5958043 - DNA, 17 bp, Homo sapiens
tgtttaatgtgaactct

SEQ ID NO: 5958044 - DNA, 16 bp, Homo sapiens
tgtttaatgtgaactt

SEQ ID NO: 5958045 - DNA, 17 bp, Homo sapiens
tgtttaatgtgaacttg

SEQ ID NO: 5958046 - DNA, 19 bp, Homo sapiens
tgtttaatgttcattttct

SEQ ID NO: 5958047 - DNA, 16 bp, Homo sapiens
tgtttaatgttctgtg

SEQ ID NO: 5958048 - DNA, 15 bp, Homo sapiens
tgtttaattgtgata

SEQ ID NO: 5958049 - DNA, 14 bp, Homo sapiens
tgtttaatttcttc

SEQ ID NO: 5958050 - DNA, 19 bp, Homo sapiens
tgtttaatttttatttctt

SEQ ID NO: 5958051 - DNA, 13 bp, Homo sapiens
tgtttacaaaagg

SEQ ID NO: 5958052 - DNA, 21 bp, Homo sapiens
tgtttacaaaaggcagccctt

SEQ ID NO: 5958053 - DNA, 15 bp, Homo sapiens
tgtttacaagaaaaa

SEQ ID NO: 5958054 - DNA, 12 bp, Homo sapiens
tgtttacaataa

SEQ ID NO: 5958055 - DNA, 15 bp, Homo sapiens
tgtttacacaattaa

SEQ ID NO: 5958056 - DNA, 15 bp, Homo sapiens
tgtttacactgtcaa

SEQ ID NO: 5958057 - DNA, 11 bp, Homo sapiens
tgtttacagac

SEQ ID NO: 5958058 - DNA, 15 bp, Homo sapiens
tgtttacagataatt

SEQ ID NO: 5958059 - DNA, 23 bp, Homo sapiens
tgtttacagggagcctcctgccc

SEQ ID NO: 5958060 - DNA, 20 bp, Homo sapiens
tgtttacatggcgccctgcc

SEQ ID NO: 5958061 - DNA, 21 bp, Homo sapiens
tgtttacatggcgccctgcct

SEQ ID NO: 5958062 - DNA, 22 bp, Homo sapiens
tgtttacatgtgtagcctatgt

SEQ ID NO: 5958063 - DNA, 15 bp, Homo sapiens
tgtttacattttctt

SEQ ID NO: 5958064 - DNA, 19 bp, Homo sapiens
tgtttacattttctttcat

SEQ ID NO: 5958065 - DNA, 14 bp, Homo sapiens
tgtttaccattttt

SEQ ID NO: 5958066 - DNA, 13 bp, Homo sapiens
tgtttaccctccc

SEQ ID NO: 5958067 - DNA, 21 bp, Homo sapiens
tgtttacctcactggtgcatt

SEQ ID NO: 5958068 - DNA, 15 bp, Homo sapiens
tgtttacctggcagt

SEQ ID NO: 5958069 - DNA, 23 bp, Homo sapiens
tgtttacctttctctctctaagg

SEQ ID NO: 5958070 - DNA, 13 bp, Homo sapiens
tgtttactaggga

SEQ ID NO: 5958071 - DNA, 20 bp, Homo sapiens
tgtttactcattgaagcaga

SEQ ID NO: 5958072 - DNA, 12 bp, Homo sapiens
tgtttactgaaa

SEQ ID NO: 5958073 - DNA, 12 bp, Homo sapiens
tgtttactgatt

SEQ ID NO: 5958074 - DNA, 13 bp, Homo sapiens
tgtttactgcttt

SEQ ID NO: 5958075 - DNA, 24 bp, Homo sapiens
tgtttactgtatcaatttctaatg

SEQ ID NO: 5958076 - DNA, 17 bp, Homo sapiens
tgtttactttaaacttg

SEQ ID NO: 5958077 - DNA, 19 bp, Homo sapiens
tgtttactttttggctgga

SEQ ID NO: 5958078 - DNA, 12 bp, Homo sapiens
tgtttagaaaaa

SEQ ID NO: 5958079 - DNA, 22 bp, Homo sapiens
tgtttagaacactggtttaaag

SEQ ID NO: 5958080 - DNA, 16 bp, Homo sapiens
tgtttagaagaagtgt

SEQ ID NO: 5958081 - DNA, 24 bp, Homo sapiens
tgtttagaagcctaattgtcacat

SEQ ID NO: 5958082 - DNA, 23 bp, Homo sapiens
tgtttagaagtacgtttttgcat

SEQ ID NO: 5958083 - DNA, 12 bp, Homo sapiens
tgtttagaattg

SEQ ID NO: 5958084 - DNA, 14 bp, Homo sapiens
tgtttagaattgaa

SEQ ID NO: 5958085 - DNA, 18 bp, Homo sapiens
tgtttagactttaacata

SEQ ID NO: 5958086 - DNA, 19 bp, Homo sapiens
tgtttagactttaacataa

SEQ ID NO: 5958087 - DNA, 23 bp, Homo sapiens
tgtttagactttaacataagcta

SEQ ID NO: 5958088 - DNA, 18 bp, Homo sapiens
tgtttagagagcctgtca

SEQ ID NO: 5958089 - DNA, 22 bp, Homo sapiens
tgtttagagagcctgtcaccag

SEQ ID NO: 5958090 - DNA, 13 bp, Homo sapiens
tgtttagagccct

SEQ ID NO: 5958091 - DNA, 18 bp, Homo sapiens
tgtttagataatacaggt

SEQ ID NO: 5958092 - DNA, 16 bp, Homo sapiens
tgtttagatagggctg

SEQ ID NO: 5958093 - DNA, 17 bp, Homo sapiens
tgtttagattccaggat

SEQ ID NO: 5958094 - DNA, 17 bp, Homo sapiens
tgtttagatttgccata

SEQ ID NO: 5958095 - DNA, 20 bp, Homo sapiens
tgtttagattttgtgtttat

SEQ ID NO: 5958096 - DNA, 22 bp, Homo sapiens
tgtttagcattaaaaataaaag

SEQ ID NO: 5958097 - DNA, 20 bp, Homo sapiens
tgtttagccagtgttttcca

SEQ ID NO: 5958098 - DNA, 20 bp, Homo sapiens
tgtttagcctgaaaaccttt

SEQ ID NO: 5958099 - DNA, 13 bp, Homo sapiens
tgtttaggaaatt

SEQ ID NO: 5958100 - DNA, 15 bp, Homo sapiens
tgtttaggaaccgct

SEQ ID NO: 5958101 - DNA, 16 bp, Homo sapiens
tgtttaggcctcattt

SEQ ID NO: 5958102 - DNA, 19 bp, Homo sapiens
tgtttagtaaactcaataa

SEQ ID NO: 5958103 - DNA, 17 bp, Homo sapiens
tgtttagtaatcatatt

SEQ ID NO: 5958104 - DNA, 22 bp, Homo sapiens
tgtttagtacttttataatgaa

SEQ ID NO: 5958105 - DNA, 15 bp, Homo sapiens
tgtttagtagaaacg

SEQ ID NO: 5958106 - DNA, 16 bp, Homo sapiens
tgtttagtagctgata

SEQ ID NO: 5958107 - DNA, 20 bp, Homo sapiens
tgtttagtagctgataaaga

SEQ ID NO: 5958108 - DNA, 23 bp, Homo sapiens
tgttttcccaacctcctgtgggc

SEQ ID NO: 5958109 - DNA, 21 bp, Homo sapiens
tgttttccccaattatcctcc

SEQ ID NO: 5958110 - DNA, 15 bp, Homo sapiens
tgttttcccccagca

SEQ ID NO: 5958111 - DNA, 23 bp, Homo sapiens
tgttttcccgagcaaagtctaaa

SEQ ID NO: 5958112 - DNA, 16 bp, Homo sapiens
tgttttccctctgctg

SEQ ID NO: 5958113 - DNA, 21 bp, Homo sapiens
tgttttccctttaaagccttt

SEQ ID NO: 5958114 - DNA, 19 bp, Homo sapiens
tgttttccgtgaaaacgga

SEQ ID NO: 5958115 - DNA, 22 bp, Homo sapiens
tgttttcctcccttctgctact

SEQ ID NO: 5958116 - DNA, 23 bp, Homo sapiens
tgttttcctcccttctgctactg

SEQ ID NO: 5958117 - DNA, 17 bp, Homo sapiens
tgttttcctgctttaca

SEQ ID NO: 5958118 - DNA, 22 bp, Homo sapiens
tgttttcctgctttacaaaatt

SEQ ID NO: 5958119 - DNA, 17 bp, Homo sapiens
tgttttccttacctatt

SEQ ID NO: 5958120 - DNA, 18 bp, Homo sapiens
tgttttcgtaccttccca

SEQ ID NO: 5958121 - DNA, 14 bp, Homo sapiens
tgttttctcagaac

SEQ ID NO: 5958122 - DNA, 20 bp, Homo sapiens
tgttttctcagaacagctga

SEQ ID NO: 5958123 - DNA, 13 bp, Homo sapiens
tgttttctctata

SEQ ID NO: 5958124 - DNA, 21 bp, Homo sapiens
tgttttctctggagtattcta

SEQ ID NO: 5958125 - DNA, 15 bp, Homo sapiens
tgttttctcttgaga

SEQ ID NO: 5958126 - DNA, 12 bp, Homo sapiens
tgttttctgaaa

SEQ ID NO: 5958127 - DNA, 17 bp, Homo sapiens
tgttttctgaataacat

SEQ ID NO: 5958128 - DNA, 18 bp, Homo sapiens
tgttttctgactagttta

SEQ ID NO: 5958129 - DNA, 11 bp, Homo sapiens
tgttttctgat

SEQ ID NO: 5958130 - DNA, 14 bp, Homo sapiens
tgttttctgctgtt

SEQ ID NO: 5958131 - DNA, 12 bp, Homo sapiens
tgttttctgctt

SEQ ID NO: 5958132 - DNA, 19 bp, Homo sapiens
tgttttctgggggaaaaag

SEQ ID NO: 5958133 - DNA, 16 bp, Homo sapiens
tgttttctgtaaataa

SEQ ID NO: 5958134 - DNA, 16 bp, Homo sapiens
tgttttctgtgcactg

SEQ ID NO: 5958135 - DNA, 14 bp, Homo sapiens
tgttttctgtgtaa

SEQ ID NO: 5958136 - DNA, 17 bp, Homo sapiens
tgttttctgtttgtaaa

SEQ ID NO: 5958137 - DNA, 11 bp, Homo sapiens
tgttttcttct

SEQ ID NO: 5958138 - DNA, 16 bp, Homo sapiens
tgttttcttgtctgtg

SEQ ID NO: 5958139 - DNA, 16 bp, Homo sapiens
tgttttctttctttaa

SEQ ID NO: 5958140 - DNA, 20 bp, Homo sapiens
tgttttctttctttaaatgt

SEQ ID NO: 5958141 - DNA, 17 bp, Homo sapiens
tgttttcttttggtaaa

SEQ ID NO: 5958142 - DNA, 15 bp, Homo sapiens
tgttttgaatattac

SEQ ID NO: 5958143 - DNA, 23 bp, Homo sapiens
tgttttgacttaagtagaagtaa

SEQ ID NO: 5958144 - DNA, 11 bp, Homo sapiens
tgttttgagaa

SEQ ID NO: 5958145 - DNA, 19 bp, Homo sapiens
tgttttgagctttccatgt

SEQ ID NO: 5958146 - DNA, 18 bp, Homo sapiens
tgttttgagttttgtagc

SEQ ID NO: 5958147 - DNA, 20 bp, Homo sapiens
tgttttgataaagtagtaaa

SEQ ID NO: 5958148 - DNA, 17 bp, Homo sapiens
tgttttgatagatgata

SEQ ID NO: 5958149 - DNA, 14 bp, Homo sapiens
tgttttgatcaaat

SEQ ID NO: 5958150 - DNA, 13 bp, Homo sapiens
tgttttgcaaagg

SEQ ID NO: 5958151 - DNA, 21 bp, Homo sapiens
tgttttgcactgacaagatgg

SEQ ID NO: 5958152 - DNA, 14 bp, Homo sapiens
tgttttgcactttt

SEQ ID NO: 5958153 - DNA, 19 bp, Homo sapiens
tgttttgccaatttgcaca

SEQ ID NO: 5958154 - DNA, 12 bp, Homo sapiens
tgttttgctaat

SEQ ID NO: 5958155 - DNA, 17 bp, Homo sapiens
tgttttgctcaatagat

SEQ ID NO: 5958156 - DNA, 11 bp, Homo sapiens
tgttttgctta

SEQ ID NO: 5958157 - DNA, 16 bp, Homo sapiens
tgttttgcttaaacta

SEQ ID NO: 5958158 - DNA, 23 bp, Homo sapiens
tgttttgcttttgtttttttcct

SEQ ID NO: 5958159 - DNA, 17 bp, Homo sapiens
tgttttgctttttctga

SEQ ID NO: 5958160 - DNA, 17 bp, Homo sapiens
tgttttggaataaagag

SEQ ID NO: 5958161 - DNA, 13 bp, Homo sapiens
tgttttggaatgt

SEQ ID NO: 5958162 - DNA, 17 bp, Homo sapiens
tgttttggactctctgt

SEQ ID NO: 5958163 - DNA, 20 bp, Homo sapiens
tgttttggactctctgtggt

SEQ ID NO: 5958164 - DNA, 17 bp, Homo sapiens
tgttttggactttgtta

SEQ ID NO: 5958165 - DNA, 17 bp, Homo sapiens
tgttttggatggcttgt

SEQ ID NO: 5958166 - DNA, 16 bp, Homo sapiens
tgttttggatgttgct

SEQ ID NO: 5958167 - DNA, 23 bp, Homo sapiens
tgttttggatgttgctatagtga

SEQ ID NO: 5958168 - DNA, 17 bp, Homo sapiens
tgttttggattctttaa

SEQ ID NO: 5958169 - DNA, 20 bp, Homo sapiens
tgttttggctgctctccatc

SEQ ID NO: 5958170 - DNA, 19 bp, Homo sapiens
tgttttgggatcaggagcc

SEQ ID NO: 5958171 - DNA, 19 bp, Homo sapiens
tgttttggggctttcccag

SEQ ID NO: 5958172 - DNA, 22 bp, Homo sapiens
tgttttgggtgaatcttgagga

SEQ ID NO: 5958173 - DNA, 16 bp, Homo sapiens
tgttttggtagattaa

SEQ ID NO: 5958174 - DNA, 19 bp, Homo sapiens
tgttttggtctcaaaatgg

SEQ ID NO: 5958175 - DNA, 15 bp, Homo sapiens
tgttttggtggaaaa

SEQ ID NO: 5958176 - DNA, 20 bp, Homo sapiens
tgttttggtggaaaaaacat

SEQ ID NO: 5958177 - DNA, 22 bp, Homo sapiens
tgttttggtgtattgtcagcca

SEQ ID NO: 5958178 - DNA, 13 bp, Homo sapiens
tgttttgtaaaca

SEQ ID NO: 5958179 - DNA, 16 bp, Homo sapiens
tgttttgtaaacattt

SEQ ID NO: 5958180 - DNA, 17 bp, Homo sapiens
tgttttgtaaacattta

SEQ ID NO: 5958181 - DNA, 15 bp, Homo sapiens
tgttttgtaaacttt

SEQ ID NO: 5958182 - DNA, 17 bp, Homo sapiens
tgttttgtaaactttga

SEQ ID NO: 5958183 - DNA, 21 bp, Homo sapiens
tgttttgtaaactttgaaata

SEQ ID NO: 5958184 - DNA, 21 bp, Homo sapiens
tgttttgtacaattactaaat

SEQ ID NO: 5958185 - DNA, 22 bp, Homo sapiens
tgttttgtacaattactaaatt

SEQ ID NO: 5958186 - DNA, 16 bp, Homo sapiens
tgttttgtacagatgt

SEQ ID NO: 5958187 - DNA, 12 bp, Homo sapiens
tgttttgtacca

SEQ ID NO: 5958188 - DNA, 16 bp, Homo sapiens
tgttttgtaccagtga

SEQ ID NO: 5958189 - DNA, 13 bp, Homo sapiens
tgttttgtataaa

SEQ ID NO: 5958190 - DNA, 13 bp, Homo sapiens
tgttttgtataca

SEQ ID NO: 5958191 - DNA, 17 bp, Homo sapiens
tgttttgtatacaaata

SEQ ID NO: 5958192 - DNA, 15 bp, Homo sapiens
tgttttgtatataca

SEQ ID NO: 5958193 - DNA, 17 bp, Homo sapiens
tgttttgtatatacagt

SEQ ID NO: 5958194 - DNA, 18 bp, Homo sapiens
tgttttgtatatgatcta

SEQ ID NO: 5958195 - DNA, 13 bp, Homo sapiens
tgttttgtatttt

SEQ ID NO: 5958196 - DNA, 13 bp, Homo sapiens
tgttttgtctata

SEQ ID NO: 5958197 - DNA, 19 bp, Homo sapiens
tgttttgtctcctaaattg

SEQ ID NO: 5958198 - DNA, 13 bp, Homo sapiens
tgttttgtgcatt

SEQ ID NO: 5958199 - DNA, 19 bp, Homo sapiens
tgttttgtggtttggaata

SEQ ID NO: 5958200 - DNA, 14 bp, Homo sapiens
tgttttgtgtatat

SEQ ID NO: 5958201 - DNA, 14 bp, Homo sapiens
tgttttgttatata

SEQ ID NO: 5958202 - DNA, 17 bp, Homo sapiens
tgttttgttctttaaag

SEQ ID NO: 5958203 - DNA, 14 bp, Homo sapiens
tgttttgttgacat

SEQ ID NO: 5958204 - DNA, 19 bp, Homo sapiens
tgttttgttgacattctga

SEQ ID NO: 5958205 - DNA, 14 bp, Homo sapiens
tgttttgttgattt

SEQ ID NO: 5958206 - DNA, 14 bp, Homo sapiens
tgttttgttgcact

SEQ ID NO: 5958207 - DNA, 15 bp, Homo sapiens
tgttttgtttcttga

SEQ ID NO: 5958208 - DNA, 14 bp, Homo sapiens
tgttttgtttgtct

SEQ ID NO: 5958209 - DNA, 18 bp, Homo sapiens
tgttttgttttatagtat

SEQ ID NO: 5958210 - DNA, 15 bp, Homo sapiens
tgttttgttttggac

SEQ ID NO: 5958211 - DNA, 15 bp, Homo sapiens
tgttttgttttgtag

SEQ ID NO: 5958212 - DNA, 15 bp, Homo sapiens
tgtttttaaaaagaa

SEQ ID NO: 5958213 - DNA, 12 bp, Homo sapiens
tgtttttaaaag

SEQ ID NO: 5958214 - DNA, 15 bp, Homo sapiens
tgtttttaaaatctt

SEQ ID NO: 5958215 - DNA, 17 bp, Homo sapiens
tgtttttaaaatcttat

SEQ ID NO: 5958216 - DNA, 14 bp, Homo sapiens
tgtttttaaactgt

SEQ ID NO: 5958217 - DNA, 18 bp, Homo sapiens
tgtttttaaactgtacag

SEQ ID NO: 5958218 - DNA, 23 bp, Homo sapiens
tgtttttaaactgtacagtgtct

SEQ ID NO: 5958219 - DNA, 12 bp, Homo sapiens
tgtttttaactc

SEQ ID NO: 5958220 - DNA, 20 bp, Homo sapiens
tgtttttaagaaaaacatgt

SEQ ID NO: 5958221 - DNA, 14 bp, Homo sapiens
tgtttttaagctgt

SEQ ID NO: 5958222 - DNA, 20 bp, Homo sapiens
tgtttttaagctgtttccat

SEQ ID NO: 5958223 - DNA, 22 bp, Homo sapiens
tgtttttaagctgtttccatag

SEQ ID NO: 5958224 - DNA, 16 bp, Homo sapiens
tgtttttaatctcctg

SEQ ID NO: 5958225 - DNA, 18 bp, Homo sapiens
tgtttttaatctcctgtt

SEQ ID NO: 5958226 - DNA, 20 bp, Homo sapiens
tgtttttaatgctttgatat

SEQ ID NO: 5958227 - DNA, 19 bp, Homo sapiens
tgtttttacattatgcaaa

SEQ ID NO: 5958228 - DNA, 14 bp, Homo sapiens
tgtttttactgtat

SEQ ID NO: 5958229 - DNA, 16 bp, Homo sapiens
tgtttttactgtatgt

SEQ ID NO: 5958230 - DNA, 19 bp, Homo sapiens
tgtttttagaacatgtaaa

SEQ ID NO: 5958231 - DNA, 20 bp, Homo sapiens
tgtttttagagcttccaaat

SEQ ID NO: 5958232 - DNA, 21 bp, Homo sapiens
tgtttttagagcttccaaatg

SEQ ID NO: 5958233 - DNA, 15 bp, Homo sapiens
tgtttttagttctga

SEQ ID NO: 5958234 - DNA, 18 bp, Homo sapiens
tgtttttataaaaacatt

SEQ ID NO: 5958235 - DNA, 15 bp, Homo sapiens
tgtttttataaaaat

SEQ ID NO: 5958236 - DNA, 14 bp, Homo sapiens
tgtttttatagaag

SEQ ID NO: 5958237 - DNA, 15 bp, Homo sapiens
tgtttttatagaagt

SEQ ID NO: 5958238 - DNA, 12 bp, Homo sapiens
tgtttttatata

SEQ ID NO: 5958239 - DNA, 18 bp, Homo sapiens
tgtttttattaatttata

SEQ ID NO: 5958240 - DNA, 16 bp, Homo sapiens
tgtttttattccttcc

SEQ ID NO: 5958241 - DNA, 18 bp, Homo sapiens
tgtttttattccttccat

SEQ ID NO: 5958242 - DNA, 21 bp, Homo sapiens
tgtttttattgcatttgctgt

SEQ ID NO: 5958243 - DNA, 17 bp, Homo sapiens
tgtttttattgttttct

SEQ ID NO: 5958244 - DNA, 19 bp, Homo sapiens
tgtttttcaatctcatctg

SEQ ID NO: 5958245 - DNA, 22 bp, Homo sapiens
tgtttttcaatctcatctgata

SEQ ID NO: 5958246 - DNA, 13 bp, Homo sapiens
tgtttttccaaaa

SEQ ID NO: 5958247 - DNA, 16 bp, Homo sapiens
tgtttttccaaaactt

SEQ ID NO: 5958248 - DNA, 16 bp, Homo sapiens
tgtttttcctttctta

SEQ ID NO: 5958249 - DNA, 17 bp, Homo sapiens
tgtttttcctttcttaa

SEQ ID NO: 5958250 - DNA, 23 bp, Homo sapiens
tgtttttctatagaaaaagtaaa

SEQ ID NO: 5958251 - DNA, 18 bp, Homo sapiens
tgtttttctattaaaaga

SEQ ID NO: 5958252 - DNA, 21 bp, Homo sapiens
tgtttttctattaaaagactc

SEQ ID NO: 5958253 - DNA, 22 bp, Homo sapiens
tgtttttctattaaaagactca

SEQ ID NO: 5958254 - DNA, 23 bp, Homo sapiens
tgtttttctcaaaaagctgctat

SEQ ID NO: 5958255 - DNA, 17 bp, Homo sapiens
tgtttttctcaaataaa

SEQ ID NO: 5958256 - DNA, 14 bp, Homo sapiens
tgtttttctccagt

SEQ ID NO: 5958257 - DNA, 12 bp, Homo sapiens
tgtttttctctc

SEQ ID NO: 5958258 - DNA, 12 bp, Homo sapiens
tgtttttctgct

SEQ ID NO: 5958259 - DNA, 13 bp, Homo sapiens
tgtttttctgtgt

SEQ ID NO: 5958260 - DNA, 17 bp, Homo sapiens
tgtttttctgtgttact

SEQ ID NO: 5958261 - DNA, 13 bp, Homo sapiens
tgtttttcttatc

SEQ ID NO: 5958262 - DNA, 17 bp, Homo sapiens
tgtttttcttctgaaat

SEQ ID NO: 5958263 - DNA, 16 bp, Homo sapiens
tgtttttctttctaca

SEQ ID NO: 5958264 - DNA, 16 bp, Homo sapiens
tgtttttctttttaca

SEQ ID NO: 5958265 - DNA, 13 bp, Homo sapiens
tgtttttgaaata

SEQ ID NO: 5958266 - DNA, 18 bp, Homo sapiens
tgtttttgaaggcagaaa

SEQ ID NO: 5958267 - DNA, 20 bp, Homo sapiens
tgtttttgaaggcagaaagc

SEQ ID NO: 5958268 - DNA, 21 bp, Homo sapiens
tgtttttgaatttaaataaag

SEQ ID NO: 5958269 - DNA, 18 bp, Homo sapiens
tgtttttgaggctttctg

SEQ ID NO: 5958270 - DNA, 16 bp, Homo sapiens
tgtttttgcactgtct

SEQ ID NO: 5958271 - DNA, 18 bp, Homo sapiens
tgtttttgcatgaaattg

SEQ ID NO: 5958272 - DNA, 23 bp, Homo sapiens
tgtttttgggaagaagaagacct

SEQ ID NO: 5958273 - DNA, 14 bp, Homo sapiens
tgtttttgggatgt

SEQ ID NO: 5958274 - DNA, 16 bp, Homo sapiens
tgtttttggtctttta

SEQ ID NO: 5958275 - DNA, 16 bp, Homo sapiens
tgtttttggtttctta

SEQ ID NO: 5958276 - DNA, 12 bp, Homo sapiens
tgtttttgtaaa

SEQ ID NO: 5958277 - DNA, 17 bp, Homo sapiens
tgtttttgtaaagaaaa

SEQ ID NO: 5958278 - DNA, 12 bp, Homo sapiens
tgtttttgtata

SEQ ID NO: 5958279 - DNA, 13 bp, Homo sapiens
tgtttttgtatat

SEQ ID NO: 5958280 - DNA, 21 bp, Homo sapiens
tgtttttgtatattggtttta

SEQ ID NO: 5958281 - DNA, 19 bp, Homo sapiens
tgtttttgtatgaagtact

SEQ ID NO: 5958282 - DNA, 13 bp, Homo sapiens
tgtttttgtattt

SEQ ID NO: 5958283 - DNA, 12 bp, Homo sapiens
tgtttttgtgaa

SEQ ID NO: 5958284 - DNA, 21 bp, Homo sapiens
tgttttttaacttgcagtata

SEQ ID NO: 5958285 - DNA, 11 bp, Homo sapiens
tgttttttaag

SEQ ID NO: 5958286 - DNA, 16 bp, Homo sapiens
tgttttttaagatagt

SEQ ID NO: 5958287 - DNA, 20 bp, Homo sapiens
tgttttttaagatagtgtaa

SEQ ID NO: 5958288 - DNA, 12 bp, Homo sapiens
ttaaaatcctca

SEQ ID NO: 5958289 - DNA, 14 bp, Homo sapiens
ttaaaatctacaga

SEQ ID NO: 5958290 - DNA, 17 bp, Homo sapiens
ttaaaatctacagaact

SEQ ID NO: 5958291 - DNA, 13 bp, Homo sapiens
ttaaaatctactt

SEQ ID NO: 5958292 - DNA, 24 bp, Homo sapiens
ttaaaatctattctgtgttgcatt

SEQ ID NO: 5958293 - DNA, 19 bp, Homo sapiens
ttaaaatctcttgattata

SEQ ID NO: 5958294 - DNA, 21 bp, Homo sapiens
ttaaaatctgagggaaatgtt

SEQ ID NO: 5958295 - DNA, 20 bp, Homo sapiens
ttaaaatctgatttaatgtt

SEQ ID NO: 5958296 - DNA, 13 bp, Homo sapiens
ttaaaatctggaa

SEQ ID NO: 5958297 - DNA, 11 bp, Homo sapiens
ttaaaatctta

SEQ ID NO: 5958298 - DNA, 14 bp, Homo sapiens
ttaaaatcttaaac

SEQ ID NO: 5958299 - DNA, 13 bp, Homo sapiens
ttaaaatcttatt

SEQ ID NO: 5958300 - DNA, 15 bp, Homo sapiens
ttaaaatcttgaaag

SEQ ID NO: 5958301 - DNA, 17 bp, Homo sapiens
ttaaaatgaagcaattt

SEQ ID NO: 5958302 - DNA, 20 bp, Homo sapiens
ttaaaatgaataatttatta

SEQ ID NO: 5958303 - DNA, 13 bp, Homo sapiens
ttaaaatgacaaa

SEQ ID NO: 5958304 - DNA, 15 bp, Homo sapiens
ttaaaatgacaaaca

SEQ ID NO: 5958305 - DNA, 18 bp, Homo sapiens
ttaaaatgacaaacatga

SEQ ID NO: 5958306 - DNA, 12 bp, Homo sapiens
ttaaaatgagaa

SEQ ID NO: 5958307 - DNA, 12 bp, Homo sapiens
ttaaaatgcaat

SEQ ID NO: 5958308 - DNA, 13 bp, Homo sapiens
ttaaaatgcaata

SEQ ID NO: 5958309 - DNA, 20 bp, Homo sapiens
ttaaaatgcaatatttgtaa

SEQ ID NO: 5958310 - DNA, 21 bp, Homo sapiens
ttaaaatgcaggtgaactttt

SEQ ID NO: 5958311 - DNA, 18 bp, Homo sapiens
ttaaaatgcatatttcta

SEQ ID NO: 5958312 - DNA, 23 bp, Homo sapiens
ttaaaatgcgaaattattggttg

SEQ ID NO: 5958313 - DNA, 18 bp, Homo sapiens
ttaaaatggcatttagca

SEQ ID NO: 5958314 - DNA, 20 bp, Homo sapiens
ttaaaatggcatttagcaca

SEQ ID NO: 5958315 - DNA, 21 bp, Homo sapiens
ttaaaatggtgcttaagttcc

SEQ ID NO: 5958316 - DNA, 18 bp, Homo sapiens
ttaaaatggttatgtgca

SEQ ID NO: 5958317 - DNA, 24 bp, Homo sapiens
ttaaaatgtaagattatagattct

SEQ ID NO: 5958318 - DNA, 17 bp, Homo sapiens
ttaaaatgtaatttaaa

SEQ ID NO: 5958319 - DNA, 21 bp, Homo sapiens
ttaaaatgtacatgtattaaa

SEQ ID NO: 5958320 - DNA, 17 bp, Homo sapiens
ttaaaatgtagttttaa

SEQ ID NO: 5958321 - DNA, 23 bp, Homo sapiens
ttaaaatgtagttttaaataaag

SEQ ID NO: 5958322 - DNA, 14 bp, Homo sapiens
ttaaaatgtatgca

SEQ ID NO: 5958323 - DNA, 23 bp, Homo sapiens
ttaaaatgtattcttaaattcat

SEQ ID NO: 5958324 - DNA, 21 bp, Homo sapiens
ttaaaatgtcttggtcttcta

SEQ ID NO: 5958325 - DNA, 19 bp, Homo sapiens
ttaaaatgtgaggcaataa

SEQ ID NO: 5958326 - DNA, 16 bp, Homo sapiens
ttaaaatgtttaggaa

SEQ ID NO: 5958327 - DNA, 16 bp, Homo sapiens
ttaaaattaaatactt

SEQ ID NO: 5958328 - DNA, 18 bp, Homo sapiens
ttaaaattaaatactttt

SEQ ID NO: 5958329 - DNA, 13 bp, Homo sapiens
ttaaaattagtga

SEQ ID NO: 5958330 - DNA, 16 bp, Homo sapiens
ttaaaattcaccccca

SEQ ID NO: 5958331 - DNA, 12 bp, Homo sapiens
ttaaaattcagt

SEQ ID NO: 5958332 - DNA, 23 bp, Homo sapiens
ttaaaattcagtttttgtatctt

SEQ ID NO: 5958333 - DNA, 15 bp, Homo sapiens
ttaaaattctgatgt

SEQ ID NO: 5958334 - DNA, 19 bp, Homo sapiens
ttaaaattctgatgtttct

SEQ ID NO: 5958335 - DNA, 23 bp, Homo sapiens
ttaaaattctgatgtttctgtga

SEQ ID NO: 5958336 - DNA, 15 bp, Homo sapiens
ttaaaattgctaacg

SEQ ID NO: 5958337 - DNA, 11 bp, Homo sapiens
ttaaaattggc

SEQ ID NO: 5958338 - DNA, 17 bp, Homo sapiens
ttaaaattggcctttta

SEQ ID NO: 5958339 - DNA, 19 bp, Homo sapiens
ttaaaattggccttttacc

SEQ ID NO: 5958340 - DNA, 18 bp, Homo sapiens
ttaaaattggtatatttg

SEQ ID NO: 5958341 - DNA, 13 bp, Homo sapiens
ttaaaattgtcac

SEQ ID NO: 5958342 - DNA, 18 bp, Homo sapiens
ttaaaattgtgatgtgtc

SEQ ID NO: 5958343 - DNA, 16 bp, Homo sapiens
ttaaaattgtgcataa

SEQ ID NO: 5958344 - DNA, 22 bp, Homo sapiens
ttaaaattgtgcataatgcttt

SEQ ID NO: 5958345 - DNA, 16 bp, Homo sapiens
ttaaaatttaacatct

SEQ ID NO: 5958346 - DNA, 12 bp, Homo sapiens
ttaaaatttatt

SEQ ID NO: 5958347 - DNA, 16 bp, Homo sapiens
ttaaaatttatttgca

SEQ ID NO: 5958348 - DNA, 17 bp, Homo sapiens
ttaaaatttatttgcaa

SEQ ID NO: 5958349 - DNA, 13 bp, Homo sapiens
ttaaaatttcact

SEQ ID NO: 5958350 - DNA, 13 bp, Homo sapiens
ttaaaatttcgtt

SEQ ID NO: 5958351 - DNA, 20 bp, Homo sapiens
ttaaaatttcgttgtccaat

SEQ ID NO: 5958352 - DNA, 19 bp, Homo sapiens
ttaaaatttcttagaaaac

SEQ ID NO: 5958353 - DNA, 13 bp, Homo sapiens
ttaaaatttgaaa

SEQ ID NO: 5958354 - DNA, 14 bp, Homo sapiens
ttaaaatttgaaac

SEQ ID NO: 5958355 - DNA, 17 bp, Homo sapiens
ttaaaatttgtcttaaa

SEQ ID NO: 5958356 - DNA, 18 bp, Homo sapiens
ttaaaattttacctctct

SEQ ID NO: 5958357 - DNA, 20 bp, Homo sapiens
ttaaaattttgtatgttaaa

SEQ ID NO: 5958358 - DNA, 15 bp, Homo sapiens
ttaaaattttttgag

SEQ ID NO: 5958359 - DNA, 19 bp, Homo sapiens
ttaaacaaaaactttccat

SEQ ID NO: 5958360 - DNA, 21 bp, Homo sapiens
ttaaacaaaagtgtacctgta

SEQ ID NO: 5958361 - DNA, 20 bp, Homo sapiens
ttaaacaaaatagaagctgt

SEQ ID NO: 5958362 - DNA, 18 bp, Homo sapiens
ttaaacaaaatgaaaata

SEQ ID NO: 5958363 - DNA, 17 bp, Homo sapiens
ttaaacaaaatttatgt

SEQ ID NO: 5958364 - DNA, 15 bp, Homo sapiens
ttaaacaaaatttca

SEQ ID NO: 5958365 - DNA, 17 bp, Homo sapiens
ttaaacaaaatttcaca

SEQ ID NO: 5958366 - DNA, 16 bp, Homo sapiens
ttaaacaaaccagaat

SEQ ID NO: 5958367 - DNA, 14 bp, Homo sapiens
ttaaacaaaggttg

SEQ ID NO: 5958368 - DNA, 14 bp, Homo sapiens
ttaaacaaagtgac

SEQ ID NO: 5958369 - DNA, 17 bp, Homo sapiens
ttaaacaaagtttcaga

SEQ ID NO: 5958370 - DNA, 13 bp, Homo sapiens
ttaaacaaataaa

SEQ ID NO: 5958371 - DNA, 12 bp, Homo sapiens
ttaaacaaatgg

SEQ ID NO: 5958372 - DNA, 14 bp, Homo sapiens
ttaaacaaatgtgt

SEQ ID NO: 5958373 - DNA, 17 bp, Homo sapiens
ttaaacaacacctcctc

SEQ ID NO: 5958374 - DNA, 19 bp, Homo sapiens
ttaaacaatataagaagga

SEQ ID NO: 5958375 - DNA, 14 bp, Homo sapiens
ttaaacaatgatca

SEQ ID NO: 5958376 - DNA, 20 bp, Homo sapiens
ttaaacaatgtataaagatt

SEQ ID NO: 5958377 - DNA, 20 bp, Homo sapiens
ttaaacaattcttgtaactt

SEQ ID NO: 5958378 - DNA, 14 bp, Homo sapiens
ttaaacacaaagtg

SEQ ID NO: 5958379 - DNA, 22 bp, Homo sapiens
ttaaacacacagatacacacac

SEQ ID NO: 5958380 - DNA, 16 bp, Homo sapiens
ttaaacacaggctgtc

SEQ ID NO: 5958381 - DNA, 14 bp, Homo sapiens
ttaaacacattaaa

SEQ ID NO: 5958382 - DNA, 14 bp, Homo sapiens
ttaaacacattgtc

SEQ ID NO: 5958383 - DNA, 16 bp, Homo sapiens
ttaaacacctgacaca

SEQ ID NO: 5958384 - DNA, 19 bp, Homo sapiens
ttaaacactacacatttga

SEQ ID NO: 5958385 - DNA, 21 bp, Homo sapiens
ttaaacactacacatttgaaa

SEQ ID NO: 5958386 - DNA, 15 bp, Homo sapiens
ttaaacactgtaatc

SEQ ID NO: 5958387 - DNA, 13 bp, Homo sapiens
ttaaacagaggat

SEQ ID NO: 5958388 - DNA, 21 bp, Homo sapiens
ttaaacagatatcttcagttt

SEQ ID NO: 5958389 - DNA, 18 bp, Homo sapiens
ttaaacagcaaagccata

SEQ ID NO: 5958390 - DNA, 21 bp, Homo sapiens
ttaaacagggcatctccagga

SEQ ID NO: 5958391 - DNA, 19 bp, Homo sapiens
ttaaacaggtggttctttt

SEQ ID NO: 5958392 - DNA, 18 bp, Homo sapiens
ttaaacagtgagcctgaa

SEQ ID NO: 5958393 - DNA, 17 bp, Homo sapiens
ttaaacagttgcacagc

SEQ ID NO: 5958394 - DNA, 14 bp, Homo sapiens
ttaaacatgcagaa

SEQ ID NO: 5958395 - DNA, 22 bp, Homo sapiens
ttaaacatgctaaatagttcta

SEQ ID NO: 5958396 - DNA, 18 bp, Homo sapiens
ttaaacattaaaaatgga

SEQ ID NO: 5958397 - DNA, 12 bp, Homo sapiens
ttaaacattatt

SEQ ID NO: 5958398 - DNA, 18 bp, Homo sapiens
ttaaacattggttcttgt

SEQ ID NO: 5958399 - DNA, 20 bp, Homo sapiens
ttaaacattggttcttgtat

SEQ ID NO: 5958400 - DNA, 20 bp, Homo sapiens
ttaaaccaatgaagaagaca

SEQ ID NO: 5958401 - DNA, 21 bp, Homo sapiens
ttaaaccacagtctggagtga

SEQ ID NO: 5958402 - DNA, 19 bp, Homo sapiens
ttaaaccagattggagcaa

SEQ ID NO: 5958403 - DNA, 15 bp, Homo sapiens
ttaaaccagcagaaa

SEQ ID NO: 5958404 - DNA, 18 bp, Homo sapiens
ttaaaccagcagaaaagt

SEQ ID NO: 5958405 - DNA, 19 bp, Homo sapiens
ttaaaccagcagaaaagtg

SEQ ID NO: 5958406 - DNA, 21 bp, Homo sapiens
ttaaaccagtttagatttcaa

SEQ ID NO: 5958407 - DNA, 14 bp, Homo sapiens
ttaaaccatctccc

SEQ ID NO: 5958408 - DNA, 15 bp, Homo sapiens
ttaaaccatctccct

SEQ ID NO: 5958409 - DNA, 22 bp, Homo sapiens
ttaaaccatctccctggtgctt

SEQ ID NO: 5958410 - DNA, 21 bp, Homo sapiens
ttaaaccatgggataaatgcc

SEQ ID NO: 5958411 - DNA, 13 bp, Homo sapiens
ttaaaccattttt

SEQ ID NO: 5958412 - DNA, 16 bp, Homo sapiens
ttaaacccaaaatata

SEQ ID NO: 5958413 - DNA, 19 bp, Homo sapiens
ttaaacccacaagctgcct

SEQ ID NO: 5958414 - DNA, 18 bp, Homo sapiens
ttaaacccatacaatgta

SEQ ID NO: 5958415 - DNA, 15 bp, Homo sapiens
ttaaacctgtctcca

SEQ ID NO: 5958416 - DNA, 20 bp, Homo sapiens
ttaaacctgtctccactgtg

SEQ ID NO: 5958417 - DNA, 15 bp, Homo sapiens
ttaaacctttcataa

SEQ ID NO: 5958418 - DNA, 13 bp, Homo sapiens
ttaaacctttcca

SEQ ID NO: 5958419 - DNA, 13 bp, Homo sapiens
ttaaaccttttat

SEQ ID NO: 5958420 - DNA, 17 bp, Homo sapiens
ttaaacctttttcttga

SEQ ID NO: 5958421 - DNA, 17 bp, Homo sapiens
ttaaacgacttttgttt

SEQ ID NO: 5958422 - DNA, 22 bp, Homo sapiens
ttaaacgattagtgatgtcctt

SEQ ID NO: 5958423 - DNA, 15 bp, Homo sapiens
ttaaacgtaaatgtt

SEQ ID NO: 5958424 - DNA, 18 bp, Homo sapiens
ttaaacgtatgcatgtga

SEQ ID NO: 5958425 - DNA, 13 bp, Homo sapiens
ttaaacgtgtaaa

SEQ ID NO: 5958426 - DNA, 20 bp, Homo sapiens
ttaaactaaaaaaaaaaagg

SEQ ID NO: 5958427 - DNA, 15 bp, Homo sapiens
ttaaactaaaataca

SEQ ID NO: 5958428 - DNA, 12 bp, Homo sapiens
ttaaactaaata

SEQ ID NO: 5958429 - DNA, 14 bp, Homo sapiens
ttaaactaaatgtg

SEQ ID NO: 5958430 - DNA, 17 bp, Homo sapiens
ttaaactacagaatatt

SEQ ID NO: 5958431 - DNA, 23 bp, Homo sapiens
ttaaactactatttttctttcca

SEQ ID NO: 5958432 - DNA, 17 bp, Homo sapiens
ttaaactagcatatctg

SEQ ID NO: 5958433 - DNA, 21 bp, Homo sapiens
ttaaactagcatatctgcctt

SEQ ID NO: 5958434 - DNA, 13 bp, Homo sapiens
ttaaactagtaat

SEQ ID NO: 5958435 - DNA, 14 bp, Homo sapiens
ttaaactagtttaa

SEQ ID NO: 5958436 - DNA, 20 bp, Homo sapiens
ttaaactattagagtatttc

SEQ ID NO: 5958437 - DNA, 17 bp, Homo sapiens
ttaaactattttgagca

SEQ ID NO: 5958438 - DNA, 15 bp, Homo sapiens
ttaaactcaaatgta

SEQ ID NO: 5958439 - DNA, 16 bp, Homo sapiens
ttaaactcaagacaat

SEQ ID NO: 5958440 - DNA, 13 bp, Homo sapiens
ttaaactcaggga

SEQ ID NO: 5958441 - DNA, 16 bp, Homo sapiens
ttaaactcagggacag

SEQ ID NO: 5958442 - DNA, 22 bp, Homo sapiens
ttaaactcagggacagagccat

SEQ ID NO: 5958443 - DNA, 22 bp, Homo sapiens
ttaaactcgagatacagctttt

SEQ ID NO: 5958444 - DNA, 21 bp, Homo sapiens
ttaaactctgagtgcaaactt

SEQ ID NO: 5958445 - DNA, 15 bp, Homo sapiens
ttaaactctgccaga

SEQ ID NO: 5958446 - DNA, 17 bp, Homo sapiens
ttaaactctgccagaaa

SEQ ID NO: 5958447 - DNA, 20 bp, Homo sapiens
ttaaactctggacactctat

SEQ ID NO: 5958448 - DNA, 19 bp, Homo sapiens
ttaaactcttcacaaaatc

SEQ ID NO: 5958449 - DNA, 13 bp, Homo sapiens
ttaaactcttgaa

SEQ ID NO: 5958450 - DNA, 18 bp, Homo sapiens
ttaaactcttgaatatgt

SEQ ID NO: 5958451 - DNA, 22 bp, Homo sapiens
ttaaactcttgaatatgtgcct

SEQ ID NO: 5958452 - DNA, 15 bp, Homo sapiens
ttaaactctttttgg

SEQ ID NO: 5958453 - DNA, 17 bp, Homo sapiens
ttaaactgaagaaggat

SEQ ID NO: 5958454 - DNA, 18 bp, Homo sapiens
ttaaactgagagtaattc

SEQ ID NO: 5958455 - DNA, 13 bp, Homo sapiens
ttaaactggtatt

SEQ ID NO: 5958456 - DNA, 22 bp, Homo sapiens
ttaaactggtattttatctttg

SEQ ID NO: 5958457 - DNA, 15 bp, Homo sapiens
ttaaactgtacagaa

SEQ ID NO: 5958458 - DNA, 17 bp, Homo sapiens
ttaaactgtacagaatt

SEQ ID NO: 5958459 - DNA, 14 bp, Homo sapiens
ttaaactgtacagt

SEQ ID NO: 5958460 - DNA, 17 bp, Homo sapiens
ttaaactgtacagtgtc

SEQ ID NO: 5958461 - DNA, 15 bp, Homo sapiens
ttaaactgtatgtct

SEQ ID NO: 5958462 - DNA, 18 bp, Homo sapiens
ttaaactgtatgtcttat

SEQ ID NO: 5958463 - DNA, 16 bp, Homo sapiens
ttaaactgtattttat

SEQ ID NO: 5958464 - DNA, 12 bp, Homo sapiens
ttaaactgtgta

SEQ ID NO: 5958465 - DNA, 21 bp, Homo sapiens
ttaaactgtgtggactgtgat

SEQ ID NO: 5958466 - DNA, 16 bp, Homo sapiens
ttaaactgttagcact

SEQ ID NO: 5958467 - DNA, 15 bp, Homo sapiens
ttaacataggcaaga

SEQ ID NO: 5958468 - DNA, 17 bp, Homo sapiens
ttaacataggcaagagg

SEQ ID NO: 5958469 - DNA, 23 bp, Homo sapiens
ttaacataggtttttaaagacta

SEQ ID NO: 5958470 - DNA, 17 bp, Homo sapiens
ttaacatagtcctgtta

SEQ ID NO: 5958471 - DNA, 14 bp, Homo sapiens
ttaacatatatatt

SEQ ID NO: 5958472 - DNA, 17 bp, Homo sapiens
ttaacatatttactaag

SEQ ID NO: 5958473 - DNA, 13 bp, Homo sapiens
ttaacatcagttt

SEQ ID NO: 5958474 - DNA, 15 bp, Homo sapiens
ttaacatctgaagtg

SEQ ID NO: 5958475 - DNA, 10 bp, Homo sapiens
ttaacatctt

SEQ ID NO: 5958476 - DNA, 17 bp, Homo sapiens
ttaacatctttgttttt

SEQ ID NO: 5958477 - DNA, 15 bp, Homo sapiens
ttaacatgaactctt

SEQ ID NO: 5958478 - DNA, 13 bp, Homo sapiens
ttaacatgatgta

SEQ ID NO: 5958479 - DNA, 16 bp, Homo sapiens
ttaacatgatttcaaa

SEQ ID NO: 5958480 - DNA, 16 bp, Homo sapiens
ttaacatggaactcta

SEQ ID NO: 5958481 - DNA, 13 bp, Homo sapiens
ttaacatggaatt

SEQ ID NO: 5958482 - DNA, 20 bp, Homo sapiens
ttaacatgggctcttcacta

SEQ ID NO: 5958483 - DNA, 13 bp, Homo sapiens
ttaacattaaagc

SEQ ID NO: 5958484 - DNA, 16 bp, Homo sapiens
ttaacattagatgtca

SEQ ID NO: 5958485 - DNA, 13 bp, Homo sapiens
ttaacattattta

SEQ ID NO: 5958486 - DNA, 15 bp, Homo sapiens
ttaacattcatagag

SEQ ID NO: 5958487 - DNA, 17 bp, Homo sapiens
ttaacattccaagactc

SEQ ID NO: 5958488 - DNA, 14 bp, Homo sapiens
ttaacattctcaat

SEQ ID NO: 5958489 - DNA, 21 bp, Homo sapiens
ttaacattctttttctgttga

SEQ ID NO: 5958490 - DNA, 20 bp, Homo sapiens
ttaacattgaccaagaactg

SEQ ID NO: 5958491 - DNA, 22 bp, Homo sapiens
ttaacattgaccaagaactgca

SEQ ID NO: 5958492 - DNA, 23 bp, Homo sapiens
ttaacattgaccaagaactgcat

SEQ ID NO: 5958493 - DNA, 16 bp, Homo sapiens
ttaacattgtttttgt

SEQ ID NO: 5958494 - DNA, 14 bp, Homo sapiens
ttaacatttcaagg

SEQ ID NO: 5958495 - DNA, 15 bp, Homo sapiens
ttaacatttctaact

SEQ ID NO: 5958496 - DNA, 23 bp, Homo sapiens
ttaacatttgccttgcagaactg

SEQ ID NO: 5958497 - DNA, 16 bp, Homo sapiens
ttaacattttgttctt

SEQ ID NO: 5958498 - DNA, 17 bp, Homo sapiens
ttaacattttgttctta

SEQ ID NO: 5958499 - DNA, 22 bp, Homo sapiens
ttaacattttgttcttacacat

SEQ ID NO: 5958500 - DNA, 19 bp, Homo sapiens
ttaacattttgtttccaaa

SEQ ID NO: 5958501 - DNA, 17 bp, Homo sapiens
ttaaccaaacaattatt

SEQ ID NO: 5958502 - DNA, 12 bp, Homo sapiens
ttaaccaaagaa

SEQ ID NO: 5958503 - DNA, 23 bp, Homo sapiens
ttaaccaaagaaagtgggtcacc

SEQ ID NO: 5958504 - DNA, 17 bp, Homo sapiens
ttaaccaagttgtttat

SEQ ID NO: 5958505 - DNA, 15 bp, Homo sapiens
ttaaccacagtgaaa

SEQ ID NO: 5958506 - DNA, 19 bp, Homo sapiens
ttaaccaccgcatatgcat

SEQ ID NO: 5958507 - DNA, 20 bp, Homo sapiens
ttaaccaccgcatatgcatg

SEQ ID NO: 5958508 - DNA, 15 bp, Homo sapiens
ttaaccagatggttg

SEQ ID NO: 5958509 - DNA, 20 bp, Homo sapiens
ttaaccagatggttgtgtat

SEQ ID NO: 5958510 - DNA, 16 bp, Homo sapiens
ttaaccattaaaactg

SEQ ID NO: 5958511 - DNA, 17 bp, Homo sapiens
ttaaccattaaaactga

SEQ ID NO: 5958512 - DNA, 18 bp, Homo sapiens
ttaaccattaaaactgaa

SEQ ID NO: 5958513 - DNA, 15 bp, Homo sapiens
ttaaccattttaacc

SEQ ID NO: 5958514 - DNA, 13 bp, Homo sapiens
ttaacccaaggag

SEQ ID NO: 5958515 - DNA, 14 bp, Homo sapiens
ttaacccccctgta

SEQ ID NO: 5958516 - DNA, 21 bp, Homo sapiens
ttaaccccgggatgcaaggta

SEQ ID NO: 5958517 - DNA, 18 bp, Homo sapiens
ttaaccccgtcaacaaat

SEQ ID NO: 5958518 - DNA, 21 bp, Homo sapiens
ttaaccccttggtactgaaaa

SEQ ID NO: 5958519 - DNA, 14 bp, Homo sapiens
ttaaccctcccctt

SEQ ID NO: 5958520 - DNA, 13 bp, Homo sapiens
ttaaccctctctt

SEQ ID NO: 5958521 - DNA, 16 bp, Homo sapiens
ttaaccctctcttccc

SEQ ID NO: 5958522 - DNA, 19 bp, Homo sapiens
ttaaccctgaacaagagtg

SEQ ID NO: 5958523 - DNA, 15 bp, Homo sapiens
ttaaccctttttcca

SEQ ID NO: 5958524 - DNA, 21 bp, Homo sapiens
ttaaccgggactacagaagtg

SEQ ID NO: 5958525 - DNA, 22 bp, Homo sapiens
ttaaccgggactacagaagtgg

SEQ ID NO: 5958526 - DNA, 15 bp, Homo sapiens
ttaacctaggcagtg

SEQ ID NO: 5958527 - DNA, 21 bp, Homo sapiens
ttaacctatgatattttctgt

SEQ ID NO: 5958528 - DNA, 13 bp, Homo sapiens
ttaacctcagaaa

SEQ ID NO: 5958529 - DNA, 18 bp, Homo sapiens
ttaacctcaggttccaaa

SEQ ID NO: 5958530 - DNA, 17 bp, Homo sapiens
ttaacctgcatgcagca

SEQ ID NO: 5958531 - DNA, 19 bp, Homo sapiens
ttaacctgtttatataatt

SEQ ID NO: 5958532 - DNA, 15 bp, Homo sapiens
ttaaccttaaaattg

SEQ ID NO: 5958533 - DNA, 15 bp, Homo sapiens
ttaaccttaaataca

SEQ ID NO: 5958534 - DNA, 21 bp, Homo sapiens
ttaaccttactaattatacta

SEQ ID NO: 5958535 - DNA, 21 bp, Homo sapiens
ttaacctttgctatgtaaggg

SEQ ID NO: 5958536 - DNA, 22 bp, Homo sapiens
ttaaccttttcaaattaatgtt

SEQ ID NO: 5958537 - DNA, 18 bp, Homo sapiens
ttaacctttttgtaaata

SEQ ID NO: 5958538 - DNA, 21 bp, Homo sapiens
ttaacctttttgtaaatactg

SEQ ID NO: 5958539 - DNA, 12 bp, Homo sapiens
ttaacctttttt

SEQ ID NO: 5958540 - DNA, 17 bp, Homo sapiens
ttaacgaatttaaaaag

SEQ ID NO: 5958541 - DNA, 19 bp, Homo sapiens
ttaacgacccactctgctt

SEQ ID NO: 5958542 - DNA, 18 bp, Homo sapiens
ttaacgatgtccaacccg

SEQ ID NO: 5958543 - DNA, 18 bp, Homo sapiens
ttaacgggcatgtattat

SEQ ID NO: 5958544 - DNA, 21 bp, Homo sapiens
ttaacgtatgtatttcattgc

SEQ ID NO: 5958545 - DNA, 20 bp, Homo sapiens
ttaacgtattagttgccaat

SEQ ID NO: 5958546 - DNA, 13 bp, Homo sapiens
ttaactaaagaag

SEQ ID NO: 5958547 - DNA, 14 bp, Homo sapiens
ttaactaaagaaga

SEQ ID NO: 5958548 - DNA, 20 bp, Homo sapiens
ttaactaaataaacagatgt

SEQ ID NO: 5958549 - DNA, 13 bp, Homo sapiens
ttaactaaatgct

SEQ ID NO: 5958550 - DNA, 16 bp, Homo sapiens
ttaactaaatgctcat

SEQ ID NO: 5958551 - DNA, 19 bp, Homo sapiens
ttaactaaatttgtctttc

SEQ ID NO: 5958552 - DNA, 18 bp, Homo sapiens
ttaactaaattttaaagc

SEQ ID NO: 5958553 - DNA, 20 bp, Homo sapiens
ttaactaaattttaaagcca

SEQ ID NO: 5958554 - DNA, 23 bp, Homo sapiens
ttaactaatatgggcattgtagt

SEQ ID NO: 5958555 - DNA, 21 bp, Homo sapiens
ttaactaatatttgtctgtgt

SEQ ID NO: 5958556 - DNA, 16 bp, Homo sapiens
ttaactaatgtaaata

SEQ ID NO: 5958557 - DNA, 19 bp, Homo sapiens
ttaactaatttaaaccagc

SEQ ID NO: 5958558 - DNA, 20 bp, Homo sapiens
ttaactaatttgaatgtggt

SEQ ID NO: 5958559 - DNA, 14 bp, Homo sapiens
ttaactacatttat

SEQ ID NO: 5958560 - DNA, 16 bp, Homo sapiens
ttaactacatttatga

SEQ ID NO: 5958561 - DNA, 16 bp, Homo sapiens
ttaactacccttaatt

SEQ ID NO: 5958562 - DNA, 20 bp, Homo sapiens
ttaactactatattgattgt

SEQ ID NO: 5958563 - DNA, 14 bp, Homo sapiens
ttaactactgtaga

SEQ ID NO: 5958564 - DNA, 20 bp, Homo sapiens
ttaactactgtagaactgat

SEQ ID NO: 5958565 - DNA, 22 bp, Homo sapiens
ttaactactgtagaactgattt

SEQ ID NO: 5958566 - DNA, 16 bp, Homo sapiens
ttaactagaatttatt

SEQ ID NO: 5958567 - DNA, 21 bp, Homo sapiens
ttaactagaatttattcaatt

SEQ ID NO: 5958568 - DNA, 19 bp, Homo sapiens
ttaactatcttctttggac

SEQ ID NO: 5958569 - DNA, 16 bp, Homo sapiens
ttaactatgacagata

SEQ ID NO: 5958570 - DNA, 20 bp, Homo sapiens
ttaactatgacagatatatt

SEQ ID NO: 5958571 - DNA, 14 bp, Homo sapiens
ttaactatgatcat

SEQ ID NO: 5958572 - DNA, 19 bp, Homo sapiens
ttaactatgattccaatta

SEQ ID NO: 5958573 - DNA, 23 bp, Homo sapiens
ttaactatgtacaatattttaag

SEQ ID NO: 5958574 - DNA, 12 bp, Homo sapiens
ttaactcaatat

SEQ ID NO: 5958575 - DNA, 14 bp, Homo sapiens
ttaactcaggactc

SEQ ID NO: 5958576 - DNA, 17 bp, Homo sapiens
ttaactcaggactccag

SEQ ID NO: 5958577 - DNA, 19 bp, Homo sapiens
ttaactcaggactccagcc

SEQ ID NO: 5958578 - DNA, 15 bp, Homo sapiens
ttaactcaggcattt

SEQ ID NO: 5958579 - DNA, 15 bp, Homo sapiens
ttaactcattagact

SEQ ID NO: 5958580 - DNA, 16 bp, Homo sapiens
ttaactcattagactg

SEQ ID NO: 5958581 - DNA, 14 bp, Homo sapiens
ttaactccctccac

SEQ ID NO: 5958582 - DNA, 16 bp, Homo sapiens
ttaactccctccacca

SEQ ID NO: 5958583 - DNA, 19 bp, Homo sapiens
ttaactccctccaccagcc

SEQ ID NO: 5958584 - DNA, 20 bp, Homo sapiens
ttaactccctccaccagcct

SEQ ID NO: 5958585 - DNA, 14 bp, Homo sapiens
ttaactccctgtaa

SEQ ID NO: 5958586 - DNA, 15 bp, Homo sapiens
ttaactctctttatg

SEQ ID NO: 5958587 - DNA, 10 bp, Homo sapiens
ttaactctgc

SEQ ID NO: 5958588 - DNA, 12 bp, Homo sapiens
ttaactctgcat

SEQ ID NO: 5958589 - DNA, 20 bp, Homo sapiens
ttaactctgtaaaagtgtct

SEQ ID NO: 5958590 - DNA, 16 bp, Homo sapiens
ttaactcttaactgaa

SEQ ID NO: 5958591 - DNA, 11 bp, Homo sapiens
ttaactctttg

SEQ ID NO: 5958592 - DNA, 20 bp, Homo sapiens
ttaactctttgaaactgtat

SEQ ID NO: 5958593 - DNA, 13 bp, Homo sapiens
ttaactcttttgg

SEQ ID NO: 5958594 - DNA, 14 bp, Homo sapiens
ttaactcttttgga

SEQ ID NO: 5958595 - DNA, 21 bp, Homo sapiens
ttaactgaacaatggccctgt

SEQ ID NO: 5958596 - DNA, 19 bp, Homo sapiens
ttaactgaagatattccaa

SEQ ID NO: 5958597 - DNA, 22 bp, Homo sapiens
ttaactgaataccactctgtaa

SEQ ID NO: 5958598 - DNA, 16 bp, Homo sapiens
ttaactgaataggaaa

SEQ ID NO: 5958599 - DNA, 21 bp, Homo sapiens
ttaactgaataggaaaatgta

SEQ ID NO: 5958600 - DNA, 20 bp, Homo sapiens
ttaactgacttcactaggca

SEQ ID NO: 5958601 - DNA, 22 bp, Homo sapiens
ttaactgcactcatagggtgct

SEQ ID NO: 5958602 - DNA, 21 bp, Homo sapiens
ttaactgcagttgactttctc

SEQ ID NO: 5958603 - DNA, 22 bp, Homo sapiens
ttaactgcagttgactttctcc

SEQ ID NO: 5958604 - DNA, 13 bp, Homo sapiens
ttaactgcatata

SEQ ID NO: 5958605 - DNA, 15 bp, Homo sapiens
ttaactgcatataga

SEQ ID NO: 5958606 - DNA, 15 bp, Homo sapiens
ttaactggcatggat

SEQ ID NO: 5958607 - DNA, 22 bp, Homo sapiens
ttaactggcatggattaataga

SEQ ID NO: 5958608 - DNA, 20 bp, Homo sapiens
ttaactggcatgtcatttgc

SEQ ID NO: 5958609 - DNA, 17 bp, Homo sapiens
ttaactggcccagaagc

SEQ ID NO: 5958610 - DNA, 21 bp, Homo sapiens
ttaactgggtaatgaaacaaa

SEQ ID NO: 5958611 - DNA, 20 bp, Homo sapiens
ttaactggtagttcattgta

SEQ ID NO: 5958612 - DNA, 16 bp, Homo sapiens
ttaactggtgaagaga

SEQ ID NO: 5958613 - DNA, 12 bp, Homo sapiens
ttaactgtactg

SEQ ID NO: 5958614 - DNA, 13 bp, Homo sapiens
ttaactgtatttt

SEQ ID NO: 5958615 - DNA, 19 bp, Homo sapiens
ttaactgtattttctttca

SEQ ID NO: 5958616 - DNA, 12 bp, Homo sapiens
ttaactgtggat

SEQ ID NO: 5958617 - DNA, 18 bp, Homo sapiens
ttaactgtgtgaagaaat

SEQ ID NO: 5958618 - DNA, 21 bp, Homo sapiens
ttaactgtgtgaagaaatgga

SEQ ID NO: 5958619 - DNA, 19 bp, Homo sapiens
ttaactgttagtattaact

SEQ ID NO: 5958620 - DNA, 11 bp, Homo sapiens
ttaactgttca

SEQ ID NO: 5958621 - DNA, 17 bp, Homo sapiens
ttaactgttcagtattg

SEQ ID NO: 5958622 - DNA, 22 bp, Homo sapiens
ttaacttaaaagattcactaaa

SEQ ID NO: 5958623 - DNA, 14 bp, Homo sapiens
ttaacttaaaattg

SEQ ID NO: 5958624 - DNA, 22 bp, Homo sapiens
ttaacttaaattttaatttatt

SEQ ID NO: 5958625 - DNA, 14 bp, Homo sapiens
ttaacttaactgaa

SEQ ID NO: 5958626 - DNA, 16 bp, Homo sapiens
ttaacttaataatcaa

SEQ ID NO: 5958627 - DNA, 14 bp, Homo sapiens
ttaacttacatttg

SEQ ID NO: 5958628 - DNA, 13 bp, Homo sapiens
ttaacttactttt

SEQ ID NO: 5958629 - DNA, 17 bp, Homo sapiens
ttaacttagttttgcat

SEQ ID NO: 5958630 - DNA, 18 bp, Homo sapiens
ttaacttagttttgcata

SEQ ID NO: 5958631 - DNA, 18 bp, Homo sapiens
ttaacttatgtctcttgt

SEQ ID NO: 5958632 - DNA, 20 bp, Homo sapiens
ttaacttatttatatgaagc

SEQ ID NO: 5958633 - DNA, 21 bp, Homo sapiens
ttaacttatttatatgaagca

SEQ ID NO: 5958634 - DNA, 22 bp, Homo sapiens
ttaacttcagagggaaagtaaa

SEQ ID NO: 5958635 - DNA, 16 bp, Homo sapiens
ttaacttccactgtta

SEQ ID NO: 5958636 - DNA, 15 bp, Homo sapiens
ttaacttctgtttta

SEQ ID NO: 5958637 - DNA, 21 bp, Homo sapiens
ttaacttcttcataattttag

SEQ ID NO: 5958638 - DNA, 16 bp, Homo sapiens
ttaacttgaagaaacc

SEQ ID NO: 5958639 - DNA, 17 bp, Homo sapiens
ttaacttgaagaaaccg

SEQ ID NO: 5958640 - DNA, 17 bp, Homo sapiens
ttaacttgagctttaaa

SEQ ID NO: 5958641 - DNA, 22 bp, Homo sapiens
ttaacttgagggtaataaactt

SEQ ID NO: 5958642 - DNA, 12 bp, Homo sapiens
ttaacttgcctc

SEQ ID NO: 5958643 - DNA, 16 bp, Homo sapiens
ttaacttggagtttca

SEQ ID NO: 5958644 - DNA, 11 bp, Homo sapiens
ttaacttgtat

SEQ ID NO: 5958645 - DNA, 14 bp, Homo sapiens
ttaacttgtctttt

SEQ ID NO: 5958646 - DNA, 20 bp, Homo sapiens
ttaatgtatatttgctgcaa

SEQ ID NO: 5958647 - DNA, 22 bp, Homo sapiens
ttaatgtatatttgctgcaaag

SEQ ID NO: 5958648 - DNA, 10 bp, Homo sapiens
ttaatgtatc

SEQ ID NO: 5958649 - DNA, 17 bp, Homo sapiens
ttaatgtatcaaactgt

SEQ ID NO: 5958650 - DNA, 20 bp, Homo sapiens
ttaatgtatctatttgtaca

SEQ ID NO: 5958651 - DNA, 21 bp, Homo sapiens
ttaatgtatctatttgtacaa

SEQ ID NO: 5958652 - DNA, 12 bp, Homo sapiens
ttaatgtatctt

SEQ ID NO: 5958653 - DNA, 14 bp, Homo sapiens
ttaatgtatcttaa

SEQ ID NO: 5958654 - DNA, 15 bp, Homo sapiens
ttaatgtatcttaaa

SEQ ID NO: 5958655 - DNA, 13 bp, Homo sapiens
ttaatgtatgtta

SEQ ID NO: 5958656 - DNA, 15 bp, Homo sapiens
ttaatgtatgttacc

SEQ ID NO: 5958657 - DNA, 18 bp, Homo sapiens
ttaatgtatgttaccaaa

SEQ ID NO: 5958658 - DNA, 16 bp, Homo sapiens
ttaatgtcagtctaca

SEQ ID NO: 5958659 - DNA, 18 bp, Homo sapiens
ttaatgtcattgctaaaa

SEQ ID NO: 5958660 - DNA, 22 bp, Homo sapiens
ttaatgtcctctcaaagtaaaa

SEQ ID NO: 5958661 - DNA, 23 bp, Homo sapiens
ttaatgtctcctttgctcttgcc

SEQ ID NO: 5958662 - DNA, 21 bp, Homo sapiens
ttaatgtctggtgtttgtcat

SEQ ID NO: 5958663 - DNA, 23 bp, Homo sapiens
ttaatgtctggtgtttgtcatgg

SEQ ID NO: 5958664 - DNA, 15 bp, Homo sapiens
ttaatgtctttgtgt

SEQ ID NO: 5958665 - DNA, 17 bp, Homo sapiens
ttaatgtgaactctccc

SEQ ID NO: 5958666 - DNA, 19 bp, Homo sapiens
ttaatgtgaacttgtagct

SEQ ID NO: 5958667 - DNA, 11 bp, Homo sapiens
ttaatgtgaat

SEQ ID NO: 5958668 - DNA, 12 bp, Homo sapiens
ttaatgtgaatt

SEQ ID NO: 5958669 - DNA, 15 bp, Homo sapiens
ttaatgtgaattttt

SEQ ID NO: 5958670 - DNA, 22 bp, Homo sapiens
ttaatgtgaatttttgcctatc

SEQ ID NO: 5958671 - DNA, 19 bp, Homo sapiens
ttaatgtgagacagcaagt

SEQ ID NO: 5958672 - DNA, 11 bp, Homo sapiens
ttaatgtgagt

SEQ ID NO: 5958673 - DNA, 23 bp, Homo sapiens
ttaatgtgatggatggcacaatg

SEQ ID NO: 5958674 - DNA, 16 bp, Homo sapiens
ttaatgtgccaaaatg

SEQ ID NO: 5958675 - DNA, 14 bp, Homo sapiens
ttaatgtgctgtgt

SEQ ID NO: 5958676 - DNA, 17 bp, Homo sapiens
ttaatgtgctgtgtaaa

SEQ ID NO: 5958677 - DNA, 18 bp, Homo sapiens
ttaatgtgctgtgtaaag

SEQ ID NO: 5958678 - DNA, 21 bp, Homo sapiens
ttaatgtgctgtgtaaagtta

SEQ ID NO: 5958679 - DNA, 22 bp, Homo sapiens
ttaatgtgctgtgtaaagttag

SEQ ID NO: 5958680 - DNA, 16 bp, Homo sapiens
ttaatgtggttgaaga

SEQ ID NO: 5958681 - DNA, 19 bp, Homo sapiens
ttaatgtgtatttactgta

SEQ ID NO: 5958682 - DNA, 19 bp, Homo sapiens
ttaatgtgtgtctgaagac

SEQ ID NO: 5958683 - DNA, 22 bp, Homo sapiens
ttaatgtgttgggaaaaaggcc

SEQ ID NO: 5958684 - DNA, 22 bp, Homo sapiens
ttaatgttaactttcaaatcca

SEQ ID NO: 5958685 - DNA, 14 bp, Homo sapiens
ttaatgttaattat

SEQ ID NO: 5958686 - DNA, 22 bp, Homo sapiens
ttaatgttaggggtatttaatg

SEQ ID NO: 5958687 - DNA, 23 bp, Homo sapiens
ttaatgttatttggaattttaag

SEQ ID NO: 5958688 - DNA, 13 bp, Homo sapiens
ttaatgttcacat

SEQ ID NO: 5958689 - DNA, 16 bp, Homo sapiens
ttaatgttcattttct

SEQ ID NO: 5958690 - DNA, 20 bp, Homo sapiens
ttaatgttctatataatttt

SEQ ID NO: 5958691 - DNA, 13 bp, Homo sapiens
ttaatgttgaatg

SEQ ID NO: 5958692 - DNA, 19 bp, Homo sapiens
ttaatgttgaatgctgctt

SEQ ID NO: 5958693 - DNA, 22 bp, Homo sapiens
ttaatgttgggatttatatcta

SEQ ID NO: 5958694 - DNA, 23 bp, Homo sapiens
ttaatgttgggatttatatctat

SEQ ID NO: 5958695 - DNA, 18 bp, Homo sapiens
ttaatgtttagtcagtgt

SEQ ID NO: 5958696 - DNA, 23 bp, Homo sapiens
ttaatgtttatacagagtaatta

SEQ ID NO: 5958697 - DNA, 17 bp, Homo sapiens
ttaatgtttattattta

SEQ ID NO: 5958698 - DNA, 10 bp, Homo sapiens
ttaatgtttc

SEQ ID NO: 5958699 - DNA, 11 bp, Homo sapiens
ttaatgtttct

SEQ ID NO: 5958700 - DNA, 15 bp, Homo sapiens
ttaatgtttcttaga

SEQ ID NO: 5958701 - DNA, 18 bp, Homo sapiens
ttaatgtttgatttagta

SEQ ID NO: 5958702 - DNA, 16 bp, Homo sapiens
ttaatgttttaaatgt

SEQ ID NO: 5958703 - DNA, 23 bp, Homo sapiens
ttaatgttttaaatgtacagaca

SEQ ID NO: 5958704 - DNA, 14 bp, Homo sapiens
ttaatgttttcaaa

SEQ ID NO: 5958705 - DNA, 22 bp, Homo sapiens
ttaatgttttcattatgttcat

SEQ ID NO: 5958706 - DNA, 11 bp, Homo sapiens
ttaatgttttt

SEQ ID NO: 5958707 - DNA, 18 bp, Homo sapiens
ttaatgtttttaaatata

SEQ ID NO: 5958708 - DNA, 23 bp, Homo sapiens
ttaattaaaaactttaaagataa

SEQ ID NO: 5958709 - DNA, 13 bp, Homo sapiens
ttaattaaaaatt

SEQ ID NO: 5958710 - DNA, 15 bp, Homo sapiens
ttaattaacatcaaa

SEQ ID NO: 5958711 - DNA, 14 bp, Homo sapiens
ttaattaagtaaac

SEQ ID NO: 5958712 - DNA, 21 bp, Homo sapiens
ttaattaagtaaactaatgag

SEQ ID NO: 5958713 - DNA, 20 bp, Homo sapiens
ttaattaatgaaatatctgt

SEQ ID NO: 5958714 - DNA, 15 bp, Homo sapiens
ttaattaattaacat

SEQ ID NO: 5958715 - DNA, 13 bp, Homo sapiens
ttaattaattctc

SEQ ID NO: 5958716 - DNA, 20 bp, Homo sapiens
ttaattaatttgattaacaa

SEQ ID NO: 5958717 - DNA, 13 bp, Homo sapiens
ttaattaccttta

SEQ ID NO: 5958718 - DNA, 14 bp, Homo sapiens
ttaattacttaaaa

SEQ ID NO: 5958719 - DNA, 18 bp, Homo sapiens
ttaattagcattctggca

SEQ ID NO: 5958720 - DNA, 18 bp, Homo sapiens
ttaattagtgctaagtgt

SEQ ID NO: 5958721 - DNA, 12 bp, Homo sapiens
ttaattataaaa

SEQ ID NO: 5958722 - DNA, 13 bp, Homo sapiens
ttaattataaaca

SEQ ID NO: 5958723 - DNA, 15 bp, Homo sapiens
ttaattataaacagc

SEQ ID NO: 5958724 - DNA, 17 bp, Homo sapiens
ttaattataaacagcag

SEQ ID NO: 5958725 - DNA, 22 bp, Homo sapiens
ttaattatattatgaataaaat

SEQ ID NO: 5958726 - DNA, 14 bp, Homo sapiens
ttaattatatttgc

SEQ ID NO: 5958727 - DNA, 22 bp, Homo sapiens
ttaattatgccttttttgatca

SEQ ID NO: 5958728 - DNA, 18 bp, Homo sapiens
ttaattatgtacaacatt

SEQ ID NO: 5958729 - DNA, 22 bp, Homo sapiens
ttaattatgtgtagttataaac

SEQ ID NO: 5958730 - DNA, 17 bp, Homo sapiens
ttaattattaactacat

SEQ ID NO: 5958731 - DNA, 18 bp, Homo sapiens
ttaattattaactacatt

SEQ ID NO: 5958732 - DNA, 17 bp, Homo sapiens
ttaattattattcttca

SEQ ID NO: 5958733 - DNA, 14 bp, Homo sapiens
ttaattattgtaca

SEQ ID NO: 5958734 - DNA, 23 bp, Homo sapiens
ttaattcaacatcaaaacttaag

SEQ ID NO: 5958735 - DNA, 18 bp, Homo sapiens
ttaattcaagaaatgaca

SEQ ID NO: 5958736 - DNA, 19 bp, Homo sapiens
ttaattcaattaaaaccat

SEQ ID NO: 5958737 - DNA, 19 bp, Homo sapiens
ttaattcacctatgttatt

SEQ ID NO: 5958738 - DNA, 14 bp, Homo sapiens
ttaattcaggtatg

SEQ ID NO: 5958739 - DNA, 13 bp, Homo sapiens
ttaattcatgttt

SEQ ID NO: 5958740 - DNA, 19 bp, Homo sapiens
ttaattccaatatgatgac

SEQ ID NO: 5958741 - DNA, 17 bp, Homo sapiens
ttaattccaattatatg

SEQ ID NO: 5958742 - DNA, 23 bp, Homo sapiens
ttaattccatattgatgaagatg

SEQ ID NO: 5958743 - DNA, 16 bp, Homo sapiens
ttaattccatgtcaga

SEQ ID NO: 5958744 - DNA, 18 bp, Homo sapiens
ttaattccatgtcagata

SEQ ID NO: 5958745 - DNA, 19 bp, Homo sapiens
ttaattcctggaaaactgg

SEQ ID NO: 5958746 - DNA, 12 bp, Homo sapiens
ttaattcctggg

SEQ ID NO: 5958747 - DNA, 20 bp, Homo sapiens
ttaattccttcagcacttta

SEQ ID NO: 5958748 - DNA, 14 bp, Homo sapiens
ttaattctcagcca

SEQ ID NO: 5958749 - DNA, 21 bp, Homo sapiens
ttaattctcagccatgtgctt

SEQ ID NO: 5958750 - DNA, 14 bp, Homo sapiens
ttaattctcattat

SEQ ID NO: 5958751 - DNA, 22 bp, Homo sapiens
ttaattctctgttccttttgca

SEQ ID NO: 5958752 - DNA, 22 bp, Homo sapiens
ttaattctgttctgatattaat

SEQ ID NO: 5958753 - DNA, 15 bp, Homo sapiens
ttaattcttaaaact

SEQ ID NO: 5958754 - DNA, 17 bp, Homo sapiens
ttaattcttaccgaaat

SEQ ID NO: 5958755 - DNA, 15 bp, Homo sapiens
ttaattcttacctca

SEQ ID NO: 5958756 - DNA, 17 bp, Homo sapiens
ttaattcttacctcatt

SEQ ID NO: 5958757 - DNA, 20 bp, Homo sapiens
ttaattcttacctcatttgc

SEQ ID NO: 5958758 - DNA, 23 bp, Homo sapiens
ttaattcttacctcatttgcatc

SEQ ID NO: 5958759 - DNA, 16 bp, Homo sapiens
ttaattcttatttctg

SEQ ID NO: 5958760 - DNA, 16 bp, Homo sapiens
ttaattcttcacctgt

SEQ ID NO: 5958761 - DNA, 21 bp, Homo sapiens
ttaattcttcacctgttatgt

SEQ ID NO: 5958762 - DNA, 15 bp, Homo sapiens
ttaattcttcacctt

SEQ ID NO: 5958763 - DNA, 13 bp, Homo sapiens
ttaattctttcta

SEQ ID NO: 5958764 - DNA, 12 bp, Homo sapiens
ttaattgaaagg

SEQ ID NO: 5958765 - DNA, 15 bp, Homo sapiens
ttaattgaaagtata

SEQ ID NO: 5958766 - DNA, 13 bp, Homo sapiens
ttaattgaaatac

SEQ ID NO: 5958767 - DNA, 21 bp, Homo sapiens
ttaattgaagaactgcacttt

SEQ ID NO: 5958768 - DNA, 14 bp, Homo sapiens
ttaattgaaggaaa

SEQ ID NO: 5958769 - DNA, 15 bp, Homo sapiens
ttaattgaaggaaag

SEQ ID NO: 5958770 - DNA, 23 bp, Homo sapiens
ttaattgactgaaattactttaa

SEQ ID NO: 5958771 - DNA, 16 bp, Homo sapiens
ttaattgatcagtttt

SEQ ID NO: 5958772 - DNA, 22 bp, Homo sapiens
ttaattgattattctgattcca

SEQ ID NO: 5958773 - DNA, 18 bp, Homo sapiens
ttaattgcaacaatgcaa

SEQ ID NO: 5958774 - DNA, 12 bp, Homo sapiens
ttaattgctgca

SEQ ID NO: 5958775 - DNA, 15 bp, Homo sapiens
ttaattgctttaaat

SEQ ID NO: 5958776 - DNA, 14 bp, Homo sapiens
ttaattgctttgaa

SEQ ID NO: 5958777 - DNA, 16 bp, Homo sapiens
ttaattgctttgaagc

SEQ ID NO: 5958778 - DNA, 13 bp, Homo sapiens
ttaattggccatg

SEQ ID NO: 5958779 - DNA, 20 bp, Homo sapiens
ttaattggtttaaagtccct

SEQ ID NO: 5958780 - DNA, 15 bp, Homo sapiens
ttaattgtaaagtaa

SEQ ID NO: 5958781 - DNA, 19 bp, Homo sapiens
ttaattgtagttctgtgta

SEQ ID NO: 5958782 - DNA, 16 bp, Homo sapiens
ttaattgtataagtca

SEQ ID NO: 5958783 - DNA, 12 bp, Homo sapiens
ttaattgtattt

SEQ ID NO: 5958784 - DNA, 12 bp, Homo sapiens
ttaattgtcatg

SEQ ID NO: 5958785 - DNA, 18 bp, Homo sapiens
ttaattgtggctttatga

SEQ ID NO: 5958786 - DNA, 17 bp, Homo sapiens
ttaattgtgtaactgtt

SEQ ID NO: 5958787 - DNA, 23 bp, Homo sapiens
ttaattgtgtaactgttctttgc

SEQ ID NO: 5958788 - DNA, 16 bp, Homo sapiens
ttaattgtgtgaactt

SEQ ID NO: 5958789 - DNA, 15 bp, Homo sapiens
ttaattgtgtttatt

SEQ ID NO: 5958790 - DNA, 13 bp, Homo sapiens
ttaattgttgttt

SEQ ID NO: 5958791 - DNA, 19 bp, Homo sapiens
ttaattgttgtttctttct

SEQ ID NO: 5958792 - DNA, 22 bp, Homo sapiens
ttaattgttgtttctttctagt

SEQ ID NO: 5958793 - DNA, 18 bp, Homo sapiens
ttaatttaaacacctcct

SEQ ID NO: 5958794 - DNA, 23 bp, Homo sapiens
ttaatttaaatgatttaaattta

SEQ ID NO: 5958795 - DNA, 15 bp, Homo sapiens
ttaatttaacaaact

SEQ ID NO: 5958796 - DNA, 15 bp, Homo sapiens
ttaatttaagttttg

SEQ ID NO: 5958797 - DNA, 15 bp, Homo sapiens
ttaatttaatgtatt

SEQ ID NO: 5958798 - DNA, 23 bp, Homo sapiens
ttaatttacaaaaatataaaata

SEQ ID NO: 5958799 - DNA, 16 bp, Homo sapiens
ttaatttagaaactga

SEQ ID NO: 5958800 - DNA, 18 bp, Homo sapiens
ttaatttagaaactgaaa

SEQ ID NO: 5958801 - DNA, 20 bp, Homo sapiens
ttaatttagaaactgaaaaa

SEQ ID NO: 5958802 - DNA, 23 bp, Homo sapiens
ttaatttagcagtccatttttga

SEQ ID NO: 5958803 - DNA, 17 bp, Homo sapiens
ttaatttagtaaatgtt

SEQ ID NO: 5958804 - DNA, 18 bp, Homo sapiens
ttaatttagtaaatgtta

SEQ ID NO: 5958805 - DNA, 19 bp, Homo sapiens
ttaatttataatgtatttg

SEQ ID NO: 5958806 - DNA, 16 bp, Homo sapiens
ttaatttatactggca

SEQ ID NO: 5958807 - DNA, 19 bp, Homo sapiens
ttaatttatatttgaaatt

SEQ ID NO: 5958808 - DNA, 13 bp, Homo sapiens
ttaatttatctgt

SEQ ID NO: 5958809 - DNA, 15 bp, Homo sapiens
ttaatttatgagttt

SEQ ID NO: 5958810 - DNA, 18 bp, Homo sapiens
ttaatttatgagtttttg

SEQ ID NO: 5958811 - DNA, 12 bp, Homo sapiens
ttaatttatggt

SEQ ID NO: 5958812 - DNA, 15 bp, Homo sapiens
ttaatttatttagtt

SEQ ID NO: 5958813 - DNA, 16 bp, Homo sapiens
ttaatttattttgctc

SEQ ID NO: 5958814 - DNA, 20 bp, Homo sapiens
ttaatttattttgctccctc

SEQ ID NO: 5958815 - DNA, 21 bp, Homo sapiens
ttaatttattttgctccctct

SEQ ID NO: 5958816 - DNA, 12 bp, Homo sapiens
ttaatttcaaat

SEQ ID NO: 5958817 - DNA, 15 bp, Homo sapiens
ttaatttcaggaaaa

SEQ ID NO: 5958818 - DNA, 13 bp, Homo sapiens
ttaatttcagtcc

SEQ ID NO: 5958819 - DNA, 14 bp, Homo sapiens
ttaatttcataaat

SEQ ID NO: 5958820 - DNA, 17 bp, Homo sapiens
ttaatttcataaattgg

SEQ ID NO: 5958821 - DNA, 21 bp, Homo sapiens
ttaatttcatgtatatctaac

SEQ ID NO: 5958822 - DNA, 18 bp, Homo sapiens
ttaatttccaggaaaaaa

SEQ ID NO: 5958823 - DNA, 11 bp, Homo sapiens
ttaatttcctt

SEQ ID NO: 5958824 - DNA, 16 bp, Homo sapiens
ttaatttccttctgtt

SEQ ID NO: 5958825 - DNA, 19 bp, Homo sapiens
ttacagttctttcctcttt

SEQ ID NO: 5958826 - DNA, 14 bp, Homo sapiens
ttacagttgcattt

SEQ ID NO: 5958827 - DNA, 18 bp, Homo sapiens
ttacagtttattttctgt

SEQ ID NO: 5958828 - DNA, 20 bp, Homo sapiens
ttacagtttattttctgtgt

SEQ ID NO: 5958829 - DNA, 21 bp, Homo sapiens
ttacagtttattttctgtgta

SEQ ID NO: 5958830 - DNA, 22 bp, Homo sapiens
ttacagtttattttctgtgtaa

SEQ ID NO: 5958831 - DNA, 23 bp, Homo sapiens
ttacagtttattttctgtgtaaa

SEQ ID NO: 5958832 - DNA, 15 bp, Homo sapiens
ttacagtttcttcat

SEQ ID NO: 5958833 - DNA, 19 bp, Homo sapiens
ttacagtttcttcatgcat

SEQ ID NO: 5958834 - DNA, 19 bp, Homo sapiens
ttacagtttttttctttgt

SEQ ID NO: 5958835 - DNA, 16 bp, Homo sapiens
ttacataaagctccct

SEQ ID NO: 5958836 - DNA, 19 bp, Homo sapiens
ttacataaagctcccttga

SEQ ID NO: 5958837 - DNA, 14 bp, Homo sapiens
ttacataaataaat

SEQ ID NO: 5958838 - DNA, 12 bp, Homo sapiens
ttacataacagg

SEQ ID NO: 5958839 - DNA, 15 bp, Homo sapiens
ttacataacaggcat

SEQ ID NO: 5958840 - DNA, 21 bp, Homo sapiens
ttacataacaggcattgcact

SEQ ID NO: 5958841 - DNA, 22 bp, Homo sapiens
ttacataacaggcattgcacta

SEQ ID NO: 5958842 - DNA, 13 bp, Homo sapiens
ttacataactgcc

SEQ ID NO: 5958843 - DNA, 18 bp, Homo sapiens
ttacataaggatgacttt

SEQ ID NO: 5958844 - DNA, 21 bp, Homo sapiens
ttacataatttagttgtttct

SEQ ID NO: 5958845 - DNA, 14 bp, Homo sapiens
ttacatacagtgat

SEQ ID NO: 5958846 - DNA, 22 bp, Homo sapiens
ttacatacagtgatatggtact

SEQ ID NO: 5958847 - DNA, 17 bp, Homo sapiens
ttacatactaggtgcct

SEQ ID NO: 5958848 - DNA, 14 bp, Homo sapiens
ttacatactgctgt

SEQ ID NO: 5958849 - DNA, 17 bp, Homo sapiens
ttacatacttttgcaaa

SEQ ID NO: 5958850 - DNA, 18 bp, Homo sapiens
ttacatagatcagccatt

SEQ ID NO: 5958851 - DNA, 23 bp, Homo sapiens
ttacatagatcagccattaaaat

SEQ ID NO: 5958852 - DNA, 22 bp, Homo sapiens
ttacatagctttagagaagcca

SEQ ID NO: 5958853 - DNA, 16 bp, Homo sapiens
ttacatagtaaatggt

SEQ ID NO: 5958854 - DNA, 16 bp, Homo sapiens
ttacatagtgtaggct

SEQ ID NO: 5958855 - DNA, 21 bp, Homo sapiens
ttacatagtgtaggctttact

SEQ ID NO: 5958856 - DNA, 22 bp, Homo sapiens
ttacatagttttaaactcattt

SEQ ID NO: 5958857 - DNA, 12 bp, Homo sapiens
ttacatataata

SEQ ID NO: 5958858 - DNA, 16 bp, Homo sapiens
ttacatataataaata

SEQ ID NO: 5958859 - DNA, 18 bp, Homo sapiens
ttacatataataaataga

SEQ ID NO: 5958860 - DNA, 12 bp, Homo sapiens
ttacatatctga

SEQ ID NO: 5958861 - DNA, 15 bp, Homo sapiens
ttacatattcctttg

SEQ ID NO: 5958862 - DNA, 19 bp, Homo sapiens
ttacatcagaagtttgcat

SEQ ID NO: 5958863 - DNA, 20 bp, Homo sapiens
ttacatcagaagtttgcatc

SEQ ID NO: 5958864 - DNA, 14 bp, Homo sapiens
ttacatcatttctt

SEQ ID NO: 5958865 - DNA, 14 bp, Homo sapiens
ttacatcatttttg

SEQ ID NO: 5958866 - DNA, 18 bp, Homo sapiens
ttacatcatttttgtatc

SEQ ID NO: 5958867 - DNA, 20 bp, Homo sapiens
ttacatcatttttgtatcta

SEQ ID NO: 5958868 - DNA, 17 bp, Homo sapiens
ttacatccatcgtaatt

SEQ ID NO: 5958869 - DNA, 20 bp, Homo sapiens
ttacatcctgctacactcat

SEQ ID NO: 5958870 - DNA, 13 bp, Homo sapiens
ttacatctaagaa

SEQ ID NO: 5958871 - DNA, 16 bp, Homo sapiens
ttacatctaagaattt

SEQ ID NO: 5958872 - DNA, 13 bp, Homo sapiens
ttacatctaatgc

SEQ ID NO: 5958873 - DNA, 24 bp, Homo sapiens
ttacatctatgtgtatgttgactt

SEQ ID NO: 5958874 - DNA, 21 bp, Homo sapiens
ttacatctgaacaaaatgcct

SEQ ID NO: 5958875 - DNA, 12 bp, Homo sapiens
ttacatctgtgc

SEQ ID NO: 5958876 - DNA, 21 bp, Homo sapiens
ttacatctgtgcagggctggt

SEQ ID NO: 5958877 - DNA, 18 bp, Homo sapiens
ttacatctgttttaaatt

SEQ ID NO: 5958878 - DNA, 12 bp, Homo sapiens
ttacatcttgta

SEQ ID NO: 5958879 - DNA, 21 bp, Homo sapiens
ttacatcttgttggtaccttt

SEQ ID NO: 5958880 - DNA, 20 bp, Homo sapiens
ttacatctttattaacctca

SEQ ID NO: 5958881 - DNA, 19 bp, Homo sapiens
ttacatctttgtttaccat

SEQ ID NO: 5958882 - DNA, 16 bp, Homo sapiens
ttacatcttttctaat

SEQ ID NO: 5958883 - DNA, 17 bp, Homo sapiens
ttacatcttttctaatc

SEQ ID NO: 5958884 - DNA, 12 bp, Homo sapiens
ttacatgaagct

SEQ ID NO: 5958885 - DNA, 13 bp, Homo sapiens
ttacatgaagtat

SEQ ID NO: 5958886 - DNA, 16 bp, Homo sapiens
ttacatgaagtatttt

SEQ ID NO: 5958887 - DNA, 10 bp, Homo sapiens
ttacatgacc

SEQ ID NO: 5958888 - DNA, 12 bp, Homo sapiens
ttacatgacttt

SEQ ID NO: 5958889 - DNA, 15 bp, Homo sapiens
ttacatgagaacaga

SEQ ID NO: 5958890 - DNA, 20 bp, Homo sapiens
ttacatgagttcaaatactt

SEQ ID NO: 5958891 - DNA, 15 bp, Homo sapiens
ttacatgatttaaag

SEQ ID NO: 5958892 - DNA, 13 bp, Homo sapiens
ttacatgcataaa

SEQ ID NO: 5958893 - DNA, 21 bp, Homo sapiens
ttacatgcatacttcaaaagt

SEQ ID NO: 5958894 - DNA, 12 bp, Homo sapiens
ttacatgcatga

SEQ ID NO: 5958895 - DNA, 22 bp, Homo sapiens
ttacatgcattactgcatgcac

SEQ ID NO: 5958896 - DNA, 14 bp, Homo sapiens
ttacatgcttattc

SEQ ID NO: 5958897 - DNA, 19 bp, Homo sapiens
ttacatgcttattccatga

SEQ ID NO: 5958898 - DNA, 23 bp, Homo sapiens
ttacatggcgccctgcctcctgg

SEQ ID NO: 5958899 - DNA, 22 bp, Homo sapiens
ttacatggctggagctagaatt

SEQ ID NO: 5958900 - DNA, 23 bp, Homo sapiens
ttacatggctggagctagaattt

SEQ ID NO: 5958901 - DNA, 21 bp, Homo sapiens
ttacatggtgtaaatattagt

SEQ ID NO: 5958902 - DNA, 14 bp, Homo sapiens
ttacatgtaaagct

SEQ ID NO: 5958903 - DNA, 14 bp, Homo sapiens
ttacatgtaaatta

SEQ ID NO: 5958904 - DNA, 16 bp, Homo sapiens
ttacatgtaaattaag

SEQ ID NO: 5958905 - DNA, 15 bp, Homo sapiens
ttacatgtaatttga

SEQ ID NO: 5958906 - DNA, 20 bp, Homo sapiens
ttacatgtaatttgatgagg

SEQ ID NO: 5958907 - DNA, 13 bp, Homo sapiens
ttacatgtatggt

SEQ ID NO: 5958908 - DNA, 17 bp, Homo sapiens
ttacatgtattatttca

SEQ ID NO: 5958909 - DNA, 23 bp, Homo sapiens
ttacatgttgtattagtaaatta

SEQ ID NO: 5958910 - DNA, 13 bp, Homo sapiens
ttacatgtttgca

SEQ ID NO: 5958911 - DNA, 22 bp, Homo sapiens
ttacattaaaatagcacatgat

SEQ ID NO: 5958912 - DNA, 13 bp, Homo sapiens
ttacattaacatt

SEQ ID NO: 5958913 - DNA, 16 bp, Homo sapiens
ttacattaatgttaat

SEQ ID NO: 5958914 - DNA, 13 bp, Homo sapiens
ttacattaggaag

SEQ ID NO: 5958915 - DNA, 17 bp, Homo sapiens
ttacattatgcaaataa

SEQ ID NO: 5958916 - DNA, 12 bp, Homo sapiens
ttacattatgcc

SEQ ID NO: 5958917 - DNA, 13 bp, Homo sapiens
ttacattatgccc

SEQ ID NO: 5958918 - DNA, 21 bp, Homo sapiens
ttacattattaatcattccat

SEQ ID NO: 5958919 - DNA, 18 bp, Homo sapiens
ttacattcctaactagaa

SEQ ID NO: 5958920 - DNA, 19 bp, Homo sapiens
ttacattcctaactagaat

SEQ ID NO: 5958921 - DNA, 12 bp, Homo sapiens
ttacattcctag

SEQ ID NO: 5958922 - DNA, 16 bp, Homo sapiens
ttacattctctaataa

SEQ ID NO: 5958923 - DNA, 14 bp, Homo sapiens
ttacattgcagaac

SEQ ID NO: 5958924 - DNA, 16 bp, Homo sapiens
ttacattgcattcaaa

SEQ ID NO: 5958925 - DNA, 15 bp, Homo sapiens
ttacattgccatttt

SEQ ID NO: 5958926 - DNA, 19 bp, Homo sapiens
ttacattgctggtcttgta

SEQ ID NO: 5958927 - DNA, 21 bp, Homo sapiens
ttacattgctggtcttgtaag

SEQ ID NO: 5958928 - DNA, 15 bp, Homo sapiens
ttacattgtcattta

SEQ ID NO: 5958929 - DNA, 15 bp, Homo sapiens
ttacattgtcctgta

SEQ ID NO: 5958930 - DNA, 21 bp, Homo sapiens
ttacattgtcctgtagcttta

SEQ ID NO: 5958931 - DNA, 13 bp, Homo sapiens
ttacattgttcaa

SEQ ID NO: 5958932 - DNA, 15 bp, Homo sapiens
ttacatttaaagcat

SEQ ID NO: 5958933 - DNA, 16 bp, Homo sapiens
ttacatttaaagcatt

SEQ ID NO: 5958934 - DNA, 21 bp, Homo sapiens
ttacatttatgtgctgttaga

SEQ ID NO: 5958935 - DNA, 15 bp, Homo sapiens
ttacatttgaataat

SEQ ID NO: 5958936 - DNA, 20 bp, Homo sapiens
ttacatttgatgcatgtctt

SEQ ID NO: 5958937 - DNA, 20 bp, Homo sapiens
ttacatttggattagaaatt

SEQ ID NO: 5958938 - DNA, 19 bp, Homo sapiens
ttacatttgtatttttcca

SEQ ID NO: 5958939 - DNA, 11 bp, Homo sapiens
ttacattttaa

SEQ ID NO: 5958940 - DNA, 12 bp, Homo sapiens
ttacattttata

SEQ ID NO: 5958941 - DNA, 20 bp, Homo sapiens
ttacattttattaagctttt

SEQ ID NO: 5958942 - DNA, 12 bp, Homo sapiens
ttacattttcag

SEQ ID NO: 5958943 - DNA, 12 bp, Homo sapiens
ttacattttccc

SEQ ID NO: 5958944 - DNA, 17 bp, Homo sapiens
ttacattttcctgtgta

SEQ ID NO: 5958945 - DNA, 18 bp, Homo sapiens
ttacattttcctgtgtaa

SEQ ID NO: 5958946 - DNA, 11 bp, Homo sapiens
ttacattttct

SEQ ID NO: 5958947 - DNA, 16 bp, Homo sapiens
ttacattttctttcat

SEQ ID NO: 5958948 - DNA, 17 bp, Homo sapiens
ttacatttttaagtgct

SEQ ID NO: 5958949 - DNA, 21 bp, Homo sapiens
ttacatttttaagtgctgcat

SEQ ID NO: 5958950 - DNA, 22 bp, Homo sapiens
ttacatttttaagtgctgcatt

SEQ ID NO: 5958951 - DNA, 21 bp, Homo sapiens
ttacatttttacaataaataa

SEQ ID NO: 5958952 - DNA, 15 bp, Homo sapiens
ttacatttttattta

SEQ ID NO: 5958953 - DNA, 18 bp, Homo sapiens
ttacatttttatttatga

SEQ ID NO: 5958954 - DNA, 19 bp, Homo sapiens
ttacatttttatttatgaa

SEQ ID NO: 5958955 - DNA, 22 bp, Homo sapiens
ttacatttttatttatgaagtt

SEQ ID NO: 5958956 - DNA, 17 bp, Homo sapiens
ttacatttttctgatgg

SEQ ID NO: 5958957 - DNA, 19 bp, Homo sapiens
ttacatttttgtggttttg

SEQ ID NO: 5958958 - DNA, 21 bp, Homo sapiens
ttacattttttgggcagcaat

SEQ ID NO: 5958959 - DNA, 21 bp, Homo sapiens
ttaccaaaaataaatatatct

SEQ ID NO: 5958960 - DNA, 13 bp, Homo sapiens
ttaccaaaacagg

SEQ ID NO: 5958961 - DNA, 21 bp, Homo sapiens
ttaccaaaattcactaatctt

SEQ ID NO: 5958962 - DNA, 14 bp, Homo sapiens
ttaccaaacagcaa

SEQ ID NO: 5958963 - DNA, 17 bp, Homo sapiens
ttaccaaacagcaaacc

SEQ ID NO: 5958964 - DNA, 20 bp, Homo sapiens
ttaccaaacagcaaaccaag

SEQ ID NO: 5958965 - DNA, 19 bp, Homo sapiens
ttaccaaaggtttttaaag

SEQ ID NO: 5958966 - DNA, 21 bp, Homo sapiens
ttaccaaatacacatttcaca

SEQ ID NO: 5958967 - DNA, 22 bp, Homo sapiens
ttaccaaatacacatttcacat

SEQ ID NO: 5958968 - DNA, 23 bp, Homo sapiens
ttaccaaatgaaatgccaaagga

SEQ ID NO: 5958969 - DNA, 21 bp, Homo sapiens
ttaccaaattgcttgagcctg

SEQ ID NO: 5958970 - DNA, 13 bp, Homo sapiens
ttaccaacctgtt

SEQ ID NO: 5958971 - DNA, 20 bp, Homo sapiens
ttaccaacctgttacctact

SEQ ID NO: 5958972 - DNA, 22 bp, Homo sapiens
ttaccaacttcctctgccatgt

SEQ ID NO: 5958973 - DNA, 13 bp, Homo sapiens
ttaccaactttct

SEQ ID NO: 5958974 - DNA, 14 bp, Homo sapiens
ttaccaactttctg

SEQ ID NO: 5958975 - DNA, 16 bp, Homo sapiens
ttaccaactttctgta

SEQ ID NO: 5958976 - DNA, 18 bp, Homo sapiens
ttaccaactttctgtaaa

SEQ ID NO: 5958977 - DNA, 13 bp, Homo sapiens
ttaccaagaagcc

SEQ ID NO: 5958978 - DNA, 20 bp, Homo sapiens
ttaccaataggcaaattaat

SEQ ID NO: 5958979 - DNA, 18 bp, Homo sapiens
ttaccaatgtaacactgg

SEQ ID NO: 5958980 - DNA, 12 bp, Homo sapiens
ttaccaattcca

SEQ ID NO: 5958981 - DNA, 20 bp, Homo sapiens
ttaccacacatctatgatat

SEQ ID NO: 5958982 - DNA, 20 bp, Homo sapiens
ttaccacagagttttttaaa

SEQ ID NO: 5958983 - DNA, 18 bp, Homo sapiens
ttaccacaggatgcatat

SEQ ID NO: 5958984 - DNA, 19 bp, Homo sapiens
ttaccacaggatgcatatt

SEQ ID NO: 5958985 - DNA, 14 bp, Homo sapiens
ttaccactaatttt

SEQ ID NO: 5958986 - DNA, 14 bp, Homo sapiens
ttaccactcaggca

SEQ ID NO: 5958987 - DNA, 21 bp, Homo sapiens
ttaccactggtaacatgtgac

SEQ ID NO: 5958988 - DNA, 21 bp, Homo sapiens
ttaccacttgtgttttgcaag

SEQ ID NO: 5958989 - DNA, 15 bp, Homo sapiens
ttaccagaaaatgag

SEQ ID NO: 5958990 - DNA, 15 bp, Homo sapiens
ttaccagacaaaaaa

SEQ ID NO: 5958991 - DNA, 20 bp, Homo sapiens
ttaccagacaaaaaaattta

SEQ ID NO: 5958992 - DNA, 21 bp, Homo sapiens
ttaccagacggttcaccagcc

SEQ ID NO: 5958993 - DNA, 13 bp, Homo sapiens
ttaccagacttca

SEQ ID NO: 5958994 - DNA, 15 bp, Homo sapiens
ttaccagacttcaag

SEQ ID NO: 5958995 - DNA, 19 bp, Homo sapiens
ttaccagagacgcccagcc

SEQ ID NO: 5958996 - DNA, 22 bp, Homo sapiens
ttaccagagacgcccagcccca

SEQ ID NO: 5958997 - DNA, 20 bp, Homo sapiens
ttaccagattcacttctgaa

SEQ ID NO: 5958998 - DNA, 17 bp, Homo sapiens
ttaccagcatttgtcct

SEQ ID NO: 5958999 - DNA, 19 bp, Homo sapiens
ttaccagccccccacccca

SEQ ID NO: 5959000 - DNA, 20 bp, Homo sapiens
ttaccagcctccgtatttca

SEQ ID NO: 5959001 - DNA, 24 bp, Homo sapiens
ttaccagggaccctggagtatttg

SEQ ID NO: 5959002 - DNA, 20 bp, Homo sapiens
ttaccagggactatctttgc

SEQ ID NO: 5959003 - DNA, 14 bp, Homo sapiens
ttacttttaaactg

SEQ ID NO: 5959004 - DNA, 13 bp, Homo sapiens
ttacttttacagt

SEQ ID NO: 5959005 - DNA, 12 bp, Homo sapiens
ttacttttccag

SEQ ID NO: 5959006 - DNA, 13 bp, Homo sapiens
ttacttttctgca

SEQ ID NO: 5959007 - DNA, 21 bp, Homo sapiens
ttacttttgcaaactgtcctc

SEQ ID NO: 5959008 - DNA, 14 bp, Homo sapiens
ttacttttgctgta

SEQ ID NO: 5959009 - DNA, 20 bp, Homo sapiens
ttacttttgtcttcctcact

SEQ ID NO: 5959010 - DNA, 21 bp, Homo sapiens
ttactttttagtcttttactc

SEQ ID NO: 5959011 - DNA, 15 bp, Homo sapiens
ttactttttgctgtt

SEQ ID NO: 5959012 - DNA, 22 bp, Homo sapiens
ttactttttgtaaatgctgtaa

SEQ ID NO: 5959013 - DNA, 21 bp, Homo sapiens
ttactttttttgtagatgaac

SEQ ID NO: 5959014 - DNA, 22 bp, Homo sapiens
ttacttttttttttttttggta

SEQ ID NO: 5959015 - DNA, 18 bp, Homo sapiens
ttagaaaaaactggaaac

SEQ ID NO: 5959016 - DNA, 23 bp, Homo sapiens
ttagaaaaaagtttacaacataa

SEQ ID NO: 5959017 - DNA, 22 bp, Homo sapiens
ttagaaaaagaacatgcagttt

SEQ ID NO: 5959018 - DNA, 15 bp, Homo sapiens
ttagaaaacaaaatt

SEQ ID NO: 5959019 - DNA, 22 bp, Homo sapiens
ttagaaaaccccacagaaatct

SEQ ID NO: 5959020 - DNA, 23 bp, Homo sapiens
ttagaaaaccccacagaaatctc

SEQ ID NO: 5959021 - DNA, 22 bp, Homo sapiens
ttagaaaactcagaatgaaaat

SEQ ID NO: 5959022 - DNA, 14 bp, Homo sapiens
ttagaaaactttaa

SEQ ID NO: 5959023 - DNA, 16 bp, Homo sapiens
ttagaaaactttgtta

SEQ ID NO: 5959024 - DNA, 20 bp, Homo sapiens
ttagaaaagcaaagggtgct

SEQ ID NO: 5959025 - DNA, 13 bp, Homo sapiens
ttagaaaaggaaa

SEQ ID NO: 5959026 - DNA, 12 bp, Homo sapiens
ttagaaaaggca

SEQ ID NO: 5959027 - DNA, 17 bp, Homo sapiens
ttagaaaagtggtgtaa

SEQ ID NO: 5959028 - DNA, 19 bp, Homo sapiens
ttagaaaagttaacattta

SEQ ID NO: 5959029 - DNA, 14 bp, Homo sapiens
ttagaaaatcagat

SEQ ID NO: 5959030 - DNA, 14 bp, Homo sapiens
ttagaaaatgactt

SEQ ID NO: 5959031 - DNA, 17 bp, Homo sapiens
ttagaaaattttgtaaa

SEQ ID NO: 5959032 - DNA, 19 bp, Homo sapiens
ttagaaacacaactatatt

SEQ ID NO: 5959033 - DNA, 16 bp, Homo sapiens
ttagaaacataaataa

SEQ ID NO: 5959034 - DNA, 17 bp, Homo sapiens
ttagaaacatggttttg

SEQ ID NO: 5959035 - DNA, 13 bp, Homo sapiens
ttagaaaccaaat

SEQ ID NO: 5959036 - DNA, 14 bp, Homo sapiens
ttagaaaccaaatt

SEQ ID NO: 5959037 - DNA, 14 bp, Homo sapiens
ttagaaaccttaat

SEQ ID NO: 5959038 - DNA, 16 bp, Homo sapiens
ttagaaactacaaata

SEQ ID NO: 5959039 - DNA, 12 bp, Homo sapiens
ttagaaactgaa

SEQ ID NO: 5959040 - DNA, 18 bp, Homo sapiens
ttagaaactgagtcctgt

SEQ ID NO: 5959041 - DNA, 19 bp, Homo sapiens
ttagaaactgagtcctgtt

SEQ ID NO: 5959042 - DNA, 16 bp, Homo sapiens
ttagaaactgatttct

SEQ ID NO: 5959043 - DNA, 23 bp, Homo sapiens
ttagaaactggaaatactagatt

SEQ ID NO: 5959044 - DNA, 17 bp, Homo sapiens
ttagaaagaaaattata

SEQ ID NO: 5959045 - DNA, 23 bp, Homo sapiens
ttagaaagaaaattatattctgt

SEQ ID NO: 5959046 - DNA, 13 bp, Homo sapiens
ttagaaagaaatt

SEQ ID NO: 5959047 - DNA, 22 bp, Homo sapiens
ttagaaagaagcccaatattat

SEQ ID NO: 5959048 - DNA, 16 bp, Homo sapiens
ttagaaagataattca

SEQ ID NO: 5959049 - DNA, 13 bp, Homo sapiens
ttagaaagcattt

SEQ ID NO: 5959050 - DNA, 15 bp, Homo sapiens
ttagaaagcatttga

SEQ ID NO: 5959051 - DNA, 17 bp, Homo sapiens
ttagaaagcatttgaat

SEQ ID NO: 5959052 - DNA, 13 bp, Homo sapiens
ttagaaagctaaa

SEQ ID NO: 5959053 - DNA, 22 bp, Homo sapiens
ttagaaagctgacattgccaaa

SEQ ID NO: 5959054 - DNA, 21 bp, Homo sapiens
ttagaaaggaaatgaatggtt

SEQ ID NO: 5959055 - DNA, 13 bp, Homo sapiens
ttagaaaggacaa

SEQ ID NO: 5959056 - DNA, 23 bp, Homo sapiens
ttagaaaggacaacagttctgag

SEQ ID NO: 5959057 - DNA, 13 bp, Homo sapiens
ttagaaaggcagc

SEQ ID NO: 5959058 - DNA, 15 bp, Homo sapiens
ttagaaataaaagat

SEQ ID NO: 5959059 - DNA, 22 bp, Homo sapiens
ttagaaataaagcatctcattt

SEQ ID NO: 5959060 - DNA, 15 bp, Homo sapiens
ttagaaataaatgaa

SEQ ID NO: 5959061 - DNA, 19 bp, Homo sapiens
ttagaaataaatgtacctg

SEQ ID NO: 5959062 - DNA, 16 bp, Homo sapiens
ttagaaataacagaag

SEQ ID NO: 5959063 - DNA, 23 bp, Homo sapiens
ttagaaataataaaaagaaagat

SEQ ID NO: 5959064 - DNA, 12 bp, Homo sapiens
ttagaaatataa

SEQ ID NO: 5959065 - DNA, 15 bp, Homo sapiens
ttagaaatattcaca

SEQ ID NO: 5959066 - DNA, 17 bp, Homo sapiens
ttagaaattaaatctgt

SEQ ID NO: 5959067 - DNA, 20 bp, Homo sapiens
ttagaaattaaatctgtgtc

SEQ ID NO: 5959068 - DNA, 12 bp, Homo sapiens
ttagaaattaca

SEQ ID NO: 5959069 - DNA, 22 bp, Homo sapiens
ttagaaattacaagtttcagta

SEQ ID NO: 5959070 - DNA, 19 bp, Homo sapiens
ttagaaattataattttag

SEQ ID NO: 5959071 - DNA, 15 bp, Homo sapiens
ttagaaattctataa

SEQ ID NO: 5959072 - DNA, 22 bp, Homo sapiens
ttagaaatttggtttcaagtgt

SEQ ID NO: 5959073 - DNA, 14 bp, Homo sapiens
ttagaacactattt

SEQ ID NO: 5959074 - DNA, 14 bp, Homo sapiens
ttagaacattcact

SEQ ID NO: 5959075 - DNA, 13 bp, Homo sapiens
ttagaacatttaa

SEQ ID NO: 5959076 - DNA, 14 bp, Homo sapiens
ttagaaccacagca

SEQ ID NO: 5959077 - DNA, 18 bp, Homo sapiens
ttagaaccgtaggttttt

SEQ ID NO: 5959078 - DNA, 16 bp, Homo sapiens
ttagaacctacaaaag

SEQ ID NO: 5959079 - DNA, 18 bp, Homo sapiens
ttagaacttagttttgtt

SEQ ID NO: 5959080 - DNA, 21 bp, Homo sapiens
ttagaactttgcatagcagct

SEQ ID NO: 5959081 - DNA, 17 bp, Homo sapiens
ttagaagaaaacatata

SEQ ID NO: 5959082 - DNA, 21 bp, Homo sapiens
ttagaagaaaacatatatttt

SEQ ID NO: 5959083 - DNA, 15 bp, Homo sapiens
ttagaagaaatgcta

SEQ ID NO: 5959084 - DNA, 14 bp, Homo sapiens
ttagaagaaattaa

SEQ ID NO: 5959085 - DNA, 14 bp, Homo sapiens
ttagaagaagtgtg

SEQ ID NO: 5959086 - DNA, 17 bp, Homo sapiens
ttagaagacaattgaca

SEQ ID NO: 5959087 - DNA, 18 bp, Homo sapiens
ttagaagatattagtctt

SEQ ID NO: 5959088 - DNA, 23 bp, Homo sapiens
ttagaagatattagtcttggggc

SEQ ID NO: 5959089 - DNA, 12 bp, Homo sapiens
ttagaagcagag

SEQ ID NO: 5959090 - DNA, 21 bp, Homo sapiens
ttagaagccatctgacagcag

SEQ ID NO: 5959091 - DNA, 14 bp, Homo sapiens
ttagaagcccattc

SEQ ID NO: 5959092 - DNA, 16 bp, Homo sapiens
ttagaagcctgacaac

SEQ ID NO: 5959093 - DNA, 23 bp, Homo sapiens
ttagaagcctgcataatgtttct

SEQ ID NO: 5959094 - DNA, 22 bp, Homo sapiens
ttagaagctaatgtaggactgt

SEQ ID NO: 5959095 - DNA, 18 bp, Homo sapiens
ttagaaggcttaagaact

SEQ ID NO: 5959096 - DNA, 19 bp, Homo sapiens
ttagaaggcttaagaactg

SEQ ID NO: 5959097 - DNA, 16 bp, Homo sapiens
ttagaagggttcagga

SEQ ID NO: 5959098 - DNA, 21 bp, Homo sapiens
ttagaagtaaggattataaac

SEQ ID NO: 5959099 - DNA, 13 bp, Homo sapiens
ttagaagtgttaa

SEQ ID NO: 5959100 - DNA, 13 bp, Homo sapiens
ttagaagtgtttt

SEQ ID NO: 5959101 - DNA, 13 bp, Homo sapiens
ttagaataaattc

SEQ ID NO: 5959102 - DNA, 16 bp, Homo sapiens
ttagaataagaatttg

SEQ ID NO: 5959103 - DNA, 21 bp, Homo sapiens
ttagaatagtgcctaaagtgc

SEQ ID NO: 5959104 - DNA, 12 bp, Homo sapiens
ttagaatatatt

SEQ ID NO: 5959105 - DNA, 13 bp, Homo sapiens
ttagaatatcttt

SEQ ID NO: 5959106 - DNA, 14 bp, Homo sapiens
ttagaatattgtaa

SEQ ID NO: 5959107 - DNA, 20 bp, Homo sapiens
ttagaatcaaacattttgaa

SEQ ID NO: 5959108 - DNA, 14 bp, Homo sapiens
ttagaatcagtgtg

SEQ ID NO: 5959109 - DNA, 20 bp, Homo sapiens
ttagaatcattaccttttac

SEQ ID NO: 5959110 - DNA, 21 bp, Homo sapiens
ttagaatccacgtattcccct

SEQ ID NO: 5959111 - DNA, 17 bp, Homo sapiens
ttagaatccctgtgtta

SEQ ID NO: 5959112 - DNA, 20 bp, Homo sapiens
ttagaatccctgtgttaatt

SEQ ID NO: 5959113 - DNA, 15 bp, Homo sapiens
ttagaatcttttaaa

SEQ ID NO: 5959114 - DNA, 13 bp, Homo sapiens
ttagaatgaaaat

SEQ ID NO: 5959115 - DNA, 23 bp, Homo sapiens
ttagaatgaatttatctttacca

SEQ ID NO: 5959116 - DNA, 18 bp, Homo sapiens
ttagaatgagggaaacaa

SEQ ID NO: 5959117 - DNA, 17 bp, Homo sapiens
ttagaatgccataaaat

SEQ ID NO: 5959118 - DNA, 23 bp, Homo sapiens
ttagaatggcctctttgtagaac

SEQ ID NO: 5959119 - DNA, 17 bp, Homo sapiens
ttagaatgtcaataaat

SEQ ID NO: 5959120 - DNA, 16 bp, Homo sapiens
ttagaatgtgaaaaaa

SEQ ID NO: 5959121 - DNA, 12 bp, Homo sapiens
ttagaatgtgat

SEQ ID NO: 5959122 - DNA, 14 bp, Homo sapiens
ttagaatgtttcta

SEQ ID NO: 5959123 - DNA, 18 bp, Homo sapiens
ttagaatgtttctatttc

SEQ ID NO: 5959124 - DNA, 20 bp, Homo sapiens
ttagaatgtttctatttcca

SEQ ID NO: 5959125 - DNA, 23 bp, Homo sapiens
ttagaatgtttctatttccataa

SEQ ID NO: 5959126 - DNA, 13 bp, Homo sapiens
ttagaattaaaaa

SEQ ID NO: 5959127 - DNA, 17 bp, Homo sapiens
ttagaattaccatttgt

SEQ ID NO: 5959128 - DNA, 17 bp, Homo sapiens
ttagaattctgtataga

SEQ ID NO: 5959129 - DNA, 16 bp, Homo sapiens
ttagaattgaaggttt

SEQ ID NO: 5959130 - DNA, 19 bp, Homo sapiens
ttagaattttgtgaaacag

SEQ ID NO: 5959131 - DNA, 23 bp, Homo sapiens
ttagacaaagccttaagcaaatt

SEQ ID NO: 5959132 - DNA, 19 bp, Homo sapiens
ttagacaaatactcatgtg

SEQ ID NO: 5959133 - DNA, 20 bp, Homo sapiens
ttagacaaatactcatgtgt

SEQ ID NO: 5959134 - DNA, 21 bp, Homo sapiens
ttagacaaatactcatgtgta

SEQ ID NO: 5959135 - DNA, 14 bp, Homo sapiens
ttagacaactagat

SEQ ID NO: 5959136 - DNA, 12 bp, Homo sapiens
ttagacaatgtg

SEQ ID NO: 5959137 - DNA, 17 bp, Homo sapiens
ttagacaccttcatttt

SEQ ID NO: 5959138 - DNA, 19 bp, Homo sapiens
ttagacactacaacatatg

SEQ ID NO: 5959139 - DNA, 23 bp, Homo sapiens
ttagacactgggagaagagaacc

SEQ ID NO: 5959140 - DNA, 21 bp, Homo sapiens
ttagacacttttatatttgaa

SEQ ID NO: 5959141 - DNA, 22 bp, Homo sapiens
ttagacagaacacctatgcaaa

SEQ ID NO: 5959142 - DNA, 20 bp, Homo sapiens
ttagacagagtctcactgtt

SEQ ID NO: 5959143 - DNA, 21 bp, Homo sapiens
ttagacagtaagagtttacaa

SEQ ID NO: 5959144 - DNA, 18 bp, Homo sapiens
ttagacagtccctgccaa

SEQ ID NO: 5959145 - DNA, 13 bp, Homo sapiens
ttagacataacaa

SEQ ID NO: 5959146 - DNA, 17 bp, Homo sapiens
ttagacatcttcagatt

SEQ ID NO: 5959147 - DNA, 20 bp, Homo sapiens
ttagacatttttgtgccatt

SEQ ID NO: 5959148 - DNA, 17 bp, Homo sapiens
ttagaccaccaagcctt

SEQ ID NO: 5959149 - DNA, 16 bp, Homo sapiens
ttagaccgctctcttt

SEQ ID NO: 5959150 - DNA, 13 bp, Homo sapiens
ttagacctcagcc

SEQ ID NO: 5959151 - DNA, 15 bp, Homo sapiens
ttagacctcagcctg

SEQ ID NO: 5959152 - DNA, 21 bp, Homo sapiens
ttagacctcttcctggaataa

SEQ ID NO: 5959153 - DNA, 19 bp, Homo sapiens
ttagacctgccagccactg

SEQ ID NO: 5959154 - DNA, 16 bp, Homo sapiens
ttagacctgtgttact

SEQ ID NO: 5959155 - DNA, 17 bp, Homo sapiens
ttagacctttatttttc

SEQ ID NO: 5959156 - DNA, 19 bp, Homo sapiens
ttagacctttatttttcta

SEQ ID NO: 5959157 - DNA, 23 bp, Homo sapiens
ttagacctttatttttctatctg

SEQ ID NO: 5959158 - DNA, 17 bp, Homo sapiens
ttagacgaagaagctgg

SEQ ID NO: 5959159 - DNA, 16 bp, Homo sapiens
ttagactagttgaaca

SEQ ID NO: 5959160 - DNA, 17 bp, Homo sapiens
ttagactatagcccctg

SEQ ID NO: 5959161 - DNA, 21 bp, Homo sapiens
ttagactcatcaatcaaataa

SEQ ID NO: 5959162 - DNA, 18 bp, Homo sapiens
ttagactctctagtttta

SEQ ID NO: 5959163 - DNA, 13 bp, Homo sapiens
ttagactcttccc

SEQ ID NO: 5959164 - DNA, 21 bp, Homo sapiens
ttagactggaacttgaactga

SEQ ID NO: 5959165 - DNA, 22 bp, Homo sapiens
ttagactggaacttgaactgat

SEQ ID NO: 5959166 - DNA, 15 bp, Homo sapiens
ttagactggacagct

SEQ ID NO: 5959167 - DNA, 21 bp, Homo sapiens
ttagacttctaaataaggtgt

SEQ ID NO: 5959168 - DNA, 14 bp, Homo sapiens
ttagacttctgttt

SEQ ID NO: 5959169 - DNA, 19 bp, Homo sapiens
ttagacttgaaaagagaca

SEQ ID NO: 5959170 - DNA, 20 bp, Homo sapiens
ttagacttgaaaagagacag

SEQ ID NO: 5959171 - DNA, 16 bp, Homo sapiens
ttagacttgtgtgcat

SEQ ID NO: 5959172 - DNA, 22 bp, Homo sapiens
ttagactttaaaatgagctact

SEQ ID NO: 5959173 - DNA, 15 bp, Homo sapiens
ttagactttaacata

SEQ ID NO: 5959174 - DNA, 16 bp, Homo sapiens
ttagactttaacataa

SEQ ID NO: 5959175 - DNA, 18 bp, Homo sapiens
ttagactttagaaataaa

SEQ ID NO: 5959176 - DNA, 20 bp, Homo sapiens
ttagagaaaaccttaaaagt

SEQ ID NO: 5959177 - DNA, 22 bp, Homo sapiens
ttagagaaaaccttaaaagtaa

SEQ ID NO: 5959178 - DNA, 16 bp, Homo sapiens
ttagagaaatgaatta

SEQ ID NO: 5959179 - DNA, 22 bp, Homo sapiens
ttagagaaatgaattataacta

SEQ ID NO: 5959180 - DNA, 21 bp, Homo sapiens
ttataaaaattctagtctgtt

SEQ ID NO: 5959181 - DNA, 22 bp, Homo sapiens
ttataaaaattctagtctgttt

SEQ ID NO: 5959182 - DNA, 17 bp, Homo sapiens
ttataaaacaatgactt

SEQ ID NO: 5959183 - DNA, 18 bp, Homo sapiens
ttataaaacaatgacttt

SEQ ID NO: 5959184 - DNA, 22 bp, Homo sapiens
ttataaaacagagtaatcttgt

SEQ ID NO: 5959185 - DNA, 22 bp, Homo sapiens
ttataaaaccatcaaaaatatt

SEQ ID NO: 5959186 - DNA, 17 bp, Homo sapiens
ttataaaactatgtgtt

SEQ ID NO: 5959187 - DNA, 12 bp, Homo sapiens
ttataaaacttc

SEQ ID NO: 5959188 - DNA, 13 bp, Homo sapiens
ttataaaacttct

SEQ ID NO: 5959189 - DNA, 21 bp, Homo sapiens
ttataaaagctcagatgacat

SEQ ID NO: 5959190 - DNA, 18 bp, Homo sapiens
ttataaaatataaacaaa

SEQ ID NO: 5959191 - DNA, 18 bp, Homo sapiens
ttataaaatattgttaat

SEQ ID NO: 5959192 - DNA, 16 bp, Homo sapiens
ttataaaatctttcca

SEQ ID NO: 5959193 - DNA, 13 bp, Homo sapiens
ttataaaatggct

SEQ ID NO: 5959194 - DNA, 18 bp, Homo sapiens
ttataaaatgtataaatt

SEQ ID NO: 5959195 - DNA, 10 bp, Homo sapiens
ttataaaatt

SEQ ID NO: 5959196 - DNA, 17 bp, Homo sapiens
ttataaaattaaagaaa

SEQ ID NO: 5959197 - DNA, 20 bp, Homo sapiens
ttataaaattaaagaaaata

SEQ ID NO: 5959198 - DNA, 22 bp, Homo sapiens
ttataaaattaaagaaaataaa

SEQ ID NO: 5959199 - DNA, 22 bp, Homo sapiens
ttataaaattatttttattaaa

SEQ ID NO: 5959200 - DNA, 15 bp, Homo sapiens
ttataaaattttaaa

SEQ ID NO: 5959201 - DNA, 21 bp, Homo sapiens
ttataaacaagaatgaaggtt

SEQ ID NO: 5959202 - DNA, 15 bp, Homo sapiens
ttataaacacattga

SEQ ID NO: 5959203 - DNA, 13 bp, Homo sapiens
ttataaacagaaa

SEQ ID NO: 5959204 - DNA, 14 bp, Homo sapiens
ttataaacagcagg

SEQ ID NO: 5959205 - DNA, 15 bp, Homo sapiens
ttataaacagtttta

SEQ ID NO: 5959206 - DNA, 15 bp, Homo sapiens
ttataaaccagcagc

SEQ ID NO: 5959207 - DNA, 17 bp, Homo sapiens
ttataaacctctaattt

SEQ ID NO: 5959208 - DNA, 17 bp, Homo sapiens
ttataaaccttcagaag

SEQ ID NO: 5959209 - DNA, 18 bp, Homo sapiens
ttataaaccttgtcaata

SEQ ID NO: 5959210 - DNA, 23 bp, Homo sapiens
ttataaactaaagttgtaccttt

SEQ ID NO: 5959211 - DNA, 14 bp, Homo sapiens
ttataaactacaaa

SEQ ID NO: 5959212 - DNA, 15 bp, Homo sapiens
ttataaactataaac

SEQ ID NO: 5959213 - DNA, 19 bp, Homo sapiens
ttataaactataaacttaa

SEQ ID NO: 5959214 - DNA, 18 bp, Homo sapiens
ttataaactcattttgct

SEQ ID NO: 5959215 - DNA, 21 bp, Homo sapiens
ttataaactctaagtgtaaaa

SEQ ID NO: 5959216 - DNA, 13 bp, Homo sapiens
ttataaactggga

SEQ ID NO: 5959217 - DNA, 22 bp, Homo sapiens
ttataaagataaaatatcctca

SEQ ID NO: 5959218 - DNA, 23 bp, Homo sapiens
ttataaagataaaatatcctcag

SEQ ID NO: 5959219 - DNA, 20 bp, Homo sapiens
ttataaagatttttgttaag

SEQ ID NO: 5959220 - DNA, 13 bp, Homo sapiens
ttataaagcatgt

SEQ ID NO: 5959221 - DNA, 16 bp, Homo sapiens
ttataaagccaagaat

SEQ ID NO: 5959222 - DNA, 17 bp, Homo sapiens
ttataaagtctaagcaa

SEQ ID NO: 5959223 - DNA, 12 bp, Homo sapiens
ttataaagtgct

SEQ ID NO: 5959224 - DNA, 19 bp, Homo sapiens
ttataaagtgcttgtgtaa

SEQ ID NO: 5959225 - DNA, 21 bp, Homo sapiens
ttataaagtgcttgtgtaatt

SEQ ID NO: 5959226 - DNA, 22 bp, Homo sapiens
ttataaagttcagatgtttcat

SEQ ID NO: 5959227 - DNA, 11 bp, Homo sapiens
ttataaataaa

SEQ ID NO: 5959228 - DNA, 15 bp, Homo sapiens
ttataaataaatgcc

SEQ ID NO: 5959229 - DNA, 16 bp, Homo sapiens
ttataaataaatgcca

SEQ ID NO: 5959230 - DNA, 19 bp, Homo sapiens
ttataaatactgcaaatca

SEQ ID NO: 5959231 - DNA, 19 bp, Homo sapiens
ttataaatatcctgctcac

SEQ ID NO: 5959232 - DNA, 12 bp, Homo sapiens
ttataaatatga

SEQ ID NO: 5959233 - DNA, 21 bp, Homo sapiens
ttataaatattaggcataaat

SEQ ID NO: 5959234 - DNA, 12 bp, Homo sapiens
ttataaatcata

SEQ ID NO: 5959235 - DNA, 17 bp, Homo sapiens
ttataaatcatattgat

SEQ ID NO: 5959236 - DNA, 17 bp, Homo sapiens
ttataaatcgcttttga

SEQ ID NO: 5959237 - DNA, 18 bp, Homo sapiens
ttataaatcgcttttgat

SEQ ID NO: 5959238 - DNA, 17 bp, Homo sapiens
ttataaatgcactgtaa

SEQ ID NO: 5959239 - DNA, 19 bp, Homo sapiens
ttataaatggaggtacagg

SEQ ID NO: 5959240 - DNA, 23 bp, Homo sapiens
ttataaatgtaccagagagagtt

SEQ ID NO: 5959241 - DNA, 12 bp, Homo sapiens
ttataaatgtgt

SEQ ID NO: 5959242 - DNA, 21 bp, Homo sapiens
ttataaatgtgtattctggct

SEQ ID NO: 5959243 - DNA, 14 bp, Homo sapiens
ttataaatgtgtgg

SEQ ID NO: 5959244 - DNA, 23 bp, Homo sapiens
ttataaatgtgtttatagctcat

SEQ ID NO: 5959245 - DNA, 15 bp, Homo sapiens
ttataaatgttttaa

SEQ ID NO: 5959246 - DNA, 17 bp, Homo sapiens
ttataaattatgtttat

SEQ ID NO: 5959247 - DNA, 12 bp, Homo sapiens
ttataaatttcg

SEQ ID NO: 5959248 - DNA, 19 bp, Homo sapiens
ttataaattttgtacattt

SEQ ID NO: 5959249 - DNA, 21 bp, Homo sapiens
ttataacagatgtgaaaatat

SEQ ID NO: 5959250 - DNA, 19 bp, Homo sapiens
ttataacagttataaagaa

SEQ ID NO: 5959251 - DNA, 17 bp, Homo sapiens
ttataacattgtaaatg

SEQ ID NO: 5959252 - DNA, 20 bp, Homo sapiens
ttataaccatggttttcctg

SEQ ID NO: 5959253 - DNA, 23 bp, Homo sapiens
ttataacctagttaaagaaagga

SEQ ID NO: 5959254 - DNA, 21 bp, Homo sapiens
ttataaccttaatttattatt

SEQ ID NO: 5959255 - DNA, 13 bp, Homo sapiens
ttataactaatat

SEQ ID NO: 5959256 - DNA, 15 bp, Homo sapiens
ttataactagacatc

SEQ ID NO: 5959257 - DNA, 16 bp, Homo sapiens
ttataactattcagtt

SEQ ID NO: 5959258 - DNA, 20 bp, Homo sapiens
ttataactcatcataaaata

SEQ ID NO: 5959259 - DNA, 21 bp, Homo sapiens
ttataactctagggatataaa

SEQ ID NO: 5959260 - DNA, 16 bp, Homo sapiens
ttataactctgcacta

SEQ ID NO: 5959261 - DNA, 19 bp, Homo sapiens
ttataactctgcactactc

SEQ ID NO: 5959262 - DNA, 18 bp, Homo sapiens
ttataactctgtataata

SEQ ID NO: 5959263 - DNA, 17 bp, Homo sapiens
ttataactgtaaagatg

SEQ ID NO: 5959264 - DNA, 13 bp, Homo sapiens
ttataactgtttt

SEQ ID NO: 5959265 - DNA, 14 bp, Homo sapiens
ttataacttctgaa

SEQ ID NO: 5959266 - DNA, 14 bp, Homo sapiens
ttataactttttat

SEQ ID NO: 5959267 - DNA, 17 bp, Homo sapiens
ttataactttttatatt

SEQ ID NO: 5959268 - DNA, 15 bp, Homo sapiens
ttataagaaagcctg

SEQ ID NO: 5959269 - DNA, 21 bp, Homo sapiens
ttataagaagaagttcatgtc

SEQ ID NO: 5959270 - DNA, 15 bp, Homo sapiens
ttataagaagaggaa

SEQ ID NO: 5959271 - DNA, 20 bp, Homo sapiens
ttataagactctcacactca

SEQ ID NO: 5959272 - DNA, 16 bp, Homo sapiens
ttataagagaagttta

SEQ ID NO: 5959273 - DNA, 22 bp, Homo sapiens
ttataagagattcactcagaag

SEQ ID NO: 5959274 - DNA, 23 bp, Homo sapiens
ttataagcaaatttcaaaagaca

SEQ ID NO: 5959275 - DNA, 17 bp, Homo sapiens
ttataagcacagacaat

SEQ ID NO: 5959276 - DNA, 20 bp, Homo sapiens
ttataagcacagacaattct

SEQ ID NO: 5959277 - DNA, 16 bp, Homo sapiens
ttataagcagatttaa

SEQ ID NO: 5959278 - DNA, 19 bp, Homo sapiens
ttataagcatcattattta

SEQ ID NO: 5959279 - DNA, 21 bp, Homo sapiens
ttataagcatcattatttatg

SEQ ID NO: 5959280 - DNA, 11 bp, Homo sapiens
ttataagcatt

SEQ ID NO: 5959281 - DNA, 18 bp, Homo sapiens
ttataagcattgaaatta

SEQ ID NO: 5959282 - DNA, 23 bp, Homo sapiens
ttataagctatgagttgaaatgt

SEQ ID NO: 5959283 - DNA, 21 bp, Homo sapiens
ttataagggagagctgagcca

SEQ ID NO: 5959284 - DNA, 18 bp, Homo sapiens
ttataagggcaaattgga

SEQ ID NO: 5959285 - DNA, 22 bp, Homo sapiens
ttataagggcaaattggagaaa

SEQ ID NO: 5959286 - DNA, 13 bp, Homo sapiens
ttataagggccct

SEQ ID NO: 5959287 - DNA, 20 bp, Homo sapiens
ttataagggccctgccctgt

SEQ ID NO: 5959288 - DNA, 21 bp, Homo sapiens
ttataaggtagtactgatttt

SEQ ID NO: 5959289 - DNA, 21 bp, Homo sapiens
ttataaggtgttttctgtgta

SEQ ID NO: 5959290 - DNA, 16 bp, Homo sapiens
ttataagtcacaaaga

SEQ ID NO: 5959291 - DNA, 16 bp, Homo sapiens
ttataagttgctttcc

SEQ ID NO: 5959292 - DNA, 17 bp, Homo sapiens
ttataataaaatttctt

SEQ ID NO: 5959293 - DNA, 22 bp, Homo sapiens
ttataataaaccactcagtaaa

SEQ ID NO: 5959294 - DNA, 13 bp, Homo sapiens
ttataataaactc

SEQ ID NO: 5959295 - DNA, 16 bp, Homo sapiens
ttataataaactgttt

SEQ ID NO: 5959296 - DNA, 18 bp, Homo sapiens
ttataataaaggactgta

SEQ ID NO: 5959297 - DNA, 19 bp, Homo sapiens
ttataataaaggactgtaa

SEQ ID NO: 5959298 - DNA, 15 bp, Homo sapiens
ttataataaatatat

SEQ ID NO: 5959299 - DNA, 13 bp, Homo sapiens
ttataataaattg

SEQ ID NO: 5959300 - DNA, 13 bp, Homo sapiens
ttataataactga

SEQ ID NO: 5959301 - DNA, 15 bp, Homo sapiens
ttataataactgaac

SEQ ID NO: 5959302 - DNA, 20 bp, Homo sapiens
ttataataactgaactgttt

SEQ ID NO: 5959303 - DNA, 18 bp, Homo sapiens
ttataataatgttaacat

SEQ ID NO: 5959304 - DNA, 14 bp, Homo sapiens
ttataatactctgt

SEQ ID NO: 5959305 - DNA, 15 bp, Homo sapiens
ttataatactctgtt

SEQ ID NO: 5959306 - DNA, 20 bp, Homo sapiens
ttataatacttttcttcccc

SEQ ID NO: 5959307 - DNA, 11 bp, Homo sapiens
ttataatagca

SEQ ID NO: 5959308 - DNA, 13 bp, Homo sapiens
ttataatatgtgc

SEQ ID NO: 5959309 - DNA, 18 bp, Homo sapiens
ttataatatgtgccttaa

SEQ ID NO: 5959310 - DNA, 21 bp, Homo sapiens
ttataatatgtgccttaagtt

SEQ ID NO: 5959311 - DNA, 22 bp, Homo sapiens
ttataatatgtgccttaagttt

SEQ ID NO: 5959312 - DNA, 21 bp, Homo sapiens
ttataatattcatacaacaaa

SEQ ID NO: 5959313 - DNA, 17 bp, Homo sapiens
ttataatcaaagctcat

SEQ ID NO: 5959314 - DNA, 14 bp, Homo sapiens
ttataatcaccagg

SEQ ID NO: 5959315 - DNA, 16 bp, Homo sapiens
ttataatccttaaatc

SEQ ID NO: 5959316 - DNA, 20 bp, Homo sapiens
ttataatctcaaaggagaaa

SEQ ID NO: 5959317 - DNA, 12 bp, Homo sapiens
ttataatgcaaa

SEQ ID NO: 5959318 - DNA, 16 bp, Homo sapiens
ttataatgcatctaaa

SEQ ID NO: 5959319 - DNA, 13 bp, Homo sapiens
ttataatgtattt

SEQ ID NO: 5959320 - DNA, 19 bp, Homo sapiens
ttataatgtgcccaaagct

SEQ ID NO: 5959321 - DNA, 21 bp, Homo sapiens
ttataatgtggatttcctatt

SEQ ID NO: 5959322 - DNA, 22 bp, Homo sapiens
ttataatgtggatttcctattt

SEQ ID NO: 5959323 - DNA, 15 bp, Homo sapiens
ttataatgtgtgttg

SEQ ID NO: 5959324 - DNA, 15 bp, Homo sapiens
ttataattaaagaaa

SEQ ID NO: 5959325 - DNA, 15 bp, Homo sapiens
ttataattaaagatg

SEQ ID NO: 5959326 - DNA, 16 bp, Homo sapiens
ttataattccttctgc

SEQ ID NO: 5959327 - DNA, 17 bp, Homo sapiens
ttataattctcattaaa

SEQ ID NO: 5959328 - DNA, 13 bp, Homo sapiens
ttataattgatga

SEQ ID NO: 5959329 - DNA, 14 bp, Homo sapiens
ttataattggctta

SEQ ID NO: 5959330 - DNA, 20 bp, Homo sapiens
ttataattggtgctatttga

SEQ ID NO: 5959331 - DNA, 12 bp, Homo sapiens
ttataatttaaa

SEQ ID NO: 5959332 - DNA, 17 bp, Homo sapiens
ttataatttaaatgata

SEQ ID NO: 5959333 - DNA, 15 bp, Homo sapiens
ttataattttaagat

SEQ ID NO: 5959334 - DNA, 18 bp, Homo sapiens
ttataattttaagattcc

SEQ ID NO: 5959335 - DNA, 19 bp, Homo sapiens
ttataattttagtttatat

SEQ ID NO: 5959336 - DNA, 15 bp, Homo sapiens
ttataattttatctg

SEQ ID NO: 5959337 - DNA, 16 bp, Homo sapiens
ttataattttcctaat

SEQ ID NO: 5959338 - DNA, 22 bp, Homo sapiens
ttataattttcctttttcatgt

SEQ ID NO: 5959339 - DNA, 21 bp, Homo sapiens
ttataatttttttattactga

SEQ ID NO: 5959340 - DNA, 20 bp, Homo sapiens
ttataattttttttaaaata

SEQ ID NO: 5959341 - DNA, 13 bp, Homo sapiens
ttatacaaaataa

SEQ ID NO: 5959342 - DNA, 20 bp, Homo sapiens
ttatacaaaataatttaact

SEQ ID NO: 5959343 - DNA, 19 bp, Homo sapiens
ttatacaaattaaaaagat

SEQ ID NO: 5959344 - DNA, 18 bp, Homo sapiens
ttatacaaatttaacttt

SEQ ID NO: 5959345 - DNA, 12 bp, Homo sapiens
ttatacaacagt

SEQ ID NO: 5959346 - DNA, 23 bp, Homo sapiens
ttatacaacagtgctaaaaatgg

SEQ ID NO: 5959347 - DNA, 21 bp, Homo sapiens
ttatacaataacccagttact

SEQ ID NO: 5959348 - DNA, 12 bp, Homo sapiens
ttatacaataat

SEQ ID NO: 5959349 - DNA, 15 bp, Homo sapiens
ttatacaatatcatc

SEQ ID NO: 5959350 - DNA, 18 bp, Homo sapiens
ttatacaatggaataaat

SEQ ID NO: 5959351 - DNA, 15 bp, Homo sapiens
ttatacacaactttg

SEQ ID NO: 5959352 - DNA, 17 bp, Homo sapiens
ttatacacaactttgca

SEQ ID NO: 5959353 - DNA, 11 bp, Homo sapiens
ttatacacaca

SEQ ID NO: 5959354 - DNA, 18 bp, Homo sapiens
ttatacaccattgttcct

SEQ ID NO: 5959355 - DNA, 20 bp, Homo sapiens
ttatacactgtgtaaatacc

SEQ ID NO: 5959356 - DNA, 23 bp, Homo sapiens
ttatacagaattgtgtctgcagg

SEQ ID NO: 5959357 - DNA, 19 bp, Homo sapiens
ttatacagacctaatatca

SEQ ID NO: 5959358 - DNA, 16 bp, Homo sapiens
ttatgcagtgctgctt

SEQ ID NO: 5959359 - DNA, 15 bp, Homo sapiens
ttatgcatgaaatga

SEQ ID NO: 5959360 - DNA, 21 bp, Homo sapiens
ttatgcatgaaatgaatgtct

SEQ ID NO: 5959361 - DNA, 19 bp, Homo sapiens
ttatgcatgagaactaaat

SEQ ID NO: 5959362 - DNA, 14 bp, Homo sapiens
ttatgcatttcatt

SEQ ID NO: 5959363 - DNA, 15 bp, Homo sapiens
ttatgcatttcattc

SEQ ID NO: 5959364 - DNA, 17 bp, Homo sapiens
ttatgcatttggaatta

SEQ ID NO: 5959365 - DNA, 19 bp, Homo sapiens
ttatgccaagaacagaaaa

SEQ ID NO: 5959366 - DNA, 13 bp, Homo sapiens
ttatgccaccccc

SEQ ID NO: 5959367 - DNA, 17 bp, Homo sapiens
ttatgccatgatttttg

SEQ ID NO: 5959368 - DNA, 20 bp, Homo sapiens
ttatgccccagttcagaaat

SEQ ID NO: 5959369 - DNA, 13 bp, Homo sapiens
ttatgcctcgctt

SEQ ID NO: 5959370 - DNA, 18 bp, Homo sapiens
ttatgcctcgcttattta

SEQ ID NO: 5959371 - DNA, 15 bp, Homo sapiens
ttatgcctgagttat

SEQ ID NO: 5959372 - DNA, 16 bp, Homo sapiens
ttatgcggtctaggga

SEQ ID NO: 5959373 - DNA, 16 bp, Homo sapiens
ttatgcggttaatttt

SEQ ID NO: 5959374 - DNA, 10 bp, Homo sapiens
ttatgctaag

SEQ ID NO: 5959375 - DNA, 17 bp, Homo sapiens
ttatgctactgaactga

SEQ ID NO: 5959376 - DNA, 21 bp, Homo sapiens
ttatgctataaattttttgaa

SEQ ID NO: 5959377 - DNA, 15 bp, Homo sapiens
ttatgctattaaagt

SEQ ID NO: 5959378 - DNA, 17 bp, Homo sapiens
ttatgctcacctgacat

SEQ ID NO: 5959379 - DNA, 23 bp, Homo sapiens
ttatgctccatcccattcacttc

SEQ ID NO: 5959380 - DNA, 19 bp, Homo sapiens
ttatgctctcactgtttgt

SEQ ID NO: 5959381 - DNA, 18 bp, Homo sapiens
ttatgctcttaattgcca

SEQ ID NO: 5959382 - DNA, 22 bp, Homo sapiens
ttatgctgcatttggctggagc

SEQ ID NO: 5959383 - DNA, 16 bp, Homo sapiens
ttatgctgtattttct

SEQ ID NO: 5959384 - DNA, 21 bp, Homo sapiens
ttatgctgtattttcttttta

SEQ ID NO: 5959385 - DNA, 12 bp, Homo sapiens
ttatgctgtttc

SEQ ID NO: 5959386 - DNA, 15 bp, Homo sapiens
ttatgctgtttccta

SEQ ID NO: 5959387 - DNA, 17 bp, Homo sapiens
ttatgctgtttcctagc

SEQ ID NO: 5959388 - DNA, 19 bp, Homo sapiens
ttatgcttaaaatatgtat

SEQ ID NO: 5959389 - DNA, 15 bp, Homo sapiens
ttatgcttccagaaa

SEQ ID NO: 5959390 - DNA, 19 bp, Homo sapiens
ttatgcttccattaacaaa

SEQ ID NO: 5959391 - DNA, 21 bp, Homo sapiens
ttatgcttccattaacaaatg

SEQ ID NO: 5959392 - DNA, 23 bp, Homo sapiens
ttatgcttgtgtatatgtataaa

SEQ ID NO: 5959393 - DNA, 19 bp, Homo sapiens
ttatgcttttagagttgca

SEQ ID NO: 5959394 - DNA, 21 bp, Homo sapiens
ttatggaaataccaggaccag

SEQ ID NO: 5959395 - DNA, 23 bp, Homo sapiens
ttatggaaataccaggaccagtt

SEQ ID NO: 5959396 - DNA, 16 bp, Homo sapiens
ttatggaaatatagtt

SEQ ID NO: 5959397 - DNA, 16 bp, Homo sapiens
ttatggaacactctga

SEQ ID NO: 5959398 - DNA, 20 bp, Homo sapiens
ttatggaacactctgagact

SEQ ID NO: 5959399 - DNA, 15 bp, Homo sapiens
ttatggaacttccct

SEQ ID NO: 5959400 - DNA, 17 bp, Homo sapiens
ttatggaagaaagagtt

SEQ ID NO: 5959401 - DNA, 20 bp, Homo sapiens
ttatggaatatcatctgtca

SEQ ID NO: 5959402 - DNA, 17 bp, Homo sapiens
ttatggaattaaccatt

SEQ ID NO: 5959403 - DNA, 21 bp, Homo sapiens
ttatggaattgatttgcattg

SEQ ID NO: 5959404 - DNA, 13 bp, Homo sapiens
ttatggacactgc

SEQ ID NO: 5959405 - DNA, 22 bp, Homo sapiens
ttatggacatcgatatgaaaaa

SEQ ID NO: 5959406 - DNA, 21 bp, Homo sapiens
ttatggagacctctccttcct

SEQ ID NO: 5959407 - DNA, 19 bp, Homo sapiens
ttatggagtcatttttaca

SEQ ID NO: 5959408 - DNA, 21 bp, Homo sapiens
ttatggagtttgtgggaaata

SEQ ID NO: 5959409 - DNA, 21 bp, Homo sapiens
ttatggatacgtgttttgaat

SEQ ID NO: 5959410 - DNA, 16 bp, Homo sapiens
ttatggatatgctgct

SEQ ID NO: 5959411 - DNA, 17 bp, Homo sapiens
ttatggatatgctgctt

SEQ ID NO: 5959412 - DNA, 16 bp, Homo sapiens
ttatggatgatttaag

SEQ ID NO: 5959413 - DNA, 14 bp, Homo sapiens
ttatggcatttcta

SEQ ID NO: 5959414 - DNA, 17 bp, Homo sapiens
ttatggccacagcccat

SEQ ID NO: 5959415 - DNA, 12 bp, Homo sapiens
ttatggcctcag

SEQ ID NO: 5959416 - DNA, 18 bp, Homo sapiens
ttatggcctcagctgcct

SEQ ID NO: 5959417 - DNA, 20 bp, Homo sapiens
ttatggcctttttaagtatt

SEQ ID NO: 5959418 - DNA, 22 bp, Homo sapiens
ttatggcgtttttctcgtcccc

SEQ ID NO: 5959419 - DNA, 14 bp, Homo sapiens
ttatggctgcatag

SEQ ID NO: 5959420 - DNA, 19 bp, Homo sapiens
ttatggcttataaatgtgt

SEQ ID NO: 5959421 - DNA, 13 bp, Homo sapiens
ttatggcttgtga

SEQ ID NO: 5959422 - DNA, 15 bp, Homo sapiens
ttatggctttgtgct

SEQ ID NO: 5959423 - DNA, 19 bp, Homo sapiens
ttatggcttttgtgcatta

SEQ ID NO: 5959424 - DNA, 17 bp, Homo sapiens
ttatgggaacaagtgta

SEQ ID NO: 5959425 - DNA, 16 bp, Homo sapiens
ttatgggatgtaaaca

SEQ ID NO: 5959426 - DNA, 15 bp, Homo sapiens
ttatgggcccctggc

SEQ ID NO: 5959427 - DNA, 14 bp, Homo sapiens
ttatggggccctgt

SEQ ID NO: 5959428 - DNA, 18 bp, Homo sapiens
ttatggggccctgtccag

SEQ ID NO: 5959429 - DNA, 20 bp, Homo sapiens
ttatgggggtgtttctatct

SEQ ID NO: 5959430 - DNA, 18 bp, Homo sapiens
ttatgggtggctttcaag

SEQ ID NO: 5959431 - DNA, 23 bp, Homo sapiens
ttatgggtgggaataaaatttct

SEQ ID NO: 5959432 - DNA, 22 bp, Homo sapiens
ttatggtaactgctttctgttc

SEQ ID NO: 5959433 - DNA, 21 bp, Homo sapiens
ttatggtacctatttggtgct

SEQ ID NO: 5959434 - DNA, 14 bp, Homo sapiens
ttatggtattatat

SEQ ID NO: 5959435 - DNA, 22 bp, Homo sapiens
ttatggtattttcgtgcatttg

SEQ ID NO: 5959436 - DNA, 13 bp, Homo sapiens
ttatggtctaatg

SEQ ID NO: 5959437 - DNA, 14 bp, Homo sapiens
ttatggtgaaatta

SEQ ID NO: 5959438 - DNA, 19 bp, Homo sapiens
ttatggtggaagaggttct

SEQ ID NO: 5959439 - DNA, 16 bp, Homo sapiens
ttatggtgtaatgcac

SEQ ID NO: 5959440 - DNA, 20 bp, Homo sapiens
ttatggttacttcttctctt

SEQ ID NO: 5959441 - DNA, 21 bp, Homo sapiens
ttatggttttataactatata

SEQ ID NO: 5959442 - DNA, 11 bp, Homo sapiens
ttatggttttg

SEQ ID NO: 5959443 - DNA, 13 bp, Homo sapiens
ttatgtaaaagga

SEQ ID NO: 5959444 - DNA, 20 bp, Homo sapiens
ttatgtaaaatgttttagca

SEQ ID NO: 5959445 - DNA, 16 bp, Homo sapiens
ttatgtaaagtatgtt

SEQ ID NO: 5959446 - DNA, 19 bp, Homo sapiens
ttatgtaaatacaatttgt

SEQ ID NO: 5959447 - DNA, 22 bp, Homo sapiens
ttatgtaaatacaatttgtact

SEQ ID NO: 5959448 - DNA, 19 bp, Homo sapiens
ttatgtaaatcccattatt

SEQ ID NO: 5959449 - DNA, 21 bp, Homo sapiens
ttatgtaaatcccattattca

SEQ ID NO: 5959450 - DNA, 23 bp, Homo sapiens
ttatgtaaatcccattattcaaa

SEQ ID NO: 5959451 - DNA, 20 bp, Homo sapiens
ttatgtaaatgtttgttaaa

SEQ ID NO: 5959452 - DNA, 11 bp, Homo sapiens
ttatgtaaatt

SEQ ID NO: 5959453 - DNA, 17 bp, Homo sapiens
ttatgtaacatccagaa

SEQ ID NO: 5959454 - DNA, 14 bp, Homo sapiens
ttatgtaagaagaa

SEQ ID NO: 5959455 - DNA, 18 bp, Homo sapiens
ttatgtaagagcaccttc

SEQ ID NO: 5959456 - DNA, 17 bp, Homo sapiens
ttatgtaataatgtgaa

SEQ ID NO: 5959457 - DNA, 16 bp, Homo sapiens
ttatgtacaaaatgaa

SEQ ID NO: 5959458 - DNA, 11 bp, Homo sapiens
ttatgtacaac

SEQ ID NO: 5959459 - DNA, 13 bp, Homo sapiens
ttatgtacaaccc

SEQ ID NO: 5959460 - DNA, 16 bp, Homo sapiens
ttatgtacaaccctga

SEQ ID NO: 5959461 - DNA, 17 bp, Homo sapiens
ttatgtacagaaaacat

SEQ ID NO: 5959462 - DNA, 15 bp, Homo sapiens
ttatgtaccttttga

SEQ ID NO: 5959463 - DNA, 15 bp, Homo sapiens
ttatgtactgtacta

SEQ ID NO: 5959464 - DNA, 21 bp, Homo sapiens
ttatgtacttgatactgaatg

SEQ ID NO: 5959465 - DNA, 16 bp, Homo sapiens
ttatgtagacattgta

SEQ ID NO: 5959466 - DNA, 18 bp, Homo sapiens
ttatgtagacattgtaaa

SEQ ID NO: 5959467 - DNA, 18 bp, Homo sapiens
ttatgtagatatttggct

SEQ ID NO: 5959468 - DNA, 18 bp, Homo sapiens
ttatgtagctctttgtca

SEQ ID NO: 5959469 - DNA, 12 bp, Homo sapiens
ttatgtagctgt

SEQ ID NO: 5959470 - DNA, 16 bp, Homo sapiens
ttatgtagtaattgac

SEQ ID NO: 5959471 - DNA, 11 bp, Homo sapiens
ttatgtagttt

SEQ ID NO: 5959472 - DNA, 14 bp, Homo sapiens
ttatgtataaaatg

SEQ ID NO: 5959473 - DNA, 15 bp, Homo sapiens
ttatgtataaaatgt

SEQ ID NO: 5959474 - DNA, 24 bp, Homo sapiens
ttatgtataaaatgtaacactgat

SEQ ID NO: 5959475 - DNA, 22 bp, Homo sapiens
ttatgtataaacataagttgca

SEQ ID NO: 5959476 - DNA, 18 bp, Homo sapiens
ttatgtatatagatgtgc

SEQ ID NO: 5959477 - DNA, 13 bp, Homo sapiens
ttatgtatatggt

SEQ ID NO: 5959478 - DNA, 19 bp, Homo sapiens
ttatgtatcagctctctgc

SEQ ID NO: 5959479 - DNA, 20 bp, Homo sapiens
ttatgtatcttagttacatt

SEQ ID NO: 5959480 - DNA, 20 bp, Homo sapiens
ttatgtatggatatatttga

SEQ ID NO: 5959481 - DNA, 20 bp, Homo sapiens
ttatgtattctttctgcctt

SEQ ID NO: 5959482 - DNA, 16 bp, Homo sapiens
ttatgtatttataatt

SEQ ID NO: 5959483 - DNA, 11 bp, Homo sapiens
ttatgtatttc

SEQ ID NO: 5959484 - DNA, 22 bp, Homo sapiens
ttatgtattttccaagtaaaat

SEQ ID NO: 5959485 - DNA, 15 bp, Homo sapiens
ttatgtattttgaaa

SEQ ID NO: 5959486 - DNA, 16 bp, Homo sapiens
ttatgtattttgaaaa

SEQ ID NO: 5959487 - DNA, 15 bp, Homo sapiens
ttatgtcaaatggat

SEQ ID NO: 5959488 - DNA, 22 bp, Homo sapiens
ttatgtcagcacacacttacag

SEQ ID NO: 5959489 - DNA, 16 bp, Homo sapiens
ttatgtcatagtttaa

SEQ ID NO: 5959490 - DNA, 14 bp, Homo sapiens
ttatgtcattttca

SEQ ID NO: 5959491 - DNA, 17 bp, Homo sapiens
ttatgtccactgtgtat

SEQ ID NO: 5959492 - DNA, 22 bp, Homo sapiens
ttatgtctcatgtaatttgcat

SEQ ID NO: 5959493 - DNA, 14 bp, Homo sapiens
ttatgtctgtttaa

SEQ ID NO: 5959494 - DNA, 15 bp, Homo sapiens
ttatgtcttcttttg

SEQ ID NO: 5959495 - DNA, 13 bp, Homo sapiens
ttatgtcttttat

SEQ ID NO: 5959496 - DNA, 21 bp, Homo sapiens
ttatgtcttttatatttgtat

SEQ ID NO: 5959497 - DNA, 21 bp, Homo sapiens
ttatgtcttttgatgaataga

SEQ ID NO: 5959498 - DNA, 13 bp, Homo sapiens
ttatgtgaaaaat

SEQ ID NO: 5959499 - DNA, 13 bp, Homo sapiens
ttatgtgaaacat

SEQ ID NO: 5959500 - DNA, 17 bp, Homo sapiens
ttatgtgaacaactgtt

SEQ ID NO: 5959501 - DNA, 17 bp, Homo sapiens
ttatgtgacaacctttg

SEQ ID NO: 5959502 - DNA, 15 bp, Homo sapiens
ttatgtgacattaac

SEQ ID NO: 5959503 - DNA, 13 bp, Homo sapiens
ttatgtgagagaa

SEQ ID NO: 5959504 - DNA, 13 bp, Homo sapiens
ttatgtgagattt

SEQ ID NO: 5959505 - DNA, 13 bp, Homo sapiens
ttatgtgatgcca

SEQ ID NO: 5959506 - DNA, 12 bp, Homo sapiens
ttatgtgatttt

SEQ ID NO: 5959507 - DNA, 15 bp, Homo sapiens
ttatgtgcactgcct

SEQ ID NO: 5959508 - DNA, 12 bp, Homo sapiens
ttatgtgcagcg

SEQ ID NO: 5959509 - DNA, 20 bp, Homo sapiens
ttatgtgcagcgacccttgg

SEQ ID NO: 5959510 - DNA, 13 bp, Homo sapiens
ttatgtgctatgc

SEQ ID NO: 5959511 - DNA, 22 bp, Homo sapiens
ttatgtgctgttagaatatgtt

SEQ ID NO: 5959512 - DNA, 15 bp, Homo sapiens
ttatgtggaataata

SEQ ID NO: 5959513 - DNA, 16 bp, Homo sapiens
ttatgtggaataatac

SEQ ID NO: 5959514 - DNA, 12 bp, Homo sapiens
ttatgtggagac

SEQ ID NO: 5959515 - DNA, 19 bp, Homo sapiens
ttatgtggctgtaatgaca

SEQ ID NO: 5959516 - DNA, 15 bp, Homo sapiens
ttatgtggcttttat

SEQ ID NO: 5959517 - DNA, 19 bp, Homo sapiens
ttatgtggcttttatttca

SEQ ID NO: 5959518 - DNA, 20 bp, Homo sapiens
ttatgtgggttatcatggaa

SEQ ID NO: 5959519 - DNA, 19 bp, Homo sapiens
ttatgtgggttgcctggtg

SEQ ID NO: 5959520 - DNA, 16 bp, Homo sapiens
ttatgtggttttagat

SEQ ID NO: 5959521 - DNA, 21 bp, Homo sapiens
ttatgtgtaggtgaacagtca

SEQ ID NO: 5959522 - DNA, 23 bp, Homo sapiens
ttatgtgtaggtgaacagtcacg

SEQ ID NO: 5959523 - DNA, 22 bp, Homo sapiens
ttatgtgtagttgtctctcttc

SEQ ID NO: 5959524 - DNA, 16 bp, Homo sapiens
ttatgtgtatatttgt

SEQ ID NO: 5959525 - DNA, 18 bp, Homo sapiens
ttatgtgtatatttgtag

SEQ ID NO: 5959526 - DNA, 13 bp, Homo sapiens
ttatgtgtatgtg

SEQ ID NO: 5959527 - DNA, 20 bp, Homo sapiens
ttatgtgtctggaagaagca

SEQ ID NO: 5959528 - DNA, 12 bp, Homo sapiens
ttatgtgtgtgt

SEQ ID NO: 5959529 - DNA, 20 bp, Homo sapiens
ttatgtgttacattattcca

SEQ ID NO: 5959530 - DNA, 17 bp, Homo sapiens
ttatgtgttttaataaa

SEQ ID NO: 5959531 - DNA, 14 bp, Homo sapiens
ttatgttaaactag

SEQ ID NO: 5959532 - DNA, 17 bp, Homo sapiens
ttatgttaaatcaataa

SEQ ID NO: 5959533 - DNA, 20 bp, Homo sapiens
ttatgttactgtatttttca

SEQ ID NO: 5959534 - DNA, 14 bp, Homo sapiens
ttatgttagtttaa

SEQ ID NO: 5959535 - DNA, 18 bp, Homo sapiens
ttatgttatatataaata

SEQ ID NO: 5959536 - DNA, 18 bp, Homo sapiens
ttatgttattgaaaaaaa

SEQ ID NO: 5959537 - DNA, 16 bp, Homo sapiens
ttatttgtgtaataga

SEQ ID NO: 5959538 - DNA, 18 bp, Homo sapiens
ttatttgttattttcagt

SEQ ID NO: 5959539 - DNA, 12 bp, Homo sapiens
ttatttgttgag

SEQ ID NO: 5959540 - DNA, 20 bp, Homo sapiens
ttatttgtttatatttaatt

SEQ ID NO: 5959541 - DNA, 14 bp, Homo sapiens
ttatttgtttgtct

SEQ ID NO: 5959542 - DNA, 22 bp, Homo sapiens
ttatttgtttgttttagaagat

SEQ ID NO: 5959543 - DNA, 14 bp, Homo sapiens
ttattttaaattat

SEQ ID NO: 5959544 - DNA, 23 bp, Homo sapiens
ttattttaaattataaggactgc

SEQ ID NO: 5959545 - DNA, 12 bp, Homo sapiens
ttattttaagac

SEQ ID NO: 5959546 - DNA, 17 bp, Homo sapiens
ttattttaataatgttt

SEQ ID NO: 5959547 - DNA, 19 bp, Homo sapiens
ttattttaataatgtttca

SEQ ID NO: 5959548 - DNA, 24 bp, Homo sapiens
ttattttaatattttgtattttca

SEQ ID NO: 5959549 - DNA, 14 bp, Homo sapiens
ttattttaatgtga

SEQ ID NO: 5959550 - DNA, 16 bp, Homo sapiens
ttattttaatgtgatg

SEQ ID NO: 5959551 - DNA, 15 bp, Homo sapiens
ttattttacaaattg

SEQ ID NO: 5959552 - DNA, 16 bp, Homo sapiens
ttattttacacagaaa

SEQ ID NO: 5959553 - DNA, 20 bp, Homo sapiens
ttattttacagctcattaaa

SEQ ID NO: 5959554 - DNA, 12 bp, Homo sapiens
ttattttacatt

SEQ ID NO: 5959555 - DNA, 14 bp, Homo sapiens
ttattttacattta

SEQ ID NO: 5959556 - DNA, 13 bp, Homo sapiens
ttattttagcaaa

SEQ ID NO: 5959557 - DNA, 14 bp, Homo sapiens
ttattttagcaaat

SEQ ID NO: 5959558 - DNA, 18 bp, Homo sapiens
ttattttagcttcagttg

SEQ ID NO: 5959559 - DNA, 21 bp, Homo sapiens
ttattttagcttcagttgttc

SEQ ID NO: 5959560 - DNA, 18 bp, Homo sapiens
ttattttaggagacagtc

SEQ ID NO: 5959561 - DNA, 23 bp, Homo sapiens
ttattttaggcactgttcaatac

SEQ ID NO: 5959562 - DNA, 12 bp, Homo sapiens
ttattttataac

SEQ ID NO: 5959563 - DNA, 22 bp, Homo sapiens
ttattttatgacatgaaaagtt

SEQ ID NO: 5959564 - DNA, 18 bp, Homo sapiens
ttattttatgtcatagtt

SEQ ID NO: 5959565 - DNA, 13 bp, Homo sapiens
ttattttatgtct

SEQ ID NO: 5959566 - DNA, 13 bp, Homo sapiens
ttattttattatg

SEQ ID NO: 5959567 - DNA, 17 bp, Homo sapiens
ttattttattattcaga

SEQ ID NO: 5959568 - DNA, 14 bp, Homo sapiens
ttattttatttgct

SEQ ID NO: 5959569 - DNA, 18 bp, Homo sapiens
ttattttattttagcagt

SEQ ID NO: 5959570 - DNA, 15 bp, Homo sapiens
ttattttcaagtagc

SEQ ID NO: 5959571 - DNA, 15 bp, Homo sapiens
ttattttcagaagct

SEQ ID NO: 5959572 - DNA, 21 bp, Homo sapiens
ttattttcagtatactgtgtg

SEQ ID NO: 5959573 - DNA, 14 bp, Homo sapiens
ttattttcagtgat

SEQ ID NO: 5959574 - DNA, 18 bp, Homo sapiens
ttattttcataattcatt

SEQ ID NO: 5959575 - DNA, 14 bp, Homo sapiens
ttattttcattaca

SEQ ID NO: 5959576 - DNA, 19 bp, Homo sapiens
ttattttcattctgccaaa

SEQ ID NO: 5959577 - DNA, 13 bp, Homo sapiens
ttattttcattgt

SEQ ID NO: 5959578 - DNA, 15 bp, Homo sapiens
ttattttccaataaa

SEQ ID NO: 5959579 - DNA, 14 bp, Homo sapiens
ttattttcctcccc

SEQ ID NO: 5959580 - DNA, 14 bp, Homo sapiens
ttattttccttcca

SEQ ID NO: 5959581 - DNA, 16 bp, Homo sapiens
ttattttccttctgaa

SEQ ID NO: 5959582 - DNA, 16 bp, Homo sapiens
ttattttctaaattct

SEQ ID NO: 5959583 - DNA, 18 bp, Homo sapiens
ttattttctccaaataaa

SEQ ID NO: 5959584 - DNA, 16 bp, Homo sapiens
ttattttctcctgata

SEQ ID NO: 5959585 - DNA, 14 bp, Homo sapiens
ttattttctgtaat

SEQ ID NO: 5959586 - DNA, 15 bp, Homo sapiens
ttattttctgtcaga

SEQ ID NO: 5959587 - DNA, 13 bp, Homo sapiens
ttattttctgttc

SEQ ID NO: 5959588 - DNA, 14 bp, Homo sapiens
ttattttcttatgt

SEQ ID NO: 5959589 - DNA, 16 bp, Homo sapiens
ttattttcttgtttaa

SEQ ID NO: 5959590 - DNA, 21 bp, Homo sapiens
ttattttctttttcttaagaa

SEQ ID NO: 5959591 - DNA, 12 bp, Homo sapiens
ttattttgaatg

SEQ ID NO: 5959592 - DNA, 15 bp, Homo sapiens
ttattttgacataaa

SEQ ID NO: 5959593 - DNA, 21 bp, Homo sapiens
ttattttgagatgtaaaaaga

SEQ ID NO: 5959594 - DNA, 14 bp, Homo sapiens
ttattttgccagtt

SEQ ID NO: 5959595 - DNA, 23 bp, Homo sapiens
ttattttgccatggatgagagtc

SEQ ID NO: 5959596 - DNA, 18 bp, Homo sapiens
ttattttgctccctctgt

SEQ ID NO: 5959597 - DNA, 11 bp, Homo sapiens
ttattttgctg

SEQ ID NO: 5959598 - DNA, 22 bp, Homo sapiens
ttattttggaaaataaattatt

SEQ ID NO: 5959599 - DNA, 13 bp, Homo sapiens
ttattttggaact

SEQ ID NO: 5959600 - DNA, 16 bp, Homo sapiens
ttattttggaactatg

SEQ ID NO: 5959601 - DNA, 17 bp, Homo sapiens
ttattttggaactatga

SEQ ID NO: 5959602 - DNA, 17 bp, Homo sapiens
ttattttggattgtgga

SEQ ID NO: 5959603 - DNA, 20 bp, Homo sapiens
ttattttggcttcatttcaa

SEQ ID NO: 5959604 - DNA, 20 bp, Homo sapiens
ttattttgggcctgttcctt

SEQ ID NO: 5959605 - DNA, 15 bp, Homo sapiens
ttattttggggtctc

SEQ ID NO: 5959606 - DNA, 20 bp, Homo sapiens
ttattttgggttcaggcctg

SEQ ID NO: 5959607 - DNA, 13 bp, Homo sapiens
ttattttggtact

SEQ ID NO: 5959608 - DNA, 13 bp, Homo sapiens
ttattttgtaata

SEQ ID NO: 5959609 - DNA, 14 bp, Homo sapiens
ttattttgtaataa

SEQ ID NO: 5959610 - DNA, 16 bp, Homo sapiens
ttattttgtaataaac

SEQ ID NO: 5959611 - DNA, 18 bp, Homo sapiens
ttattttgtattacatct

SEQ ID NO: 5959612 - DNA, 13 bp, Homo sapiens
ttattttgtctta

SEQ ID NO: 5959613 - DNA, 13 bp, Homo sapiens
ttattttgtgaac

SEQ ID NO: 5959614 - DNA, 22 bp, Homo sapiens
ttattttgtgatgcaaataaat

SEQ ID NO: 5959615 - DNA, 17 bp, Homo sapiens
ttattttgttactgtct

SEQ ID NO: 5959616 - DNA, 19 bp, Homo sapiens
ttattttgttactgtctgt

SEQ ID NO: 5959617 - DNA, 20 bp, Homo sapiens
ttattttgtttaagtggctt

SEQ ID NO: 5959618 - DNA, 14 bp, Homo sapiens
ttattttgtttcaa

SEQ ID NO: 5959619 - DNA, 19 bp, Homo sapiens
ttatttttaaaataaaaat

SEQ ID NO: 5959620 - DNA, 14 bp, Homo sapiens
ttatttttaaagat

SEQ ID NO: 5959621 - DNA, 18 bp, Homo sapiens
ttatttttaaattttctt

SEQ ID NO: 5959622 - DNA, 16 bp, Homo sapiens
ttatttttaagaaaga

SEQ ID NO: 5959623 - DNA, 18 bp, Homo sapiens
ttatttttagacagagtc

SEQ ID NO: 5959624 - DNA, 15 bp, Homo sapiens
ttatttttataaaac

SEQ ID NO: 5959625 - DNA, 15 bp, Homo sapiens
ttatttttataatta

SEQ ID NO: 5959626 - DNA, 18 bp, Homo sapiens
ttatttttataattgtac

SEQ ID NO: 5959627 - DNA, 22 bp, Homo sapiens
ttatttttatacagtagtgaga

SEQ ID NO: 5959628 - DNA, 19 bp, Homo sapiens
ttatttttatatagcttga

SEQ ID NO: 5959629 - DNA, 18 bp, Homo sapiens
ttatttttattaaatgta

SEQ ID NO: 5959630 - DNA, 19 bp, Homo sapiens
ttatttttcatattgtgcc

SEQ ID NO: 5959631 - DNA, 13 bp, Homo sapiens
ttatttttcctgt

SEQ ID NO: 5959632 - DNA, 15 bp, Homo sapiens
ttatttttcctgtcc

SEQ ID NO: 5959633 - DNA, 13 bp, Homo sapiens
ttatttttctaaa

SEQ ID NO: 5959634 - DNA, 22 bp, Homo sapiens
ttatttttctaaggttctcata

SEQ ID NO: 5959635 - DNA, 16 bp, Homo sapiens
ttatttttctaagtgt

SEQ ID NO: 5959636 - DNA, 16 bp, Homo sapiens
ttatttttctatgaat

SEQ ID NO: 5959637 - DNA, 14 bp, Homo sapiens
ttatttttctctct

SEQ ID NO: 5959638 - DNA, 16 bp, Homo sapiens
ttatttttctgtgggt

SEQ ID NO: 5959639 - DNA, 13 bp, Homo sapiens
ttatttttcttac

SEQ ID NO: 5959640 - DNA, 15 bp, Homo sapiens
ttatttttcttacca

SEQ ID NO: 5959641 - DNA, 22 bp, Homo sapiens
ttatttttcttaccaattgtga

SEQ ID NO: 5959642 - DNA, 19 bp, Homo sapiens
ttatttttcttactggaaa

SEQ ID NO: 5959643 - DNA, 18 bp, Homo sapiens
ttatttttgaattcttta

SEQ ID NO: 5959644 - DNA, 23 bp, Homo sapiens
ttatttttgacagtgttgaaaat

SEQ ID NO: 5959645 - DNA, 13 bp, Homo sapiens
ttatttttgcaaa

SEQ ID NO: 5959646 - DNA, 22 bp, Homo sapiens
ttatttttgggtttggccaggg

SEQ ID NO: 5959647 - DNA, 16 bp, Homo sapiens
ttatttttgtacattt

SEQ ID NO: 5959648 - DNA, 17 bp, Homo sapiens
ttatttttgtactgtgc

SEQ ID NO: 5959649 - DNA, 15 bp, Homo sapiens
ttatttttgtataaa

SEQ ID NO: 5959650 - DNA, 15 bp, Homo sapiens
ttatttttgtatttt

SEQ ID NO: 5959651 - DNA, 13 bp, Homo sapiens
ttattttttaaga

SEQ ID NO: 5959652 - DNA, 22 bp, Homo sapiens
ttattttttaagtgggctcctg

SEQ ID NO: 5959653 - DNA, 19 bp, Homo sapiens
ttattttttagtgatgaga

SEQ ID NO: 5959654 - DNA, 18 bp, Homo sapiens
ttattttttctacacagt

SEQ ID NO: 5959655 - DNA, 20 bp, Homo sapiens
ttattttttctacacagtaa

SEQ ID NO: 5959656 - DNA, 20 bp, Homo sapiens
ttattttttcttttgtaatt

SEQ ID NO: 5959657 - DNA, 21 bp, Homo sapiens
ttattttttggacttcaaagc

SEQ ID NO: 5959658 - DNA, 15 bp, Homo sapiens
ttattttttgggcca

SEQ ID NO: 5959659 - DNA, 23 bp, Homo sapiens
ttattttttggtggtgaaattga

SEQ ID NO: 5959660 - DNA, 17 bp, Homo sapiens
ttattttttgtaactct

SEQ ID NO: 5959661 - DNA, 24 bp, Homo sapiens
ttatttttttctacataattgtga

SEQ ID NO: 5959662 - DNA, 19 bp, Homo sapiens
ttattttttttaattgtat

SEQ ID NO: 5959663 - DNA, 16 bp, Homo sapiens
ttattttttttcaaaa

SEQ ID NO: 5959664 - DNA, 19 bp, Homo sapiens
ttattttttttcaaaatga

SEQ ID NO: 5959665 - DNA, 21 bp, Homo sapiens
ttattttttttcttccaacat

SEQ ID NO: 5959666 - DNA, 20 bp, Homo sapiens
ttattttttttttttgaaaa

SEQ ID NO: 5959667 - DNA, 22 bp, Homo sapiens
ttcaaaaaaaaaaaaaaagact

SEQ ID NO: 5959668 - DNA, 21 bp, Homo sapiens
ttcaaaaaaaaaaaaaagaga

SEQ ID NO: 5959669 - DNA, 14 bp, Homo sapiens
ttcaaaaaaacact

SEQ ID NO: 5959670 - DNA, 18 bp, Homo sapiens
ttcaaaaaaatgttttta

SEQ ID NO: 5959671 - DNA, 16 bp, Homo sapiens
ttcaaaaaacttgtaa

SEQ ID NO: 5959672 - DNA, 23 bp, Homo sapiens
ttcaaaaacacagtgtttttgta

SEQ ID NO: 5959673 - DNA, 22 bp, Homo sapiens
ttcaaaaacatgcttttccaaa

SEQ ID NO: 5959674 - DNA, 16 bp, Homo sapiens
ttcaaaaacatttcat

SEQ ID NO: 5959675 - DNA, 17 bp, Homo sapiens
ttcaaaaaccagccagg

SEQ ID NO: 5959676 - DNA, 18 bp, Homo sapiens
ttcaaaaactaaaatcat

SEQ ID NO: 5959677 - DNA, 16 bp, Homo sapiens
ttcaaaaagaactaaa

SEQ ID NO: 5959678 - DNA, 17 bp, Homo sapiens
ttcaaaaagccaaaata

SEQ ID NO: 5959679 - DNA, 21 bp, Homo sapiens
ttcaaaaagtctacgctctcc

SEQ ID NO: 5959680 - DNA, 13 bp, Homo sapiens
ttcaaaaagtgtt

SEQ ID NO: 5959681 - DNA, 17 bp, Homo sapiens
ttcaaaaagtgtttatt

SEQ ID NO: 5959682 - DNA, 15 bp, Homo sapiens
ttcaaaaatataact

SEQ ID NO: 5959683 - DNA, 16 bp, Homo sapiens
ttcaaaaatctgaaga

SEQ ID NO: 5959684 - DNA, 12 bp, Homo sapiens
ttcaaaaatgct

SEQ ID NO: 5959685 - DNA, 14 bp, Homo sapiens
ttcaaaaatgctgt

SEQ ID NO: 5959686 - DNA, 11 bp, Homo sapiens
ttcaaaaatgt

SEQ ID NO: 5959687 - DNA, 17 bp, Homo sapiens
ttcaaaaatgtacaaaa

SEQ ID NO: 5959688 - DNA, 21 bp, Homo sapiens
ttcaaaaattacactacaagt

SEQ ID NO: 5959689 - DNA, 20 bp, Homo sapiens
ttcaaaaattgtgtttagat

SEQ ID NO: 5959690 - DNA, 13 bp, Homo sapiens
ttcaaaaatttca

SEQ ID NO: 5959691 - DNA, 13 bp, Homo sapiens
ttcaaaaatttgg

SEQ ID NO: 5959692 - DNA, 16 bp, Homo sapiens
ttcaaaacagttactt

SEQ ID NO: 5959693 - DNA, 19 bp, Homo sapiens
ttcaaaacagttacttaag

SEQ ID NO: 5959694 - DNA, 21 bp, Homo sapiens
ttcaaaacattctcctttgca

SEQ ID NO: 5959695 - DNA, 18 bp, Homo sapiens
ttcaaaacattgtgccat

SEQ ID NO: 5959696 - DNA, 20 bp, Homo sapiens
ttcaaaaccaggtccaatga

SEQ ID NO: 5959697 - DNA, 15 bp, Homo sapiens
ttcaaaactgtttgt

SEQ ID NO: 5959698 - DNA, 13 bp, Homo sapiens
ttcaaaagaaaac

SEQ ID NO: 5959699 - DNA, 23 bp, Homo sapiens
ttcaaaagcaaaacatctctgca

SEQ ID NO: 5959700 - DNA, 23 bp, Homo sapiens
ttcaaaagcacaaaccctgggga

SEQ ID NO: 5959701 - DNA, 22 bp, Homo sapiens
ttcaaaagctttttgatgtata

SEQ ID NO: 5959702 - DNA, 15 bp, Homo sapiens
ttcaaaagtaagaat

SEQ ID NO: 5959703 - DNA, 21 bp, Homo sapiens
ttcaaaagtaatgcctctgtc

SEQ ID NO: 5959704 - DNA, 20 bp, Homo sapiens
ttcaaaagtattttcctgta

SEQ ID NO: 5959705 - DNA, 17 bp, Homo sapiens
ttcaaaataaaaatgag

SEQ ID NO: 5959706 - DNA, 17 bp, Homo sapiens
ttcaaaataaaatatca

SEQ ID NO: 5959707 - DNA, 21 bp, Homo sapiens
ttcaaaataaacaataaatgg

SEQ ID NO: 5959708 - DNA, 23 bp, Homo sapiens
ttcaaaataaagcttttgcatag

SEQ ID NO: 5959709 - DNA, 15 bp, Homo sapiens
ttcaaaatacttctt

SEQ ID NO: 5959710 - DNA, 16 bp, Homo sapiens
ttcaaaatacttcttt

SEQ ID NO: 5959711 - DNA, 19 bp, Homo sapiens
ttcaaaatagggtatattt

SEQ ID NO: 5959712 - DNA, 20 bp, Homo sapiens
ttcaaaatagggtatatttt

SEQ ID NO: 5959713 - DNA, 17 bp, Homo sapiens
ttcaaaatagttctatt

SEQ ID NO: 5959714 - DNA, 21 bp, Homo sapiens
ttcaaaatagttctatttcta

SEQ ID NO: 5959715 - DNA, 16 bp, Homo sapiens
ttcaaaatatattgaa

SEQ ID NO: 5959716 - DNA, 16 bp, Homo sapiens
ttcactgaatacaaat

SEQ ID NO: 5959717 - DNA, 20 bp, Homo sapiens
ttcactgaatatcatatgta

SEQ ID NO: 5959718 - DNA, 23 bp, Homo sapiens
ttcactgaatttcaaacatttgt

SEQ ID NO: 5959719 - DNA, 19 bp, Homo sapiens
ttcactgaccagcggctgc

SEQ ID NO: 5959720 - DNA, 21 bp, Homo sapiens
ttcactgagagctgcctcctg

SEQ ID NO: 5959721 - DNA, 15 bp, Homo sapiens
ttcactgattggaag

SEQ ID NO: 5959722 - DNA, 21 bp, Homo sapiens
ttcactgcagatttctcacct

SEQ ID NO: 5959723 - DNA, 12 bp, Homo sapiens
ttcactgcagcc

SEQ ID NO: 5959724 - DNA, 13 bp, Homo sapiens
ttcactgccatga

SEQ ID NO: 5959725 - DNA, 20 bp, Homo sapiens
ttcactgccttcctctctct

SEQ ID NO: 5959726 - DNA, 16 bp, Homo sapiens
ttcactgcctttgctc

SEQ ID NO: 5959727 - DNA, 10 bp, Homo sapiens
ttcactgctg

SEQ ID NO: 5959728 - DNA, 17 bp, Homo sapiens
ttcactgctggctgcct

SEQ ID NO: 5959729 - DNA, 18 bp, Homo sapiens
ttcactgctggctgcctt

SEQ ID NO: 5959730 - DNA, 23 bp, Homo sapiens
ttcactgctgttatatttcatca

SEQ ID NO: 5959731 - DNA, 16 bp, Homo sapiens
ttcactggaaaggaaa

SEQ ID NO: 5959732 - DNA, 20 bp, Homo sapiens
ttcactggaaaggaaagatg

SEQ ID NO: 5959733 - DNA, 19 bp, Homo sapiens
ttcactggagttacattaa

SEQ ID NO: 5959734 - DNA, 14 bp, Homo sapiens
ttcactggcataaa

SEQ ID NO: 5959735 - DNA, 21 bp, Homo sapiens
ttcactggcataaatctgaag

SEQ ID NO: 5959736 - DNA, 21 bp, Homo sapiens
ttcactggcgccttctcggag

SEQ ID NO: 5959737 - DNA, 14 bp, Homo sapiens
ttcactgggccagt

SEQ ID NO: 5959738 - DNA, 21 bp, Homo sapiens
ttcactggggcatgagatttt

SEQ ID NO: 5959739 - DNA, 19 bp, Homo sapiens
ttcactggtctctaagtgt

SEQ ID NO: 5959740 - DNA, 16 bp, Homo sapiens
ttcactggttttacac

SEQ ID NO: 5959741 - DNA, 20 bp, Homo sapiens
ttcactgtaagactcattcc

SEQ ID NO: 5959742 - DNA, 18 bp, Homo sapiens
ttcactgtactgcatgtg

SEQ ID NO: 5959743 - DNA, 15 bp, Homo sapiens
ttcactgtagaatga

SEQ ID NO: 5959744 - DNA, 16 bp, Homo sapiens
ttcactgtataaatag

SEQ ID NO: 5959745 - DNA, 23 bp, Homo sapiens
ttcactgtataaataggagagga

SEQ ID NO: 5959746 - DNA, 22 bp, Homo sapiens
ttcactgtatataaacatattt

SEQ ID NO: 5959747 - DNA, 20 bp, Homo sapiens
ttcactgtcaccaccctgct

SEQ ID NO: 5959748 - DNA, 23 bp, Homo sapiens
ttcactgtcaccaccctgctcat

SEQ ID NO: 5959749 - DNA, 22 bp, Homo sapiens
ttcactgtcaggaagaaatcac

SEQ ID NO: 5959750 - DNA, 16 bp, Homo sapiens
ttcactgtcatcttca

SEQ ID NO: 5959751 - DNA, 16 bp, Homo sapiens
ttcactgtctgtctgg

SEQ ID NO: 5959752 - DNA, 17 bp, Homo sapiens
ttcactgtctgttgctt

SEQ ID NO: 5959753 - DNA, 22 bp, Homo sapiens
ttcactgtgttggccaggctgg

SEQ ID NO: 5959754 - DNA, 16 bp, Homo sapiens
ttcactgttagctttt

SEQ ID NO: 5959755 - DNA, 21 bp, Homo sapiens
ttcactgttgaaaattatttt

SEQ ID NO: 5959756 - DNA, 21 bp, Homo sapiens
ttcactgtttcacttgctctt

SEQ ID NO: 5959757 - DNA, 22 bp, Homo sapiens
ttcactgtttcctattaatctt

SEQ ID NO: 5959758 - DNA, 18 bp, Homo sapiens
ttcacttaaactttgtca

SEQ ID NO: 5959759 - DNA, 19 bp, Homo sapiens
ttcacttaaactttgtcac

SEQ ID NO: 5959760 - DNA, 15 bp, Homo sapiens
ttcacttaacaaaca

SEQ ID NO: 5959761 - DNA, 15 bp, Homo sapiens
ttcacttaataattt

SEQ ID NO: 5959762 - DNA, 15 bp, Homo sapiens
ttcacttacagcacc

SEQ ID NO: 5959763 - DNA, 16 bp, Homo sapiens
ttcacttacctgaaaa

SEQ ID NO: 5959764 - DNA, 13 bp, Homo sapiens
ttcacttcaaagc

SEQ ID NO: 5959765 - DNA, 12 bp, Homo sapiens
ttcacttcactg

SEQ ID NO: 5959766 - DNA, 14 bp, Homo sapiens
ttcacttcactgtg

SEQ ID NO: 5959767 - DNA, 15 bp, Homo sapiens
ttcacttcatcttct

SEQ ID NO: 5959768 - DNA, 15 bp, Homo sapiens
ttcacttcctccaga

SEQ ID NO: 5959769 - DNA, 16 bp, Homo sapiens
ttcacttcctccagaa

SEQ ID NO: 5959770 - DNA, 23 bp, Homo sapiens
ttcacttcgatgactggatacag

SEQ ID NO: 5959771 - DNA, 13 bp, Homo sapiens
ttcacttcttaag

SEQ ID NO: 5959772 - DNA, 15 bp, Homo sapiens
ttcacttctttccct

SEQ ID NO: 5959773 - DNA, 17 bp, Homo sapiens
ttcacttgaaagatttt

SEQ ID NO: 5959774 - DNA, 13 bp, Homo sapiens
ttcacttgcacat

SEQ ID NO: 5959775 - DNA, 14 bp, Homo sapiens
ttcacttgcacatc

SEQ ID NO: 5959776 - DNA, 18 bp, Homo sapiens
ttcacttgcacatcatgg

SEQ ID NO: 5959777 - DNA, 21 bp, Homo sapiens
ttcacttgccatgcaggaaga

SEQ ID NO: 5959778 - DNA, 13 bp, Homo sapiens
ttcacttgtattg

SEQ ID NO: 5959779 - DNA, 17 bp, Homo sapiens
ttcacttgtattgactt

SEQ ID NO: 5959780 - DNA, 18 bp, Homo sapiens
ttcacttgtctcctttct

SEQ ID NO: 5959781 - DNA, 15 bp, Homo sapiens
ttcacttgtgtttgt

SEQ ID NO: 5959782 - DNA, 12 bp, Homo sapiens
ttcactttaaag

SEQ ID NO: 5959783 - DNA, 22 bp, Homo sapiens
ttcactttaaagtctttccgtc

SEQ ID NO: 5959784 - DNA, 14 bp, Homo sapiens
ttcactttcttcaa

SEQ ID NO: 5959785 - DNA, 14 bp, Homo sapiens
ttcactttgaaaaa

SEQ ID NO: 5959786 - DNA, 14 bp, Homo sapiens
ttcactttgacact

SEQ ID NO: 5959787 - DNA, 23 bp, Homo sapiens
ttcactttgtgtattaaatggtt

SEQ ID NO: 5959788 - DNA, 20 bp, Homo sapiens
ttcacttttagggagagtca

SEQ ID NO: 5959789 - DNA, 16 bp, Homo sapiens
ttcacttttattgtat

SEQ ID NO: 5959790 - DNA, 24 bp, Homo sapiens
ttcacttttccggggcacaagttt

SEQ ID NO: 5959791 - DNA, 16 bp, Homo sapiens
ttcacttttgttctgc

SEQ ID NO: 5959792 - DNA, 17 bp, Homo sapiens
ttcacttttgttctgct

SEQ ID NO: 5959793 - DNA, 22 bp, Homo sapiens
ttcacttttgttgcccaggctg

SEQ ID NO: 5959794 - DNA, 19 bp, Homo sapiens
ttcagaaaaaatgtgaagt

SEQ ID NO: 5959795 - DNA, 14 bp, Homo sapiens
ttcagaaaaagaaa

SEQ ID NO: 5959796 - DNA, 20 bp, Homo sapiens
ttcagaaaaattaaaaaaga

SEQ ID NO: 5959797 - DNA, 17 bp, Homo sapiens
ttcagaaaacagaaaaa

SEQ ID NO: 5959798 - DNA, 23 bp, Homo sapiens
ttcagaaaacagaaaaaaaacac

SEQ ID NO: 5959799 - DNA, 13 bp, Homo sapiens
ttcagaaaagaca

SEQ ID NO: 5959800 - DNA, 14 bp, Homo sapiens
ttcagaaaagacac

SEQ ID NO: 5959801 - DNA, 15 bp, Homo sapiens
ttcagaaaagacact

SEQ ID NO: 5959802 - DNA, 13 bp, Homo sapiens
ttcagaaaatatt

SEQ ID NO: 5959803 - DNA, 20 bp, Homo sapiens
ttcagaaaatattatgtgtt

SEQ ID NO: 5959804 - DNA, 13 bp, Homo sapiens
ttcagaaaattaa

SEQ ID NO: 5959805 - DNA, 18 bp, Homo sapiens
ttcagaaacagggcagca

SEQ ID NO: 5959806 - DNA, 21 bp, Homo sapiens
ttcagaaacagggcagcagtg

SEQ ID NO: 5959807 - DNA, 14 bp, Homo sapiens
ttcagaaacttttt

SEQ ID NO: 5959808 - DNA, 19 bp, Homo sapiens
ttcagaaagatgaagaaga

SEQ ID NO: 5959809 - DNA, 20 bp, Homo sapiens
ttcagaaagggcagcccctc

SEQ ID NO: 5959810 - DNA, 22 bp, Homo sapiens
ttcagaaaggggctcttctgag

SEQ ID NO: 5959811 - DNA, 16 bp, Homo sapiens
ttcagaaagtgtgctt

SEQ ID NO: 5959812 - DNA, 23 bp, Homo sapiens
ttcagaaataaaatgaaatgtct

SEQ ID NO: 5959813 - DNA, 11 bp, Homo sapiens
ttcagaaatat

SEQ ID NO: 5959814 - DNA, 20 bp, Homo sapiens
ttcagaaatataacacattt

SEQ ID NO: 5959815 - DNA, 21 bp, Homo sapiens
ttcagaaatataacacatttt

SEQ ID NO: 5959816 - DNA, 22 bp, Homo sapiens
ttcagaaatataacacattttt

SEQ ID NO: 5959817 - DNA, 16 bp, Homo sapiens
ttcagaaatgctgcct

SEQ ID NO: 5959818 - DNA, 19 bp, Homo sapiens
ttcagaaatgctgcctgcc

SEQ ID NO: 5959819 - DNA, 18 bp, Homo sapiens
ttcagaaattaaaatatt

SEQ ID NO: 5959820 - DNA, 18 bp, Homo sapiens
ttcagaaattctcaaaat

SEQ ID NO: 5959821 - DNA, 14 bp, Homo sapiens
ttcagaaatttaaa

SEQ ID NO: 5959822 - DNA, 22 bp, Homo sapiens
ttcagaacacacagactttctg

SEQ ID NO: 5959823 - DNA, 23 bp, Homo sapiens
ttcagaacacacagactttctgt

SEQ ID NO: 5959824 - DNA, 13 bp, Homo sapiens
ttcagaacacttt

SEQ ID NO: 5959825 - DNA, 23 bp, Homo sapiens
ttcagaaccccaactactgtgtt

SEQ ID NO: 5959826 - DNA, 17 bp, Homo sapiens
ttcagaacctcttcccc

SEQ ID NO: 5959827 - DNA, 17 bp, Homo sapiens
ttcagaactaaattttt

SEQ ID NO: 5959828 - DNA, 21 bp, Homo sapiens
ttcagaactaaatttttcata

SEQ ID NO: 5959829 - DNA, 18 bp, Homo sapiens
ttcagaactatttaaaat

SEQ ID NO: 5959830 - DNA, 15 bp, Homo sapiens
ttcagaactctcaga

SEQ ID NO: 5959831 - DNA, 17 bp, Homo sapiens
ttcagaactctcagact

SEQ ID NO: 5959832 - DNA, 19 bp, Homo sapiens
ttcagaacttcatctgcca

SEQ ID NO: 5959833 - DNA, 20 bp, Homo sapiens
ttcagaacttcatctgccac

SEQ ID NO: 5959834 - DNA, 12 bp, Homo sapiens
ttcagaagaaaa

SEQ ID NO: 5959835 - DNA, 13 bp, Homo sapiens
ttcagaagaaatt

SEQ ID NO: 5959836 - DNA, 18 bp, Homo sapiens
ttcagaagaatcttcctg

SEQ ID NO: 5959837 - DNA, 19 bp, Homo sapiens
ttcagaagaatcttcctgg

SEQ ID NO: 5959838 - DNA, 15 bp, Homo sapiens
ttcagaagacacaga

SEQ ID NO: 5959839 - DNA, 20 bp, Homo sapiens
ttcagaagatggtgaagaca

SEQ ID NO: 5959840 - DNA, 22 bp, Homo sapiens
ttcagaagatggtgaagacaga

SEQ ID NO: 5959841 - DNA, 16 bp, Homo sapiens
ttcagaaggggagggg

SEQ ID NO: 5959842 - DNA, 21 bp, Homo sapiens
ttcagaaggtaggggccgtgt

SEQ ID NO: 5959843 - DNA, 16 bp, Homo sapiens
ttcagaaggtgtgtcc

SEQ ID NO: 5959844 - DNA, 19 bp, Homo sapiens
ttcagaaggttattttctt

SEQ ID NO: 5959845 - DNA, 11 bp, Homo sapiens
ttcagaagtac

SEQ ID NO: 5959846 - DNA, 17 bp, Homo sapiens
ttcagaagtcacacatt

SEQ ID NO: 5959847 - DNA, 21 bp, Homo sapiens
ttcagaagtgagctttgctgc

SEQ ID NO: 5959848 - DNA, 22 bp, Homo sapiens
ttcagaagtgagctttgctgct

SEQ ID NO: 5959849 - DNA, 21 bp, Homo sapiens
ttcagaagtggagatttcagt

SEQ ID NO: 5959850 - DNA, 20 bp, Homo sapiens
ttcagaagttagtttgtata

SEQ ID NO: 5959851 - DNA, 15 bp, Homo sapiens
ttcagaagtttaaat

SEQ ID NO: 5959852 - DNA, 20 bp, Homo sapiens
ttcagaagtttggcaatagt

SEQ ID NO: 5959853 - DNA, 16 bp, Homo sapiens
ttcagaataagcttcc

SEQ ID NO: 5959854 - DNA, 19 bp, Homo sapiens
ttcagaatattttcaaaat

SEQ ID NO: 5959855 - DNA, 18 bp, Homo sapiens
ttcagaatcaaacctttt

SEQ ID NO: 5959856 - DNA, 17 bp, Homo sapiens
ttcagaatctgaatgta

SEQ ID NO: 5959857 - DNA, 17 bp, Homo sapiens
ttcagaatctttgttaa

SEQ ID NO: 5959858 - DNA, 19 bp, Homo sapiens
ttcagaatggcagtcctgg

SEQ ID NO: 5959859 - DNA, 17 bp, Homo sapiens
ttcagaattaagcagaa

SEQ ID NO: 5959860 - DNA, 23 bp, Homo sapiens
ttcagaattatacagacctaata

SEQ ID NO: 5959861 - DNA, 19 bp, Homo sapiens
ttcagaattttggaaaaat

SEQ ID NO: 5959862 - DNA, 18 bp, Homo sapiens
ttcagaattttgtatatt

SEQ ID NO: 5959863 - DNA, 17 bp, Homo sapiens
ttcagacaacattatga

SEQ ID NO: 5959864 - DNA, 21 bp, Homo sapiens
ttcagacaagacagaggggag

SEQ ID NO: 5959865 - DNA, 20 bp, Homo sapiens
ttcagacacaggaaaaataa

SEQ ID NO: 5959866 - DNA, 15 bp, Homo sapiens
ttcagacacatgcta

SEQ ID NO: 5959867 - DNA, 21 bp, Homo sapiens
ttcagacacatgctatgttct

SEQ ID NO: 5959868 - DNA, 22 bp, Homo sapiens
ttcagacacctgttcacagaaa

SEQ ID NO: 5959869 - DNA, 15 bp, Homo sapiens
ttcagacactttgga

SEQ ID NO: 5959870 - DNA, 16 bp, Homo sapiens
ttcagacactttggaa

SEQ ID NO: 5959871 - DNA, 16 bp, Homo sapiens
ttcagacatagaatta

SEQ ID NO: 5959872 - DNA, 20 bp, Homo sapiens
ttcagacatctgaggtttta

SEQ ID NO: 5959873 - DNA, 20 bp, Homo sapiens
ttcagacatttttggaaatt

SEQ ID NO: 5959874 - DNA, 14 bp, Homo sapiens
ttcagaccagcccc

SEQ ID NO: 5959875 - DNA, 23 bp, Homo sapiens
ttcagaccagccccaccatgcaa

SEQ ID NO: 5959876 - DNA, 14 bp, Homo sapiens
ttcagacccagaga

SEQ ID NO: 5959877 - DNA, 13 bp, Homo sapiens
ttcagaccccagc

SEQ ID NO: 5959878 - DNA, 15 bp, Homo sapiens
ttcagacccctgcct

SEQ ID NO: 5959879 - DNA, 23 bp, Homo sapiens
ttcagacctgacaccgtccctca

SEQ ID NO: 5959880 - DNA, 14 bp, Homo sapiens
ttcagacgagatcc

SEQ ID NO: 5959881 - DNA, 20 bp, Homo sapiens
ttcagactcccattcctgaa

SEQ ID NO: 5959882 - DNA, 19 bp, Homo sapiens
ttcagactgaggccttttg

SEQ ID NO: 5959883 - DNA, 13 bp, Homo sapiens
ttcagactgcctg

SEQ ID NO: 5959884 - DNA, 19 bp, Homo sapiens
ttcagactgtgcaatactt

SEQ ID NO: 5959885 - DNA, 13 bp, Homo sapiens
ttcagagaagtca

SEQ ID NO: 5959886 - DNA, 13 bp, Homo sapiens
ttcagagaatatc

SEQ ID NO: 5959887 - DNA, 20 bp, Homo sapiens
ttcagagaattatctcaagt

SEQ ID NO: 5959888 - DNA, 19 bp, Homo sapiens
ttcagagacaacttcccaa

SEQ ID NO: 5959889 - DNA, 20 bp, Homo sapiens
ttcagagactcagggcccca

SEQ ID NO: 5959890 - DNA, 21 bp, Homo sapiens
ttcagagactcagggccccag

SEQ ID NO: 5959891 - DNA, 15 bp, Homo sapiens
ttcagagactcctgc

SEQ ID NO: 5959892 - DNA, 19 bp, Homo sapiens
ttcatagctaagaaataaa

SEQ ID NO: 5959893 - DNA, 17 bp, Homo sapiens
ttcatagctccttggag

SEQ ID NO: 5959894 - DNA, 15 bp, Homo sapiens
ttcatagctgtactt

SEQ ID NO: 5959895 - DNA, 18 bp, Homo sapiens
ttcataggcagagcccgc

SEQ ID NO: 5959896 - DNA, 19 bp, Homo sapiens
ttcataggcggtcatgtgt

SEQ ID NO: 5959897 - DNA, 23 bp, Homo sapiens
ttcatagggaaaggttttgtatt

SEQ ID NO: 5959898 - DNA, 20 bp, Homo sapiens
ttcataggtaacacattata

SEQ ID NO: 5959899 - DNA, 17 bp, Homo sapiens
ttcataggttactacct

SEQ ID NO: 5959900 - DNA, 15 bp, Homo sapiens
ttcatagtaaaatac

SEQ ID NO: 5959901 - DNA, 19 bp, Homo sapiens
ttcatagtaagtgcgaaga

SEQ ID NO: 5959902 - DNA, 20 bp, Homo sapiens
ttcatagtcattgtggttta

SEQ ID NO: 5959903 - DNA, 22 bp, Homo sapiens
ttcatagtcccaccttggagca

SEQ ID NO: 5959904 - DNA, 23 bp, Homo sapiens
ttcatagtcccaccttggagcat

SEQ ID NO: 5959905 - DNA, 19 bp, Homo sapiens
ttcatagtgacctgtgttt

SEQ ID NO: 5959906 - DNA, 21 bp, Homo sapiens
ttcatagtgacctgtgtttca

SEQ ID NO: 5959907 - DNA, 18 bp, Homo sapiens
ttcatagtgcctttttcc

SEQ ID NO: 5959908 - DNA, 16 bp, Homo sapiens
ttcatagttcagaatt

SEQ ID NO: 5959909 - DNA, 12 bp, Homo sapiens
ttcatagttctg

SEQ ID NO: 5959910 - DNA, 16 bp, Homo sapiens
ttcatagttctgttaa

SEQ ID NO: 5959911 - DNA, 17 bp, Homo sapiens
ttcatagttctgttaaa

SEQ ID NO: 5959912 - DNA, 23 bp, Homo sapiens
ttcatagttctgttaaatatttt

SEQ ID NO: 5959913 - DNA, 14 bp, Homo sapiens
ttcatagtttatta

SEQ ID NO: 5959914 - DNA, 20 bp, Homo sapiens
ttcatataaaagttgcgttt

SEQ ID NO: 5959915 - DNA, 16 bp, Homo sapiens
ttcatataaagtatca

SEQ ID NO: 5959916 - DNA, 13 bp, Homo sapiens
ttcatataaatgg

SEQ ID NO: 5959917 - DNA, 16 bp, Homo sapiens
ttcatataactgagat

SEQ ID NO: 5959918 - DNA, 14 bp, Homo sapiens
ttcatatactataa

SEQ ID NO: 5959919 - DNA, 22 bp, Homo sapiens
ttcatatagcattgataatctt

SEQ ID NO: 5959920 - DNA, 15 bp, Homo sapiens
ttcatatagccaggg

SEQ ID NO: 5959921 - DNA, 21 bp, Homo sapiens
ttcatatagttagctaataaa

SEQ ID NO: 5959922 - DNA, 22 bp, Homo sapiens
ttcatatataagactgctgcag

SEQ ID NO: 5959923 - DNA, 18 bp, Homo sapiens
ttcatatatgctttgcag

SEQ ID NO: 5959924 - DNA, 16 bp, Homo sapiens
ttcatatattattccg

SEQ ID NO: 5959925 - DNA, 16 bp, Homo sapiens
ttcatatattgcattt

SEQ ID NO: 5959926 - DNA, 20 bp, Homo sapiens
ttcatatattgcatttctgt

SEQ ID NO: 5959927 - DNA, 16 bp, Homo sapiens
ttcatatcatactgtt

SEQ ID NO: 5959928 - DNA, 22 bp, Homo sapiens
ttcatatcatcaatgtgacatt

SEQ ID NO: 5959929 - DNA, 13 bp, Homo sapiens
ttcatatcatttg

SEQ ID NO: 5959930 - DNA, 15 bp, Homo sapiens
ttcatatctaacttt

SEQ ID NO: 5959931 - DNA, 14 bp, Homo sapiens
ttcatatctaattt

SEQ ID NO: 5959932 - DNA, 21 bp, Homo sapiens
ttcatatgaaaggtgccatgg

SEQ ID NO: 5959933 - DNA, 19 bp, Homo sapiens
ttcatatgaggggacccag

SEQ ID NO: 5959934 - DNA, 18 bp, Homo sapiens
ttcatatggtaggaacca

SEQ ID NO: 5959935 - DNA, 20 bp, Homo sapiens
ttcatatgtaccatgtacat

SEQ ID NO: 5959936 - DNA, 22 bp, Homo sapiens
ttcatatgtacttgtttgctat

SEQ ID NO: 5959937 - DNA, 13 bp, Homo sapiens
ttcatatgttgct

SEQ ID NO: 5959938 - DNA, 14 bp, Homo sapiens
ttcatatgttgctc

SEQ ID NO: 5959939 - DNA, 22 bp, Homo sapiens
ttcatattaagaatgatctgat

SEQ ID NO: 5959940 - DNA, 19 bp, Homo sapiens
ttcatattaatataagttt

SEQ ID NO: 5959941 - DNA, 16 bp, Homo sapiens
ttcatattacaatatt

SEQ ID NO: 5959942 - DNA, 20 bp, Homo sapiens
ttcatattaccagaaaatga

SEQ ID NO: 5959943 - DNA, 22 bp, Homo sapiens
ttcatattattttagtgtgtaa

SEQ ID NO: 5959944 - DNA, 14 bp, Homo sapiens
ttcatattcctgcc

SEQ ID NO: 5959945 - DNA, 11 bp, Homo sapiens
ttcatattgat

SEQ ID NO: 5959946 - DNA, 18 bp, Homo sapiens
ttcatattgctgagagaa

SEQ ID NO: 5959947 - DNA, 14 bp, Homo sapiens
ttcatattggaaaa

SEQ ID NO: 5959948 - DNA, 13 bp, Homo sapiens
ttcatattgtaat

SEQ ID NO: 5959949 - DNA, 23 bp, Homo sapiens
ttcatattgtaatctatgtttat

SEQ ID NO: 5959950 - DNA, 22 bp, Homo sapiens
ttcatatttaaagccaaatgta

SEQ ID NO: 5959951 - DNA, 19 bp, Homo sapiens
ttcatatttaatatatgtg

SEQ ID NO: 5959952 - DNA, 16 bp, Homo sapiens
ttcatatttacttctt

SEQ ID NO: 5959953 - DNA, 17 bp, Homo sapiens
ttcatatttgcaataaa

SEQ ID NO: 5959954 - DNA, 11 bp, Homo sapiens
ttcatatttgt

SEQ ID NO: 5959955 - DNA, 14 bp, Homo sapiens
ttcatatttgtact

SEQ ID NO: 5959956 - DNA, 18 bp, Homo sapiens
ttcatatttgtagttgca

SEQ ID NO: 5959957 - DNA, 10 bp, Homo sapiens
ttcatatttt

SEQ ID NO: 5959958 - DNA, 21 bp, Homo sapiens
ttcatattttaaacagaggat

SEQ ID NO: 5959959 - DNA, 14 bp, Homo sapiens
ttcatattttaaat

SEQ ID NO: 5959960 - DNA, 17 bp, Homo sapiens
ttcatatttttcaaaat

SEQ ID NO: 5959961 - DNA, 19 bp, Homo sapiens
ttcatatttttcaaaatag

SEQ ID NO: 5959962 - DNA, 21 bp, Homo sapiens
ttcatatttttcatagctaaa

SEQ ID NO: 5959963 - DNA, 19 bp, Homo sapiens
ttcatcaaaacctaccctg

SEQ ID NO: 5959964 - DNA, 14 bp, Homo sapiens
ttcatcaaataaac

SEQ ID NO: 5959965 - DNA, 20 bp, Homo sapiens
ttcatcaaataaaccttgtt

SEQ ID NO: 5959966 - DNA, 15 bp, Homo sapiens
ttcatcaaatcatca

SEQ ID NO: 5959967 - DNA, 14 bp, Homo sapiens
ttcatcaagagttt

SEQ ID NO: 5959968 - DNA, 13 bp, Homo sapiens
ttcatcaatcatt

SEQ ID NO: 5959969 - DNA, 12 bp, Homo sapiens
ttcatcaatgaa

SEQ ID NO: 5959970 - DNA, 12 bp, Homo sapiens
ttcatcaattta

SEQ ID NO: 5959971 - DNA, 12 bp, Homo sapiens
ttcatcaatttt

SEQ ID NO: 5959972 - DNA, 18 bp, Homo sapiens
ttcatcaatttttataca

SEQ ID NO: 5959973 - DNA, 21 bp, Homo sapiens
ttcatcaatttttatacatat

SEQ ID NO: 5959974 - DNA, 13 bp, Homo sapiens
ttcatcactggga

SEQ ID NO: 5959975 - DNA, 16 bp, Homo sapiens
ttcatcacttcttcca

SEQ ID NO: 5959976 - DNA, 16 bp, Homo sapiens
ttcatcagaacagctg

SEQ ID NO: 5959977 - DNA, 19 bp, Homo sapiens
ttcatcagaactcttcctc

SEQ ID NO: 5959978 - DNA, 20 bp, Homo sapiens
ttcatcaggctctgttcctc

SEQ ID NO: 5959979 - DNA, 15 bp, Homo sapiens
ttcatcatccctccc

SEQ ID NO: 5959980 - DNA, 18 bp, Homo sapiens
ttcatcatcctaagctat

SEQ ID NO: 5959981 - DNA, 15 bp, Homo sapiens
ttcatcattgtttct

SEQ ID NO: 5959982 - DNA, 23 bp, Homo sapiens
ttcatcattgtttctgcatgaat

SEQ ID NO: 5959983 - DNA, 14 bp, Homo sapiens
ttcatcatttcagc

SEQ ID NO: 5959984 - DNA, 16 bp, Homo sapiens
ttcatccaactggaag

SEQ ID NO: 5959985 - DNA, 20 bp, Homo sapiens
ttcatccaagttaaatgtag

SEQ ID NO: 5959986 - DNA, 18 bp, Homo sapiens
ttcatccaatcctcactg

SEQ ID NO: 5959987 - DNA, 20 bp, Homo sapiens
ttcatccaatcctcactggg

SEQ ID NO: 5959988 - DNA, 21 bp, Homo sapiens
ttcatccaccaatatcatgtg

SEQ ID NO: 5959989 - DNA, 15 bp, Homo sapiens
ttcatccactagtgc

SEQ ID NO: 5959990 - DNA, 13 bp, Homo sapiens
ttcatccagagtt

SEQ ID NO: 5959991 - DNA, 15 bp, Homo sapiens
ttcatccagcagtgt

SEQ ID NO: 5959992 - DNA, 16 bp, Homo sapiens
ttcatccagcagtgtt

SEQ ID NO: 5959993 - DNA, 18 bp, Homo sapiens
ttcatccatagacacagt

SEQ ID NO: 5959994 - DNA, 18 bp, Homo sapiens
ttcatcccaacagcccag

SEQ ID NO: 5959995 - DNA, 14 bp, Homo sapiens
ttcatcccagcccc

SEQ ID NO: 5959996 - DNA, 16 bp, Homo sapiens
ttcatcccagccccaa

SEQ ID NO: 5959997 - DNA, 16 bp, Homo sapiens
ttcatcccagctgctg

SEQ ID NO: 5959998 - DNA, 15 bp, Homo sapiens
ttcatcccctcagaa

SEQ ID NO: 5959999 - DNA, 22 bp, Homo sapiens
ttcatcccggagcgcacctgct

SEQ ID NO: 5960000 - DNA, 13 bp, Homo sapiens
ttcatccctgcca

SEQ ID NO: 5960001 - DNA, 16 bp, Homo sapiens
ttcatcccttctcttc

SEQ ID NO: 5960002 - DNA, 18 bp, Homo sapiens
ttcatcccttctcttcca

SEQ ID NO: 5960003 - DNA, 14 bp, Homo sapiens
ttcatccgcactgt

SEQ ID NO: 5960004 - DNA, 18 bp, Homo sapiens
ttcatccggcagcctgga

SEQ ID NO: 5960005 - DNA, 21 bp, Homo sapiens
ttcatcctaacatgacagtat

SEQ ID NO: 5960006 - DNA, 15 bp, Homo sapiens
ttcatcctcacatgt

SEQ ID NO: 5960007 - DNA, 20 bp, Homo sapiens
ttcatcctcattgcctcctg

SEQ ID NO: 5960008 - DNA, 19 bp, Homo sapiens
ttcatcctcctcagatctt

SEQ ID NO: 5960009 - DNA, 12 bp, Homo sapiens
ttcatccttccc

SEQ ID NO: 5960010 - DNA, 14 bp, Homo sapiens
ttcatccttctttc

SEQ ID NO: 5960011 - DNA, 22 bp, Homo sapiens
ttcatccttctttccttgttca

SEQ ID NO: 5960012 - DNA, 18 bp, Homo sapiens
ttcatcgaacaaactgat

SEQ ID NO: 5960013 - DNA, 18 bp, Homo sapiens
ttcatcgaatctactaat

SEQ ID NO: 5960014 - DNA, 20 bp, Homo sapiens
ttcatcgaatctactaattc

SEQ ID NO: 5960015 - DNA, 15 bp, Homo sapiens
ttcatctaaatgaaa

SEQ ID NO: 5960016 - DNA, 19 bp, Homo sapiens
ttcatctaaatgaaagtgg

SEQ ID NO: 5960017 - DNA, 21 bp, Homo sapiens
ttcatctaatgtattatgagc

SEQ ID NO: 5960018 - DNA, 23 bp, Homo sapiens
ttcatctaatgtattatgagcca

SEQ ID NO: 5960019 - DNA, 19 bp, Homo sapiens
ttcatctaccttttctggc

SEQ ID NO: 5960020 - DNA, 13 bp, Homo sapiens
ttcatctactaca

SEQ ID NO: 5960021 - DNA, 19 bp, Homo sapiens
ttcatctagttaagtcgct

SEQ ID NO: 5960022 - DNA, 23 bp, Homo sapiens
ttcatctatggcagtccagccag

SEQ ID NO: 5960023 - DNA, 21 bp, Homo sapiens
ttcatctatttcgagtgttgt

SEQ ID NO: 5960024 - DNA, 14 bp, Homo sapiens
ttcatctcagcttt

SEQ ID NO: 5960025 - DNA, 19 bp, Homo sapiens
ttcatctcatttaagggaa

SEQ ID NO: 5960026 - DNA, 15 bp, Homo sapiens
ttcatctccagggag

SEQ ID NO: 5960027 - DNA, 22 bp, Homo sapiens
ttcatctccagggagtcccctc

SEQ ID NO: 5960028 - DNA, 14 bp, Homo sapiens
ttcatctccagtgt

SEQ ID NO: 5960029 - DNA, 22 bp, Homo sapiens
ttcatctcccacctagcagcac

SEQ ID NO: 5960030 - DNA, 14 bp, Homo sapiens
ttcatctccctgcc

SEQ ID NO: 5960031 - DNA, 15 bp, Homo sapiens
ttcatctccctgcca

SEQ ID NO: 5960032 - DNA, 16 bp, Homo sapiens
ttcatctcctgagtat

SEQ ID NO: 5960033 - DNA, 21 bp, Homo sapiens
ttcatctctctacctccaccc

SEQ ID NO: 5960034 - DNA, 23 bp, Homo sapiens
ttcatctctctacctccaccctg

SEQ ID NO: 5960035 - DNA, 15 bp, Homo sapiens
ttcatctctgctgaa

SEQ ID NO: 5960036 - DNA, 17 bp, Homo sapiens
ttcatctctgctgaaca

SEQ ID NO: 5960037 - DNA, 13 bp, Homo sapiens
ttcatctcttcaa

SEQ ID NO: 5960038 - DNA, 14 bp, Homo sapiens
ttcatctctttaga

SEQ ID NO: 5960039 - DNA, 17 bp, Homo sapiens
ttcatctctttagagaa

SEQ ID NO: 5960040 - DNA, 18 bp, Homo sapiens
ttcatctctttgtcctga

SEQ ID NO: 5960041 - DNA, 17 bp, Homo sapiens
ttcatctgactatgaca

SEQ ID NO: 5960042 - DNA, 19 bp, Homo sapiens
ttcatctgaggagtccaaa

SEQ ID NO: 5960043 - DNA, 13 bp, Homo sapiens
ttcatctggaagt

SEQ ID NO: 5960044 - DNA, 19 bp, Homo sapiens
ttcatctggcaacatcttt

SEQ ID NO: 5960045 - DNA, 13 bp, Homo sapiens
ttcatctgggaaa

SEQ ID NO: 5960046 - DNA, 12 bp, Homo sapiens
ttcatctgggtg

SEQ ID NO: 5960047 - DNA, 13 bp, Homo sapiens
ttcatctgggtgg

SEQ ID NO: 5960048 - DNA, 18 bp, Homo sapiens
ttcatctgtaactctaaa

SEQ ID NO: 5960049 - DNA, 23 bp, Homo sapiens
ttcatctgtaactctaaaagatc

SEQ ID NO: 5960050 - DNA, 16 bp, Homo sapiens
ttcatctgttgttctg

SEQ ID NO: 5960051 - DNA, 22 bp, Homo sapiens
ttcatcttcaaccttaaggact

SEQ ID NO: 5960052 - DNA, 23 bp, Homo sapiens
ttcatcttcaaccttaaggactt

SEQ ID NO: 5960053 - DNA, 19 bp, Homo sapiens
ttcatcttcagttgtctct

SEQ ID NO: 5960054 - DNA, 20 bp, Homo sapiens
ttcatcttccaactcaaact

SEQ ID NO: 5960055 - DNA, 18 bp, Homo sapiens
ttcatcttcctgtgtcct

SEQ ID NO: 5960056 - DNA, 12 bp, Homo sapiens
ttcatcttctgg

SEQ ID NO: 5960057 - DNA, 13 bp, Homo sapiens
ttcatcttctgga

SEQ ID NO: 5960058 - DNA, 12 bp, Homo sapiens
ttcatcttgcag

SEQ ID NO: 5960059 - DNA, 19 bp, Homo sapiens
ttcatctttcagaaataaa

SEQ ID NO: 5960060 - DNA, 22 bp, Homo sapiens
ttcatcttttgaggcttctgtt

SEQ ID NO: 5960061 - DNA, 18 bp, Homo sapiens
ttcatgaaaatcctacca

SEQ ID NO: 5960062 - DNA, 23 bp, Homo sapiens
ttcatgaaaatctgccactcagg

SEQ ID NO: 5960063 - DNA, 13 bp, Homo sapiens
ttcatgaaatcct

SEQ ID NO: 5960064 - DNA, 23 bp, Homo sapiens
ttcatgaaatgctatgtcatttc

SEQ ID NO: 5960065 - DNA, 12 bp, Homo sapiens
ttcatgaagagt

SEQ ID NO: 5960066 - DNA, 12 bp, Homo sapiens
ttcatgaagtga

SEQ ID NO: 5960067 - DNA, 14 bp, Homo sapiens
ttcatgacagaata

SEQ ID NO: 5960068 - DNA, 18 bp, Homo sapiens
ttcatgacagaatataca

SEQ ID NO: 5960069 - DNA, 19 bp, Homo sapiens
ttcatgacataataaagta

SEQ ID NO: 5960070 - DNA, 20 bp, Homo sapiens
ttccactaccaaaagacatt

SEQ ID NO: 5960071 - DNA, 23 bp, Homo sapiens
ttccactaccaaaagacattaga

SEQ ID NO: 5960072 - DNA, 18 bp, Homo sapiens
ttccactaccctccctcg

SEQ ID NO: 5960073 - DNA, 19 bp, Homo sapiens
ttccactatacaattcagt

SEQ ID NO: 5960074 - DNA, 19 bp, Homo sapiens
ttccactattatagaaatt

SEQ ID NO: 5960075 - DNA, 15 bp, Homo sapiens
ttccactattttcaa

SEQ ID NO: 5960076 - DNA, 18 bp, Homo sapiens
ttccactcaggtctgttt

SEQ ID NO: 5960077 - DNA, 16 bp, Homo sapiens
ttccactccattgtcg

SEQ ID NO: 5960078 - DNA, 18 bp, Homo sapiens
ttccactcctcctagcca

SEQ ID NO: 5960079 - DNA, 21 bp, Homo sapiens
ttccactcctcctagccaccc

SEQ ID NO: 5960080 - DNA, 17 bp, Homo sapiens
ttccactgaaacctctg

SEQ ID NO: 5960081 - DNA, 16 bp, Homo sapiens
ttccactgaagtagtg

SEQ ID NO: 5960082 - DNA, 13 bp, Homo sapiens
ttccactgagacc

SEQ ID NO: 5960083 - DNA, 12 bp, Homo sapiens
ttccactgagct

SEQ ID NO: 5960084 - DNA, 20 bp, Homo sapiens
ttccactgagctccatgtgc

SEQ ID NO: 5960085 - DNA, 16 bp, Homo sapiens
ttccactgagggcagt

SEQ ID NO: 5960086 - DNA, 20 bp, Homo sapiens
ttccactgaggtgggagcat

SEQ ID NO: 5960087 - DNA, 23 bp, Homo sapiens
ttccactgatggaaacaaagtgg

SEQ ID NO: 5960088 - DNA, 16 bp, Homo sapiens
ttccactgcctctgcc

SEQ ID NO: 5960089 - DNA, 23 bp, Homo sapiens
ttccactgctactgacccagagg

SEQ ID NO: 5960090 - DNA, 13 bp, Homo sapiens
ttccactgcttct

SEQ ID NO: 5960091 - DNA, 12 bp, Homo sapiens
ttccactggact

SEQ ID NO: 5960092 - DNA, 17 bp, Homo sapiens
ttccactggctccacat

SEQ ID NO: 5960093 - DNA, 13 bp, Homo sapiens
ttccactgtagct

SEQ ID NO: 5960094 - DNA, 13 bp, Homo sapiens
ttccacttctctg

SEQ ID NO: 5960095 - DNA, 12 bp, Homo sapiens
ttccacttctgg

SEQ ID NO: 5960096 - DNA, 14 bp, Homo sapiens
ttccacttcttcct

SEQ ID NO: 5960097 - DNA, 17 bp, Homo sapiens
ttccacttgagtgtcaa

SEQ ID NO: 5960098 - DNA, 16 bp, Homo sapiens
ttccacttgccctgtg

SEQ ID NO: 5960099 - DNA, 17 bp, Homo sapiens
ttccacttgccctgtgt

SEQ ID NO: 5960100 - DNA, 19 bp, Homo sapiens
ttccacttgccctgtgttc

SEQ ID NO: 5960101 - DNA, 18 bp, Homo sapiens
ttccacttgtgggcttca

SEQ ID NO: 5960102 - DNA, 17 bp, Homo sapiens
ttccacttgtttgcact

SEQ ID NO: 5960103 - DNA, 18 bp, Homo sapiens
ttccacttgtttgcactg

SEQ ID NO: 5960104 - DNA, 18 bp, Homo sapiens
ttccactttgtataaatt

SEQ ID NO: 5960105 - DNA, 14 bp, Homo sapiens
ttccacttttgttc

SEQ ID NO: 5960106 - DNA, 18 bp, Homo sapiens
ttccagaaaaccccagca

SEQ ID NO: 5960107 - DNA, 21 bp, Homo sapiens
ttccagaaaaccccagcatcc

SEQ ID NO: 5960108 - DNA, 11 bp, Homo sapiens
ttccagaaaat

SEQ ID NO: 5960109 - DNA, 15 bp, Homo sapiens
ttccagaaaatataa

SEQ ID NO: 5960110 - DNA, 21 bp, Homo sapiens
ttccagaaaatataaatgcat

SEQ ID NO: 5960111 - DNA, 22 bp, Homo sapiens
ttccagaaaggatatttaagaa

SEQ ID NO: 5960112 - DNA, 18 bp, Homo sapiens
ttccagaaatacctgtct

SEQ ID NO: 5960113 - DNA, 17 bp, Homo sapiens
ttccagaacaaattgtt

SEQ ID NO: 5960114 - DNA, 14 bp, Homo sapiens
ttccagaacagccc

SEQ ID NO: 5960115 - DNA, 16 bp, Homo sapiens
ttccagaacagccctc

SEQ ID NO: 5960116 - DNA, 21 bp, Homo sapiens
ttccagaaccacacttgaaac

SEQ ID NO: 5960117 - DNA, 18 bp, Homo sapiens
ttccagaacgccctgtgt

SEQ ID NO: 5960118 - DNA, 20 bp, Homo sapiens
ttccagaagaagagaagctg

SEQ ID NO: 5960119 - DNA, 23 bp, Homo sapiens
ttccagaagaagagaagctgctg

SEQ ID NO: 5960120 - DNA, 19 bp, Homo sapiens
ttccagaagatgccctcca

SEQ ID NO: 5960121 - DNA, 17 bp, Homo sapiens
ttccagaaggatccaag

SEQ ID NO: 5960122 - DNA, 20 bp, Homo sapiens
ttccagaagtgtgactggct

SEQ ID NO: 5960123 - DNA, 15 bp, Homo sapiens
ttccagaagtgtgat

SEQ ID NO: 5960124 - DNA, 11 bp, Homo sapiens
ttccagaatcc

SEQ ID NO: 5960125 - DNA, 14 bp, Homo sapiens
ttccagaatctgta

SEQ ID NO: 5960126 - DNA, 21 bp, Homo sapiens
ttccagaatcttgactttctg

SEQ ID NO: 5960127 - DNA, 18 bp, Homo sapiens
ttccagaatgctgtacat

SEQ ID NO: 5960128 - DNA, 19 bp, Homo sapiens
ttccagaatgctgtacatc

SEQ ID NO: 5960129 - DNA, 12 bp, Homo sapiens
ttccagaattga

SEQ ID NO: 5960130 - DNA, 15 bp, Homo sapiens
ttccagaattgagag

SEQ ID NO: 5960131 - DNA, 10 bp, Homo sapiens
ttccagacag

SEQ ID NO: 5960132 - DNA, 17 bp, Homo sapiens
ttccagacagagtggat

SEQ ID NO: 5960133 - DNA, 20 bp, Homo sapiens
ttccagacagggtggggctt

SEQ ID NO: 5960134 - DNA, 21 bp, Homo sapiens
ttccagaccaataaatttgta

SEQ ID NO: 5960135 - DNA, 19 bp, Homo sapiens
ttccagaccacctgccagc

SEQ ID NO: 5960136 - DNA, 23 bp, Homo sapiens
ttccagaccacctgccagccatc

SEQ ID NO: 5960137 - DNA, 17 bp, Homo sapiens
ttccagacctgaagaat

SEQ ID NO: 5960138 - DNA, 22 bp, Homo sapiens
ttccagacctgcttcctgaaat

SEQ ID NO: 5960139 - DNA, 23 bp, Homo sapiens
ttccagacctgcttcctgaaata

SEQ ID NO: 5960140 - DNA, 21 bp, Homo sapiens
ttccagactcaggttccagaa

SEQ ID NO: 5960141 - DNA, 15 bp, Homo sapiens
ttccagacttcaaaa

SEQ ID NO: 5960142 - DNA, 20 bp, Homo sapiens
ttccagacttccttgagaca

SEQ ID NO: 5960143 - DNA, 20 bp, Homo sapiens
ttccagagacaaatatttct

SEQ ID NO: 5960144 - DNA, 17 bp, Homo sapiens
ttccagagagtcctctg

SEQ ID NO: 5960145 - DNA, 23 bp, Homo sapiens
ttccagagagtggagagagcagg

SEQ ID NO: 5960146 - DNA, 21 bp, Homo sapiens
ttccagagagtggctcctccc

SEQ ID NO: 5960147 - DNA, 16 bp, Homo sapiens
ttccagagcagagcct

SEQ ID NO: 5960148 - DNA, 21 bp, Homo sapiens
ttccagagcattccagtcagg

SEQ ID NO: 5960149 - DNA, 14 bp, Homo sapiens
ttccagagccagaa

SEQ ID NO: 5960150 - DNA, 15 bp, Homo sapiens
ttccagagcccaagg

SEQ ID NO: 5960151 - DNA, 17 bp, Homo sapiens
ttccagagcctaagaaa

SEQ ID NO: 5960152 - DNA, 23 bp, Homo sapiens
ttccagagctctttgatcgcttt

SEQ ID NO: 5960153 - DNA, 12 bp, Homo sapiens
ttccagagctgt

SEQ ID NO: 5960154 - DNA, 14 bp, Homo sapiens
ttccagaggacagc

SEQ ID NO: 5960155 - DNA, 17 bp, Homo sapiens
ttccagaggccctaggc

SEQ ID NO: 5960156 - DNA, 17 bp, Homo sapiens
ttccagagtttgtcatt

SEQ ID NO: 5960157 - DNA, 23 bp, Homo sapiens
ttccagataaccagctgtaacac

SEQ ID NO: 5960158 - DNA, 19 bp, Homo sapiens
ttccagatggtcatccaga

SEQ ID NO: 5960159 - DNA, 23 bp, Homo sapiens
ttccagatggtcatccagactca

SEQ ID NO: 5960160 - DNA, 19 bp, Homo sapiens
ttccagatgtctaaaagat

SEQ ID NO: 5960161 - DNA, 14 bp, Homo sapiens
ttccagatgtgatg

SEQ ID NO: 5960162 - DNA, 17 bp, Homo sapiens
ttccagattcttccact

SEQ ID NO: 5960163 - DNA, 20 bp, Homo sapiens
ttccagattttaaattttat

SEQ ID NO: 5960164 - DNA, 16 bp, Homo sapiens
ttccagcaaaatccaa

SEQ ID NO: 5960165 - DNA, 20 bp, Homo sapiens
ttccagcaaaatccaaactg

SEQ ID NO: 5960166 - DNA, 21 bp, Homo sapiens
ttccagcaaaatccaaactgc

SEQ ID NO: 5960167 - DNA, 21 bp, Homo sapiens
ttccagcaaaatggaagcaaa

SEQ ID NO: 5960168 - DNA, 15 bp, Homo sapiens
ttccagcaataagaa

SEQ ID NO: 5960169 - DNA, 17 bp, Homo sapiens
ttccagcaataagaaat

SEQ ID NO: 5960170 - DNA, 22 bp, Homo sapiens
ttccagcaataagaaatgaaca

SEQ ID NO: 5960171 - DNA, 14 bp, Homo sapiens
ttccagcaattctc

SEQ ID NO: 5960172 - DNA, 20 bp, Homo sapiens
ttccagcaattctcctgcct

SEQ ID NO: 5960173 - DNA, 14 bp, Homo sapiens
ttccagcagctgca

SEQ ID NO: 5960174 - DNA, 12 bp, Homo sapiens
ttccagcaggag

SEQ ID NO: 5960175 - DNA, 15 bp, Homo sapiens
ttccagcagtcagtc

SEQ ID NO: 5960176 - DNA, 20 bp, Homo sapiens
ttccagcatttagctggcca

SEQ ID NO: 5960177 - DNA, 21 bp, Homo sapiens
ttccagcatttagctggccac

SEQ ID NO: 5960178 - DNA, 15 bp, Homo sapiens
ttccagcatttttat

SEQ ID NO: 5960179 - DNA, 17 bp, Homo sapiens
ttccagccaaagcatgc

SEQ ID NO: 5960180 - DNA, 20 bp, Homo sapiens
ttccagccacattgagactt

SEQ ID NO: 5960181 - DNA, 13 bp, Homo sapiens
ttccagccaggcc

SEQ ID NO: 5960182 - DNA, 15 bp, Homo sapiens
ttccagccaggccca

SEQ ID NO: 5960183 - DNA, 12 bp, Homo sapiens
ttccagccaggg

SEQ ID NO: 5960184 - DNA, 23 bp, Homo sapiens
ttccagcccagacccccagtgta

SEQ ID NO: 5960185 - DNA, 18 bp, Homo sapiens
ttccagccttatgtgtta

SEQ ID NO: 5960186 - DNA, 21 bp, Homo sapiens
ttccagccttatgtgttacat

SEQ ID NO: 5960187 - DNA, 14 bp, Homo sapiens
ttccagccttttta

SEQ ID NO: 5960188 - DNA, 16 bp, Homo sapiens
ttccagcgggccctct

SEQ ID NO: 5960189 - DNA, 21 bp, Homo sapiens
ttccagctaagcctgatgatg

SEQ ID NO: 5960190 - DNA, 14 bp, Homo sapiens
ttccagctactttt

SEQ ID NO: 5960191 - DNA, 20 bp, Homo sapiens
ttccagctcagtcccacagc

SEQ ID NO: 5960192 - DNA, 17 bp, Homo sapiens
ttccagctccctcccct

SEQ ID NO: 5960193 - DNA, 20 bp, Homo sapiens
ttccagctccctcccctgct

SEQ ID NO: 5960194 - DNA, 14 bp, Homo sapiens
ttccagctcctgta

SEQ ID NO: 5960195 - DNA, 16 bp, Homo sapiens
ttccagctctcccatg

SEQ ID NO: 5960196 - DNA, 19 bp, Homo sapiens
ttccagctgacatcttgca

SEQ ID NO: 5960197 - DNA, 18 bp, Homo sapiens
ttccagctgccaagtgct

SEQ ID NO: 5960198 - DNA, 14 bp, Homo sapiens
ttccagctgcctgg

SEQ ID NO: 5960199 - DNA, 15 bp, Homo sapiens
ttccagctgcctggg

SEQ ID NO: 5960200 - DNA, 11 bp, Homo sapiens
ttccagctgct

SEQ ID NO: 5960201 - DNA, 12 bp, Homo sapiens
ttccagctgctg

SEQ ID NO: 5960202 - DNA, 13 bp, Homo sapiens
ttccagctgctgt

SEQ ID NO: 5960203 - DNA, 17 bp, Homo sapiens
ttccagctgtcccccca

SEQ ID NO: 5960204 - DNA, 13 bp, Homo sapiens
ttccagcttagaa

SEQ ID NO: 5960205 - DNA, 12 bp, Homo sapiens
ttccagcttcag

SEQ ID NO: 5960206 - DNA, 13 bp, Homo sapiens
ttccagcttcagg

SEQ ID NO: 5960207 - DNA, 15 bp, Homo sapiens
ttccagcttcaggca

SEQ ID NO: 5960208 - DNA, 17 bp, Homo sapiens
ttccagcttcaggcacc

SEQ ID NO: 5960209 - DNA, 20 bp, Homo sapiens
ttccagcttcctctgagccg

SEQ ID NO: 5960210 - DNA, 14 bp, Homo sapiens
ttccagcttgcatt

SEQ ID NO: 5960211 - DNA, 14 bp, Homo sapiens
ttccaggaaaaaat

SEQ ID NO: 5960212 - DNA, 18 bp, Homo sapiens
ttccaggaaaaaataaaa

SEQ ID NO: 5960213 - DNA, 13 bp, Homo sapiens
ttccaggaaaaag

SEQ ID NO: 5960214 - DNA, 17 bp, Homo sapiens
ttccaggaaaaaggaca

SEQ ID NO: 5960215 - DNA, 23 bp, Homo sapiens
ttccaggaaactccacatctgcc

SEQ ID NO: 5960216 - DNA, 11 bp, Homo sapiens
ttccaggaaga

SEQ ID NO: 5960217 - DNA, 18 bp, Homo sapiens
ttccaggactctctgctt

SEQ ID NO: 5960218 - DNA, 21 bp, Homo sapiens
ttccaggagccaccttgccac

SEQ ID NO: 5960219 - DNA, 20 bp, Homo sapiens
ttccaggaggagttagccaa

SEQ ID NO: 5960220 - DNA, 16 bp, Homo sapiens
ttccaggagtgggtcg

SEQ ID NO: 5960221 - DNA, 16 bp, Homo sapiens
ttccaggatcctgcag

SEQ ID NO: 5960222 - DNA, 21 bp, Homo sapiens
ttccaggcaccctcagggagc

SEQ ID NO: 5960223 - DNA, 19 bp, Homo sapiens
ttccaggcagcctctgtca

SEQ ID NO: 5960224 - DNA, 19 bp, Homo sapiens
ttccaggcatgaccctgga

SEQ ID NO: 5960225 - DNA, 14 bp, Homo sapiens
ttccaggccaccgc

SEQ ID NO: 5960226 - DNA, 17 bp, Homo sapiens
ttccaggccctccagtg

SEQ ID NO: 5960227 - DNA, 22 bp, Homo sapiens
ttccaggcctgaagtcttctcc

SEQ ID NO: 5960228 - DNA, 20 bp, Homo sapiens
ttccaggcctgatcttgcct

SEQ ID NO: 5960229 - DNA, 18 bp, Homo sapiens
ttccaggcgtagggccag

SEQ ID NO: 5960230 - DNA, 22 bp, Homo sapiens
ttccaggcgtagggccagggct

SEQ ID NO: 5960231 - DNA, 20 bp, Homo sapiens
ttccaggctcacctttagaa

SEQ ID NO: 5960232 - DNA, 11 bp, Homo sapiens
ttccaggctct

SEQ ID NO: 5960233 - DNA, 21 bp, Homo sapiens
ttccaggctcttcctggacct

SEQ ID NO: 5960234 - DNA, 21 bp, Homo sapiens
ttccaggctgcatagaaggag

SEQ ID NO: 5960235 - DNA, 19 bp, Homo sapiens
ttccaggcttccctgactt

SEQ ID NO: 5960236 - DNA, 16 bp, Homo sapiens
ttccaggcttctgctg

SEQ ID NO: 5960237 - DNA, 17 bp, Homo sapiens
ttccaggcttctgctgg

SEQ ID NO: 5960238 - DNA, 19 bp, Homo sapiens
ttccagggactgtacctgt

SEQ ID NO: 5960239 - DNA, 20 bp, Homo sapiens
ttccagggactgtacctgta

SEQ ID NO: 5960240 - DNA, 18 bp, Homo sapiens
ttccagggatttgcctca

SEQ ID NO: 5960241 - DNA, 19 bp, Homo sapiens
ttccagggatttgcctcac

SEQ ID NO: 5960242 - DNA, 21 bp, Homo sapiens
ttccagggatttgcctcacct

SEQ ID NO: 5960243 - DNA, 23 bp, Homo sapiens
ttccagggcatccgcagcccagg

SEQ ID NO: 5960244 - DNA, 16 bp, Homo sapiens
ttccagggcctgagca

SEQ ID NO: 5960245 - DNA, 18 bp, Homo sapiens
ttccagggctcttccaga

SEQ ID NO: 5960246 - DNA, 11 bp, Homo sapiens
ttccagggctg

SEQ ID NO: 5960247 - DNA, 15 bp, Homo sapiens
ttccagggctggggt

SEQ ID NO: 5960248 - DNA, 13 bp, Homo sapiens
ttcccctctggct

SEQ ID NO: 5960249 - DNA, 18 bp, Homo sapiens
ttcccctcttaaatgaga

SEQ ID NO: 5960250 - DNA, 17 bp, Homo sapiens
ttcccctcttgtctccc

SEQ ID NO: 5960251 - DNA, 18 bp, Homo sapiens
ttcccctcttgtctcccc

SEQ ID NO: 5960252 - DNA, 17 bp, Homo sapiens
ttcccctcttttgtctt

SEQ ID NO: 5960253 - DNA, 21 bp, Homo sapiens
ttcccctgagagtttcctcag

SEQ ID NO: 5960254 - DNA, 12 bp, Homo sapiens
ttcccctgcaat

SEQ ID NO: 5960255 - DNA, 19 bp, Homo sapiens
ttcccctgcacctggcctg

SEQ ID NO: 5960256 - DNA, 13 bp, Homo sapiens
ttcccctgcctcc

SEQ ID NO: 5960257 - DNA, 13 bp, Homo sapiens
ttcccctggcctc

SEQ ID NO: 5960258 - DNA, 23 bp, Homo sapiens
ttcccctgggaactctcctggcc

SEQ ID NO: 5960259 - DNA, 14 bp, Homo sapiens
ttcccctgggatgc

SEQ ID NO: 5960260 - DNA, 15 bp, Homo sapiens
ttcccctgtggggat

SEQ ID NO: 5960261 - DNA, 17 bp, Homo sapiens
ttcccctgttcactcta

SEQ ID NO: 5960262 - DNA, 16 bp, Homo sapiens
ttccccttatcctccc

SEQ ID NO: 5960263 - DNA, 15 bp, Homo sapiens
ttccccttcaccgct

SEQ ID NO: 5960264 - DNA, 14 bp, Homo sapiens
ttccccttccactg

SEQ ID NO: 5960265 - DNA, 15 bp, Homo sapiens
ttccccttccactga

SEQ ID NO: 5960266 - DNA, 15 bp, Homo sapiens
ttccccttcccttat

SEQ ID NO: 5960267 - DNA, 11 bp, Homo sapiens
ttccccttcct

SEQ ID NO: 5960268 - DNA, 12 bp, Homo sapiens
ttccccttcctg

SEQ ID NO: 5960269 - DNA, 14 bp, Homo sapiens
ttccccttgccctt

SEQ ID NO: 5960270 - DNA, 20 bp, Homo sapiens
ttccccttgcccttgccctg

SEQ ID NO: 5960271 - DNA, 23 bp, Homo sapiens
ttccccttgcccttgccctgacc

SEQ ID NO: 5960272 - DNA, 14 bp, Homo sapiens
ttccccttggcttc

SEQ ID NO: 5960273 - DNA, 22 bp, Homo sapiens
ttccccttgggatgggcacagg

SEQ ID NO: 5960274 - DNA, 19 bp, Homo sapiens
ttccccttgtctccctggt

SEQ ID NO: 5960275 - DNA, 19 bp, Homo sapiens
ttcccctttcctgtcccac

SEQ ID NO: 5960276 - DNA, 16 bp, Homo sapiens
ttcccctttgtcctgc

SEQ ID NO: 5960277 - DNA, 13 bp, Homo sapiens
ttccccttttgca

SEQ ID NO: 5960278 - DNA, 17 bp, Homo sapiens
ttcccgacccagccagc

SEQ ID NO: 5960279 - DNA, 21 bp, Homo sapiens
ttcccgagcaaagtctaaagt

SEQ ID NO: 5960280 - DNA, 14 bp, Homo sapiens
ttcccgagggagct

SEQ ID NO: 5960281 - DNA, 20 bp, Homo sapiens
ttcccgatggtctctctccc

SEQ ID NO: 5960282 - DNA, 22 bp, Homo sapiens
ttcccgccgccccccctatctc

SEQ ID NO: 5960283 - DNA, 13 bp, Homo sapiens
ttcccgccggagg

SEQ ID NO: 5960284 - DNA, 18 bp, Homo sapiens
ttcccgccggaggccagc

SEQ ID NO: 5960285 - DNA, 14 bp, Homo sapiens
ttcccgccttccaa

SEQ ID NO: 5960286 - DNA, 16 bp, Homo sapiens
ttcccgctcagccctc

SEQ ID NO: 5960287 - DNA, 18 bp, Homo sapiens
ttcccgctcagccctccc

SEQ ID NO: 5960288 - DNA, 14 bp, Homo sapiens
ttcccgctctgcat

SEQ ID NO: 5960289 - DNA, 20 bp, Homo sapiens
ttcccggagcacagccctgg

SEQ ID NO: 5960290 - DNA, 15 bp, Homo sapiens
ttcccggcccttacc

SEQ ID NO: 5960291 - DNA, 19 bp, Homo sapiens
ttcccgggaacgcttgctc

SEQ ID NO: 5960292 - DNA, 22 bp, Homo sapiens
ttcccgggaacgcttgctctta

SEQ ID NO: 5960293 - DNA, 16 bp, Homo sapiens
ttcccgggagctgggc

SEQ ID NO: 5960294 - DNA, 17 bp, Homo sapiens
ttcccgggagctgggcc

SEQ ID NO: 5960295 - DNA, 18 bp, Homo sapiens
ttcccgggagctgggccc

SEQ ID NO: 5960296 - DNA, 21 bp, Homo sapiens
ttcccgggagctgggccctgc

SEQ ID NO: 5960297 - DNA, 21 bp, Homo sapiens
ttcccgggataaactgagcct

SEQ ID NO: 5960298 - DNA, 18 bp, Homo sapiens
ttcccgggccagggctgc

SEQ ID NO: 5960299 - DNA, 17 bp, Homo sapiens
ttcccgggccctcagcc

SEQ ID NO: 5960300 - DNA, 18 bp, Homo sapiens
ttcccggtgcagaacagg

SEQ ID NO: 5960301 - DNA, 17 bp, Homo sapiens
ttcccggttcaggacca

SEQ ID NO: 5960302 - DNA, 12 bp, Homo sapiens
ttcccgtataat

SEQ ID NO: 5960303 - DNA, 20 bp, Homo sapiens
ttcccgtcccatatcctgcc

SEQ ID NO: 5960304 - DNA, 20 bp, Homo sapiens
ttcccgtctgattgttcctc

SEQ ID NO: 5960305 - DNA, 16 bp, Homo sapiens
ttcccgtggccccagc

SEQ ID NO: 5960306 - DNA, 13 bp, Homo sapiens
ttcccgttcttaa

SEQ ID NO: 5960307 - DNA, 15 bp, Homo sapiens
ttccctaaaatgtag

SEQ ID NO: 5960308 - DNA, 14 bp, Homo sapiens
ttccctaacactta

SEQ ID NO: 5960309 - DNA, 20 bp, Homo sapiens
ttccctacagcctagggcag

SEQ ID NO: 5960310 - DNA, 14 bp, Homo sapiens
ttccctacattaaa

SEQ ID NO: 5960311 - DNA, 23 bp, Homo sapiens
ttccctacctaagaatttcactg

SEQ ID NO: 5960312 - DNA, 13 bp, Homo sapiens
ttccctacctcag

SEQ ID NO: 5960313 - DNA, 21 bp, Homo sapiens
ttccctactaacatcccaata

SEQ ID NO: 5960314 - DNA, 17 bp, Homo sapiens
ttccctactgaagccct

SEQ ID NO: 5960315 - DNA, 14 bp, Homo sapiens
ttccctacttcctg

SEQ ID NO: 5960316 - DNA, 22 bp, Homo sapiens
ttccctagaaacttccaaatcc

SEQ ID NO: 5960317 - DNA, 22 bp, Homo sapiens
ttccctagaaagccatattcca

SEQ ID NO: 5960318 - DNA, 16 bp, Homo sapiens
ttccctagactctgta

SEQ ID NO: 5960319 - DNA, 16 bp, Homo sapiens
ttccctagagagaata

SEQ ID NO: 5960320 - DNA, 16 bp, Homo sapiens
ttccctagcaggaact

SEQ ID NO: 5960321 - DNA, 18 bp, Homo sapiens
ttccctagggctgggtgt

SEQ ID NO: 5960322 - DNA, 19 bp, Homo sapiens
ttccctaggggacacttcc

SEQ ID NO: 5960323 - DNA, 21 bp, Homo sapiens
ttccctaggggacacttccct

SEQ ID NO: 5960324 - DNA, 20 bp, Homo sapiens
ttccctataggaacagccca

SEQ ID NO: 5960325 - DNA, 16 bp, Homo sapiens
ttccctatcaaaacat

SEQ ID NO: 5960326 - DNA, 17 bp, Homo sapiens
ttccctatcaaaacata

SEQ ID NO: 5960327 - DNA, 18 bp, Homo sapiens
ttccctatggagaggctt

SEQ ID NO: 5960328 - DNA, 15 bp, Homo sapiens
ttccctattagagaa

SEQ ID NO: 5960329 - DNA, 15 bp, Homo sapiens
ttccctcaaatgtgt

SEQ ID NO: 5960330 - DNA, 19 bp, Homo sapiens
ttccctcaccccctcccac

SEQ ID NO: 5960331 - DNA, 21 bp, Homo sapiens
ttccctcaccttggcaccaga

SEQ ID NO: 5960332 - DNA, 12 bp, Homo sapiens
ttccctcagcct

SEQ ID NO: 5960333 - DNA, 12 bp, Homo sapiens
ttccctcagtga

SEQ ID NO: 5960334 - DNA, 13 bp, Homo sapiens
ttccctcatcttg

SEQ ID NO: 5960335 - DNA, 15 bp, Homo sapiens
ttccctccaggcaaa

SEQ ID NO: 5960336 - DNA, 15 bp, Homo sapiens
ttccctcccaacaga

SEQ ID NO: 5960337 - DNA, 20 bp, Homo sapiens
ttccctccccacagtcctca

SEQ ID NO: 5960338 - DNA, 12 bp, Homo sapiens
ttccctccccag

SEQ ID NO: 5960339 - DNA, 13 bp, Homo sapiens
ttccctccccaga

SEQ ID NO: 5960340 - DNA, 15 bp, Homo sapiens
ttccctccccagaat

SEQ ID NO: 5960341 - DNA, 11 bp, Homo sapiens
ttccctccccc

SEQ ID NO: 5960342 - DNA, 15 bp, Homo sapiens
ttccctccccctcct

SEQ ID NO: 5960343 - DNA, 23 bp, Homo sapiens
ttccctccctgctgtcattgctt

SEQ ID NO: 5960344 - DNA, 11 bp, Homo sapiens
ttccctccctt

SEQ ID NO: 5960345 - DNA, 20 bp, Homo sapiens
ttccctcccttcctctttcc

SEQ ID NO: 5960346 - DNA, 19 bp, Homo sapiens
ttccctccgaacgctgctc

SEQ ID NO: 5960347 - DNA, 16 bp, Homo sapiens
ttccctccgggcaggg

SEQ ID NO: 5960348 - DNA, 17 bp, Homo sapiens
ttccctcctagctctcc

SEQ ID NO: 5960349 - DNA, 11 bp, Homo sapiens
ttccctcctcc

SEQ ID NO: 5960350 - DNA, 13 bp, Homo sapiens
ttccctcctccca

SEQ ID NO: 5960351 - DNA, 14 bp, Homo sapiens
ttccctcctgacaa

SEQ ID NO: 5960352 - DNA, 22 bp, Homo sapiens
ttccctcctgagtgccccactt

SEQ ID NO: 5960353 - DNA, 12 bp, Homo sapiens
ttccctcctggt

SEQ ID NO: 5960354 - DNA, 15 bp, Homo sapiens
ttccctcctggtcct

SEQ ID NO: 5960355 - DNA, 13 bp, Homo sapiens
ttccctccttccc

SEQ ID NO: 5960356 - DNA, 17 bp, Homo sapiens
ttccctcctttcctttt

SEQ ID NO: 5960357 - DNA, 18 bp, Homo sapiens
ttccctcgacttgaccct

SEQ ID NO: 5960358 - DNA, 23 bp, Homo sapiens
ttccctcggcgttagtccctagc

SEQ ID NO: 5960359 - DNA, 16 bp, Homo sapiens
ttccctctcccaccca

SEQ ID NO: 5960360 - DNA, 21 bp, Homo sapiens
ttccctctcccacccaaggag

SEQ ID NO: 5960361 - DNA, 15 bp, Homo sapiens
ttccctctcccaggc

SEQ ID NO: 5960362 - DNA, 16 bp, Homo sapiens
ttccctctcccaggcc

SEQ ID NO: 5960363 - DNA, 14 bp, Homo sapiens
ttccctctcccagt

SEQ ID NO: 5960364 - DNA, 18 bp, Homo sapiens
ttccctctccctctctct

SEQ ID NO: 5960365 - DNA, 20 bp, Homo sapiens
ttccctctccctctctctgg

SEQ ID NO: 5960366 - DNA, 14 bp, Homo sapiens
ttccctctccctgt

SEQ ID NO: 5960367 - DNA, 12 bp, Homo sapiens
ttccctctcctg

SEQ ID NO: 5960368 - DNA, 15 bp, Homo sapiens
ttccctctccttcca

SEQ ID NO: 5960369 - DNA, 11 bp, Homo sapiens
ttccctctcta

SEQ ID NO: 5960370 - DNA, 12 bp, Homo sapiens
ttccctctctag

SEQ ID NO: 5960371 - DNA, 13 bp, Homo sapiens
ttccctctctcag

SEQ ID NO: 5960372 - DNA, 15 bp, Homo sapiens
ttccctctctccctg

SEQ ID NO: 5960373 - DNA, 23 bp, Homo sapiens
ttccctctctccctgcctcactc

SEQ ID NO: 5960374 - DNA, 22 bp, Homo sapiens
ttccctctgagaattccaagga

SEQ ID NO: 5960375 - DNA, 15 bp, Homo sapiens
ttccctctgcctggg

SEQ ID NO: 5960376 - DNA, 16 bp, Homo sapiens
ttccctctgcctggga

SEQ ID NO: 5960377 - DNA, 18 bp, Homo sapiens
ttccctctgcctgtccct

SEQ ID NO: 5960378 - DNA, 21 bp, Homo sapiens
ttccctctgcctgtccctctc

SEQ ID NO: 5960379 - DNA, 11 bp, Homo sapiens
ttccctctgct

SEQ ID NO: 5960380 - DNA, 13 bp, Homo sapiens
ttccctctgctca

SEQ ID NO: 5960381 - DNA, 15 bp, Homo sapiens
ttccctctgctcagc

SEQ ID NO: 5960382 - DNA, 14 bp, Homo sapiens
ttccctctgctcca

SEQ ID NO: 5960383 - DNA, 14 bp, Homo sapiens
ttccctctgctgct

SEQ ID NO: 5960384 - DNA, 16 bp, Homo sapiens
ttccctctgctgcttt

SEQ ID NO: 5960385 - DNA, 14 bp, Homo sapiens
ttccctctggcttc

SEQ ID NO: 5960386 - DNA, 14 bp, Homo sapiens
ttccctcttcccag

SEQ ID NO: 5960387 - DNA, 24 bp, Homo sapiens
ttccctcttctaacccaactgact

SEQ ID NO: 5960388 - DNA, 12 bp, Homo sapiens
ttccctcttgtg

SEQ ID NO: 5960389 - DNA, 19 bp, Homo sapiens
ttccctcttgtgctcagtc

SEQ ID NO: 5960390 - DNA, 16 bp, Homo sapiens
ttccctctttggctcc

SEQ ID NO: 5960391 - DNA, 23 bp, Homo sapiens
ttccctcttttcttactcctcct

SEQ ID NO: 5960392 - DNA, 17 bp, Homo sapiens
ttccctgaaaacccaga

SEQ ID NO: 5960393 - DNA, 21 bp, Homo sapiens
ttccctgaaacacgaaacttg

SEQ ID NO: 5960394 - DNA, 23 bp, Homo sapiens
ttccctgaaacacgaaacttgtt

SEQ ID NO: 5960395 - DNA, 15 bp, Homo sapiens
ttccctgaacactca

SEQ ID NO: 5960396 - DNA, 18 bp, Homo sapiens
ttccctgaacatctgtgt

SEQ ID NO: 5960397 - DNA, 16 bp, Homo sapiens
ttccctgaaccttcct

SEQ ID NO: 5960398 - DNA, 21 bp, Homo sapiens
ttccctgaacgttttcttctt

SEQ ID NO: 5960399 - DNA, 14 bp, Homo sapiens
ttccctgaagctat

SEQ ID NO: 5960400 - DNA, 15 bp, Homo sapiens
ttccctgacactgtc

SEQ ID NO: 5960401 - DNA, 21 bp, Homo sapiens
ttccctgacactgtctgctgc

SEQ ID NO: 5960402 - DNA, 20 bp, Homo sapiens
ttccctgacctcccaactct

SEQ ID NO: 5960403 - DNA, 11 bp, Homo sapiens
ttccctgagga

SEQ ID NO: 5960404 - DNA, 13 bp, Homo sapiens
ttccctgaggacc

SEQ ID NO: 5960405 - DNA, 12 bp, Homo sapiens
ttccctgaggtg

SEQ ID NO: 5960406 - DNA, 19 bp, Homo sapiens
ttccctgattatttatcct

SEQ ID NO: 5960407 - DNA, 21 bp, Homo sapiens
ttccctgcaaccaattgaaaa

SEQ ID NO: 5960408 - DNA, 12 bp, Homo sapiens
ttccctgcacta

SEQ ID NO: 5960409 - DNA, 22 bp, Homo sapiens
ttccctgcagagctttggccat

SEQ ID NO: 5960410 - DNA, 15 bp, Homo sapiens
ttccctgcagctgac

SEQ ID NO: 5960411 - DNA, 22 bp, Homo sapiens
ttccctgcaggtagttgagttg

SEQ ID NO: 5960412 - DNA, 19 bp, Homo sapiens
ttccctgcatatgcttctg

SEQ ID NO: 5960413 - DNA, 23 bp, Homo sapiens
ttccctgcatcccttggcccctc

SEQ ID NO: 5960414 - DNA, 22 bp, Homo sapiens
ttccctgcccaaacccttaact

SEQ ID NO: 5960415 - DNA, 15 bp, Homo sapiens
ttccctgcccaatcc

SEQ ID NO: 5960416 - DNA, 15 bp, Homo sapiens
ttccctgcccctgtg

SEQ ID NO: 5960417 - DNA, 16 bp, Homo sapiens
ttccctgcccctgtgc

SEQ ID NO: 5960418 - DNA, 16 bp, Homo sapiens
ttccctgcctccagct

SEQ ID NO: 5960419 - DNA, 12 bp, Homo sapiens
ttccctgcctgg

SEQ ID NO: 5960420 - DNA, 12 bp, Homo sapiens
ttccctgcctgt

SEQ ID NO: 5960421 - DNA, 18 bp, Homo sapiens
ttccctgcctgtggcatt

SEQ ID NO: 5960422 - DNA, 23 bp, Homo sapiens
ttccctgccttgctgacaataaa

SEQ ID NO: 5960423 - DNA, 22 bp, Homo sapiens
ttccctgcgagacgcacacagc

SEQ ID NO: 5960424 - DNA, 19 bp, Homo sapiens
ttccctgcgcctgtgatgc

SEQ ID NO: 5960425 - DNA, 13 bp, Homo sapiens
ttccctgctggcc

SEQ ID NO: 5960426 - DNA, 18 bp, Homo sapiens
ttccctgctggccaaagt

SEQ ID NO: 5960427 - DNA, 21 bp, Homo sapiens
ttccctgctttgcatctttgt

SEQ ID NO: 5960428 - DNA, 22 bp, Homo sapiens
ttcctgataattgtgcacacct

SEQ ID NO: 5960429 - DNA, 21 bp, Homo sapiens
ttcctgatactgggtacaaga

SEQ ID NO: 5960430 - DNA, 22 bp, Homo sapiens
ttcctgatagcatatgacaaat

SEQ ID NO: 5960431 - DNA, 20 bp, Homo sapiens
ttcctgatatgatttaaaac

SEQ ID NO: 5960432 - DNA, 17 bp, Homo sapiens
ttcctgatcaaggtgct

SEQ ID NO: 5960433 - DNA, 15 bp, Homo sapiens
ttcctgatgacccag

SEQ ID NO: 5960434 - DNA, 16 bp, Homo sapiens
ttcctgatgacccagg

SEQ ID NO: 5960435 - DNA, 12 bp, Homo sapiens
ttcctgatgatg

SEQ ID NO: 5960436 - DNA, 18 bp, Homo sapiens
ttcctgatgcttcttcag

SEQ ID NO: 5960437 - DNA, 23 bp, Homo sapiens
ttcctgatgcttcttcagagact

SEQ ID NO: 5960438 - DNA, 21 bp, Homo sapiens
ttcctgattaccagtctgatt

SEQ ID NO: 5960439 - DNA, 18 bp, Homo sapiens
ttcctgattgtttacagt

SEQ ID NO: 5960440 - DNA, 20 bp, Homo sapiens
ttcctgcaactcaaggactt

SEQ ID NO: 5960441 - DNA, 13 bp, Homo sapiens
ttcctgcaatgaa

SEQ ID NO: 5960442 - DNA, 12 bp, Homo sapiens
ttcctgcacccg

SEQ ID NO: 5960443 - DNA, 19 bp, Homo sapiens
ttcctgcagccagaaagga

SEQ ID NO: 5960444 - DNA, 15 bp, Homo sapiens
ttcctgcagcctgga

SEQ ID NO: 5960445 - DNA, 21 bp, Homo sapiens
ttcctgcaggcaggaacaaac

SEQ ID NO: 5960446 - DNA, 13 bp, Homo sapiens
ttcctgcatcttt

SEQ ID NO: 5960447 - DNA, 17 bp, Homo sapiens
ttcctgcatctttcata

SEQ ID NO: 5960448 - DNA, 20 bp, Homo sapiens
ttcctgcatctttcatagtt

SEQ ID NO: 5960449 - DNA, 11 bp, Homo sapiens
ttcctgcatgt

SEQ ID NO: 5960450 - DNA, 18 bp, Homo sapiens
ttcctgcattcacccaga

SEQ ID NO: 5960451 - DNA, 20 bp, Homo sapiens
ttcctgcatttctcttctca

SEQ ID NO: 5960452 - DNA, 15 bp, Homo sapiens
ttcctgcatttgtga

SEQ ID NO: 5960453 - DNA, 15 bp, Homo sapiens
ttcctgccaccagtc

SEQ ID NO: 5960454 - DNA, 17 bp, Homo sapiens
ttcctgccaccagtcac

SEQ ID NO: 5960455 - DNA, 17 bp, Homo sapiens
ttcctgccactgtgtaa

SEQ ID NO: 5960456 - DNA, 15 bp, Homo sapiens
ttcctgccagcccct

SEQ ID NO: 5960457 - DNA, 17 bp, Homo sapiens
ttcctgccaggcatggt

SEQ ID NO: 5960458 - DNA, 15 bp, Homo sapiens
ttcctgccaggctct

SEQ ID NO: 5960459 - DNA, 11 bp, Homo sapiens
ttcctgcccag

SEQ ID NO: 5960460 - DNA, 18 bp, Homo sapiens
ttcctgcccagcctgggg

SEQ ID NO: 5960461 - DNA, 21 bp, Homo sapiens
ttcctgccccagatggctttg

SEQ ID NO: 5960462 - DNA, 18 bp, Homo sapiens
ttcctgccccaggcctga

SEQ ID NO: 5960463 - DNA, 23 bp, Homo sapiens
ttcctgccccatcacttacagaa

SEQ ID NO: 5960464 - DNA, 13 bp, Homo sapiens
ttcctgcccccgc

SEQ ID NO: 5960465 - DNA, 21 bp, Homo sapiens
ttcctgcccctctttctcttt

SEQ ID NO: 5960466 - DNA, 11 bp, Homo sapiens
ttcctgccctg

SEQ ID NO: 5960467 - DNA, 13 bp, Homo sapiens
ttcctgccctggg

SEQ ID NO: 5960468 - DNA, 12 bp, Homo sapiens
ttcctgccctgt

SEQ ID NO: 5960469 - DNA, 17 bp, Homo sapiens
ttcctgccctgtacctc

SEQ ID NO: 5960470 - DNA, 22 bp, Homo sapiens
ttcctgccctgtacctctctct

SEQ ID NO: 5960471 - DNA, 15 bp, Homo sapiens
ttcctgccctgtcca

SEQ ID NO: 5960472 - DNA, 14 bp, Homo sapiens
ttcctgcccttccc

SEQ ID NO: 5960473 - DNA, 18 bp, Homo sapiens
ttcctgcccttcctcagt

SEQ ID NO: 5960474 - DNA, 12 bp, Homo sapiens
ttcctgcccttg

SEQ ID NO: 5960475 - DNA, 13 bp, Homo sapiens
ttcctgcccttga

SEQ ID NO: 5960476 - DNA, 19 bp, Homo sapiens
ttcctgccgtccctcctgt

SEQ ID NO: 5960477 - DNA, 19 bp, Homo sapiens
ttcctgcctactgcccctg

SEQ ID NO: 5960478 - DNA, 11 bp, Homo sapiens
ttcctgcctgg

SEQ ID NO: 5960479 - DNA, 22 bp, Homo sapiens
ttcctgcctggtctcctgcccc

SEQ ID NO: 5960480 - DNA, 18 bp, Homo sapiens
ttcctgcctgtctccttt

SEQ ID NO: 5960481 - DNA, 18 bp, Homo sapiens
ttcctgcctttcttccat

SEQ ID NO: 5960482 - DNA, 13 bp, Homo sapiens
ttcctgcctttga

SEQ ID NO: 5960483 - DNA, 22 bp, Homo sapiens
ttcctgcgtagaagatatggaa

SEQ ID NO: 5960484 - DNA, 14 bp, Homo sapiens
ttcctgctacagga

SEQ ID NO: 5960485 - DNA, 13 bp, Homo sapiens
ttcctgctccagt

SEQ ID NO: 5960486 - DNA, 17 bp, Homo sapiens
ttcctgctccctaacct

SEQ ID NO: 5960487 - DNA, 19 bp, Homo sapiens
ttcctgctccgtggactgc

SEQ ID NO: 5960488 - DNA, 22 bp, Homo sapiens
ttcctgctcctccagtacaata

SEQ ID NO: 5960489 - DNA, 13 bp, Homo sapiens
ttcctgctctctg

SEQ ID NO: 5960490 - DNA, 14 bp, Homo sapiens
ttcctgctctctgc

SEQ ID NO: 5960491 - DNA, 15 bp, Homo sapiens
ttcctgctctctgct

SEQ ID NO: 5960492 - DNA, 21 bp, Homo sapiens
ttcctgctctctgctcatggg

SEQ ID NO: 5960493 - DNA, 18 bp, Homo sapiens
ttcctgctgaacgtttcc

SEQ ID NO: 5960494 - DNA, 13 bp, Homo sapiens
ttcctgctgcctg

SEQ ID NO: 5960495 - DNA, 14 bp, Homo sapiens
ttcctgctgcctgg

SEQ ID NO: 5960496 - DNA, 11 bp, Homo sapiens
ttcctgctgct

SEQ ID NO: 5960497 - DNA, 17 bp, Homo sapiens
ttcctgctgctgctact

SEQ ID NO: 5960498 - DNA, 23 bp, Homo sapiens
ttcctgctgctgtaactgctgag

SEQ ID NO: 5960499 - DNA, 18 bp, Homo sapiens
ttcctgctgctgtctggg

SEQ ID NO: 5960500 - DNA, 20 bp, Homo sapiens
ttcctgctgctgtctgggtg

SEQ ID NO: 5960501 - DNA, 12 bp, Homo sapiens
ttcctgctgctt

SEQ ID NO: 5960502 - DNA, 14 bp, Homo sapiens
ttcctgctgggact

SEQ ID NO: 5960503 - DNA, 10 bp, Homo sapiens
ttcctgctgt

SEQ ID NO: 5960504 - DNA, 11 bp, Homo sapiens
ttcctgctgta

SEQ ID NO: 5960505 - DNA, 17 bp, Homo sapiens
ttcctgctgtcttctcc

SEQ ID NO: 5960506 - DNA, 18 bp, Homo sapiens
ttcctgctgtcttctccc

SEQ ID NO: 5960507 - DNA, 14 bp, Homo sapiens
ttcctgctgtgggg

SEQ ID NO: 5960508 - DNA, 17 bp, Homo sapiens
ttcctgcttagaattaa

SEQ ID NO: 5960509 - DNA, 15 bp, Homo sapiens
ttcctgctttctctt

SEQ ID NO: 5960510 - DNA, 11 bp, Homo sapiens
ttcctgctttt

SEQ ID NO: 5960511 - DNA, 15 bp, Homo sapiens
ttcctgcttttcccc

SEQ ID NO: 5960512 - DNA, 17 bp, Homo sapiens
ttcctggaaaagaagaa

SEQ ID NO: 5960513 - DNA, 21 bp, Homo sapiens
ttcctggaaaagaagaaactt

SEQ ID NO: 5960514 - DNA, 20 bp, Homo sapiens
ttcctggaaacagcatgaat

SEQ ID NO: 5960515 - DNA, 21 bp, Homo sapiens
ttcctggaaacagcatgaata

SEQ ID NO: 5960516 - DNA, 11 bp, Homo sapiens
ttcctggaacc

SEQ ID NO: 5960517 - DNA, 11 bp, Homo sapiens
ttcctggaagc

SEQ ID NO: 5960518 - DNA, 15 bp, Homo sapiens
ttcctggaagcagag

SEQ ID NO: 5960519 - DNA, 22 bp, Homo sapiens
ttcctggaagtcaaataaatgt

SEQ ID NO: 5960520 - DNA, 16 bp, Homo sapiens
ttcctggaattagttg

SEQ ID NO: 5960521 - DNA, 13 bp, Homo sapiens
ttcctggacacac

SEQ ID NO: 5960522 - DNA, 14 bp, Homo sapiens
ttcctggacacact

SEQ ID NO: 5960523 - DNA, 19 bp, Homo sapiens
ttcctggacagctgtgcct

SEQ ID NO: 5960524 - DNA, 21 bp, Homo sapiens
ttcctggacagctgtgcctcg

SEQ ID NO: 5960525 - DNA, 18 bp, Homo sapiens
ttcctggacaggccaggt

SEQ ID NO: 5960526 - DNA, 12 bp, Homo sapiens
ttcctggacatc

SEQ ID NO: 5960527 - DNA, 19 bp, Homo sapiens
ttcctggacatcaccagtc

SEQ ID NO: 5960528 - DNA, 20 bp, Homo sapiens
ttcctggacatcctcttctg

SEQ ID NO: 5960529 - DNA, 17 bp, Homo sapiens
ttcctggactggccctt

SEQ ID NO: 5960530 - DNA, 22 bp, Homo sapiens
ttcctggactggcccttgccca

SEQ ID NO: 5960531 - DNA, 20 bp, Homo sapiens
ttcctggagcccgaggcacc

SEQ ID NO: 5960532 - DNA, 17 bp, Homo sapiens
ttcctggagtgccctgc

SEQ ID NO: 5960533 - DNA, 18 bp, Homo sapiens
ttcctggagtgccctgca

SEQ ID NO: 5960534 - DNA, 23 bp, Homo sapiens
ttcctggagtgccctgcaggcac

SEQ ID NO: 5960535 - DNA, 16 bp, Homo sapiens
ttcctggagttttcag

SEQ ID NO: 5960536 - DNA, 14 bp, Homo sapiens
ttcctggatggggc

SEQ ID NO: 5960537 - DNA, 19 bp, Homo sapiens
ttcctggattttctttcta

SEQ ID NO: 5960538 - DNA, 23 bp, Homo sapiens
ttcctggattttctttctatgta

SEQ ID NO: 5960539 - DNA, 12 bp, Homo sapiens
ttcctggcacaa

SEQ ID NO: 5960540 - DNA, 22 bp, Homo sapiens
ttcctggcactgcttccagtga

SEQ ID NO: 5960541 - DNA, 18 bp, Homo sapiens
ttcctggcagcctgctgc

SEQ ID NO: 5960542 - DNA, 14 bp, Homo sapiens
ttcctggcagctgc

SEQ ID NO: 5960543 - DNA, 16 bp, Homo sapiens
ttcctggcatttgctg

SEQ ID NO: 5960544 - DNA, 17 bp, Homo sapiens
ttcctggcccactctgt

SEQ ID NO: 5960545 - DNA, 12 bp, Homo sapiens
ttcctggcccag

SEQ ID NO: 5960546 - DNA, 15 bp, Homo sapiens
ttcctggcccaggcc

SEQ ID NO: 5960547 - DNA, 15 bp, Homo sapiens
ttcctggccccctca

SEQ ID NO: 5960548 - DNA, 24 bp, Homo sapiens
ttcctggccccgggctctggccac

SEQ ID NO: 5960549 - DNA, 14 bp, Homo sapiens
ttcctggccttctg

SEQ ID NO: 5960550 - DNA, 17 bp, Homo sapiens
ttcctggccttctgaac

SEQ ID NO: 5960551 - DNA, 14 bp, Homo sapiens
ttcctggcgccccc

SEQ ID NO: 5960552 - DNA, 13 bp, Homo sapiens
ttcctggctagga

SEQ ID NO: 5960553 - DNA, 14 bp, Homo sapiens
ttcctggctctggg

SEQ ID NO: 5960554 - DNA, 17 bp, Homo sapiens
ttcctggctctggggga

SEQ ID NO: 5960555 - DNA, 13 bp, Homo sapiens
ttcctggctgatg

SEQ ID NO: 5960556 - DNA, 20 bp, Homo sapiens
ttcctggctgatgatccaga

SEQ ID NO: 5960557 - DNA, 14 bp, Homo sapiens
ttcctggcttctta

SEQ ID NO: 5960558 - DNA, 18 bp, Homo sapiens
ttcctggctttttaactc

SEQ ID NO: 5960559 - DNA, 15 bp, Homo sapiens
ttcctgggaccccct

SEQ ID NO: 5960560 - DNA, 17 bp, Homo sapiens
ttcctgggaccccctcg

SEQ ID NO: 5960561 - DNA, 22 bp, Homo sapiens
ttcctgggaggacaggcaggcc

SEQ ID NO: 5960562 - DNA, 18 bp, Homo sapiens
ttcctgggagtgggagtc

SEQ ID NO: 5960563 - DNA, 23 bp, Homo sapiens
ttcctgggatgatgtgtgaaacc

SEQ ID NO: 5960564 - DNA, 16 bp, Homo sapiens
ttcctgggcagcccag

SEQ ID NO: 5960565 - DNA, 18 bp, Homo sapiens
ttcctgggcagcccagag

SEQ ID NO: 5960566 - DNA, 23 bp, Homo sapiens
ttcctgggccttctcagctctcc

SEQ ID NO: 5960567 - DNA, 17 bp, Homo sapiens
ttcctgggcctttgcaa

SEQ ID NO: 5960568 - DNA, 14 bp, Homo sapiens
ttcctggggatgtc

SEQ ID NO: 5960569 - DNA, 11 bp, Homo sapiens
ttcctggggcc

SEQ ID NO: 5960570 - DNA, 12 bp, Homo sapiens
ttcctggggccg

SEQ ID NO: 5960571 - DNA, 15 bp, Homo sapiens
ttcctggggtgccct

SEQ ID NO: 5960572 - DNA, 22 bp, Homo sapiens
ttcctgggtcctgcctggtcct

SEQ ID NO: 5960573 - DNA, 15 bp, Homo sapiens
ttcctgggtgctcag

SEQ ID NO: 5960574 - DNA, 17 bp, Homo sapiens
ttcctgggtttcctgca

SEQ ID NO: 5960575 - DNA, 17 bp, Homo sapiens
ttcctggtacccagcca

SEQ ID NO: 5960576 - DNA, 18 bp, Homo sapiens
ttcctggtacccagccat

SEQ ID NO: 5960577 - DNA, 15 bp, Homo sapiens
ttcctggtgactcct

SEQ ID NO: 5960578 - DNA, 16 bp, Homo sapiens
ttcctggtgactcctg

SEQ ID NO: 5960579 - DNA, 20 bp, Homo sapiens
ttcctggtgccaatttcaag

SEQ ID NO: 5960580 - DNA, 22 bp, Homo sapiens
ttcctggtttaattcagcagag

SEQ ID NO: 5960581 - DNA, 21 bp, Homo sapiens
ttcctggttttgtacactgct

SEQ ID NO: 5960582 - DNA, 22 bp, Homo sapiens
ttcctgtaaagaaacatttcct

SEQ ID NO: 5960583 - DNA, 11 bp, Homo sapiens
ttcctgtaaca

SEQ ID NO: 5960584 - DNA, 21 bp, Homo sapiens
ttcctgtaacacaagccacag

SEQ ID NO: 5960585 - DNA, 23 bp, Homo sapiens
ttcctgtaacacaagccacagaa

SEQ ID NO: 5960586 - DNA, 15 bp, Homo sapiens
ttcctgtaatatatt

SEQ ID NO: 5960587 - DNA, 16 bp, Homo sapiens
ttcctgtactgtgtct

SEQ ID NO: 5960588 - DNA, 16 bp, Homo sapiens
ttcctgtatgttgtcc

SEQ ID NO: 5960589 - DNA, 11 bp, Homo sapiens
ttcctgtcaat

SEQ ID NO: 5960590 - DNA, 20 bp, Homo sapiens
ttcctgtcagtgtttttgaa

SEQ ID NO: 5960591 - DNA, 12 bp, Homo sapiens
ttcctgtcccca

SEQ ID NO: 5960592 - DNA, 18 bp, Homo sapiens
ttcctgtccccaaaatgt

SEQ ID NO: 5960593 - DNA, 18 bp, Homo sapiens
ttcctgtccgccctcttc

SEQ ID NO: 5960594 - DNA, 21 bp, Homo sapiens
ttcctgtcctctttcagctcc

SEQ ID NO: 5960595 - DNA, 24 bp, Homo sapiens
ttcctgtcctctttcagctcctga

SEQ ID NO: 5960596 - DNA, 14 bp, Homo sapiens
ttcctgtcctgccc

SEQ ID NO: 5960597 - DNA, 13 bp, Homo sapiens
ttcctgtcctgct

SEQ ID NO: 5960598 - DNA, 21 bp, Homo sapiens
ttcctgtcctgctcacgtctg

SEQ ID NO: 5960599 - DNA, 15 bp, Homo sapiens
ttcctgtccttcaca

SEQ ID NO: 5960600 - DNA, 23 bp, Homo sapiens
ttcctgtccttctctcacctcct

SEQ ID NO: 5960601 - DNA, 14 bp, Homo sapiens
ttcctgtctaaagt

SEQ ID NO: 5960602 - DNA, 20 bp, Homo sapiens
ttcctgtctcaatagctcca

SEQ ID NO: 5960603 - DNA, 19 bp, Homo sapiens
ttcctgtctcactcttctg

SEQ ID NO: 5960604 - DNA, 15 bp, Homo sapiens
ttcctgtctcccagg

SEQ ID NO: 5960605 - DNA, 13 bp, Homo sapiens
ttcctgtctcctt

SEQ ID NO: 5960606 - DNA, 21 bp, Homo sapiens
ttcctgtctggcttctagaga

SEQ ID NO: 5960607 - DNA, 15 bp, Homo sapiens
ttcctgtctgtttat

SEQ ID NO: 5960608 - DNA, 12 bp, Homo sapiens
ttctagaaaaac

SEQ ID NO: 5960609 - DNA, 21 bp, Homo sapiens
ttctagaaacaaacatctaat

SEQ ID NO: 5960610 - DNA, 23 bp, Homo sapiens
ttctagaaagcctgttcccctca

SEQ ID NO: 5960611 - DNA, 12 bp, Homo sapiens
ttctagaaccac

SEQ ID NO: 5960612 - DNA, 17 bp, Homo sapiens
ttctagaacctgggctg

SEQ ID NO: 5960613 - DNA, 20 bp, Homo sapiens
ttctagaacctgggctgtgc

SEQ ID NO: 5960614 - DNA, 17 bp, Homo sapiens
ttctagaagataacatt

SEQ ID NO: 5960615 - DNA, 19 bp, Homo sapiens
ttctagaaggatgaacagt

SEQ ID NO: 5960616 - DNA, 22 bp, Homo sapiens
ttctagaaggatgaacagttct

SEQ ID NO: 5960617 - DNA, 20 bp, Homo sapiens
ttctagaagtttcccttcct

SEQ ID NO: 5960618 - DNA, 19 bp, Homo sapiens
ttctagaatactaataaaa

SEQ ID NO: 5960619 - DNA, 18 bp, Homo sapiens
ttctagaatcatgtattt

SEQ ID NO: 5960620 - DNA, 22 bp, Homo sapiens
ttctagaattataagtcacaaa

SEQ ID NO: 5960621 - DNA, 21 bp, Homo sapiens
ttctagaatttatcacacttc

SEQ ID NO: 5960622 - DNA, 18 bp, Homo sapiens
ttctagacactgaaggca

SEQ ID NO: 5960623 - DNA, 14 bp, Homo sapiens
ttctagactataaa

SEQ ID NO: 5960624 - DNA, 22 bp, Homo sapiens
ttctagactcaaaacctggaga

SEQ ID NO: 5960625 - DNA, 15 bp, Homo sapiens
ttctagactttctgt

SEQ ID NO: 5960626 - DNA, 14 bp, Homo sapiens
ttctagagacacat

SEQ ID NO: 5960627 - DNA, 14 bp, Homo sapiens
ttctagagcctcga

SEQ ID NO: 5960628 - DNA, 15 bp, Homo sapiens
ttctagaggcctcag

SEQ ID NO: 5960629 - DNA, 19 bp, Homo sapiens
ttctagagttcagagtcct

SEQ ID NO: 5960630 - DNA, 18 bp, Homo sapiens
ttctagataaccttgttt

SEQ ID NO: 5960631 - DNA, 19 bp, Homo sapiens
ttctagatacaataaattg

SEQ ID NO: 5960632 - DNA, 20 bp, Homo sapiens
ttctagatacaataaattgc

SEQ ID NO: 5960633 - DNA, 16 bp, Homo sapiens
ttctagatatgagaaa

SEQ ID NO: 5960634 - DNA, 17 bp, Homo sapiens
ttctagatcagagagca

SEQ ID NO: 5960635 - DNA, 22 bp, Homo sapiens
ttctagatcagatgctccaaga

SEQ ID NO: 5960636 - DNA, 24 bp, Homo sapiens
ttctagatcagatgctccaagatt

SEQ ID NO: 5960637 - DNA, 15 bp, Homo sapiens
ttctagattaccatg

SEQ ID NO: 5960638 - DNA, 16 bp, Homo sapiens
ttctagattatgtctt

SEQ ID NO: 5960639 - DNA, 17 bp, Homo sapiens
ttctagattcactgtct

SEQ ID NO: 5960640 - DNA, 18 bp, Homo sapiens
ttctagcaagatagtctt

SEQ ID NO: 5960641 - DNA, 19 bp, Homo sapiens
ttctagcaagatagtcttc

SEQ ID NO: 5960642 - DNA, 19 bp, Homo sapiens
ttctagcaattttctttgt

SEQ ID NO: 5960643 - DNA, 12 bp, Homo sapiens
ttctagcacatc

SEQ ID NO: 5960644 - DNA, 17 bp, Homo sapiens
ttctagcaccttatcta

SEQ ID NO: 5960645 - DNA, 12 bp, Homo sapiens
ttctagcactgg

SEQ ID NO: 5960646 - DNA, 14 bp, Homo sapiens
ttctagcagagacc

SEQ ID NO: 5960647 - DNA, 16 bp, Homo sapiens
ttctagcagtccccag

SEQ ID NO: 5960648 - DNA, 17 bp, Homo sapiens
ttctagcagtgagccaa

SEQ ID NO: 5960649 - DNA, 23 bp, Homo sapiens
ttctagcatatagactatataat

SEQ ID NO: 5960650 - DNA, 15 bp, Homo sapiens
ttctagcatggcata

SEQ ID NO: 5960651 - DNA, 22 bp, Homo sapiens
ttctagcatggcatatttttca

SEQ ID NO: 5960652 - DNA, 15 bp, Homo sapiens
ttctagcatttcttc

SEQ ID NO: 5960653 - DNA, 16 bp, Homo sapiens
ttctagccctctccct

SEQ ID NO: 5960654 - DNA, 21 bp, Homo sapiens
ttctagcgaacgtatttctcc

SEQ ID NO: 5960655 - DNA, 23 bp, Homo sapiens
ttctagcgaacgtatttctccag

SEQ ID NO: 5960656 - DNA, 23 bp, Homo sapiens
ttctagctaaatgaccatccagt

SEQ ID NO: 5960657 - DNA, 22 bp, Homo sapiens
ttctagctaatggaaaatgatt

SEQ ID NO: 5960658 - DNA, 23 bp, Homo sapiens
ttctagctataacaactctattt

SEQ ID NO: 5960659 - DNA, 15 bp, Homo sapiens
ttctagctgtctgtg

SEQ ID NO: 5960660 - DNA, 22 bp, Homo sapiens
ttctagcttatctacttccaaa

SEQ ID NO: 5960661 - DNA, 11 bp, Homo sapiens
ttctaggaaaa

SEQ ID NO: 5960662 - DNA, 19 bp, Homo sapiens
ttctaggaaattcttgaaa

SEQ ID NO: 5960663 - DNA, 23 bp, Homo sapiens
ttctaggaagaattttaaaaatg

SEQ ID NO: 5960664 - DNA, 17 bp, Homo sapiens
ttctaggaatggaggag

SEQ ID NO: 5960665 - DNA, 16 bp, Homo sapiens
ttctaggacctgtgtc

SEQ ID NO: 5960666 - DNA, 13 bp, Homo sapiens
ttctaggactgaa

SEQ ID NO: 5960667 - DNA, 16 bp, Homo sapiens
ttctaggatgaacaat

SEQ ID NO: 5960668 - DNA, 19 bp, Homo sapiens
ttctaggatgaacaatgta

SEQ ID NO: 5960669 - DNA, 18 bp, Homo sapiens
ttctaggcaaaattgtga

SEQ ID NO: 5960670 - DNA, 21 bp, Homo sapiens
ttctaggcaaaattgtgaagc

SEQ ID NO: 5960671 - DNA, 23 bp, Homo sapiens
ttctaggcactgtagttctaaga

SEQ ID NO: 5960672 - DNA, 19 bp, Homo sapiens
ttctaggcatacttttcaa

SEQ ID NO: 5960673 - DNA, 20 bp, Homo sapiens
ttctaggcatacttttcaaa

SEQ ID NO: 5960674 - DNA, 16 bp, Homo sapiens
ttctaggcatctcctc

SEQ ID NO: 5960675 - DNA, 20 bp, Homo sapiens
ttctaggcatctcctctccc

SEQ ID NO: 5960676 - DNA, 16 bp, Homo sapiens
ttctaggcatctctgt

SEQ ID NO: 5960677 - DNA, 13 bp, Homo sapiens
ttctaggcctttc

SEQ ID NO: 5960678 - DNA, 14 bp, Homo sapiens
ttctaggcctttcc

SEQ ID NO: 5960679 - DNA, 18 bp, Homo sapiens
ttctaggcctttcctctg

SEQ ID NO: 5960680 - DNA, 19 bp, Homo sapiens
ttctaggcctttcctctgc

SEQ ID NO: 5960681 - DNA, 20 bp, Homo sapiens
ttctaggcctttcctctgca

SEQ ID NO: 5960682 - DNA, 14 bp, Homo sapiens
ttctagggctggga

SEQ ID NO: 5960683 - DNA, 18 bp, Homo sapiens
ttctaggggagaagagcc

SEQ ID NO: 5960684 - DNA, 14 bp, Homo sapiens
ttctaggtaggaaa

SEQ ID NO: 5960685 - DNA, 21 bp, Homo sapiens
ttctaggtcaaggcctgtccc

SEQ ID NO: 5960686 - DNA, 20 bp, Homo sapiens
ttctaggtcagtctaacagt

SEQ ID NO: 5960687 - DNA, 21 bp, Homo sapiens
ttctaggtcagtctaacagtt

SEQ ID NO: 5960688 - DNA, 21 bp, Homo sapiens
ttctaggtggaggttgtgcat

SEQ ID NO: 5960689 - DNA, 23 bp, Homo sapiens
ttctaggtggcaaggctgtgctc

SEQ ID NO: 5960690 - DNA, 13 bp, Homo sapiens
ttctaggtttcaa

SEQ ID NO: 5960691 - DNA, 21 bp, Homo sapiens
ttctaggtttcaaagatgctg

SEQ ID NO: 5960692 - DNA, 16 bp, Homo sapiens
ttctagtaacagtatt

SEQ ID NO: 5960693 - DNA, 18 bp, Homo sapiens
ttctagtacctgtgactc

SEQ ID NO: 5960694 - DNA, 21 bp, Homo sapiens
ttctagtatgtcttgaaacat

SEQ ID NO: 5960695 - DNA, 16 bp, Homo sapiens
ttctagtcaactgctg

SEQ ID NO: 5960696 - DNA, 18 bp, Homo sapiens
ttctagtcaactgctgtt

SEQ ID NO: 5960697 - DNA, 19 bp, Homo sapiens
ttctagtcaactgctgttt

SEQ ID NO: 5960698 - DNA, 14 bp, Homo sapiens
ttctagtctctctg

SEQ ID NO: 5960699 - DNA, 14 bp, Homo sapiens
ttctagtctctgat

SEQ ID NO: 5960700 - DNA, 23 bp, Homo sapiens
ttctagtctggaactgctgctga

SEQ ID NO: 5960701 - DNA, 19 bp, Homo sapiens
ttctagtgagcctgggcca

SEQ ID NO: 5960702 - DNA, 13 bp, Homo sapiens
ttctagtggctgt

SEQ ID NO: 5960703 - DNA, 15 bp, Homo sapiens
ttctagtggtctttg

SEQ ID NO: 5960704 - DNA, 22 bp, Homo sapiens
ttctagtggtctttgtaagagt

SEQ ID NO: 5960705 - DNA, 18 bp, Homo sapiens
ttctagtgtaacactgca

SEQ ID NO: 5960706 - DNA, 18 bp, Homo sapiens
ttctagtgtatactctgt

SEQ ID NO: 5960707 - DNA, 16 bp, Homo sapiens
ttctagtgtccataaa

SEQ ID NO: 5960708 - DNA, 19 bp, Homo sapiens
ttctagttaactttttcca

SEQ ID NO: 5960709 - DNA, 19 bp, Homo sapiens
ttctagttagcaggaaata

SEQ ID NO: 5960710 - DNA, 22 bp, Homo sapiens
ttctagttagctgctttaaatc

SEQ ID NO: 5960711 - DNA, 23 bp, Homo sapiens
ttctagttagctgctttaaatct

SEQ ID NO: 5960712 - DNA, 12 bp, Homo sapiens
ttctagttatta

SEQ ID NO: 5960713 - DNA, 17 bp, Homo sapiens
ttctagttatttattct

SEQ ID NO: 5960714 - DNA, 12 bp, Homo sapiens
ttctagttcaat

SEQ ID NO: 5960715 - DNA, 17 bp, Homo sapiens
ttctagttgaggagttt

SEQ ID NO: 5960716 - DNA, 15 bp, Homo sapiens
ttctagtttcccaca

SEQ ID NO: 5960717 - DNA, 22 bp, Homo sapiens
ttctagtttcccacaatataaa

SEQ ID NO: 5960718 - DNA, 14 bp, Homo sapiens
ttctagtttcctgc

SEQ ID NO: 5960719 - DNA, 14 bp, Homo sapiens
ttctagtttgcatt

SEQ ID NO: 5960720 - DNA, 16 bp, Homo sapiens
ttctagtttggcacat

SEQ ID NO: 5960721 - DNA, 14 bp, Homo sapiens
ttctagttttcagt

SEQ ID NO: 5960722 - DNA, 13 bp, Homo sapiens
ttctagttttgtc

SEQ ID NO: 5960723 - DNA, 17 bp, Homo sapiens
ttctataaatagatgct

SEQ ID NO: 5960724 - DNA, 15 bp, Homo sapiens
ttctataaatcagta

SEQ ID NO: 5960725 - DNA, 15 bp, Homo sapiens
ttctataaatgacta

SEQ ID NO: 5960726 - DNA, 16 bp, Homo sapiens
ttctataaatgactat

SEQ ID NO: 5960727 - DNA, 13 bp, Homo sapiens
ttctataaattta

SEQ ID NO: 5960728 - DNA, 14 bp, Homo sapiens
ttctataaatttaa

SEQ ID NO: 5960729 - DNA, 16 bp, Homo sapiens
ttctataacaacaaca

SEQ ID NO: 5960730 - DNA, 17 bp, Homo sapiens
ttctataacctggattt

SEQ ID NO: 5960731 - DNA, 20 bp, Homo sapiens
ttctataacctggatttttt

SEQ ID NO: 5960732 - DNA, 14 bp, Homo sapiens
ttctataagctatt

SEQ ID NO: 5960733 - DNA, 14 bp, Homo sapiens
ttctataaggccat

SEQ ID NO: 5960734 - DNA, 15 bp, Homo sapiens
ttctataagttgtac

SEQ ID NO: 5960735 - DNA, 21 bp, Homo sapiens
ttctataagttgtaccaaaac

SEQ ID NO: 5960736 - DNA, 21 bp, Homo sapiens
ttctataataagttttgatat

SEQ ID NO: 5960737 - DNA, 23 bp, Homo sapiens
ttctataataagttttgatataa

SEQ ID NO: 5960738 - DNA, 16 bp, Homo sapiens
ttctataattttacaa

SEQ ID NO: 5960739 - DNA, 23 bp, Homo sapiens
ttctatacacaccctgcccctgc

SEQ ID NO: 5960740 - DNA, 16 bp, Homo sapiens
ttctatacatgtttgc

SEQ ID NO: 5960741 - DNA, 19 bp, Homo sapiens
ttctatacatgtttgcagt

SEQ ID NO: 5960742 - DNA, 14 bp, Homo sapiens
ttctatagccaaaa

SEQ ID NO: 5960743 - DNA, 23 bp, Homo sapiens
ttctatagccaaaaatagctaaa

SEQ ID NO: 5960744 - DNA, 19 bp, Homo sapiens
ttctatagctcttctattt

SEQ ID NO: 5960745 - DNA, 22 bp, Homo sapiens
ttctatagctcttctatttaaa

SEQ ID NO: 5960746 - DNA, 20 bp, Homo sapiens
ttctataggaacatatgaaa

SEQ ID NO: 5960747 - DNA, 22 bp, Homo sapiens
ttctatataaaatgtattcaag

SEQ ID NO: 5960748 - DNA, 23 bp, Homo sapiens
ttctatatatacaatgagtaaaa

SEQ ID NO: 5960749 - DNA, 22 bp, Homo sapiens
ttctatatcattaggaaaacat

SEQ ID NO: 5960750 - DNA, 20 bp, Homo sapiens
ttctatatgaatttaaatat

SEQ ID NO: 5960751 - DNA, 17 bp, Homo sapiens
ttctatatgtaacttca

SEQ ID NO: 5960752 - DNA, 20 bp, Homo sapiens
ttctatatgtaacttcagat

SEQ ID NO: 5960753 - DNA, 14 bp, Homo sapiens
ttctatatgtttaa

SEQ ID NO: 5960754 - DNA, 19 bp, Homo sapiens
ttctatattcctccagctg

SEQ ID NO: 5960755 - DNA, 14 bp, Homo sapiens
ttctatatttactg

SEQ ID NO: 5960756 - DNA, 15 bp, Homo sapiens
ttctatatttactgt

SEQ ID NO: 5960757 - DNA, 16 bp, Homo sapiens
ttctatatttggattc

SEQ ID NO: 5960758 - DNA, 16 bp, Homo sapiens
ttctatatttgtaact

SEQ ID NO: 5960759 - DNA, 17 bp, Homo sapiens
ttctatattttaataga

SEQ ID NO: 5960760 - DNA, 14 bp, Homo sapiens
ttctatattttcat

SEQ ID NO: 5960761 - DNA, 18 bp, Homo sapiens
ttctatattttcattctc

SEQ ID NO: 5960762 - DNA, 21 bp, Homo sapiens
ttctatattttcattctccta

SEQ ID NO: 5960763 - DNA, 14 bp, Homo sapiens
ttctatcaagccca

SEQ ID NO: 5960764 - DNA, 17 bp, Homo sapiens
ttctatcacatatttga

SEQ ID NO: 5960765 - DNA, 18 bp, Homo sapiens
ttctatcagaagttgtat

SEQ ID NO: 5960766 - DNA, 18 bp, Homo sapiens
ttctatcagactcagttt

SEQ ID NO: 5960767 - DNA, 19 bp, Homo sapiens
ttctatcagactcagtttt

SEQ ID NO: 5960768 - DNA, 15 bp, Homo sapiens
ttctatcagtgactt

SEQ ID NO: 5960769 - DNA, 16 bp, Homo sapiens
ttctatcagtgacttc

SEQ ID NO: 5960770 - DNA, 22 bp, Homo sapiens
ttctatcagttatcctttgtga

SEQ ID NO: 5960771 - DNA, 17 bp, Homo sapiens
ttctatccaaacatgta

SEQ ID NO: 5960772 - DNA, 21 bp, Homo sapiens
ttctatcccccttaaagaaaa

SEQ ID NO: 5960773 - DNA, 23 bp, Homo sapiens
ttctatcctacaacaagagttta

SEQ ID NO: 5960774 - DNA, 14 bp, Homo sapiens
ttctatcctctgta

SEQ ID NO: 5960775 - DNA, 19 bp, Homo sapiens
ttctatcctgtgaggcttt

SEQ ID NO: 5960776 - DNA, 18 bp, Homo sapiens
ttctatccttttgcctgc

SEQ ID NO: 5960777 - DNA, 21 bp, Homo sapiens
ttctatcgttattataaatgt

SEQ ID NO: 5960778 - DNA, 22 bp, Homo sapiens
ttctatcgttattataaatgtt

SEQ ID NO: 5960779 - DNA, 15 bp, Homo sapiens
ttctatctactgatt

SEQ ID NO: 5960780 - DNA, 20 bp, Homo sapiens
ttctatcttttgtttccttt

SEQ ID NO: 5960781 - DNA, 19 bp, Homo sapiens
ttctatgacaaattcaaga

SEQ ID NO: 5960782 - DNA, 17 bp, Homo sapiens
ttctatgacacatgcaa

SEQ ID NO: 5960783 - DNA, 13 bp, Homo sapiens
ttctatgagaaaa

SEQ ID NO: 5960784 - DNA, 13 bp, Homo sapiens
ttctgaagaagat

SEQ ID NO: 5960785 - DNA, 16 bp, Homo sapiens
ttctgaagactgagaa

SEQ ID NO: 5960786 - DNA, 21 bp, Homo sapiens
ttctgaagaggaaaagtcaaa

SEQ ID NO: 5960787 - DNA, 23 bp, Homo sapiens
ttctgaagagtaaggagtagtat

SEQ ID NO: 5960788 - DNA, 16 bp, Homo sapiens
ttctgaagatctcaga

SEQ ID NO: 5960789 - DNA, 16 bp, Homo sapiens
ttctgaagctgacagc

SEQ ID NO: 5960790 - DNA, 18 bp, Homo sapiens
ttctgaaggaagagaaga

SEQ ID NO: 5960791 - DNA, 18 bp, Homo sapiens
ttctgaaggtgcccagga

SEQ ID NO: 5960792 - DNA, 18 bp, Homo sapiens
ttctgaaggttggaactg

SEQ ID NO: 5960793 - DNA, 13 bp, Homo sapiens
ttctgaagtactt

SEQ ID NO: 5960794 - DNA, 16 bp, Homo sapiens
ttctgaagtatgaagt

SEQ ID NO: 5960795 - DNA, 18 bp, Homo sapiens
ttctgaagtctactttgt

SEQ ID NO: 5960796 - DNA, 23 bp, Homo sapiens
ttctgaagtctgagcccatttct

SEQ ID NO: 5960797 - DNA, 19 bp, Homo sapiens
ttctgaagtgggaaaaaat

SEQ ID NO: 5960798 - DNA, 17 bp, Homo sapiens
ttctgaagttatatttc

SEQ ID NO: 5960799 - DNA, 18 bp, Homo sapiens
ttctgaagttatatttcc

SEQ ID NO: 5960800 - DNA, 22 bp, Homo sapiens
ttctgaagttatatttcctata

SEQ ID NO: 5960801 - DNA, 10 bp, Homo sapiens
ttctgaataa

SEQ ID NO: 5960802 - DNA, 12 bp, Homo sapiens
ttctgaataaaa

SEQ ID NO: 5960803 - DNA, 17 bp, Homo sapiens
ttctgaataaaaaagat

SEQ ID NO: 5960804 - DNA, 20 bp, Homo sapiens
ttctgaataaaaaagattct

SEQ ID NO: 5960805 - DNA, 15 bp, Homo sapiens
ttctgaataaagcaa

SEQ ID NO: 5960806 - DNA, 17 bp, Homo sapiens
ttctgaataaagcaatt

SEQ ID NO: 5960807 - DNA, 16 bp, Homo sapiens
ttctgaataacttgaa

SEQ ID NO: 5960808 - DNA, 17 bp, Homo sapiens
ttctgaataatgaagat

SEQ ID NO: 5960809 - DNA, 22 bp, Homo sapiens
ttctgaatcaagcacactgtat

SEQ ID NO: 5960810 - DNA, 22 bp, Homo sapiens
ttctgaatcctggtaattaaaa

SEQ ID NO: 5960811 - DNA, 18 bp, Homo sapiens
ttctgaatgctgctactt

SEQ ID NO: 5960812 - DNA, 18 bp, Homo sapiens
ttctgaatgcttctaagt

SEQ ID NO: 5960813 - DNA, 14 bp, Homo sapiens
ttctgaatgtttgt

SEQ ID NO: 5960814 - DNA, 11 bp, Homo sapiens
ttctgaattca

SEQ ID NO: 5960815 - DNA, 18 bp, Homo sapiens
ttctgaattcaaagcttg

SEQ ID NO: 5960816 - DNA, 20 bp, Homo sapiens
ttctgaattcaaagcttgtg

SEQ ID NO: 5960817 - DNA, 23 bp, Homo sapiens
ttctgaattcaaagcttgtgaaa

SEQ ID NO: 5960818 - DNA, 18 bp, Homo sapiens
ttctgaattggaagggaa

SEQ ID NO: 5960819 - DNA, 19 bp, Homo sapiens
ttctgaattggaagggaaa

SEQ ID NO: 5960820 - DNA, 16 bp, Homo sapiens
ttctgaatttgcaaag

SEQ ID NO: 5960821 - DNA, 21 bp, Homo sapiens
ttctgaatttgcaaagtactg

SEQ ID NO: 5960822 - DNA, 20 bp, Homo sapiens
ttctgacaaaggtggtaaat

SEQ ID NO: 5960823 - DNA, 23 bp, Homo sapiens
ttctgacaagataaaggaagtca

SEQ ID NO: 5960824 - DNA, 15 bp, Homo sapiens
ttctgacagttgtga

SEQ ID NO: 5960825 - DNA, 14 bp, Homo sapiens
ttctgacataaaat

SEQ ID NO: 5960826 - DNA, 15 bp, Homo sapiens
ttctgacataaaatt

SEQ ID NO: 5960827 - DNA, 23 bp, Homo sapiens
ttctgacatcttagtatttgcat

SEQ ID NO: 5960828 - DNA, 12 bp, Homo sapiens
ttctgacatgta

SEQ ID NO: 5960829 - DNA, 14 bp, Homo sapiens
ttctgacattaaca

SEQ ID NO: 5960830 - DNA, 21 bp, Homo sapiens
ttctgaccaaaatgtgtttca

SEQ ID NO: 5960831 - DNA, 16 bp, Homo sapiens
ttctgacccaaagcaa

SEQ ID NO: 5960832 - DNA, 18 bp, Homo sapiens
ttctgacccaaagcaaaa

SEQ ID NO: 5960833 - DNA, 21 bp, Homo sapiens
ttctgacccaaagcaaaacat

SEQ ID NO: 5960834 - DNA, 21 bp, Homo sapiens
ttctgacccaagaggtgggga

SEQ ID NO: 5960835 - DNA, 18 bp, Homo sapiens
ttctgacccatgctgccc

SEQ ID NO: 5960836 - DNA, 20 bp, Homo sapiens
ttctgacccatgctgccctg

SEQ ID NO: 5960837 - DNA, 21 bp, Homo sapiens
ttctgacccatgctgccctgt

SEQ ID NO: 5960838 - DNA, 23 bp, Homo sapiens
ttctgacccatgctgccctgtga

SEQ ID NO: 5960839 - DNA, 21 bp, Homo sapiens
ttctgaccctgcttcaaatat

SEQ ID NO: 5960840 - DNA, 18 bp, Homo sapiens
ttctgaccttcagctcac

SEQ ID NO: 5960841 - DNA, 15 bp, Homo sapiens
ttctgacggccctgc

SEQ ID NO: 5960842 - DNA, 18 bp, Homo sapiens
ttctgactagtttaaaga

SEQ ID NO: 5960843 - DNA, 12 bp, Homo sapiens
ttctgactgtcc

SEQ ID NO: 5960844 - DNA, 18 bp, Homo sapiens
ttctgactgtttatttaa

SEQ ID NO: 5960845 - DNA, 21 bp, Homo sapiens
ttctgactgtttatttaagga

SEQ ID NO: 5960846 - DNA, 22 bp, Homo sapiens
ttctgacttctagctgtctgtg

SEQ ID NO: 5960847 - DNA, 15 bp, Homo sapiens
ttctgactttacttg

SEQ ID NO: 5960848 - DNA, 16 bp, Homo sapiens
ttctgactttgaattt

SEQ ID NO: 5960849 - DNA, 20 bp, Homo sapiens
ttctgactttgaatttatat

SEQ ID NO: 5960850 - DNA, 23 bp, Homo sapiens
ttctgactttgaatttatataaa

SEQ ID NO: 5960851 - DNA, 16 bp, Homo sapiens
ttctgacttttacaga

SEQ ID NO: 5960852 - DNA, 21 bp, Homo sapiens
ttctgagaaaacaagcaagtt

SEQ ID NO: 5960853 - DNA, 12 bp, Homo sapiens
ttctgagaaaag

SEQ ID NO: 5960854 - DNA, 15 bp, Homo sapiens
ttctgagaaagacta

SEQ ID NO: 5960855 - DNA, 20 bp, Homo sapiens
ttctgagaagcgctgccctg

SEQ ID NO: 5960856 - DNA, 13 bp, Homo sapiens
ttctgagaaggtg

SEQ ID NO: 5960857 - DNA, 12 bp, Homo sapiens
ttctgagaccag

SEQ ID NO: 5960858 - DNA, 17 bp, Homo sapiens
ttctgagacgtcatgag

SEQ ID NO: 5960859 - DNA, 22 bp, Homo sapiens
ttctgagacgtcatgaggagat

SEQ ID NO: 5960860 - DNA, 22 bp, Homo sapiens
ttctgagagttggctcaggcag

SEQ ID NO: 5960861 - DNA, 22 bp, Homo sapiens
ttctgagatccagcacaactca

SEQ ID NO: 5960862 - DNA, 16 bp, Homo sapiens
ttctgagcaaagcatc

SEQ ID NO: 5960863 - DNA, 18 bp, Homo sapiens
ttctgagcaaaggccctg

SEQ ID NO: 5960864 - DNA, 10 bp, Homo sapiens
ttctgagcag

SEQ ID NO: 5960865 - DNA, 20 bp, Homo sapiens
ttctgagcagcgagcctgct

SEQ ID NO: 5960866 - DNA, 14 bp, Homo sapiens
ttctgagccccagc

SEQ ID NO: 5960867 - DNA, 19 bp, Homo sapiens
ttctgagcccgggctgcct

SEQ ID NO: 5960868 - DNA, 19 bp, Homo sapiens
ttctgagcccggtaagagc

SEQ ID NO: 5960869 - DNA, 21 bp, Homo sapiens
ttctgagctagttggttgaat

SEQ ID NO: 5960870 - DNA, 20 bp, Homo sapiens
ttctgagctccacctctggt

SEQ ID NO: 5960871 - DNA, 16 bp, Homo sapiens
ttctgagctccccatc

SEQ ID NO: 5960872 - DNA, 15 bp, Homo sapiens
ttctgagctgccagt

SEQ ID NO: 5960873 - DNA, 14 bp, Homo sapiens
ttctgagctggcct

SEQ ID NO: 5960874 - DNA, 19 bp, Homo sapiens
ttctgagcttttcatggaa

SEQ ID NO: 5960875 - DNA, 19 bp, Homo sapiens
ttctgaggacattccaaga

SEQ ID NO: 5960876 - DNA, 19 bp, Homo sapiens
ttctgaggagctgttactg

SEQ ID NO: 5960877 - DNA, 12 bp, Homo sapiens
ttctgaggagga

SEQ ID NO: 5960878 - DNA, 21 bp, Homo sapiens
ttctgaggcctgaatccaaaa

SEQ ID NO: 5960879 - DNA, 16 bp, Homo sapiens
ttctgaggctttatga

SEQ ID NO: 5960880 - DNA, 15 bp, Homo sapiens
ttctgaggtccttat

SEQ ID NO: 5960881 - DNA, 13 bp, Homo sapiens
ttctgagtaatta

SEQ ID NO: 5960882 - DNA, 15 bp, Homo sapiens
ttctgagtgaatgtt

SEQ ID NO: 5960883 - DNA, 14 bp, Homo sapiens
ttctgagtgttttt

SEQ ID NO: 5960884 - DNA, 12 bp, Homo sapiens
ttctgagttcct

SEQ ID NO: 5960885 - DNA, 15 bp, Homo sapiens
ttctgagttcctgca

SEQ ID NO: 5960886 - DNA, 21 bp, Homo sapiens
ttctgagtttatattctgaaa

SEQ ID NO: 5960887 - DNA, 15 bp, Homo sapiens
ttctgagttttacca

SEQ ID NO: 5960888 - DNA, 19 bp, Homo sapiens
ttctgagttttgtgtttgt

SEQ ID NO: 5960889 - DNA, 21 bp, Homo sapiens
ttctgagttttgtgtttgttg

SEQ ID NO: 5960890 - DNA, 18 bp, Homo sapiens
ttctgataaaagatggcc

SEQ ID NO: 5960891 - DNA, 19 bp, Homo sapiens
ttctgataaaagatggcca

SEQ ID NO: 5960892 - DNA, 19 bp, Homo sapiens
ttctgataaagttccttaa

SEQ ID NO: 5960893 - DNA, 23 bp, Homo sapiens
ttctgataagactggaaaatagt

SEQ ID NO: 5960894 - DNA, 23 bp, Homo sapiens
ttctgataatttattgtctttat

SEQ ID NO: 5960895 - DNA, 17 bp, Homo sapiens
ttctgataggagggggc

SEQ ID NO: 5960896 - DNA, 13 bp, Homo sapiens
ttctgatattaat

SEQ ID NO: 5960897 - DNA, 14 bp, Homo sapiens
ttctgatcagaggt

SEQ ID NO: 5960898 - DNA, 14 bp, Homo sapiens
ttctgatcatgaat

SEQ ID NO: 5960899 - DNA, 14 bp, Homo sapiens
ttctgatcctcagc

SEQ ID NO: 5960900 - DNA, 15 bp, Homo sapiens
ttctgatctgatttt

SEQ ID NO: 5960901 - DNA, 14 bp, Homo sapiens
ttctgatctgtact

SEQ ID NO: 5960902 - DNA, 9 bp, Homo sapiens
ttctgatga

SEQ ID NO: 5960903 - DNA, 18 bp, Homo sapiens
ttctgatgaaatgttaac

SEQ ID NO: 5960904 - DNA, 18 bp, Homo sapiens
ttctgatgaatctcaaag

SEQ ID NO: 5960905 - DNA, 13 bp, Homo sapiens
ttctgatgagcaa

SEQ ID NO: 5960906 - DNA, 14 bp, Homo sapiens
ttctgatggccaaa

SEQ ID NO: 5960907 - DNA, 16 bp, Homo sapiens
ttctgatgtactctaa

SEQ ID NO: 5960908 - DNA, 18 bp, Homo sapiens
ttctgatgtattacatga

SEQ ID NO: 5960909 - DNA, 23 bp, Homo sapiens
ttctgatgtctccagattggcac

SEQ ID NO: 5960910 - DNA, 20 bp, Homo sapiens
ttctgattaatatatttaat

SEQ ID NO: 5960911 - DNA, 17 bp, Homo sapiens
ttctgattacacaaaac

SEQ ID NO: 5960912 - DNA, 17 bp, Homo sapiens
ttctgattagaaatgac

SEQ ID NO: 5960913 - DNA, 18 bp, Homo sapiens
ttctgattagctttgtgt

SEQ ID NO: 5960914 - DNA, 17 bp, Homo sapiens
ttctgattcatttgaat

SEQ ID NO: 5960915 - DNA, 21 bp, Homo sapiens
ttctgattcgaatgacactgt

SEQ ID NO: 5960916 - DNA, 19 bp, Homo sapiens
ttctgattctgattgctat

SEQ ID NO: 5960917 - DNA, 18 bp, Homo sapiens
ttctgattcttttttcag

SEQ ID NO: 5960918 - DNA, 20 bp, Homo sapiens
ttctgattggacctggccca

SEQ ID NO: 5960919 - DNA, 22 bp, Homo sapiens
ttctgattggacctggcccagt

SEQ ID NO: 5960920 - DNA, 11 bp, Homo sapiens
ttctgattgta

SEQ ID NO: 5960921 - DNA, 23 bp, Homo sapiens
ttctgattgtaacgttgctgtgg

SEQ ID NO: 5960922 - DNA, 13 bp, Homo sapiens
ttctgatttctga

SEQ ID NO: 5960923 - DNA, 15 bp, Homo sapiens
ttctgatttctgaag

SEQ ID NO: 5960924 - DNA, 16 bp, Homo sapiens
ttctgattttaagttt

SEQ ID NO: 5960925 - DNA, 17 bp, Homo sapiens
ttctgattttaggagct

SEQ ID NO: 5960926 - DNA, 23 bp, Homo sapiens
ttctgattttaggagctaaggct

SEQ ID NO: 5960927 - DNA, 23 bp, Homo sapiens
ttctgattttatgtaaaattttg

SEQ ID NO: 5960928 - DNA, 14 bp, Homo sapiens
ttctgcaaacaaac

SEQ ID NO: 5960929 - DNA, 17 bp, Homo sapiens
ttctgcaaatagaaaac

SEQ ID NO: 5960930 - DNA, 15 bp, Homo sapiens
ttctgcaacagcctg

SEQ ID NO: 5960931 - DNA, 19 bp, Homo sapiens
ttctgcaactagccaaggc

SEQ ID NO: 5960932 - DNA, 17 bp, Homo sapiens
ttctgcaactcatgaac

SEQ ID NO: 5960933 - DNA, 20 bp, Homo sapiens
ttctgcaagaattaaaactg

SEQ ID NO: 5960934 - DNA, 22 bp, Homo sapiens
ttctgcaagaattaaaactgag

SEQ ID NO: 5960935 - DNA, 15 bp, Homo sapiens
ttctgcaataacagt

SEQ ID NO: 5960936 - DNA, 19 bp, Homo sapiens
ttctgcaataacagtttta

SEQ ID NO: 5960937 - DNA, 15 bp, Homo sapiens
ttctgcacaggtctc

SEQ ID NO: 5960938 - DNA, 17 bp, Homo sapiens
ttctgcacatacagatg

SEQ ID NO: 5960939 - DNA, 13 bp, Homo sapiens
ttctgcaccctcc

SEQ ID NO: 5960940 - DNA, 17 bp, Homo sapiens
ttctgcaccctccaccc

SEQ ID NO: 5960941 - DNA, 23 bp, Homo sapiens
ttctgcaccctccaccctgtccc

SEQ ID NO: 5960942 - DNA, 18 bp, Homo sapiens
ttctgcaccttgccaggg

SEQ ID NO: 5960943 - DNA, 15 bp, Homo sapiens
ttctgcactcttgta

SEQ ID NO: 5960944 - DNA, 15 bp, Homo sapiens
ttctgcactgagcag

SEQ ID NO: 5960945 - DNA, 20 bp, Homo sapiens
ttctgcactgagcagagtct

SEQ ID NO: 5960946 - DNA, 22 bp, Homo sapiens
ttctgcacttgcggttccggca

SEQ ID NO: 5960947 - DNA, 13 bp, Homo sapiens
ttctgcagaaaat

SEQ ID NO: 5960948 - DNA, 20 bp, Homo sapiens
ttctgcagaactcctccaaa

SEQ ID NO: 5960949 - DNA, 15 bp, Homo sapiens
ttctgcagaggcagc

SEQ ID NO: 5960950 - DNA, 20 bp, Homo sapiens
ttctgcagatcttccgtggt

SEQ ID NO: 5960951 - DNA, 14 bp, Homo sapiens
ttctgcagcaactc

SEQ ID NO: 5960952 - DNA, 18 bp, Homo sapiens
ttctgcagcaactcccac

SEQ ID NO: 5960953 - DNA, 13 bp, Homo sapiens
ttctgcagctgct

SEQ ID NO: 5960954 - DNA, 13 bp, Homo sapiens
ttctgcagctgtt

SEQ ID NO: 5960955 - DNA, 23 bp, Homo sapiens
ttctgcaggttgaagccatgtct

SEQ ID NO: 5960956 - DNA, 19 bp, Homo sapiens
ttctgcagtagtctctgtg

SEQ ID NO: 5960957 - DNA, 21 bp, Homo sapiens
ttctgcagtagtctctgtgct

SEQ ID NO: 5960958 - DNA, 17 bp, Homo sapiens
ttctgcagtattctgta

SEQ ID NO: 5960959 - DNA, 16 bp, Homo sapiens
ttctgcagtcagactg

SEQ ID NO: 5960960 - DNA, 19 bp, Homo sapiens
ttctgcagtcatctcccct

SEQ ID NO: 5960961 - DNA, 11 bp, Homo sapiens
ttctgtataga

SEQ ID NO: 5960962 - DNA, 19 bp, Homo sapiens
ttctgtatataaatgggaa

SEQ ID NO: 5960963 - DNA, 21 bp, Homo sapiens
ttctgtatataaatgggaaca

SEQ ID NO: 5960964 - DNA, 18 bp, Homo sapiens
ttctgtatatagatgtct

SEQ ID NO: 5960965 - DNA, 22 bp, Homo sapiens
ttctgtatatgattctctgtgg

SEQ ID NO: 5960966 - DNA, 18 bp, Homo sapiens
ttctgtatcaagcccctg

SEQ ID NO: 5960967 - DNA, 14 bp, Homo sapiens
ttctgtatccgtga

SEQ ID NO: 5960968 - DNA, 15 bp, Homo sapiens
ttctgtatgtgacaa

SEQ ID NO: 5960969 - DNA, 15 bp, Homo sapiens
ttctgtattaaatat

SEQ ID NO: 5960970 - DNA, 18 bp, Homo sapiens
ttctgtatttcactcttt

SEQ ID NO: 5960971 - DNA, 14 bp, Homo sapiens
ttctgtatttcctt

SEQ ID NO: 5960972 - DNA, 14 bp, Homo sapiens
ttctgtatttctag

SEQ ID NO: 5960973 - DNA, 15 bp, Homo sapiens
ttctgtatttctagg

SEQ ID NO: 5960974 - DNA, 11 bp, Homo sapiens
ttctgtatttt

SEQ ID NO: 5960975 - DNA, 20 bp, Homo sapiens
ttctgtattttcaaagactg

SEQ ID NO: 5960976 - DNA, 23 bp, Homo sapiens
ttctgtcaaagtcagaacaaatt

SEQ ID NO: 5960977 - DNA, 17 bp, Homo sapiens
ttctgtcacgtgaaata

SEQ ID NO: 5960978 - DNA, 13 bp, Homo sapiens
ttctgtcactcag

SEQ ID NO: 5960979 - DNA, 22 bp, Homo sapiens
ttctgtcagatgagaacaaagc

SEQ ID NO: 5960980 - DNA, 22 bp, Homo sapiens
ttctgtcattggttacaaattt

SEQ ID NO: 5960981 - DNA, 17 bp, Homo sapiens
ttctgtcatttacacac

SEQ ID NO: 5960982 - DNA, 14 bp, Homo sapiens
ttctgtccaaggca

SEQ ID NO: 5960983 - DNA, 22 bp, Homo sapiens
ttctgtcccaagtctccagaga

SEQ ID NO: 5960984 - DNA, 11 bp, Homo sapiens
ttctgtcccag

SEQ ID NO: 5960985 - DNA, 21 bp, Homo sapiens
ttctgtccctaggtgttttgt

SEQ ID NO: 5960986 - DNA, 11 bp, Homo sapiens
ttctgtccctg

SEQ ID NO: 5960987 - DNA, 14 bp, Homo sapiens
ttctgtccctgtcc

SEQ ID NO: 5960988 - DNA, 13 bp, Homo sapiens
ttctgtcccttcc

SEQ ID NO: 5960989 - DNA, 14 bp, Homo sapiens
ttctgtcccttctg

SEQ ID NO: 5960990 - DNA, 17 bp, Homo sapiens
ttctgtcccttggagct

SEQ ID NO: 5960991 - DNA, 17 bp, Homo sapiens
ttctgtcctactctgtg

SEQ ID NO: 5960992 - DNA, 13 bp, Homo sapiens
ttctgtcctgggc

SEQ ID NO: 5960993 - DNA, 17 bp, Homo sapiens
ttctgtcgtccccagac

SEQ ID NO: 5960994 - DNA, 20 bp, Homo sapiens
ttctgtcgtccccagaccag

SEQ ID NO: 5960995 - DNA, 19 bp, Homo sapiens
ttctgtctagactggccta

SEQ ID NO: 5960996 - DNA, 20 bp, Homo sapiens
ttctgtctaggttaaagcta

SEQ ID NO: 5960997 - DNA, 11 bp, Homo sapiens
ttctgtctcca

SEQ ID NO: 5960998 - DNA, 15 bp, Homo sapiens
ttctgtctcccttct

SEQ ID NO: 5960999 - DNA, 16 bp, Homo sapiens
ttctgtctcctgtctt

SEQ ID NO: 5961000 - DNA, 17 bp, Homo sapiens
ttctgtctcctgtcttc

SEQ ID NO: 5961001 - DNA, 14 bp, Homo sapiens
ttctgtctctgcct

SEQ ID NO: 5961002 - DNA, 13 bp, Homo sapiens
ttctgtctctgct

SEQ ID NO: 5961003 - DNA, 18 bp, Homo sapiens
ttctgtctcttttctctt

SEQ ID NO: 5961004 - DNA, 17 bp, Homo sapiens
ttctgtcttcacaacag

SEQ ID NO: 5961005 - DNA, 21 bp, Homo sapiens
ttctgtcttcatcccctcaga

SEQ ID NO: 5961006 - DNA, 13 bp, Homo sapiens
ttctgtcttccca

SEQ ID NO: 5961007 - DNA, 21 bp, Homo sapiens
ttctgtcttgttcattttgag

SEQ ID NO: 5961008 - DNA, 22 bp, Homo sapiens
ttctgtcttgttcattttgagt

SEQ ID NO: 5961009 - DNA, 14 bp, Homo sapiens
ttctgtctttagat

SEQ ID NO: 5961010 - DNA, 17 bp, Homo sapiens
ttctgtgaaaaacctga

SEQ ID NO: 5961011 - DNA, 15 bp, Homo sapiens
ttctgtgaaactatc

SEQ ID NO: 5961012 - DNA, 11 bp, Homo sapiens
ttctgtgaaag

SEQ ID NO: 5961013 - DNA, 14 bp, Homo sapiens
ttctgtgaaagcct

SEQ ID NO: 5961014 - DNA, 14 bp, Homo sapiens
ttctgtgaaattct

SEQ ID NO: 5961015 - DNA, 19 bp, Homo sapiens
ttctgtgaagaagccctgt

SEQ ID NO: 5961016 - DNA, 22 bp, Homo sapiens
ttctgtgaagaagccctgttct

SEQ ID NO: 5961017 - DNA, 12 bp, Homo sapiens
ttctgtgaatag

SEQ ID NO: 5961018 - DNA, 16 bp, Homo sapiens
ttctgtgaatagcagt

SEQ ID NO: 5961019 - DNA, 13 bp, Homo sapiens
ttctgtgacattt

SEQ ID NO: 5961020 - DNA, 14 bp, Homo sapiens
ttctgtgacattta

SEQ ID NO: 5961021 - DNA, 16 bp, Homo sapiens
ttctgtgacatttatg

SEQ ID NO: 5961022 - DNA, 23 bp, Homo sapiens
ttctgtgactgaagaagatgagc

SEQ ID NO: 5961023 - DNA, 19 bp, Homo sapiens
ttctgtgagacccccacac

SEQ ID NO: 5961024 - DNA, 14 bp, Homo sapiens
ttctgtgcacctgg

SEQ ID NO: 5961025 - DNA, 13 bp, Homo sapiens
ttctgtgcagcca

SEQ ID NO: 5961026 - DNA, 14 bp, Homo sapiens
ttctgtgcatctgg

SEQ ID NO: 5961027 - DNA, 21 bp, Homo sapiens
ttctgtgcatttgtgtctgcc

SEQ ID NO: 5961028 - DNA, 21 bp, Homo sapiens
ttctgtgccaaagcagctaca

SEQ ID NO: 5961029 - DNA, 15 bp, Homo sapiens
ttctgtgcctccagg

SEQ ID NO: 5961030 - DNA, 23 bp, Homo sapiens
ttctgtgctgttacagttttctt

SEQ ID NO: 5961031 - DNA, 16 bp, Homo sapiens
ttctgtgcttggattt

SEQ ID NO: 5961032 - DNA, 13 bp, Homo sapiens
ttctgtggaaaaa

SEQ ID NO: 5961033 - DNA, 15 bp, Homo sapiens
ttctgtggaaaacaa

SEQ ID NO: 5961034 - DNA, 13 bp, Homo sapiens
ttctgtggaaagt

SEQ ID NO: 5961035 - DNA, 15 bp, Homo sapiens
ttctgtggaaagtgt

SEQ ID NO: 5961036 - DNA, 17 bp, Homo sapiens
ttctgtggaaagtgtaa

SEQ ID NO: 5961037 - DNA, 22 bp, Homo sapiens
ttctgtggaaagtgtaaagcat

SEQ ID NO: 5961038 - DNA, 23 bp, Homo sapiens
ttctgtggaaagtgtaaagcatt

SEQ ID NO: 5961039 - DNA, 17 bp, Homo sapiens
ttctgtggaggacagac

SEQ ID NO: 5961040 - DNA, 21 bp, Homo sapiens
ttctgtggagggttgccatgg

SEQ ID NO: 5961041 - DNA, 20 bp, Homo sapiens
ttctgtggatacagtgccca

SEQ ID NO: 5961042 - DNA, 16 bp, Homo sapiens
ttctgtggattctata

SEQ ID NO: 5961043 - DNA, 19 bp, Homo sapiens
ttctgtggattctatattt

SEQ ID NO: 5961044 - DNA, 18 bp, Homo sapiens
ttctgtggctgatttact

SEQ ID NO: 5961045 - DNA, 23 bp, Homo sapiens
ttctgtggctgatttactaacag

SEQ ID NO: 5961046 - DNA, 14 bp, Homo sapiens
ttctgtggctggct

SEQ ID NO: 5961047 - DNA, 18 bp, Homo sapiens
ttctgtggggactccggc

SEQ ID NO: 5961048 - DNA, 22 bp, Homo sapiens
ttctgtggggcccctcacctac

SEQ ID NO: 5961049 - DNA, 21 bp, Homo sapiens
ttctgtggttcctctgctcac

SEQ ID NO: 5961050 - DNA, 20 bp, Homo sapiens
ttctgtggttggctgggaaa

SEQ ID NO: 5961051 - DNA, 15 bp, Homo sapiens
ttctgtgtaaaatga

SEQ ID NO: 5961052 - DNA, 13 bp, Homo sapiens
ttctgtgtacaca

SEQ ID NO: 5961053 - DNA, 20 bp, Homo sapiens
ttctgtgtagtatttatatt

SEQ ID NO: 5961054 - DNA, 23 bp, Homo sapiens
ttctgtgtatttaattgtaaact

SEQ ID NO: 5961055 - DNA, 14 bp, Homo sapiens
ttctgtgtcacgtg

SEQ ID NO: 5961056 - DNA, 19 bp, Homo sapiens
ttctgtgtcacgtgaccct

SEQ ID NO: 5961057 - DNA, 20 bp, Homo sapiens
ttctgtgtcacgtgaccctg

SEQ ID NO: 5961058 - DNA, 23 bp, Homo sapiens
ttctgtgtcacgtgaccctgtgc

SEQ ID NO: 5961059 - DNA, 23 bp, Homo sapiens
ttctgtgtcagagcccagcccag

SEQ ID NO: 5961060 - DNA, 14 bp, Homo sapiens
ttctgtgtctgctg

SEQ ID NO: 5961061 - DNA, 15 bp, Homo sapiens
ttctgtgtctgtcac

SEQ ID NO: 5961062 - DNA, 13 bp, Homo sapiens
ttctgtgtgaaga

SEQ ID NO: 5961063 - DNA, 18 bp, Homo sapiens
ttctgtgtgccctgaaaa

SEQ ID NO: 5961064 - DNA, 21 bp, Homo sapiens
ttctgtgtggtctccagctcc

SEQ ID NO: 5961065 - DNA, 22 bp, Homo sapiens
ttctgtgtggtgcattcctgaa

SEQ ID NO: 5961066 - DNA, 13 bp, Homo sapiens
ttctgtgtgtgag

SEQ ID NO: 5961067 - DNA, 13 bp, Homo sapiens
ttctgtgttcatt

SEQ ID NO: 5961068 - DNA, 16 bp, Homo sapiens
ttctgtgttcattttt

SEQ ID NO: 5961069 - DNA, 16 bp, Homo sapiens
ttctgtgttgaacaca

SEQ ID NO: 5961070 - DNA, 20 bp, Homo sapiens
ttctgtgtttaatttcttca

SEQ ID NO: 5961071 - DNA, 17 bp, Homo sapiens
ttctgtgtttacagaga

SEQ ID NO: 5961072 - DNA, 13 bp, Homo sapiens
ttctgtgtttagc

SEQ ID NO: 5961073 - DNA, 12 bp, Homo sapiens
ttctgtgtttat

SEQ ID NO: 5961074 - DNA, 15 bp, Homo sapiens
ttctgtgtttctgga

SEQ ID NO: 5961075 - DNA, 15 bp, Homo sapiens
ttctgtgttttcaga

SEQ ID NO: 5961076 - DNA, 17 bp, Homo sapiens
ttctgtgttttcagact

SEQ ID NO: 5961077 - DNA, 23 bp, Homo sapiens
ttctgtgttttcagactgcctgt

SEQ ID NO: 5961078 - DNA, 13 bp, Homo sapiens
ttctgttaaaatc

SEQ ID NO: 5961079 - DNA, 15 bp, Homo sapiens
ttctgttaaaatcag

SEQ ID NO: 5961080 - DNA, 17 bp, Homo sapiens
ttctgttaaaatcagga

SEQ ID NO: 5961081 - DNA, 14 bp, Homo sapiens
ttctgttaaaatct

SEQ ID NO: 5961082 - DNA, 17 bp, Homo sapiens
ttctgttaaaatctatt

SEQ ID NO: 5961083 - DNA, 16 bp, Homo sapiens
ttctgttaaaatgcat

SEQ ID NO: 5961084 - DNA, 22 bp, Homo sapiens
ttctgttaaaatgcatgattgc

SEQ ID NO: 5961085 - DNA, 14 bp, Homo sapiens
ttctgttaaatatt

SEQ ID NO: 5961086 - DNA, 23 bp, Homo sapiens
ttctgttaactgaagatattcca

SEQ ID NO: 5961087 - DNA, 16 bp, Homo sapiens
ttctgttaactgaata

SEQ ID NO: 5961088 - DNA, 14 bp, Homo sapiens
ttctgttaagaaag

SEQ ID NO: 5961089 - DNA, 19 bp, Homo sapiens
ttctgttaatagtcccggc

SEQ ID NO: 5961090 - DNA, 14 bp, Homo sapiens
ttctgttacaaaat

SEQ ID NO: 5961091 - DNA, 23 bp, Homo sapiens
ttctgttacccagggctctgcag

SEQ ID NO: 5961092 - DNA, 23 bp, Homo sapiens
ttctgttactaaatccttttgtt

SEQ ID NO: 5961093 - DNA, 16 bp, Homo sapiens
ttctgttagctgctca

SEQ ID NO: 5961094 - DNA, 21 bp, Homo sapiens
ttctgttatttttaagctttt

SEQ ID NO: 5961095 - DNA, 11 bp, Homo sapiens
ttctgttcagc

SEQ ID NO: 5961096 - DNA, 14 bp, Homo sapiens
ttctgttcatctct

SEQ ID NO: 5961097 - DNA, 18 bp, Homo sapiens
ttctgttcatctctttgt

SEQ ID NO: 5961098 - DNA, 21 bp, Homo sapiens
ttctgttcatctctttgtcct

SEQ ID NO: 5961099 - DNA, 16 bp, Homo sapiens
ttctgttcatttccta

SEQ ID NO: 5961100 - DNA, 16 bp, Homo sapiens
ttctgttcatttgtta

SEQ ID NO: 5961101 - DNA, 17 bp, Homo sapiens
ttctgttcatttgttat

SEQ ID NO: 5961102 - DNA, 13 bp, Homo sapiens
ttctgttccaaat

SEQ ID NO: 5961103 - DNA, 14 bp, Homo sapiens
ttctgttccctgct

SEQ ID NO: 5961104 - DNA, 23 bp, Homo sapiens
ttctgttcctctcttttcctgtt

SEQ ID NO: 5961105 - DNA, 16 bp, Homo sapiens
ttctgttcgaagttca

SEQ ID NO: 5961106 - DNA, 19 bp, Homo sapiens
ttctgttcgaagttcattt

SEQ ID NO: 5961107 - DNA, 11 bp, Homo sapiens
ttctgttctaa

SEQ ID NO: 5961108 - DNA, 21 bp, Homo sapiens
ttctgttctagttttttactt

SEQ ID NO: 5961109 - DNA, 13 bp, Homo sapiens
ttctgttctctgc

SEQ ID NO: 5961110 - DNA, 17 bp, Homo sapiens
ttctgttcttacaaatg

SEQ ID NO: 5961111 - DNA, 22 bp, Homo sapiens
ttctgttcttacaaatgtgaaa

SEQ ID NO: 5961112 - DNA, 13 bp, Homo sapiens
ttctgttgcccag

SEQ ID NO: 5961113 - DNA, 15 bp, Homo sapiens
ttctgttgcccaggc

SEQ ID NO: 5961114 - DNA, 17 bp, Homo sapiens
ttctgttgcccaggctg

SEQ ID NO: 5961115 - DNA, 23 bp, Homo sapiens
ttctgttgcccaggctggcctga

SEQ ID NO: 5961116 - DNA, 16 bp, Homo sapiens
ttctgttgctgcctca

SEQ ID NO: 5961117 - DNA, 14 bp, Homo sapiens
ttctgttgctggag

SEQ ID NO: 5961118 - DNA, 21 bp, Homo sapiens
ttctgttggcctaagtgcctc

SEQ ID NO: 5961119 - DNA, 23 bp, Homo sapiens
ttctgttggtcttaactaatgta

SEQ ID NO: 5961120 - DNA, 12 bp, Homo sapiens
ttctgttgtaac

SEQ ID NO: 5961121 - DNA, 22 bp, Homo sapiens
ttctgttgtaacttatgtagat

SEQ ID NO: 5961122 - DNA, 23 bp, Homo sapiens
ttctgttgtagaataataataaa

SEQ ID NO: 5961123 - DNA, 14 bp, Homo sapiens
ttctgttgtctgcg

SEQ ID NO: 5961124 - DNA, 15 bp, Homo sapiens
ttctgttgttccatt

SEQ ID NO: 5961125 - DNA, 14 bp, Homo sapiens
ttctgtttaatttt

SEQ ID NO: 5961126 - DNA, 19 bp, Homo sapiens
ttctgtttaattttcactt

SEQ ID NO: 5961127 - DNA, 19 bp, Homo sapiens
ttctgtttagttttacact

SEQ ID NO: 5961128 - DNA, 12 bp, Homo sapiens
ttctgtttcaag

SEQ ID NO: 5961129 - DNA, 23 bp, Homo sapiens
ttctgtttcaaggcactctagat

SEQ ID NO: 5961130 - DNA, 20 bp, Homo sapiens
ttctgtttccataggaatca

SEQ ID NO: 5961131 - DNA, 18 bp, Homo sapiens
ttctgtttcctatttaat

SEQ ID NO: 5961132 - DNA, 23 bp, Homo sapiens
ttctgtttcctatttaatacagc

SEQ ID NO: 5961133 - DNA, 19 bp, Homo sapiens
ttctgtttcctggcctcag

SEQ ID NO: 5961134 - DNA, 22 bp, Homo sapiens
ttctgtttcctggcctcagagc

SEQ ID NO: 5961135 - DNA, 18 bp, Homo sapiens
ttctgtttcctgtaccag

SEQ ID NO: 5961136 - DNA, 14 bp, Homo sapiens
ttctgtttcctgtg

SEQ ID NO: 5961137 - DNA, 21 bp, Homo sapiens
ttctgtttctcttttggtttc

SEQ ID NO: 5961138 - DNA, 23 bp, Homo sapiens
ttctgtttctcttttggtttctg

SEQ ID NO: 5961139 - DNA, 15 bp, Homo sapiens
ttctgtttctttttc

SEQ ID NO: 5961140 - DNA, 16 bp, Homo sapiens
ttctttttaaatgtgc

SEQ ID NO: 5961141 - DNA, 13 bp, Homo sapiens
ttctttttaaatt

SEQ ID NO: 5961142 - DNA, 16 bp, Homo sapiens
ttctttttaaattttt

SEQ ID NO: 5961143 - DNA, 23 bp, Homo sapiens
ttctttttacataactgccttga

SEQ ID NO: 5961144 - DNA, 14 bp, Homo sapiens
ttctttttactgtt

SEQ ID NO: 5961145 - DNA, 16 bp, Homo sapiens
ttctttttattttctt

SEQ ID NO: 5961146 - DNA, 12 bp, Homo sapiens
ttctttttcatc

SEQ ID NO: 5961147 - DNA, 13 bp, Homo sapiens
ttctttttccagt

SEQ ID NO: 5961148 - DNA, 23 bp, Homo sapiens
ttctttttccttcataattttca

SEQ ID NO: 5961149 - DNA, 13 bp, Homo sapiens
ttctttttctaca

SEQ ID NO: 5961150 - DNA, 13 bp, Homo sapiens
ttctttttctgag

SEQ ID NO: 5961151 - DNA, 14 bp, Homo sapiens
ttctttttctggaa

SEQ ID NO: 5961152 - DNA, 17 bp, Homo sapiens
ttctttttctgtctctc

SEQ ID NO: 5961153 - DNA, 17 bp, Homo sapiens
ttctttttcttgtcatt

SEQ ID NO: 5961154 - DNA, 15 bp, Homo sapiens
ttctttttgaagtat

SEQ ID NO: 5961155 - DNA, 18 bp, Homo sapiens
ttctttttgaatctttaa

SEQ ID NO: 5961156 - DNA, 12 bp, Homo sapiens
ttctttttgctc

SEQ ID NO: 5961157 - DNA, 21 bp, Homo sapiens
ttctttttgctctaaaatatt

SEQ ID NO: 5961158 - DNA, 19 bp, Homo sapiens
ttctttttgggagagactt

SEQ ID NO: 5961159 - DNA, 12 bp, Homo sapiens
ttctttttgggg

SEQ ID NO: 5961160 - DNA, 23 bp, Homo sapiens
ttctttttgtagctggggctttg

SEQ ID NO: 5961161 - DNA, 19 bp, Homo sapiens
ttcttttttaaagtaaact

SEQ ID NO: 5961162 - DNA, 19 bp, Homo sapiens
ttcttttttaaatgtttct

SEQ ID NO: 5961163 - DNA, 17 bp, Homo sapiens
ttcttttttaaattaat

SEQ ID NO: 5961164 - DNA, 23 bp, Homo sapiens
ttcttttttaaattttcttcagt

SEQ ID NO: 5961165 - DNA, 17 bp, Homo sapiens
ttcttttttaattgaaa

SEQ ID NO: 5961166 - DNA, 21 bp, Homo sapiens
ttcttttttattaatcactgt

SEQ ID NO: 5961167 - DNA, 22 bp, Homo sapiens
ttcttttttattaatcactgtg

SEQ ID NO: 5961168 - DNA, 18 bp, Homo sapiens
ttcttttttgtaaaaact

SEQ ID NO: 5961169 - DNA, 18 bp, Homo sapiens
ttcttttttgtacagtat

SEQ ID NO: 5961170 - DNA, 17 bp, Homo sapiens
ttcttttttgtctcaag

SEQ ID NO: 5961171 - DNA, 18 bp, Homo sapiens
ttctttttttattaaaca

SEQ ID NO: 5961172 - DNA, 22 bp, Homo sapiens
ttctttttttattattatttat

SEQ ID NO: 5961173 - DNA, 13 bp, Homo sapiens
ttctttttttcct

SEQ ID NO: 5961174 - DNA, 19 bp, Homo sapiens
ttctttttttcctttttaa

SEQ ID NO: 5961175 - DNA, 17 bp, Homo sapiens
ttctttttttctgtcag

SEQ ID NO: 5961176 - DNA, 14 bp, Homo sapiens
ttctttttttgcat

SEQ ID NO: 5961177 - DNA, 17 bp, Homo sapiens
ttctttttttttaagtt

SEQ ID NO: 5961178 - DNA, 21 bp, Homo sapiens
ttctttttttttaagttctta

SEQ ID NO: 5961179 - DNA, 20 bp, Homo sapiens
ttcttttttttttctgttga

SEQ ID NO: 5961180 - DNA, 21 bp, Homo sapiens
ttgaaaaaaaaaaacacaaaa

SEQ ID NO: 5961181 - DNA, 19 bp, Homo sapiens
ttgaaaaaaaatagatgtt

SEQ ID NO: 5961182 - DNA, 19 bp, Homo sapiens
ttgaaaaaaagtttctatt

SEQ ID NO: 5961183 - DNA, 23 bp, Homo sapiens
ttgaaaaaaagtttctatttagt

SEQ ID NO: 5961184 - DNA, 20 bp, Homo sapiens
ttgaaaaaaattgaaataaa

SEQ ID NO: 5961185 - DNA, 14 bp, Homo sapiens
ttgaaaaaaattgg

SEQ ID NO: 5961186 - DNA, 13 bp, Homo sapiens
ttgaaaaaacttt

SEQ ID NO: 5961187 - DNA, 21 bp, Homo sapiens
ttgaaaaaactttctctttgc

SEQ ID NO: 5961188 - DNA, 13 bp, Homo sapiens
ttgaaaaaagaag

SEQ ID NO: 5961189 - DNA, 15 bp, Homo sapiens
ttgaaaaaagctcat

SEQ ID NO: 5961190 - DNA, 18 bp, Homo sapiens
ttgaaaaaagctcatttc

SEQ ID NO: 5961191 - DNA, 20 bp, Homo sapiens
ttgaaaaaatagagcctgag

SEQ ID NO: 5961192 - DNA, 16 bp, Homo sapiens
ttgaaaaaatgttcta

SEQ ID NO: 5961193 - DNA, 19 bp, Homo sapiens
ttgaaaaaattaaaatctt

SEQ ID NO: 5961194 - DNA, 21 bp, Homo sapiens
ttgaaaaaatttaaaagtaaa

SEQ ID NO: 5961195 - DNA, 13 bp, Homo sapiens
ttgaaaaactttt

SEQ ID NO: 5961196 - DNA, 12 bp, Homo sapiens
ttgaaaaagcag

SEQ ID NO: 5961197 - DNA, 20 bp, Homo sapiens
ttgaaaaaggaaaaatgtag

SEQ ID NO: 5961198 - DNA, 18 bp, Homo sapiens
ttgaaaaagtaggctgcc

SEQ ID NO: 5961199 - DNA, 12 bp, Homo sapiens
ttgaaaaagtgt

SEQ ID NO: 5961200 - DNA, 20 bp, Homo sapiens
ttgaaaaagttccatagaaa

SEQ ID NO: 5961201 - DNA, 16 bp, Homo sapiens
ttgaaaaataaaaacc

SEQ ID NO: 5961202 - DNA, 18 bp, Homo sapiens
ttgaaaaataaaaaccat

SEQ ID NO: 5961203 - DNA, 19 bp, Homo sapiens
ttgaaaaatataaaattat

SEQ ID NO: 5961204 - DNA, 14 bp, Homo sapiens
ttgaaaaatcactt

SEQ ID NO: 5961205 - DNA, 15 bp, Homo sapiens
ttgaaaaatgcatgt

SEQ ID NO: 5961206 - DNA, 13 bp, Homo sapiens
ttgaaaaattcct

SEQ ID NO: 5961207 - DNA, 15 bp, Homo sapiens
ttgaaaaattcctat

SEQ ID NO: 5961208 - DNA, 14 bp, Homo sapiens
ttgaaaacaattca

SEQ ID NO: 5961209 - DNA, 18 bp, Homo sapiens
ttgaaaacaattcagtgg

SEQ ID NO: 5961210 - DNA, 10 bp, Homo sapiens
ttgaaaacac

SEQ ID NO: 5961211 - DNA, 21 bp, Homo sapiens
ttgaaaacaccagctgtatat

SEQ ID NO: 5961212 - DNA, 19 bp, Homo sapiens
ttgaaaacactgttctctg

SEQ ID NO: 5961213 - DNA, 23 bp, Homo sapiens
ttgaaaacactgttctctgccct

SEQ ID NO: 5961214 - DNA, 12 bp, Homo sapiens
ttgaaaacactt

SEQ ID NO: 5961215 - DNA, 13 bp, Homo sapiens
ttgaaaacagata

SEQ ID NO: 5961216 - DNA, 23 bp, Homo sapiens
ttgaaaacatgttagtcaaggac

SEQ ID NO: 5961217 - DNA, 16 bp, Homo sapiens
ttgaaaaccacagtca

SEQ ID NO: 5961218 - DNA, 15 bp, Homo sapiens
ttgaaaacccctggc

SEQ ID NO: 5961219 - DNA, 18 bp, Homo sapiens
ttgaaaacctaaaagaca

SEQ ID NO: 5961220 - DNA, 16 bp, Homo sapiens
ttgaaaacctgacaaa

SEQ ID NO: 5961221 - DNA, 16 bp, Homo sapiens
ttgaaaactacatttt

SEQ ID NO: 5961222 - DNA, 20 bp, Homo sapiens
ttgaaaactacattttaaca

SEQ ID NO: 5961223 - DNA, 22 bp, Homo sapiens
ttgaaaactacattttaacatg

SEQ ID NO: 5961224 - DNA, 17 bp, Homo sapiens
ttgaaaactctcagtca

SEQ ID NO: 5961225 - DNA, 22 bp, Homo sapiens
ttgaaaactctcagtcagtgtc

SEQ ID NO: 5961226 - DNA, 19 bp, Homo sapiens
ttgaaaactgtgcaacttt

SEQ ID NO: 5961227 - DNA, 13 bp, Homo sapiens
ttgaaaacttcaa

SEQ ID NO: 5961228 - DNA, 18 bp, Homo sapiens
ttgaaaacttcagaagca

SEQ ID NO: 5961229 - DNA, 21 bp, Homo sapiens
ttgaaaacttgctgaaaaaca

SEQ ID NO: 5961230 - DNA, 12 bp, Homo sapiens
ttgaaaagaaaa

SEQ ID NO: 5961231 - DNA, 17 bp, Homo sapiens
ttgaaaagaaagtgttt

SEQ ID NO: 5961232 - DNA, 17 bp, Homo sapiens
ttgaaaagaacagaagg

SEQ ID NO: 5961233 - DNA, 13 bp, Homo sapiens
ttgaaaagaagaa

SEQ ID NO: 5961234 - DNA, 19 bp, Homo sapiens
ttgaaaagaagaaagtcta

SEQ ID NO: 5961235 - DNA, 22 bp, Homo sapiens
ttgaaaagaagaaagtctatgc

SEQ ID NO: 5961236 - DNA, 18 bp, Homo sapiens
ttgaaaagacaatagccc

SEQ ID NO: 5961237 - DNA, 13 bp, Homo sapiens
ttgaaaagacatc

SEQ ID NO: 5961238 - DNA, 14 bp, Homo sapiens
ttgaaaagattcca

SEQ ID NO: 5961239 - DNA, 15 bp, Homo sapiens
ttgaaaagattgcaa

SEQ ID NO: 5961240 - DNA, 18 bp, Homo sapiens
ttgaaaagattgcaaagg

SEQ ID NO: 5961241 - DNA, 13 bp, Homo sapiens
ttgaaaagccatg

SEQ ID NO: 5961242 - DNA, 23 bp, Homo sapiens
ttgaaaagccatgtttaagattt

SEQ ID NO: 5961243 - DNA, 16 bp, Homo sapiens
ttgaaaagctaatgaa

SEQ ID NO: 5961244 - DNA, 14 bp, Homo sapiens
ttgaaaagctgcta

SEQ ID NO: 5961245 - DNA, 19 bp, Homo sapiens
ttgaaaagcttcttaatta

SEQ ID NO: 5961246 - DNA, 23 bp, Homo sapiens
ttgaaaaggtgtccttttccttt

SEQ ID NO: 5961247 - DNA, 17 bp, Homo sapiens
ttgaaaagtaatattta

SEQ ID NO: 5961248 - DNA, 22 bp, Homo sapiens
ttgaaaagtaatatttattaaa

SEQ ID NO: 5961249 - DNA, 12 bp, Homo sapiens
ttgaaaagtatt

SEQ ID NO: 5961250 - DNA, 15 bp, Homo sapiens
ttgaaaataaaaaga

SEQ ID NO: 5961251 - DNA, 21 bp, Homo sapiens
ttgaaaataagaatagaaata

SEQ ID NO: 5961252 - DNA, 20 bp, Homo sapiens
ttgaaaataggatttgcact

SEQ ID NO: 5961253 - DNA, 14 bp, Homo sapiens
ttgaaaatagttta

SEQ ID NO: 5961254 - DNA, 23 bp, Homo sapiens
ttgaaaatatatattatatacat

SEQ ID NO: 5961255 - DNA, 15 bp, Homo sapiens
ttgaaaatatgtact

SEQ ID NO: 5961256 - DNA, 11 bp, Homo sapiens
ttgaaaatcaa

SEQ ID NO: 5961257 - DNA, 20 bp, Homo sapiens
ttgaaaatggtattaaagat

SEQ ID NO: 5961258 - DNA, 14 bp, Homo sapiens
ttgaaaatgtcact

SEQ ID NO: 5961259 - DNA, 16 bp, Homo sapiens
ttgaaaatgtcactgt

SEQ ID NO: 5961260 - DNA, 15 bp, Homo sapiens
ttgaaaatgtgtttg

SEQ ID NO: 5961261 - DNA, 18 bp, Homo sapiens
ttgaaaattaacatgaat

SEQ ID NO: 5961262 - DNA, 19 bp, Homo sapiens
ttgaaaattaaggaaatgt

SEQ ID NO: 5961263 - DNA, 17 bp, Homo sapiens
ttgaaaattacatgttt

SEQ ID NO: 5961264 - DNA, 16 bp, Homo sapiens
ttgaaaattaccttta

SEQ ID NO: 5961265 - DNA, 23 bp, Homo sapiens
ttgaaaattacctttaatgcaat

SEQ ID NO: 5961266 - DNA, 16 bp, Homo sapiens
ttgaaaattatgcaaa

SEQ ID NO: 5961267 - DNA, 22 bp, Homo sapiens
ttgaaaattattttaaacaaaa

SEQ ID NO: 5961268 - DNA, 18 bp, Homo sapiens
ttgaaaattgtatttttg

SEQ ID NO: 5961269 - DNA, 18 bp, Homo sapiens
ttgaaaattttacttcca

SEQ ID NO: 5961270 - DNA, 15 bp, Homo sapiens
ttgaaacaatactca

SEQ ID NO: 5961271 - DNA, 23 bp, Homo sapiens
ttgaaacaatactcataatgtga

SEQ ID NO: 5961272 - DNA, 20 bp, Homo sapiens
ttgaaacacacagtgaccaa

SEQ ID NO: 5961273 - DNA, 14 bp, Homo sapiens
ttgaaacagcctgg

SEQ ID NO: 5961274 - DNA, 14 bp, Homo sapiens
ttgaaacagttcca

SEQ ID NO: 5961275 - DNA, 15 bp, Homo sapiens
ttgaaacatgaaaca

SEQ ID NO: 5961276 - DNA, 12 bp, Homo sapiens
ttgaaacattgc

SEQ ID NO: 5961277 - DNA, 12 bp, Homo sapiens
ttgaaacattta

SEQ ID NO: 5961278 - DNA, 13 bp, Homo sapiens
ttgaaacatttat

SEQ ID NO: 5961279 - DNA, 16 bp, Homo sapiens
ttgaaaccagtattta

SEQ ID NO: 5961280 - DNA, 13 bp, Homo sapiens
ttgaaacccacag

SEQ ID NO: 5961281 - DNA, 15 bp, Homo sapiens
ttgaaacccacagtt

SEQ ID NO: 5961282 - DNA, 13 bp, Homo sapiens
ttgaaacctcagg

SEQ ID NO: 5961283 - DNA, 22 bp, Homo sapiens
ttgaaacggatgatttctatgc

SEQ ID NO: 5961284 - DNA, 20 bp, Homo sapiens
ttgaaactaaaataaattaa

SEQ ID NO: 5961285 - DNA, 14 bp, Homo sapiens
ttgaaactctctgt

SEQ ID NO: 5961286 - DNA, 22 bp, Homo sapiens
ttgaaactgagtataatcaata

SEQ ID NO: 5961287 - DNA, 17 bp, Homo sapiens
ttgaaactgcatttgtg

SEQ ID NO: 5961288 - DNA, 14 bp, Homo sapiens
ttgaaactgctata

SEQ ID NO: 5961289 - DNA, 21 bp, Homo sapiens
ttgaaactgtatttacttgtt

SEQ ID NO: 5961290 - DNA, 17 bp, Homo sapiens
ttgaaacttacactgtt

SEQ ID NO: 5961291 - DNA, 16 bp, Homo sapiens
ttgaaactttgagatc

SEQ ID NO: 5961292 - DNA, 18 bp, Homo sapiens
ttgaaagaaaaaaaaata

SEQ ID NO: 5961293 - DNA, 12 bp, Homo sapiens
ttgaaagaactt

SEQ ID NO: 5961294 - DNA, 13 bp, Homo sapiens
ttgaaagaagttt

SEQ ID NO: 5961295 - DNA, 17 bp, Homo sapiens
ttgaaagaatgtaaagc

SEQ ID NO: 5961296 - DNA, 17 bp, Homo sapiens
ttgaaagacatcaatga

SEQ ID NO: 5961297 - DNA, 17 bp, Homo sapiens
ttgaaagagaaccagtt

SEQ ID NO: 5961298 - DNA, 22 bp, Homo sapiens
ttgaaagatggtaatcttttct

SEQ ID NO: 5961299 - DNA, 20 bp, Homo sapiens
ttgaaagattttattgtata

SEQ ID NO: 5961300 - DNA, 13 bp, Homo sapiens
ttgaaagcaaaaa

SEQ ID NO: 5961301 - DNA, 17 bp, Homo sapiens
ttgaaagcaaaaatgct

SEQ ID NO: 5961302 - DNA, 19 bp, Homo sapiens
ttgaaagcaaaaatgctaa

SEQ ID NO: 5961303 - DNA, 16 bp, Homo sapiens
ttgaaagcatccatgt

SEQ ID NO: 5961304 - DNA, 12 bp, Homo sapiens
ttgaaaggaaaa

SEQ ID NO: 5961305 - DNA, 16 bp, Homo sapiens
ttgaaaggaaaaacag

SEQ ID NO: 5961306 - DNA, 21 bp, Homo sapiens
ttgaaaggacctcttctgaag

SEQ ID NO: 5961307 - DNA, 23 bp, Homo sapiens
ttgaaaggagaaaaaaaaagcca

SEQ ID NO: 5961308 - DNA, 17 bp, Homo sapiens
ttgaaagggatcatcat

SEQ ID NO: 5961309 - DNA, 23 bp, Homo sapiens
ttgaaaggggaaacgtctcccag

SEQ ID NO: 5961310 - DNA, 21 bp, Homo sapiens
ttgaaaggggacacctgtaca

SEQ ID NO: 5961311 - DNA, 19 bp, Homo sapiens
ttgaaaggtcagaattttg

SEQ ID NO: 5961312 - DNA, 12 bp, Homo sapiens
ttgaaagtaaaa

SEQ ID NO: 5961313 - DNA, 22 bp, Homo sapiens
ttgaaagtaaaaacctgcttgg

SEQ ID NO: 5961314 - DNA, 16 bp, Homo sapiens
ttgaaagtagagctag

SEQ ID NO: 5961315 - DNA, 23 bp, Homo sapiens
ttgaaagtgaaataatttgtgtc

SEQ ID NO: 5961316 - DNA, 21 bp, Homo sapiens
ttgaaagtgaataaacttcag

SEQ ID NO: 5961317 - DNA, 19 bp, Homo sapiens
ttgaaagtgggcaaaagct

SEQ ID NO: 5961318 - DNA, 17 bp, Homo sapiens
ttgaccaggcacctccc

SEQ ID NO: 5961319 - DNA, 19 bp, Homo sapiens
ttgaccagtataaaattac

SEQ ID NO: 5961320 - DNA, 15 bp, Homo sapiens
ttgaccatgtgatta

SEQ ID NO: 5961321 - DNA, 17 bp, Homo sapiens
ttgaccattaataaaga

SEQ ID NO: 5961322 - DNA, 23 bp, Homo sapiens
ttgaccattctcaccctgtgaaa

SEQ ID NO: 5961323 - DNA, 19 bp, Homo sapiens
ttgaccattctccacctgc

SEQ ID NO: 5961324 - DNA, 17 bp, Homo sapiens
ttgaccattttagtttt

SEQ ID NO: 5961325 - DNA, 21 bp, Homo sapiens
ttgaccattttgttaaaatct

SEQ ID NO: 5961326 - DNA, 17 bp, Homo sapiens
ttgacccacaagaaatg

SEQ ID NO: 5961327 - DNA, 14 bp, Homo sapiens
ttgacccactcaca

SEQ ID NO: 5961328 - DNA, 19 bp, Homo sapiens
ttgaccccagtttcttctt

SEQ ID NO: 5961329 - DNA, 15 bp, Homo sapiens
ttgacccctcctgaa

SEQ ID NO: 5961330 - DNA, 16 bp, Homo sapiens
ttgaccctactgtgga

SEQ ID NO: 5961331 - DNA, 17 bp, Homo sapiens
ttgaccctactgtggat

SEQ ID NO: 5961332 - DNA, 19 bp, Homo sapiens
ttgaccctattttttgaca

SEQ ID NO: 5961333 - DNA, 18 bp, Homo sapiens
ttgaccctgaaatatttt

SEQ ID NO: 5961334 - DNA, 20 bp, Homo sapiens
ttgaccctgaaatattttct

SEQ ID NO: 5961335 - DNA, 16 bp, Homo sapiens
ttgacccttgctgtga

SEQ ID NO: 5961336 - DNA, 21 bp, Homo sapiens
ttgaccgttttcatcctggcc

SEQ ID NO: 5961337 - DNA, 20 bp, Homo sapiens
ttgaccgtttttatattact

SEQ ID NO: 5961338 - DNA, 22 bp, Homo sapiens
ttgacctcagctgcacattcct

SEQ ID NO: 5961339 - DNA, 24 bp, Homo sapiens
ttgacctcatctcccgagcaatgg

SEQ ID NO: 5961340 - DNA, 15 bp, Homo sapiens
ttgacctctgcagca

SEQ ID NO: 5961341 - DNA, 16 bp, Homo sapiens
ttgacctctgcagcaa

SEQ ID NO: 5961342 - DNA, 16 bp, Homo sapiens
ttgacctgaactctgc

SEQ ID NO: 5961343 - DNA, 13 bp, Homo sapiens
ttgacctgaggct

SEQ ID NO: 5961344 - DNA, 17 bp, Homo sapiens
ttgacctggactgaagt

SEQ ID NO: 5961345 - DNA, 20 bp, Homo sapiens
ttgacctggaggggagaggt

SEQ ID NO: 5961346 - DNA, 18 bp, Homo sapiens
ttgacctgtcctctttgt

SEQ ID NO: 5961347 - DNA, 23 bp, Homo sapiens
ttgaccttaccaagttggtctta

SEQ ID NO: 5961348 - DNA, 12 bp, Homo sapiens
ttgaccttcccc

SEQ ID NO: 5961349 - DNA, 20 bp, Homo sapiens
ttgaccttctgtcgtcccca

SEQ ID NO: 5961350 - DNA, 21 bp, Homo sapiens
ttgaccttctgtcgtccccag

SEQ ID NO: 5961351 - DNA, 20 bp, Homo sapiens
ttgacctttaaatgcaacag

SEQ ID NO: 5961352 - DNA, 13 bp, Homo sapiens
ttgacctttgtac

SEQ ID NO: 5961353 - DNA, 15 bp, Homo sapiens
ttgacctttgtacag

SEQ ID NO: 5961354 - DNA, 23 bp, Homo sapiens
ttgacgaagtctcttttctttag

SEQ ID NO: 5961355 - DNA, 21 bp, Homo sapiens
ttgacgacctacatctgaaat

SEQ ID NO: 5961356 - DNA, 23 bp, Homo sapiens
ttgacgagtgtgaagcttccttg

SEQ ID NO: 5961357 - DNA, 17 bp, Homo sapiens
ttgacgattccttctct

SEQ ID NO: 5961358 - DNA, 19 bp, Homo sapiens
ttgacgcagccccccacgc

SEQ ID NO: 5961359 - DNA, 15 bp, Homo sapiens
ttgacgccaccataa

SEQ ID NO: 5961360 - DNA, 19 bp, Homo sapiens
ttgacgccatcccagcccc

SEQ ID NO: 5961361 - DNA, 15 bp, Homo sapiens
ttgacggatgattgg

SEQ ID NO: 5961362 - DNA, 22 bp, Homo sapiens
ttgacgggagcattggcccctg

SEQ ID NO: 5961363 - DNA, 15 bp, Homo sapiens
ttgacgggccaggcc

SEQ ID NO: 5961364 - DNA, 22 bp, Homo sapiens
ttgacgggctgtccgtgtgcct

SEQ ID NO: 5961365 - DNA, 23 bp, Homo sapiens
ttgacggttttttattattgtgg

SEQ ID NO: 5961366 - DNA, 19 bp, Homo sapiens
ttgacgtattattgtcctt

SEQ ID NO: 5961367 - DNA, 23 bp, Homo sapiens
ttgacgtcactttttggccatgt

SEQ ID NO: 5961368 - DNA, 23 bp, Homo sapiens
ttgacgttgttgtcattgtccag

SEQ ID NO: 5961369 - DNA, 15 bp, Homo sapiens
ttgactaaaatgctg

SEQ ID NO: 5961370 - DNA, 15 bp, Homo sapiens
ttgactaaagcatca

SEQ ID NO: 5961371 - DNA, 23 bp, Homo sapiens
ttgactaactcaaatacacattt

SEQ ID NO: 5961372 - DNA, 17 bp, Homo sapiens
ttgactaagaattttgt

SEQ ID NO: 5961373 - DNA, 21 bp, Homo sapiens
ttgactaatgaggcattacaa

SEQ ID NO: 5961374 - DNA, 14 bp, Homo sapiens
ttgactaattttac

SEQ ID NO: 5961375 - DNA, 21 bp, Homo sapiens
ttgactagggattcaggctgc

SEQ ID NO: 5961376 - DNA, 21 bp, Homo sapiens
ttgactatcacatacaatttg

SEQ ID NO: 5961377 - DNA, 20 bp, Homo sapiens
ttgactatggagtcttgtga

SEQ ID NO: 5961378 - DNA, 21 bp, Homo sapiens
ttgactatggagtcttgtgaa

SEQ ID NO: 5961379 - DNA, 12 bp, Homo sapiens
ttgactattttt

SEQ ID NO: 5961380 - DNA, 14 bp, Homo sapiens
ttgactcacctgtt

SEQ ID NO: 5961381 - DNA, 22 bp, Homo sapiens
ttgactcagaggctgggagcat

SEQ ID NO: 5961382 - DNA, 22 bp, Homo sapiens
ttgactcatggcagctgtttct

SEQ ID NO: 5961383 - DNA, 15 bp, Homo sapiens
ttgactccactactt

SEQ ID NO: 5961384 - DNA, 12 bp, Homo sapiens
ttgactcctttt

SEQ ID NO: 5961385 - DNA, 17 bp, Homo sapiens
ttgactctaaatgcagt

SEQ ID NO: 5961386 - DNA, 22 bp, Homo sapiens
ttgactctaatatgattataca

SEQ ID NO: 5961387 - DNA, 18 bp, Homo sapiens
ttgactctgggtccttcc

SEQ ID NO: 5961388 - DNA, 21 bp, Homo sapiens
ttgactctgggtccttcctga

SEQ ID NO: 5961389 - DNA, 21 bp, Homo sapiens
ttgactcttgcgtgtcaattt

SEQ ID NO: 5961390 - DNA, 21 bp, Homo sapiens
ttgactctttcaaagaaatcc

SEQ ID NO: 5961391 - DNA, 20 bp, Homo sapiens
ttgactcttttatctgagtt

SEQ ID NO: 5961392 - DNA, 13 bp, Homo sapiens
ttgactgaaatta

SEQ ID NO: 5961393 - DNA, 23 bp, Homo sapiens
ttgactgaactgcacgttctata

SEQ ID NO: 5961394 - DNA, 19 bp, Homo sapiens
ttgactgaagcgaacatct

SEQ ID NO: 5961395 - DNA, 17 bp, Homo sapiens
ttgactgatgattttcc

SEQ ID NO: 5961396 - DNA, 19 bp, Homo sapiens
ttgactgatgattttcctt

SEQ ID NO: 5961397 - DNA, 16 bp, Homo sapiens
ttgactgattgtttta

SEQ ID NO: 5961398 - DNA, 20 bp, Homo sapiens
ttgactgccctcttactgtt

SEQ ID NO: 5961399 - DNA, 22 bp, Homo sapiens
ttgactgccgcatcatgggagt

SEQ ID NO: 5961400 - DNA, 16 bp, Homo sapiens
ttgactgcttctctgc

SEQ ID NO: 5961401 - DNA, 20 bp, Homo sapiens
ttgactgcttttaaatgacc

SEQ ID NO: 5961402 - DNA, 17 bp, Homo sapiens
ttgactgtagccacagc

SEQ ID NO: 5961403 - DNA, 22 bp, Homo sapiens
ttgactgtcacggaacagatct

SEQ ID NO: 5961404 - DNA, 14 bp, Homo sapiens
ttgactgtcagcaa

SEQ ID NO: 5961405 - DNA, 19 bp, Homo sapiens
ttgactgtctagccactcc

SEQ ID NO: 5961406 - DNA, 20 bp, Homo sapiens
ttgactgtctagccactccc

SEQ ID NO: 5961407 - DNA, 22 bp, Homo sapiens
ttgactgtctagccactccctc

SEQ ID NO: 5961408 - DNA, 19 bp, Homo sapiens
ttgactgtctcacttttta

SEQ ID NO: 5961409 - DNA, 18 bp, Homo sapiens
ttgactgtctttcctata

SEQ ID NO: 5961410 - DNA, 17 bp, Homo sapiens
ttgactgtgattagatc

SEQ ID NO: 5961411 - DNA, 16 bp, Homo sapiens
ttgactgtgctggaga

SEQ ID NO: 5961412 - DNA, 19 bp, Homo sapiens
ttgactgtttttacccata

SEQ ID NO: 5961413 - DNA, 21 bp, Homo sapiens
ttgacttaatgtgattactgc

SEQ ID NO: 5961414 - DNA, 15 bp, Homo sapiens
ttgacttactgtttc

SEQ ID NO: 5961415 - DNA, 20 bp, Homo sapiens
ttgacttactgtttcttacc

SEQ ID NO: 5961416 - DNA, 23 bp, Homo sapiens
ttgacttagatattaaaatttgg

SEQ ID NO: 5961417 - DNA, 17 bp, Homo sapiens
ttgacttaggtttttag

SEQ ID NO: 5961418 - DNA, 18 bp, Homo sapiens
ttgacttattaggacttt

SEQ ID NO: 5961419 - DNA, 17 bp, Homo sapiens
ttgacttcaaatgtgta

SEQ ID NO: 5961420 - DNA, 13 bp, Homo sapiens
ttgacttcagatt

SEQ ID NO: 5961421 - DNA, 18 bp, Homo sapiens
ttgacttcagctgcctga

SEQ ID NO: 5961422 - DNA, 19 bp, Homo sapiens
ttgacttctatcctgttaa

SEQ ID NO: 5961423 - DNA, 20 bp, Homo sapiens
ttgacttctcttgaattatt

SEQ ID NO: 5961424 - DNA, 22 bp, Homo sapiens
ttgacttcttggtttggggaga

SEQ ID NO: 5961425 - DNA, 16 bp, Homo sapiens
ttgacttgaaaagaaa

SEQ ID NO: 5961426 - DNA, 16 bp, Homo sapiens
ttgacttgaaatgctc

SEQ ID NO: 5961427 - DNA, 16 bp, Homo sapiens
ttgacttgcatgaaga

SEQ ID NO: 5961428 - DNA, 16 bp, Homo sapiens
ttgacttgcattcaga

SEQ ID NO: 5961429 - DNA, 23 bp, Homo sapiens
ttgacttgccatgaaggcacctg

SEQ ID NO: 5961430 - DNA, 16 bp, Homo sapiens
ttgacttgtataacat

SEQ ID NO: 5961431 - DNA, 22 bp, Homo sapiens
ttgactttacgcccatctcagg

SEQ ID NO: 5961432 - DNA, 13 bp, Homo sapiens
ttgactttataaa

SEQ ID NO: 5961433 - DNA, 15 bp, Homo sapiens
ttgactttatttctg

SEQ ID NO: 5961434 - DNA, 16 bp, Homo sapiens
ttgactttatttctga

SEQ ID NO: 5961435 - DNA, 15 bp, Homo sapiens
ttgactttctgattg

SEQ ID NO: 5961436 - DNA, 14 bp, Homo sapiens
ttgactttcttaaa

SEQ ID NO: 5961437 - DNA, 13 bp, Homo sapiens
ttgactttgtaat

SEQ ID NO: 5961438 - DNA, 21 bp, Homo sapiens
ttgacttttataaagcatgtt

SEQ ID NO: 5961439 - DNA, 17 bp, Homo sapiens
ttgacttttcaataaat

SEQ ID NO: 5961440 - DNA, 13 bp, Homo sapiens
ttgacttttctgt

SEQ ID NO: 5961441 - DNA, 12 bp, Homo sapiens
ttgactttttat

SEQ ID NO: 5961442 - DNA, 12 bp, Homo sapiens
ttgagaaacagt

SEQ ID NO: 5961443 - DNA, 10 bp, Homo sapiens
ttgagaaacc

SEQ ID NO: 5961444 - DNA, 22 bp, Homo sapiens
ttgagaaatgaataatttccca

SEQ ID NO: 5961445 - DNA, 16 bp, Homo sapiens
ttgagaaatgcatatt

SEQ ID NO: 5961446 - DNA, 23 bp, Homo sapiens
ttgagaaccagtctcctcactct

SEQ ID NO: 5961447 - DNA, 15 bp, Homo sapiens
ttgagaactccagct

SEQ ID NO: 5961448 - DNA, 20 bp, Homo sapiens
ttgagaactgcttctaagat

SEQ ID NO: 5961449 - DNA, 15 bp, Homo sapiens
ttgagaactttccat

SEQ ID NO: 5961450 - DNA, 14 bp, Homo sapiens
ttgagaagaatgtt

SEQ ID NO: 5961451 - DNA, 23 bp, Homo sapiens
ttgagaagccttcagctccaggg

SEQ ID NO: 5961452 - DNA, 16 bp, Homo sapiens
ttgagaagctgctcaa

SEQ ID NO: 5961453 - DNA, 19 bp, Homo sapiens
ttgagaaggaaaattttag

SEQ ID NO: 5961454 - DNA, 12 bp, Homo sapiens
ttgagaaggaac

SEQ ID NO: 5961455 - DNA, 23 bp, Homo sapiens
ttgagaagggaaatcttagcatg

SEQ ID NO: 5961456 - DNA, 14 bp, Homo sapiens
ttgagaaggtgcct

SEQ ID NO: 5961457 - DNA, 15 bp, Homo sapiens
ttgagaaggtgcctg

SEQ ID NO: 5961458 - DNA, 18 bp, Homo sapiens
ttgagaagttttgtacag

SEQ ID NO: 5961459 - DNA, 17 bp, Homo sapiens
ttgagaataagaatttg

SEQ ID NO: 5961460 - DNA, 16 bp, Homo sapiens
ttgagaatattgaagt

SEQ ID NO: 5961461 - DNA, 20 bp, Homo sapiens
ttgagaatcactgctccagg

SEQ ID NO: 5961462 - DNA, 21 bp, Homo sapiens
ttgagaatcactgctccaggc

SEQ ID NO: 5961463 - DNA, 23 bp, Homo sapiens
ttgagaatcccaaatttgattga

SEQ ID NO: 5961464 - DNA, 16 bp, Homo sapiens
ttgagaatggaaacca

SEQ ID NO: 5961465 - DNA, 21 bp, Homo sapiens
ttgagaatgtttgaaaattag

SEQ ID NO: 5961466 - DNA, 22 bp, Homo sapiens
ttgagaattgtgctcaaaattt

SEQ ID NO: 5961467 - DNA, 15 bp, Homo sapiens
ttgagacaaaaatta

SEQ ID NO: 5961468 - DNA, 14 bp, Homo sapiens
ttgagacaagccct

SEQ ID NO: 5961469 - DNA, 16 bp, Homo sapiens
ttgagacaagccctgg

SEQ ID NO: 5961470 - DNA, 18 bp, Homo sapiens
ttgagacaagccctggca

SEQ ID NO: 5961471 - DNA, 22 bp, Homo sapiens
ttgagacacggagcccagccct

SEQ ID NO: 5961472 - DNA, 17 bp, Homo sapiens
ttgagacactgtcaaga

SEQ ID NO: 5961473 - DNA, 20 bp, Homo sapiens
ttgagacagtgcacatgaac

SEQ ID NO: 5961474 - DNA, 16 bp, Homo sapiens
ttgagaccagaagaaa

SEQ ID NO: 5961475 - DNA, 22 bp, Homo sapiens
ttgagaccagaagaaaagactt

SEQ ID NO: 5961476 - DNA, 14 bp, Homo sapiens
ttgagaccagaagg

SEQ ID NO: 5961477 - DNA, 23 bp, Homo sapiens
ttgagaccagcctgccaggccct

SEQ ID NO: 5961478 - DNA, 21 bp, Homo sapiens
ttgagaccagcctggccaaca

SEQ ID NO: 5961479 - DNA, 15 bp, Homo sapiens
ttgagaccaggctgg

SEQ ID NO: 5961480 - DNA, 20 bp, Homo sapiens
ttgagaccctcttctctggg

SEQ ID NO: 5961481 - DNA, 17 bp, Homo sapiens
ttgagacctcagccatg

SEQ ID NO: 5961482 - DNA, 16 bp, Homo sapiens
ttgagacctttcctct

SEQ ID NO: 5961483 - DNA, 18 bp, Homo sapiens
ttgagacggagtctctca

SEQ ID NO: 5961484 - DNA, 16 bp, Homo sapiens
ttgagactatttaaac

SEQ ID NO: 5961485 - DNA, 17 bp, Homo sapiens
ttgagactcaaaaaaac

SEQ ID NO: 5961486 - DNA, 16 bp, Homo sapiens
ttgagactgaaagaaa

SEQ ID NO: 5961487 - DNA, 15 bp, Homo sapiens
ttgagactgaaattt

SEQ ID NO: 5961488 - DNA, 19 bp, Homo sapiens
ttgagactgaaatttagta

SEQ ID NO: 5961489 - DNA, 14 bp, Homo sapiens
ttgagactgctaga

SEQ ID NO: 5961490 - DNA, 23 bp, Homo sapiens
ttgagactttcttctagtgcttt

SEQ ID NO: 5961491 - DNA, 23 bp, Homo sapiens
ttgagactttttggtggatgtaa

SEQ ID NO: 5961492 - DNA, 23 bp, Homo sapiens
ttgagagaagccacgctgtcctc

SEQ ID NO: 5961493 - DNA, 15 bp, Homo sapiens
ttgatattgtttgct

SEQ ID NO: 5961494 - DNA, 16 bp, Homo sapiens
ttgatattgtttgctg

SEQ ID NO: 5961495 - DNA, 18 bp, Homo sapiens
ttgatattgtttgctgtt

SEQ ID NO: 5961496 - DNA, 16 bp, Homo sapiens
ttgatatttatttatg

SEQ ID NO: 5961497 - DNA, 17 bp, Homo sapiens
ttgatatttatttcctg

SEQ ID NO: 5961498 - DNA, 14 bp, Homo sapiens
ttgatatttctgtg

SEQ ID NO: 5961499 - DNA, 16 bp, Homo sapiens
ttgatatttgcattga

SEQ ID NO: 5961500 - DNA, 13 bp, Homo sapiens
ttgatatttggtt

SEQ ID NO: 5961501 - DNA, 20 bp, Homo sapiens
ttgatatttgtgcattttct

SEQ ID NO: 5961502 - DNA, 21 bp, Homo sapiens
ttgatatttgtgcattttcta

SEQ ID NO: 5961503 - DNA, 22 bp, Homo sapiens
ttgatattttcaacgcagccct

SEQ ID NO: 5961504 - DNA, 15 bp, Homo sapiens
ttgatattttctata

SEQ ID NO: 5961505 - DNA, 17 bp, Homo sapiens
ttgatatttttatacaa

SEQ ID NO: 5961506 - DNA, 20 bp, Homo sapiens
ttgatatttttccatttatt

SEQ ID NO: 5961507 - DNA, 14 bp, Homo sapiens
ttgatcaaatgtac

SEQ ID NO: 5961508 - DNA, 16 bp, Homo sapiens
ttgatcaaatgtacat

SEQ ID NO: 5961509 - DNA, 18 bp, Homo sapiens
ttgatcaacatcttttct

SEQ ID NO: 5961510 - DNA, 14 bp, Homo sapiens
ttgatcacagatgt

SEQ ID NO: 5961511 - DNA, 23 bp, Homo sapiens
ttgatcacagatgtgcccagagt

SEQ ID NO: 5961512 - DNA, 22 bp, Homo sapiens
ttgatcacagtggcgagaggag

SEQ ID NO: 5961513 - DNA, 15 bp, Homo sapiens
ttgatcactgtgaac

SEQ ID NO: 5961514 - DNA, 13 bp, Homo sapiens
ttgatcagaatcc

SEQ ID NO: 5961515 - DNA, 13 bp, Homo sapiens
ttgatcagacagc

SEQ ID NO: 5961516 - DNA, 18 bp, Homo sapiens
ttgatcagatctgacatg

SEQ ID NO: 5961517 - DNA, 17 bp, Homo sapiens
ttgatcagatgctgaat

SEQ ID NO: 5961518 - DNA, 20 bp, Homo sapiens
ttgatcatccctttctccca

SEQ ID NO: 5961519 - DNA, 14 bp, Homo sapiens
ttgatcatgcagga

SEQ ID NO: 5961520 - DNA, 15 bp, Homo sapiens
ttgatcatgcaggaa

SEQ ID NO: 5961521 - DNA, 16 bp, Homo sapiens
ttgatcatgcaggaac

SEQ ID NO: 5961522 - DNA, 17 bp, Homo sapiens
ttgatcatttcttgtga

SEQ ID NO: 5961523 - DNA, 22 bp, Homo sapiens
ttgatccacttcttaatgcttt

SEQ ID NO: 5961524 - DNA, 20 bp, Homo sapiens
ttgatccagaagagcccata

SEQ ID NO: 5961525 - DNA, 16 bp, Homo sapiens
ttgatccatttctaat

SEQ ID NO: 5961526 - DNA, 12 bp, Homo sapiens
ttgatcccacat

SEQ ID NO: 5961527 - DNA, 15 bp, Homo sapiens
ttgatcccacttcac

SEQ ID NO: 5961528 - DNA, 18 bp, Homo sapiens
ttgatcccacttcactgt

SEQ ID NO: 5961529 - DNA, 22 bp, Homo sapiens
ttgatcccagaaagtatatact

SEQ ID NO: 5961530 - DNA, 16 bp, Homo sapiens
ttgatcccctctctgt

SEQ ID NO: 5961531 - DNA, 19 bp, Homo sapiens
ttgatccttctgagctcca

SEQ ID NO: 5961532 - DNA, 14 bp, Homo sapiens
ttgatccttggaaa

SEQ ID NO: 5961533 - DNA, 15 bp, Homo sapiens
ttgatcgatgttaaa

SEQ ID NO: 5961534 - DNA, 20 bp, Homo sapiens
ttgatcgatgttaaacgtca

SEQ ID NO: 5961535 - DNA, 20 bp, Homo sapiens
ttgatcgcctctttgacatt

SEQ ID NO: 5961536 - DNA, 21 bp, Homo sapiens
ttgatcgcctctttgacattt

SEQ ID NO: 5961537 - DNA, 19 bp, Homo sapiens
ttgatcgcctttcccaggt

SEQ ID NO: 5961538 - DNA, 21 bp, Homo sapiens
ttgatcgcttttaataaactg

SEQ ID NO: 5961539 - DNA, 17 bp, Homo sapiens
ttgatctacccgtgcct

SEQ ID NO: 5961540 - DNA, 15 bp, Homo sapiens
ttgatctatgggaaa

SEQ ID NO: 5961541 - DNA, 19 bp, Homo sapiens
ttgatctatgggaaatcta

SEQ ID NO: 5961542 - DNA, 12 bp, Homo sapiens
ttgatctcccca

SEQ ID NO: 5961543 - DNA, 14 bp, Homo sapiens
ttgatctctaatga

SEQ ID NO: 5961544 - DNA, 18 bp, Homo sapiens
ttgatctctcttgtcctc

SEQ ID NO: 5961545 - DNA, 18 bp, Homo sapiens
ttgatctctgttctttca

SEQ ID NO: 5961546 - DNA, 20 bp, Homo sapiens
ttgatctctgttctttcata

SEQ ID NO: 5961547 - DNA, 17 bp, Homo sapiens
ttgatctgctcagccct

SEQ ID NO: 5961548 - DNA, 22 bp, Homo sapiens
ttgatctgctcagccctggagg

SEQ ID NO: 5961549 - DNA, 15 bp, Homo sapiens
ttgatctggaaccca

SEQ ID NO: 5961550 - DNA, 14 bp, Homo sapiens
ttgatctggacaga

SEQ ID NO: 5961551 - DNA, 19 bp, Homo sapiens
ttgatctggtgcgtgtggc

SEQ ID NO: 5961552 - DNA, 12 bp, Homo sapiens
ttgatctgtatt

SEQ ID NO: 5961553 - DNA, 13 bp, Homo sapiens
ttgatctgttttg

SEQ ID NO: 5961554 - DNA, 15 bp, Homo sapiens
ttgatcttcaacaaa

SEQ ID NO: 5961555 - DNA, 18 bp, Homo sapiens
ttgatcttgtaaaaatag

SEQ ID NO: 5961556 - DNA, 13 bp, Homo sapiens
ttgatctttcact

SEQ ID NO: 5961557 - DNA, 13 bp, Homo sapiens
ttgatctttgagc

SEQ ID NO: 5961558 - DNA, 16 bp, Homo sapiens
ttgatctttgtttaaa

SEQ ID NO: 5961559 - DNA, 16 bp, Homo sapiens
ttgatctttttatcat

SEQ ID NO: 5961560 - DNA, 17 bp, Homo sapiens
ttgatctttttatcatg

SEQ ID NO: 5961561 - DNA, 18 bp, Homo sapiens
ttgatctttttatcatga

SEQ ID NO: 5961562 - DNA, 19 bp, Homo sapiens
ttgatctttttatcatgat

SEQ ID NO: 5961563 - DNA, 14 bp, Homo sapiens
ttgatcttttttaa

SEQ ID NO: 5961564 - DNA, 11 bp, Homo sapiens
ttgatgaaaag

SEQ ID NO: 5961565 - DNA, 19 bp, Homo sapiens
ttgatgaaaagatttaagc

SEQ ID NO: 5961566 - DNA, 14 bp, Homo sapiens
ttgatgaaaagctt

SEQ ID NO: 5961567 - DNA, 21 bp, Homo sapiens
ttgatgaagcaaggaagatat

SEQ ID NO: 5961568 - DNA, 14 bp, Homo sapiens
ttgatgaagcccgt

SEQ ID NO: 5961569 - DNA, 19 bp, Homo sapiens
ttgatgactcgaaactgac

SEQ ID NO: 5961570 - DNA, 13 bp, Homo sapiens
ttgatgactggaa

SEQ ID NO: 5961571 - DNA, 15 bp, Homo sapiens
ttgatgactggaatt

SEQ ID NO: 5961572 - DNA, 20 bp, Homo sapiens
ttgatgactggaatttttat

SEQ ID NO: 5961573 - DNA, 19 bp, Homo sapiens
ttgatgagaatcctgacca

SEQ ID NO: 5961574 - DNA, 19 bp, Homo sapiens
ttgatgagatattaaattc

SEQ ID NO: 5961575 - DNA, 20 bp, Homo sapiens
ttgatgagatattaaattct

SEQ ID NO: 5961576 - DNA, 21 bp, Homo sapiens
ttgatgagtgtaacaagaaag

SEQ ID NO: 5961577 - DNA, 22 bp, Homo sapiens
ttgatgagtgtaacaagaaagg

SEQ ID NO: 5961578 - DNA, 20 bp, Homo sapiens
ttgatgagttaactgtgaaa

SEQ ID NO: 5961579 - DNA, 15 bp, Homo sapiens
ttgatgatcactgtg

SEQ ID NO: 5961580 - DNA, 16 bp, Homo sapiens
ttgatgatcactgtga

SEQ ID NO: 5961581 - DNA, 21 bp, Homo sapiens
ttgatgattgccaacagtggc

SEQ ID NO: 5961582 - DNA, 22 bp, Homo sapiens
ttgatgattgccaacagtggct

SEQ ID NO: 5961583 - DNA, 22 bp, Homo sapiens
ttgatgcaatccttacaaatga

SEQ ID NO: 5961584 - DNA, 18 bp, Homo sapiens
ttgatgcagcatttgata

SEQ ID NO: 5961585 - DNA, 16 bp, Homo sapiens
ttgatgcatgctattc

SEQ ID NO: 5961586 - DNA, 11 bp, Homo sapiens
ttgatgcatgt

SEQ ID NO: 5961587 - DNA, 20 bp, Homo sapiens
ttgatgcattaaaagaaaat

SEQ ID NO: 5961588 - DNA, 14 bp, Homo sapiens
ttgatgccaaaaaa

SEQ ID NO: 5961589 - DNA, 22 bp, Homo sapiens
ttgatgccaaaaaaaaatacat

SEQ ID NO: 5961590 - DNA, 19 bp, Homo sapiens
ttgatgccaaagcagacat

SEQ ID NO: 5961591 - DNA, 20 bp, Homo sapiens
ttgatgccaaagcagacatt

SEQ ID NO: 5961592 - DNA, 14 bp, Homo sapiens
ttgatgccagaggg

SEQ ID NO: 5961593 - DNA, 17 bp, Homo sapiens
ttgatgcccagctcagt

SEQ ID NO: 5961594 - DNA, 12 bp, Homo sapiens
ttgatgcctggc

SEQ ID NO: 5961595 - DNA, 17 bp, Homo sapiens
ttgatgctatttatgca

SEQ ID NO: 5961596 - DNA, 14 bp, Homo sapiens
ttgatgctgtattt

SEQ ID NO: 5961597 - DNA, 14 bp, Homo sapiens
ttgatggaaaaaga

SEQ ID NO: 5961598 - DNA, 20 bp, Homo sapiens
ttgatggaagaaaatggaat

SEQ ID NO: 5961599 - DNA, 17 bp, Homo sapiens
ttgatggagattaagat

SEQ ID NO: 5961600 - DNA, 18 bp, Homo sapiens
ttgatggagcctgaaccg

SEQ ID NO: 5961601 - DNA, 16 bp, Homo sapiens
ttgatggagtgtgagc

SEQ ID NO: 5961602 - DNA, 11 bp, Homo sapiens
ttgatggctaa

SEQ ID NO: 5961603 - DNA, 18 bp, Homo sapiens
ttgatggctaagatactg

SEQ ID NO: 5961604 - DNA, 23 bp, Homo sapiens
ttgatgggaaaagcccccagtta

SEQ ID NO: 5961605 - DNA, 18 bp, Homo sapiens
ttgatgggagaaatgagg

SEQ ID NO: 5961606 - DNA, 22 bp, Homo sapiens
ttgatgggatgattgaagaaac

SEQ ID NO: 5961607 - DNA, 15 bp, Homo sapiens
ttgatgggatttggt

SEQ ID NO: 5961608 - DNA, 12 bp, Homo sapiens
ttgatggggaca

SEQ ID NO: 5961609 - DNA, 13 bp, Homo sapiens
ttgatggggagaa

SEQ ID NO: 5961610 - DNA, 17 bp, Homo sapiens
ttgatggggcctgggtt

SEQ ID NO: 5961611 - DNA, 13 bp, Homo sapiens
ttgatgggttcta

SEQ ID NO: 5961612 - DNA, 23 bp, Homo sapiens
ttgatggtgatgaaatgtaaata

SEQ ID NO: 5961613 - DNA, 22 bp, Homo sapiens
ttgatggtggactaagcaattt

SEQ ID NO: 5961614 - DNA, 16 bp, Homo sapiens
ttgatgtaaaatcttg

SEQ ID NO: 5961615 - DNA, 18 bp, Homo sapiens
ttgatgtaaaatcttgtc

SEQ ID NO: 5961616 - DNA, 12 bp, Homo sapiens
ttgatgtaagga

SEQ ID NO: 5961617 - DNA, 17 bp, Homo sapiens
ttgatgtacatgtgtag

SEQ ID NO: 5961618 - DNA, 20 bp, Homo sapiens
ttgatgtactgattgagaag

SEQ ID NO: 5961619 - DNA, 22 bp, Homo sapiens
ttgatgtatccaacaagccaga

SEQ ID NO: 5961620 - DNA, 16 bp, Homo sapiens
ttgatgtatgtgtgaa

SEQ ID NO: 5961621 - DNA, 12 bp, Homo sapiens
ttgatgtcagca

SEQ ID NO: 5961622 - DNA, 18 bp, Homo sapiens
ttgatgtcagcagttgct

SEQ ID NO: 5961623 - DNA, 14 bp, Homo sapiens
ttgatgtcagtatt

SEQ ID NO: 5961624 - DNA, 18 bp, Homo sapiens
ttgatgtcagtatttcaa

SEQ ID NO: 5961625 - DNA, 21 bp, Homo sapiens
ttgatgtcatgtacttcctgt

SEQ ID NO: 5961626 - DNA, 15 bp, Homo sapiens
ttgatgtcattttgt

SEQ ID NO: 5961627 - DNA, 18 bp, Homo sapiens
ttgatgtctagataacat

SEQ ID NO: 5961628 - DNA, 22 bp, Homo sapiens
ttgatgtgaagataatttgcat

SEQ ID NO: 5961629 - DNA, 23 bp, Homo sapiens
ttgatgtgaagataatttgcata

SEQ ID NO: 5961630 - DNA, 14 bp, Homo sapiens
ttgatgtgacaata

SEQ ID NO: 5961631 - DNA, 15 bp, Homo sapiens
ttgatgtgacaataa

SEQ ID NO: 5961632 - DNA, 19 bp, Homo sapiens
ttgatgtgacaataatatt

SEQ ID NO: 5961633 - DNA, 18 bp, Homo sapiens
ttgatgtgcaaaaatttt

SEQ ID NO: 5961634 - DNA, 16 bp, Homo sapiens
ttgatgtgcactgcat

SEQ ID NO: 5961635 - DNA, 11 bp, Homo sapiens
ttgatgtgctt

SEQ ID NO: 5961636 - DNA, 20 bp, Homo sapiens
ttgatgtgtttatttataga

SEQ ID NO: 5961637 - DNA, 18 bp, Homo sapiens
ttgatgtgtttttgtatg

SEQ ID NO: 5961638 - DNA, 13 bp, Homo sapiens
ttgatgttaacaa

SEQ ID NO: 5961639 - DNA, 23 bp, Homo sapiens
ttgatgttaacaagaggggaaaa

SEQ ID NO: 5961640 - DNA, 14 bp, Homo sapiens
ttgatgttaacaca

SEQ ID NO: 5961641 - DNA, 12 bp, Homo sapiens
ttgatgttacaa

SEQ ID NO: 5961642 - DNA, 14 bp, Homo sapiens
ttgatgttccttcc

SEQ ID NO: 5961643 - DNA, 23 bp, Homo sapiens
ttgatgttctttcacccttttct

SEQ ID NO: 5961644 - DNA, 13 bp, Homo sapiens
ttgatgttggctg

SEQ ID NO: 5961645 - DNA, 16 bp, Homo sapiens
ttgatgttggctggga

SEQ ID NO: 5961646 - DNA, 13 bp, Homo sapiens
ttgatgtttaagt

SEQ ID NO: 5961647 - DNA, 15 bp, Homo sapiens
ttgatgtttagaaaa

SEQ ID NO: 5961648 - DNA, 20 bp, Homo sapiens
ttgatgtttgtggcctcaga

SEQ ID NO: 5961649 - DNA, 23 bp, Homo sapiens
ttgatgttttaaggatgcttgta

SEQ ID NO: 5961650 - DNA, 11 bp, Homo sapiens
ttgatgttttc

SEQ ID NO: 5961651 - DNA, 17 bp, Homo sapiens
ttgatgttttttctgta

SEQ ID NO: 5961652 - DNA, 13 bp, Homo sapiens
ttgattaaaagca

SEQ ID NO: 5961653 - DNA, 14 bp, Homo sapiens
ttgattaaaatctc

SEQ ID NO: 5961654 - DNA, 15 bp, Homo sapiens
ttgattaaaatctct

SEQ ID NO: 5961655 - DNA, 21 bp, Homo sapiens
ttgattaaaatctcttgatta

SEQ ID NO: 5961656 - DNA, 13 bp, Homo sapiens
ttgattaaacagc

SEQ ID NO: 5961657 - DNA, 19 bp, Homo sapiens
ttgattaaactgtatgtct

SEQ ID NO: 5961658 - DNA, 20 bp, Homo sapiens
ttgattaaactgtatgtctt

SEQ ID NO: 5961659 - DNA, 16 bp, Homo sapiens
ttgattaaattatgaa

SEQ ID NO: 5961660 - DNA, 22 bp, Homo sapiens
ttgattaaattatgaatgagtt

SEQ ID NO: 5961661 - DNA, 18 bp, Homo sapiens
ttgattaaccttttcaaa

SEQ ID NO: 5961662 - DNA, 17 bp, Homo sapiens
ttgattaagaaaggaag

SEQ ID NO: 5961663 - DNA, 22 bp, Homo sapiens
ttgattaagatctcagtggtta

SEQ ID NO: 5961664 - DNA, 15 bp, Homo sapiens
ttgattaagatttta

SEQ ID NO: 5961665 - DNA, 17 bp, Homo sapiens
ttgattaagcttttgtc

SEQ ID NO: 5961666 - DNA, 11 bp, Homo sapiens
ttgattaaggc

SEQ ID NO: 5961667 - DNA, 20 bp, Homo sapiens
ttgattaatgaagaaagtaa

SEQ ID NO: 5961668 - DNA, 14 bp, Homo sapiens
ttgattaatgtact

SEQ ID NO: 5961669 - DNA, 16 bp, Homo sapiens
ttgattaatgtacttt

SEQ ID NO: 5961670 - DNA, 17 bp, Homo sapiens
ttgattacagtgcagtg

SEQ ID NO: 5961671 - DNA, 21 bp, Homo sapiens
ttgattagaaaataaactcat

SEQ ID NO: 5961672 - DNA, 14 bp, Homo sapiens
ttgcatttactttt

SEQ ID NO: 5961673 - DNA, 16 bp, Homo sapiens
ttgcatttagcttctt

SEQ ID NO: 5961674 - DNA, 20 bp, Homo sapiens
ttgcatttattgcagtttat

SEQ ID NO: 5961675 - DNA, 22 bp, Homo sapiens
ttgcatttcctgtgtttgtcct

SEQ ID NO: 5961676 - DNA, 19 bp, Homo sapiens
ttgcatttctcttcctaaa

SEQ ID NO: 5961677 - DNA, 14 bp, Homo sapiens
ttgcatttctgtat

SEQ ID NO: 5961678 - DNA, 15 bp, Homo sapiens
ttgcatttctgtatt

SEQ ID NO: 5961679 - DNA, 18 bp, Homo sapiens
ttgcatttctgtattttt

SEQ ID NO: 5961680 - DNA, 22 bp, Homo sapiens
ttgcatttcttgtgttctgtag

SEQ ID NO: 5961681 - DNA, 21 bp, Homo sapiens
ttgcatttgctgttgtttcta

SEQ ID NO: 5961682 - DNA, 12 bp, Homo sapiens
ttgcatttggaa

SEQ ID NO: 5961683 - DNA, 15 bp, Homo sapiens
ttgcatttggtcaag

SEQ ID NO: 5961684 - DNA, 15 bp, Homo sapiens
ttgcatttgtaaaaa

SEQ ID NO: 5961685 - DNA, 13 bp, Homo sapiens
ttgcatttgtacc

SEQ ID NO: 5961686 - DNA, 14 bp, Homo sapiens
ttgcatttgtttat

SEQ ID NO: 5961687 - DNA, 22 bp, Homo sapiens
ttgcatttgttttgtttacaga

SEQ ID NO: 5961688 - DNA, 17 bp, Homo sapiens
ttgcattttaaaaatga

SEQ ID NO: 5961689 - DNA, 18 bp, Homo sapiens
ttgcattttctgatgtat

SEQ ID NO: 5961690 - DNA, 12 bp, Homo sapiens
ttgcattttgat

SEQ ID NO: 5961691 - DNA, 15 bp, Homo sapiens
ttgcattttgtttca

SEQ ID NO: 5961692 - DNA, 20 bp, Homo sapiens
ttgcatttttgttttgaaag

SEQ ID NO: 5961693 - DNA, 18 bp, Homo sapiens
ttgcattttttaaaacaa

SEQ ID NO: 5961694 - DNA, 12 bp, Homo sapiens
ttgccaaaaaaa

SEQ ID NO: 5961695 - DNA, 15 bp, Homo sapiens
ttgccaaaaaggata

SEQ ID NO: 5961696 - DNA, 22 bp, Homo sapiens
ttgccaaaaatacaacacagac

SEQ ID NO: 5961697 - DNA, 23 bp, Homo sapiens
ttgccaaaaatacaacacagacg

SEQ ID NO: 5961698 - DNA, 18 bp, Homo sapiens
ttgccaaaacccagctgc

SEQ ID NO: 5961699 - DNA, 19 bp, Homo sapiens
ttgccaaaataatgtcttg

SEQ ID NO: 5961700 - DNA, 16 bp, Homo sapiens
ttgccaaaataccaga

SEQ ID NO: 5961701 - DNA, 19 bp, Homo sapiens
ttgccaaaatcctgaactt

SEQ ID NO: 5961702 - DNA, 15 bp, Homo sapiens
ttgccaaacattaat

SEQ ID NO: 5961703 - DNA, 19 bp, Homo sapiens
ttgccaaacattaatgttg

SEQ ID NO: 5961704 - DNA, 19 bp, Homo sapiens
ttgccaaagcagattttcc

SEQ ID NO: 5961705 - DNA, 22 bp, Homo sapiens
ttgccaaagcagattttcctaa

SEQ ID NO: 5961706 - DNA, 18 bp, Homo sapiens
ttgccaaatatgtcctgg

SEQ ID NO: 5961707 - DNA, 15 bp, Homo sapiens
ttgccaaatctggct

SEQ ID NO: 5961708 - DNA, 14 bp, Homo sapiens
ttgccaacagttgt

SEQ ID NO: 5961709 - DNA, 18 bp, Homo sapiens
ttgccaacctgtaataaa

SEQ ID NO: 5961710 - DNA, 22 bp, Homo sapiens
ttgccaaccttatagggatgag

SEQ ID NO: 5961711 - DNA, 16 bp, Homo sapiens
ttgccaactaagccct

SEQ ID NO: 5961712 - DNA, 22 bp, Homo sapiens
ttgccaactgaagccttcttct

SEQ ID NO: 5961713 - DNA, 18 bp, Homo sapiens
ttgccaacttgccatgtt

SEQ ID NO: 5961714 - DNA, 15 bp, Homo sapiens
ttgccaagaaaatga

SEQ ID NO: 5961715 - DNA, 13 bp, Homo sapiens
ttgccaagacaaa

SEQ ID NO: 5961716 - DNA, 24 bp, Homo sapiens
ttgccaagacaaatcaacagaagc

SEQ ID NO: 5961717 - DNA, 14 bp, Homo sapiens
ttgccaagaccttt

SEQ ID NO: 5961718 - DNA, 15 bp, Homo sapiens
ttgccaagacctttc

SEQ ID NO: 5961719 - DNA, 21 bp, Homo sapiens
ttgccaagctaatctgcctgg

SEQ ID NO: 5961720 - DNA, 22 bp, Homo sapiens
ttgccaagctccaagccccatc

SEQ ID NO: 5961721 - DNA, 17 bp, Homo sapiens
ttgccaaggcaaaaaac

SEQ ID NO: 5961722 - DNA, 18 bp, Homo sapiens
ttgccaaggccgcccacc

SEQ ID NO: 5961723 - DNA, 19 bp, Homo sapiens
ttgccaaggccgcccacct

SEQ ID NO: 5961724 - DNA, 21 bp, Homo sapiens
ttgccaagttgctgtcactgt

SEQ ID NO: 5961725 - DNA, 13 bp, Homo sapiens
ttgccaatatgcc

SEQ ID NO: 5961726 - DNA, 19 bp, Homo sapiens
ttgccaatatgccagcttg

SEQ ID NO: 5961727 - DNA, 19 bp, Homo sapiens
ttgccaatctaaaatggca

SEQ ID NO: 5961728 - DNA, 19 bp, Homo sapiens
ttgccaatttgcacattaa

SEQ ID NO: 5961729 - DNA, 15 bp, Homo sapiens
ttgccacaatcacta

SEQ ID NO: 5961730 - DNA, 21 bp, Homo sapiens
ttgccacaatgcctctcccac

SEQ ID NO: 5961731 - DNA, 22 bp, Homo sapiens
ttgccacaatgcctctcccacg

SEQ ID NO: 5961732 - DNA, 18 bp, Homo sapiens
ttgccacagctgtatttt

SEQ ID NO: 5961733 - DNA, 11 bp, Homo sapiens
ttgccacaggc

SEQ ID NO: 5961734 - DNA, 15 bp, Homo sapiens
ttgccacaggcctcc

SEQ ID NO: 5961735 - DNA, 16 bp, Homo sapiens
ttgccacaggcctccc

SEQ ID NO: 5961736 - DNA, 18 bp, Homo sapiens
ttgccacaggcctccctg

SEQ ID NO: 5961737 - DNA, 22 bp, Homo sapiens
ttgccacagggtactaaaagaa

SEQ ID NO: 5961738 - DNA, 23 bp, Homo sapiens
ttgccacagggtactaaaagaaa

SEQ ID NO: 5961739 - DNA, 18 bp, Homo sapiens
ttgccacataattcatta

SEQ ID NO: 5961740 - DNA, 22 bp, Homo sapiens
ttgccacataattcattaaaaa

SEQ ID NO: 5961741 - DNA, 14 bp, Homo sapiens
ttgccacatcccta

SEQ ID NO: 5961742 - DNA, 17 bp, Homo sapiens
ttgccacatcttgaaaa

SEQ ID NO: 5961743 - DNA, 14 bp, Homo sapiens
ttgccacattaaat

SEQ ID NO: 5961744 - DNA, 20 bp, Homo sapiens
ttgccacattgcttcattaa

SEQ ID NO: 5961745 - DNA, 12 bp, Homo sapiens
ttgccacattta

SEQ ID NO: 5961746 - DNA, 13 bp, Homo sapiens
ttgccacatttct

SEQ ID NO: 5961747 - DNA, 19 bp, Homo sapiens
ttgccaccaactggccctc

SEQ ID NO: 5961748 - DNA, 21 bp, Homo sapiens
ttgccaccaccagatgagaag

SEQ ID NO: 5961749 - DNA, 21 bp, Homo sapiens
ttgccaccactagagctgaga

SEQ ID NO: 5961750 - DNA, 15 bp, Homo sapiens
ttgccaccaggagaa

SEQ ID NO: 5961751 - DNA, 14 bp, Homo sapiens
ttgccaccccaacc

SEQ ID NO: 5961752 - DNA, 12 bp, Homo sapiens
ttgccaccccac

SEQ ID NO: 5961753 - DNA, 17 bp, Homo sapiens
ttgccaccccaccctcc

SEQ ID NO: 5961754 - DNA, 19 bp, Homo sapiens
ttgccaccccaccctccct

SEQ ID NO: 5961755 - DNA, 22 bp, Homo sapiens
ttgccaccccaccctccctgga

SEQ ID NO: 5961756 - DNA, 16 bp, Homo sapiens
ttgccaccctcatgct

SEQ ID NO: 5961757 - DNA, 14 bp, Homo sapiens
ttgccaccctctgg

SEQ ID NO: 5961758 - DNA, 18 bp, Homo sapiens
ttgccacgctttttgact

SEQ ID NO: 5961759 - DNA, 20 bp, Homo sapiens
ttgccacgctttttgactgc

SEQ ID NO: 5961760 - DNA, 16 bp, Homo sapiens
ttgccactaattttag

SEQ ID NO: 5961761 - DNA, 21 bp, Homo sapiens
ttgccactaattttagtattc

SEQ ID NO: 5961762 - DNA, 18 bp, Homo sapiens
ttgccactgatattcaga

SEQ ID NO: 5961763 - DNA, 15 bp, Homo sapiens
ttgccactgcctctt

SEQ ID NO: 5961764 - DNA, 10 bp, Homo sapiens
ttgccacttg

SEQ ID NO: 5961765 - DNA, 21 bp, Homo sapiens
ttgccactttggcttctcctg

SEQ ID NO: 5961766 - DNA, 24 bp, Homo sapiens
ttgccactttggcttctcctgtga

SEQ ID NO: 5961767 - DNA, 14 bp, Homo sapiens
ttgccagagatgga

SEQ ID NO: 5961768 - DNA, 12 bp, Homo sapiens
ttgccagagcag

SEQ ID NO: 5961769 - DNA, 15 bp, Homo sapiens
ttgccagagccttaa

SEQ ID NO: 5961770 - DNA, 13 bp, Homo sapiens
ttgccagaggccc

SEQ ID NO: 5961771 - DNA, 21 bp, Homo sapiens
ttgccagaggccctggaggga

SEQ ID NO: 5961772 - DNA, 17 bp, Homo sapiens
ttgccagcacaggggcc

SEQ ID NO: 5961773 - DNA, 16 bp, Homo sapiens
ttgccagcagagccag

SEQ ID NO: 5961774 - DNA, 18 bp, Homo sapiens
ttgccagcagagccaggg

SEQ ID NO: 5961775 - DNA, 21 bp, Homo sapiens
ttgccagcagagccagggcag

SEQ ID NO: 5961776 - DNA, 12 bp, Homo sapiens
ttgccagcccca

SEQ ID NO: 5961777 - DNA, 23 bp, Homo sapiens
ttgccagcctccttgctgacccc

SEQ ID NO: 5961778 - DNA, 12 bp, Homo sapiens
ttgccagctttt

SEQ ID NO: 5961779 - DNA, 22 bp, Homo sapiens
ttgccaggaaaggagagtactt

SEQ ID NO: 5961780 - DNA, 16 bp, Homo sapiens
ttgccaggaatgtttc

SEQ ID NO: 5961781 - DNA, 15 bp, Homo sapiens
ttgccaggacatgca

SEQ ID NO: 5961782 - DNA, 17 bp, Homo sapiens
ttgccaggacatgcaat

SEQ ID NO: 5961783 - DNA, 21 bp, Homo sapiens
ttgccaggagatggccccaac

SEQ ID NO: 5961784 - DNA, 20 bp, Homo sapiens
ttgccaggaggaacaaagag

SEQ ID NO: 5961785 - DNA, 16 bp, Homo sapiens
ttgccaggcttaagga

SEQ ID NO: 5961786 - DNA, 20 bp, Homo sapiens
ttgccagggaggtggaagga

SEQ ID NO: 5961787 - DNA, 19 bp, Homo sapiens
ttgccaggttgcagctgct

SEQ ID NO: 5961788 - DNA, 19 bp, Homo sapiens
ttgccagtaacacaggcca

SEQ ID NO: 5961789 - DNA, 21 bp, Homo sapiens
ttgccagtatataagctgttt

SEQ ID NO: 5961790 - DNA, 18 bp, Homo sapiens
ttgccagtcaccccggcc

SEQ ID NO: 5961791 - DNA, 15 bp, Homo sapiens
ttgccagtcctgcaa

SEQ ID NO: 5961792 - DNA, 21 bp, Homo sapiens
ttgccagtcttttgtcctgca

SEQ ID NO: 5961793 - DNA, 15 bp, Homo sapiens
ttgccagtgaagact

SEQ ID NO: 5961794 - DNA, 19 bp, Homo sapiens
ttgccagtgagaacggtga

SEQ ID NO: 5961795 - DNA, 18 bp, Homo sapiens
ttgccagtgtctttcttt

SEQ ID NO: 5961796 - DNA, 20 bp, Homo sapiens
ttgccataactttatgaagt

SEQ ID NO: 5961797 - DNA, 17 bp, Homo sapiens
ttgccataccattccca

SEQ ID NO: 5961798 - DNA, 17 bp, Homo sapiens
ttgccatagccccatat

SEQ ID NO: 5961799 - DNA, 19 bp, Homo sapiens
ttgccatattttcaccatt

SEQ ID NO: 5961800 - DNA, 22 bp, Homo sapiens
ttgccatcactggtccaggtct

SEQ ID NO: 5961801 - DNA, 17 bp, Homo sapiens
ttgccatccattctgga

SEQ ID NO: 5961802 - DNA, 23 bp, Homo sapiens
ttgccatcccctatggaccagaa

SEQ ID NO: 5961803 - DNA, 23 bp, Homo sapiens
ttgccatccctccctccacctcc

SEQ ID NO: 5961804 - DNA, 21 bp, Homo sapiens
ttgccatcctaaaagccaccc

SEQ ID NO: 5961805 - DNA, 14 bp, Homo sapiens
ttgccatcctgatg

SEQ ID NO: 5961806 - DNA, 17 bp, Homo sapiens
ttgccatctctgctcca

SEQ ID NO: 5961807 - DNA, 20 bp, Homo sapiens
ttgccatgaaggcacctgcc

SEQ ID NO: 5961808 - DNA, 20 bp, Homo sapiens
ttgccatgacatttcatctg

SEQ ID NO: 5961809 - DNA, 14 bp, Homo sapiens
ttgccatgaggcct

SEQ ID NO: 5961810 - DNA, 22 bp, Homo sapiens
ttgccatgcttcagtgaacata

SEQ ID NO: 5961811 - DNA, 20 bp, Homo sapiens
ttgccatggagatctgaagg

SEQ ID NO: 5961812 - DNA, 14 bp, Homo sapiens
ttgccatgggcctg

SEQ ID NO: 5961813 - DNA, 17 bp, Homo sapiens
ttgccatgggcctgctg

SEQ ID NO: 5961814 - DNA, 20 bp, Homo sapiens
ttgccatgggcttcactgta

SEQ ID NO: 5961815 - DNA, 17 bp, Homo sapiens
ttgccatgtagcagaca

SEQ ID NO: 5961816 - DNA, 17 bp, Homo sapiens
ttgccatgttggccagg

SEQ ID NO: 5961817 - DNA, 18 bp, Homo sapiens
ttgccatgttggccaggc

SEQ ID NO: 5961818 - DNA, 18 bp, Homo sapiens
ttgccattataattttga

SEQ ID NO: 5961819 - DNA, 20 bp, Homo sapiens
ttgccattattctatgtagt

SEQ ID NO: 5961820 - DNA, 14 bp, Homo sapiens
ttgccattcctgga

SEQ ID NO: 5961821 - DNA, 17 bp, Homo sapiens
ttgccattgccaggaga

SEQ ID NO: 5961822 - DNA, 17 bp, Homo sapiens
ttgccattggacagttg

SEQ ID NO: 5961823 - DNA, 15 bp, Homo sapiens
ttgccattggtttct

SEQ ID NO: 5961824 - DNA, 14 bp, Homo sapiens
ttgccatttctctg

SEQ ID NO: 5961825 - DNA, 12 bp, Homo sapiens
ttgccatttctt

SEQ ID NO: 5961826 - DNA, 16 bp, Homo sapiens
ttgccatttcttccca

SEQ ID NO: 5961827 - DNA, 13 bp, Homo sapiens
ttgcccaacacca

SEQ ID NO: 5961828 - DNA, 19 bp, Homo sapiens
ttgcccaacaccagcccct

SEQ ID NO: 5961829 - DNA, 17 bp, Homo sapiens
ttgcccaacctcagcaa

SEQ ID NO: 5961830 - DNA, 20 bp, Homo sapiens
ttgcccaagtcacacagcta

SEQ ID NO: 5961831 - DNA, 17 bp, Homo sapiens
ttgcccacacacactcc

SEQ ID NO: 5961832 - DNA, 14 bp, Homo sapiens
ttgcccacacactt

SEQ ID NO: 5961833 - DNA, 23 bp, Homo sapiens
ttgcccacacactttccatctct

SEQ ID NO: 5961834 - DNA, 14 bp, Homo sapiens
ttgcccacaggtgc

SEQ ID NO: 5961835 - DNA, 15 bp, Homo sapiens
ttgcccacccctcac

SEQ ID NO: 5961836 - DNA, 20 bp, Homo sapiens
ttgcccagagcactttagca

SEQ ID NO: 5961837 - DNA, 17 bp, Homo sapiens
ttgcccagataatgata

SEQ ID NO: 5961838 - DNA, 22 bp, Homo sapiens
ttgcccagcattttactgattc

SEQ ID NO: 5961839 - DNA, 14 bp, Homo sapiens
ttgcccagcctgga

SEQ ID NO: 5961840 - DNA, 20 bp, Homo sapiens
ttgcccaggctagagtgcaa

SEQ ID NO: 5961841 - DNA, 20 bp, Homo sapiens
ttgcccaggctggagtgcag

SEQ ID NO: 5961842 - DNA, 20 bp, Homo sapiens
ttgcccagggctcagcctgg

SEQ ID NO: 5961843 - DNA, 13 bp, Homo sapiens
ttgcccagtcctg

SEQ ID NO: 5961844 - DNA, 15 bp, Homo sapiens
ttgcccagtcctggg

SEQ ID NO: 5961845 - DNA, 13 bp, Homo sapiens
ttgcccagtgagc

SEQ ID NO: 5961846 - DNA, 21 bp, Homo sapiens
ttgcccagtgagccctgctct

SEQ ID NO: 5961847 - DNA, 17 bp, Homo sapiens
ttgcccagttcatccca

SEQ ID NO: 5961848 - DNA, 15 bp, Homo sapiens
ttgcccatataaaat

SEQ ID NO: 5961849 - DNA, 18 bp, Homo sapiens
ttgctgctgtccagtgcc

SEQ ID NO: 5961850 - DNA, 13 bp, Homo sapiens
ttgctgctgtgga

SEQ ID NO: 5961851 - DNA, 15 bp, Homo sapiens
ttgctgcttctccca

SEQ ID NO: 5961852 - DNA, 16 bp, Homo sapiens
ttgctgcttgaggcaa

SEQ ID NO: 5961853 - DNA, 15 bp, Homo sapiens
ttgctgctttagtcc

SEQ ID NO: 5961854 - DNA, 22 bp, Homo sapiens
ttgctggaaaactgccacaagc

SEQ ID NO: 5961855 - DNA, 23 bp, Homo sapiens
ttgctggaaaatcatattgagaa

SEQ ID NO: 5961856 - DNA, 13 bp, Homo sapiens
ttgctggaacaca

SEQ ID NO: 5961857 - DNA, 16 bp, Homo sapiens
ttgctggaacacaggg

SEQ ID NO: 5961858 - DNA, 19 bp, Homo sapiens
ttgctggaagaaactaaaa

SEQ ID NO: 5961859 - DNA, 19 bp, Homo sapiens
ttgctggaatctactagaa

SEQ ID NO: 5961860 - DNA, 23 bp, Homo sapiens
ttgctggacctgaattctactga

SEQ ID NO: 5961861 - DNA, 23 bp, Homo sapiens
ttgctggacggggactggggatg

SEQ ID NO: 5961862 - DNA, 13 bp, Homo sapiens
ttgctggaggggc

SEQ ID NO: 5961863 - DNA, 21 bp, Homo sapiens
ttgctggagtcatgtgcctct

SEQ ID NO: 5961864 - DNA, 14 bp, Homo sapiens
ttgctggagtcctg

SEQ ID NO: 5961865 - DNA, 19 bp, Homo sapiens
ttgctggagtgctggctcc

SEQ ID NO: 5961866 - DNA, 17 bp, Homo sapiens
ttgctggatcaggaagc

SEQ ID NO: 5961867 - DNA, 15 bp, Homo sapiens
ttgctggcatgtctt

SEQ ID NO: 5961868 - DNA, 22 bp, Homo sapiens
ttgctggccagtccaccctgcc

SEQ ID NO: 5961869 - DNA, 14 bp, Homo sapiens
ttgctggccccagc

SEQ ID NO: 5961870 - DNA, 14 bp, Homo sapiens
ttgctggctgtgaa

SEQ ID NO: 5961871 - DNA, 22 bp, Homo sapiens
ttgctgggacttggatcccagg

SEQ ID NO: 5961872 - DNA, 23 bp, Homo sapiens
ttgctgggattgttttttcttta

SEQ ID NO: 5961873 - DNA, 13 bp, Homo sapiens
ttgctgggccagg

SEQ ID NO: 5961874 - DNA, 14 bp, Homo sapiens
ttgctgggccaggg

SEQ ID NO: 5961875 - DNA, 15 bp, Homo sapiens
ttgctgggcctgggg

SEQ ID NO: 5961876 - DNA, 11 bp, Homo sapiens
ttgctgggctt

SEQ ID NO: 5961877 - DNA, 15 bp, Homo sapiens
ttgctggggtccagg

SEQ ID NO: 5961878 - DNA, 17 bp, Homo sapiens
ttgctggggtccagggc

SEQ ID NO: 5961879 - DNA, 15 bp, Homo sapiens
ttgctggtaaaatga

SEQ ID NO: 5961880 - DNA, 16 bp, Homo sapiens
ttgctggtcaggtccc

SEQ ID NO: 5961881 - DNA, 19 bp, Homo sapiens
ttgctggtgcaaagataga

SEQ ID NO: 5961882 - DNA, 20 bp, Homo sapiens
ttgctggtgtctgagcttca

SEQ ID NO: 5961883 - DNA, 14 bp, Homo sapiens
ttgctggttgctgt

SEQ ID NO: 5961884 - DNA, 15 bp, Homo sapiens
ttgctggttgctgtg

SEQ ID NO: 5961885 - DNA, 22 bp, Homo sapiens
ttgctggttgtaaatactttgt

SEQ ID NO: 5961886 - DNA, 13 bp, Homo sapiens
ttgctgtaaaatt

SEQ ID NO: 5961887 - DNA, 23 bp, Homo sapiens
ttgctgtaaataaaaatagctat

SEQ ID NO: 5961888 - DNA, 21 bp, Homo sapiens
ttgctgtaccacatctgctct

SEQ ID NO: 5961889 - DNA, 16 bp, Homo sapiens
ttgctgtactcttgct

SEQ ID NO: 5961890 - DNA, 12 bp, Homo sapiens
ttgctgtagaaa

SEQ ID NO: 5961891 - DNA, 17 bp, Homo sapiens
ttgctgtagtgtttctt

SEQ ID NO: 5961892 - DNA, 17 bp, Homo sapiens
ttgctgtatacaaacag

SEQ ID NO: 5961893 - DNA, 18 bp, Homo sapiens
ttgctgtatgctgatcat

SEQ ID NO: 5961894 - DNA, 17 bp, Homo sapiens
ttgctgtcaagccattt

SEQ ID NO: 5961895 - DNA, 20 bp, Homo sapiens
ttgctgtcacttcttcacct

SEQ ID NO: 5961896 - DNA, 13 bp, Homo sapiens
ttgctgtcacttt

SEQ ID NO: 5961897 - DNA, 20 bp, Homo sapiens
ttgctgtcactttctctctt

SEQ ID NO: 5961898 - DNA, 22 bp, Homo sapiens
ttgctgtcatgtgaatccctca

SEQ ID NO: 5961899 - DNA, 11 bp, Homo sapiens
ttgctgtccta

SEQ ID NO: 5961900 - DNA, 20 bp, Homo sapiens
ttgctgtcctccagggcgag

SEQ ID NO: 5961901 - DNA, 16 bp, Homo sapiens
ttgctgtcctgatctg

SEQ ID NO: 5961902 - DNA, 23 bp, Homo sapiens
ttgctgtctacagtagctgctac

SEQ ID NO: 5961903 - DNA, 14 bp, Homo sapiens
ttgctgtctctgct

SEQ ID NO: 5961904 - DNA, 15 bp, Homo sapiens
ttgctgtctctgctc

SEQ ID NO: 5961905 - DNA, 16 bp, Homo sapiens
ttgctgtctctgctcg

SEQ ID NO: 5961906 - DNA, 14 bp, Homo sapiens
ttgctgtctgaaaa

SEQ ID NO: 5961907 - DNA, 18 bp, Homo sapiens
ttgctgtctggctttccc

SEQ ID NO: 5961908 - DNA, 17 bp, Homo sapiens
ttgctgtgaaacagtgt

SEQ ID NO: 5961909 - DNA, 17 bp, Homo sapiens
ttgctgtgaaatgactg

SEQ ID NO: 5961910 - DNA, 19 bp, Homo sapiens
ttgctgtgacagtgatggc

SEQ ID NO: 5961911 - DNA, 16 bp, Homo sapiens
ttgctgtgactagata

SEQ ID NO: 5961912 - DNA, 15 bp, Homo sapiens
ttgctgtgccaaagc

SEQ ID NO: 5961913 - DNA, 14 bp, Homo sapiens
ttgctgtgcctccc

SEQ ID NO: 5961914 - DNA, 20 bp, Homo sapiens
ttgctgtgctgtacattact

SEQ ID NO: 5961915 - DNA, 20 bp, Homo sapiens
ttgctgtgcttcaaactact

SEQ ID NO: 5961916 - DNA, 17 bp, Homo sapiens
ttgctgtgctttggaac

SEQ ID NO: 5961917 - DNA, 13 bp, Homo sapiens
ttgctgtggagct

SEQ ID NO: 5961918 - DNA, 13 bp, Homo sapiens
ttgctgtgggaac

SEQ ID NO: 5961919 - DNA, 22 bp, Homo sapiens
ttgctgtgtagttccctctgcc

SEQ ID NO: 5961920 - DNA, 19 bp, Homo sapiens
ttgctgtgtccaactccag

SEQ ID NO: 5961921 - DNA, 18 bp, Homo sapiens
ttgctgtgtcttcatttt

SEQ ID NO: 5961922 - DNA, 20 bp, Homo sapiens
ttgctgtgtgaccctgggca

SEQ ID NO: 5961923 - DNA, 20 bp, Homo sapiens
ttgctgtgtgtcccaggcag

SEQ ID NO: 5961924 - DNA, 13 bp, Homo sapiens
ttgctgttattat

SEQ ID NO: 5961925 - DNA, 21 bp, Homo sapiens
ttgctgttcagtgctttttcc

SEQ ID NO: 5961926 - DNA, 21 bp, Homo sapiens
ttgctgttcatcttgtacaaa

SEQ ID NO: 5961927 - DNA, 22 bp, Homo sapiens
ttgctgttgaaagcaaaaatgc

SEQ ID NO: 5961928 - DNA, 23 bp, Homo sapiens
ttgctgttgaaagcaaaaatgct

SEQ ID NO: 5961929 - DNA, 20 bp, Homo sapiens
ttgctgttgacatatttaat

SEQ ID NO: 5961930 - DNA, 13 bp, Homo sapiens
ttgctgttgctgt

SEQ ID NO: 5961931 - DNA, 18 bp, Homo sapiens
ttgctgttgctgttgctg

SEQ ID NO: 5961932 - DNA, 17 bp, Homo sapiens
ttgctgttgttgcaggg

SEQ ID NO: 5961933 - DNA, 18 bp, Homo sapiens
ttgctgttgttgcaggga

SEQ ID NO: 5961934 - DNA, 20 bp, Homo sapiens
ttgctgttgttgttaatttt

SEQ ID NO: 5961935 - DNA, 14 bp, Homo sapiens
ttgctgttgtttct

SEQ ID NO: 5961936 - DNA, 21 bp, Homo sapiens
ttgctgtttagagtaaataaa

SEQ ID NO: 5961937 - DNA, 13 bp, Homo sapiens
ttgctgttttaat

SEQ ID NO: 5961938 - DNA, 18 bp, Homo sapiens
ttgctgttttcctccctt

SEQ ID NO: 5961939 - DNA, 22 bp, Homo sapiens
ttgctgttttcctcccttctgc

SEQ ID NO: 5961940 - DNA, 21 bp, Homo sapiens
ttgctgttttgttctgtggtt

SEQ ID NO: 5961941 - DNA, 16 bp, Homo sapiens
ttgctgtttttcttgt

SEQ ID NO: 5961942 - DNA, 13 bp, Homo sapiens
ttgcttaaaagca

SEQ ID NO: 5961943 - DNA, 15 bp, Homo sapiens
ttgcttaaaatatgt

SEQ ID NO: 5961944 - DNA, 17 bp, Homo sapiens
ttgcttaaaatatgtga

SEQ ID NO: 5961945 - DNA, 23 bp, Homo sapiens
ttgcttaaaatatgtgaagtttt

SEQ ID NO: 5961946 - DNA, 12 bp, Homo sapiens
ttgcttaaacaa

SEQ ID NO: 5961947 - DNA, 13 bp, Homo sapiens
ttgcttaaatgtg

SEQ ID NO: 5961948 - DNA, 16 bp, Homo sapiens
ttgcttaaatgtgaat

SEQ ID NO: 5961949 - DNA, 13 bp, Homo sapiens
ttgcttaacatta

SEQ ID NO: 5961950 - DNA, 15 bp, Homo sapiens
ttgcttaactggctg

SEQ ID NO: 5961951 - DNA, 23 bp, Homo sapiens
ttgcttaacttccatgttctggg

SEQ ID NO: 5961952 - DNA, 15 bp, Homo sapiens
ttgcttaagatgcta

SEQ ID NO: 5961953 - DNA, 19 bp, Homo sapiens
ttgcttaaggcatactttt

SEQ ID NO: 5961954 - DNA, 14 bp, Homo sapiens
ttgcttacctctca

SEQ ID NO: 5961955 - DNA, 17 bp, Homo sapiens
ttgcttaccttttccta

SEQ ID NO: 5961956 - DNA, 23 bp, Homo sapiens
ttgcttaccttttcctattctgt

SEQ ID NO: 5961957 - DNA, 12 bp, Homo sapiens
ttgcttactaag

SEQ ID NO: 5961958 - DNA, 23 bp, Homo sapiens
ttgcttagtatctaataatgaag

SEQ ID NO: 5961959 - DNA, 19 bp, Homo sapiens
ttgcttagtatggttctca

SEQ ID NO: 5961960 - DNA, 21 bp, Homo sapiens
ttgcttagtatggttctcaga

SEQ ID NO: 5961961 - DNA, 12 bp, Homo sapiens
ttgcttatgaat

SEQ ID NO: 5961962 - DNA, 21 bp, Homo sapiens
ttgcttattgtaacaggcttt

SEQ ID NO: 5961963 - DNA, 16 bp, Homo sapiens
ttgcttattgttccaa

SEQ ID NO: 5961964 - DNA, 22 bp, Homo sapiens
ttgcttattgttccaagacatt

SEQ ID NO: 5961965 - DNA, 16 bp, Homo sapiens
ttgcttatttaataaa

SEQ ID NO: 5961966 - DNA, 16 bp, Homo sapiens
ttgcttatttatattc

SEQ ID NO: 5961967 - DNA, 19 bp, Homo sapiens
ttgcttatttttataatta

SEQ ID NO: 5961968 - DNA, 18 bp, Homo sapiens
ttgcttcaaattggtctg

SEQ ID NO: 5961969 - DNA, 16 bp, Homo sapiens
ttgcttcaatttcaaa

SEQ ID NO: 5961970 - DNA, 22 bp, Homo sapiens
ttgcttcaccatggccttatga

SEQ ID NO: 5961971 - DNA, 24 bp, Homo sapiens
ttgcttcactttgccttctggtta

SEQ ID NO: 5961972 - DNA, 23 bp, Homo sapiens
ttgcttcagctgctgaagggagg

SEQ ID NO: 5961973 - DNA, 21 bp, Homo sapiens
ttgcttcatagctggttcctg

SEQ ID NO: 5961974 - DNA, 17 bp, Homo sapiens
ttgcttcattaaaacaa

SEQ ID NO: 5961975 - DNA, 15 bp, Homo sapiens
ttgcttccaagacca

SEQ ID NO: 5961976 - DNA, 14 bp, Homo sapiens
ttgcttcccctcca

SEQ ID NO: 5961977 - DNA, 17 bp, Homo sapiens
ttgcttccccttttgcc

SEQ ID NO: 5961978 - DNA, 18 bp, Homo sapiens
ttgcttcccgctgcacat

SEQ ID NO: 5961979 - DNA, 15 bp, Homo sapiens
ttgcttccgccactc

SEQ ID NO: 5961980 - DNA, 22 bp, Homo sapiens
ttgcttcctcagtaacatttct

SEQ ID NO: 5961981 - DNA, 14 bp, Homo sapiens
ttgcttcctcctcc

SEQ ID NO: 5961982 - DNA, 15 bp, Homo sapiens
ttgcttcctcctccc

SEQ ID NO: 5961983 - DNA, 23 bp, Homo sapiens
ttgcttcctgtgtaacatctgcc

SEQ ID NO: 5961984 - DNA, 14 bp, Homo sapiens
ttgcttccttctca

SEQ ID NO: 5961985 - DNA, 23 bp, Homo sapiens
ttgcttctaggagtcaactggct

SEQ ID NO: 5961986 - DNA, 18 bp, Homo sapiens
ttgcttctcccatttcct

SEQ ID NO: 5961987 - DNA, 14 bp, Homo sapiens
ttgcttctgaatca

SEQ ID NO: 5961988 - DNA, 12 bp, Homo sapiens
ttgcttctgtag

SEQ ID NO: 5961989 - DNA, 18 bp, Homo sapiens
ttgcttctgtatttcctt

SEQ ID NO: 5961990 - DNA, 23 bp, Homo sapiens
ttgcttcttatggtataataaag

SEQ ID NO: 5961991 - DNA, 21 bp, Homo sapiens
ttgcttcttcccttaaaattt

SEQ ID NO: 5961992 - DNA, 21 bp, Homo sapiens
ttgcttcttgtgaaggccatg

SEQ ID NO: 5961993 - DNA, 14 bp, Homo sapiens
ttgcttcttgtgtt

SEQ ID NO: 5961994 - DNA, 20 bp, Homo sapiens
ttgcttctttctagaaagag

SEQ ID NO: 5961995 - DNA, 12 bp, Homo sapiens
ttgcttgaaaga

SEQ ID NO: 5961996 - DNA, 15 bp, Homo sapiens
ttgcttgaaagaaaa

SEQ ID NO: 5961997 - DNA, 16 bp, Homo sapiens
ttgcttgaacacagta

SEQ ID NO: 5961998 - DNA, 19 bp, Homo sapiens
ttgcttgaacacagtattt

SEQ ID NO: 5961999 - DNA, 21 bp, Homo sapiens
ttgcttgaacacagtattttc

SEQ ID NO: 5962000 - DNA, 22 bp, Homo sapiens
ttgcttgaacctgtgaggaaga

SEQ ID NO: 5962001 - DNA, 21 bp, Homo sapiens
ttgcttgaagcaaacagttga

SEQ ID NO: 5962002 - DNA, 15 bp, Homo sapiens
ttgcttgactctact

SEQ ID NO: 5962003 - DNA, 16 bp, Homo sapiens
ttgcttgagcaggatt

SEQ ID NO: 5962004 - DNA, 19 bp, Homo sapiens
ttgcttgagcccagaactt

SEQ ID NO: 5962005 - DNA, 16 bp, Homo sapiens
ttgcttgagcccagga

SEQ ID NO: 5962006 - DNA, 15 bp, Homo sapiens
ttgcttgagctcagg

SEQ ID NO: 5962007 - DNA, 14 bp, Homo sapiens
ttgcttgagcttgg

SEQ ID NO: 5962008 - DNA, 13 bp, Homo sapiens
ttgcttgatccag

SEQ ID NO: 5962009 - DNA, 16 bp, Homo sapiens
ttgcttgattaaacag

SEQ ID NO: 5962010 - DNA, 23 bp, Homo sapiens
ttgcttgcaatctaatctgaact

SEQ ID NO: 5962011 - DNA, 20 bp, Homo sapiens
ttgcttgcagtagattttct

SEQ ID NO: 5962012 - DNA, 22 bp, Homo sapiens
ttgcttgccgagcctaatgaaa

SEQ ID NO: 5962013 - DNA, 16 bp, Homo sapiens
ttgcttgcctctctgt

SEQ ID NO: 5962014 - DNA, 18 bp, Homo sapiens
ttgcttggactacctata

SEQ ID NO: 5962015 - DNA, 14 bp, Homo sapiens
ttgcttggctgctt

SEQ ID NO: 5962016 - DNA, 19 bp, Homo sapiens
ttgcttggctgcttggcct

SEQ ID NO: 5962017 - DNA, 20 bp, Homo sapiens
ttgcttggtgctggtttatt

SEQ ID NO: 5962018 - DNA, 21 bp, Homo sapiens
ttgcttgtaaaaccaactaaa

SEQ ID NO: 5962019 - DNA, 14 bp, Homo sapiens
ttgcttgtacagtg

SEQ ID NO: 5962020 - DNA, 15 bp, Homo sapiens
ttgcttgtattgtaa

SEQ ID NO: 5962021 - DNA, 24 bp, Homo sapiens
ttgcttgttgggattcctgaccca

SEQ ID NO: 5962022 - DNA, 23 bp, Homo sapiens
ttgctttaaagagtcctccttcc

SEQ ID NO: 5962023 - DNA, 23 bp, Homo sapiens
ttgctttaaagtacctgtagtga

SEQ ID NO: 5962024 - DNA, 16 bp, Homo sapiens
ttgctttaatataaat

SEQ ID NO: 5962025 - DNA, 19 bp, Homo sapiens
ttgctttaatataaatgca

SEQ ID NO: 5962026 - DNA, 17 bp, Homo sapiens
ttggccctgcccctccc

SEQ ID NO: 5962027 - DNA, 23 bp, Homo sapiens
ttggccctgcccctccccctacc

SEQ ID NO: 5962028 - DNA, 16 bp, Homo sapiens
ttggccctggagccag

SEQ ID NO: 5962029 - DNA, 15 bp, Homo sapiens
ttggcccttccagtg

SEQ ID NO: 5962030 - DNA, 16 bp, Homo sapiens
ttggcccttctgccct

SEQ ID NO: 5962031 - DNA, 19 bp, Homo sapiens
ttggccctttccttccaga

SEQ ID NO: 5962032 - DNA, 19 bp, Homo sapiens
ttggccgagctcctgggga

SEQ ID NO: 5962033 - DNA, 22 bp, Homo sapiens
ttggccgcacctaaagcagcca

SEQ ID NO: 5962034 - DNA, 17 bp, Homo sapiens
ttggccgccatccggga

SEQ ID NO: 5962035 - DNA, 19 bp, Homo sapiens
ttggccgccatccgggacg

SEQ ID NO: 5962036 - DNA, 14 bp, Homo sapiens
ttggccggctggcc

SEQ ID NO: 5962037 - DNA, 19 bp, Homo sapiens
ttggccggctgtgctcaga

SEQ ID NO: 5962038 - DNA, 22 bp, Homo sapiens
ttggccgtggccatcagggtgg

SEQ ID NO: 5962039 - DNA, 23 bp, Homo sapiens
ttggcctagcccaccctgctgcc

SEQ ID NO: 5962040 - DNA, 20 bp, Homo sapiens
ttggcctatctcctagggct

SEQ ID NO: 5962041 - DNA, 12 bp, Homo sapiens
ttggcctcagaa

SEQ ID NO: 5962042 - DNA, 16 bp, Homo sapiens
ttggcctcagcagaag

SEQ ID NO: 5962043 - DNA, 22 bp, Homo sapiens
ttggcctcagcagaaggccttg

SEQ ID NO: 5962044 - DNA, 22 bp, Homo sapiens
ttggcctcagggccaggaagga

SEQ ID NO: 5962045 - DNA, 18 bp, Homo sapiens
ttggcctcatctctgcct

SEQ ID NO: 5962046 - DNA, 20 bp, Homo sapiens
ttggcctcatctctgcctga

SEQ ID NO: 5962047 - DNA, 21 bp, Homo sapiens
ttggcctcgcctgggcccagg

SEQ ID NO: 5962048 - DNA, 16 bp, Homo sapiens
ttggcctctctctagg

SEQ ID NO: 5962049 - DNA, 12 bp, Homo sapiens
ttggcctctgct

SEQ ID NO: 5962050 - DNA, 20 bp, Homo sapiens
ttggcctgaacagatgtaaa

SEQ ID NO: 5962051 - DNA, 23 bp, Homo sapiens
ttggcctgagatgcctggtgagc

SEQ ID NO: 5962052 - DNA, 19 bp, Homo sapiens
ttggcctgatcagaccacg

SEQ ID NO: 5962053 - DNA, 12 bp, Homo sapiens
ttggcctgctgt

SEQ ID NO: 5962054 - DNA, 13 bp, Homo sapiens
ttggcctggagag

SEQ ID NO: 5962055 - DNA, 14 bp, Homo sapiens
ttggcctggcctcc

SEQ ID NO: 5962056 - DNA, 16 bp, Homo sapiens
ttggcctggcctccag

SEQ ID NO: 5962057 - DNA, 16 bp, Homo sapiens
ttggcctgtctcatcc

SEQ ID NO: 5962058 - DNA, 13 bp, Homo sapiens
ttggcctgtgagc

SEQ ID NO: 5962059 - DNA, 20 bp, Homo sapiens
ttggcctgtgatgttttatc

SEQ ID NO: 5962060 - DNA, 14 bp, Homo sapiens
ttggcctgtgggcc

SEQ ID NO: 5962061 - DNA, 11 bp, Homo sapiens
ttggccttaag

SEQ ID NO: 5962062 - DNA, 22 bp, Homo sapiens
ttggccttcagaaccatccata

SEQ ID NO: 5962063 - DNA, 22 bp, Homo sapiens
ttggccttctcccctcttctga

SEQ ID NO: 5962064 - DNA, 20 bp, Homo sapiens
ttggccttgcagctggccca

SEQ ID NO: 5962065 - DNA, 15 bp, Homo sapiens
ttggccttgggccgg

SEQ ID NO: 5962066 - DNA, 16 bp, Homo sapiens
ttggccttgggccggt

SEQ ID NO: 5962067 - DNA, 16 bp, Homo sapiens
ttggcctttcctggaa

SEQ ID NO: 5962068 - DNA, 13 bp, Homo sapiens
ttggcctttttac

SEQ ID NO: 5962069 - DNA, 23 bp, Homo sapiens
ttggcgatgaggtaattctccct

SEQ ID NO: 5962070 - DNA, 15 bp, Homo sapiens
ttggcgcaccctccc

SEQ ID NO: 5962071 - DNA, 17 bp, Homo sapiens
ttggcgcaccctcccct

SEQ ID NO: 5962072 - DNA, 16 bp, Homo sapiens
ttggcgctattacaaa

SEQ ID NO: 5962073 - DNA, 17 bp, Homo sapiens
ttggcgctattacaaat

SEQ ID NO: 5962074 - DNA, 16 bp, Homo sapiens
ttggcgctctcagctt

SEQ ID NO: 5962075 - DNA, 22 bp, Homo sapiens
ttggcgctgcccctggcagccc

SEQ ID NO: 5962076 - DNA, 14 bp, Homo sapiens
ttggcgctggagag

SEQ ID NO: 5962077 - DNA, 12 bp, Homo sapiens
ttggcggaggga

SEQ ID NO: 5962078 - DNA, 14 bp, Homo sapiens
ttggcgggccaagg

SEQ ID NO: 5962079 - DNA, 22 bp, Homo sapiens
ttggcgtagcagagttaaatct

SEQ ID NO: 5962080 - DNA, 19 bp, Homo sapiens
ttggcgtaggctacagaga

SEQ ID NO: 5962081 - DNA, 14 bp, Homo sapiens
ttggcgttcctgcc

SEQ ID NO: 5962082 - DNA, 16 bp, Homo sapiens
ttggctaacatagcac

SEQ ID NO: 5962083 - DNA, 22 bp, Homo sapiens
ttggctaacatagcacagtatt

SEQ ID NO: 5962084 - DNA, 15 bp, Homo sapiens
ttggctactgactgt

SEQ ID NO: 5962085 - DNA, 17 bp, Homo sapiens
ttggctagaagaaagta

SEQ ID NO: 5962086 - DNA, 20 bp, Homo sapiens
ttggctagaatcagggtgga

SEQ ID NO: 5962087 - DNA, 23 bp, Homo sapiens
ttggctagagcttctgtattttc

SEQ ID NO: 5962088 - DNA, 17 bp, Homo sapiens
ttggctataagtgctca

SEQ ID NO: 5962089 - DNA, 19 bp, Homo sapiens
ttggctatgaaaatgagcc

SEQ ID NO: 5962090 - DNA, 20 bp, Homo sapiens
ttggctatgaaaatgagccc

SEQ ID NO: 5962091 - DNA, 23 bp, Homo sapiens
ttggctattagagatcaacccct

SEQ ID NO: 5962092 - DNA, 22 bp, Homo sapiens
ttggctattgaagatgctgcct

SEQ ID NO: 5962093 - DNA, 20 bp, Homo sapiens
ttggctattgtccttgtgta

SEQ ID NO: 5962094 - DNA, 21 bp, Homo sapiens
ttggctattgtccttgtgtat

SEQ ID NO: 5962095 - DNA, 21 bp, Homo sapiens
ttggctatttgaaatactaaa

SEQ ID NO: 5962096 - DNA, 16 bp, Homo sapiens
ttggctcacactgaga

SEQ ID NO: 5962097 - DNA, 14 bp, Homo sapiens
ttggctcagaaaat

SEQ ID NO: 5962098 - DNA, 15 bp, Homo sapiens
ttggctcagagtcca

SEQ ID NO: 5962099 - DNA, 15 bp, Homo sapiens
ttggctcctttccca

SEQ ID NO: 5962100 - DNA, 17 bp, Homo sapiens
ttggctcctttcccaca

SEQ ID NO: 5962101 - DNA, 17 bp, Homo sapiens
ttggctcgaatctctgt

SEQ ID NO: 5962102 - DNA, 20 bp, Homo sapiens
ttggctcgaatctctgtgcc

SEQ ID NO: 5962103 - DNA, 13 bp, Homo sapiens
ttggctctactcc

SEQ ID NO: 5962104 - DNA, 22 bp, Homo sapiens
ttggctctattggatttgtcca

SEQ ID NO: 5962105 - DNA, 15 bp, Homo sapiens
ttggctctcccaccc

SEQ ID NO: 5962106 - DNA, 14 bp, Homo sapiens
ttggctctctgacg

SEQ ID NO: 5962107 - DNA, 13 bp, Homo sapiens
ttggctctggaga

SEQ ID NO: 5962108 - DNA, 23 bp, Homo sapiens
ttggctctggagacagccccaga

SEQ ID NO: 5962109 - DNA, 19 bp, Homo sapiens
ttggctcttggcttccaga

SEQ ID NO: 5962110 - DNA, 11 bp, Homo sapiens
ttggctctttc

SEQ ID NO: 5962111 - DNA, 20 bp, Homo sapiens
ttggctgaaattctcctgga

SEQ ID NO: 5962112 - DNA, 21 bp, Homo sapiens
ttggctgaaattctcctggag

SEQ ID NO: 5962113 - DNA, 12 bp, Homo sapiens
ttggctgagacc

SEQ ID NO: 5962114 - DNA, 18 bp, Homo sapiens
ttggctgagacctgggat

SEQ ID NO: 5962115 - DNA, 18 bp, Homo sapiens
ttggctgagggattctat

SEQ ID NO: 5962116 - DNA, 18 bp, Homo sapiens
ttggctgaggggcttggg

SEQ ID NO: 5962117 - DNA, 17 bp, Homo sapiens
ttggctgagtactggaa

SEQ ID NO: 5962118 - DNA, 15 bp, Homo sapiens
ttggctgattggaaa

SEQ ID NO: 5962119 - DNA, 20 bp, Homo sapiens
ttggctgattggaaaataat

SEQ ID NO: 5962120 - DNA, 23 bp, Homo sapiens
ttggctgcacgtcaccctcctga

SEQ ID NO: 5962121 - DNA, 12 bp, Homo sapiens
ttggctgcagcc

SEQ ID NO: 5962122 - DNA, 15 bp, Homo sapiens
ttggctgcagccatc

SEQ ID NO: 5962123 - DNA, 16 bp, Homo sapiens
ttggctgcagccatcc

SEQ ID NO: 5962124 - DNA, 22 bp, Homo sapiens
ttggctgcaggaagaaactttt

SEQ ID NO: 5962125 - DNA, 17 bp, Homo sapiens
ttggctgcatttgcctg

SEQ ID NO: 5962126 - DNA, 19 bp, Homo sapiens
ttggctgccaagagtccaa

SEQ ID NO: 5962127 - DNA, 20 bp, Homo sapiens
ttggctgcgtactccactgg

SEQ ID NO: 5962128 - DNA, 16 bp, Homo sapiens
ttggctgctcattcct

SEQ ID NO: 5962129 - DNA, 19 bp, Homo sapiens
ttggctgctcattccttct

SEQ ID NO: 5962130 - DNA, 14 bp, Homo sapiens
ttggctgctgccac

SEQ ID NO: 5962131 - DNA, 15 bp, Homo sapiens
ttggctggacccagc

SEQ ID NO: 5962132 - DNA, 21 bp, Homo sapiens
ttggctggactgtagaaggtg

SEQ ID NO: 5962133 - DNA, 16 bp, Homo sapiens
ttggctgggcccagaa

SEQ ID NO: 5962134 - DNA, 17 bp, Homo sapiens
ttggctgggcccagaag

SEQ ID NO: 5962135 - DNA, 20 bp, Homo sapiens
ttggctgggctacaatttgt

SEQ ID NO: 5962136 - DNA, 19 bp, Homo sapiens
ttggctggggaggaccagg

SEQ ID NO: 5962137 - DNA, 23 bp, Homo sapiens
ttggctgggggcatgggggaggc

SEQ ID NO: 5962138 - DNA, 18 bp, Homo sapiens
ttggctgggggcctcagt

SEQ ID NO: 5962139 - DNA, 21 bp, Homo sapiens
ttggctggtgtggtacagaga

SEQ ID NO: 5962140 - DNA, 19 bp, Homo sapiens
ttggctggttaatgggaaa

SEQ ID NO: 5962141 - DNA, 18 bp, Homo sapiens
ttggctgtccttcccctt

SEQ ID NO: 5962142 - DNA, 22 bp, Homo sapiens
ttggctgtgatgtcacagtttg

SEQ ID NO: 5962143 - DNA, 23 bp, Homo sapiens
ttggctgtgtctaaactgcatta

SEQ ID NO: 5962144 - DNA, 23 bp, Homo sapiens
ttggctgttaagaagtttgttat

SEQ ID NO: 5962145 - DNA, 15 bp, Homo sapiens
ttggctgttccagac

SEQ ID NO: 5962146 - DNA, 13 bp, Homo sapiens
ttggcttaaaaat

SEQ ID NO: 5962147 - DNA, 18 bp, Homo sapiens
ttggcttaaagggatgga

SEQ ID NO: 5962148 - DNA, 16 bp, Homo sapiens
ttggcttaaagtgaag

SEQ ID NO: 5962149 - DNA, 17 bp, Homo sapiens
ttggcttaatttaatgt

SEQ ID NO: 5962150 - DNA, 16 bp, Homo sapiens
ttggcttacctgacct

SEQ ID NO: 5962151 - DNA, 17 bp, Homo sapiens
ttggcttataattcttt

SEQ ID NO: 5962152 - DNA, 19 bp, Homo sapiens
ttggcttataattctttca

SEQ ID NO: 5962153 - DNA, 13 bp, Homo sapiens
ttggcttattttt

SEQ ID NO: 5962154 - DNA, 22 bp, Homo sapiens
ttggcttattttttaaaataat

SEQ ID NO: 5962155 - DNA, 23 bp, Homo sapiens
ttggcttcacggaagagccttgc

SEQ ID NO: 5962156 - DNA, 15 bp, Homo sapiens
ttggcttcagaattg

SEQ ID NO: 5962157 - DNA, 17 bp, Homo sapiens
ttggcttcatttcaatc

SEQ ID NO: 5962158 - DNA, 21 bp, Homo sapiens
ttggcttcatttcaatcattg

SEQ ID NO: 5962159 - DNA, 21 bp, Homo sapiens
ttggcttccagattttaaatt

SEQ ID NO: 5962160 - DNA, 21 bp, Homo sapiens
ttggcttccatgatggttatt

SEQ ID NO: 5962161 - DNA, 16 bp, Homo sapiens
ttggcttcctctgctg

SEQ ID NO: 5962162 - DNA, 17 bp, Homo sapiens
ttggcttcctctgctgc

SEQ ID NO: 5962163 - DNA, 11 bp, Homo sapiens
ttggcttcctg

SEQ ID NO: 5962164 - DNA, 13 bp, Homo sapiens
ttggcttcctggc

SEQ ID NO: 5962165 - DNA, 16 bp, Homo sapiens
ttggcttcctggcgcc

SEQ ID NO: 5962166 - DNA, 16 bp, Homo sapiens
ttggcttctcctgtga

SEQ ID NO: 5962167 - DNA, 18 bp, Homo sapiens
ttggcttctcctgtgacc

SEQ ID NO: 5962168 - DNA, 19 bp, Homo sapiens
ttggcttctcctgtgaccc

SEQ ID NO: 5962169 - DNA, 14 bp, Homo sapiens
ttggcttctgtgcc

SEQ ID NO: 5962170 - DNA, 15 bp, Homo sapiens
ttggcttctgtgcct

SEQ ID NO: 5962171 - DNA, 16 bp, Homo sapiens
ttggcttctgtttcta

SEQ ID NO: 5962172 - DNA, 16 bp, Homo sapiens
ttggcttcttaaaaac

SEQ ID NO: 5962173 - DNA, 21 bp, Homo sapiens
ttggcttcttaaaaactgtgt

SEQ ID NO: 5962174 - DNA, 20 bp, Homo sapiens
ttggcttctttgctttctcg

SEQ ID NO: 5962175 - DNA, 14 bp, Homo sapiens
ttggcttgactcag

SEQ ID NO: 5962176 - DNA, 16 bp, Homo sapiens
ttggcttgataaacat

SEQ ID NO: 5962177 - DNA, 14 bp, Homo sapiens
ttggcttgcacttt

SEQ ID NO: 5962178 - DNA, 16 bp, Homo sapiens
ttggcttgccattttt

SEQ ID NO: 5962179 - DNA, 17 bp, Homo sapiens
ttggcttgcttatgtgt

SEQ ID NO: 5962180 - DNA, 13 bp, Homo sapiens
ttggcttggccct

SEQ ID NO: 5962181 - DNA, 18 bp, Homo sapiens
ttggcttgtagaattgtt

SEQ ID NO: 5962182 - DNA, 18 bp, Homo sapiens
ttggcttgttttattttg

SEQ ID NO: 5962183 - DNA, 22 bp, Homo sapiens
ttggctttaaccgtttttcaag

SEQ ID NO: 5962184 - DNA, 17 bp, Homo sapiens
ttggctttacaaataat

SEQ ID NO: 5962185 - DNA, 16 bp, Homo sapiens
ttggctttatgcaaat

SEQ ID NO: 5962186 - DNA, 20 bp, Homo sapiens
ttggctttatgcaaatacaa

SEQ ID NO: 5962187 - DNA, 19 bp, Homo sapiens
ttggctttcagagccagcc

SEQ ID NO: 5962188 - DNA, 23 bp, Homo sapiens
ttggctttcagagccagcctggc

SEQ ID NO: 5962189 - DNA, 20 bp, Homo sapiens
ttggctttcgatgcgtgtgt

SEQ ID NO: 5962190 - DNA, 12 bp, Homo sapiens
ttggctttgcag

SEQ ID NO: 5962191 - DNA, 17 bp, Homo sapiens
ttggctttgcagctgct

SEQ ID NO: 5962192 - DNA, 15 bp, Homo sapiens
ttggctttgcccacc

SEQ ID NO: 5962193 - DNA, 22 bp, Homo sapiens
ttggctttgggttgcaggacct

SEQ ID NO: 5962194 - DNA, 16 bp, Homo sapiens
ttggctttgtttggat

SEQ ID NO: 5962195 - DNA, 16 bp, Homo sapiens
ttggctttttcagagt

SEQ ID NO: 5962196 - DNA, 15 bp, Homo sapiens
ttgggaaaaattatt

SEQ ID NO: 5962197 - DNA, 19 bp, Homo sapiens
ttgggaaaaattatttgtg

SEQ ID NO: 5962198 - DNA, 20 bp, Homo sapiens
ttgggaaaaattatttgtgt

SEQ ID NO: 5962199 - DNA, 16 bp, Homo sapiens
ttgggaaaacatgtta

SEQ ID NO: 5962200 - DNA, 22 bp, Homo sapiens
ttgggaaagatggataaactga

SEQ ID NO: 5962201 - DNA, 14 bp, Homo sapiens
ttgggaaagcccag

SEQ ID NO: 5962202 - DNA, 17 bp, Homo sapiens
ttgggaaagcccagact

SEQ ID NO: 5962203 - DNA, 22 bp, Homo sapiens
ttgtaagcgtatggctttattt

SEQ ID NO: 5962204 - DNA, 17 bp, Homo sapiens
ttgtaagctataacata

SEQ ID NO: 5962205 - DNA, 19 bp, Homo sapiens
ttgtaagctataacatatt

SEQ ID NO: 5962206 - DNA, 21 bp, Homo sapiens
ttgtaaggattgcctttgtag

SEQ ID NO: 5962207 - DNA, 18 bp, Homo sapiens
ttgtaaggtctttgtaaa

SEQ ID NO: 5962208 - DNA, 20 bp, Homo sapiens
ttgtaaggtctttgtaaaat

SEQ ID NO: 5962209 - DNA, 21 bp, Homo sapiens
ttgtaaggtctttgtaaaatc

SEQ ID NO: 5962210 - DNA, 21 bp, Homo sapiens
ttgtaagtaacaatatgtaat

SEQ ID NO: 5962211 - DNA, 18 bp, Homo sapiens
ttgtaagtaacacagtat

SEQ ID NO: 5962212 - DNA, 19 bp, Homo sapiens
ttgtaagtaagtaagaaag

SEQ ID NO: 5962213 - DNA, 12 bp, Homo sapiens
ttgtaagtcatc

SEQ ID NO: 5962214 - DNA, 21 bp, Homo sapiens
ttgtaagtgagagagacaaga

SEQ ID NO: 5962215 - DNA, 18 bp, Homo sapiens
ttgtaagtgagtgtgctg

SEQ ID NO: 5962216 - DNA, 21 bp, Homo sapiens
ttgtaagtgctacataaattg

SEQ ID NO: 5962217 - DNA, 19 bp, Homo sapiens
ttgtaagttgtacaaatgt

SEQ ID NO: 5962218 - DNA, 12 bp, Homo sapiens
ttgtaagtttat

SEQ ID NO: 5962219 - DNA, 16 bp, Homo sapiens
ttgtaagtttcaggtg

SEQ ID NO: 5962220 - DNA, 19 bp, Homo sapiens
ttgtaagtttcaggtgaca

SEQ ID NO: 5962221 - DNA, 14 bp, Homo sapiens
ttgtaagtttgaat

SEQ ID NO: 5962222 - DNA, 20 bp, Homo sapiens
ttgtaataaaactatttgta

SEQ ID NO: 5962223 - DNA, 14 bp, Homo sapiens
ttgtaataaaatgt

SEQ ID NO: 5962224 - DNA, 15 bp, Homo sapiens
ttgtaataaactctc

SEQ ID NO: 5962225 - DNA, 15 bp, Homo sapiens
ttgtaataacattta

SEQ ID NO: 5962226 - DNA, 18 bp, Homo sapiens
ttgtaataacatttaatt

SEQ ID NO: 5962227 - DNA, 21 bp, Homo sapiens
ttgtaatagatgtttgataga

SEQ ID NO: 5962228 - DNA, 11 bp, Homo sapiens
ttgtaatagtc

SEQ ID NO: 5962229 - DNA, 16 bp, Homo sapiens
ttgtaatataatgagt

SEQ ID NO: 5962230 - DNA, 19 bp, Homo sapiens
ttgtaatatacagtttttg

SEQ ID NO: 5962231 - DNA, 21 bp, Homo sapiens
ttgtaatatagaaaaaaacat

SEQ ID NO: 5962232 - DNA, 17 bp, Homo sapiens
ttgtaatatatcctgtt

SEQ ID NO: 5962233 - DNA, 13 bp, Homo sapiens
ttgtaatatcagt

SEQ ID NO: 5962234 - DNA, 13 bp, Homo sapiens
ttgtaatatgaca

SEQ ID NO: 5962235 - DNA, 16 bp, Homo sapiens
ttgtaatatgacagat

SEQ ID NO: 5962236 - DNA, 17 bp, Homo sapiens
ttgtaatattctgtttt

SEQ ID NO: 5962237 - DNA, 14 bp, Homo sapiens
ttgtaatattttgt

SEQ ID NO: 5962238 - DNA, 15 bp, Homo sapiens
ttgtaatattttgta

SEQ ID NO: 5962239 - DNA, 14 bp, Homo sapiens
ttgtaatattttta

SEQ ID NO: 5962240 - DNA, 16 bp, Homo sapiens
ttgtaatcaagccttt

SEQ ID NO: 5962241 - DNA, 14 bp, Homo sapiens
ttgtaatcactccc

SEQ ID NO: 5962242 - DNA, 16 bp, Homo sapiens
ttgtaatcctgtatat

SEQ ID NO: 5962243 - DNA, 19 bp, Homo sapiens
ttgtaatcctgtatattat

SEQ ID NO: 5962244 - DNA, 16 bp, Homo sapiens
ttgtaatcgtgtgcca

SEQ ID NO: 5962245 - DNA, 15 bp, Homo sapiens
ttgtaatctgaataa

SEQ ID NO: 5962246 - DNA, 20 bp, Homo sapiens
ttgtaatctgctttgttaat

SEQ ID NO: 5962247 - DNA, 12 bp, Homo sapiens
ttgtaatgaaaa

SEQ ID NO: 5962248 - DNA, 22 bp, Homo sapiens
ttgtaatgcactgtttttaatc

SEQ ID NO: 5962249 - DNA, 14 bp, Homo sapiens
ttgtaatggtgctt

SEQ ID NO: 5962250 - DNA, 16 bp, Homo sapiens
ttgtaatggtgcttat

SEQ ID NO: 5962251 - DNA, 14 bp, Homo sapiens
ttgtaatgtgaaaa

SEQ ID NO: 5962252 - DNA, 15 bp, Homo sapiens
ttgtaatgttactga

SEQ ID NO: 5962253 - DNA, 13 bp, Homo sapiens
ttgtaattaactg

SEQ ID NO: 5962254 - DNA, 21 bp, Homo sapiens
ttgtaattaataatagattgt

SEQ ID NO: 5962255 - DNA, 15 bp, Homo sapiens
ttgtaattatatctg

SEQ ID NO: 5962256 - DNA, 14 bp, Homo sapiens
ttgtaattatggag

SEQ ID NO: 5962257 - DNA, 15 bp, Homo sapiens
ttgtaattatgtaaa

SEQ ID NO: 5962258 - DNA, 13 bp, Homo sapiens
ttgtaattcagaa

SEQ ID NO: 5962259 - DNA, 17 bp, Homo sapiens
ttgtaattcctgatctt

SEQ ID NO: 5962260 - DNA, 17 bp, Homo sapiens
ttgtaattctaaatgaa

SEQ ID NO: 5962261 - DNA, 12 bp, Homo sapiens
ttgtaattgctt

SEQ ID NO: 5962262 - DNA, 19 bp, Homo sapiens
ttgtaattgcttacatttt

SEQ ID NO: 5962263 - DNA, 19 bp, Homo sapiens
ttgtaattgtggattaatg

SEQ ID NO: 5962264 - DNA, 14 bp, Homo sapiens
ttgtaattgtgtaa

SEQ ID NO: 5962265 - DNA, 22 bp, Homo sapiens
ttgtaattgtgtaaaaaatgga

SEQ ID NO: 5962266 - DNA, 23 bp, Homo sapiens
ttgtaatttaaacaggcccagca

SEQ ID NO: 5962267 - DNA, 16 bp, Homo sapiens
ttgtaatttgaagatg

SEQ ID NO: 5962268 - DNA, 15 bp, Homo sapiens
ttgtaattttacacg

SEQ ID NO: 5962269 - DNA, 22 bp, Homo sapiens
ttgtaattttacacgcttttgt

SEQ ID NO: 5962270 - DNA, 13 bp, Homo sapiens
ttgtaattttctt

SEQ ID NO: 5962271 - DNA, 23 bp, Homo sapiens
ttgtaatttttttaatttacaaa

SEQ ID NO: 5962272 - DNA, 22 bp, Homo sapiens
ttgtacaaaaaaaaagttttat

SEQ ID NO: 5962273 - DNA, 18 bp, Homo sapiens
ttgtacaaaaaagttata

SEQ ID NO: 5962274 - DNA, 22 bp, Homo sapiens
ttgtacaaaaaagttataagaa

SEQ ID NO: 5962275 - DNA, 14 bp, Homo sapiens
ttgtacaaaataaa

SEQ ID NO: 5962276 - DNA, 13 bp, Homo sapiens
ttgtacaaacttt

SEQ ID NO: 5962277 - DNA, 16 bp, Homo sapiens
ttgtacaaactttgtt

SEQ ID NO: 5962278 - DNA, 15 bp, Homo sapiens
ttgtacaaagatatg

SEQ ID NO: 5962279 - DNA, 16 bp, Homo sapiens
ttgtacaaagatatgc

SEQ ID NO: 5962280 - DNA, 18 bp, Homo sapiens
ttgtacaaagatatgcta

SEQ ID NO: 5962281 - DNA, 20 bp, Homo sapiens
ttgtacaaagattagtttca

SEQ ID NO: 5962282 - DNA, 14 bp, Homo sapiens
ttgtacaaagtatt

SEQ ID NO: 5962283 - DNA, 20 bp, Homo sapiens
ttgtacaaagttttcctttg

SEQ ID NO: 5962284 - DNA, 13 bp, Homo sapiens
ttgtacaaataaa

SEQ ID NO: 5962285 - DNA, 22 bp, Homo sapiens
ttgtacaaataaacctgaggca

SEQ ID NO: 5962286 - DNA, 14 bp, Homo sapiens
ttgtacaaatactg

SEQ ID NO: 5962287 - DNA, 13 bp, Homo sapiens
ttgtacaaatgta

SEQ ID NO: 5962288 - DNA, 20 bp, Homo sapiens
ttgtacaagagtccctttga

SEQ ID NO: 5962289 - DNA, 15 bp, Homo sapiens
ttgtacaagctcagg

SEQ ID NO: 5962290 - DNA, 22 bp, Homo sapiens
ttgtacaaggtatttacacata

SEQ ID NO: 5962291 - DNA, 13 bp, Homo sapiens
ttgtacaagtatt

SEQ ID NO: 5962292 - DNA, 13 bp, Homo sapiens
ttgtacaataaat

SEQ ID NO: 5962293 - DNA, 15 bp, Homo sapiens
ttgtacaataaattt

SEQ ID NO: 5962294 - DNA, 15 bp, Homo sapiens
ttgtacaatcatgtt

SEQ ID NO: 5962295 - DNA, 12 bp, Homo sapiens
ttgtacaatggt

SEQ ID NO: 5962296 - DNA, 20 bp, Homo sapiens
ttgtacaattttaaagttct

SEQ ID NO: 5962297 - DNA, 13 bp, Homo sapiens
ttgtacacttttt

SEQ ID NO: 5962298 - DNA, 19 bp, Homo sapiens
ttgtacagaatcattgctt

SEQ ID NO: 5962299 - DNA, 21 bp, Homo sapiens
ttgtacagcgttttaaaagaa

SEQ ID NO: 5962300 - DNA, 21 bp, Homo sapiens
ttgtacaggactgtaaagatt

SEQ ID NO: 5962301 - DNA, 21 bp, Homo sapiens
ttgtacaggggccatgcccca

SEQ ID NO: 5962302 - DNA, 22 bp, Homo sapiens
ttgtacaggggccatgccccac

SEQ ID NO: 5962303 - DNA, 15 bp, Homo sapiens
ttgtacagtattttt

SEQ ID NO: 5962304 - DNA, 16 bp, Homo sapiens
ttgtacagtggagaaa

SEQ ID NO: 5962305 - DNA, 16 bp, Homo sapiens
ttgtacagttcagttc

SEQ ID NO: 5962306 - DNA, 11 bp, Homo sapiens
ttgtacagttt

SEQ ID NO: 5962307 - DNA, 12 bp, Homo sapiens
ttgtacagtttt

SEQ ID NO: 5962308 - DNA, 16 bp, Homo sapiens
ttgtacagtttttatt

SEQ ID NO: 5962309 - DNA, 18 bp, Homo sapiens
ttgtacataatgcgtgca

SEQ ID NO: 5962310 - DNA, 15 bp, Homo sapiens
ttgtacatattgtta

SEQ ID NO: 5962311 - DNA, 18 bp, Homo sapiens
ttgtacatcgcttctttt

SEQ ID NO: 5962312 - DNA, 17 bp, Homo sapiens
ttgtacatctggcttat

SEQ ID NO: 5962313 - DNA, 13 bp, Homo sapiens
ttgtacatgaaca

SEQ ID NO: 5962314 - DNA, 19 bp, Homo sapiens
ttgtacatgataagacatt

SEQ ID NO: 5962315 - DNA, 22 bp, Homo sapiens
ttgtacatggaattttttgaat

SEQ ID NO: 5962316 - DNA, 11 bp, Homo sapiens
ttgtacattat

SEQ ID NO: 5962317 - DNA, 22 bp, Homo sapiens
ttgtacatttatttattactgt

SEQ ID NO: 5962318 - DNA, 14 bp, Homo sapiens
ttgtacatttggaa

SEQ ID NO: 5962319 - DNA, 18 bp, Homo sapiens
ttgtacattttgtaaaat

SEQ ID NO: 5962320 - DNA, 21 bp, Homo sapiens
ttgtacattttgtaaaatatt

SEQ ID NO: 5962321 - DNA, 21 bp, Homo sapiens
ttgtacatttttgatcaaatg

SEQ ID NO: 5962322 - DNA, 18 bp, Homo sapiens
ttgtacatttttgggggg

SEQ ID NO: 5962323 - DNA, 19 bp, Homo sapiens
ttgtacatttttgggggga

SEQ ID NO: 5962324 - DNA, 14 bp, Homo sapiens
ttgtaccaaaacat

SEQ ID NO: 5962325 - DNA, 15 bp, Homo sapiens
ttgtaccaaagctgt

SEQ ID NO: 5962326 - DNA, 15 bp, Homo sapiens
ttgtaccaactttta

SEQ ID NO: 5962327 - DNA, 12 bp, Homo sapiens
ttgtaccagtga

SEQ ID NO: 5962328 - DNA, 21 bp, Homo sapiens
ttgtaccatagaaaaatgtat

SEQ ID NO: 5962329 - DNA, 13 bp, Homo sapiens
ttgtaccatattg

SEQ ID NO: 5962330 - DNA, 15 bp, Homo sapiens
ttgtaccatattgct

SEQ ID NO: 5962331 - DNA, 18 bp, Homo sapiens
ttgtaccatcattttatt

SEQ ID NO: 5962332 - DNA, 18 bp, Homo sapiens
ttgtaccattccttcaaa

SEQ ID NO: 5962333 - DNA, 23 bp, Homo sapiens
ttgtaccattccttcaaataaag

SEQ ID NO: 5962334 - DNA, 12 bp, Homo sapiens
ttgtaccccatc

SEQ ID NO: 5962335 - DNA, 20 bp, Homo sapiens
ttgtaccccccaacccctga

SEQ ID NO: 5962336 - DNA, 20 bp, Homo sapiens
ttgtacccttcttgtctctc

SEQ ID NO: 5962337 - DNA, 18 bp, Homo sapiens
ttgtaccgaaacaccccg

SEQ ID NO: 5962338 - DNA, 22 bp, Homo sapiens
ttgtaccgatgcagctctcttt

SEQ ID NO: 5962339 - DNA, 11 bp, Homo sapiens
ttgtacctctc

SEQ ID NO: 5962340 - DNA, 23 bp, Homo sapiens
ttgtaccttttgtagttttattt

SEQ ID NO: 5962341 - DNA, 18 bp, Homo sapiens
ttgtacgacgtcagatgt

SEQ ID NO: 5962342 - DNA, 21 bp, Homo sapiens
ttgtacgtaaagcttaaattg

SEQ ID NO: 5962343 - DNA, 14 bp, Homo sapiens
ttgtacgtaatgta

SEQ ID NO: 5962344 - DNA, 15 bp, Homo sapiens
ttgtacgtgggagag

SEQ ID NO: 5962345 - DNA, 21 bp, Homo sapiens
ttgtacgtgggagaggcagaa

SEQ ID NO: 5962346 - DNA, 18 bp, Homo sapiens
ttgtacgtgttattatta

SEQ ID NO: 5962347 - DNA, 18 bp, Homo sapiens
ttgtacgttaattaaaca

SEQ ID NO: 5962348 - DNA, 18 bp, Homo sapiens
ttgtacgttatatattgt

SEQ ID NO: 5962349 - DNA, 16 bp, Homo sapiens
ttgtactaagccagga

SEQ ID NO: 5962350 - DNA, 14 bp, Homo sapiens
ttgtactatgttaa

SEQ ID NO: 5962351 - DNA, 13 bp, Homo sapiens
ttgtactatttaa

SEQ ID NO: 5962352 - DNA, 19 bp, Homo sapiens
ttgtactatttaactgact

SEQ ID NO: 5962353 - DNA, 22 bp, Homo sapiens
ttgtactatttaactgactatt

SEQ ID NO: 5962354 - DNA, 21 bp, Homo sapiens
ttgtactcaaagcccagaatc

SEQ ID NO: 5962355 - DNA, 14 bp, Homo sapiens
ttgtactcagtgga

SEQ ID NO: 5962356 - DNA, 20 bp, Homo sapiens
ttgtactccagcctgggtga

SEQ ID NO: 5962357 - DNA, 15 bp, Homo sapiens
ttgtactctacaaaa

SEQ ID NO: 5962358 - DNA, 19 bp, Homo sapiens
ttgtactcttgctttttca

SEQ ID NO: 5962359 - DNA, 22 bp, Homo sapiens
ttgtactgaatttttttgtaat

SEQ ID NO: 5962360 - DNA, 18 bp, Homo sapiens
ttgtactgcatcttagtt

SEQ ID NO: 5962361 - DNA, 15 bp, Homo sapiens
ttgtactgtaaagag

SEQ ID NO: 5962362 - DNA, 16 bp, Homo sapiens
ttgtactgtgttttta

SEQ ID NO: 5962363 - DNA, 18 bp, Homo sapiens
ttgtactgtgtttttaaa

SEQ ID NO: 5962364 - DNA, 13 bp, Homo sapiens
ttgtactgttcat

SEQ ID NO: 5962365 - DNA, 19 bp, Homo sapiens
ttgtactgttcatacagtt

SEQ ID NO: 5962366 - DNA, 22 bp, Homo sapiens
ttgtactgttcatacagtttta

SEQ ID NO: 5962367 - DNA, 18 bp, Homo sapiens
ttgtactgttgctttaat

SEQ ID NO: 5962368 - DNA, 14 bp, Homo sapiens
ttgtacttctgtgt

SEQ ID NO: 5962369 - DNA, 17 bp, Homo sapiens
ttgtacttctgtgttca

SEQ ID NO: 5962370 - DNA, 14 bp, Homo sapiens
ttgtacttggaagt

SEQ ID NO: 5962371 - DNA, 18 bp, Homo sapiens
ttgtactttagggaagta

SEQ ID NO: 5962372 - DNA, 19 bp, Homo sapiens
ttgtactttatatcttgtt

SEQ ID NO: 5962373 - DNA, 15 bp, Homo sapiens
ttgtactttattttt

SEQ ID NO: 5962374 - DNA, 13 bp, Homo sapiens
ttgtactttctgt

SEQ ID NO: 5962375 - DNA, 18 bp, Homo sapiens
ttgtactttgtttttcca

SEQ ID NO: 5962376 - DNA, 15 bp, Homo sapiens
ttgtacttttatctt

SEQ ID NO: 5962377 - DNA, 17 bp, Homo sapiens
ttgtacttttcattctg

SEQ ID NO: 5962378 - DNA, 23 bp, Homo sapiens
ttgtactttttgttccagagctg

SEQ ID NO: 5962379 - DNA, 22 bp, Homo sapiens
ttgtagaaacacagttttgaaa

SEQ ID NO: 5962380 - DNA, 12 bp, Homo sapiens
ttgtagaaagct

SEQ ID NO: 5962381 - DNA, 20 bp, Homo sapiens
ttgtagaaagctaatacaaa

SEQ ID NO: 5962382 - DNA, 17 bp, Homo sapiens
ttgtgcagtaacttggg

SEQ ID NO: 5962383 - DNA, 17 bp, Homo sapiens
ttgtgcatcctgtgaaa

SEQ ID NO: 5962384 - DNA, 14 bp, Homo sapiens
ttgtgcatgcaaaa

SEQ ID NO: 5962385 - DNA, 20 bp, Homo sapiens
ttgtgcatgcaaaccaggag

SEQ ID NO: 5962386 - DNA, 17 bp, Homo sapiens
ttgtgcatgtatgtata

SEQ ID NO: 5962387 - DNA, 16 bp, Homo sapiens
ttgtgcatgtttactt

SEQ ID NO: 5962388 - DNA, 17 bp, Homo sapiens
ttgtgcattttgtgtga

SEQ ID NO: 5962389 - DNA, 22 bp, Homo sapiens
ttgtgccaacctattttgaagt

SEQ ID NO: 5962390 - DNA, 17 bp, Homo sapiens
ttgtgccaagccttctg

SEQ ID NO: 5962391 - DNA, 16 bp, Homo sapiens
ttgtgccaatatgtat

SEQ ID NO: 5962392 - DNA, 17 bp, Homo sapiens
ttgtgcccactgtctct

SEQ ID NO: 5962393 - DNA, 17 bp, Homo sapiens
ttgtgccccttcactca

SEQ ID NO: 5962394 - DNA, 22 bp, Homo sapiens
ttgtgccctgcccccatctccc

SEQ ID NO: 5962395 - DNA, 22 bp, Homo sapiens
ttgtgccctgtagctccttagc

SEQ ID NO: 5962396 - DNA, 19 bp, Homo sapiens
ttgtgcctcactggacttg

SEQ ID NO: 5962397 - DNA, 12 bp, Homo sapiens
ttgtgcctcagc

SEQ ID NO: 5962398 - DNA, 19 bp, Homo sapiens
ttgtgcctcatttatttat

SEQ ID NO: 5962399 - DNA, 17 bp, Homo sapiens
ttgtgcctcccttccca

SEQ ID NO: 5962400 - DNA, 13 bp, Homo sapiens
ttgtgcctggggt

SEQ ID NO: 5962401 - DNA, 19 bp, Homo sapiens
ttgtgcctggttcgtgcca

SEQ ID NO: 5962402 - DNA, 17 bp, Homo sapiens
ttgtgccttactaaata

SEQ ID NO: 5962403 - DNA, 12 bp, Homo sapiens
ttgtgccttccc

SEQ ID NO: 5962404 - DNA, 14 bp, Homo sapiens
ttgtgccttccctt

SEQ ID NO: 5962405 - DNA, 16 bp, Homo sapiens
ttgtgccttttatagc

SEQ ID NO: 5962406 - DNA, 20 bp, Homo sapiens
ttgtgcgccggcgccccgga

SEQ ID NO: 5962407 - DNA, 22 bp, Homo sapiens
ttgtgcgctaaacttttctgat

SEQ ID NO: 5962408 - DNA, 23 bp, Homo sapiens
ttgtgcgctaaacttttctgata

SEQ ID NO: 5962409 - DNA, 18 bp, Homo sapiens
ttgtgctaaatcctagca

SEQ ID NO: 5962410 - DNA, 13 bp, Homo sapiens
ttgtgctataaag

SEQ ID NO: 5962411 - DNA, 14 bp, Homo sapiens
ttgtgctatagtat

SEQ ID NO: 5962412 - DNA, 21 bp, Homo sapiens
ttgtgctatatttttaaagaa

SEQ ID NO: 5962413 - DNA, 16 bp, Homo sapiens
ttgtgctcagagacac

SEQ ID NO: 5962414 - DNA, 13 bp, Homo sapiens
ttgtgctcagtcg

SEQ ID NO: 5962415 - DNA, 22 bp, Homo sapiens
ttgtgctcagtcgccctgttct

SEQ ID NO: 5962416 - DNA, 20 bp, Homo sapiens
ttgtgctcctcttgattcct

SEQ ID NO: 5962417 - DNA, 13 bp, Homo sapiens
ttgtgctgcttct

SEQ ID NO: 5962418 - DNA, 19 bp, Homo sapiens
ttgtgctggggttatctga

SEQ ID NO: 5962419 - DNA, 19 bp, Homo sapiens
ttgtgctgtgggcagcacc

SEQ ID NO: 5962420 - DNA, 19 bp, Homo sapiens
ttgtgcttatgtcatttct

SEQ ID NO: 5962421 - DNA, 16 bp, Homo sapiens
ttgtgcttcacagtag

SEQ ID NO: 5962422 - DNA, 17 bp, Homo sapiens
ttgtgcttctccccaga

SEQ ID NO: 5962423 - DNA, 19 bp, Homo sapiens
ttgtgcttctccccagaat

SEQ ID NO: 5962424 - DNA, 19 bp, Homo sapiens
ttgtgcttggcaaatgagt

SEQ ID NO: 5962425 - DNA, 13 bp, Homo sapiens
ttgtgctttgaaa

SEQ ID NO: 5962426 - DNA, 15 bp, Homo sapiens
ttgtgctttgctctt

SEQ ID NO: 5962427 - DNA, 12 bp, Homo sapiens
ttgtgctttgta

SEQ ID NO: 5962428 - DNA, 13 bp, Homo sapiens
ttgtgctttgtat

SEQ ID NO: 5962429 - DNA, 15 bp, Homo sapiens
ttgtgctttgtatca

SEQ ID NO: 5962430 - DNA, 16 bp, Homo sapiens
ttgtgcttttcctatt

SEQ ID NO: 5962431 - DNA, 18 bp, Homo sapiens
ttgtgctttttgtcatgt

SEQ ID NO: 5962432 - DNA, 13 bp, Homo sapiens
ttgtggaaactgg

SEQ ID NO: 5962433 - DNA, 18 bp, Homo sapiens
ttgtggaaagataataaa

SEQ ID NO: 5962434 - DNA, 23 bp, Homo sapiens
ttgtggaaagataataaattgat

SEQ ID NO: 5962435 - DNA, 18 bp, Homo sapiens
ttgtggaaagcctctgct

SEQ ID NO: 5962436 - DNA, 20 bp, Homo sapiens
ttgtggaaagtagctgctag

SEQ ID NO: 5962437 - DNA, 15 bp, Homo sapiens
ttgtggaacaaaagt

SEQ ID NO: 5962438 - DNA, 13 bp, Homo sapiens
ttgtggaatgttg

SEQ ID NO: 5962439 - DNA, 18 bp, Homo sapiens
ttgtggaatgttggataa

SEQ ID NO: 5962440 - DNA, 16 bp, Homo sapiens
ttgtggacatttaaga

SEQ ID NO: 5962441 - DNA, 17 bp, Homo sapiens
ttgtggacctcaccaga

SEQ ID NO: 5962442 - DNA, 16 bp, Homo sapiens
ttgtggactaaaagat

SEQ ID NO: 5962443 - DNA, 19 bp, Homo sapiens
ttgtggactctctgcctgc

SEQ ID NO: 5962444 - DNA, 13 bp, Homo sapiens
ttgtggagaggag

SEQ ID NO: 5962445 - DNA, 15 bp, Homo sapiens
ttgtggagaggagag

SEQ ID NO: 5962446 - DNA, 16 bp, Homo sapiens
ttgtggataagggaga

SEQ ID NO: 5962447 - DNA, 19 bp, Homo sapiens
ttgtggatactattaaagt

SEQ ID NO: 5962448 - DNA, 17 bp, Homo sapiens
ttgtggatgctccaggg

SEQ ID NO: 5962449 - DNA, 16 bp, Homo sapiens
ttgtggatgtgttcat

SEQ ID NO: 5962450 - DNA, 23 bp, Homo sapiens
ttgtggatgttttaattccatga

SEQ ID NO: 5962451 - DNA, 18 bp, Homo sapiens
ttgtggattataaaaaat

SEQ ID NO: 5962452 - DNA, 20 bp, Homo sapiens
ttgtggattataaaaaatgt

SEQ ID NO: 5962453 - DNA, 21 bp, Homo sapiens
ttgtggattataaaaaatgta

SEQ ID NO: 5962454 - DNA, 19 bp, Homo sapiens
ttgtggatttcagttttaa

SEQ ID NO: 5962455 - DNA, 18 bp, Homo sapiens
ttgtggcaaaagccacat

SEQ ID NO: 5962456 - DNA, 14 bp, Homo sapiens
ttgtggcaaaatat

SEQ ID NO: 5962457 - DNA, 16 bp, Homo sapiens
ttgtggcaagtgaatt

SEQ ID NO: 5962458 - DNA, 15 bp, Homo sapiens
ttgtggcaattttat

SEQ ID NO: 5962459 - DNA, 11 bp, Homo sapiens
ttgtggcagag

SEQ ID NO: 5962460 - DNA, 20 bp, Homo sapiens
ttgtggcagtgctgaagggg

SEQ ID NO: 5962461 - DNA, 19 bp, Homo sapiens
ttgtggcccccgccccctc

SEQ ID NO: 5962462 - DNA, 21 bp, Homo sapiens
ttgtggcccccgccccctccc

SEQ ID NO: 5962463 - DNA, 19 bp, Homo sapiens
ttgtggccccttttacttt

SEQ ID NO: 5962464 - DNA, 20 bp, Homo sapiens
ttgtggccccttttactttt

SEQ ID NO: 5962465 - DNA, 11 bp, Homo sapiens
ttgtggcctca

SEQ ID NO: 5962466 - DNA, 23 bp, Homo sapiens
ttgtggcctcaagcaatccacct

SEQ ID NO: 5962467 - DNA, 13 bp, Homo sapiens
ttgtggcctcaga

SEQ ID NO: 5962468 - DNA, 16 bp, Homo sapiens
ttgtggccttttttat

SEQ ID NO: 5962469 - DNA, 18 bp, Homo sapiens
ttgtggctccacacacac

SEQ ID NO: 5962470 - DNA, 14 bp, Homo sapiens
ttgtggctccctgg

SEQ ID NO: 5962471 - DNA, 15 bp, Homo sapiens
ttgtggctccctggg

SEQ ID NO: 5962472 - DNA, 18 bp, Homo sapiens
ttgtggctcctatctgtg

SEQ ID NO: 5962473 - DNA, 22 bp, Homo sapiens
ttgtggctgtcaaatccatgtg

SEQ ID NO: 5962474 - DNA, 15 bp, Homo sapiens
ttgtggctgtcagca

SEQ ID NO: 5962475 - DNA, 10 bp, Homo sapiens
ttgtgggaat

SEQ ID NO: 5962476 - DNA, 11 bp, Homo sapiens
ttgtgggaata

SEQ ID NO: 5962477 - DNA, 23 bp, Homo sapiens
ttgtgggcaaaagagaaaaagaa

SEQ ID NO: 5962478 - DNA, 21 bp, Homo sapiens
ttgtgggcaaaggcagggcca

SEQ ID NO: 5962479 - DNA, 21 bp, Homo sapiens
ttgtgggcatgagctgctgtg

SEQ ID NO: 5962480 - DNA, 14 bp, Homo sapiens
ttgtgggcctgggc

SEQ ID NO: 5962481 - DNA, 15 bp, Homo sapiens
ttgtgggcctgggct

SEQ ID NO: 5962482 - DNA, 11 bp, Homo sapiens
ttgtgggcgct

SEQ ID NO: 5962483 - DNA, 20 bp, Homo sapiens
ttgtggggacctcagcctgc

SEQ ID NO: 5962484 - DNA, 20 bp, Homo sapiens
ttgtggggaggctgcactgg

SEQ ID NO: 5962485 - DNA, 13 bp, Homo sapiens
ttgtggggccagg

SEQ ID NO: 5962486 - DNA, 14 bp, Homo sapiens
ttgtggggcctggg

SEQ ID NO: 5962487 - DNA, 18 bp, Homo sapiens
ttgtgggggactgtaagt

SEQ ID NO: 5962488 - DNA, 20 bp, Homo sapiens
ttgtgggggctagaaaaaac

SEQ ID NO: 5962489 - DNA, 12 bp, Homo sapiens
ttgtggggtgca

SEQ ID NO: 5962490 - DNA, 13 bp, Homo sapiens
ttgtggggtgcag

SEQ ID NO: 5962491 - DNA, 20 bp, Homo sapiens
ttgtggggtgcagctgggtg

SEQ ID NO: 5962492 - DNA, 13 bp, Homo sapiens
ttgtgggtcctgg

SEQ ID NO: 5962493 - DNA, 13 bp, Homo sapiens
ttgtgggtgggag

SEQ ID NO: 5962494 - DNA, 20 bp, Homo sapiens
ttgtgggttctatgtttact

SEQ ID NO: 5962495 - DNA, 20 bp, Homo sapiens
ttgtgggtttttatttccta

SEQ ID NO: 5962496 - DNA, 20 bp, Homo sapiens
ttgtggtaaccagccctgca

SEQ ID NO: 5962497 - DNA, 15 bp, Homo sapiens
ttgtggtaatctaca

SEQ ID NO: 5962498 - DNA, 18 bp, Homo sapiens
ttgtggtctaaagtgttt

SEQ ID NO: 5962499 - DNA, 16 bp, Homo sapiens
ttgtggtggtgctaaa

SEQ ID NO: 5962500 - DNA, 21 bp, Homo sapiens
ttgtggtgtaaagctggccct

SEQ ID NO: 5962501 - DNA, 19 bp, Homo sapiens
ttgtggtgtcccctatcct

SEQ ID NO: 5962502 - DNA, 13 bp, Homo sapiens
ttgtggtgtctta

SEQ ID NO: 5962503 - DNA, 13 bp, Homo sapiens
ttgtggtgtgacc

SEQ ID NO: 5962504 - DNA, 20 bp, Homo sapiens
ttgtggtgtgaccatgttca

SEQ ID NO: 5962505 - DNA, 22 bp, Homo sapiens
ttgtggtgtgagtatcagaatt

SEQ ID NO: 5962506 - DNA, 13 bp, Homo sapiens
ttgtggtgtgcca

SEQ ID NO: 5962507 - DNA, 15 bp, Homo sapiens
ttgtggttagaatct

SEQ ID NO: 5962508 - DNA, 14 bp, Homo sapiens
ttgtggttattttt

SEQ ID NO: 5962509 - DNA, 22 bp, Homo sapiens
ttgtggttccatgcagccttgg

SEQ ID NO: 5962510 - DNA, 20 bp, Homo sapiens
ttgtggttctattttacttt

SEQ ID NO: 5962511 - DNA, 16 bp, Homo sapiens
ttgtggttttatggag

SEQ ID NO: 5962512 - DNA, 15 bp, Homo sapiens
ttgtgtaactgttct

SEQ ID NO: 5962513 - DNA, 20 bp, Homo sapiens
ttgtgtaactgttctttgca

SEQ ID NO: 5962514 - DNA, 21 bp, Homo sapiens
ttgtgtaaggactttggctta

SEQ ID NO: 5962515 - DNA, 14 bp, Homo sapiens
ttgtgtaataaagt

SEQ ID NO: 5962516 - DNA, 15 bp, Homo sapiens
ttgtgtaatatgaaa

SEQ ID NO: 5962517 - DNA, 24 bp, Homo sapiens
ttgtgtaatgaaaatgaatatcta

SEQ ID NO: 5962518 - DNA, 21 bp, Homo sapiens
ttgtgtacaaagtagagaagt

SEQ ID NO: 5962519 - DNA, 22 bp, Homo sapiens
ttgtgtacaaagtagagaagta

SEQ ID NO: 5962520 - DNA, 21 bp, Homo sapiens
ttgtgtacactttcattactt

SEQ ID NO: 5962521 - DNA, 15 bp, Homo sapiens
ttgtgtacagtatgt

SEQ ID NO: 5962522 - DNA, 15 bp, Homo sapiens
ttgtgtacagttatt

SEQ ID NO: 5962523 - DNA, 22 bp, Homo sapiens
ttgtgtacatagagcaatgttg

SEQ ID NO: 5962524 - DNA, 17 bp, Homo sapiens
ttgtgtactctggcctc

SEQ ID NO: 5962525 - DNA, 18 bp, Homo sapiens
ttgtgtactctggcctct

SEQ ID NO: 5962526 - DNA, 16 bp, Homo sapiens
ttgtgtacttttaaga

SEQ ID NO: 5962527 - DNA, 17 bp, Homo sapiens
ttgtgtacttttccttt

SEQ ID NO: 5962528 - DNA, 11 bp, Homo sapiens
ttgtgtagaaa

SEQ ID NO: 5962529 - DNA, 15 bp, Homo sapiens
ttgtgtagattgtgt

SEQ ID NO: 5962530 - DNA, 15 bp, Homo sapiens
ttgtgtagccttttt

SEQ ID NO: 5962531 - DNA, 13 bp, Homo sapiens
ttgtgtataattt

SEQ ID NO: 5962532 - DNA, 14 bp, Homo sapiens
ttgtgtataattta

SEQ ID NO: 5962533 - DNA, 24 bp, Homo sapiens
ttgtgtatatatcttataactgtt

SEQ ID NO: 5962534 - DNA, 16 bp, Homo sapiens
ttgtgtatattacacc

SEQ ID NO: 5962535 - DNA, 16 bp, Homo sapiens
ttgtgtatatttgtat

SEQ ID NO: 5962536 - DNA, 22 bp, Homo sapiens
ttgtgtatccattatcatgtgt

SEQ ID NO: 5962537 - DNA, 18 bp, Homo sapiens
ttgtgtatgagactgtgt

SEQ ID NO: 5962538 - DNA, 15 bp, Homo sapiens
ttgtgtatgatccaa

SEQ ID NO: 5962539 - DNA, 18 bp, Homo sapiens
ttgtgtatggatatgtgt

SEQ ID NO: 5962540 - DNA, 14 bp, Homo sapiens
ttgtgtatgtactt

SEQ ID NO: 5962541 - DNA, 20 bp, Homo sapiens
ttgtgtatgtacttagctgt

SEQ ID NO: 5962542 - DNA, 23 bp, Homo sapiens
ttgtgtatgtacttagctgtact

SEQ ID NO: 5962543 - DNA, 12 bp, Homo sapiens
ttgtgtatgtgt

SEQ ID NO: 5962544 - DNA, 13 bp, Homo sapiens
ttgtgtatgtgta

SEQ ID NO: 5962545 - DNA, 22 bp, Homo sapiens
ttgtgtattgagtcttaactgt

SEQ ID NO: 5962546 - DNA, 15 bp, Homo sapiens
ttgtgtattgatgca

SEQ ID NO: 5962547 - DNA, 18 bp, Homo sapiens
ttgtgtattgatgcaata

SEQ ID NO: 5962548 - DNA, 19 bp, Homo sapiens
ttgtgtatttacgctttga

SEQ ID NO: 5962549 - DNA, 20 bp, Homo sapiens
ttgtgtatttacgctttgat

SEQ ID NO: 5962550 - DNA, 22 bp, Homo sapiens
ttgtgtatttacgctttgattc

SEQ ID NO: 5962551 - DNA, 23 bp, Homo sapiens
ttgtgtatttacgctttgattca

SEQ ID NO: 5962552 - DNA, 15 bp, Homo sapiens
ttgtgtatttctctg

SEQ ID NO: 5962553 - DNA, 22 bp, Homo sapiens
ttgtgtcaacatgaacaaattt

SEQ ID NO: 5962554 - DNA, 20 bp, Homo sapiens
ttgtgtcagaaacatgaaat

SEQ ID NO: 5962555 - DNA, 20 bp, Homo sapiens
ttgtgtcataaattacacaa

SEQ ID NO: 5962556 - DNA, 17 bp, Homo sapiens
ttgtgtcataccagaaa

SEQ ID NO: 5962557 - DNA, 19 bp, Homo sapiens
ttgtgtccataagagaaat

SEQ ID NO: 5962558 - DNA, 16 bp, Homo sapiens
ttgtgtccattttgca

SEQ ID NO: 5962559 - DNA, 9 bp, Homo sapiens
ttgtgtccc

SEQ ID NO: 5962560 - DNA, 21 bp, Homo sapiens
ttgtgtcccaaaatcccctca

SEQ ID NO: 5962561 - DNA, 17 bp, Homo sapiens
ttgttttgaaagtttaa

SEQ ID NO: 5962562 - DNA, 20 bp, Homo sapiens
ttgttttgcacactttgcca

SEQ ID NO: 5962563 - DNA, 14 bp, Homo sapiens
ttgttttgcacttt

SEQ ID NO: 5962564 - DNA, 16 bp, Homo sapiens
ttgttttgcacttttt

SEQ ID NO: 5962565 - DNA, 16 bp, Homo sapiens
ttgttttgcattgtct

SEQ ID NO: 5962566 - DNA, 18 bp, Homo sapiens
ttgttttgccaacattgc

SEQ ID NO: 5962567 - DNA, 23 bp, Homo sapiens
ttgttttgctacgattccactga

SEQ ID NO: 5962568 - DNA, 19 bp, Homo sapiens
ttgttttgctgagagcata

SEQ ID NO: 5962569 - DNA, 15 bp, Homo sapiens
ttgttttgctttttc

SEQ ID NO: 5962570 - DNA, 14 bp, Homo sapiens
ttgttttggatgcc

SEQ ID NO: 5962571 - DNA, 17 bp, Homo sapiens
ttgttttggatggcttg

SEQ ID NO: 5962572 - DNA, 12 bp, Homo sapiens
ttgttttggatt

SEQ ID NO: 5962573 - DNA, 19 bp, Homo sapiens
ttgttttggcgataggtct

SEQ ID NO: 5962574 - DNA, 15 bp, Homo sapiens
ttgttttgggtgaat

SEQ ID NO: 5962575 - DNA, 16 bp, Homo sapiens
ttgttttggtctcaaa

SEQ ID NO: 5962576 - DNA, 13 bp, Homo sapiens
ttgttttgtacag

SEQ ID NO: 5962577 - DNA, 13 bp, Homo sapiens
ttgttttgtgttt

SEQ ID NO: 5962578 - DNA, 19 bp, Homo sapiens
ttgtttttaaaaagcaaat

SEQ ID NO: 5962579 - DNA, 17 bp, Homo sapiens
ttgtttttaatctcctg

SEQ ID NO: 5962580 - DNA, 12 bp, Homo sapiens
ttgtttttactg

SEQ ID NO: 5962581 - DNA, 13 bp, Homo sapiens
ttgtttttactgt

SEQ ID NO: 5962582 - DNA, 15 bp, Homo sapiens
ttgtttttactgtat

SEQ ID NO: 5962583 - DNA, 22 bp, Homo sapiens
ttgtttttatatattataagtt

SEQ ID NO: 5962584 - DNA, 16 bp, Homo sapiens
ttgtttttattaaaag

SEQ ID NO: 5962585 - DNA, 18 bp, Homo sapiens
ttgtttttattctgttaa

SEQ ID NO: 5962586 - DNA, 19 bp, Homo sapiens
ttgtttttcattcagtctt

SEQ ID NO: 5962587 - DNA, 21 bp, Homo sapiens
ttgtttttccttgtatttaaa

SEQ ID NO: 5962588 - DNA, 22 bp, Homo sapiens
ttgtttttccttgtatttaaat

SEQ ID NO: 5962589 - DNA, 12 bp, Homo sapiens
ttgtttttctgc

SEQ ID NO: 5962590 - DNA, 15 bp, Homo sapiens
ttgtttttcttcagc

SEQ ID NO: 5962591 - DNA, 14 bp, Homo sapiens
ttgtttttctttct

SEQ ID NO: 5962592 - DNA, 15 bp, Homo sapiens
ttgtttttctttcta

SEQ ID NO: 5962593 - DNA, 23 bp, Homo sapiens
ttgtttttgaatttaaataaagt

SEQ ID NO: 5962594 - DNA, 14 bp, Homo sapiens
ttgtttttgcattt

SEQ ID NO: 5962595 - DNA, 17 bp, Homo sapiens
ttgtttttgcatttttg

SEQ ID NO: 5962596 - DNA, 16 bp, Homo sapiens
ttgtttttggtttctt

SEQ ID NO: 5962597 - DNA, 15 bp, Homo sapiens
ttgtttttgtaaaga

SEQ ID NO: 5962598 - DNA, 17 bp, Homo sapiens
ttgtttttgtaatgcac

SEQ ID NO: 5962599 - DNA, 15 bp, Homo sapiens
ttgtttttgtatatt

SEQ ID NO: 5962600 - DNA, 16 bp, Homo sapiens
ttgttttttgaagtgt

SEQ ID NO: 5962601 - DNA, 12 bp, Homo sapiens
ttgttttttgag

SEQ ID NO: 5962602 - DNA, 15 bp, Homo sapiens
ttgttttttgtaact

SEQ ID NO: 5962603 - DNA, 23 bp, Homo sapiens
ttgtttttttcctcatgtaacat

SEQ ID NO: 5962604 - DNA, 13 bp, Homo sapiens
ttgtttttttgag

SEQ ID NO: 5962605 - DNA, 14 bp, Homo sapiens
ttgtttttttgcca

SEQ ID NO: 5962606 - DNA, 20 bp, Homo sapiens
tttaaaaaaaaatcttgtgt

SEQ ID NO: 5962607 - DNA, 19 bp, Homo sapiens
tttaaaaaaaactatttaa

SEQ ID NO: 5962608 - DNA, 20 bp, Homo sapiens
tttaaaaaaaatagaagcta

SEQ ID NO: 5962609 - DNA, 22 bp, Homo sapiens
tttaaaaaaaatccttctaatc

SEQ ID NO: 5962610 - DNA, 18 bp, Homo sapiens
tttaaaaaaacaaataaa

SEQ ID NO: 5962611 - DNA, 21 bp, Homo sapiens
tttaaaaaaacaaataaataa

SEQ ID NO: 5962612 - DNA, 19 bp, Homo sapiens
tttaaaaaaacattattgt

SEQ ID NO: 5962613 - DNA, 14 bp, Homo sapiens
tttaaaaaaactga

SEQ ID NO: 5962614 - DNA, 17 bp, Homo sapiens
tttaaaaaaactgaagg

SEQ ID NO: 5962615 - DNA, 21 bp, Homo sapiens
tttaaaaaaactgaaggtttt

SEQ ID NO: 5962616 - DNA, 15 bp, Homo sapiens
tttaaaaaaagaaaa

SEQ ID NO: 5962617 - DNA, 22 bp, Homo sapiens
tttaaaaaaagaaaatgaaaaa

SEQ ID NO: 5962618 - DNA, 18 bp, Homo sapiens
tttaaaaaaataacatct

SEQ ID NO: 5962619 - DNA, 23 bp, Homo sapiens
tttaaaaaaataatataaatgaa

SEQ ID NO: 5962620 - DNA, 15 bp, Homo sapiens
tttaaaaaaataatt

SEQ ID NO: 5962621 - DNA, 18 bp, Homo sapiens
tttaaaaaaattccaagt

SEQ ID NO: 5962622 - DNA, 14 bp, Homo sapiens
tttaaaaaaatttt

SEQ ID NO: 5962623 - DNA, 18 bp, Homo sapiens
tttaaaaaacaaaaaaag

SEQ ID NO: 5962624 - DNA, 23 bp, Homo sapiens
tttaaaaaacaaaaaccagcagg

SEQ ID NO: 5962625 - DNA, 17 bp, Homo sapiens
tttaaaaaacagaaaaa

SEQ ID NO: 5962626 - DNA, 20 bp, Homo sapiens
tttaaaaaactattttatgt

SEQ ID NO: 5962627 - DNA, 14 bp, Homo sapiens
tttaaaaaactttc

SEQ ID NO: 5962628 - DNA, 16 bp, Homo sapiens
tttaaaaaactttcta

SEQ ID NO: 5962629 - DNA, 18 bp, Homo sapiens
tttaaaaaactttctact

SEQ ID NO: 5962630 - DNA, 19 bp, Homo sapiens
tttaaaaaactttctactc

SEQ ID NO: 5962631 - DNA, 14 bp, Homo sapiens
tttaaaaaagctta

SEQ ID NO: 5962632 - DNA, 18 bp, Homo sapiens
tttaaaaaagtttaaaat

SEQ ID NO: 5962633 - DNA, 14 bp, Homo sapiens
tttaaaaaataaag

SEQ ID NO: 5962634 - DNA, 19 bp, Homo sapiens
tttaaaaaataatttagat

SEQ ID NO: 5962635 - DNA, 12 bp, Homo sapiens
tttaaaaaatac

SEQ ID NO: 5962636 - DNA, 13 bp, Homo sapiens
tttaaaaaataca

SEQ ID NO: 5962637 - DNA, 13 bp, Homo sapiens
tttaaaaaatatt

SEQ ID NO: 5962638 - DNA, 18 bp, Homo sapiens
tttaaaaaatatttatta

SEQ ID NO: 5962639 - DNA, 18 bp, Homo sapiens
tttaaaaaatattttaag

SEQ ID NO: 5962640 - DNA, 20 bp, Homo sapiens
tttaaaaaatattttaagaa

SEQ ID NO: 5962641 - DNA, 22 bp, Homo sapiens
tttaaaaaatattttaagaaag

SEQ ID NO: 5962642 - DNA, 17 bp, Homo sapiens
tttaaaaaatattttct

SEQ ID NO: 5962643 - DNA, 12 bp, Homo sapiens
tttaaaaaatca

SEQ ID NO: 5962644 - DNA, 19 bp, Homo sapiens
tttaaaaaatcaatcaatg

SEQ ID NO: 5962645 - DNA, 18 bp, Homo sapiens
tttaaaaaatgctgggtt

SEQ ID NO: 5962646 - DNA, 14 bp, Homo sapiens
tttaaaaacaaaca

SEQ ID NO: 5962647 - DNA, 18 bp, Homo sapiens
tttaaaaacatagaaaaa

SEQ ID NO: 5962648 - DNA, 22 bp, Homo sapiens
tttaaaaacatgagaaatgtga

SEQ ID NO: 5962649 - DNA, 14 bp, Homo sapiens
tttaaaaacatttt

SEQ ID NO: 5962650 - DNA, 20 bp, Homo sapiens
tttaaaaaccaatcatttta

SEQ ID NO: 5962651 - DNA, 19 bp, Homo sapiens
tttaaaaaccgaataaatg

SEQ ID NO: 5962652 - DNA, 22 bp, Homo sapiens
tttaaaaacctattttgaaagg

SEQ ID NO: 5962653 - DNA, 21 bp, Homo sapiens
tttaaaaactatttaacttga

SEQ ID NO: 5962654 - DNA, 23 bp, Homo sapiens
tttaaaaactatttaacttgagc

SEQ ID NO: 5962655 - DNA, 11 bp, Homo sapiens
tttaaaaactt

SEQ ID NO: 5962656 - DNA, 17 bp, Homo sapiens
tttaaaaacttaaatat

SEQ ID NO: 5962657 - DNA, 13 bp, Homo sapiens
tttaaaaacttgt

SEQ ID NO: 5962658 - DNA, 13 bp, Homo sapiens
tttaaaaagaaaa

SEQ ID NO: 5962659 - DNA, 21 bp, Homo sapiens
tttaaaaagaaacaagatgct

SEQ ID NO: 5962660 - DNA, 17 bp, Homo sapiens
tttaaaaagaaatctgg

SEQ ID NO: 5962661 - DNA, 15 bp, Homo sapiens
tttaaaaagcaaatc

SEQ ID NO: 5962662 - DNA, 19 bp, Homo sapiens
tttaaaaagcatgttgtga

SEQ ID NO: 5962663 - DNA, 13 bp, Homo sapiens
tttaaaaaggaaa

SEQ ID NO: 5962664 - DNA, 23 bp, Homo sapiens
tttaaaaaggaaatttgtttgta

SEQ ID NO: 5962665 - DNA, 20 bp, Homo sapiens
tttaaaaaggaactgcagca

SEQ ID NO: 5962666 - DNA, 13 bp, Homo sapiens
tttaaaaaggcct

SEQ ID NO: 5962667 - DNA, 15 bp, Homo sapiens
tttaaaaaggccttt

SEQ ID NO: 5962668 - DNA, 17 bp, Homo sapiens
tttaaaaagggaagaaa

SEQ ID NO: 5962669 - DNA, 19 bp, Homo sapiens
tttaaaaagggaagaaact

SEQ ID NO: 5962670 - DNA, 20 bp, Homo sapiens
tttaaaaagggaagaaactg

SEQ ID NO: 5962671 - DNA, 14 bp, Homo sapiens
tttaaaaagggtaa

SEQ ID NO: 5962672 - DNA, 19 bp, Homo sapiens
tttaaaaagggtaacttgt

SEQ ID NO: 5962673 - DNA, 14 bp, Homo sapiens
tttaaaaagtgttt

SEQ ID NO: 5962674 - DNA, 17 bp, Homo sapiens
tttaaaaagttgcacat

SEQ ID NO: 5962675 - DNA, 23 bp, Homo sapiens
tttaaaaagttgtagcagattgt

SEQ ID NO: 5962676 - DNA, 20 bp, Homo sapiens
tttaaaaataaaagctatta

SEQ ID NO: 5962677 - DNA, 20 bp, Homo sapiens
tttaaaaataaagctactga

SEQ ID NO: 5962678 - DNA, 23 bp, Homo sapiens
tttaaaaataagtcaacagtaaa

SEQ ID NO: 5962679 - DNA, 16 bp, Homo sapiens
tttaaaaatacacatg

SEQ ID NO: 5962680 - DNA, 23 bp, Homo sapiens
tttaaaaatacagatagatatat

SEQ ID NO: 5962681 - DNA, 19 bp, Homo sapiens
tttaaaaataccaatcaca

SEQ ID NO: 5962682 - DNA, 16 bp, Homo sapiens
tttaaaaatagaaaca

SEQ ID NO: 5962683 - DNA, 15 bp, Homo sapiens
tttaaaaatatatat

SEQ ID NO: 5962684 - DNA, 12 bp, Homo sapiens
tttaaaaatatt

SEQ ID NO: 5962685 - DNA, 16 bp, Homo sapiens
tttaaaaatatttcag

SEQ ID NO: 5962686 - DNA, 14 bp, Homo sapiens
tttaaaaatatttt

SEQ ID NO: 5962687 - DNA, 15 bp, Homo sapiens
tttaaaaatcaactt

SEQ ID NO: 5962688 - DNA, 16 bp, Homo sapiens
tttaaaaatcataaac

SEQ ID NO: 5962689 - DNA, 20 bp, Homo sapiens
tttaaaaatcattgtatgga

SEQ ID NO: 5962690 - DNA, 15 bp, Homo sapiens
tttaaaaatccccaa

SEQ ID NO: 5962691 - DNA, 22 bp, Homo sapiens
tttaaaaatctacgtctttatt

SEQ ID NO: 5962692 - DNA, 16 bp, Homo sapiens
tttaaaaatctgccac

SEQ ID NO: 5962693 - DNA, 18 bp, Homo sapiens
tttaaaaatctgccacct

SEQ ID NO: 5962694 - DNA, 11 bp, Homo sapiens
tttaaaaatga

SEQ ID NO: 5962695 - DNA, 12 bp, Homo sapiens
tttaaaaatgat

SEQ ID NO: 5962696 - DNA, 14 bp, Homo sapiens
tttaaaaatgtctt

SEQ ID NO: 5962697 - DNA, 17 bp, Homo sapiens
tttaaaaatgtcttgct

SEQ ID NO: 5962698 - DNA, 19 bp, Homo sapiens
tttaaaaattgaaaaaagt

SEQ ID NO: 5962699 - DNA, 14 bp, Homo sapiens
tttaaaaatttact

SEQ ID NO: 5962700 - DNA, 14 bp, Homo sapiens
tttaaaacaaaaga

SEQ ID NO: 5962701 - DNA, 23 bp, Homo sapiens
tttaaaacaaagggaaaaaagag

SEQ ID NO: 5962702 - DNA, 21 bp, Homo sapiens
tttaaaacaagctgatagtgt

SEQ ID NO: 5962703 - DNA, 17 bp, Homo sapiens
tttaaaacacagtattg

SEQ ID NO: 5962704 - DNA, 23 bp, Homo sapiens
tttaaaacacagtattgtagaaa

SEQ ID NO: 5962705 - DNA, 13 bp, Homo sapiens
tttaaaacacatg

SEQ ID NO: 5962706 - DNA, 16 bp, Homo sapiens
tttaaaacacatgttt

SEQ ID NO: 5962707 - DNA, 18 bp, Homo sapiens
tttaaaacaccttctata

SEQ ID NO: 5962708 - DNA, 18 bp, Homo sapiens
tttaaaacatgctgtctt

SEQ ID NO: 5962709 - DNA, 21 bp, Homo sapiens
tttaaaacatttcatgtattt

SEQ ID NO: 5962710 - DNA, 16 bp, Homo sapiens
tttaaaacatttttta

SEQ ID NO: 5962711 - DNA, 13 bp, Homo sapiens
tttaaaacccaaa

SEQ ID NO: 5962712 - DNA, 14 bp, Homo sapiens
tttaaaacccaaac

SEQ ID NO: 5962713 - DNA, 14 bp, Homo sapiens
tttaaaacccattt

SEQ ID NO: 5962714 - DNA, 21 bp, Homo sapiens
tttaaaacctcttaataatct

SEQ ID NO: 5962715 - DNA, 21 bp, Homo sapiens
tttaaaacgcgtctgcctggg

SEQ ID NO: 5962716 - DNA, 17 bp, Homo sapiens
tttaaaacgtgtaaatg

SEQ ID NO: 5962717 - DNA, 20 bp, Homo sapiens
tttaaaactgtatttaagga

SEQ ID NO: 5962718 - DNA, 15 bp, Homo sapiens
tttaaaactgttgga

SEQ ID NO: 5962719 - DNA, 14 bp, Homo sapiens
tttaaaagaaactt

SEQ ID NO: 5962720 - DNA, 23 bp, Homo sapiens
tttaaaagaaacttaactgttct

SEQ ID NO: 5962721 - DNA, 12 bp, Homo sapiens
tttaaaagaaat

SEQ ID NO: 5962722 - DNA, 17 bp, Homo sapiens
tttaaaagaatgattat

SEQ ID NO: 5962723 - DNA, 23 bp, Homo sapiens
tttaaaagaatgggcagttacat

SEQ ID NO: 5962724 - DNA, 12 bp, Homo sapiens
tttaaaagacaa

SEQ ID NO: 5962725 - DNA, 16 bp, Homo sapiens
tttaaaagacaagact

SEQ ID NO: 5962726 - DNA, 12 bp, Homo sapiens
tttaaaagacac

SEQ ID NO: 5962727 - DNA, 23 bp, Homo sapiens
tttaaaagagagagagagaaaaa

SEQ ID NO: 5962728 - DNA, 19 bp, Homo sapiens
tttaaaagaggaaattaaa

SEQ ID NO: 5962729 - DNA, 20 bp, Homo sapiens
tttaaaagataaatattata

SEQ ID NO: 5962730 - DNA, 12 bp, Homo sapiens
tttaaaagcaaa

SEQ ID NO: 5962731 - DNA, 20 bp, Homo sapiens
tttaaaagcaattatattgt

SEQ ID NO: 5962732 - DNA, 14 bp, Homo sapiens
tttaaaagcatgaa

SEQ ID NO: 5962733 - DNA, 14 bp, Homo sapiens
tttaaaagcatttt

SEQ ID NO: 5962734 - DNA, 17 bp, Homo sapiens
tttaaaagccatgtata

SEQ ID NO: 5962735 - DNA, 20 bp, Homo sapiens
tttaaaaggatttttatctt

SEQ ID NO: 5962736 - DNA, 13 bp, Homo sapiens
tttaaaaggcaac

SEQ ID NO: 5962737 - DNA, 23 bp, Homo sapiens
tttaaaaggcaactcaaagatga

SEQ ID NO: 5962738 - DNA, 20 bp, Homo sapiens
tttaaaagggttcaaggact

SEQ ID NO: 5962739 - DNA, 21 bp, Homo sapiens
tttaaaagggttcaaggacta

SEQ ID NO: 5962740 - DNA, 16 bp, Homo sapiens
tttaagtgctgcattt

SEQ ID NO: 5962741 - DNA, 19 bp, Homo sapiens
tttaagtgctgcatttaaa

SEQ ID NO: 5962742 - DNA, 17 bp, Homo sapiens
tttaagtggactctctg

SEQ ID NO: 5962743 - DNA, 16 bp, Homo sapiens
tttaagtgggctcctg

SEQ ID NO: 5962744 - DNA, 17 bp, Homo sapiens
tttaagttaatagattt

SEQ ID NO: 5962745 - DNA, 18 bp, Homo sapiens
tttaagttaatgaaataa

SEQ ID NO: 5962746 - DNA, 16 bp, Homo sapiens
tttaagttattttaaa

SEQ ID NO: 5962747 - DNA, 19 bp, Homo sapiens
tttaagttcctgctgcctg

SEQ ID NO: 5962748 - DNA, 14 bp, Homo sapiens
tttaagttctattc

SEQ ID NO: 5962749 - DNA, 19 bp, Homo sapiens
tttaagttggctagagctt

SEQ ID NO: 5962750 - DNA, 13 bp, Homo sapiens
tttaagttgtaaa

SEQ ID NO: 5962751 - DNA, 21 bp, Homo sapiens
tttaagttgtctgtctgaatg

SEQ ID NO: 5962752 - DNA, 22 bp, Homo sapiens
tttaagtttcaaacttactatt

SEQ ID NO: 5962753 - DNA, 18 bp, Homo sapiens
tttaagtttgactacata

SEQ ID NO: 5962754 - DNA, 18 bp, Homo sapiens
tttaagtttgcagattta

SEQ ID NO: 5962755 - DNA, 16 bp, Homo sapiens
tttaagttttatttaa

SEQ ID NO: 5962756 - DNA, 21 bp, Homo sapiens
tttaagttttgattaatgttt

SEQ ID NO: 5962757 - DNA, 14 bp, Homo sapiens
tttaataaaaagga

SEQ ID NO: 5962758 - DNA, 20 bp, Homo sapiens
tttaataaaaaggcacctat

SEQ ID NO: 5962759 - DNA, 12 bp, Homo sapiens
tttaataaaaca

SEQ ID NO: 5962760 - DNA, 21 bp, Homo sapiens
tttaataaaactgcgaggaca

SEQ ID NO: 5962761 - DNA, 11 bp, Homo sapiens
tttaataaaag

SEQ ID NO: 5962762 - DNA, 12 bp, Homo sapiens
tttaataaaaga

SEQ ID NO: 5962763 - DNA, 19 bp, Homo sapiens
tttaataaaagatttacat

SEQ ID NO: 5962764 - DNA, 22 bp, Homo sapiens
tttaataaaagtactgaagacc

SEQ ID NO: 5962765 - DNA, 16 bp, Homo sapiens
tttaataaaataattc

SEQ ID NO: 5962766 - DNA, 20 bp, Homo sapiens
tttaataaaataattctaaa

SEQ ID NO: 5962767 - DNA, 15 bp, Homo sapiens
tttaataaacactct

SEQ ID NO: 5962768 - DNA, 13 bp, Homo sapiens
tttaataaaccat

SEQ ID NO: 5962769 - DNA, 14 bp, Homo sapiens
tttaataaactact

SEQ ID NO: 5962770 - DNA, 21 bp, Homo sapiens
tttaataaactttgaataaaa

SEQ ID NO: 5962771 - DNA, 14 bp, Homo sapiens
tttaataaagaaat

SEQ ID NO: 5962772 - DNA, 17 bp, Homo sapiens
tttaataaagaaatatt

SEQ ID NO: 5962773 - DNA, 14 bp, Homo sapiens
tttaataaagcttt

SEQ ID NO: 5962774 - DNA, 21 bp, Homo sapiens
tttaataaaggctgaagcttt

SEQ ID NO: 5962775 - DNA, 19 bp, Homo sapiens
tttaataaagtatgaatat

SEQ ID NO: 5962776 - DNA, 16 bp, Homo sapiens
tttaataaattgctta

SEQ ID NO: 5962777 - DNA, 23 bp, Homo sapiens
tttaataaattgcttactgatat

SEQ ID NO: 5962778 - DNA, 16 bp, Homo sapiens
tttaataacatatcta

SEQ ID NO: 5962779 - DNA, 12 bp, Homo sapiens
tttaataacatt

SEQ ID NO: 5962780 - DNA, 18 bp, Homo sapiens
tttaataacattacctta

SEQ ID NO: 5962781 - DNA, 12 bp, Homo sapiens
tttaataacttt

SEQ ID NO: 5962782 - DNA, 11 bp, Homo sapiens
tttaataagag

SEQ ID NO: 5962783 - DNA, 13 bp, Homo sapiens
tttaataagattt

SEQ ID NO: 5962784 - DNA, 14 bp, Homo sapiens
tttaataagtatat

SEQ ID NO: 5962785 - DNA, 16 bp, Homo sapiens
tttaataataatctag

SEQ ID NO: 5962786 - DNA, 18 bp, Homo sapiens
tttaataatatgtacaaa

SEQ ID NO: 5962787 - DNA, 20 bp, Homo sapiens
tttaataatatgtacaaata

SEQ ID NO: 5962788 - DNA, 22 bp, Homo sapiens
tttaataatatgtacaaataat

SEQ ID NO: 5962789 - DNA, 14 bp, Homo sapiens
tttaatacagcagt

SEQ ID NO: 5962790 - DNA, 21 bp, Homo sapiens
tttaatacaggacttttaaat

SEQ ID NO: 5962791 - DNA, 15 bp, Homo sapiens
tttaatactgttgtc

SEQ ID NO: 5962792 - DNA, 13 bp, Homo sapiens
tttaatagaaaat

SEQ ID NO: 5962793 - DNA, 17 bp, Homo sapiens
tttaatagaaccatgtt

SEQ ID NO: 5962794 - DNA, 17 bp, Homo sapiens
tttaatagaagttttat

SEQ ID NO: 5962795 - DNA, 11 bp, Homo sapiens
tttaatagact

SEQ ID NO: 5962796 - DNA, 22 bp, Homo sapiens
tttaatagagatgaatcagttt

SEQ ID NO: 5962797 - DNA, 16 bp, Homo sapiens
tttaatagcctgtcat

SEQ ID NO: 5962798 - DNA, 17 bp, Homo sapiens
tttaatagtcattccaa

SEQ ID NO: 5962799 - DNA, 20 bp, Homo sapiens
tttaatagtcattccaaata

SEQ ID NO: 5962800 - DNA, 13 bp, Homo sapiens
tttaatagtgctt

SEQ ID NO: 5962801 - DNA, 13 bp, Homo sapiens
tttaatataaaag

SEQ ID NO: 5962802 - DNA, 17 bp, Homo sapiens
tttaatataaaagatat

SEQ ID NO: 5962803 - DNA, 12 bp, Homo sapiens
tttaatataaac

SEQ ID NO: 5962804 - DNA, 23 bp, Homo sapiens
tttaatataaagtagtcctgtga

SEQ ID NO: 5962805 - DNA, 22 bp, Homo sapiens
tttaatatactaaccatttctt

SEQ ID NO: 5962806 - DNA, 15 bp, Homo sapiens
tttaatatactgcat

SEQ ID NO: 5962807 - DNA, 14 bp, Homo sapiens
tttaatatagctat

SEQ ID NO: 5962808 - DNA, 16 bp, Homo sapiens
tttaatatagctattt

SEQ ID NO: 5962809 - DNA, 23 bp, Homo sapiens
tttaatatattgaataaaaaata

SEQ ID NO: 5962810 - DNA, 15 bp, Homo sapiens
tttaatatcttcagc

SEQ ID NO: 5962811 - DNA, 20 bp, Homo sapiens
tttaatatgagcttcaatat

SEQ ID NO: 5962812 - DNA, 12 bp, Homo sapiens
tttaatatgcaa

SEQ ID NO: 5962813 - DNA, 14 bp, Homo sapiens
tttaatatgttgac

SEQ ID NO: 5962814 - DNA, 17 bp, Homo sapiens
tttaatattaaagccat

SEQ ID NO: 5962815 - DNA, 21 bp, Homo sapiens
tttaatattaaagccatgttt

SEQ ID NO: 5962816 - DNA, 16 bp, Homo sapiens
tttaatattactgtct

SEQ ID NO: 5962817 - DNA, 20 bp, Homo sapiens
tttaatattactgtctttat

SEQ ID NO: 5962818 - DNA, 22 bp, Homo sapiens
tttaatattcttttgtttccat

SEQ ID NO: 5962819 - DNA, 15 bp, Homo sapiens
tttaatattgagaaa

SEQ ID NO: 5962820 - DNA, 16 bp, Homo sapiens
tttaatatttatgttt

SEQ ID NO: 5962821 - DNA, 20 bp, Homo sapiens
tttaatattttgtattttca

SEQ ID NO: 5962822 - DNA, 17 bp, Homo sapiens
tttaatatttttcaaaa

SEQ ID NO: 5962823 - DNA, 21 bp, Homo sapiens
tttaatatttttcaaaatcaa

SEQ ID NO: 5962824 - DNA, 13 bp, Homo sapiens
tttaatcaaattt

SEQ ID NO: 5962825 - DNA, 15 bp, Homo sapiens
tttaatcaagagaga

SEQ ID NO: 5962826 - DNA, 15 bp, Homo sapiens
tttaatcaagcagtt

SEQ ID NO: 5962827 - DNA, 19 bp, Homo sapiens
tttaatcaagttgtaactt

SEQ ID NO: 5962828 - DNA, 19 bp, Homo sapiens
tttaatcacagtcatcttt

SEQ ID NO: 5962829 - DNA, 13 bp, Homo sapiens
tttaatcaggagg

SEQ ID NO: 5962830 - DNA, 16 bp, Homo sapiens
tttaatcagttctgtg

SEQ ID NO: 5962831 - DNA, 23 bp, Homo sapiens
tttaatcatagttactgtgtaaa

SEQ ID NO: 5962832 - DNA, 12 bp, Homo sapiens
tttaatcatata

SEQ ID NO: 5962833 - DNA, 22 bp, Homo sapiens
tttaatcatataaatagaatgt

SEQ ID NO: 5962834 - DNA, 24 bp, Homo sapiens
tttaatcatgaaattacttatcat

SEQ ID NO: 5962835 - DNA, 15 bp, Homo sapiens
tttaatcatgaatat

SEQ ID NO: 5962836 - DNA, 20 bp, Homo sapiens
tttaatcatgaatatgatga

SEQ ID NO: 5962837 - DNA, 17 bp, Homo sapiens
tttaatcatgagcctgt

SEQ ID NO: 5962838 - DNA, 15 bp, Homo sapiens
tttaatcattgcctg

SEQ ID NO: 5962839 - DNA, 12 bp, Homo sapiens
tttaatcattta

SEQ ID NO: 5962840 - DNA, 13 bp, Homo sapiens
tttaatcatttcc

SEQ ID NO: 5962841 - DNA, 15 bp, Homo sapiens
tttaatcatttccag

SEQ ID NO: 5962842 - DNA, 14 bp, Homo sapiens
tttaatccagaatt

SEQ ID NO: 5962843 - DNA, 14 bp, Homo sapiens
tttaatccattttt

SEQ ID NO: 5962844 - DNA, 15 bp, Homo sapiens
tttaatccattttta

SEQ ID NO: 5962845 - DNA, 21 bp, Homo sapiens
tttaatcccattgcaaacatt

SEQ ID NO: 5962846 - DNA, 22 bp, Homo sapiens
tttaatcccattgcaaacatta

SEQ ID NO: 5962847 - DNA, 12 bp, Homo sapiens
tttaatcccctg

SEQ ID NO: 5962848 - DNA, 21 bp, Homo sapiens
tttaatcccggtttcagaagc

SEQ ID NO: 5962849 - DNA, 22 bp, Homo sapiens
tttaatccctatgtttgtctca

SEQ ID NO: 5962850 - DNA, 13 bp, Homo sapiens
tttaatctactgc

SEQ ID NO: 5962851 - DNA, 17 bp, Homo sapiens
tttaatctactgcattt

SEQ ID NO: 5962852 - DNA, 21 bp, Homo sapiens
tttaatctccaccagtcattt

SEQ ID NO: 5962853 - DNA, 16 bp, Homo sapiens
tttaatctcctgagtt

SEQ ID NO: 5962854 - DNA, 23 bp, Homo sapiens
tttaatctctccaccttccaaag

SEQ ID NO: 5962855 - DNA, 18 bp, Homo sapiens
tttaatctgcatttatta

SEQ ID NO: 5962856 - DNA, 17 bp, Homo sapiens
tttaatctgttgtttga

SEQ ID NO: 5962857 - DNA, 12 bp, Homo sapiens
tttaatcttagc

SEQ ID NO: 5962858 - DNA, 14 bp, Homo sapiens
tttaatcttagctt

SEQ ID NO: 5962859 - DNA, 16 bp, Homo sapiens
tttaatcttagctttt

SEQ ID NO: 5962860 - DNA, 24 bp, Homo sapiens
tttaatcttagcttttaatagtgt

SEQ ID NO: 5962861 - DNA, 11 bp, Homo sapiens
tttaatgaaat

SEQ ID NO: 5962862 - DNA, 14 bp, Homo sapiens
tttaatgaaatcaa

SEQ ID NO: 5962863 - DNA, 20 bp, Homo sapiens
tttaatgaatttaaggcaaa

SEQ ID NO: 5962864 - DNA, 21 bp, Homo sapiens
tttaatgacattgatttctaa

SEQ ID NO: 5962865 - DNA, 17 bp, Homo sapiens
tttaatgagaatagaaa

SEQ ID NO: 5962866 - DNA, 15 bp, Homo sapiens
tttaatgatcaacaa

SEQ ID NO: 5962867 - DNA, 21 bp, Homo sapiens
tttaatgcaagagaacatttt

SEQ ID NO: 5962868 - DNA, 19 bp, Homo sapiens
tttaatgctaatcttgtga

SEQ ID NO: 5962869 - DNA, 19 bp, Homo sapiens
tttaatgctgtctttgtgg

SEQ ID NO: 5962870 - DNA, 22 bp, Homo sapiens
tttaatggaaagtttgtagcat

SEQ ID NO: 5962871 - DNA, 19 bp, Homo sapiens
tttaatggactgtgaattt

SEQ ID NO: 5962872 - DNA, 17 bp, Homo sapiens
tttaatggattgttaat

SEQ ID NO: 5962873 - DNA, 20 bp, Homo sapiens
tttaatggattgttaatttc

SEQ ID NO: 5962874 - DNA, 20 bp, Homo sapiens
tttaatggccggctggaaat

SEQ ID NO: 5962875 - DNA, 22 bp, Homo sapiens
tttaatgggggtagcagctgga

SEQ ID NO: 5962876 - DNA, 18 bp, Homo sapiens
tttaatggtgatggggta

SEQ ID NO: 5962877 - DNA, 12 bp, Homo sapiens
tttaatgtaaag

SEQ ID NO: 5962878 - DNA, 15 bp, Homo sapiens
tttaatgtaaagatt

SEQ ID NO: 5962879 - DNA, 21 bp, Homo sapiens
tttaatgtaatagggaaaatt

SEQ ID NO: 5962880 - DNA, 14 bp, Homo sapiens
tttaatgtagccat

SEQ ID NO: 5962881 - DNA, 10 bp, Homo sapiens
tttaatgtat

SEQ ID NO: 5962882 - DNA, 18 bp, Homo sapiens
tttaatgtatagtaaatc

SEQ ID NO: 5962883 - DNA, 20 bp, Homo sapiens
tttaatgtatatttgctgca

SEQ ID NO: 5962884 - DNA, 21 bp, Homo sapiens
tttaatgtatctatttgtaca

SEQ ID NO: 5962885 - DNA, 17 bp, Homo sapiens
tttaatgtgaacttgta

SEQ ID NO: 5962886 - DNA, 12 bp, Homo sapiens
tttaatgtgaag

SEQ ID NO: 5962887 - DNA, 18 bp, Homo sapiens
tttaatgtgctctgtacc

SEQ ID NO: 5962888 - DNA, 15 bp, Homo sapiens
tttaatgtgctgtgt

SEQ ID NO: 5962889 - DNA, 16 bp, Homo sapiens
tttaatgtgctgtgta

SEQ ID NO: 5962890 - DNA, 22 bp, Homo sapiens
tttaatgtgctgtgtaaagtta

SEQ ID NO: 5962891 - DNA, 16 bp, Homo sapiens
tttaatgttaactttc

SEQ ID NO: 5962892 - DNA, 22 bp, Homo sapiens
tttaatgttaattatgcagtgt

SEQ ID NO: 5962893 - DNA, 12 bp, Homo sapiens
tttaatgttcat

SEQ ID NO: 5962894 - DNA, 17 bp, Homo sapiens
tttaatgttcattttct

SEQ ID NO: 5962895 - DNA, 22 bp, Homo sapiens
tttaatgttcattttctctgta

SEQ ID NO: 5962896 - DNA, 15 bp, Homo sapiens
tttaatgttctgtga

SEQ ID NO: 5962897 - DNA, 22 bp, Homo sapiens
tttaatgttggaaaacatatga

SEQ ID NO: 5962898 - DNA, 19 bp, Homo sapiens
tttaatgttggaagagcat

SEQ ID NO: 5962899 - DNA, 23 bp, Homo sapiens
tttaatgtttattatttacatca

SEQ ID NO: 5962900 - DNA, 16 bp, Homo sapiens
tttaatgtttgattta

SEQ ID NO: 5962901 - DNA, 19 bp, Homo sapiens
tttaatgtttgtaagcaat

SEQ ID NO: 5962902 - DNA, 18 bp, Homo sapiens
tttaatgttttaaatgta

SEQ ID NO: 5962903 - DNA, 14 bp, Homo sapiens
tttaatgttttctg

SEQ ID NO: 5962904 - DNA, 16 bp, Homo sapiens
tttaatgtttttctgg

SEQ ID NO: 5962905 - DNA, 16 bp, Homo sapiens
tttaatgtttttttgt

SEQ ID NO: 5962906 - DNA, 17 bp, Homo sapiens
tttaattaaaaaatcaa

SEQ ID NO: 5962907 - DNA, 23 bp, Homo sapiens
tttaattaaaaactttaaagata

SEQ ID NO: 5962908 - DNA, 16 bp, Homo sapiens
tttaattaaaaatttt

SEQ ID NO: 5962909 - DNA, 15 bp, Homo sapiens
tttaattaaatctca

SEQ ID NO: 5962910 - DNA, 15 bp, Homo sapiens
tttaattaactatgt

SEQ ID NO: 5962911 - DNA, 19 bp, Homo sapiens
tttaattaactatgtgatg

SEQ ID NO: 5962912 - DNA, 14 bp, Homo sapiens
tttaattaagcaaa

SEQ ID NO: 5962913 - DNA, 23 bp, Homo sapiens
tttaattaatatgttcattaaat

SEQ ID NO: 5962914 - DNA, 19 bp, Homo sapiens
tttaattaatgaaatatct

SEQ ID NO: 5962915 - DNA, 22 bp, Homo sapiens
tttaattaatgaaatatctgta

SEQ ID NO: 5962916 - DNA, 19 bp, Homo sapiens
tttaattaattaagtatct

SEQ ID NO: 5962917 - DNA, 14 bp, Homo sapiens
tttaattaattggg

SEQ ID NO: 5962918 - DNA, 20 bp, Homo sapiens
tttaattacaaacaataaga

SEQ ID NO: 5962919 - DNA, 19 bp, Homo sapiens
tttagccccactgcttgca

SEQ ID NO: 5962920 - DNA, 16 bp, Homo sapiens
tttagccctgaacatt

SEQ ID NO: 5962921 - DNA, 21 bp, Homo sapiens
tttagccctggtttgaaattt

SEQ ID NO: 5962922 - DNA, 16 bp, Homo sapiens
tttagccctttaaaac

SEQ ID NO: 5962923 - DNA, 13 bp, Homo sapiens
tttagcctggctg

SEQ ID NO: 5962924 - DNA, 14 bp, Homo sapiens
tttagcctgtcctg

SEQ ID NO: 5962925 - DNA, 13 bp, Homo sapiens
tttagcctgtgtc

SEQ ID NO: 5962926 - DNA, 21 bp, Homo sapiens
tttagccttccaacatttctt

SEQ ID NO: 5962927 - DNA, 23 bp, Homo sapiens
tttagcgattgattgatgtacag

SEQ ID NO: 5962928 - DNA, 20 bp, Homo sapiens
tttagcgcacccagagaaaa

SEQ ID NO: 5962929 - DNA, 20 bp, Homo sapiens
tttagctacagcttgtttaa

SEQ ID NO: 5962930 - DNA, 21 bp, Homo sapiens
tttagctacagcttgtttaac

SEQ ID NO: 5962931 - DNA, 23 bp, Homo sapiens
tttagctactatatatgtgatga

SEQ ID NO: 5962932 - DNA, 15 bp, Homo sapiens
tttagctagaatcca

SEQ ID NO: 5962933 - DNA, 17 bp, Homo sapiens
tttagctagtatcttca

SEQ ID NO: 5962934 - DNA, 18 bp, Homo sapiens
tttagctagtatcttcaa

SEQ ID NO: 5962935 - DNA, 11 bp, Homo sapiens
tttagctctga

SEQ ID NO: 5962936 - DNA, 18 bp, Homo sapiens
tttagctctgatcagcat

SEQ ID NO: 5962937 - DNA, 15 bp, Homo sapiens
tttagctgacaaaat

SEQ ID NO: 5962938 - DNA, 23 bp, Homo sapiens
tttagctgatgaacttattctgt

SEQ ID NO: 5962939 - DNA, 20 bp, Homo sapiens
tttagctggaaaagtatgtt

SEQ ID NO: 5962940 - DNA, 23 bp, Homo sapiens
tttagctgtattcatatattgca

SEQ ID NO: 5962941 - DNA, 23 bp, Homo sapiens
tttagctgtgaatggctgtgccc

SEQ ID NO: 5962942 - DNA, 17 bp, Homo sapiens
tttagctgtgttattat

SEQ ID NO: 5962943 - DNA, 17 bp, Homo sapiens
tttagctgttttggaac

SEQ ID NO: 5962944 - DNA, 17 bp, Homo sapiens
tttagcttcctccagag

SEQ ID NO: 5962945 - DNA, 13 bp, Homo sapiens
tttagctttgaca

SEQ ID NO: 5962946 - DNA, 16 bp, Homo sapiens
tttagctttgtgttta

SEQ ID NO: 5962947 - DNA, 13 bp, Homo sapiens
tttaggaaaatca

SEQ ID NO: 5962948 - DNA, 13 bp, Homo sapiens
tttaggaaaatgc

SEQ ID NO: 5962949 - DNA, 12 bp, Homo sapiens
tttaggaaacac

SEQ ID NO: 5962950 - DNA, 21 bp, Homo sapiens
tttaggaaagttgtgattctt

SEQ ID NO: 5962951 - DNA, 16 bp, Homo sapiens
tttaggaaatttatac

SEQ ID NO: 5962952 - DNA, 19 bp, Homo sapiens
tttaggaaatttatacaaa

SEQ ID NO: 5962953 - DNA, 16 bp, Homo sapiens
tttaggaacttcagag

SEQ ID NO: 5962954 - DNA, 22 bp, Homo sapiens
tttaggaagttgacttatagta

SEQ ID NO: 5962955 - DNA, 19 bp, Homo sapiens
tttaggaataataaattca

SEQ ID NO: 5962956 - DNA, 14 bp, Homo sapiens
tttaggaatgctca

SEQ ID NO: 5962957 - DNA, 15 bp, Homo sapiens
tttaggacatgaaaa

SEQ ID NO: 5962958 - DNA, 10 bp, Homo sapiens
tttaggagaa

SEQ ID NO: 5962959 - DNA, 16 bp, Homo sapiens
tttaggagaaaccagc

SEQ ID NO: 5962960 - DNA, 23 bp, Homo sapiens
tttaggagaaattatagttaggc

SEQ ID NO: 5962961 - DNA, 14 bp, Homo sapiens
tttaggagaagttg

SEQ ID NO: 5962962 - DNA, 20 bp, Homo sapiens
tttaggagggagttatctaa

SEQ ID NO: 5962963 - DNA, 13 bp, Homo sapiens
tttaggatactta

SEQ ID NO: 5962964 - DNA, 16 bp, Homo sapiens
tttaggatacttaaca

SEQ ID NO: 5962965 - DNA, 21 bp, Homo sapiens
tttaggatacttaacaaatac

SEQ ID NO: 5962966 - DNA, 23 bp, Homo sapiens
tttaggatgtaactttataaata

SEQ ID NO: 5962967 - DNA, 23 bp, Homo sapiens
tttaggatgtgtatttcatttat

SEQ ID NO: 5962968 - DNA, 16 bp, Homo sapiens
tttaggattgaagtgg

SEQ ID NO: 5962969 - DNA, 17 bp, Homo sapiens
tttaggcagcctgccgc

SEQ ID NO: 5962970 - DNA, 14 bp, Homo sapiens
tttaggcaggaagt

SEQ ID NO: 5962971 - DNA, 19 bp, Homo sapiens
tttaggcagggatttgagg

SEQ ID NO: 5962972 - DNA, 21 bp, Homo sapiens
tttaggccatttgttacagtt

SEQ ID NO: 5962973 - DNA, 15 bp, Homo sapiens
tttaggccttgccag

SEQ ID NO: 5962974 - DNA, 17 bp, Homo sapiens
tttaggctattataata

SEQ ID NO: 5962975 - DNA, 23 bp, Homo sapiens
tttaggctattataatatagaaa

SEQ ID NO: 5962976 - DNA, 18 bp, Homo sapiens
tttaggctgttccttgta

SEQ ID NO: 5962977 - DNA, 12 bp, Homo sapiens
tttaggcttcta

SEQ ID NO: 5962978 - DNA, 16 bp, Homo sapiens
tttagggaacaatttg

SEQ ID NO: 5962979 - DNA, 16 bp, Homo sapiens
tttagggaagcaggga

SEQ ID NO: 5962980 - DNA, 20 bp, Homo sapiens
tttagggagacccaataaag

SEQ ID NO: 5962981 - DNA, 15 bp, Homo sapiens
tttagggagtattct

SEQ ID NO: 5962982 - DNA, 20 bp, Homo sapiens
tttagggctgtaaaatgcat

SEQ ID NO: 5962983 - DNA, 22 bp, Homo sapiens
tttaggggagttttgttttttg

SEQ ID NO: 5962984 - DNA, 19 bp, Homo sapiens
tttaggggcaaacatcaca

SEQ ID NO: 5962985 - DNA, 20 bp, Homo sapiens
tttaggggtagaaaatgttt

SEQ ID NO: 5962986 - DNA, 17 bp, Homo sapiens
tttaggggtagcatttg

SEQ ID NO: 5962987 - DNA, 16 bp, Homo sapiens
tttaggggtgaaggag

SEQ ID NO: 5962988 - DNA, 14 bp, Homo sapiens
tttagggtactaaa

SEQ ID NO: 5962989 - DNA, 21 bp, Homo sapiens
tttagggtgattttaaagaac

SEQ ID NO: 5962990 - DNA, 18 bp, Homo sapiens
tttagggttctaaatgca

SEQ ID NO: 5962991 - DNA, 20 bp, Homo sapiens
tttaggtcatccaacctctt

SEQ ID NO: 5962992 - DNA, 17 bp, Homo sapiens
tttaggtgcctcctgtc

SEQ ID NO: 5962993 - DNA, 20 bp, Homo sapiens
tttaggtgcctcctgtctta

SEQ ID NO: 5962994 - DNA, 13 bp, Homo sapiens
tttaggtgcttta

SEQ ID NO: 5962995 - DNA, 14 bp, Homo sapiens
tttaggttaacaat

SEQ ID NO: 5962996 - DNA, 13 bp, Homo sapiens
tttaggttctaaa

SEQ ID NO: 5962997 - DNA, 21 bp, Homo sapiens
tttaggtttgaaaggcaattt

SEQ ID NO: 5962998 - DNA, 19 bp, Homo sapiens
tttagtaaaaataaatcaa

SEQ ID NO: 5962999 - DNA, 19 bp, Homo sapiens
tttagtaaaattatctgtt

SEQ ID NO: 5963000 - DNA, 21 bp, Homo sapiens
tttagtaaaattatctgttct

SEQ ID NO: 5963001 - DNA, 22 bp, Homo sapiens
tttagtaaaccaatcctatgca

SEQ ID NO: 5963002 - DNA, 18 bp, Homo sapiens
tttagtaaatacatcact

SEQ ID NO: 5963003 - DNA, 12 bp, Homo sapiens
tttagtaaatgt

SEQ ID NO: 5963004 - DNA, 14 bp, Homo sapiens
tttagtaagtatgt

SEQ ID NO: 5963005 - DNA, 23 bp, Homo sapiens
tttagtaagtatgttttttatgt

SEQ ID NO: 5963006 - DNA, 20 bp, Homo sapiens
tttagtaatagtccaatatt

SEQ ID NO: 5963007 - DNA, 18 bp, Homo sapiens
tttagtaatattttactt

SEQ ID NO: 5963008 - DNA, 19 bp, Homo sapiens
tttagtaatctgtacattt

SEQ ID NO: 5963009 - DNA, 15 bp, Homo sapiens
tttagtaatttccta

SEQ ID NO: 5963010 - DNA, 12 bp, Homo sapiens
tttagtacaata

SEQ ID NO: 5963011 - DNA, 21 bp, Homo sapiens
tttagtacctgaaaagtaact

SEQ ID NO: 5963012 - DNA, 17 bp, Homo sapiens
tttagtactcaatgttt

SEQ ID NO: 5963013 - DNA, 22 bp, Homo sapiens
tttagtactgaagccaaatgaa

SEQ ID NO: 5963014 - DNA, 18 bp, Homo sapiens
tttagtagagacagtgtt

SEQ ID NO: 5963015 - DNA, 20 bp, Homo sapiens
tttagtagagacagtgtttt

SEQ ID NO: 5963016 - DNA, 23 bp, Homo sapiens
tttagtagatattaccagttttc

SEQ ID NO: 5963017 - DNA, 16 bp, Homo sapiens
tttagtatacgtataa

SEQ ID NO: 5963018 - DNA, 22 bp, Homo sapiens
tttagtatatgaaatattttga

SEQ ID NO: 5963019 - DNA, 23 bp, Homo sapiens
tttagtatatgaaatattttgaa

SEQ ID NO: 5963020 - DNA, 22 bp, Homo sapiens
tttagtatcagtgttttaaatt

SEQ ID NO: 5963021 - DNA, 17 bp, Homo sapiens
tttagtatccacaggat

SEQ ID NO: 5963022 - DNA, 20 bp, Homo sapiens
tttagtatgacgctgataca

SEQ ID NO: 5963023 - DNA, 15 bp, Homo sapiens
tttagtattatcaaa

SEQ ID NO: 5963024 - DNA, 15 bp, Homo sapiens
tttagtattcattct

SEQ ID NO: 5963025 - DNA, 21 bp, Homo sapiens
tttagtcacgtgtattttcat

SEQ ID NO: 5963026 - DNA, 17 bp, Homo sapiens
tttagtcactaagactt

SEQ ID NO: 5963027 - DNA, 23 bp, Homo sapiens
tttagtcagaaatgattcagggt

SEQ ID NO: 5963028 - DNA, 17 bp, Homo sapiens
tttagtcatttaagaat

SEQ ID NO: 5963029 - DNA, 20 bp, Homo sapiens
tttagtccacggacccccag

SEQ ID NO: 5963030 - DNA, 21 bp, Homo sapiens
tttagtccacggacccccaga

SEQ ID NO: 5963031 - DNA, 18 bp, Homo sapiens
tttagtctaacacagttg

SEQ ID NO: 5963032 - DNA, 21 bp, Homo sapiens
tttagtctacataggcaaagt

SEQ ID NO: 5963033 - DNA, 18 bp, Homo sapiens
tttagtctgcaaaatgag

SEQ ID NO: 5963034 - DNA, 15 bp, Homo sapiens
tttagtcttttactc

SEQ ID NO: 5963035 - DNA, 17 bp, Homo sapiens
tttagtcttttactcct

SEQ ID NO: 5963036 - DNA, 22 bp, Homo sapiens
tttagtcttttactcctttgca

SEQ ID NO: 5963037 - DNA, 12 bp, Homo sapiens
tttagtgaaaaa

SEQ ID NO: 5963038 - DNA, 20 bp, Homo sapiens
tttagtgaaaaactgctgta

SEQ ID NO: 5963039 - DNA, 18 bp, Homo sapiens
tttagtgatttttttcat

SEQ ID NO: 5963040 - DNA, 23 bp, Homo sapiens
tttagtgccaatgttgtgtgttg

SEQ ID NO: 5963041 - DNA, 13 bp, Homo sapiens
tttagtgccaggc

SEQ ID NO: 5963042 - DNA, 23 bp, Homo sapiens
tttagtgccctgccccctggctg

SEQ ID NO: 5963043 - DNA, 13 bp, Homo sapiens
tttagtgctgcat

SEQ ID NO: 5963044 - DNA, 17 bp, Homo sapiens
tttagtgctttgtgata

SEQ ID NO: 5963045 - DNA, 19 bp, Homo sapiens
tttagtggaagcttctaaa

SEQ ID NO: 5963046 - DNA, 20 bp, Homo sapiens
tttagtggaagcttctaaat

SEQ ID NO: 5963047 - DNA, 20 bp, Homo sapiens
tttagtggaccctgaaatgt

SEQ ID NO: 5963048 - DNA, 20 bp, Homo sapiens
tttagtggccatcatttctg

SEQ ID NO: 5963049 - DNA, 24 bp, Homo sapiens
tttagtggtagcatatagattgtc

SEQ ID NO: 5963050 - DNA, 22 bp, Homo sapiens
tttagtggtggtagaaatgatt

SEQ ID NO: 5963051 - DNA, 22 bp, Homo sapiens
tttagtgtaaaaatgagaacat

SEQ ID NO: 5963052 - DNA, 18 bp, Homo sapiens
tttagtgtaaaattgtta

SEQ ID NO: 5963053 - DNA, 16 bp, Homo sapiens
tttagtgtaataagac

SEQ ID NO: 5963054 - DNA, 16 bp, Homo sapiens
tttagtgtattttctg

SEQ ID NO: 5963055 - DNA, 14 bp, Homo sapiens
tttagtgtctgacc

SEQ ID NO: 5963056 - DNA, 22 bp, Homo sapiens
tttagtgtgaatattcctttat

SEQ ID NO: 5963057 - DNA, 15 bp, Homo sapiens
tttagtgtgctgctg

SEQ ID NO: 5963058 - DNA, 17 bp, Homo sapiens
tttagtgtgctgctgtt

SEQ ID NO: 5963059 - DNA, 23 bp, Homo sapiens
tttagtgtgctgctgttctgtgt

SEQ ID NO: 5963060 - DNA, 15 bp, Homo sapiens
tttagtgtgtaaaat

SEQ ID NO: 5963061 - DNA, 17 bp, Homo sapiens
tttagtgtgtaaaatta

SEQ ID NO: 5963062 - DNA, 18 bp, Homo sapiens
tttagtgttagttataaa

SEQ ID NO: 5963063 - DNA, 21 bp, Homo sapiens
tttagtgtttttttatttcta

SEQ ID NO: 5963064 - DNA, 23 bp, Homo sapiens
tttagttaagcatgactttagat

SEQ ID NO: 5963065 - DNA, 16 bp, Homo sapiens
tttagttacagctgtg

SEQ ID NO: 5963066 - DNA, 21 bp, Homo sapiens
tttagttaccgagacatgaat

SEQ ID NO: 5963067 - DNA, 21 bp, Homo sapiens
tttagttacgtataatgcttt

SEQ ID NO: 5963068 - DNA, 13 bp, Homo sapiens
tttagttactgaa

SEQ ID NO: 5963069 - DNA, 16 bp, Homo sapiens
tttagttactttagat

SEQ ID NO: 5963070 - DNA, 15 bp, Homo sapiens
tttagttatagtttc

SEQ ID NO: 5963071 - DNA, 22 bp, Homo sapiens
tttagttcaccccttatcctga

SEQ ID NO: 5963072 - DNA, 23 bp, Homo sapiens
tttagttgaattttttttaacat

SEQ ID NO: 5963073 - DNA, 13 bp, Homo sapiens
tttagttgactaa

SEQ ID NO: 5963074 - DNA, 19 bp, Homo sapiens
tttagttgcagaaacattt

SEQ ID NO: 5963075 - DNA, 19 bp, Homo sapiens
tttagttgcagactcagtt

SEQ ID NO: 5963076 - DNA, 19 bp, Homo sapiens
tttagttggaaaaacaatt

SEQ ID NO: 5963077 - DNA, 17 bp, Homo sapiens
tttagttggcatttgtt

SEQ ID NO: 5963078 - DNA, 17 bp, Homo sapiens
tttagttgtatctcttt

SEQ ID NO: 5963079 - DNA, 13 bp, Homo sapiens
tttagtttaaaat

SEQ ID NO: 5963080 - DNA, 15 bp, Homo sapiens
tttagtttaaaatct

SEQ ID NO: 5963081 - DNA, 16 bp, Homo sapiens
tttagtttaaaatctt

SEQ ID NO: 5963082 - DNA, 20 bp, Homo sapiens
tttagtttgtactcagtgga

SEQ ID NO: 5963083 - DNA, 12 bp, Homo sapiens
tttagtttgttt

SEQ ID NO: 5963084 - DNA, 16 bp, Homo sapiens
tttagttttaaaactc

SEQ ID NO: 5963085 - DNA, 13 bp, Homo sapiens
tttagttttctct

SEQ ID NO: 5963086 - DNA, 15 bp, Homo sapiens
tttagttttctctta

SEQ ID NO: 5963087 - DNA, 12 bp, Homo sapiens
tttagtttttct

SEQ ID NO: 5963088 - DNA, 20 bp, Homo sapiens
tttataaaaaaaatgaaatg

SEQ ID NO: 5963089 - DNA, 22 bp, Homo sapiens
tttataaaaacattgaaatatt

SEQ ID NO: 5963090 - DNA, 23 bp, Homo sapiens
tttataaaaacccctaaaaacaa

SEQ ID NO: 5963091 - DNA, 21 bp, Homo sapiens
tttataaaaataaaaaacact

SEQ ID NO: 5963092 - DNA, 22 bp, Homo sapiens
tttataaaaataaatagaaaag

SEQ ID NO: 5963093 - DNA, 19 bp, Homo sapiens
tttataaaaatataaattg

SEQ ID NO: 5963094 - DNA, 13 bp, Homo sapiens
tttattattgttt

SEQ ID NO: 5963095 - DNA, 17 bp, Homo sapiens
tttattattgtttatgc

SEQ ID NO: 5963096 - DNA, 23 bp, Homo sapiens
tttattatttattttttttaatt

SEQ ID NO: 5963097 - DNA, 15 bp, Homo sapiens
tttattattttcata

SEQ ID NO: 5963098 - DNA, 14 bp, Homo sapiens
tttattattttctt

SEQ ID NO: 5963099 - DNA, 16 bp, Homo sapiens
tttattatttttacct

SEQ ID NO: 5963100 - DNA, 15 bp, Homo sapiens
tttattcaaactacc

SEQ ID NO: 5963101 - DNA, 14 bp, Homo sapiens
tttattcaaactga

SEQ ID NO: 5963102 - DNA, 17 bp, Homo sapiens
tttattcaaacttttat

SEQ ID NO: 5963103 - DNA, 18 bp, Homo sapiens
tttattcaaggaagtttt

SEQ ID NO: 5963104 - DNA, 17 bp, Homo sapiens
tttattcaagttattgt

SEQ ID NO: 5963105 - DNA, 11 bp, Homo sapiens
tttattcacat

SEQ ID NO: 5963106 - DNA, 14 bp, Homo sapiens
tttattcacatata

SEQ ID NO: 5963107 - DNA, 16 bp, Homo sapiens
tttattcaccttttct

SEQ ID NO: 5963108 - DNA, 18 bp, Homo sapiens
tttattcagctagaattt

SEQ ID NO: 5963109 - DNA, 22 bp, Homo sapiens
tttattcagcttcatttgtgtc

SEQ ID NO: 5963110 - DNA, 16 bp, Homo sapiens
tttattcagtaaacaa

SEQ ID NO: 5963111 - DNA, 18 bp, Homo sapiens
tttattcagtaaacaaat

SEQ ID NO: 5963112 - DNA, 21 bp, Homo sapiens
tttattcatacgtaaaatttt

SEQ ID NO: 5963113 - DNA, 15 bp, Homo sapiens
tttattcatatgcat

SEQ ID NO: 5963114 - DNA, 16 bp, Homo sapiens
tttattcatatgcata

SEQ ID NO: 5963115 - DNA, 14 bp, Homo sapiens
tttattcatctgca

SEQ ID NO: 5963116 - DNA, 20 bp, Homo sapiens
tttattcatgccatctgttt

SEQ ID NO: 5963117 - DNA, 18 bp, Homo sapiens
tttattcattagctgtga

SEQ ID NO: 5963118 - DNA, 13 bp, Homo sapiens
tttattcattcag

SEQ ID NO: 5963119 - DNA, 23 bp, Homo sapiens
tttattccagaatgctgtacatc

SEQ ID NO: 5963120 - DNA, 21 bp, Homo sapiens
tttattccccagtgactccag

SEQ ID NO: 5963121 - DNA, 22 bp, Homo sapiens
tttattccctgcccaaaccctt

SEQ ID NO: 5963122 - DNA, 17 bp, Homo sapiens
tttattcctctgtccta

SEQ ID NO: 5963123 - DNA, 16 bp, Homo sapiens
tttattcctgtatgtt

SEQ ID NO: 5963124 - DNA, 13 bp, Homo sapiens
tttattccttcca

SEQ ID NO: 5963125 - DNA, 14 bp, Homo sapiens
tttattccttccat

SEQ ID NO: 5963126 - DNA, 18 bp, Homo sapiens
tttattctatgtatgtta

SEQ ID NO: 5963127 - DNA, 22 bp, Homo sapiens
tttattctcagaacaccaagta

SEQ ID NO: 5963128 - DNA, 20 bp, Homo sapiens
tttattctcaggtaatcatt

SEQ ID NO: 5963129 - DNA, 17 bp, Homo sapiens
tttattctctgctgcat

SEQ ID NO: 5963130 - DNA, 12 bp, Homo sapiens
tttattctgtat

SEQ ID NO: 5963131 - DNA, 21 bp, Homo sapiens
tttattctgtcaatgaaaagc

SEQ ID NO: 5963132 - DNA, 14 bp, Homo sapiens
tttattctgtccat

SEQ ID NO: 5963133 - DNA, 12 bp, Homo sapiens
tttattctgtgg

SEQ ID NO: 5963134 - DNA, 15 bp, Homo sapiens
tttattctgtggttc

SEQ ID NO: 5963135 - DNA, 14 bp, Homo sapiens
tttattctgttata

SEQ ID NO: 5963136 - DNA, 12 bp, Homo sapiens
tttattctgttt

SEQ ID NO: 5963137 - DNA, 17 bp, Homo sapiens
tttattctgttttcttg

SEQ ID NO: 5963138 - DNA, 18 bp, Homo sapiens
tttattctgttttcttgt

SEQ ID NO: 5963139 - DNA, 17 bp, Homo sapiens
tttattcttattactat

SEQ ID NO: 5963140 - DNA, 14 bp, Homo sapiens
tttattcttccaga

SEQ ID NO: 5963141 - DNA, 16 bp, Homo sapiens
tttattcttccagaat

SEQ ID NO: 5963142 - DNA, 15 bp, Homo sapiens
tttattcttctagag

SEQ ID NO: 5963143 - DNA, 12 bp, Homo sapiens
tttattcttgat

SEQ ID NO: 5963144 - DNA, 16 bp, Homo sapiens
tttattctttaattgt

SEQ ID NO: 5963145 - DNA, 16 bp, Homo sapiens
tttattgaacttgaaa

SEQ ID NO: 5963146 - DNA, 13 bp, Homo sapiens
tttattgaagaac

SEQ ID NO: 5963147 - DNA, 13 bp, Homo sapiens
tttattgaatatt

SEQ ID NO: 5963148 - DNA, 23 bp, Homo sapiens
tttattgaattattttgttactg

SEQ ID NO: 5963149 - DNA, 12 bp, Homo sapiens
tttattgacaat

SEQ ID NO: 5963150 - DNA, 12 bp, Homo sapiens
tttattgacaca

SEQ ID NO: 5963151 - DNA, 13 bp, Homo sapiens
tttattgacacag

SEQ ID NO: 5963152 - DNA, 14 bp, Homo sapiens
tttattgacacaga

SEQ ID NO: 5963153 - DNA, 12 bp, Homo sapiens
tttattgagtac

SEQ ID NO: 5963154 - DNA, 18 bp, Homo sapiens
tttattgatgtgcaaaaa

SEQ ID NO: 5963155 - DNA, 12 bp, Homo sapiens
tttattgcaatg

SEQ ID NO: 5963156 - DNA, 21 bp, Homo sapiens
tttattgcacaaaatataaag

SEQ ID NO: 5963157 - DNA, 17 bp, Homo sapiens
tttattgcatatagatt

SEQ ID NO: 5963158 - DNA, 17 bp, Homo sapiens
tttattgccattatagc

SEQ ID NO: 5963159 - DNA, 14 bp, Homo sapiens
tttattgctacttc

SEQ ID NO: 5963160 - DNA, 15 bp, Homo sapiens
tttattgctgcattt

SEQ ID NO: 5963161 - DNA, 16 bp, Homo sapiens
tttattgctgcatttt

SEQ ID NO: 5963162 - DNA, 19 bp, Homo sapiens
tttattgctgtgtaacact

SEQ ID NO: 5963163 - DNA, 13 bp, Homo sapiens
tttattgcttgtt

SEQ ID NO: 5963164 - DNA, 14 bp, Homo sapiens
tttattgctttata

SEQ ID NO: 5963165 - DNA, 18 bp, Homo sapiens
tttattggaagtgttcaa

SEQ ID NO: 5963166 - DNA, 17 bp, Homo sapiens
tttattggcttttctga

SEQ ID NO: 5963167 - DNA, 15 bp, Homo sapiens
tttattggttttgca

SEQ ID NO: 5963168 - DNA, 12 bp, Homo sapiens
tttattgtaaaa

SEQ ID NO: 5963169 - DNA, 16 bp, Homo sapiens
tttattgtaacagaca

SEQ ID NO: 5963170 - DNA, 18 bp, Homo sapiens
tttattgtaatcataaat

SEQ ID NO: 5963171 - DNA, 12 bp, Homo sapiens
tttattgtacag

SEQ ID NO: 5963172 - DNA, 18 bp, Homo sapiens
tttattgtacagactgtt

SEQ ID NO: 5963173 - DNA, 18 bp, Homo sapiens
tttattgtattctggggt

SEQ ID NO: 5963174 - DNA, 22 bp, Homo sapiens
tttattgtcagttttgttcact

SEQ ID NO: 5963175 - DNA, 21 bp, Homo sapiens
tttattgtcattactgccttt

SEQ ID NO: 5963176 - DNA, 14 bp, Homo sapiens
tttattgtctgtaa

SEQ ID NO: 5963177 - DNA, 18 bp, Homo sapiens
tttattgtgcattaaaat

SEQ ID NO: 5963178 - DNA, 23 bp, Homo sapiens
tttattgttcacacaaagcctgt

SEQ ID NO: 5963179 - DNA, 18 bp, Homo sapiens
tttattgtttgaaatgtc

SEQ ID NO: 5963180 - DNA, 16 bp, Homo sapiens
tttatttaaaactctg

SEQ ID NO: 5963181 - DNA, 12 bp, Homo sapiens
tttatttaaaag

SEQ ID NO: 5963182 - DNA, 15 bp, Homo sapiens
tttatttaaaagatt

SEQ ID NO: 5963183 - DNA, 14 bp, Homo sapiens
tttatttaaactat

SEQ ID NO: 5963184 - DNA, 15 bp, Homo sapiens
tttatttaaatgctt

SEQ ID NO: 5963185 - DNA, 13 bp, Homo sapiens
tttatttaaggat

SEQ ID NO: 5963186 - DNA, 14 bp, Homo sapiens
tttatttaaggatg

SEQ ID NO: 5963187 - DNA, 18 bp, Homo sapiens
tttatttaaggatggatg

SEQ ID NO: 5963188 - DNA, 19 bp, Homo sapiens
tttatttaaggatggatgg

SEQ ID NO: 5963189 - DNA, 22 bp, Homo sapiens
tttatttaaggatggatggcac

SEQ ID NO: 5963190 - DNA, 18 bp, Homo sapiens
tttatttaattaaatgta

SEQ ID NO: 5963191 - DNA, 19 bp, Homo sapiens
tttatttaattaaatgtat

SEQ ID NO: 5963192 - DNA, 18 bp, Homo sapiens
tttatttacagctgtgct

SEQ ID NO: 5963193 - DNA, 12 bp, Homo sapiens
tttatttacttc

SEQ ID NO: 5963194 - DNA, 15 bp, Homo sapiens
tttatttaggaaaca

SEQ ID NO: 5963195 - DNA, 15 bp, Homo sapiens
tttatttagggaaca

SEQ ID NO: 5963196 - DNA, 14 bp, Homo sapiens
tttatttatatctt

SEQ ID NO: 5963197 - DNA, 19 bp, Homo sapiens
tttatttatatgtactgtt

SEQ ID NO: 5963198 - DNA, 15 bp, Homo sapiens
tttatttatatgtat

SEQ ID NO: 5963199 - DNA, 17 bp, Homo sapiens
tttatttatatttattg

SEQ ID NO: 5963200 - DNA, 14 bp, Homo sapiens
tttatttatcagtg

SEQ ID NO: 5963201 - DNA, 16 bp, Homo sapiens
tttatttatttatttg

SEQ ID NO: 5963202 - DNA, 15 bp, Homo sapiens
tttatttattttatc

SEQ ID NO: 5963203 - DNA, 10 bp, Homo sapiens
tttatttcaa

SEQ ID NO: 5963204 - DNA, 19 bp, Homo sapiens
tttatttcaataaatcttt

SEQ ID NO: 5963205 - DNA, 14 bp, Homo sapiens
tttatttcaatgta

SEQ ID NO: 5963206 - DNA, 13 bp, Homo sapiens
tttatttcacata

SEQ ID NO: 5963207 - DNA, 11 bp, Homo sapiens
tttatttcact

SEQ ID NO: 5963208 - DNA, 15 bp, Homo sapiens
tttatttcagatttt

SEQ ID NO: 5963209 - DNA, 19 bp, Homo sapiens
tttatttcagcaaacttgt

SEQ ID NO: 5963210 - DNA, 12 bp, Homo sapiens
tttatttcatga

SEQ ID NO: 5963211 - DNA, 11 bp, Homo sapiens
tttatttcatt

SEQ ID NO: 5963212 - DNA, 12 bp, Homo sapiens
tttatttccaaa

SEQ ID NO: 5963213 - DNA, 13 bp, Homo sapiens
tttatttccatat

SEQ ID NO: 5963214 - DNA, 17 bp, Homo sapiens
tttatttcctatgatgt

SEQ ID NO: 5963215 - DNA, 21 bp, Homo sapiens
tttatttcctgctacttaaat

SEQ ID NO: 5963216 - DNA, 13 bp, Homo sapiens
tttatttcctgta

SEQ ID NO: 5963217 - DNA, 16 bp, Homo sapiens
tttatttctaagtatt

SEQ ID NO: 5963218 - DNA, 14 bp, Homo sapiens
tttatttctactgt

SEQ ID NO: 5963219 - DNA, 15 bp, Homo sapiens
tttatttctcctttt

SEQ ID NO: 5963220 - DNA, 21 bp, Homo sapiens
tttatttctccttttgtgttc

SEQ ID NO: 5963221 - DNA, 13 bp, Homo sapiens
tttatttctctct

SEQ ID NO: 5963222 - DNA, 13 bp, Homo sapiens
tttatttctctgg

SEQ ID NO: 5963223 - DNA, 12 bp, Homo sapiens
tttatttctctt

SEQ ID NO: 5963224 - DNA, 16 bp, Homo sapiens
tttatttctgagcaaa

SEQ ID NO: 5963225 - DNA, 16 bp, Homo sapiens
tttatttctgcatatg

SEQ ID NO: 5963226 - DNA, 16 bp, Homo sapiens
tttatttctgtatctg

SEQ ID NO: 5963227 - DNA, 15 bp, Homo sapiens
tttatttctgtgaaa

SEQ ID NO: 5963228 - DNA, 12 bp, Homo sapiens
tttatttgagaa

SEQ ID NO: 5963229 - DNA, 17 bp, Homo sapiens
tttatttgaggtcagtg

SEQ ID NO: 5963230 - DNA, 23 bp, Homo sapiens
tttatttgcaatttgagccattt

SEQ ID NO: 5963231 - DNA, 11 bp, Homo sapiens
tttatttgcat

SEQ ID NO: 5963232 - DNA, 18 bp, Homo sapiens
tttatttgcttattttta

SEQ ID NO: 5963233 - DNA, 12 bp, Homo sapiens
tttatttggcat

SEQ ID NO: 5963234 - DNA, 13 bp, Homo sapiens
tttatttgtatta

SEQ ID NO: 5963235 - DNA, 17 bp, Homo sapiens
tttatttgtattactag

SEQ ID NO: 5963236 - DNA, 14 bp, Homo sapiens
tttatttgttgaga

SEQ ID NO: 5963237 - DNA, 14 bp, Homo sapiens
tttatttgtttttc

SEQ ID NO: 5963238 - DNA, 22 bp, Homo sapiens
tttattttaaaaaacactgata

SEQ ID NO: 5963239 - DNA, 20 bp, Homo sapiens
tttattttaaaatttcatag

SEQ ID NO: 5963240 - DNA, 17 bp, Homo sapiens
tttattttaatgtaaag

SEQ ID NO: 5963241 - DNA, 10 bp, Homo sapiens
tttattttac

SEQ ID NO: 5963242 - DNA, 13 bp, Homo sapiens
tttattttagcaa

SEQ ID NO: 5963243 - DNA, 14 bp, Homo sapiens
tttattttagcaaa

SEQ ID NO: 5963244 - DNA, 15 bp, Homo sapiens
tttattttagcagtt

SEQ ID NO: 5963245 - DNA, 23 bp, Homo sapiens
tttattttagcagttctgcaaat

SEQ ID NO: 5963246 - DNA, 16 bp, Homo sapiens
tttattttaggcactg

SEQ ID NO: 5963247 - DNA, 21 bp, Homo sapiens
tttattttatataataaagta

SEQ ID NO: 5963248 - DNA, 20 bp, Homo sapiens
tttattttatgagaaatgta

SEQ ID NO: 5963249 - DNA, 16 bp, Homo sapiens
tttattttatgtttag

SEQ ID NO: 5963250 - DNA, 12 bp, Homo sapiens
tttattttccta

SEQ ID NO: 5963251 - DNA, 15 bp, Homo sapiens
tttattttcctaaag

SEQ ID NO: 5963252 - DNA, 14 bp, Homo sapiens
tttattttcctgtg

SEQ ID NO: 5963253 - DNA, 22 bp, Homo sapiens
tttattttctggtagatagaaa

SEQ ID NO: 5963254 - DNA, 16 bp, Homo sapiens
tttattttctgtgtaa

SEQ ID NO: 5963255 - DNA, 19 bp, Homo sapiens
tttattttgaaaagcttct

SEQ ID NO: 5963256 - DNA, 14 bp, Homo sapiens
tttattttgaatgt

SEQ ID NO: 5963257 - DNA, 16 bp, Homo sapiens
tttattttgaatgtac

SEQ ID NO: 5963258 - DNA, 16 bp, Homo sapiens
tttattttgctccctc

SEQ ID NO: 5963259 - DNA, 18 bp, Homo sapiens
tttattttgctgagttgt

SEQ ID NO: 5963260 - DNA, 18 bp, Homo sapiens
tttattttgctttgtctt

SEQ ID NO: 5963261 - DNA, 22 bp, Homo sapiens
tttattttggaattggtgtata

SEQ ID NO: 5963262 - DNA, 18 bp, Homo sapiens
tttattttgtaattattg

SEQ ID NO: 5963263 - DNA, 21 bp, Homo sapiens
tttattttgtatgaaatatat

SEQ ID NO: 5963264 - DNA, 23 bp, Homo sapiens
tttattttgtatttttgaataaa

SEQ ID NO: 5963265 - DNA, 21 bp, Homo sapiens
tttattttgtctctgagattt

SEQ ID NO: 5963266 - DNA, 12 bp, Homo sapiens
tttattttgtgg

SEQ ID NO: 5963267 - DNA, 15 bp, Homo sapiens
tttattttgtgtaaa

SEQ ID NO: 5963268 - DNA, 15 bp, Homo sapiens
tttattttgttaaaa

SEQ ID NO: 5963269 - DNA, 15 bp, Homo sapiens
tttatttttaagaaa

SEQ ID NO: 5963270 - DNA, 21 bp, Homo sapiens
tttatttttaagaaaaattca

SEQ ID NO: 5963271 - DNA, 14 bp, Homo sapiens
tttatttttacctg

SEQ ID NO: 5963272 - DNA, 15 bp, Homo sapiens
tttatttttcatatt

SEQ ID NO: 5963273 - DNA, 20 bp, Homo sapiens
tttatttttcatattgtgcc

SEQ ID NO: 5963274 - DNA, 17 bp, Homo sapiens
tttatttttctaagtgt

SEQ ID NO: 5963275 - DNA, 19 bp, Homo sapiens
tttatttttgcacaacttt

SEQ ID NO: 5963276 - DNA, 16 bp, Homo sapiens
tttatttttgctctcc

SEQ ID NO: 5963277 - DNA, 16 bp, Homo sapiens
tttcatatttgcacta

SEQ ID NO: 5963278 - DNA, 14 bp, Homo sapiens
tttcatatttgggg

SEQ ID NO: 5963279 - DNA, 18 bp, Homo sapiens
tttcatatttttcaaaat

SEQ ID NO: 5963280 - DNA, 23 bp, Homo sapiens
tttcatcaagagtttattattgt

SEQ ID NO: 5963281 - DNA, 19 bp, Homo sapiens
tttcatcaatcattgtaca

SEQ ID NO: 5963282 - DNA, 21 bp, Homo sapiens
tttcatcaatcattgtacagt

SEQ ID NO: 5963283 - DNA, 13 bp, Homo sapiens
tttcatcaatgca

SEQ ID NO: 5963284 - DNA, 18 bp, Homo sapiens
tttcatcactaaaagaaa

SEQ ID NO: 5963285 - DNA, 13 bp, Homo sapiens
tttcatcactggg

SEQ ID NO: 5963286 - DNA, 17 bp, Homo sapiens
tttcatcagaacagctg

SEQ ID NO: 5963287 - DNA, 20 bp, Homo sapiens
tttcatcagtaagcagcctt

SEQ ID NO: 5963288 - DNA, 21 bp, Homo sapiens
tttcatcagtaagcagccttt

SEQ ID NO: 5963289 - DNA, 14 bp, Homo sapiens
tttcatcatgagga

SEQ ID NO: 5963290 - DNA, 20 bp, Homo sapiens
tttcatcattcacttcactg

SEQ ID NO: 5963291 - DNA, 21 bp, Homo sapiens
tttcatcattcacttcactgt

SEQ ID NO: 5963292 - DNA, 16 bp, Homo sapiens
tttcatcattgtttct

SEQ ID NO: 5963293 - DNA, 23 bp, Homo sapiens
tttcatccaaaatattttttgca

SEQ ID NO: 5963294 - DNA, 15 bp, Homo sapiens
tttcatccaccaata

SEQ ID NO: 5963295 - DNA, 20 bp, Homo sapiens
tttcatccaccaatatcatg

SEQ ID NO: 5963296 - DNA, 22 bp, Homo sapiens
tttcatccagtttgttctccgg

SEQ ID NO: 5963297 - DNA, 19 bp, Homo sapiens
tttcatccataactgaaca

SEQ ID NO: 5963298 - DNA, 20 bp, Homo sapiens
tttcatccataactgaacat

SEQ ID NO: 5963299 - DNA, 14 bp, Homo sapiens
tttcatccatgtcc

SEQ ID NO: 5963300 - DNA, 15 bp, Homo sapiens
tttcatccattaaaa

SEQ ID NO: 5963301 - DNA, 22 bp, Homo sapiens
tttcatccccttacccttagaa

SEQ ID NO: 5963302 - DNA, 19 bp, Homo sapiens
tttcatcccgtatcacagt

SEQ ID NO: 5963303 - DNA, 21 bp, Homo sapiens
tttcatcccgtatcacagtgt

SEQ ID NO: 5963304 - DNA, 13 bp, Homo sapiens
tttcatccgtgtg

SEQ ID NO: 5963305 - DNA, 13 bp, Homo sapiens
tttcatcctggcc

SEQ ID NO: 5963306 - DNA, 16 bp, Homo sapiens
tttcatcctgtgtccc

SEQ ID NO: 5963307 - DNA, 18 bp, Homo sapiens
tttcatcctgtgtcccct

SEQ ID NO: 5963308 - DNA, 14 bp, Homo sapiens
tttcatccttccca

SEQ ID NO: 5963309 - DNA, 16 bp, Homo sapiens
tttcatccttcccact

SEQ ID NO: 5963310 - DNA, 13 bp, Homo sapiens
tttcatccttctt

SEQ ID NO: 5963311 - DNA, 16 bp, Homo sapiens
tttcatccttctttcc

SEQ ID NO: 5963312 - DNA, 15 bp, Homo sapiens
tttcatccttgtctt

SEQ ID NO: 5963313 - DNA, 17 bp, Homo sapiens
tttcatccttttttctc

SEQ ID NO: 5963314 - DNA, 23 bp, Homo sapiens
tttcatccttttttctcttctgt

SEQ ID NO: 5963315 - DNA, 16 bp, Homo sapiens
tttcatcggtgcctgg

SEQ ID NO: 5963316 - DNA, 13 bp, Homo sapiens
tttcatctaaatg

SEQ ID NO: 5963317 - DNA, 19 bp, Homo sapiens
tttcatctaaattactgat

SEQ ID NO: 5963318 - DNA, 13 bp, Homo sapiens
tttcatctaattt

SEQ ID NO: 5963319 - DNA, 16 bp, Homo sapiens
tttcatctaatttaat

SEQ ID NO: 5963320 - DNA, 16 bp, Homo sapiens
tttcatctatttctga

SEQ ID NO: 5963321 - DNA, 12 bp, Homo sapiens
tttcatctcatt

SEQ ID NO: 5963322 - DNA, 20 bp, Homo sapiens
tttcatctcattaattcaat

SEQ ID NO: 5963323 - DNA, 22 bp, Homo sapiens
tttcatctcatttaagggaaaa

SEQ ID NO: 5963324 - DNA, 16 bp, Homo sapiens
tttcatctcttgtata

SEQ ID NO: 5963325 - DNA, 16 bp, Homo sapiens
tttcatctgagctttt

SEQ ID NO: 5963326 - DNA, 11 bp, Homo sapiens
tttcatctgct

SEQ ID NO: 5963327 - DNA, 18 bp, Homo sapiens
tttcatctgctctccttc

SEQ ID NO: 5963328 - DNA, 22 bp, Homo sapiens
tttcatctgctctccttcctgg

SEQ ID NO: 5963329 - DNA, 18 bp, Homo sapiens
tttcatctgctgctgaaa

SEQ ID NO: 5963330 - DNA, 20 bp, Homo sapiens
tttcatctggggatgacaat

SEQ ID NO: 5963331 - DNA, 14 bp, Homo sapiens
tttcatctgggtgg

SEQ ID NO: 5963332 - DNA, 18 bp, Homo sapiens
tttcatctgggtggtctg

SEQ ID NO: 5963333 - DNA, 14 bp, Homo sapiens
tttcatctgttgtt

SEQ ID NO: 5963334 - DNA, 15 bp, Homo sapiens
tttcatcttaaacta

SEQ ID NO: 5963335 - DNA, 14 bp, Homo sapiens
tttcatgaaaatac

SEQ ID NO: 5963336 - DNA, 22 bp, Homo sapiens
tttcatgaaaatggagttatca

SEQ ID NO: 5963337 - DNA, 22 bp, Homo sapiens
tttcatgacataataaagtatt

SEQ ID NO: 5963338 - DNA, 12 bp, Homo sapiens
tttcatgagttt

SEQ ID NO: 5963339 - DNA, 15 bp, Homo sapiens
tttcatgattagaca

SEQ ID NO: 5963340 - DNA, 18 bp, Homo sapiens
tttcatgattagacaatg

SEQ ID NO: 5963341 - DNA, 19 bp, Homo sapiens
tttcatgattagacaatgt

SEQ ID NO: 5963342 - DNA, 21 bp, Homo sapiens
tttcatgattagcaagttaca

SEQ ID NO: 5963343 - DNA, 19 bp, Homo sapiens
tttcatgattggcttaaag

SEQ ID NO: 5963344 - DNA, 21 bp, Homo sapiens
tttcatgcgatgacacttgta

SEQ ID NO: 5963345 - DNA, 21 bp, Homo sapiens
tttcatgctatcagaaacagt

SEQ ID NO: 5963346 - DNA, 16 bp, Homo sapiens
tttcatgctatctctg

SEQ ID NO: 5963347 - DNA, 18 bp, Homo sapiens
tttcatgctccactattt

SEQ ID NO: 5963348 - DNA, 14 bp, Homo sapiens
tttcatgctttgat

SEQ ID NO: 5963349 - DNA, 17 bp, Homo sapiens
tttcatggaatgcaatt

SEQ ID NO: 5963350 - DNA, 19 bp, Homo sapiens
tttcatggcccttcaaatt

SEQ ID NO: 5963351 - DNA, 21 bp, Homo sapiens
tttcatggtgaaaatgtactg

SEQ ID NO: 5963352 - DNA, 14 bp, Homo sapiens
tttcatgtaaaaca

SEQ ID NO: 5963353 - DNA, 14 bp, Homo sapiens
tttcatgtaaataa

SEQ ID NO: 5963354 - DNA, 23 bp, Homo sapiens
tttcatgtaaccaagagtattcc

SEQ ID NO: 5963355 - DNA, 19 bp, Homo sapiens
tttcatgtaacttttttat

SEQ ID NO: 5963356 - DNA, 21 bp, Homo sapiens
tttcatgtaacttttttattt

SEQ ID NO: 5963357 - DNA, 16 bp, Homo sapiens
tttcatgtaattatct

SEQ ID NO: 5963358 - DNA, 12 bp, Homo sapiens
tttcatgtacaa

SEQ ID NO: 5963359 - DNA, 18 bp, Homo sapiens
tttcatgtacaagatgaa

SEQ ID NO: 5963360 - DNA, 13 bp, Homo sapiens
tttcatgtacagc

SEQ ID NO: 5963361 - DNA, 16 bp, Homo sapiens
tttcatgtactgcatt

SEQ ID NO: 5963362 - DNA, 18 bp, Homo sapiens
tttcatgtcccagaactt

SEQ ID NO: 5963363 - DNA, 22 bp, Homo sapiens
tttcatgtcctgtgtcagttta

SEQ ID NO: 5963364 - DNA, 17 bp, Homo sapiens
tttcatgtcttgtcata

SEQ ID NO: 5963365 - DNA, 13 bp, Homo sapiens
tttcatgtgcaga

SEQ ID NO: 5963366 - DNA, 20 bp, Homo sapiens
tttcatgtgctatagacatt

SEQ ID NO: 5963367 - DNA, 12 bp, Homo sapiens
tttcatgtgctc

SEQ ID NO: 5963368 - DNA, 21 bp, Homo sapiens
tttcatgtgttgcaaattatt

SEQ ID NO: 5963369 - DNA, 23 bp, Homo sapiens
tttcatgttactgttgcagcttg

SEQ ID NO: 5963370 - DNA, 19 bp, Homo sapiens
tttcatgttatgcctgttg

SEQ ID NO: 5963371 - DNA, 20 bp, Homo sapiens
tttcatgttgatgactcgaa

SEQ ID NO: 5963372 - DNA, 15 bp, Homo sapiens
tttcatgtttaagaa

SEQ ID NO: 5963373 - DNA, 17 bp, Homo sapiens
tttcatgttttaacaaa

SEQ ID NO: 5963374 - DNA, 14 bp, Homo sapiens
tttcattaaaaatg

SEQ ID NO: 5963375 - DNA, 23 bp, Homo sapiens
tttcattaaaatagattatccca

SEQ ID NO: 5963376 - DNA, 14 bp, Homo sapiens
tttcattaaataaa

SEQ ID NO: 5963377 - DNA, 15 bp, Homo sapiens
tttcattaaataaat

SEQ ID NO: 5963378 - DNA, 16 bp, Homo sapiens
tttcattaaatccttt

SEQ ID NO: 5963379 - DNA, 14 bp, Homo sapiens
tttcattacaatgg

SEQ ID NO: 5963380 - DNA, 15 bp, Homo sapiens
tttcattacttttaa

SEQ ID NO: 5963381 - DNA, 22 bp, Homo sapiens
tttcattagaagttaccaaatt

SEQ ID NO: 5963382 - DNA, 21 bp, Homo sapiens
tttcattagcaaaaaaagttg

SEQ ID NO: 5963383 - DNA, 23 bp, Homo sapiens
tttcattagcaaaaaaagttgta

SEQ ID NO: 5963384 - DNA, 18 bp, Homo sapiens
tttcattagcagttgctc

SEQ ID NO: 5963385 - DNA, 15 bp, Homo sapiens
tttcattaggcaaag

SEQ ID NO: 5963386 - DNA, 12 bp, Homo sapiens
tttcattatgca

SEQ ID NO: 5963387 - DNA, 16 bp, Homo sapiens
tttcattatgctttga

SEQ ID NO: 5963388 - DNA, 15 bp, Homo sapiens
tttcattatgttcat

SEQ ID NO: 5963389 - DNA, 20 bp, Homo sapiens
tttcattattttattatgaa

SEQ ID NO: 5963390 - DNA, 15 bp, Homo sapiens
tttcattcaacacat

SEQ ID NO: 5963391 - DNA, 18 bp, Homo sapiens
tttcattcagcctttaga

SEQ ID NO: 5963392 - DNA, 23 bp, Homo sapiens
tttcattcagctaacaaactaga

SEQ ID NO: 5963393 - DNA, 14 bp, Homo sapiens
tttcattcatgaat

SEQ ID NO: 5963394 - DNA, 15 bp, Homo sapiens
tttcattcatgaata

SEQ ID NO: 5963395 - DNA, 12 bp, Homo sapiens
tttcattcattt

SEQ ID NO: 5963396 - DNA, 14 bp, Homo sapiens
tttcattccaaagg

SEQ ID NO: 5963397 - DNA, 12 bp, Homo sapiens
tttcattccatt

SEQ ID NO: 5963398 - DNA, 13 bp, Homo sapiens
tttcattccttca

SEQ ID NO: 5963399 - DNA, 16 bp, Homo sapiens
tttcattcggtgtgaa

SEQ ID NO: 5963400 - DNA, 24 bp, Homo sapiens
tttcattcgtgggcctgctgctct

SEQ ID NO: 5963401 - DNA, 16 bp, Homo sapiens
tttcattctaaaatca

SEQ ID NO: 5963402 - DNA, 17 bp, Homo sapiens
tttcattctcctcctcc

SEQ ID NO: 5963403 - DNA, 14 bp, Homo sapiens
tttcattgaatact

SEQ ID NO: 5963404 - DNA, 22 bp, Homo sapiens
tttcattgactatcaaactgaa

SEQ ID NO: 5963405 - DNA, 16 bp, Homo sapiens
tttcattgaggataaa

SEQ ID NO: 5963406 - DNA, 19 bp, Homo sapiens
tttcattgaggataaattg

SEQ ID NO: 5963407 - DNA, 21 bp, Homo sapiens
tttcattgaggataaattgcc

SEQ ID NO: 5963408 - DNA, 19 bp, Homo sapiens
tttcattgattatatgggt

SEQ ID NO: 5963409 - DNA, 13 bp, Homo sapiens
tttcattgcactt

SEQ ID NO: 5963410 - DNA, 14 bp, Homo sapiens
tttcattgcacttt

SEQ ID NO: 5963411 - DNA, 16 bp, Homo sapiens
tttcattgcactttcc

SEQ ID NO: 5963412 - DNA, 13 bp, Homo sapiens
tttcattgccagt

SEQ ID NO: 5963413 - DNA, 19 bp, Homo sapiens
tttcattgccagtgtcttt

SEQ ID NO: 5963414 - DNA, 17 bp, Homo sapiens
tttcattgcctgtgtat

SEQ ID NO: 5963415 - DNA, 15 bp, Homo sapiens
tttcattgccttcct

SEQ ID NO: 5963416 - DNA, 22 bp, Homo sapiens
tttcattggaaattaggatgta

SEQ ID NO: 5963417 - DNA, 21 bp, Homo sapiens
tttcattggatttttgttaat

SEQ ID NO: 5963418 - DNA, 14 bp, Homo sapiens
tttcattgtaaaac

SEQ ID NO: 5963419 - DNA, 13 bp, Homo sapiens
tttcattgtacaa

SEQ ID NO: 5963420 - DNA, 19 bp, Homo sapiens
tttcattgtacaagtatta

SEQ ID NO: 5963421 - DNA, 17 bp, Homo sapiens
tttcattgtatgatgtg

SEQ ID NO: 5963422 - DNA, 13 bp, Homo sapiens
tttcattgtctct

SEQ ID NO: 5963423 - DNA, 15 bp, Homo sapiens
tttcattgtctgtga

SEQ ID NO: 5963424 - DNA, 18 bp, Homo sapiens
tttcattgtgatttatat

SEQ ID NO: 5963425 - DNA, 20 bp, Homo sapiens
tttcatttaaatatctgtta

SEQ ID NO: 5963426 - DNA, 18 bp, Homo sapiens
tttcatttaactttataa

SEQ ID NO: 5963427 - DNA, 19 bp, Homo sapiens
tttcatttaagggaaagaa

SEQ ID NO: 5963428 - DNA, 14 bp, Homo sapiens
tttcatttactgtg

SEQ ID NO: 5963429 - DNA, 17 bp, Homo sapiens
tttcatttactgtggct

SEQ ID NO: 5963430 - DNA, 14 bp, Homo sapiens
tttcatttaggtga

SEQ ID NO: 5963431 - DNA, 20 bp, Homo sapiens
tttcatttagtgctaaacaa

SEQ ID NO: 5963432 - DNA, 20 bp, Homo sapiens
tttcatttatactgtagcaa

SEQ ID NO: 5963433 - DNA, 22 bp, Homo sapiens
tttcatttatactgtagcaata

SEQ ID NO: 5963434 - DNA, 14 bp, Homo sapiens
tttcatttcaactg

SEQ ID NO: 5963435 - DNA, 14 bp, Homo sapiens
tttcatttcagatt

SEQ ID NO: 5963436 - DNA, 19 bp, Homo sapiens
tttcatttctaacataagt

SEQ ID NO: 5963437 - DNA, 16 bp, Homo sapiens
tttcatttcttattaa

SEQ ID NO: 5963438 - DNA, 12 bp, Homo sapiens
tttcatttcttg

SEQ ID NO: 5963439 - DNA, 22 bp, Homo sapiens
tttcatttgcctattcccacac

SEQ ID NO: 5963440 - DNA, 20 bp, Homo sapiens
tttcatttgctgttcatctt

SEQ ID NO: 5963441 - DNA, 17 bp, Homo sapiens
tttcatttgtaaaaatg

SEQ ID NO: 5963442 - DNA, 15 bp, Homo sapiens
tttcatttgtacaag

SEQ ID NO: 5963443 - DNA, 17 bp, Homo sapiens
tttcatttgtacaaggt

SEQ ID NO: 5963444 - DNA, 21 bp, Homo sapiens
tttcatttgtttgttttcctt

SEQ ID NO: 5963445 - DNA, 14 bp, Homo sapiens
tttcattttaaaaa

SEQ ID NO: 5963446 - DNA, 16 bp, Homo sapiens
tttcattttaaaaagt

SEQ ID NO: 5963447 - DNA, 17 bp, Homo sapiens
tttcattttaaaaagtc

SEQ ID NO: 5963448 - DNA, 16 bp, Homo sapiens
tttcattttaacatga

SEQ ID NO: 5963449 - DNA, 17 bp, Homo sapiens
tttcattttaactggca

SEQ ID NO: 5963450 - DNA, 16 bp, Homo sapiens
tttcattttaatatat

SEQ ID NO: 5963451 - DNA, 20 bp, Homo sapiens
tttcattttaatatataatt

SEQ ID NO: 5963452 - DNA, 22 bp, Homo sapiens
tttcattttaatatataattta

SEQ ID NO: 5963453 - DNA, 15 bp, Homo sapiens
tttcattttaattta

SEQ ID NO: 5963454 - DNA, 21 bp, Homo sapiens
tttcattttacagttactttt

SEQ ID NO: 5963455 - DNA, 12 bp, Homo sapiens
tttcctttctca

SEQ ID NO: 5963456 - DNA, 15 bp, Homo sapiens
tttcctttctggccc

SEQ ID NO: 5963457 - DNA, 11 bp, Homo sapiens
tttcctttctt

SEQ ID NO: 5963458 - DNA, 13 bp, Homo sapiens
tttcctttcttaa

SEQ ID NO: 5963459 - DNA, 19 bp, Homo sapiens
tttcctttcttccttcctt

SEQ ID NO: 5963460 - DNA, 19 bp, Homo sapiens
tttcctttgaacgtgcttc

SEQ ID NO: 5963461 - DNA, 16 bp, Homo sapiens
tttcctttgccgtgtt

SEQ ID NO: 5963462 - DNA, 14 bp, Homo sapiens
tttccttttaagaa

SEQ ID NO: 5963463 - DNA, 15 bp, Homo sapiens
tttccttttaagaaa

SEQ ID NO: 5963464 - DNA, 17 bp, Homo sapiens
tttccttttaagaaagc

SEQ ID NO: 5963465 - DNA, 17 bp, Homo sapiens
tttccttttcatctgtt

SEQ ID NO: 5963466 - DNA, 13 bp, Homo sapiens
tttccttttcatt

SEQ ID NO: 5963467 - DNA, 21 bp, Homo sapiens
tttccttttctattccttctg

SEQ ID NO: 5963468 - DNA, 12 bp, Homo sapiens
tttcctttttct

SEQ ID NO: 5963469 - DNA, 14 bp, Homo sapiens
tttcctttttctaa

SEQ ID NO: 5963470 - DNA, 17 bp, Homo sapiens
tttcctttttgacactg

SEQ ID NO: 5963471 - DNA, 21 bp, Homo sapiens
tttcctttttggggagttgtt

SEQ ID NO: 5963472 - DNA, 15 bp, Homo sapiens
tttccttttttaaaa

SEQ ID NO: 5963473 - DNA, 20 bp, Homo sapiens
tttccttttttcccataaga

SEQ ID NO: 5963474 - DNA, 15 bp, Homo sapiens
tttccttttttgtct

SEQ ID NO: 5963475 - DNA, 14 bp, Homo sapiens
tttcgaaaatcaaa

SEQ ID NO: 5963476 - DNA, 14 bp, Homo sapiens
tttcgaccctgggg

SEQ ID NO: 5963477 - DNA, 15 bp, Homo sapiens
tttcgacttgcattt

SEQ ID NO: 5963478 - DNA, 16 bp, Homo sapiens
tttcgatgaagttctg

SEQ ID NO: 5963479 - DNA, 22 bp, Homo sapiens
tttcgcaggattcttcctccct

SEQ ID NO: 5963480 - DNA, 16 bp, Homo sapiens
tttcgccccctgcctg

SEQ ID NO: 5963481 - DNA, 13 bp, Homo sapiens
tttcgcctcctcc

SEQ ID NO: 5963482 - DNA, 15 bp, Homo sapiens
tttcgccttaaactc

SEQ ID NO: 5963483 - DNA, 17 bp, Homo sapiens
tttcgcttgcttctgca

SEQ ID NO: 5963484 - DNA, 12 bp, Homo sapiens
tttcgctttcct

SEQ ID NO: 5963485 - DNA, 13 bp, Homo sapiens
tttcggaaaaaaa

SEQ ID NO: 5963486 - DNA, 19 bp, Homo sapiens
tttcggaaaaaaaaaaaga

SEQ ID NO: 5963487 - DNA, 15 bp, Homo sapiens
tttcggaaacactga

SEQ ID NO: 5963488 - DNA, 13 bp, Homo sapiens
tttcggaacacat

SEQ ID NO: 5963489 - DNA, 16 bp, Homo sapiens
tttcgtaacacagcat

SEQ ID NO: 5963490 - DNA, 16 bp, Homo sapiens
tttcgtcatcttccct

SEQ ID NO: 5963491 - DNA, 16 bp, Homo sapiens
tttcgtctactgcaag

SEQ ID NO: 5963492 - DNA, 14 bp, Homo sapiens
tttcgtgaactgca

SEQ ID NO: 5963493 - DNA, 15 bp, Homo sapiens
tttcgtgagccccat

SEQ ID NO: 5963494 - DNA, 14 bp, Homo sapiens
tttcgtgcatttgt

SEQ ID NO: 5963495 - DNA, 13 bp, Homo sapiens
tttcgtggcttca

SEQ ID NO: 5963496 - DNA, 20 bp, Homo sapiens
tttcgtgtaatattctctga

SEQ ID NO: 5963497 - DNA, 19 bp, Homo sapiens
tttcgtgtagtggaagagc

SEQ ID NO: 5963498 - DNA, 21 bp, Homo sapiens
tttcgtgttgtgttctttata

SEQ ID NO: 5963499 - DNA, 23 bp, Homo sapiens
tttcgtgtttttggttttctcct

SEQ ID NO: 5963500 - DNA, 18 bp, Homo sapiens
tttcgttaacattgacca

SEQ ID NO: 5963501 - DNA, 14 bp, Homo sapiens
tttcgttccctgat

SEQ ID NO: 5963502 - DNA, 14 bp, Homo sapiens
tttcgttgcatggt

SEQ ID NO: 5963503 - DNA, 20 bp, Homo sapiens
tttcgttggttgtttctctg

SEQ ID NO: 5963504 - DNA, 14 bp, Homo sapiens
tttcgttgttatta

SEQ ID NO: 5963505 - DNA, 12 bp, Homo sapiens
tttcgtttgttt

SEQ ID NO: 5963506 - DNA, 20 bp, Homo sapiens
tttctaaaaaaaaaaactgt

SEQ ID NO: 5963507 - DNA, 14 bp, Homo sapiens
tttctaaaaaacag

SEQ ID NO: 5963508 - DNA, 20 bp, Homo sapiens
tttctaaaaagattagcaag

SEQ ID NO: 5963509 - DNA, 17 bp, Homo sapiens
tttctaaaaagtcagat

SEQ ID NO: 5963510 - DNA, 15 bp, Homo sapiens
tttctaaaacaagtt

SEQ ID NO: 5963511 - DNA, 20 bp, Homo sapiens
tttctaaaacattcccctcc

SEQ ID NO: 5963512 - DNA, 15 bp, Homo sapiens
tttctaaaagaatat

SEQ ID NO: 5963513 - DNA, 13 bp, Homo sapiens
tttctaaaagctt

SEQ ID NO: 5963514 - DNA, 16 bp, Homo sapiens
tttctaaaatctaaaa

SEQ ID NO: 5963515 - DNA, 17 bp, Homo sapiens
tttctaaaatctaaaat

SEQ ID NO: 5963516 - DNA, 23 bp, Homo sapiens
tttctaaacaagaaccatttgca

SEQ ID NO: 5963517 - DNA, 15 bp, Homo sapiens
tttctaaacctgtgc

SEQ ID NO: 5963518 - DNA, 16 bp, Homo sapiens
tttctaaacctgtgcc

SEQ ID NO: 5963519 - DNA, 15 bp, Homo sapiens
tttctaaactaggat

SEQ ID NO: 5963520 - DNA, 14 bp, Homo sapiens
tttctaaactgttt

SEQ ID NO: 5963521 - DNA, 21 bp, Homo sapiens
tttctaaactgttttcatgtg

SEQ ID NO: 5963522 - DNA, 13 bp, Homo sapiens
tttctaaagaaat

SEQ ID NO: 5963523 - DNA, 20 bp, Homo sapiens
tttctaaagcagtttattat

SEQ ID NO: 5963524 - DNA, 19 bp, Homo sapiens
tttctaaagctctgaacaa

SEQ ID NO: 5963525 - DNA, 22 bp, Homo sapiens
tttctaaagctctgaacaaaag

SEQ ID NO: 5963526 - DNA, 14 bp, Homo sapiens
tttctaaagctgcc

SEQ ID NO: 5963527 - DNA, 17 bp, Homo sapiens
tttctaaagctgccagc

SEQ ID NO: 5963528 - DNA, 14 bp, Homo sapiens
tttctaaaggagtt

SEQ ID NO: 5963529 - DNA, 19 bp, Homo sapiens
tttctaaaggcctcttcct

SEQ ID NO: 5963530 - DNA, 14 bp, Homo sapiens
tttctaaaggctac

SEQ ID NO: 5963531 - DNA, 18 bp, Homo sapiens
tttctaaaggctaccttt

SEQ ID NO: 5963532 - DNA, 12 bp, Homo sapiens
tttctaaagtaa

SEQ ID NO: 5963533 - DNA, 17 bp, Homo sapiens
tttctaaagtaaaaaca

SEQ ID NO: 5963534 - DNA, 23 bp, Homo sapiens
tttctaaagtaaaattgaagcaa

SEQ ID NO: 5963535 - DNA, 14 bp, Homo sapiens
tttctaaagtactg

SEQ ID NO: 5963536 - DNA, 15 bp, Homo sapiens
tttctaaagtgttgg

SEQ ID NO: 5963537 - DNA, 14 bp, Homo sapiens
tttctaaagttgtt

SEQ ID NO: 5963538 - DNA, 13 bp, Homo sapiens
tttctaaatgttt

SEQ ID NO: 5963539 - DNA, 15 bp, Homo sapiens
tttctaaatgtttct

SEQ ID NO: 5963540 - DNA, 17 bp, Homo sapiens
tttctaaattctttcat

SEQ ID NO: 5963541 - DNA, 15 bp, Homo sapiens
tttctaaatttatat

SEQ ID NO: 5963542 - DNA, 14 bp, Homo sapiens
tttctaacagtcct

SEQ ID NO: 5963543 - DNA, 17 bp, Homo sapiens
tttctaacagtccttgc

SEQ ID NO: 5963544 - DNA, 16 bp, Homo sapiens
tttctaacataagtaa

SEQ ID NO: 5963545 - DNA, 21 bp, Homo sapiens
tttctaacatatgtattaagc

SEQ ID NO: 5963546 - DNA, 22 bp, Homo sapiens
tttctaaccttcacgattaact

SEQ ID NO: 5963547 - DNA, 17 bp, Homo sapiens
tttctaaccttgaatgc

SEQ ID NO: 5963548 - DNA, 14 bp, Homo sapiens
tttctaactatata

SEQ ID NO: 5963549 - DNA, 17 bp, Homo sapiens
tttctaactcacaggca

SEQ ID NO: 5963550 - DNA, 15 bp, Homo sapiens
tttctaactctatta

SEQ ID NO: 5963551 - DNA, 16 bp, Homo sapiens
tttctaactctgatgt

SEQ ID NO: 5963552 - DNA, 20 bp, Homo sapiens
tttctaactctgatgtaaat

SEQ ID NO: 5963553 - DNA, 14 bp, Homo sapiens
tttctaactgtaaa

SEQ ID NO: 5963554 - DNA, 17 bp, Homo sapiens
tttctaactgtaaatca

SEQ ID NO: 5963555 - DNA, 20 bp, Homo sapiens
tttctaactgtaaatcactt

SEQ ID NO: 5963556 - DNA, 16 bp, Homo sapiens
tttctaactttcttta

SEQ ID NO: 5963557 - DNA, 14 bp, Homo sapiens
tttctaagaaacat

SEQ ID NO: 5963558 - DNA, 19 bp, Homo sapiens
tttctaagaagttactttt

SEQ ID NO: 5963559 - DNA, 13 bp, Homo sapiens
tttctaagacagt

SEQ ID NO: 5963560 - DNA, 11 bp, Homo sapiens
tttctaagaga

SEQ ID NO: 5963561 - DNA, 18 bp, Homo sapiens
tttctaagattctaaagg

SEQ ID NO: 5963562 - DNA, 21 bp, Homo sapiens
tttctaagcagatatagtagt

SEQ ID NO: 5963563 - DNA, 19 bp, Homo sapiens
tttctaagcataaaagatg

SEQ ID NO: 5963564 - DNA, 20 bp, Homo sapiens
tttctaagcataaaagatga

SEQ ID NO: 5963565 - DNA, 14 bp, Homo sapiens
tttctaagctgttt

SEQ ID NO: 5963566 - DNA, 18 bp, Homo sapiens
tttctaaggaatgcacaa

SEQ ID NO: 5963567 - DNA, 21 bp, Homo sapiens
tttctaaggaatgcacaaatt

SEQ ID NO: 5963568 - DNA, 20 bp, Homo sapiens
tttctaaggatagcctttgt

SEQ ID NO: 5963569 - DNA, 18 bp, Homo sapiens
tttctaagggaaaaagtt

SEQ ID NO: 5963570 - DNA, 23 bp, Homo sapiens
tttctaagtagatagaaagcaat

SEQ ID NO: 5963571 - DNA, 18 bp, Homo sapiens
tttctaagtggcgtgtgc

SEQ ID NO: 5963572 - DNA, 18 bp, Homo sapiens
tttctaagtgttcgtctt

SEQ ID NO: 5963573 - DNA, 18 bp, Homo sapiens
tttctaagttaaatcatt

SEQ ID NO: 5963574 - DNA, 20 bp, Homo sapiens
tttctaagttaaatcatttt

SEQ ID NO: 5963575 - DNA, 15 bp, Homo sapiens
tttctaataaagcca

SEQ ID NO: 5963576 - DNA, 21 bp, Homo sapiens
tttctaatacgagccttctca

SEQ ID NO: 5963577 - DNA, 18 bp, Homo sapiens
tttctaatccttttcctt

SEQ ID NO: 5963578 - DNA, 14 bp, Homo sapiens
tttctaatgagata

SEQ ID NO: 5963579 - DNA, 24 bp, Homo sapiens
tttctaatgttattttccttctga

SEQ ID NO: 5963580 - DNA, 22 bp, Homo sapiens
tttctaatgttctaaattctat

SEQ ID NO: 5963581 - DNA, 19 bp, Homo sapiens
tttctaatgtttactatat

SEQ ID NO: 5963582 - DNA, 22 bp, Homo sapiens
tttctaatgtttactatataga

SEQ ID NO: 5963583 - DNA, 17 bp, Homo sapiens
tttctaattatgtagct

SEQ ID NO: 5963584 - DNA, 16 bp, Homo sapiens
tttctaatttgaatga

SEQ ID NO: 5963585 - DNA, 16 bp, Homo sapiens
tttctaatttgctgct

SEQ ID NO: 5963586 - DNA, 17 bp, Homo sapiens
tttctaatttgctgctg

SEQ ID NO: 5963587 - DNA, 18 bp, Homo sapiens
tttctacaaaataacatt

SEQ ID NO: 5963588 - DNA, 20 bp, Homo sapiens
tttctacaaataattttagt

SEQ ID NO: 5963589 - DNA, 19 bp, Homo sapiens
tttctacaaggtgttcatt

SEQ ID NO: 5963590 - DNA, 18 bp, Homo sapiens
tttctacaatgtgaactt

SEQ ID NO: 5963591 - DNA, 20 bp, Homo sapiens
tttctacactgtattacata

SEQ ID NO: 5963592 - DNA, 23 bp, Homo sapiens
tttctacagagaaaatgaatttg

SEQ ID NO: 5963593 - DNA, 15 bp, Homo sapiens
tttctacagcaaatt

SEQ ID NO: 5963594 - DNA, 17 bp, Homo sapiens
tttctacagcaaattta

SEQ ID NO: 5963595 - DNA, 19 bp, Homo sapiens
tttctacatagttattcta

SEQ ID NO: 5963596 - DNA, 23 bp, Homo sapiens
tttctacatgactgggcctccct

SEQ ID NO: 5963597 - DNA, 14 bp, Homo sapiens
tttctacatgcaaa

SEQ ID NO: 5963598 - DNA, 17 bp, Homo sapiens
tttctacattaacttga

SEQ ID NO: 5963599 - DNA, 15 bp, Homo sapiens
tttctacattattgc

SEQ ID NO: 5963600 - DNA, 17 bp, Homo sapiens
tttctacattattgctt

SEQ ID NO: 5963601 - DNA, 19 bp, Homo sapiens
tttctaccacacacagcct

SEQ ID NO: 5963602 - DNA, 16 bp, Homo sapiens
tttctaccatttcaga

SEQ ID NO: 5963603 - DNA, 22 bp, Homo sapiens
tttctacccagcgagccctggt

SEQ ID NO: 5963604 - DNA, 15 bp, Homo sapiens
tttctaccctagcca

SEQ ID NO: 5963605 - DNA, 16 bp, Homo sapiens
tttctacctatatgca

SEQ ID NO: 5963606 - DNA, 15 bp, Homo sapiens
tttctacctcccaga

SEQ ID NO: 5963607 - DNA, 16 bp, Homo sapiens
tttctaccttgaggtc

SEQ ID NO: 5963608 - DNA, 16 bp, Homo sapiens
tttctacggtgacagt

SEQ ID NO: 5963609 - DNA, 14 bp, Homo sapiens
tttctacgtcatgt

SEQ ID NO: 5963610 - DNA, 21 bp, Homo sapiens
tttctacgtcatgtattttat

SEQ ID NO: 5963611 - DNA, 23 bp, Homo sapiens
tttctacgttatgaaaacagatg

SEQ ID NO: 5963612 - DNA, 13 bp, Homo sapiens
tttctactcattt

SEQ ID NO: 5963613 - DNA, 17 bp, Homo sapiens
tttctactcattttaat

SEQ ID NO: 5963614 - DNA, 15 bp, Homo sapiens
tttctactgaagttg

SEQ ID NO: 5963615 - DNA, 16 bp, Homo sapiens
tttctacttatcctca

SEQ ID NO: 5963616 - DNA, 14 bp, Homo sapiens
tttctacttcccct

SEQ ID NO: 5963617 - DNA, 21 bp, Homo sapiens
tttctactttaaattgtggat

SEQ ID NO: 5963618 - DNA, 11 bp, Homo sapiens
tttctactttt

SEQ ID NO: 5963619 - DNA, 23 bp, Homo sapiens
tttctagaacaattacatgtaaa

SEQ ID NO: 5963620 - DNA, 21 bp, Homo sapiens
tttctagactataaatgttgc

SEQ ID NO: 5963621 - DNA, 23 bp, Homo sapiens
tttctagacttcagaacatgctg

SEQ ID NO: 5963622 - DNA, 16 bp, Homo sapiens
tttctagactttctgt

SEQ ID NO: 5963623 - DNA, 16 bp, Homo sapiens
tttctagagacacatt

SEQ ID NO: 5963624 - DNA, 23 bp, Homo sapiens
tttctagatacaataaattgcta

SEQ ID NO: 5963625 - DNA, 19 bp, Homo sapiens
tttctagcaattttctttg

SEQ ID NO: 5963626 - DNA, 20 bp, Homo sapiens
tttctagcaattttctttgt

SEQ ID NO: 5963627 - DNA, 21 bp, Homo sapiens
tttctagcaattttctttgtt

SEQ ID NO: 5963628 - DNA, 22 bp, Homo sapiens
tttctagcaattttctttgttt

SEQ ID NO: 5963629 - DNA, 20 bp, Homo sapiens
tttctagcagtatgtgtgct

SEQ ID NO: 5963630 - DNA, 18 bp, Homo sapiens
tttctagcccctctggat

SEQ ID NO: 5963631 - DNA, 20 bp, Homo sapiens
tttctagcctggggcttgaa

SEQ ID NO: 5963632 - DNA, 12 bp, Homo sapiens
tttctagcctta

SEQ ID NO: 5963633 - DNA, 23 bp, Homo sapiens
tttctagcgaacgtatttctcca

SEQ ID NO: 5963634 - DNA, 21 bp, Homo sapiens
tttcttcccgtgtgtatttct

SEQ ID NO: 5963635 - DNA, 23 bp, Homo sapiens
tttcttcccgtgtgtatttctaa

SEQ ID NO: 5963636 - DNA, 15 bp, Homo sapiens
tttcttccttcaaat

SEQ ID NO: 5963637 - DNA, 13 bp, Homo sapiens
tttcttcctttga

SEQ ID NO: 5963638 - DNA, 15 bp, Homo sapiens
tttcttcgtgaacat

SEQ ID NO: 5963639 - DNA, 18 bp, Homo sapiens
tttcttctacaaccagag

SEQ ID NO: 5963640 - DNA, 21 bp, Homo sapiens
tttcttctacaaccagagccc

SEQ ID NO: 5963641 - DNA, 21 bp, Homo sapiens
tttcttctagctgagctttaa

SEQ ID NO: 5963642 - DNA, 16 bp, Homo sapiens
tttcttctagtatttt

SEQ ID NO: 5963643 - DNA, 19 bp, Homo sapiens
tttcttctattgcctctga

SEQ ID NO: 5963644 - DNA, 16 bp, Homo sapiens
tttcttctctgcctcc

SEQ ID NO: 5963645 - DNA, 15 bp, Homo sapiens
tttcttctctggaga

SEQ ID NO: 5963646 - DNA, 19 bp, Homo sapiens
tttcttctctggagaagtt

SEQ ID NO: 5963647 - DNA, 23 bp, Homo sapiens
tttcttctcttatcctctctctc

SEQ ID NO: 5963648 - DNA, 16 bp, Homo sapiens
tttcttctctttcata

SEQ ID NO: 5963649 - DNA, 11 bp, Homo sapiens
tttcttctgcc

SEQ ID NO: 5963650 - DNA, 12 bp, Homo sapiens
tttcttctgtag

SEQ ID NO: 5963651 - DNA, 14 bp, Homo sapiens
tttcttctgtagct

SEQ ID NO: 5963652 - DNA, 14 bp, Homo sapiens
tttcttctgtgtta

SEQ ID NO: 5963653 - DNA, 14 bp, Homo sapiens
tttcttcttcctgg

SEQ ID NO: 5963654 - DNA, 16 bp, Homo sapiens
tttcttcttcctggta

SEQ ID NO: 5963655 - DNA, 16 bp, Homo sapiens
tttcttcttctaagaa

SEQ ID NO: 5963656 - DNA, 20 bp, Homo sapiens
tttcttcttctaagaagaca

SEQ ID NO: 5963657 - DNA, 22 bp, Homo sapiens
tttcttcttgtcaccccagttc

SEQ ID NO: 5963658 - DNA, 14 bp, Homo sapiens
tttcttctttaatt

SEQ ID NO: 5963659 - DNA, 23 bp, Homo sapiens
tttcttctttaatttttctgttg

SEQ ID NO: 5963660 - DNA, 13 bp, Homo sapiens
tttcttctttcct

SEQ ID NO: 5963661 - DNA, 15 bp, Homo sapiens
tttcttctttccttt

SEQ ID NO: 5963662 - DNA, 15 bp, Homo sapiens
tttcttcttttactt

SEQ ID NO: 5963663 - DNA, 15 bp, Homo sapiens
tttcttgaaaagcct

SEQ ID NO: 5963664 - DNA, 14 bp, Homo sapiens
tttcttgaaattga

SEQ ID NO: 5963665 - DNA, 18 bp, Homo sapiens
tttcttgatttgagttga

SEQ ID NO: 5963666 - DNA, 16 bp, Homo sapiens
tttcttgccccagtgt

SEQ ID NO: 5963667 - DNA, 21 bp, Homo sapiens
tttcttgcctctgtccccttc

SEQ ID NO: 5963668 - DNA, 14 bp, Homo sapiens
tttcttgccttttg

SEQ ID NO: 5963669 - DNA, 13 bp, Homo sapiens
tttcttgctagta

SEQ ID NO: 5963670 - DNA, 13 bp, Homo sapiens
tttcttgctccct

SEQ ID NO: 5963671 - DNA, 18 bp, Homo sapiens
tttcttgctccctgactg

SEQ ID NO: 5963672 - DNA, 18 bp, Homo sapiens
tttcttgctctctctccc

SEQ ID NO: 5963673 - DNA, 16 bp, Homo sapiens
tttcttgcttgtacct

SEQ ID NO: 5963674 - DNA, 20 bp, Homo sapiens
tttcttggaactgtcccagc

SEQ ID NO: 5963675 - DNA, 19 bp, Homo sapiens
tttcttggaattttgtaaa

SEQ ID NO: 5963676 - DNA, 22 bp, Homo sapiens
tttcttggaattttgtaaaaag

SEQ ID NO: 5963677 - DNA, 21 bp, Homo sapiens
tttcttggacacttaattctg

SEQ ID NO: 5963678 - DNA, 23 bp, Homo sapiens
tttcttggacacttaattctgtt

SEQ ID NO: 5963679 - DNA, 22 bp, Homo sapiens
tttcttggcaaaagccttgtgt

SEQ ID NO: 5963680 - DNA, 19 bp, Homo sapiens
tttcttggcccccttccca

SEQ ID NO: 5963681 - DNA, 22 bp, Homo sapiens
tttcttggggtactcttgatgt

SEQ ID NO: 5963682 - DNA, 18 bp, Homo sapiens
tttcttggtctcagcttc

SEQ ID NO: 5963683 - DNA, 19 bp, Homo sapiens
tttcttggttcataaatga

SEQ ID NO: 5963684 - DNA, 19 bp, Homo sapiens
tttcttgtaaatgtttctt

SEQ ID NO: 5963685 - DNA, 20 bp, Homo sapiens
tttcttgtagccatggctgg

SEQ ID NO: 5963686 - DNA, 14 bp, Homo sapiens
tttcttgtatctgg

SEQ ID NO: 5963687 - DNA, 13 bp, Homo sapiens
tttcttgtccaaa

SEQ ID NO: 5963688 - DNA, 18 bp, Homo sapiens
tttcttgtctataaagca

SEQ ID NO: 5963689 - DNA, 15 bp, Homo sapiens
tttcttgtgtagatt

SEQ ID NO: 5963690 - DNA, 17 bp, Homo sapiens
tttcttgtgtagatttg

SEQ ID NO: 5963691 - DNA, 19 bp, Homo sapiens
tttcttgtgtagatttgaa

SEQ ID NO: 5963692 - DNA, 20 bp, Homo sapiens
tttcttgtgtagatttgaaa

SEQ ID NO: 5963693 - DNA, 16 bp, Homo sapiens
tttcttgtgttctgta

SEQ ID NO: 5963694 - DNA, 21 bp, Homo sapiens
tttcttgtgttgttttctctg

SEQ ID NO: 5963695 - DNA, 22 bp, Homo sapiens
tttcttgtgttgttttctctga

SEQ ID NO: 5963696 - DNA, 21 bp, Homo sapiens
tttcttgttgctttgttgcac

SEQ ID NO: 5963697 - DNA, 20 bp, Homo sapiens
tttcttgtttatcagcagtt

SEQ ID NO: 5963698 - DNA, 23 bp, Homo sapiens
tttcttgtttatcagcagttgtt

SEQ ID NO: 5963699 - DNA, 13 bp, Homo sapiens
tttcttgtttctc

SEQ ID NO: 5963700 - DNA, 15 bp, Homo sapiens
tttcttgtttgtcag

SEQ ID NO: 5963701 - DNA, 18 bp, Homo sapiens
tttcttgtttgtcagcat

SEQ ID NO: 5963702 - DNA, 17 bp, Homo sapiens
tttctttaaaaaagaaa

SEQ ID NO: 5963703 - DNA, 14 bp, Homo sapiens
tttctttaaaacca

SEQ ID NO: 5963704 - DNA, 13 bp, Homo sapiens
tttctttaaaaga

SEQ ID NO: 5963705 - DNA, 15 bp, Homo sapiens
tttctttaaaagaat

SEQ ID NO: 5963706 - DNA, 20 bp, Homo sapiens
tttctttaaaagaatgggca

SEQ ID NO: 5963707 - DNA, 19 bp, Homo sapiens
tttctttaaagccagtcat

SEQ ID NO: 5963708 - DNA, 17 bp, Homo sapiens
tttctttaaatcagtat

SEQ ID NO: 5963709 - DNA, 20 bp, Homo sapiens
tttctttaaatttcaaatgt

SEQ ID NO: 5963710 - DNA, 13 bp, Homo sapiens
tttctttaactgc

SEQ ID NO: 5963711 - DNA, 15 bp, Homo sapiens
tttctttaagaaagt

SEQ ID NO: 5963712 - DNA, 13 bp, Homo sapiens
tttctttaagttt

SEQ ID NO: 5963713 - DNA, 11 bp, Homo sapiens
tttctttacag

SEQ ID NO: 5963714 - DNA, 20 bp, Homo sapiens
tttctttacttaacatatct

SEQ ID NO: 5963715 - DNA, 17 bp, Homo sapiens
tttctttacttatctct

SEQ ID NO: 5963716 - DNA, 14 bp, Homo sapiens
tttctttactttct

SEQ ID NO: 5963717 - DNA, 16 bp, Homo sapiens
tttctttagagaactg

SEQ ID NO: 5963718 - DNA, 20 bp, Homo sapiens
tttctttagagaactgaaaa

SEQ ID NO: 5963719 - DNA, 18 bp, Homo sapiens
tttctttaggagatttat

SEQ ID NO: 5963720 - DNA, 16 bp, Homo sapiens
tttctttataatggct

SEQ ID NO: 5963721 - DNA, 11 bp, Homo sapiens
tttctttatat

SEQ ID NO: 5963722 - DNA, 23 bp, Homo sapiens
tttctttatcacctggcttgttt

SEQ ID NO: 5963723 - DNA, 12 bp, Homo sapiens
tttctttatcta

SEQ ID NO: 5963724 - DNA, 20 bp, Homo sapiens
tttctttattgcttactgtg

SEQ ID NO: 5963725 - DNA, 13 bp, Homo sapiens
tttctttcaactt

SEQ ID NO: 5963726 - DNA, 19 bp, Homo sapiens
tttctttcaacttgcatcc

SEQ ID NO: 5963727 - DNA, 13 bp, Homo sapiens
tttctttcacttt

SEQ ID NO: 5963728 - DNA, 16 bp, Homo sapiens
tttctttcagatcatt

SEQ ID NO: 5963729 - DNA, 11 bp, Homo sapiens
tttctttcagt

SEQ ID NO: 5963730 - DNA, 20 bp, Homo sapiens
tttctttccaaaacatttct

SEQ ID NO: 5963731 - DNA, 17 bp, Homo sapiens
tttctttcccatgtatt

SEQ ID NO: 5963732 - DNA, 19 bp, Homo sapiens
tttctttcccatgtatttg

SEQ ID NO: 5963733 - DNA, 22 bp, Homo sapiens
tttctttcccatgtatttgtta

SEQ ID NO: 5963734 - DNA, 21 bp, Homo sapiens
tttctttccccaaaaattgac

SEQ ID NO: 5963735 - DNA, 18 bp, Homo sapiens
tttctttcctcctttcct

SEQ ID NO: 5963736 - DNA, 19 bp, Homo sapiens
tttctttcctgtaaagaaa

SEQ ID NO: 5963737 - DNA, 13 bp, Homo sapiens
tttctttctatgt

SEQ ID NO: 5963738 - DNA, 15 bp, Homo sapiens
tttctttctgtctct

SEQ ID NO: 5963739 - DNA, 13 bp, Homo sapiens
tttctttcttaga

SEQ ID NO: 5963740 - DNA, 15 bp, Homo sapiens
tttctttcttagaaa

SEQ ID NO: 5963741 - DNA, 15 bp, Homo sapiens
tttctttcttcccgt

SEQ ID NO: 5963742 - DNA, 14 bp, Homo sapiens
tttctttcttcctc

SEQ ID NO: 5963743 - DNA, 16 bp, Homo sapiens
tttctttctttttctg

SEQ ID NO: 5963744 - DNA, 20 bp, Homo sapiens
tttctttgaaaaaaaataaa

SEQ ID NO: 5963745 - DNA, 17 bp, Homo sapiens
tttctttgaaatgctaa

SEQ ID NO: 5963746 - DNA, 18 bp, Homo sapiens
tttctttgaaatgctaaa

SEQ ID NO: 5963747 - DNA, 22 bp, Homo sapiens
tttctttgaatgctttttgaat

SEQ ID NO: 5963748 - DNA, 13 bp, Homo sapiens
tttctttgaatgt

SEQ ID NO: 5963749 - DNA, 22 bp, Homo sapiens
tttctttgaccagatctttctc

SEQ ID NO: 5963750 - DNA, 23 bp, Homo sapiens
tttctttgaccagatctttctct

SEQ ID NO: 5963751 - DNA, 12 bp, Homo sapiens
tttctttgagga

SEQ ID NO: 5963752 - DNA, 20 bp, Homo sapiens
tttctttgagttttaaatta

SEQ ID NO: 5963753 - DNA, 16 bp, Homo sapiens
tttctttgatcatgaa

SEQ ID NO: 5963754 - DNA, 17 bp, Homo sapiens
tttctttgatttaactg

SEQ ID NO: 5963755 - DNA, 14 bp, Homo sapiens
tttctttgcaaagt

SEQ ID NO: 5963756 - DNA, 15 bp, Homo sapiens
tttctttgcaaagta

SEQ ID NO: 5963757 - DNA, 18 bp, Homo sapiens
tttctttgcaccaaagac

SEQ ID NO: 5963758 - DNA, 20 bp, Homo sapiens
tttctttgcaccaaagacat

SEQ ID NO: 5963759 - DNA, 13 bp, Homo sapiens
tttctttgcctct

SEQ ID NO: 5963760 - DNA, 22 bp, Homo sapiens
tttctttgcctctgcagtctca

SEQ ID NO: 5963761 - DNA, 21 bp, Homo sapiens
tttctttgcctgttcagttac

SEQ ID NO: 5963762 - DNA, 18 bp, Homo sapiens
tttctttgcgatgtcctc

SEQ ID NO: 5963763 - DNA, 19 bp, Homo sapiens
tttctttgctgctgtggaa

SEQ ID NO: 5963764 - DNA, 16 bp, Homo sapiens
tttctttgctgtgcca

SEQ ID NO: 5963765 - DNA, 22 bp, Homo sapiens
tttctttggcctacattcttta

SEQ ID NO: 5963766 - DNA, 14 bp, Homo sapiens
tttctttggctgca

SEQ ID NO: 5963767 - DNA, 21 bp, Homo sapiens
tttctttgggaatatttgaat

SEQ ID NO: 5963768 - DNA, 20 bp, Homo sapiens
tttctttggggaaaaattct

SEQ ID NO: 5963769 - DNA, 18 bp, Homo sapiens
tttctttgtagaataaat

SEQ ID NO: 5963770 - DNA, 19 bp, Homo sapiens
tttctttgtcattcagttc

SEQ ID NO: 5963771 - DNA, 19 bp, Homo sapiens
tttctttgtctttttccta

SEQ ID NO: 5963772 - DNA, 13 bp, Homo sapiens
tttctttgtggct

SEQ ID NO: 5963773 - DNA, 14 bp, Homo sapiens
tttctttgtgtagt

SEQ ID NO: 5963774 - DNA, 12 bp, Homo sapiens
tttctttgtgtt

SEQ ID NO: 5963775 - DNA, 18 bp, Homo sapiens
tttctttgtttctttctt

SEQ ID NO: 5963776 - DNA, 12 bp, Homo sapiens
tttcttttaaaa

SEQ ID NO: 5963777 - DNA, 16 bp, Homo sapiens
tttcttttaaagaagt

SEQ ID NO: 5963778 - DNA, 21 bp, Homo sapiens
tttcttttaagcatttgtata

SEQ ID NO: 5963779 - DNA, 14 bp, Homo sapiens
tttcttttatatat

SEQ ID NO: 5963780 - DNA, 15 bp, Homo sapiens
tttcttttatatata

SEQ ID NO: 5963781 - DNA, 14 bp, Homo sapiens
tttcttttcacata

SEQ ID NO: 5963782 - DNA, 15 bp, Homo sapiens
tttcttttcttcctg

SEQ ID NO: 5963783 - DNA, 14 bp, Homo sapiens
tttcttttctttat

SEQ ID NO: 5963784 - DNA, 16 bp, Homo sapiens
tttcttttgttactgt

SEQ ID NO: 5963785 - DNA, 21 bp, Homo sapiens
tttcttttgttgtactttata

SEQ ID NO: 5963786 - DNA, 20 bp, Homo sapiens
tttcttttgttttcttcatt

SEQ ID NO: 5963787 - DNA, 20 bp, Homo sapiens
tttcttttgttttttgaagt

SEQ ID NO: 5963788 - DNA, 21 bp, Homo sapiens
tttcttttgttttttgaagtg

SEQ ID NO: 5963789 - DNA, 13 bp, Homo sapiens
tttctttttaaat

SEQ ID NO: 5963790 - DNA, 20 bp, Homo sapiens
tttctttttaactttaccaa

SEQ ID NO: 5963791 - DNA, 20 bp, Homo sapiens
tttctttttaagtaatgtgg

SEQ ID NO: 5963792 - DNA, 22 bp, Homo sapiens
tttctttttaagtaatgtggaa

SEQ ID NO: 5963793 - DNA, 23 bp, Homo sapiens
tttctttttacccatttgttcat

SEQ ID NO: 5963794 - DNA, 16 bp, Homo sapiens
tttctttttcctttat

SEQ ID NO: 5963795 - DNA, 17 bp, Homo sapiens
tttctttttctggaaat

SEQ ID NO: 5963796 - DNA, 19 bp, Homo sapiens
tttctttttcttcttccct

SEQ ID NO: 5963797 - DNA, 17 bp, Homo sapiens
tttctttttgaatcttt

SEQ ID NO: 5963798 - DNA, 20 bp, Homo sapiens
tttctttttgaatctttaat

SEQ ID NO: 5963799 - DNA, 22 bp, Homo sapiens
tttctttttgatttttaaatca

SEQ ID NO: 5963800 - DNA, 15 bp, Homo sapiens
tttcttttttaaagt

SEQ ID NO: 5963801 - DNA, 21 bp, Homo sapiens
tttcttttttaaagtaaactt

SEQ ID NO: 5963802 - DNA, 20 bp, Homo sapiens
tttcttttttaaatgtttct

SEQ ID NO: 5963803 - DNA, 15 bp, Homo sapiens
tttcttttttatgtg

SEQ ID NO: 5963804 - DNA, 14 bp, Homo sapiens
tttcttttttctct

SEQ ID NO: 5963805 - DNA, 15 bp, Homo sapiens
tttcttttttgatat

SEQ ID NO: 5963806 - DNA, 19 bp, Homo sapiens
tttcttttttgctttcttg

SEQ ID NO: 5963807 - DNA, 15 bp, Homo sapiens
tttctttttttaact

SEQ ID NO: 5963808 - DNA, 14 bp, Homo sapiens
tttctttttttcct

SEQ ID NO: 5963809 - DNA, 14 bp, Homo sapiens
tttctttttttggt

SEQ ID NO: 5963810 - DNA, 17 bp, Homo sapiens
tttctttttttttaagt

SEQ ID NO: 5963811 - DNA, 19 bp, Homo sapiens
tttcttttttttttcgtct

SEQ ID NO: 5963812 - DNA, 14 bp, Homo sapiens
tttgcaacctcgct

SEQ ID NO: 5963813 - DNA, 17 bp, Homo sapiens
tttgcaaccttgtactt

SEQ ID NO: 5963814 - DNA, 15 bp, Homo sapiens
tttgcaactggtata

SEQ ID NO: 5963815 - DNA, 23 bp, Homo sapiens
tttgcaagcttatttagcacatt

SEQ ID NO: 5963816 - DNA, 20 bp, Homo sapiens
tttgcaagggaaaagtctct

SEQ ID NO: 5963817 - DNA, 20 bp, Homo sapiens
tttgcaagggaatgaatcca

SEQ ID NO: 5963818 - DNA, 18 bp, Homo sapiens
tttgcaagtcatggctgt

SEQ ID NO: 5963819 - DNA, 16 bp, Homo sapiens
tttgcaagtgaaggtt

SEQ ID NO: 5963820 - DNA, 21 bp, Homo sapiens
tttgcaagtgaaggtttacaa

SEQ ID NO: 5963821 - DNA, 17 bp, Homo sapiens
tttgcaataacttctat

SEQ ID NO: 5963822 - DNA, 19 bp, Homo sapiens
tttgcaataacttctatat

SEQ ID NO: 5963823 - DNA, 20 bp, Homo sapiens
tttgcaataacttctatatt

SEQ ID NO: 5963824 - DNA, 14 bp, Homo sapiens
tttgcaataaggat

SEQ ID NO: 5963825 - DNA, 22 bp, Homo sapiens
tttgcaataatgcagtatggta

SEQ ID NO: 5963826 - DNA, 13 bp, Homo sapiens
tttgcaatactgc

SEQ ID NO: 5963827 - DNA, 12 bp, Homo sapiens
tttgcaatagca

SEQ ID NO: 5963828 - DNA, 23 bp, Homo sapiens
tttgcaatcttaagcagagataa

SEQ ID NO: 5963829 - DNA, 15 bp, Homo sapiens
tttgcaatcttatgt

SEQ ID NO: 5963830 - DNA, 17 bp, Homo sapiens
tttgcaatgtatttagc

SEQ ID NO: 5963831 - DNA, 15 bp, Homo sapiens
tttgcaattattcta

SEQ ID NO: 5963832 - DNA, 13 bp, Homo sapiens
tttgcaatttcag

SEQ ID NO: 5963833 - DNA, 12 bp, Homo sapiens
tttgcacaaaaa

SEQ ID NO: 5963834 - DNA, 23 bp, Homo sapiens
tttgcacaagttccctggagaaa

SEQ ID NO: 5963835 - DNA, 12 bp, Homo sapiens
tttgcacagctc

SEQ ID NO: 5963836 - DNA, 19 bp, Homo sapiens
tttgcacagtgtgtgactt

SEQ ID NO: 5963837 - DNA, 15 bp, Homo sapiens
tttgcacatatattt

SEQ ID NO: 5963838 - DNA, 14 bp, Homo sapiens
tttgcacatgtgac

SEQ ID NO: 5963839 - DNA, 19 bp, Homo sapiens
tttgcacatgtttcctcta

SEQ ID NO: 5963840 - DNA, 12 bp, Homo sapiens
tttgcacattaa

SEQ ID NO: 5963841 - DNA, 13 bp, Homo sapiens
tttgcacattaaa

SEQ ID NO: 5963842 - DNA, 18 bp, Homo sapiens
tttgcacattttgatttt

SEQ ID NO: 5963843 - DNA, 14 bp, Homo sapiens
tttgcacattttgt

SEQ ID NO: 5963844 - DNA, 22 bp, Homo sapiens
tttgcacattttgtggctgttg

SEQ ID NO: 5963845 - DNA, 14 bp, Homo sapiens
tttgcaccaaagac

SEQ ID NO: 5963846 - DNA, 18 bp, Homo sapiens
tttgcaccccatgctgtt

SEQ ID NO: 5963847 - DNA, 12 bp, Homo sapiens
tttgcacccctc

SEQ ID NO: 5963848 - DNA, 19 bp, Homo sapiens
tttgcacccctttcctccc

SEQ ID NO: 5963849 - DNA, 23 bp, Homo sapiens
tttgcacccctttcctccccata

SEQ ID NO: 5963850 - DNA, 17 bp, Homo sapiens
tttgcaccgcctgccct

SEQ ID NO: 5963851 - DNA, 18 bp, Homo sapiens
tttgcaccgcctgccctc

SEQ ID NO: 5963852 - DNA, 15 bp, Homo sapiens
tttgcacctgtcccc

SEQ ID NO: 5963853 - DNA, 18 bp, Homo sapiens
tttgcaccttattcagaa

SEQ ID NO: 5963854 - DNA, 17 bp, Homo sapiens
tttgcacctttctagtt

SEQ ID NO: 5963855 - DNA, 21 bp, Homo sapiens
tttgcacgacgccctctcccc

SEQ ID NO: 5963856 - DNA, 17 bp, Homo sapiens
tttgcacgtttggtttg

SEQ ID NO: 5963857 - DNA, 20 bp, Homo sapiens
tttgcactaaatcagagaca

SEQ ID NO: 5963858 - DNA, 21 bp, Homo sapiens
tttgcactaaatcagagacaa

SEQ ID NO: 5963859 - DNA, 21 bp, Homo sapiens
tttgcactaggaagaatcagt

SEQ ID NO: 5963860 - DNA, 16 bp, Homo sapiens
tttgcactcaaatctt

SEQ ID NO: 5963861 - DNA, 18 bp, Homo sapiens
tttgcactgaggatattc

SEQ ID NO: 5963862 - DNA, 17 bp, Homo sapiens
tttgcactgagggccac

SEQ ID NO: 5963863 - DNA, 22 bp, Homo sapiens
tttgcactggaatatctgagaa

SEQ ID NO: 5963864 - DNA, 20 bp, Homo sapiens
tttgcactggagttctatgc

SEQ ID NO: 5963865 - DNA, 17 bp, Homo sapiens
tttgcactgtatgctgg

SEQ ID NO: 5963866 - DNA, 12 bp, Homo sapiens
tttgcactgtct

SEQ ID NO: 5963867 - DNA, 16 bp, Homo sapiens
tttgcactgtgtgctg

SEQ ID NO: 5963868 - DNA, 19 bp, Homo sapiens
tttgcactgtgtgctgact

SEQ ID NO: 5963869 - DNA, 21 bp, Homo sapiens
tttgcactgttactttttagt

SEQ ID NO: 5963870 - DNA, 13 bp, Homo sapiens
tttgcactgtttt

SEQ ID NO: 5963871 - DNA, 15 bp, Homo sapiens
tttgcacttctgtaa

SEQ ID NO: 5963872 - DNA, 14 bp, Homo sapiens
tttgcagaaacaga

SEQ ID NO: 5963873 - DNA, 16 bp, Homo sapiens
tttgcagaaggaaatg

SEQ ID NO: 5963874 - DNA, 18 bp, Homo sapiens
tttgcagaaggaaatgat

SEQ ID NO: 5963875 - DNA, 22 bp, Homo sapiens
tttgcagacatattttcttaca

SEQ ID NO: 5963876 - DNA, 16 bp, Homo sapiens
tttgcagacctgggac

SEQ ID NO: 5963877 - DNA, 18 bp, Homo sapiens
tttgcagataattctgga

SEQ ID NO: 5963878 - DNA, 16 bp, Homo sapiens
tttgcagatgacaaaa

SEQ ID NO: 5963879 - DNA, 18 bp, Homo sapiens
tttgcagcagaagccaaa

SEQ ID NO: 5963880 - DNA, 19 bp, Homo sapiens
tttgcagcagcaagtacaa

SEQ ID NO: 5963881 - DNA, 18 bp, Homo sapiens
tttgcagcataccaatta

SEQ ID NO: 5963882 - DNA, 18 bp, Homo sapiens
tttgcagccaaggtgcta

SEQ ID NO: 5963883 - DNA, 21 bp, Homo sapiens
tttgcagctatggacaattta

SEQ ID NO: 5963884 - DNA, 18 bp, Homo sapiens
tttgcagctgctgtctga

SEQ ID NO: 5963885 - DNA, 15 bp, Homo sapiens
tttgcagctgtgaga

SEQ ID NO: 5963886 - DNA, 12 bp, Homo sapiens
tttgcaggactt

SEQ ID NO: 5963887 - DNA, 16 bp, Homo sapiens
tttgcaggagtttgtg

SEQ ID NO: 5963888 - DNA, 21 bp, Homo sapiens
tttgcaggagtttgtggtaac

SEQ ID NO: 5963889 - DNA, 18 bp, Homo sapiens
tttgcaggattcccttct

SEQ ID NO: 5963890 - DNA, 18 bp, Homo sapiens
tttgcaggcccagcagac

SEQ ID NO: 5963891 - DNA, 12 bp, Homo sapiens
tttgcaggctca

SEQ ID NO: 5963892 - DNA, 12 bp, Homo sapiens
tttgcaggctct

SEQ ID NO: 5963893 - DNA, 14 bp, Homo sapiens
tttgcagggcagcc

SEQ ID NO: 5963894 - DNA, 19 bp, Homo sapiens
tttgcaggggactgggcca

SEQ ID NO: 5963895 - DNA, 22 bp, Homo sapiens
tttgcagggtcctcttctgggc

SEQ ID NO: 5963896 - DNA, 21 bp, Homo sapiens
tttgcaggtgaccagaatgag

SEQ ID NO: 5963897 - DNA, 14 bp, Homo sapiens
tttgcaggttgctt

SEQ ID NO: 5963898 - DNA, 10 bp, Homo sapiens
tttgcagtaa

SEQ ID NO: 5963899 - DNA, 14 bp, Homo sapiens
tttgcagtgtctta

SEQ ID NO: 5963900 - DNA, 18 bp, Homo sapiens
tttgcagttcctcttcat

SEQ ID NO: 5963901 - DNA, 16 bp, Homo sapiens
tttgcataacaattcc

SEQ ID NO: 5963902 - DNA, 21 bp, Homo sapiens
tttgcataatgcaatcaaaaa

SEQ ID NO: 5963903 - DNA, 16 bp, Homo sapiens
tttgcatactgaaaat

SEQ ID NO: 5963904 - DNA, 21 bp, Homo sapiens
tttgcatatatgttcttcata

SEQ ID NO: 5963905 - DNA, 15 bp, Homo sapiens
tttgcatatgtatga

SEQ ID NO: 5963906 - DNA, 18 bp, Homo sapiens
tttgcatattctctattt

SEQ ID NO: 5963907 - DNA, 20 bp, Homo sapiens
tttgcatattgcatactatt

SEQ ID NO: 5963908 - DNA, 14 bp, Homo sapiens
tttgcatcatttaa

SEQ ID NO: 5963909 - DNA, 16 bp, Homo sapiens
tttgcatcatttaact

SEQ ID NO: 5963910 - DNA, 20 bp, Homo sapiens
tttgcatccacttcaggagc

SEQ ID NO: 5963911 - DNA, 13 bp, Homo sapiens
tttgcatctcagt

SEQ ID NO: 5963912 - DNA, 15 bp, Homo sapiens
tttgcatctgaaaat

SEQ ID NO: 5963913 - DNA, 16 bp, Homo sapiens
tttgcatgagaaaagt

SEQ ID NO: 5963914 - DNA, 13 bp, Homo sapiens
tttgcatgcatgc

SEQ ID NO: 5963915 - DNA, 20 bp, Homo sapiens
tttgcatgcatgcaaatgag

SEQ ID NO: 5963916 - DNA, 22 bp, Homo sapiens
tttgcatggctccagaaatgtc

SEQ ID NO: 5963917 - DNA, 16 bp, Homo sapiens
tttgcatgtcgcacaa

SEQ ID NO: 5963918 - DNA, 11 bp, Homo sapiens
tttgcatgtgt

SEQ ID NO: 5963919 - DNA, 14 bp, Homo sapiens
tttgcatgttatgt

SEQ ID NO: 5963920 - DNA, 17 bp, Homo sapiens
tttgcatgttatgttta

SEQ ID NO: 5963921 - DNA, 18 bp, Homo sapiens
tttgcatgttatgtttaa

SEQ ID NO: 5963922 - DNA, 22 bp, Homo sapiens
tttgcatgttcttgttttgtta

SEQ ID NO: 5963923 - DNA, 15 bp, Homo sapiens
tttgcattaaattac

SEQ ID NO: 5963924 - DNA, 18 bp, Homo sapiens
tttgcattaaattcacaa

SEQ ID NO: 5963925 - DNA, 14 bp, Homo sapiens
tttgcattcaaatt

SEQ ID NO: 5963926 - DNA, 15 bp, Homo sapiens
tttgcattcaaatta

SEQ ID NO: 5963927 - DNA, 17 bp, Homo sapiens
tttgcattccatgattt

SEQ ID NO: 5963928 - DNA, 19 bp, Homo sapiens
tttgcattccatgatttta

SEQ ID NO: 5963929 - DNA, 23 bp, Homo sapiens
tttgcattgaggaaatattaatt

SEQ ID NO: 5963930 - DNA, 19 bp, Homo sapiens
tttgcattgtctaatgaca

SEQ ID NO: 5963931 - DNA, 14 bp, Homo sapiens
tttgcattgtctgt

SEQ ID NO: 5963932 - DNA, 13 bp, Homo sapiens
tttgcatttaaga

SEQ ID NO: 5963933 - DNA, 23 bp, Homo sapiens
tttgcatttatttatacagtgcc

SEQ ID NO: 5963934 - DNA, 20 bp, Homo sapiens
tttgcatttcctgtgtttgt

SEQ ID NO: 5963935 - DNA, 13 bp, Homo sapiens
tttgcatttctct

SEQ ID NO: 5963936 - DNA, 19 bp, Homo sapiens
tttgcatttctcttcctaa

SEQ ID NO: 5963937 - DNA, 23 bp, Homo sapiens
tttgcatttgtttatgtaatttc

SEQ ID NO: 5963938 - DNA, 13 bp, Homo sapiens
tttgcatttttgt

SEQ ID NO: 5963939 - DNA, 20 bp, Homo sapiens
tttgcatttttgtattttgt

SEQ ID NO: 5963940 - DNA, 19 bp, Homo sapiens
tttgcatttttgttttgaa

SEQ ID NO: 5963941 - DNA, 17 bp, Homo sapiens
tttgccaaaaaaaaaag

SEQ ID NO: 5963942 - DNA, 23 bp, Homo sapiens
tttgccaaaataatgtcttgtta

SEQ ID NO: 5963943 - DNA, 15 bp, Homo sapiens
tttgccaagaccttt

SEQ ID NO: 5963944 - DNA, 14 bp, Homo sapiens
tttgccaagccctt

SEQ ID NO: 5963945 - DNA, 18 bp, Homo sapiens
tttgccaagccctttgct

SEQ ID NO: 5963946 - DNA, 20 bp, Homo sapiens
tttgccaagctaatctgcct

SEQ ID NO: 5963947 - DNA, 20 bp, Homo sapiens
tttgccaaggctctcccctc

SEQ ID NO: 5963948 - DNA, 22 bp, Homo sapiens
tttgccaagggcataaattatt

SEQ ID NO: 5963949 - DNA, 23 bp, Homo sapiens
tttgccaagggcataaattattg

SEQ ID NO: 5963950 - DNA, 23 bp, Homo sapiens
tttgccaataaagcttttggaag

SEQ ID NO: 5963951 - DNA, 20 bp, Homo sapiens
tttgccaatttgcacattaa

SEQ ID NO: 5963952 - DNA, 13 bp, Homo sapiens
tttgccacagctt

SEQ ID NO: 5963953 - DNA, 18 bp, Homo sapiens
tttgccaccactagagct

SEQ ID NO: 5963954 - DNA, 19 bp, Homo sapiens
tttgccaccctcatgctgt

SEQ ID NO: 5963955 - DNA, 16 bp, Homo sapiens
tttgccacctctgccc

SEQ ID NO: 5963956 - DNA, 15 bp, Homo sapiens
tttgccacctttcct

SEQ ID NO: 5963957 - DNA, 22 bp, Homo sapiens
tttgccactaattttagtattc

SEQ ID NO: 5963958 - DNA, 16 bp, Homo sapiens
tttgccactgtgtttc

SEQ ID NO: 5963959 - DNA, 20 bp, Homo sapiens
tttgccactttggcttctcc

SEQ ID NO: 5963960 - DNA, 12 bp, Homo sapiens
tttgccagagca

SEQ ID NO: 5963961 - DNA, 23 bp, Homo sapiens
tttgccagagccaaattttatct

SEQ ID NO: 5963962 - DNA, 15 bp, Homo sapiens
tttgccagaggacca

SEQ ID NO: 5963963 - DNA, 10 bp, Homo sapiens
tttgccagcc

SEQ ID NO: 5963964 - DNA, 17 bp, Homo sapiens
tttgccagcccatttgg

SEQ ID NO: 5963965 - DNA, 16 bp, Homo sapiens
tttgccagctgctgct

SEQ ID NO: 5963966 - DNA, 23 bp, Homo sapiens
tttgccagtgaagacttcttggg

SEQ ID NO: 5963967 - DNA, 20 bp, Homo sapiens
tttgccagtgataagagcag

SEQ ID NO: 5963968 - DNA, 16 bp, Homo sapiens
tttgccagtgggaact

SEQ ID NO: 5963969 - DNA, 20 bp, Homo sapiens
tttgccagttttccctggaa

SEQ ID NO: 5963970 - DNA, 13 bp, Homo sapiens
tttgccatacatc

SEQ ID NO: 5963971 - DNA, 15 bp, Homo sapiens
tttgccatctctgct

SEQ ID NO: 5963972 - DNA, 20 bp, Homo sapiens
tttgccatgacatttcatct

SEQ ID NO: 5963973 - DNA, 14 bp, Homo sapiens
tttgccatgggctt

SEQ ID NO: 5963974 - DNA, 20 bp, Homo sapiens
tttgccatgggcttcactgt

SEQ ID NO: 5963975 - DNA, 14 bp, Homo sapiens
tttgccatgtcgct

SEQ ID NO: 5963976 - DNA, 16 bp, Homo sapiens
tttgccatgttgccca

SEQ ID NO: 5963977 - DNA, 16 bp, Homo sapiens
tttgccatttgatacc

SEQ ID NO: 5963978 - DNA, 19 bp, Homo sapiens
tttgccatttttctataaa

SEQ ID NO: 5963979 - DNA, 21 bp, Homo sapiens
tttgcccaaaatttattttat

SEQ ID NO: 5963980 - DNA, 18 bp, Homo sapiens
tttgcccaattccaggtg

SEQ ID NO: 5963981 - DNA, 18 bp, Homo sapiens
tttgcccacacacactcc

SEQ ID NO: 5963982 - DNA, 14 bp, Homo sapiens
tttgcccacccctc

SEQ ID NO: 5963983 - DNA, 14 bp, Homo sapiens
tttgcccatcctcc

SEQ ID NO: 5963984 - DNA, 15 bp, Homo sapiens
tttgcccatttacac

SEQ ID NO: 5963985 - DNA, 19 bp, Homo sapiens
tttgcccatttacactttt

SEQ ID NO: 5963986 - DNA, 13 bp, Homo sapiens
tttgcccattttg

SEQ ID NO: 5963987 - DNA, 22 bp, Homo sapiens
tttgccccaacttaagtttaga

SEQ ID NO: 5963988 - DNA, 17 bp, Homo sapiens
tttgccccactgggaga

SEQ ID NO: 5963989 - DNA, 15 bp, Homo sapiens
tttgccccagttaca

SEQ ID NO: 5963990 - DNA, 22 bp, Homo sapiens
tttgggaggggatggcagacag

SEQ ID NO: 5963991 - DNA, 18 bp, Homo sapiens
tttgggaggtccaggcag

SEQ ID NO: 5963992 - DNA, 22 bp, Homo sapiens
tttgggaggtcgaggtgggcgt

SEQ ID NO: 5963993 - DNA, 15 bp, Homo sapiens
tttgggagtttttgt

SEQ ID NO: 5963994 - DNA, 14 bp, Homo sapiens
tttgggatgtctta

SEQ ID NO: 5963995 - DNA, 15 bp, Homo sapiens
tttgggatgtcttat

SEQ ID NO: 5963996 - DNA, 17 bp, Homo sapiens
tttgggatgtcttattt

SEQ ID NO: 5963997 - DNA, 13 bp, Homo sapiens
tttgggatttgtt

SEQ ID NO: 5963998 - DNA, 18 bp, Homo sapiens
tttgggccactgcactct

SEQ ID NO: 5963999 - DNA, 23 bp, Homo sapiens
tttgggccactgcactctagcct

SEQ ID NO: 5964000 - DNA, 12 bp, Homo sapiens
tttgggcccagg

SEQ ID NO: 5964001 - DNA, 15 bp, Homo sapiens
tttgggcccctcaga

SEQ ID NO: 5964002 - DNA, 14 bp, Homo sapiens
tttgggccctgcat

SEQ ID NO: 5964003 - DNA, 14 bp, Homo sapiens
tttgggctaacatt

SEQ ID NO: 5964004 - DNA, 19 bp, Homo sapiens
tttgggctgaatgtatgta

SEQ ID NO: 5964005 - DNA, 15 bp, Homo sapiens
tttgggcttgggcct

SEQ ID NO: 5964006 - DNA, 14 bp, Homo sapiens
tttgggcttttatt

SEQ ID NO: 5964007 - DNA, 23 bp, Homo sapiens
tttggggaaaaaagcacatacat

SEQ ID NO: 5964008 - DNA, 13 bp, Homo sapiens
tttggggaaaaat

SEQ ID NO: 5964009 - DNA, 16 bp, Homo sapiens
tttggggaaatgtgga

SEQ ID NO: 5964010 - DNA, 15 bp, Homo sapiens
tttggggaagtttat

SEQ ID NO: 5964011 - DNA, 22 bp, Homo sapiens
tttggggactcaggaccagatg

SEQ ID NO: 5964012 - DNA, 22 bp, Homo sapiens
tttggggagagctggcagtgtg

SEQ ID NO: 5964013 - DNA, 22 bp, Homo sapiens
tttggggagggaggggaaatgt

SEQ ID NO: 5964014 - DNA, 22 bp, Homo sapiens
tttggggagggggaagagaaat

SEQ ID NO: 5964015 - DNA, 19 bp, Homo sapiens
tttggggatagtctggaaa

SEQ ID NO: 5964016 - DNA, 19 bp, Homo sapiens
tttggggatcgatgtgctc

SEQ ID NO: 5964017 - DNA, 18 bp, Homo sapiens
tttggggcagaaaggact

SEQ ID NO: 5964018 - DNA, 20 bp, Homo sapiens
tttggggcaggagtagctga

SEQ ID NO: 5964019 - DNA, 12 bp, Homo sapiens
tttggggcaggg

SEQ ID NO: 5964020 - DNA, 22 bp, Homo sapiens
tttggggcagggggttctggga

SEQ ID NO: 5964021 - DNA, 17 bp, Homo sapiens
tttggggcatcctggat

SEQ ID NO: 5964022 - DNA, 15 bp, Homo sapiens
tttggggcctttccc

SEQ ID NO: 5964023 - DNA, 14 bp, Homo sapiens
tttggggctgcgaa

SEQ ID NO: 5964024 - DNA, 16 bp, Homo sapiens
tttggggctggcccca

SEQ ID NO: 5964025 - DNA, 15 bp, Homo sapiens
tttgggggaaaaaaa

SEQ ID NO: 5964026 - DNA, 22 bp, Homo sapiens
tttgggggaaaaaaaagaaaaa

SEQ ID NO: 5964027 - DNA, 22 bp, Homo sapiens
tttgggggaaaatttagaaata

SEQ ID NO: 5964028 - DNA, 22 bp, Homo sapiens
tttgggggaaacgggctccttc

SEQ ID NO: 5964029 - DNA, 19 bp, Homo sapiens
tttgggggattcaaatgca

SEQ ID NO: 5964030 - DNA, 22 bp, Homo sapiens
tttgggggattcaaatgcatga

SEQ ID NO: 5964031 - DNA, 17 bp, Homo sapiens
tttgggggcttccctgg

SEQ ID NO: 5964032 - DNA, 21 bp, Homo sapiens
tttgggggggaataagattat

SEQ ID NO: 5964033 - DNA, 19 bp, Homo sapiens
tttggggggtgtgctgaca

SEQ ID NO: 5964034 - DNA, 15 bp, Homo sapiens
tttgggggtcaggca

SEQ ID NO: 5964035 - DNA, 20 bp, Homo sapiens
tttgggggtcaggcagccag

SEQ ID NO: 5964036 - DNA, 19 bp, Homo sapiens
tttgggggtggaaaaggaa

SEQ ID NO: 5964037 - DNA, 10 bp, Homo sapiens
tttggggtct

SEQ ID NO: 5964038 - DNA, 15 bp, Homo sapiens
tttggggtgggcgtt

SEQ ID NO: 5964039 - DNA, 17 bp, Homo sapiens
tttggggttcggcctgt

SEQ ID NO: 5964040 - DNA, 17 bp, Homo sapiens
tttgggtacctattttc

SEQ ID NO: 5964041 - DNA, 22 bp, Homo sapiens
tttgggtatgtttaatctgtta

SEQ ID NO: 5964042 - DNA, 16 bp, Homo sapiens
tttgggtgaccagcca

SEQ ID NO: 5964043 - DNA, 16 bp, Homo sapiens
tttgggtgcctcctgc

SEQ ID NO: 5964044 - DNA, 12 bp, Homo sapiens
tttgggtggtaa

SEQ ID NO: 5964045 - DNA, 23 bp, Homo sapiens
tttgggtgtggtgtcaccagcct

SEQ ID NO: 5964046 - DNA, 21 bp, Homo sapiens
tttgggtgtttttcatgtttt

SEQ ID NO: 5964047 - DNA, 16 bp, Homo sapiens
tttgggttcaggcctg

SEQ ID NO: 5964048 - DNA, 12 bp, Homo sapiens
tttgggttgacc

SEQ ID NO: 5964049 - DNA, 17 bp, Homo sapiens
tttgggttgcaaagcta

SEQ ID NO: 5964050 - DNA, 22 bp, Homo sapiens
tttgggttggttccaagtcttt

SEQ ID NO: 5964051 - DNA, 17 bp, Homo sapiens
tttgggtttatttggaa

SEQ ID NO: 5964052 - DNA, 11 bp, Homo sapiens
tttgggtttct

SEQ ID NO: 5964053 - DNA, 19 bp, Homo sapiens
tttgggtttggccagggag

SEQ ID NO: 5964054 - DNA, 17 bp, Homo sapiens
tttgggttttttctgtt

SEQ ID NO: 5964055 - DNA, 15 bp, Homo sapiens
tttgggtttttttgt

SEQ ID NO: 5964056 - DNA, 19 bp, Homo sapiens
tttggtaaaaatgctgctc

SEQ ID NO: 5964057 - DNA, 20 bp, Homo sapiens
tttggtaaaatacttcttga

SEQ ID NO: 5964058 - DNA, 16 bp, Homo sapiens
tttggtaaatgtttct

SEQ ID NO: 5964059 - DNA, 20 bp, Homo sapiens
tttggtaacgaatttaaaat

SEQ ID NO: 5964060 - DNA, 22 bp, Homo sapiens
tttggtaacgaatttaaaatgt

SEQ ID NO: 5964061 - DNA, 23 bp, Homo sapiens
tttggtaacgaatttaaaatgta

SEQ ID NO: 5964062 - DNA, 16 bp, Homo sapiens
tttggtaactcatttg

SEQ ID NO: 5964063 - DNA, 14 bp, Homo sapiens
tttggtaagggaag

SEQ ID NO: 5964064 - DNA, 21 bp, Homo sapiens
tttggtaatatatatattttt

SEQ ID NO: 5964065 - DNA, 17 bp, Homo sapiens
tttggtaatgtgtcaaa

SEQ ID NO: 5964066 - DNA, 18 bp, Homo sapiens
tttggtaattttttttgt

SEQ ID NO: 5964067 - DNA, 13 bp, Homo sapiens
tttggtacaaaaa

SEQ ID NO: 5964068 - DNA, 13 bp, Homo sapiens
tttggtacacatg

SEQ ID NO: 5964069 - DNA, 16 bp, Homo sapiens
tttggtacacatgtgt

SEQ ID NO: 5964070 - DNA, 17 bp, Homo sapiens
tttggtacacatgtgtt

SEQ ID NO: 5964071 - DNA, 14 bp, Homo sapiens
tttggtactaataa

SEQ ID NO: 5964072 - DNA, 23 bp, Homo sapiens
tttggtacttttgagtgtgtgtg

SEQ ID NO: 5964073 - DNA, 16 bp, Homo sapiens
tttggtagatcttcaa

SEQ ID NO: 5964074 - DNA, 17 bp, Homo sapiens
tttggtagatgacaaat

SEQ ID NO: 5964075 - DNA, 14 bp, Homo sapiens
tttggtagattaaa

SEQ ID NO: 5964076 - DNA, 19 bp, Homo sapiens
tttggtagctgggaaagca

SEQ ID NO: 5964077 - DNA, 22 bp, Homo sapiens
tttggtaggtaaatctagagtt

SEQ ID NO: 5964078 - DNA, 14 bp, Homo sapiens
tttggtataaatta

SEQ ID NO: 5964079 - DNA, 15 bp, Homo sapiens
tttggtatgaaacaa

SEQ ID NO: 5964080 - DNA, 15 bp, Homo sapiens
tttggtattcaattt

SEQ ID NO: 5964081 - DNA, 12 bp, Homo sapiens
tttggtatttat

SEQ ID NO: 5964082 - DNA, 13 bp, Homo sapiens
tttggtatttgaa

SEQ ID NO: 5964083 - DNA, 16 bp, Homo sapiens
tttggtcacccagact

SEQ ID NO: 5964084 - DNA, 21 bp, Homo sapiens
tttggtcctgcctaaatttca

SEQ ID NO: 5964085 - DNA, 23 bp, Homo sapiens
tttggtcctgcctaaatttcaca

SEQ ID NO: 5964086 - DNA, 15 bp, Homo sapiens
tttggtgagaaggtg

SEQ ID NO: 5964087 - DNA, 12 bp, Homo sapiens
tttggtgaggac

SEQ ID NO: 5964088 - DNA, 18 bp, Homo sapiens
tttggtgattacatttta

SEQ ID NO: 5964089 - DNA, 14 bp, Homo sapiens
tttggtgcagaggt

SEQ ID NO: 5964090 - DNA, 21 bp, Homo sapiens
tttggtgcagaggtttcttga

SEQ ID NO: 5964091 - DNA, 17 bp, Homo sapiens
tttggtgcatagaactg

SEQ ID NO: 5964092 - DNA, 20 bp, Homo sapiens
tttggtgccgatgttgaact

SEQ ID NO: 5964093 - DNA, 20 bp, Homo sapiens
tttggtgctcatttaaatat

SEQ ID NO: 5964094 - DNA, 20 bp, Homo sapiens
tttggtgctttttataaaaa

SEQ ID NO: 5964095 - DNA, 21 bp, Homo sapiens
tttggtggtttaaaaatggta

SEQ ID NO: 5964096 - DNA, 21 bp, Homo sapiens
tttggtgtcaacatgaaacac

SEQ ID NO: 5964097 - DNA, 14 bp, Homo sapiens
tttggtgtctgatg

SEQ ID NO: 5964098 - DNA, 18 bp, Homo sapiens
tttggtgtgcatctgtgt

SEQ ID NO: 5964099 - DNA, 21 bp, Homo sapiens
tttggtgtgcatctgtgtgtg

SEQ ID NO: 5964100 - DNA, 12 bp, Homo sapiens
tttggtgtgccc

SEQ ID NO: 5964101 - DNA, 19 bp, Homo sapiens
tttggtgtgccctgtgtgt

SEQ ID NO: 5964102 - DNA, 18 bp, Homo sapiens
tttggtgtggattttcta

SEQ ID NO: 5964103 - DNA, 16 bp, Homo sapiens
tttggtgtgttcctgt

SEQ ID NO: 5964104 - DNA, 13 bp, Homo sapiens
tttggttatagtg

SEQ ID NO: 5964105 - DNA, 16 bp, Homo sapiens
tttggttatagtgcaa

SEQ ID NO: 5964106 - DNA, 16 bp, Homo sapiens
tttggttattggtttt

SEQ ID NO: 5964107 - DNA, 14 bp, Homo sapiens
tttggttattttac

SEQ ID NO: 5964108 - DNA, 17 bp, Homo sapiens
tttggttcctctctggt

SEQ ID NO: 5964109 - DNA, 20 bp, Homo sapiens
tttggttccttctctgggtc

SEQ ID NO: 5964110 - DNA, 11 bp, Homo sapiens
tttggttctaa

SEQ ID NO: 5964111 - DNA, 13 bp, Homo sapiens
tttggttctaata

SEQ ID NO: 5964112 - DNA, 14 bp, Homo sapiens
tttggttctggggc

SEQ ID NO: 5964113 - DNA, 15 bp, Homo sapiens
tttggttgaataaac

SEQ ID NO: 5964114 - DNA, 17 bp, Homo sapiens
tttggttgaataaacta

SEQ ID NO: 5964115 - DNA, 22 bp, Homo sapiens
tttggttggtaactctgtaatt

SEQ ID NO: 5964116 - DNA, 18 bp, Homo sapiens
tttggttgtattctttga

SEQ ID NO: 5964117 - DNA, 13 bp, Homo sapiens
tttggttgtttgc

SEQ ID NO: 5964118 - DNA, 17 bp, Homo sapiens
tttggttgtttgctgtt

SEQ ID NO: 5964119 - DNA, 15 bp, Homo sapiens
tttggtttatgactt

SEQ ID NO: 5964120 - DNA, 12 bp, Homo sapiens
tttggtttccac

SEQ ID NO: 5964121 - DNA, 13 bp, Homo sapiens
tttggtttctagc

SEQ ID NO: 5964122 - DNA, 14 bp, Homo sapiens
tttggtttgacaat

SEQ ID NO: 5964123 - DNA, 14 bp, Homo sapiens
tttggtttggcctc

SEQ ID NO: 5964124 - DNA, 16 bp, Homo sapiens
tttggttttaaaagca

SEQ ID NO: 5964125 - DNA, 17 bp, Homo sapiens
tttggttttctactgtt

SEQ ID NO: 5964126 - DNA, 16 bp, Homo sapiens
tttggtttttcctcat

SEQ ID NO: 5964127 - DNA, 21 bp, Homo sapiens
tttgtaaaaacagcattgctt

SEQ ID NO: 5964128 - DNA, 15 bp, Homo sapiens
tttgtaaaaactgaa

SEQ ID NO: 5964129 - DNA, 13 bp, Homo sapiens
tttgtaaaaatac

SEQ ID NO: 5964130 - DNA, 21 bp, Homo sapiens
tttgtaaaaatgagtcatttg

SEQ ID NO: 5964131 - DNA, 13 bp, Homo sapiens
tttgtaaaacaat

SEQ ID NO: 5964132 - DNA, 15 bp, Homo sapiens
tttgtaaaagagctg

SEQ ID NO: 5964133 - DNA, 14 bp, Homo sapiens
tttgtaaaagctaa

SEQ ID NO: 5964134 - DNA, 13 bp, Homo sapiens
tttgtaaaccatt

SEQ ID NO: 5964135 - DNA, 16 bp, Homo sapiens
tttgtaaactcaaaat

SEQ ID NO: 5964136 - DNA, 21 bp, Homo sapiens
tttgtaaactgatgtttgtga

SEQ ID NO: 5964137 - DNA, 11 bp, Homo sapiens
tttgtaaactt

SEQ ID NO: 5964138 - DNA, 16 bp, Homo sapiens
tttgtaaactttgaaa

SEQ ID NO: 5964139 - DNA, 19 bp, Homo sapiens
tttgtaaactttgaaatat

SEQ ID NO: 5964140 - DNA, 16 bp, Homo sapiens
tttgtaaagaaaaata

SEQ ID NO: 5964141 - DNA, 22 bp, Homo sapiens
tttgtaaagaaatttactatat

SEQ ID NO: 5964142 - DNA, 17 bp, Homo sapiens
tttgtaaaggaaataat

SEQ ID NO: 5964143 - DNA, 23 bp, Homo sapiens
tttgtaaaggtcagagtcaaaat

SEQ ID NO: 5964144 - DNA, 16 bp, Homo sapiens
tttgtaaagtaaaata

SEQ ID NO: 5964145 - DNA, 16 bp, Homo sapiens
tttgtaaagtgaagaa

SEQ ID NO: 5964146 - DNA, 16 bp, Homo sapiens
tttgtaaataaaaaca

SEQ ID NO: 5964147 - DNA, 14 bp, Homo sapiens
tttgtaaataagag

SEQ ID NO: 5964148 - DNA, 20 bp, Homo sapiens
tttgtaaataggatttttag

SEQ ID NO: 5964149 - DNA, 15 bp, Homo sapiens
tttgtaaatcacatc

SEQ ID NO: 5964150 - DNA, 15 bp, Homo sapiens
tttgtaaatctgtac

SEQ ID NO: 5964151 - DNA, 17 bp, Homo sapiens
tttgtaaatctgtactt

SEQ ID NO: 5964152 - DNA, 22 bp, Homo sapiens
tttgtaaatctttgtgaacatt

SEQ ID NO: 5964153 - DNA, 22 bp, Homo sapiens
tttgtaaatgaaacttaagaat

SEQ ID NO: 5964154 - DNA, 14 bp, Homo sapiens
tttgtaaatgactt

SEQ ID NO: 5964155 - DNA, 18 bp, Homo sapiens
tttgtaaatgactttcat

SEQ ID NO: 5964156 - DNA, 19 bp, Homo sapiens
tttgtaaatgactttcata

SEQ ID NO: 5964157 - DNA, 12 bp, Homo sapiens
tttgtaaatgat

SEQ ID NO: 5964158 - DNA, 14 bp, Homo sapiens
tttgtaaatgattt

SEQ ID NO: 5964159 - DNA, 20 bp, Homo sapiens
tttgtaaatgttatttctgc

SEQ ID NO: 5964160 - DNA, 19 bp, Homo sapiens
tttgtaaatgttcttggtg

SEQ ID NO: 5964161 - DNA, 11 bp, Homo sapiens
tttgtaaattc

SEQ ID NO: 5964162 - DNA, 20 bp, Homo sapiens
tttgtaaattctggaaatgt

SEQ ID NO: 5964163 - DNA, 13 bp, Homo sapiens
tttgtaaattgtc

SEQ ID NO: 5964164 - DNA, 16 bp, Homo sapiens
tttgtaaatttagtgt

SEQ ID NO: 5964165 - DNA, 19 bp, Homo sapiens
tttgtaacattgtaaagta

SEQ ID NO: 5964166 - DNA, 23 bp, Homo sapiens
tttgtaacattgtaaagtatgtg

SEQ ID NO: 5964167 - DNA, 15 bp, Homo sapiens
tttgtaaccatatga

SEQ ID NO: 5964168 - DNA, 18 bp, Homo sapiens
tttgtaacctcagctctg

SEQ ID NO: 5964169 - DNA, 15 bp, Homo sapiens
tttgttgtcatgtgt

SEQ ID NO: 5964170 - DNA, 16 bp, Homo sapiens
tttgttgtcctcccag

SEQ ID NO: 5964171 - DNA, 13 bp, Homo sapiens
tttgttgtctaca

SEQ ID NO: 5964172 - DNA, 13 bp, Homo sapiens
tttgttgtgactt

SEQ ID NO: 5964173 - DNA, 21 bp, Homo sapiens
tttgttgtggccaatgtcgaa

SEQ ID NO: 5964174 - DNA, 21 bp, Homo sapiens
tttgttgtgtgcctctagctg

SEQ ID NO: 5964175 - DNA, 15 bp, Homo sapiens
tttgttgtgttctgt

SEQ ID NO: 5964176 - DNA, 14 bp, Homo sapiens
tttgttgttaatgt

SEQ ID NO: 5964177 - DNA, 14 bp, Homo sapiens
tttgttgttcctct

SEQ ID NO: 5964178 - DNA, 23 bp, Homo sapiens
tttgttgttcctctatactttgt

SEQ ID NO: 5964179 - DNA, 12 bp, Homo sapiens
tttgttgtttgt

SEQ ID NO: 5964180 - DNA, 13 bp, Homo sapiens
tttgtttaaagtt

SEQ ID NO: 5964181 - DNA, 19 bp, Homo sapiens
tttgtttaatggacacttt

SEQ ID NO: 5964182 - DNA, 21 bp, Homo sapiens
tttgtttaatttttatttctt

SEQ ID NO: 5964183 - DNA, 20 bp, Homo sapiens
tttgtttacaacacagtagt

SEQ ID NO: 5964184 - DNA, 13 bp, Homo sapiens
tttgtttactctc

SEQ ID NO: 5964185 - DNA, 11 bp, Homo sapiens
tttgtttagaa

SEQ ID NO: 5964186 - DNA, 22 bp, Homo sapiens
tttgtttagcctgaaaaccttt

SEQ ID NO: 5964187 - DNA, 18 bp, Homo sapiens
tttgtttatccttaagaa

SEQ ID NO: 5964188 - DNA, 13 bp, Homo sapiens
tttgtttatgtta

SEQ ID NO: 5964189 - DNA, 19 bp, Homo sapiens
tttgtttattttttaactt

SEQ ID NO: 5964190 - DNA, 21 bp, Homo sapiens
tttgtttcaaagggattgctt

SEQ ID NO: 5964191 - DNA, 16 bp, Homo sapiens
tttgtttcaactttct

SEQ ID NO: 5964192 - DNA, 14 bp, Homo sapiens
tttgtttcactgga

SEQ ID NO: 5964193 - DNA, 12 bp, Homo sapiens
tttgtttcactt

SEQ ID NO: 5964194 - DNA, 13 bp, Homo sapiens
tttgtttcagtgc

SEQ ID NO: 5964195 - DNA, 13 bp, Homo sapiens
tttgtttcatatt

SEQ ID NO: 5964196 - DNA, 14 bp, Homo sapiens
tttgtttccaaagc

SEQ ID NO: 5964197 - DNA, 21 bp, Homo sapiens
tttgtttccaaagctgaagat

SEQ ID NO: 5964198 - DNA, 13 bp, Homo sapiens
tttgtttccccta

SEQ ID NO: 5964199 - DNA, 14 bp, Homo sapiens
tttgtttcctcctt

SEQ ID NO: 5964200 - DNA, 12 bp, Homo sapiens
tttgtttcctct

SEQ ID NO: 5964201 - DNA, 17 bp, Homo sapiens
tttgtttcctctgttca

SEQ ID NO: 5964202 - DNA, 16 bp, Homo sapiens
tttgtttctgaaaggg

SEQ ID NO: 5964203 - DNA, 17 bp, Homo sapiens
tttgtttctgagaaaag

SEQ ID NO: 5964204 - DNA, 10 bp, Homo sapiens
tttgtttctt

SEQ ID NO: 5964205 - DNA, 18 bp, Homo sapiens
tttgtttcttcttttcct

SEQ ID NO: 5964206 - DNA, 22 bp, Homo sapiens
tttgtttctttgaattttcatt

SEQ ID NO: 5964207 - DNA, 15 bp, Homo sapiens
tttgtttgctatctt

SEQ ID NO: 5964208 - DNA, 12 bp, Homo sapiens
tttgtttgctgc

SEQ ID NO: 5964209 - DNA, 20 bp, Homo sapiens
tttgtttgcttaatttcctt

SEQ ID NO: 5964210 - DNA, 16 bp, Homo sapiens
tttgtttgcttccatt

SEQ ID NO: 5964211 - DNA, 18 bp, Homo sapiens
tttgtttggtataaatta

SEQ ID NO: 5964212 - DNA, 18 bp, Homo sapiens
tttgtttggtattgtatt

SEQ ID NO: 5964213 - DNA, 13 bp, Homo sapiens
tttgtttgtagct

SEQ ID NO: 5964214 - DNA, 13 bp, Homo sapiens
tttgtttgtgcat

SEQ ID NO: 5964215 - DNA, 16 bp, Homo sapiens
tttgtttgtgcttcta

SEQ ID NO: 5964216 - DNA, 16 bp, Homo sapiens
tttgtttgttcttgtt

SEQ ID NO: 5964217 - DNA, 15 bp, Homo sapiens
tttgttttaaactgt

SEQ ID NO: 5964218 - DNA, 20 bp, Homo sapiens
tttgttttaaggaagaaaaa

SEQ ID NO: 5964219 - DNA, 15 bp, Homo sapiens
tttgttttaatctta

SEQ ID NO: 5964220 - DNA, 14 bp, Homo sapiens
tttgttttcaagat

SEQ ID NO: 5964221 - DNA, 15 bp, Homo sapiens
tttgttttcatttgt

SEQ ID NO: 5964222 - DNA, 13 bp, Homo sapiens
tttgttttcttaa

SEQ ID NO: 5964223 - DNA, 15 bp, Homo sapiens
tttgttttctttttc

SEQ ID NO: 5964224 - DNA, 12 bp, Homo sapiens
tttgttttgaaa

SEQ ID NO: 5964225 - DNA, 12 bp, Homo sapiens
tttgttttgctt

SEQ ID NO: 5964226 - DNA, 21 bp, Homo sapiens
tttgttttgggatttttgtgt

SEQ ID NO: 5964227 - DNA, 18 bp, Homo sapiens
tttgttttggtagatctt

SEQ ID NO: 5964228 - DNA, 14 bp, Homo sapiens
tttgttttgtgcta

SEQ ID NO: 5964229 - DNA, 15 bp, Homo sapiens
tttgttttgtgtctc

SEQ ID NO: 5964230 - DNA, 14 bp, Homo sapiens
tttgttttgttgca

SEQ ID NO: 5964231 - DNA, 14 bp, Homo sapiens
tttgttttgttgga

SEQ ID NO: 5964232 - DNA, 15 bp, Homo sapiens
tttgtttttactgta

SEQ ID NO: 5964233 - DNA, 16 bp, Homo sapiens
tttgtttttattttca

SEQ ID NO: 5964234 - DNA, 15 bp, Homo sapiens
tttgttttttaaaaa

SEQ ID NO: 5964235 - DNA, 23 bp, Homo sapiens
tttgttttttaaagtcttgctgt

SEQ ID NO: 5964236 - DNA, 17 bp, Homo sapiens
tttgttttttgaagtgt

SEQ ID NO: 5964237 - DNA, 18 bp, Homo sapiens
tttgttttttgagtcttt

SEQ ID NO: 5964238 - DNA, 13 bp, Homo sapiens
tttgttttttggt

SEQ ID NO: 5964239 - DNA, 15 bp, Homo sapiens
tttgttttttggtga

SEQ ID NO: 5964240 - DNA, 19 bp, Homo sapiens
tttgttttttgtaactaca

SEQ ID NO: 5964241 - DNA, 14 bp, Homo sapiens
tttgtttttttgag

SEQ ID NO: 5964242 - DNA, 19 bp, Homo sapiens
tttgttttttttgactaaa

SEQ ID NO: 5964243 - DNA, 19 bp, Homo sapiens
ttttaaaaaaaatattctg

SEQ ID NO: 5964244 - DNA, 20 bp, Homo sapiens
ttttaaaaaaaatattctgt

SEQ ID NO: 5964245 - DNA, 15 bp, Homo sapiens
ttttaaaaaaactga

SEQ ID NO: 5964246 - DNA, 16 bp, Homo sapiens
ttttaaaaaaactgaa

SEQ ID NO: 5964247 - DNA, 13 bp, Homo sapiens
ttttaaaaaaaga

SEQ ID NO: 5964248 - DNA, 21 bp, Homo sapiens
ttttaaaaaaagctaaattac

SEQ ID NO: 5964249 - DNA, 13 bp, Homo sapiens
ttttaaaaaaata

SEQ ID NO: 5964250 - DNA, 21 bp, Homo sapiens
ttttaaaaaaataaaacattt

SEQ ID NO: 5964251 - DNA, 21 bp, Homo sapiens
ttttaaaaaaatttttgcaaa

SEQ ID NO: 5964252 - DNA, 17 bp, Homo sapiens
ttttaaaaaactctttg

SEQ ID NO: 5964253 - DNA, 14 bp, Homo sapiens
ttttaaaaaagaaa

SEQ ID NO: 5964254 - DNA, 14 bp, Homo sapiens
ttttaaaaaagctt

SEQ ID NO: 5964255 - DNA, 15 bp, Homo sapiens
ttttaaaaaagctta

SEQ ID NO: 5964256 - DNA, 21 bp, Homo sapiens
ttttaaaaaagggagtttttg

SEQ ID NO: 5964257 - DNA, 16 bp, Homo sapiens
ttttaaaaaataacat

SEQ ID NO: 5964258 - DNA, 18 bp, Homo sapiens
ttttaaaaaataccattg

SEQ ID NO: 5964259 - DNA, 14 bp, Homo sapiens
ttttaaaaaatatt

SEQ ID NO: 5964260 - DNA, 21 bp, Homo sapiens
ttttaaaaaatattttaagaa

SEQ ID NO: 5964261 - DNA, 15 bp, Homo sapiens
ttttaaaaaatcaat

SEQ ID NO: 5964262 - DNA, 20 bp, Homo sapiens
ttttaaaaaatgttttctgg

SEQ ID NO: 5964263 - DNA, 22 bp, Homo sapiens
ttttaaaaaatgttttctgggg

SEQ ID NO: 5964264 - DNA, 11 bp, Homo sapiens
ttttaaaaaca

SEQ ID NO: 5964265 - DNA, 19 bp, Homo sapiens
ttttaaaaacctgtatctg

SEQ ID NO: 5964266 - DNA, 15 bp, Homo sapiens
ttttaaaaactcctt

SEQ ID NO: 5964267 - DNA, 15 bp, Homo sapiens
ttttaaaaagaaggg

SEQ ID NO: 5964268 - DNA, 21 bp, Homo sapiens
ttttaaaaagagtaatttcat

SEQ ID NO: 5964269 - DNA, 15 bp, Homo sapiens
ttttaaaaaggcctt

SEQ ID NO: 5964270 - DNA, 18 bp, Homo sapiens
ttttaaaaagggtaactt

SEQ ID NO: 5964271 - DNA, 18 bp, Homo sapiens
ttttaaaaaggtaaatgg

SEQ ID NO: 5964272 - DNA, 14 bp, Homo sapiens
ttttaaaaagtatt

SEQ ID NO: 5964273 - DNA, 11 bp, Homo sapiens
ttttaaaaata

SEQ ID NO: 5964274 - DNA, 23 bp, Homo sapiens
ttttaaaaatacaattattgtat

SEQ ID NO: 5964275 - DNA, 21 bp, Homo sapiens
ttttaaaaatacatatcgctg

SEQ ID NO: 5964276 - DNA, 21 bp, Homo sapiens
ttttaaaaatctaagcagctt

SEQ ID NO: 5964277 - DNA, 22 bp, Homo sapiens
ttttaaaaatctaccttctgta

SEQ ID NO: 5964278 - DNA, 13 bp, Homo sapiens
ttttaaaaatgtt

SEQ ID NO: 5964279 - DNA, 16 bp, Homo sapiens
ttttaaaaattttgtc

SEQ ID NO: 5964280 - DNA, 19 bp, Homo sapiens
ttttaaaacactaaaagca

SEQ ID NO: 5964281 - DNA, 17 bp, Homo sapiens
ttttaaaacagatatta

SEQ ID NO: 5964282 - DNA, 12 bp, Homo sapiens
ttttaaaacatg

SEQ ID NO: 5964283 - DNA, 15 bp, Homo sapiens
ttttaaaaccatgca

SEQ ID NO: 5964284 - DNA, 18 bp, Homo sapiens
ttttaaaactacttagca

SEQ ID NO: 5964285 - DNA, 18 bp, Homo sapiens
ttttaaaactctacagat

SEQ ID NO: 5964286 - DNA, 20 bp, Homo sapiens
ttttaaaactggacctgtat

SEQ ID NO: 5964287 - DNA, 11 bp, Homo sapiens
ttttaaaagaa

SEQ ID NO: 5964288 - DNA, 12 bp, Homo sapiens
ttttaaaagaaa

SEQ ID NO: 5964289 - DNA, 13 bp, Homo sapiens
ttttaaaagaaca

SEQ ID NO: 5964290 - DNA, 21 bp, Homo sapiens
ttttaaaagaatgattatgaa

SEQ ID NO: 5964291 - DNA, 23 bp, Homo sapiens
ttttaaaagacaagacttcagta

SEQ ID NO: 5964292 - DNA, 23 bp, Homo sapiens
ttttaaaagagacaaactgtaaa

SEQ ID NO: 5964293 - DNA, 16 bp, Homo sapiens
ttttaaaagataaaca

SEQ ID NO: 5964294 - DNA, 20 bp, Homo sapiens
ttttaaaagataaacagttt

SEQ ID NO: 5964295 - DNA, 23 bp, Homo sapiens
ttttaaaagccttggcctcagag

SEQ ID NO: 5964296 - DNA, 12 bp, Homo sapiens
ttttaaaaggaa

SEQ ID NO: 5964297 - DNA, 14 bp, Homo sapiens
ttttaaaaggaaaa

SEQ ID NO: 5964298 - DNA, 15 bp, Homo sapiens
ttttaaaaggattga

SEQ ID NO: 5964299 - DNA, 22 bp, Homo sapiens
ttttaaaaggcagattaaaagc

SEQ ID NO: 5964300 - DNA, 18 bp, Homo sapiens
ttttaaaaggccctgtgg

SEQ ID NO: 5964301 - DNA, 19 bp, Homo sapiens
ttttaaaaggtagagtctt

SEQ ID NO: 5964302 - DNA, 18 bp, Homo sapiens
ttttaaaagtaaatgtac

SEQ ID NO: 5964303 - DNA, 17 bp, Homo sapiens
ttttaaaagtctatttt

SEQ ID NO: 5964304 - DNA, 21 bp, Homo sapiens
ttttaaaagttgttaccaaat

SEQ ID NO: 5964305 - DNA, 13 bp, Homo sapiens
ttttaaaagtttc

SEQ ID NO: 5964306 - DNA, 19 bp, Homo sapiens
ttttaaaagtttcaatgtg

SEQ ID NO: 5964307 - DNA, 22 bp, Homo sapiens
ttttaaaagtttcaatgtgatt

SEQ ID NO: 5964308 - DNA, 17 bp, Homo sapiens
ttttaaaataaaaatat

SEQ ID NO: 5964309 - DNA, 15 bp, Homo sapiens
ttttaaaataagtct

SEQ ID NO: 5964310 - DNA, 15 bp, Homo sapiens
ttttaaaataattta

SEQ ID NO: 5964311 - DNA, 14 bp, Homo sapiens
ttttaaaatagaaa

SEQ ID NO: 5964312 - DNA, 21 bp, Homo sapiens
ttttaaaatagaatgatagaa

SEQ ID NO: 5964313 - DNA, 14 bp, Homo sapiens
ttttaaaatagagg

SEQ ID NO: 5964314 - DNA, 17 bp, Homo sapiens
ttttaaaatatatgtat

SEQ ID NO: 5964315 - DNA, 17 bp, Homo sapiens
ttttaaaatatcctgta

SEQ ID NO: 5964316 - DNA, 20 bp, Homo sapiens
ttttaaaatatcctgtaact

SEQ ID NO: 5964317 - DNA, 14 bp, Homo sapiens
ttttaaaatatctt

SEQ ID NO: 5964318 - DNA, 21 bp, Homo sapiens
ttttaaaatattacacaggag

SEQ ID NO: 5964319 - DNA, 21 bp, Homo sapiens
ttttaaaatatttaacttttt

SEQ ID NO: 5964320 - DNA, 16 bp, Homo sapiens
ttttaaaatatttagt

SEQ ID NO: 5964321 - DNA, 20 bp, Homo sapiens
ttttaaaatcactaacatta

SEQ ID NO: 5964322 - DNA, 18 bp, Homo sapiens
ttttaaaatcataacatt

SEQ ID NO: 5964323 - DNA, 19 bp, Homo sapiens
ttttaaaatctgatttaat

SEQ ID NO: 5964324 - DNA, 14 bp, Homo sapiens
ttttaaaatcttat

SEQ ID NO: 5964325 - DNA, 19 bp, Homo sapiens
ttttaaaatgaaatgcatt

SEQ ID NO: 5964326 - DNA, 15 bp, Homo sapiens
ttttaaaatgagaaa

SEQ ID NO: 5964327 - DNA, 18 bp, Homo sapiens
ttttaaaatgcaaatatt

SEQ ID NO: 5964328 - DNA, 24 bp, Homo sapiens
ttttaaaatgccgattacacccaa

SEQ ID NO: 5964329 - DNA, 12 bp, Homo sapiens
ttttaaaatgta

SEQ ID NO: 5964330 - DNA, 13 bp, Homo sapiens
ttttaaaatgtac

SEQ ID NO: 5964331 - DNA, 13 bp, Homo sapiens
ttttaaaatgtca

SEQ ID NO: 5964332 - DNA, 17 bp, Homo sapiens
ttttaaaatgtcaagac

SEQ ID NO: 5964333 - DNA, 22 bp, Homo sapiens
ttttaaaatgtgaggcaataag

SEQ ID NO: 5964334 - DNA, 11 bp, Homo sapiens
ttttaaaattg

SEQ ID NO: 5964335 - DNA, 17 bp, Homo sapiens
ttttaaaattgaatagt

SEQ ID NO: 5964336 - DNA, 12 bp, Homo sapiens
ttttaaaattta

SEQ ID NO: 5964337 - DNA, 16 bp, Homo sapiens
ttttaaaatttatttg

SEQ ID NO: 5964338 - DNA, 20 bp, Homo sapiens
ttttaaaatttatttgcaaa

SEQ ID NO: 5964339 - DNA, 20 bp, Homo sapiens
ttttaaacaaaatagaagct

SEQ ID NO: 5964340 - DNA, 21 bp, Homo sapiens
ttttaaacaaaatttatgtca

SEQ ID NO: 5964341 - DNA, 13 bp, Homo sapiens
ttttaaacaaaca

SEQ ID NO: 5964342 - DNA, 14 bp, Homo sapiens
ttttaaacaaatga

SEQ ID NO: 5964343 - DNA, 13 bp, Homo sapiens
ttttaaacacatt

SEQ ID NO: 5964344 - DNA, 16 bp, Homo sapiens
ttttaaacagatattc

SEQ ID NO: 5964345 - DNA, 21 bp, Homo sapiens
ttttaaacatcaatctttaaa

SEQ ID NO: 5964346 - DNA, 21 bp, Homo sapiens
ttttaaaccataaaaagctga

SEQ ID NO: 5964347 - DNA, 20 bp, Homo sapiens
ttttaaaccctattggtaaa

SEQ ID NO: 5964348 - DNA, 19 bp, Homo sapiens
ttttaaacctgttcctgac

SEQ ID NO: 5964349 - DNA, 21 bp, Homo sapiens
ttttaaactaagatctgttaa

SEQ ID NO: 5964350 - DNA, 17 bp, Homo sapiens
ttttatatgatggggga

SEQ ID NO: 5964351 - DNA, 20 bp, Homo sapiens
ttttatatgcttctgtttta

SEQ ID NO: 5964352 - DNA, 21 bp, Homo sapiens
ttttatatgctttttctcaga

SEQ ID NO: 5964353 - DNA, 15 bp, Homo sapiens
ttttatatgtaaatg

SEQ ID NO: 5964354 - DNA, 14 bp, Homo sapiens
ttttatatgtcaaa

SEQ ID NO: 5964355 - DNA, 14 bp, Homo sapiens
ttttatatgtggaa

SEQ ID NO: 5964356 - DNA, 14 bp, Homo sapiens
ttttatatgttcat

SEQ ID NO: 5964357 - DNA, 20 bp, Homo sapiens
ttttatattacttttgtaaa

SEQ ID NO: 5964358 - DNA, 23 bp, Homo sapiens
ttttatatttagttatagtttca

SEQ ID NO: 5964359 - DNA, 14 bp, Homo sapiens
ttttatatttcctt

SEQ ID NO: 5964360 - DNA, 20 bp, Homo sapiens
ttttatatttcctttatgtg

SEQ ID NO: 5964361 - DNA, 21 bp, Homo sapiens
ttttatatttcctttatgtga

SEQ ID NO: 5964362 - DNA, 23 bp, Homo sapiens
ttttatatttcctttatgtgaat

SEQ ID NO: 5964363 - DNA, 11 bp, Homo sapiens
ttttatatttg

SEQ ID NO: 5964364 - DNA, 18 bp, Homo sapiens
ttttatatttgaaatatt

SEQ ID NO: 5964365 - DNA, 18 bp, Homo sapiens
ttttatatttgttatgat

SEQ ID NO: 5964366 - DNA, 12 bp, Homo sapiens
ttttatcagtag

SEQ ID NO: 5964367 - DNA, 19 bp, Homo sapiens
ttttatcattaaaaattac

SEQ ID NO: 5964368 - DNA, 14 bp, Homo sapiens
ttttatcatttcta

SEQ ID NO: 5964369 - DNA, 19 bp, Homo sapiens
ttttatcattttcaaaatg

SEQ ID NO: 5964370 - DNA, 13 bp, Homo sapiens
ttttatccataat

SEQ ID NO: 5964371 - DNA, 15 bp, Homo sapiens
ttttatccatcctgt

SEQ ID NO: 5964372 - DNA, 18 bp, Homo sapiens
ttttatcccttcctgtct

SEQ ID NO: 5964373 - DNA, 12 bp, Homo sapiens
ttttatcctgta

SEQ ID NO: 5964374 - DNA, 15 bp, Homo sapiens
ttttatccttacaat

SEQ ID NO: 5964375 - DNA, 16 bp, Homo sapiens
ttttatcgcagatttt

SEQ ID NO: 5964376 - DNA, 23 bp, Homo sapiens
ttttatcgtttttgtattttcat

SEQ ID NO: 5964377 - DNA, 22 bp, Homo sapiens
ttttatctacccagtcatgtac

SEQ ID NO: 5964378 - DNA, 22 bp, Homo sapiens
ttttatctattctgagaaaaca

SEQ ID NO: 5964379 - DNA, 20 bp, Homo sapiens
ttttatctccatactttgga

SEQ ID NO: 5964380 - DNA, 22 bp, Homo sapiens
ttttatctccatactttggatg

SEQ ID NO: 5964381 - DNA, 23 bp, Homo sapiens
ttttatctccccttcacatgcat

SEQ ID NO: 5964382 - DNA, 13 bp, Homo sapiens
ttttatctcttct

SEQ ID NO: 5964383 - DNA, 17 bp, Homo sapiens
ttttatctcttcttcct

SEQ ID NO: 5964384 - DNA, 21 bp, Homo sapiens
ttttatctgaaatcaattaaa

SEQ ID NO: 5964385 - DNA, 18 bp, Homo sapiens
ttttatctggtgcctcct

SEQ ID NO: 5964386 - DNA, 15 bp, Homo sapiens
ttttatctgtgagtt

SEQ ID NO: 5964387 - DNA, 23 bp, Homo sapiens
ttttatctgttaaccaaataaaa

SEQ ID NO: 5964388 - DNA, 14 bp, Homo sapiens
ttttatctgtttaa

SEQ ID NO: 5964389 - DNA, 13 bp, Homo sapiens
ttttatcttctat

SEQ ID NO: 5964390 - DNA, 17 bp, Homo sapiens
ttttatcttgagtgtta

SEQ ID NO: 5964391 - DNA, 19 bp, Homo sapiens
ttttatgaaaccaactgtt

SEQ ID NO: 5964392 - DNA, 19 bp, Homo sapiens
ttttatgaacattgtactg

SEQ ID NO: 5964393 - DNA, 12 bp, Homo sapiens
ttttatgaagaa

SEQ ID NO: 5964394 - DNA, 14 bp, Homo sapiens
ttttatgaagaaaa

SEQ ID NO: 5964395 - DNA, 23 bp, Homo sapiens
ttttatgaagaaaaaatacattt

SEQ ID NO: 5964396 - DNA, 21 bp, Homo sapiens
ttttatgaagtgcgtgaatgt

SEQ ID NO: 5964397 - DNA, 17 bp, Homo sapiens
ttttatgactaatcctt

SEQ ID NO: 5964398 - DNA, 12 bp, Homo sapiens
ttttatgactgt

SEQ ID NO: 5964399 - DNA, 19 bp, Homo sapiens
ttttatgactgtaaacata

SEQ ID NO: 5964400 - DNA, 11 bp, Homo sapiens
ttttatgagaa

SEQ ID NO: 5964401 - DNA, 16 bp, Homo sapiens
ttttatgagaaatgta

SEQ ID NO: 5964402 - DNA, 21 bp, Homo sapiens
ttttatgagctcatgtagcaa

SEQ ID NO: 5964403 - DNA, 18 bp, Homo sapiens
ttttatgagcttccaagg

SEQ ID NO: 5964404 - DNA, 13 bp, Homo sapiens
ttttatgatcagt

SEQ ID NO: 5964405 - DNA, 13 bp, Homo sapiens
ttttatgatccag

SEQ ID NO: 5964406 - DNA, 15 bp, Homo sapiens
ttttatgatccagca

SEQ ID NO: 5964407 - DNA, 13 bp, Homo sapiens
ttttatgatgacg

SEQ ID NO: 5964408 - DNA, 16 bp, Homo sapiens
ttttatgatgatgaaa

SEQ ID NO: 5964409 - DNA, 19 bp, Homo sapiens
ttttatgatttaaaaaata

SEQ ID NO: 5964410 - DNA, 13 bp, Homo sapiens
ttttatgatttct

SEQ ID NO: 5964411 - DNA, 15 bp, Homo sapiens
ttttatgcaaatatt

SEQ ID NO: 5964412 - DNA, 23 bp, Homo sapiens
ttttatgcaaatatttttttgta

SEQ ID NO: 5964413 - DNA, 13 bp, Homo sapiens
ttttatgccatgt

SEQ ID NO: 5964414 - DNA, 17 bp, Homo sapiens
ttttatgcgcaaataca

SEQ ID NO: 5964415 - DNA, 18 bp, Homo sapiens
ttttatgcgtgtgacagt

SEQ ID NO: 5964416 - DNA, 24 bp, Homo sapiens
ttttatgctcttttttactcattg

SEQ ID NO: 5964417 - DNA, 12 bp, Homo sapiens
ttttatggatga

SEQ ID NO: 5964418 - DNA, 18 bp, Homo sapiens
ttttatggatgattaaat

SEQ ID NO: 5964419 - DNA, 19 bp, Homo sapiens
ttttatggatgattaaatt

SEQ ID NO: 5964420 - DNA, 18 bp, Homo sapiens
ttttatggcatgatttat

SEQ ID NO: 5964421 - DNA, 22 bp, Homo sapiens
ttttatggcatgatttatatat

SEQ ID NO: 5964422 - DNA, 18 bp, Homo sapiens
ttttatggcttttgtgca

SEQ ID NO: 5964423 - DNA, 21 bp, Homo sapiens
ttttatggcttttgtgcatta

SEQ ID NO: 5964424 - DNA, 22 bp, Homo sapiens
ttttatggtactaatgaaattt

SEQ ID NO: 5964425 - DNA, 23 bp, Homo sapiens
ttttatggtgcctagtattgaca

SEQ ID NO: 5964426 - DNA, 22 bp, Homo sapiens
ttttatggtggaaaagaactgt

SEQ ID NO: 5964427 - DNA, 17 bp, Homo sapiens
ttttatggttacttctt

SEQ ID NO: 5964428 - DNA, 13 bp, Homo sapiens
ttttatgtaaatt

SEQ ID NO: 5964429 - DNA, 23 bp, Homo sapiens
ttttatgtaatttctttaaatgt

SEQ ID NO: 5964430 - DNA, 13 bp, Homo sapiens
ttttatgtacaac

SEQ ID NO: 5964431 - DNA, 12 bp, Homo sapiens
ttttatgtactt

SEQ ID NO: 5964432 - DNA, 19 bp, Homo sapiens
ttttatgtagtaattgaca

SEQ ID NO: 5964433 - DNA, 17 bp, Homo sapiens
ttttatgtcatactctg

SEQ ID NO: 5964434 - DNA, 22 bp, Homo sapiens
ttttatgtcatactctgtgtaa

SEQ ID NO: 5964435 - DNA, 20 bp, Homo sapiens
ttttatgtctttcttgtaag

SEQ ID NO: 5964436 - DNA, 16 bp, Homo sapiens
ttttatgtgatgccaa

SEQ ID NO: 5964437 - DNA, 22 bp, Homo sapiens
ttttatgtgcagcgacccttgg

SEQ ID NO: 5964438 - DNA, 18 bp, Homo sapiens
ttttatgtgcctttttgt

SEQ ID NO: 5964439 - DNA, 14 bp, Homo sapiens
ttttatgtgctatg

SEQ ID NO: 5964440 - DNA, 17 bp, Homo sapiens
ttttatgtgctatgcaa

SEQ ID NO: 5964441 - DNA, 12 bp, Homo sapiens
ttttatgtgctt

SEQ ID NO: 5964442 - DNA, 15 bp, Homo sapiens
ttttatgtgcttgaa

SEQ ID NO: 5964443 - DNA, 23 bp, Homo sapiens
ttttatgttaaaaagaaatccag

SEQ ID NO: 5964444 - DNA, 18 bp, Homo sapiens
ttttatgttcttggcttt

SEQ ID NO: 5964445 - DNA, 15 bp, Homo sapiens
ttttatgttgacatt

SEQ ID NO: 5964446 - DNA, 15 bp, Homo sapiens
ttttatgttgatctg

SEQ ID NO: 5964447 - DNA, 18 bp, Homo sapiens
ttttatgtttaaaatggc

SEQ ID NO: 5964448 - DNA, 12 bp, Homo sapiens
ttttatgtttga

SEQ ID NO: 5964449 - DNA, 16 bp, Homo sapiens
ttttatgtttgaatat

SEQ ID NO: 5964450 - DNA, 20 bp, Homo sapiens
ttttatgttttctttctcac

SEQ ID NO: 5964451 - DNA, 14 bp, Homo sapiens
ttttattaaaacat

SEQ ID NO: 5964452 - DNA, 13 bp, Homo sapiens
ttttattaaagat

SEQ ID NO: 5964453 - DNA, 14 bp, Homo sapiens
ttttattaaatctt

SEQ ID NO: 5964454 - DNA, 19 bp, Homo sapiens
ttttattaaattaattgaa

SEQ ID NO: 5964455 - DNA, 21 bp, Homo sapiens
ttttattaagccaggaaacat

SEQ ID NO: 5964456 - DNA, 23 bp, Homo sapiens
ttttattaagccaggaaacatga

SEQ ID NO: 5964457 - DNA, 12 bp, Homo sapiens
ttttattaataa

SEQ ID NO: 5964458 - DNA, 22 bp, Homo sapiens
ttttattaataaacattctatc

SEQ ID NO: 5964459 - DNA, 14 bp, Homo sapiens
ttttattaatatat

SEQ ID NO: 5964460 - DNA, 18 bp, Homo sapiens
ttttattaatcactgtgt

SEQ ID NO: 5964461 - DNA, 13 bp, Homo sapiens
ttttattaatgca

SEQ ID NO: 5964462 - DNA, 13 bp, Homo sapiens
ttttattaattta

SEQ ID NO: 5964463 - DNA, 15 bp, Homo sapiens
ttttattagaataat

SEQ ID NO: 5964464 - DNA, 22 bp, Homo sapiens
ttttattagtattgttgtcctt

SEQ ID NO: 5964465 - DNA, 22 bp, Homo sapiens
ttttattataatcctcaagaga

SEQ ID NO: 5964466 - DNA, 21 bp, Homo sapiens
ttttattatgaaacttgtgta

SEQ ID NO: 5964467 - DNA, 14 bp, Homo sapiens
ttttattatgcata

SEQ ID NO: 5964468 - DNA, 13 bp, Homo sapiens
ttttattatgtaa

SEQ ID NO: 5964469 - DNA, 13 bp, Homo sapiens
ttttattatgtta

SEQ ID NO: 5964470 - DNA, 19 bp, Homo sapiens
ttttattattaatgctttg

SEQ ID NO: 5964471 - DNA, 15 bp, Homo sapiens
ttttattattgtggt

SEQ ID NO: 5964472 - DNA, 22 bp, Homo sapiens
ttttattattgtggtaggcctt

SEQ ID NO: 5964473 - DNA, 15 bp, Homo sapiens
ttttattatttctat

SEQ ID NO: 5964474 - DNA, 14 bp, Homo sapiens
ttttattattttct

SEQ ID NO: 5964475 - DNA, 21 bp, Homo sapiens
ttttattcagctcatggactt

SEQ ID NO: 5964476 - DNA, 15 bp, Homo sapiens
ttttattcctgtatg

SEQ ID NO: 5964477 - DNA, 18 bp, Homo sapiens
ttttattcctgtatgttg

SEQ ID NO: 5964478 - DNA, 16 bp, Homo sapiens
ttttattcctttgaat

SEQ ID NO: 5964479 - DNA, 19 bp, Homo sapiens
ttttattcggcatttaact

SEQ ID NO: 5964480 - DNA, 18 bp, Homo sapiens
ttttattctgttttcttg

SEQ ID NO: 5964481 - DNA, 16 bp, Homo sapiens
ttttattcttatttca

SEQ ID NO: 5964482 - DNA, 16 bp, Homo sapiens
ttttattgaaatgtat

SEQ ID NO: 5964483 - DNA, 23 bp, Homo sapiens
ttttattgaatactgtctgtatc

SEQ ID NO: 5964484 - DNA, 20 bp, Homo sapiens
ttttattgagtaatattaca

SEQ ID NO: 5964485 - DNA, 20 bp, Homo sapiens
ttttattgctagtatttgaa

SEQ ID NO: 5964486 - DNA, 14 bp, Homo sapiens
ttttattggggaat

SEQ ID NO: 5964487 - DNA, 16 bp, Homo sapiens
ttttattgtaacagac

SEQ ID NO: 5964488 - DNA, 11 bp, Homo sapiens
ttttattgtgt

SEQ ID NO: 5964489 - DNA, 12 bp, Homo sapiens
ttttattgtttt

SEQ ID NO: 5964490 - DNA, 13 bp, Homo sapiens
ttttatttaaaaa

SEQ ID NO: 5964491 - DNA, 13 bp, Homo sapiens
ttttatttagttc

SEQ ID NO: 5964492 - DNA, 17 bp, Homo sapiens
ttttatttataaactag

SEQ ID NO: 5964493 - DNA, 16 bp, Homo sapiens
ttttatttatagttaa

SEQ ID NO: 5964494 - DNA, 14 bp, Homo sapiens
ttttatttatcaaa

SEQ ID NO: 5964495 - DNA, 15 bp, Homo sapiens
ttttatttatgaagt

SEQ ID NO: 5964496 - DNA, 16 bp, Homo sapiens
ttttatttatgaagtt

SEQ ID NO: 5964497 - DNA, 14 bp, Homo sapiens
ttttatttcaatgt

SEQ ID NO: 5964498 - DNA, 23 bp, Homo sapiens
ttttatttcagattttgataact

SEQ ID NO: 5964499 - DNA, 16 bp, Homo sapiens
ttttatttcattcaca

SEQ ID NO: 5964500 - DNA, 22 bp, Homo sapiens
ttttatttcattggttaatttt

SEQ ID NO: 5964501 - DNA, 14 bp, Homo sapiens
ttttatttccatca

SEQ ID NO: 5964502 - DNA, 11 bp, Homo sapiens
ttttatttcct

SEQ ID NO: 5964503 - DNA, 14 bp, Homo sapiens
ttttatttctcctt

SEQ ID NO: 5964504 - DNA, 15 bp, Homo sapiens
ttttatttctgattt

SEQ ID NO: 5964505 - DNA, 15 bp, Homo sapiens
ttttatttgacaaaa

SEQ ID NO: 5964506 - DNA, 13 bp, Homo sapiens
ttttatttgtaaa

SEQ ID NO: 5964507 - DNA, 17 bp, Homo sapiens
ttttatttgtaaagtga

SEQ ID NO: 5964508 - DNA, 18 bp, Homo sapiens
ttttatttgtaaagtgat

SEQ ID NO: 5964509 - DNA, 12 bp, Homo sapiens
ttttatttgttt

SEQ ID NO: 5964510 - DNA, 14 bp, Homo sapiens
ttttattttaaatt

SEQ ID NO: 5964511 - DNA, 11 bp, Homo sapiens
ttttattttac

SEQ ID NO: 5964512 - DNA, 16 bp, Homo sapiens
ttttattttactttta

SEQ ID NO: 5964513 - DNA, 13 bp, Homo sapiens
ttttattttatgt

SEQ ID NO: 5964514 - DNA, 14 bp, Homo sapiens
ttttattttatgtt

SEQ ID NO: 5964515 - DNA, 13 bp, Homo sapiens
ttttattttcaaa

SEQ ID NO: 5964516 - DNA, 14 bp, Homo sapiens
ttttattttcaaga

SEQ ID NO: 5964517 - DNA, 14 bp, Homo sapiens
ttttattttctaaa

SEQ ID NO: 5964518 - DNA, 16 bp, Homo sapiens
ttttattttctaaagt

SEQ ID NO: 5964519 - DNA, 19 bp, Homo sapiens
ttttattttctaaattctt

SEQ ID NO: 5964520 - DNA, 14 bp, Homo sapiens
ttttattttgctga

SEQ ID NO: 5964521 - DNA, 20 bp, Homo sapiens
ttttattttgctgagttgtt

SEQ ID NO: 5964522 - DNA, 16 bp, Homo sapiens
ttttatttttaagaaa

SEQ ID NO: 5964523 - DNA, 21 bp, Homo sapiens
ttttatttttctcatgatgag

SEQ ID NO: 5964524 - DNA, 22 bp, Homo sapiens
ttttatttttggcaaagccaga

SEQ ID NO: 5964525 - DNA, 18 bp, Homo sapiens
ttttattttttccctcct

SEQ ID NO: 5964526 - DNA, 14 bp, Homo sapiens
ttttcaaaaaccag

SEQ ID NO: 5964527 - DNA, 18 bp, Homo sapiens
ttttcaaaaattgtgttt

SEQ ID NO: 5964528 - DNA, 22 bp, Homo sapiens
ttttcaaaaccaggtccaatga

SEQ ID NO: 5964529 - DNA, 17 bp, Homo sapiens
ttttcaaaataaaaatg

SEQ ID NO: 5964530 - DNA, 12 bp, Homo sapiens
ttttcttggttt

SEQ ID NO: 5964531 - DNA, 17 bp, Homo sapiens
ttttcttggtttctgga

SEQ ID NO: 5964532 - DNA, 18 bp, Homo sapiens
ttttcttggtttctggat

SEQ ID NO: 5964533 - DNA, 13 bp, Homo sapiens
ttttcttgtccaa

SEQ ID NO: 5964534 - DNA, 20 bp, Homo sapiens
ttttcttgtctataaagcat

SEQ ID NO: 5964535 - DNA, 17 bp, Homo sapiens
ttttcttgtctctgagg

SEQ ID NO: 5964536 - DNA, 14 bp, Homo sapiens
ttttcttgtgacag

SEQ ID NO: 5964537 - DNA, 18 bp, Homo sapiens
ttttcttgttgcatcttt

SEQ ID NO: 5964538 - DNA, 19 bp, Homo sapiens
ttttcttgtttatcagcag

SEQ ID NO: 5964539 - DNA, 15 bp, Homo sapiens
ttttctttaaaagaa

SEQ ID NO: 5964540 - DNA, 16 bp, Homo sapiens
ttttctttaatatgat

SEQ ID NO: 5964541 - DNA, 19 bp, Homo sapiens
ttttctttaatatgattct

SEQ ID NO: 5964542 - DNA, 20 bp, Homo sapiens
ttttctttacaaaacaaact

SEQ ID NO: 5964543 - DNA, 23 bp, Homo sapiens
ttttctttacccaaggattttta

SEQ ID NO: 5964544 - DNA, 17 bp, Homo sapiens
ttttctttagagaactg

SEQ ID NO: 5964545 - DNA, 18 bp, Homo sapiens
ttttctttagagaactga

SEQ ID NO: 5964546 - DNA, 21 bp, Homo sapiens
ttttctttagagaactgaaaa

SEQ ID NO: 5964547 - DNA, 19 bp, Homo sapiens
ttttctttaggacataaag

SEQ ID NO: 5964548 - DNA, 21 bp, Homo sapiens
ttttctttaggacataaagag

SEQ ID NO: 5964549 - DNA, 12 bp, Homo sapiens
ttttctttcagt

SEQ ID NO: 5964550 - DNA, 17 bp, Homo sapiens
ttttctttcctcctttc

SEQ ID NO: 5964551 - DNA, 16 bp, Homo sapiens
ttttctttccttaaaa

SEQ ID NO: 5964552 - DNA, 13 bp, Homo sapiens
ttttctttctatg

SEQ ID NO: 5964553 - DNA, 11 bp, Homo sapiens
ttttctttctc

SEQ ID NO: 5964554 - DNA, 14 bp, Homo sapiens
ttttctttgaaatg

SEQ ID NO: 5964555 - DNA, 17 bp, Homo sapiens
ttttctttgaatgcttt

SEQ ID NO: 5964556 - DNA, 15 bp, Homo sapiens
ttttctttgcaaagt

SEQ ID NO: 5964557 - DNA, 17 bp, Homo sapiens
ttttctttgctgtgcca

SEQ ID NO: 5964558 - DNA, 15 bp, Homo sapiens
ttttctttggctgca

SEQ ID NO: 5964559 - DNA, 18 bp, Homo sapiens
ttttctttgtaaaggtca

SEQ ID NO: 5964560 - DNA, 15 bp, Homo sapiens
ttttctttgtatcat

SEQ ID NO: 5964561 - DNA, 20 bp, Homo sapiens
ttttctttgtatcattcatc

SEQ ID NO: 5964562 - DNA, 16 bp, Homo sapiens
ttttctttgtgtagct

SEQ ID NO: 5964563 - DNA, 22 bp, Homo sapiens
ttttctttgttaaaaccaaact

SEQ ID NO: 5964564 - DNA, 20 bp, Homo sapiens
ttttcttttaagccctgctc

SEQ ID NO: 5964565 - DNA, 13 bp, Homo sapiens
ttttcttttctat

SEQ ID NO: 5964566 - DNA, 22 bp, Homo sapiens
ttttcttttgcttcctcttctt

SEQ ID NO: 5964567 - DNA, 15 bp, Homo sapiens
ttttcttttgctttc

SEQ ID NO: 5964568 - DNA, 22 bp, Homo sapiens
ttttcttttgctttcctttcct

SEQ ID NO: 5964569 - DNA, 17 bp, Homo sapiens
ttttcttttgttactgt

SEQ ID NO: 5964570 - DNA, 17 bp, Homo sapiens
ttttctttttactgttg

SEQ ID NO: 5964571 - DNA, 15 bp, Homo sapiens
ttttctttttccagt

SEQ ID NO: 5964572 - DNA, 13 bp, Homo sapiens
ttttctttttctg

SEQ ID NO: 5964573 - DNA, 15 bp, Homo sapiens
ttttcttttttatta

SEQ ID NO: 5964574 - DNA, 22 bp, Homo sapiens
ttttcttttttttaatgtttct

SEQ ID NO: 5964575 - DNA, 14 bp, Homo sapiens
ttttgaaaaaagct

SEQ ID NO: 5964576 - DNA, 23 bp, Homo sapiens
ttttgaaaaaagctcatttcatg

SEQ ID NO: 5964577 - DNA, 15 bp, Homo sapiens
ttttgaaaaagtgta

SEQ ID NO: 5964578 - DNA, 14 bp, Homo sapiens
ttttgaaaaatatt

SEQ ID NO: 5964579 - DNA, 21 bp, Homo sapiens
ttttgaaaaatattgctaaaa

SEQ ID NO: 5964580 - DNA, 13 bp, Homo sapiens
ttttgaaaaatta

SEQ ID NO: 5964581 - DNA, 18 bp, Homo sapiens
ttttgaaaaattcctatt

SEQ ID NO: 5964582 - DNA, 20 bp, Homo sapiens
ttttgaaaagcagacatttt

SEQ ID NO: 5964583 - DNA, 21 bp, Homo sapiens
ttttgaaaagcttcttaatta

SEQ ID NO: 5964584 - DNA, 14 bp, Homo sapiens
ttttgaaaagtatt

SEQ ID NO: 5964585 - DNA, 14 bp, Homo sapiens
ttttgaaaagttga

SEQ ID NO: 5964586 - DNA, 12 bp, Homo sapiens
ttttgaaaataa

SEQ ID NO: 5964587 - DNA, 16 bp, Homo sapiens
ttttgaaaatcctgaa

SEQ ID NO: 5964588 - DNA, 18 bp, Homo sapiens
ttttgaaaatgtttatgc

SEQ ID NO: 5964589 - DNA, 13 bp, Homo sapiens
ttttgaaacaaag

SEQ ID NO: 5964590 - DNA, 20 bp, Homo sapiens
ttttgaaacccacagtttta

SEQ ID NO: 5964591 - DNA, 15 bp, Homo sapiens
ttttgaaagaaaaat

SEQ ID NO: 5964592 - DNA, 21 bp, Homo sapiens
ttttgaaatgaaatttaaaca

SEQ ID NO: 5964593 - DNA, 22 bp, Homo sapiens
ttttgaaatgaaatttaaacat

SEQ ID NO: 5964594 - DNA, 20 bp, Homo sapiens
ttttgaaatgctgaaaattg

SEQ ID NO: 5964595 - DNA, 13 bp, Homo sapiens
ttttgaaatgggc

SEQ ID NO: 5964596 - DNA, 20 bp, Homo sapiens
ttttgaaattatgtgacatt

SEQ ID NO: 5964597 - DNA, 16 bp, Homo sapiens
ttttgaaatttaaaaa

SEQ ID NO: 5964598 - DNA, 20 bp, Homo sapiens
ttttgaaatttaaaaatctt

SEQ ID NO: 5964599 - DNA, 18 bp, Homo sapiens
ttttgaactaagaaactt

SEQ ID NO: 5964600 - DNA, 18 bp, Homo sapiens
ttttgaactcacgagcct

SEQ ID NO: 5964601 - DNA, 18 bp, Homo sapiens
ttttgaactttgtaggac

SEQ ID NO: 5964602 - DNA, 20 bp, Homo sapiens
ttttgaactttttatttgag

SEQ ID NO: 5964603 - DNA, 14 bp, Homo sapiens
ttttgaagaacaaa

SEQ ID NO: 5964604 - DNA, 16 bp, Homo sapiens
ttttgaagaacaaaag

SEQ ID NO: 5964605 - DNA, 19 bp, Homo sapiens
ttttgaagaatatttaaga

SEQ ID NO: 5964606 - DNA, 21 bp, Homo sapiens
ttttgaagcagtcttgctctg

SEQ ID NO: 5964607 - DNA, 20 bp, Homo sapiens
ttttgaagcctgctaaatga

SEQ ID NO: 5964608 - DNA, 21 bp, Homo sapiens
ttttgaagggagaagacactg

SEQ ID NO: 5964609 - DNA, 19 bp, Homo sapiens
ttttgaagtgagaaaatga

SEQ ID NO: 5964610 - DNA, 22 bp, Homo sapiens
ttttgaagtgtaggcagacaca

SEQ ID NO: 5964611 - DNA, 22 bp, Homo sapiens
ttttgaataaaaaacatttgta

SEQ ID NO: 5964612 - DNA, 16 bp, Homo sapiens
ttttgaatccatgctt

SEQ ID NO: 5964613 - DNA, 16 bp, Homo sapiens
ttttgaatctttaatt

SEQ ID NO: 5964614 - DNA, 17 bp, Homo sapiens
ttttgaatgtcacaaat

SEQ ID NO: 5964615 - DNA, 15 bp, Homo sapiens
ttttgaatgtggata

SEQ ID NO: 5964616 - DNA, 13 bp, Homo sapiens
ttttgaatgttat

SEQ ID NO: 5964617 - DNA, 19 bp, Homo sapiens
ttttgaattaatctagaaa

SEQ ID NO: 5964618 - DNA, 13 bp, Homo sapiens
ttttgaattgtgt

SEQ ID NO: 5964619 - DNA, 16 bp, Homo sapiens
ttttgaattgttacat

SEQ ID NO: 5964620 - DNA, 16 bp, Homo sapiens
ttttgaatttaaataa

SEQ ID NO: 5964621 - DNA, 19 bp, Homo sapiens
ttttgaatttaaataaagt

SEQ ID NO: 5964622 - DNA, 23 bp, Homo sapiens
ttttgacaatcaaagaaaagact

SEQ ID NO: 5964623 - DNA, 12 bp, Homo sapiens
ttttgacacagt

SEQ ID NO: 5964624 - DNA, 18 bp, Homo sapiens
ttttgacacctagattat

SEQ ID NO: 5964625 - DNA, 16 bp, Homo sapiens
ttttgacactgaaata

SEQ ID NO: 5964626 - DNA, 22 bp, Homo sapiens
ttttgacacttccattgtttaa

SEQ ID NO: 5964627 - DNA, 11 bp, Homo sapiens
ttttgacagaa

SEQ ID NO: 5964628 - DNA, 20 bp, Homo sapiens
ttttgacagccttcttgatg

SEQ ID NO: 5964629 - DNA, 15 bp, Homo sapiens
ttttgacaggtgcct

SEQ ID NO: 5964630 - DNA, 13 bp, Homo sapiens
ttttgacataaga

SEQ ID NO: 5964631 - DNA, 19 bp, Homo sapiens
ttttgacataatgagtaat

SEQ ID NO: 5964632 - DNA, 19 bp, Homo sapiens
ttttgacggccttcttggt

SEQ ID NO: 5964633 - DNA, 22 bp, Homo sapiens
ttttgactagggattcaggctg

SEQ ID NO: 5964634 - DNA, 13 bp, Homo sapiens
ttttgactgcttg

SEQ ID NO: 5964635 - DNA, 15 bp, Homo sapiens
ttttgacttgaataa

SEQ ID NO: 5964636 - DNA, 16 bp, Homo sapiens
ttttgacttgaataaa

SEQ ID NO: 5964637 - DNA, 17 bp, Homo sapiens
ttttgacttgccactgc

SEQ ID NO: 5964638 - DNA, 13 bp, Homo sapiens
ttttgagaaactg

SEQ ID NO: 5964639 - DNA, 11 bp, Homo sapiens
ttttgagaaag

SEQ ID NO: 5964640 - DNA, 21 bp, Homo sapiens
ttttgagacagggtctcacta

SEQ ID NO: 5964641 - DNA, 15 bp, Homo sapiens
ttttgagacagtctt

SEQ ID NO: 5964642 - DNA, 12 bp, Homo sapiens
ttttgagatatt

SEQ ID NO: 5964643 - DNA, 22 bp, Homo sapiens
ttttgagattttttttccgtgt

SEQ ID NO: 5964644 - DNA, 13 bp, Homo sapiens
ttttgagcacttt

SEQ ID NO: 5964645 - DNA, 14 bp, Homo sapiens
ttttgagcatgggt

SEQ ID NO: 5964646 - DNA, 16 bp, Homo sapiens
ttttgagcccttgttt

SEQ ID NO: 5964647 - DNA, 16 bp, Homo sapiens
ttttgagccttattaa

SEQ ID NO: 5964648 - DNA, 21 bp, Homo sapiens
ttttgagctactggattctta

SEQ ID NO: 5964649 - DNA, 11 bp, Homo sapiens
ttttgagctat

SEQ ID NO: 5964650 - DNA, 17 bp, Homo sapiens
ttttgagctatttcctt

SEQ ID NO: 5964651 - DNA, 22 bp, Homo sapiens
ttttgagctcctaagctgccag

SEQ ID NO: 5964652 - DNA, 21 bp, Homo sapiens
ttttgagctgaaatgctgcat

SEQ ID NO: 5964653 - DNA, 22 bp, Homo sapiens
ttttgagctgaaatgctgcatt

SEQ ID NO: 5964654 - DNA, 15 bp, Homo sapiens
ttttgaggagcccca

SEQ ID NO: 5964655 - DNA, 15 bp, Homo sapiens
ttttgagtaattcaa

SEQ ID NO: 5964656 - DNA, 16 bp, Homo sapiens
ttttgagtagatatta

SEQ ID NO: 5964657 - DNA, 23 bp, Homo sapiens
ttttgagtagatattactttatc

SEQ ID NO: 5964658 - DNA, 13 bp, Homo sapiens
ttttgagtattcc

SEQ ID NO: 5964659 - DNA, 14 bp, Homo sapiens
ttttgagtctcagg

SEQ ID NO: 5964660 - DNA, 18 bp, Homo sapiens
ttttgagtgtatgctgta

SEQ ID NO: 5964661 - DNA, 18 bp, Homo sapiens
ttttgagtgtgtgtgtgc

SEQ ID NO: 5964662 - DNA, 21 bp, Homo sapiens
ttttgagtttcagctggaaac

SEQ ID NO: 5964663 - DNA, 14 bp, Homo sapiens
ttttgagtttgcct

SEQ ID NO: 5964664 - DNA, 20 bp, Homo sapiens
ttttgataaagtaattcata

SEQ ID NO: 5964665 - DNA, 18 bp, Homo sapiens
ttttgataaagtagtaaa

SEQ ID NO: 5964666 - DNA, 14 bp, Homo sapiens
ttttgataactgtt

SEQ ID NO: 5964667 - DNA, 18 bp, Homo sapiens
ttttgatactaagcattg

SEQ ID NO: 5964668 - DNA, 22 bp, Homo sapiens
ttttgatagcaatgttccagga

SEQ ID NO: 5964669 - DNA, 20 bp, Homo sapiens
ttttgatagctgtcccatct

SEQ ID NO: 5964670 - DNA, 15 bp, Homo sapiens
ttttgatagctttat

SEQ ID NO: 5964671 - DNA, 18 bp, Homo sapiens
ttttgatataattgtact

SEQ ID NO: 5964672 - DNA, 21 bp, Homo sapiens
ttttgatataattgtactgtg

SEQ ID NO: 5964673 - DNA, 16 bp, Homo sapiens
ttttgatatacattgt

SEQ ID NO: 5964674 - DNA, 19 bp, Homo sapiens
ttttgatatgcatatttgt

SEQ ID NO: 5964675 - DNA, 22 bp, Homo sapiens
ttttgatatttatttcctgcta

SEQ ID NO: 5964676 - DNA, 15 bp, Homo sapiens
ttttgatcaaatgta

SEQ ID NO: 5964677 - DNA, 21 bp, Homo sapiens
ttttgatcaaatgtacatctc

SEQ ID NO: 5964678 - DNA, 15 bp, Homo sapiens
ttttgatcagtgtta

SEQ ID NO: 5964679 - DNA, 17 bp, Homo sapiens
ttttgatcatccctttc

SEQ ID NO: 5964680 - DNA, 14 bp, Homo sapiens
ttttgatctctgct

SEQ ID NO: 5964681 - DNA, 17 bp, Homo sapiens
ttttgatctctgttctt

SEQ ID NO: 5964682 - DNA, 14 bp, Homo sapiens
ttttgatctgcttt

SEQ ID NO: 5964683 - DNA, 20 bp, Homo sapiens
ttttgatctgcttttcagaa

SEQ ID NO: 5964684 - DNA, 20 bp, Homo sapiens
ttttgatgactggcatttta

SEQ ID NO: 5964685 - DNA, 18 bp, Homo sapiens
ttttgatgccatttgtct

SEQ ID NO: 5964686 - DNA, 11 bp, Homo sapiens
ttttgatggaa

SEQ ID NO: 5964687 - DNA, 14 bp, Homo sapiens
ttttgatggctatg

SEQ ID NO: 5964688 - DNA, 14 bp, Homo sapiens
ttttgatggggaga

SEQ ID NO: 5964689 - DNA, 23 bp, Homo sapiens
ttttgatggtactgatgagtctt

SEQ ID NO: 5964690 - DNA, 23 bp, Homo sapiens
ttttgatgtattattatatatgt

SEQ ID NO: 5964691 - DNA, 12 bp, Homo sapiens
ttttgatgtgaa

SEQ ID NO: 5964692 - DNA, 13 bp, Homo sapiens
ttttgatgtgaaa

SEQ ID NO: 5964693 - DNA, 22 bp, Homo sapiens
ttttgatgtgcgtgctgtctgt

SEQ ID NO: 5964694 - DNA, 20 bp, Homo sapiens
ttttgattaatgaagaaagt

SEQ ID NO: 5964695 - DNA, 12 bp, Homo sapiens
ttttgattatgt

SEQ ID NO: 5964696 - DNA, 15 bp, Homo sapiens
ttttgattattgtat

SEQ ID NO: 5964697 - DNA, 20 bp, Homo sapiens
ttttgattcagctcattatg

SEQ ID NO: 5964698 - DNA, 17 bp, Homo sapiens
ttttgattgtttgatga

SEQ ID NO: 5964699 - DNA, 18 bp, Homo sapiens
ttttgatttatatgtgta

SEQ ID NO: 5964700 - DNA, 22 bp, Homo sapiens
ttttgatttgaatgtaaaacag

SEQ ID NO: 5964701 - DNA, 21 bp, Homo sapiens
ttttgatttgtactgaaaaat

SEQ ID NO: 5964702 - DNA, 21 bp, Homo sapiens
ttttgattttgtttactgaaa

SEQ ID NO: 5964703 - DNA, 18 bp, Homo sapiens
ttttgatttttaaatcat

SEQ ID NO: 5964704 - DNA, 22 bp, Homo sapiens
ttttgatttttaaatcattcat

SEQ ID NO: 5964705 - DNA, 19 bp, Homo sapiens
ttttgcaaagatttaatct

SEQ ID NO: 5964706 - DNA, 12 bp, Homo sapiens
ttttgcaaaggg

SEQ ID NO: 5964707 - DNA, 20 bp, Homo sapiens
ttttgcaaatataaacatct

SEQ ID NO: 5964708 - DNA, 20 bp, Homo sapiens
tttttaatgaccaattgagt

SEQ ID NO: 5964709 - DNA, 15 bp, Homo sapiens
tttttaatgactttt

SEQ ID NO: 5964710 - DNA, 13 bp, Homo sapiens
tttttaatgatat

SEQ ID NO: 5964711 - DNA, 20 bp, Homo sapiens
tttttaatgctaatcttgtg

SEQ ID NO: 5964712 - DNA, 12 bp, Homo sapiens
tttttaatgctt

SEQ ID NO: 5964713 - DNA, 13 bp, Homo sapiens
tttttaatggaaa

SEQ ID NO: 5964714 - DNA, 18 bp, Homo sapiens
tttttaatggaaagtttg

SEQ ID NO: 5964715 - DNA, 18 bp, Homo sapiens
tttttaatgtatagtaaa

SEQ ID NO: 5964716 - DNA, 23 bp, Homo sapiens
tttttaatgtgagacagcaagtt

SEQ ID NO: 5964717 - DNA, 12 bp, Homo sapiens
tttttaatgtgc

SEQ ID NO: 5964718 - DNA, 15 bp, Homo sapiens
tttttaatgtgctct

SEQ ID NO: 5964719 - DNA, 20 bp, Homo sapiens
tttttaatgtgctgtgtaaa

SEQ ID NO: 5964720 - DNA, 13 bp, Homo sapiens
tttttaatgttat

SEQ ID NO: 5964721 - DNA, 13 bp, Homo sapiens
tttttaatgtttt

SEQ ID NO: 5964722 - DNA, 13 bp, Homo sapiens
tttttaattaaaa

SEQ ID NO: 5964723 - DNA, 17 bp, Homo sapiens
tttttaattaaaaactt

SEQ ID NO: 5964724 - DNA, 21 bp, Homo sapiens
tttttaattgaggacagcctg

SEQ ID NO: 5964725 - DNA, 11 bp, Homo sapiens
tttttaattta

SEQ ID NO: 5964726 - DNA, 14 bp, Homo sapiens
tttttaatttaaca

SEQ ID NO: 5964727 - DNA, 19 bp, Homo sapiens
tttttaatttaacaaacta

SEQ ID NO: 5964728 - DNA, 21 bp, Homo sapiens
tttttaatttaacaaactaaa

SEQ ID NO: 5964729 - DNA, 23 bp, Homo sapiens
tttttaatttacaaaaatataaa

SEQ ID NO: 5964730 - DNA, 21 bp, Homo sapiens
tttttaatttattattgaaat

SEQ ID NO: 5964731 - DNA, 16 bp, Homo sapiens
tttttaatttatttat

SEQ ID NO: 5964732 - DNA, 22 bp, Homo sapiens
tttttacaaatgttaaaatgtg

SEQ ID NO: 5964733 - DNA, 23 bp, Homo sapiens
tttttacaaatgttaaaatgtgt

SEQ ID NO: 5964734 - DNA, 14 bp, Homo sapiens
tttttacaagatgt

SEQ ID NO: 5964735 - DNA, 19 bp, Homo sapiens
tttttacaagttttaaata

SEQ ID NO: 5964736 - DNA, 17 bp, Homo sapiens
tttttacagcaaaagat

SEQ ID NO: 5964737 - DNA, 16 bp, Homo sapiens
tttttacatccttgat

SEQ ID NO: 5964738 - DNA, 16 bp, Homo sapiens
tttttacattacagaa

SEQ ID NO: 5964739 - DNA, 20 bp, Homo sapiens
tttttacattatgcaaataa

SEQ ID NO: 5964740 - DNA, 13 bp, Homo sapiens
tttttacatttca

SEQ ID NO: 5964741 - DNA, 21 bp, Homo sapiens
tttttaccaactctatactca

SEQ ID NO: 5964742 - DNA, 16 bp, Homo sapiens
tttttacccaaatatg

SEQ ID NO: 5964743 - DNA, 21 bp, Homo sapiens
tttttaccggttgattgaaat

SEQ ID NO: 5964744 - DNA, 11 bp, Homo sapiens
tttttactaat

SEQ ID NO: 5964745 - DNA, 19 bp, Homo sapiens
tttttactaatatatattt

SEQ ID NO: 5964746 - DNA, 16 bp, Homo sapiens
tttttactattaacat

SEQ ID NO: 5964747 - DNA, 14 bp, Homo sapiens
tttttactcaacca

SEQ ID NO: 5964748 - DNA, 18 bp, Homo sapiens
tttttactcattgaaatg

SEQ ID NO: 5964749 - DNA, 20 bp, Homo sapiens
tttttactggggattcttga

SEQ ID NO: 5964750 - DNA, 22 bp, Homo sapiens
tttttacttaacaaccaacttg

SEQ ID NO: 5964751 - DNA, 22 bp, Homo sapiens
tttttacttttcacactgtctt

SEQ ID NO: 5964752 - DNA, 17 bp, Homo sapiens
tttttagaaatgtgaag

SEQ ID NO: 5964753 - DNA, 14 bp, Homo sapiens
tttttagaacagaa

SEQ ID NO: 5964754 - DNA, 12 bp, Homo sapiens
tttttagaacat

SEQ ID NO: 5964755 - DNA, 13 bp, Homo sapiens
tttttagaaggaa

SEQ ID NO: 5964756 - DNA, 21 bp, Homo sapiens
tttttagataataactgtctt

SEQ ID NO: 5964757 - DNA, 17 bp, Homo sapiens
tttttagatgtagcact

SEQ ID NO: 5964758 - DNA, 19 bp, Homo sapiens
tttttagattggttctgtt

SEQ ID NO: 5964759 - DNA, 18 bp, Homo sapiens
tttttagcttcatatcta

SEQ ID NO: 5964760 - DNA, 13 bp, Homo sapiens
tttttagctttgt

SEQ ID NO: 5964761 - DNA, 12 bp, Homo sapiens
tttttaggaaat

SEQ ID NO: 5964762 - DNA, 14 bp, Homo sapiens
tttttaggcaaaga

SEQ ID NO: 5964763 - DNA, 12 bp, Homo sapiens
tttttaggccac

SEQ ID NO: 5964764 - DNA, 16 bp, Homo sapiens
tttttagtaatctgta

SEQ ID NO: 5964765 - DNA, 20 bp, Homo sapiens
tttttagtaatctgtacatt

SEQ ID NO: 5964766 - DNA, 15 bp, Homo sapiens
tttttagttgaattt

SEQ ID NO: 5964767 - DNA, 12 bp, Homo sapiens
tttttagtttaa

SEQ ID NO: 5964768 - DNA, 19 bp, Homo sapiens
tttttataaactacaaaaa

SEQ ID NO: 5964769 - DNA, 15 bp, Homo sapiens
tttttataatagatt

SEQ ID NO: 5964770 - DNA, 13 bp, Homo sapiens
tttttataattgt

SEQ ID NO: 5964771 - DNA, 13 bp, Homo sapiens
tttttatacaaaa

SEQ ID NO: 5964772 - DNA, 13 bp, Homo sapiens
tttttatacacat

SEQ ID NO: 5964773 - DNA, 13 bp, Homo sapiens
tttttatacatat

SEQ ID NO: 5964774 - DNA, 18 bp, Homo sapiens
tttttatacatatcagaa

SEQ ID NO: 5964775 - DNA, 15 bp, Homo sapiens
tttttatacctgtac

SEQ ID NO: 5964776 - DNA, 15 bp, Homo sapiens
tttttatactcagaa

SEQ ID NO: 5964777 - DNA, 12 bp, Homo sapiens
tttttatactgc

SEQ ID NO: 5964778 - DNA, 14 bp, Homo sapiens
tttttatagaagtg

SEQ ID NO: 5964779 - DNA, 21 bp, Homo sapiens
tttttatataatatgaatata

SEQ ID NO: 5964780 - DNA, 12 bp, Homo sapiens
tttttatataca

SEQ ID NO: 5964781 - DNA, 13 bp, Homo sapiens
tttttatatatga

SEQ ID NO: 5964782 - DNA, 16 bp, Homo sapiens
tttttatatatgaata

SEQ ID NO: 5964783 - DNA, 14 bp, Homo sapiens
tttttatatttcaa

SEQ ID NO: 5964784 - DNA, 21 bp, Homo sapiens
tttttatatttcaagtacact

SEQ ID NO: 5964785 - DNA, 22 bp, Homo sapiens
tttttatatttcaagtacactg

SEQ ID NO: 5964786 - DNA, 22 bp, Homo sapiens
tttttatatttcctttatgtga

SEQ ID NO: 5964787 - DNA, 17 bp, Homo sapiens
tttttatatttgaaata

SEQ ID NO: 5964788 - DNA, 17 bp, Homo sapiens
tttttatcatgcatgtc

SEQ ID NO: 5964789 - DNA, 17 bp, Homo sapiens
tttttatcccatttagt

SEQ ID NO: 5964790 - DNA, 18 bp, Homo sapiens
tttttatcccgccaggga

SEQ ID NO: 5964791 - DNA, 16 bp, Homo sapiens
tttttatcgctaaatg

SEQ ID NO: 5964792 - DNA, 18 bp, Homo sapiens
tttttatctatataaaat

SEQ ID NO: 5964793 - DNA, 11 bp, Homo sapiens
tttttatcttt

SEQ ID NO: 5964794 - DNA, 12 bp, Homo sapiens
tttttatgatat

SEQ ID NO: 5964795 - DNA, 23 bp, Homo sapiens
tttttatgcctttctctcctagt

SEQ ID NO: 5964796 - DNA, 12 bp, Homo sapiens
tttttatggctt

SEQ ID NO: 5964797 - DNA, 10 bp, Homo sapiens
tttttatgta

SEQ ID NO: 5964798 - DNA, 12 bp, Homo sapiens
tttttatgtgat

SEQ ID NO: 5964799 - DNA, 12 bp, Homo sapiens
tttttatgtgta

SEQ ID NO: 5964800 - DNA, 12 bp, Homo sapiens
tttttatgtgtt

SEQ ID NO: 5964801 - DNA, 19 bp, Homo sapiens
tttttattaatcactgtgt

SEQ ID NO: 5964802 - DNA, 13 bp, Homo sapiens
tttttattatgca

SEQ ID NO: 5964803 - DNA, 14 bp, Homo sapiens
tttttattatgcat

SEQ ID NO: 5964804 - DNA, 15 bp, Homo sapiens
tttttattcagcaga

SEQ ID NO: 5964805 - DNA, 23 bp, Homo sapiens
tttttattgaatctatttaagta

SEQ ID NO: 5964806 - DNA, 15 bp, Homo sapiens
tttttattgatgtgc

SEQ ID NO: 5964807 - DNA, 18 bp, Homo sapiens
tttttattgatgtgcaaa

SEQ ID NO: 5964808 - DNA, 24 bp, Homo sapiens
tttttattgcatggtgtgaactaa

SEQ ID NO: 5964809 - DNA, 21 bp, Homo sapiens
tttttatttaattaaatgtat

SEQ ID NO: 5964810 - DNA, 18 bp, Homo sapiens
tttttatttatatgtact

SEQ ID NO: 5964811 - DNA, 14 bp, Homo sapiens
tttttatttatgaa

SEQ ID NO: 5964812 - DNA, 12 bp, Homo sapiens
tttttatttcta

SEQ ID NO: 5964813 - DNA, 18 bp, Homo sapiens
tttttatttctaaatgag

SEQ ID NO: 5964814 - DNA, 14 bp, Homo sapiens
tttttatttctaag

SEQ ID NO: 5964815 - DNA, 22 bp, Homo sapiens
tttttatttctgtcagttatga

SEQ ID NO: 5964816 - DNA, 12 bp, Homo sapiens
tttttatttctt

SEQ ID NO: 5964817 - DNA, 14 bp, Homo sapiens
tttttatttgtaaa

SEQ ID NO: 5964818 - DNA, 16 bp, Homo sapiens
tttttatttttggcaa

SEQ ID NO: 5964819 - DNA, 19 bp, Homo sapiens
tttttatttttggcaaagc

SEQ ID NO: 5964820 - DNA, 21 bp, Homo sapiens
tttttcaaaacgccatgtcct

SEQ ID NO: 5964821 - DNA, 11 bp, Homo sapiens
tttttcaaaat

SEQ ID NO: 5964822 - DNA, 15 bp, Homo sapiens
tttttcaaaatagaa

SEQ ID NO: 5964823 - DNA, 16 bp, Homo sapiens
tttttcaaaatcaaag

SEQ ID NO: 5964824 - DNA, 13 bp, Homo sapiens
tttttcaaatatt

SEQ ID NO: 5964825 - DNA, 18 bp, Homo sapiens
tttttcaagaaaattttg

SEQ ID NO: 5964826 - DNA, 12 bp, Homo sapiens
tttttcaatata

SEQ ID NO: 5964827 - DNA, 20 bp, Homo sapiens
tttttcaatcaactttactg

SEQ ID NO: 5964828 - DNA, 22 bp, Homo sapiens
tttttcacaatgtgaaactgaa

SEQ ID NO: 5964829 - DNA, 13 bp, Homo sapiens
tttttcacatttt

SEQ ID NO: 5964830 - DNA, 19 bp, Homo sapiens
tttttcacctccatgtcat

SEQ ID NO: 5964831 - DNA, 19 bp, Homo sapiens
tttttcacggaagttttca

SEQ ID NO: 5964832 - DNA, 22 bp, Homo sapiens
tttttcacggaagttttcaatg

SEQ ID NO: 5964833 - DNA, 22 bp, Homo sapiens
tttttcacttctacctacatat

SEQ ID NO: 5964834 - DNA, 15 bp, Homo sapiens
tttttcactttgaaa

SEQ ID NO: 5964835 - DNA, 16 bp, Homo sapiens
tttttcagaaagtttg

SEQ ID NO: 5964836 - DNA, 14 bp, Homo sapiens
tttttcagaaatat

SEQ ID NO: 5964837 - DNA, 17 bp, Homo sapiens
tttttcagagttttcta

SEQ ID NO: 5964838 - DNA, 21 bp, Homo sapiens
tttttcagatataaatactga

SEQ ID NO: 5964839 - DNA, 23 bp, Homo sapiens
tttttcagcacatgttaccatgt

SEQ ID NO: 5964840 - DNA, 17 bp, Homo sapiens
tttttcaggaccttagt

SEQ ID NO: 5964841 - DNA, 20 bp, Homo sapiens
tttttcaggagcgcaagata

SEQ ID NO: 5964842 - DNA, 17 bp, Homo sapiens
tttttcagtattatatg

SEQ ID NO: 5964843 - DNA, 21 bp, Homo sapiens
tttttcagtgatcttcactgt

SEQ ID NO: 5964844 - DNA, 22 bp, Homo sapiens
tttttcagtgatcttcactgta

SEQ ID NO: 5964845 - DNA, 16 bp, Homo sapiens
tttttcagttcaaagt

SEQ ID NO: 5964846 - DNA, 21 bp, Homo sapiens
tttttcagttcatatgcagaa

SEQ ID NO: 5964847 - DNA, 21 bp, Homo sapiens
tttttcagttccaagaaagat

SEQ ID NO: 5964848 - DNA, 11 bp, Homo sapiens
tttttcagttg

SEQ ID NO: 5964849 - DNA, 16 bp, Homo sapiens
tttttcagttgttctt

SEQ ID NO: 5964850 - DNA, 18 bp, Homo sapiens
tttttcataaacaagttc

SEQ ID NO: 5964851 - DNA, 21 bp, Homo sapiens
tttttcatactcttaagtgta

SEQ ID NO: 5964852 - DNA, 15 bp, Homo sapiens
tttttcatactgtac

SEQ ID NO: 5964853 - DNA, 19 bp, Homo sapiens
tttttcatactgtacacat

SEQ ID NO: 5964854 - DNA, 20 bp, Homo sapiens
tttttcatatgtggaaatat

SEQ ID NO: 5964855 - DNA, 13 bp, Homo sapiens
tttttcatattgt

SEQ ID NO: 5964856 - DNA, 19 bp, Homo sapiens
tttttcatattttctaaag

SEQ ID NO: 5964857 - DNA, 14 bp, Homo sapiens
tttttcatcattgt

SEQ ID NO: 5964858 - DNA, 23 bp, Homo sapiens
tttttcatcattgttgtgtataa

SEQ ID NO: 5964859 - DNA, 19 bp, Homo sapiens
tttttcatccttctttcct

SEQ ID NO: 5964860 - DNA, 24 bp, Homo sapiens
tttttcatccttctttccttgttc

SEQ ID NO: 5964861 - DNA, 14 bp, Homo sapiens
tttttcatctgaaa

SEQ ID NO: 5964862 - DNA, 15 bp, Homo sapiens
tttttcatcttcagt

SEQ ID NO: 5964863 - DNA, 16 bp, Homo sapiens
tttttcatcttcagtt

SEQ ID NO: 5964864 - DNA, 22 bp, Homo sapiens
tttttcatgacataataaagta

SEQ ID NO: 5964865 - DNA, 10 bp, Homo sapiens
tttttcatgt

SEQ ID NO: 5964866 - DNA, 16 bp, Homo sapiens
tttttcatgtaagttt

SEQ ID NO: 5964867 - DNA, 18 bp, Homo sapiens
tttttcatgttttaacaa

SEQ ID NO: 5964868 - DNA, 22 bp, Homo sapiens
tttttcattaaataaatttgac

SEQ ID NO: 5964869 - DNA, 15 bp, Homo sapiens
tttttcattattgtg

SEQ ID NO: 5964870 - DNA, 14 bp, Homo sapiens
tttttcattgtgtt

SEQ ID NO: 5964871 - DNA, 22 bp, Homo sapiens
tttttcatttattgtttatgta

SEQ ID NO: 5964872 - DNA, 13 bp, Homo sapiens
tttttcatttgtt

SEQ ID NO: 5964873 - DNA, 11 bp, Homo sapiens
tttttcatttt

SEQ ID NO: 5964874 - DNA, 14 bp, Homo sapiens
tttttcattttcca

SEQ ID NO: 5964875 - DNA, 16 bp, Homo sapiens
tttttcattttccaat

SEQ ID NO: 5964876 - DNA, 15 bp, Homo sapiens
tttttcattttctct

SEQ ID NO: 5964877 - DNA, 16 bp, Homo sapiens
tttttccaaaaaaata

SEQ ID NO: 5964878 - DNA, 15 bp, Homo sapiens
tttttccaaaacttg

SEQ ID NO: 5964879 - DNA, 11 bp, Homo sapiens
tttttccaaat

SEQ ID NO: 5964880 - DNA, 21 bp, Homo sapiens
tttttccaactactaatagaa

SEQ ID NO: 5964881 - DNA, 23 bp, Homo sapiens
tttttccaactactaatagaata

SEQ ID NO: 5964882 - DNA, 14 bp, Homo sapiens
tttttccactttgt

SEQ ID NO: 5964883 - DNA, 13 bp, Homo sapiens
tttttccagttca

SEQ ID NO: 5964884 - DNA, 13 bp, Homo sapiens
tttttccatctgt

SEQ ID NO: 5964885 - DNA, 22 bp, Homo sapiens
tttttcccagccctttccaggg

SEQ ID NO: 5964886 - DNA, 13 bp, Homo sapiens
tttttcccatgag

SEQ ID NO: 5964887 - DNA, 15 bp, Homo sapiens
tttttcccatttaga

SEQ ID NO: 5964888 - DNA, 16 bp, Homo sapiens
tttttcccatttagaa

SEQ ID NO: 5964889 - DNA, 17 bp, Homo sapiens
aacattagatgtcatga

SEQ ID NO: 5964890 - DNA, 22 bp, Homo sapiens
aacattagatgtcatgaggaaa

SEQ ID NO: 5964891 - DNA, 16 bp, Homo sapiens
aacattaggaattgtt

SEQ ID NO: 5964892 - DNA, 21 bp, Homo sapiens
aacattaggcaggttgcttaa

SEQ ID NO: 5964893 - DNA, 15 bp, Homo sapiens
aacattagtacttta

SEQ ID NO: 5964894 - DNA, 15 bp, Homo sapiens
aacattagttgcact

SEQ ID NO: 5964895 - DNA, 22 bp, Homo sapiens
aacattagttgcactaactgct

SEQ ID NO: 5964896 - DNA, 14 bp, Homo sapiens
aacattataaatga

SEQ ID NO: 5964897 - DNA, 16 bp, Homo sapiens
aacattatataacaaa

SEQ ID NO: 5964898 - DNA, 15 bp, Homo sapiens
aacattatattgcaa

SEQ ID NO: 5964899 - DNA, 12 bp, Homo sapiens
aacattatcaca

SEQ ID NO: 5964900 - DNA, 16 bp, Homo sapiens
aacattatttattcag

SEQ ID NO: 5964901 - DNA, 16 bp, Homo sapiens
aacattattttaaaat

SEQ ID NO: 5964902 - DNA, 21 bp, Homo sapiens
aacattattttaaaatcaaag

SEQ ID NO: 5964903 - DNA, 15 bp, Homo sapiens
aacattattttttat

SEQ ID NO: 5964904 - DNA, 11 bp, Homo sapiens
aacattcacac

SEQ ID NO: 5964905 - DNA, 14 bp, Homo sapiens
aacattcacagccc

SEQ ID NO: 5964906 - DNA, 14 bp, Homo sapiens
aacattcacttttg

SEQ ID NO: 5964907 - DNA, 18 bp, Homo sapiens
aacattcagatttaccat

SEQ ID NO: 5964908 - DNA, 15 bp, Homo sapiens
aacattcagctctgg

SEQ ID NO: 5964909 - DNA, 16 bp, Homo sapiens
aacattcagctctgga

SEQ ID NO: 5964910 - DNA, 17 bp, Homo sapiens
aacattcagctctggag

SEQ ID NO: 5964911 - DNA, 15 bp, Homo sapiens
aacattcatgtaact

SEQ ID NO: 5964912 - DNA, 21 bp, Homo sapiens
aacattcatgtaactctccag

SEQ ID NO: 5964913 - DNA, 11 bp, Homo sapiens
aacattccaag

SEQ ID NO: 5964914 - DNA, 12 bp, Homo sapiens
aacattccaaga

SEQ ID NO: 5964915 - DNA, 20 bp, Homo sapiens
aacattccaaggagttggaa

SEQ ID NO: 5964916 - DNA, 15 bp, Homo sapiens
aacattccagggatg

SEQ ID NO: 5964917 - DNA, 21 bp, Homo sapiens
aacattccagggatgagccaa

SEQ ID NO: 5964918 - DNA, 17 bp, Homo sapiens
aacattcccagcccagc

SEQ ID NO: 5964919 - DNA, 23 bp, Homo sapiens
aacattcccctccccactcctct

SEQ ID NO: 5964920 - DNA, 17 bp, Homo sapiens
aacattcctaaaatgct

SEQ ID NO: 5964921 - DNA, 20 bp, Homo sapiens
aacattcctccagcctcccc

SEQ ID NO: 5964922 - DNA, 21 bp, Homo sapiens
aacattcgatctcattcagta

SEQ ID NO: 5964923 - DNA, 16 bp, Homo sapiens
aacattcgttctctaa

SEQ ID NO: 5964924 - DNA, 15 bp, Homo sapiens
aacattctatttcaa

SEQ ID NO: 5964925 - DNA, 18 bp, Homo sapiens
aacattctcctgtggaag

SEQ ID NO: 5964926 - DNA, 17 bp, Homo sapiens
aacattctgatttggaa

SEQ ID NO: 5964927 - DNA, 18 bp, Homo sapiens
aacattctgatttggaaa

SEQ ID NO: 5964928 - DNA, 14 bp, Homo sapiens
aacattctgccctc

SEQ ID NO: 5964929 - DNA, 14 bp, Homo sapiens
aacattctttttct

SEQ ID NO: 5964930 - DNA, 16 bp, Homo sapiens
aacattgaatatcagt

SEQ ID NO: 5964931 - DNA, 23 bp, Homo sapiens
aacattgaccaagaactgcatgg

SEQ ID NO: 5964932 - DNA, 13 bp, Homo sapiens
aacattgagactg

SEQ ID NO: 5964933 - DNA, 16 bp, Homo sapiens
aacattgagactgcta

SEQ ID NO: 5964934 - DNA, 17 bp, Homo sapiens
aacattgagactgctag

SEQ ID NO: 5964935 - DNA, 14 bp, Homo sapiens
aacattgatctgtt

SEQ ID NO: 5964936 - DNA, 23 bp, Homo sapiens
aacattgatctgttttacaggaa

SEQ ID NO: 5964937 - DNA, 16 bp, Homo sapiens
aacattgattggataa

SEQ ID NO: 5964938 - DNA, 15 bp, Homo sapiens
aacattgcaatagaa

SEQ ID NO: 5964939 - DNA, 22 bp, Homo sapiens
aacattgcactttataaacact

SEQ ID NO: 5964940 - DNA, 13 bp, Homo sapiens
aacattgcatgta

SEQ ID NO: 5964941 - DNA, 20 bp, Homo sapiens
aacattgcatgtatttaaga

SEQ ID NO: 5964942 - DNA, 22 bp, Homo sapiens
aacattgcatgtatttaagaaa

SEQ ID NO: 5964943 - DNA, 16 bp, Homo sapiens
aacattgcctatttca

SEQ ID NO: 5964944 - DNA, 15 bp, Homo sapiens
aacattgctgatttt

SEQ ID NO: 5964945 - DNA, 13 bp, Homo sapiens
aacattgctttgt

SEQ ID NO: 5964946 - DNA, 24 bp, Homo sapiens
aacattggaagcaggttaaatgtt

SEQ ID NO: 5964947 - DNA, 12 bp, Homo sapiens
aacattggacag

SEQ ID NO: 5964948 - DNA, 21 bp, Homo sapiens
aacattggacagaaaatgcaa

SEQ ID NO: 5964949 - DNA, 16 bp, Homo sapiens
aacattggattatcct

SEQ ID NO: 5964950 - DNA, 20 bp, Homo sapiens
aacattgggccacttcctaa

SEQ ID NO: 5964951 - DNA, 22 bp, Homo sapiens
aacattggggattgaaaatcat

SEQ ID NO: 5964952 - DNA, 19 bp, Homo sapiens
aacattggttcttgtatta

SEQ ID NO: 5964953 - DNA, 23 bp, Homo sapiens
aacattggttcttgtattaagaa

SEQ ID NO: 5964954 - DNA, 17 bp, Homo sapiens
aacattgtaaagtatgt

SEQ ID NO: 5964955 - DNA, 22 bp, Homo sapiens
aacattgtactgttgctttaat

SEQ ID NO: 5964956 - DNA, 13 bp, Homo sapiens
aacattgtgttcc

SEQ ID NO: 5964957 - DNA, 21 bp, Homo sapiens
aacattgttaatataatttaa

SEQ ID NO: 5964958 - DNA, 20 bp, Homo sapiens
aacattgttgctccctgtga

SEQ ID NO: 5964959 - DNA, 14 bp, Homo sapiens
aacatttaaaatta

SEQ ID NO: 5964960 - DNA, 16 bp, Homo sapiens
aacatttaaacttttt

SEQ ID NO: 5964961 - DNA, 17 bp, Homo sapiens
aacatttaaacttttta

SEQ ID NO: 5964962 - DNA, 21 bp, Homo sapiens
aacatttaaagacaaagacat

SEQ ID NO: 5964963 - DNA, 12 bp, Homo sapiens
aacatttaaatt

SEQ ID NO: 5964964 - DNA, 13 bp, Homo sapiens
aacatttaaattc

SEQ ID NO: 5964965 - DNA, 22 bp, Homo sapiens
aacatttaatttagatattttc

SEQ ID NO: 5964966 - DNA, 24 bp, Homo sapiens
aacatttacaataaatattctgca

SEQ ID NO: 5964967 - DNA, 13 bp, Homo sapiens
aacatttactaca

SEQ ID NO: 5964968 - DNA, 19 bp, Homo sapiens
aacatttactacagttttt

SEQ ID NO: 5964969 - DNA, 23 bp, Homo sapiens
aacatttagacaatggctatatt

SEQ ID NO: 5964970 - DNA, 19 bp, Homo sapiens
aacatttagtaccctgcag

SEQ ID NO: 5964971 - DNA, 14 bp, Homo sapiens
aacatttatgacct

SEQ ID NO: 5964972 - DNA, 19 bp, Homo sapiens
aacatttattttatgagaa

SEQ ID NO: 5964973 - DNA, 21 bp, Homo sapiens
aacatttattttatgagaaat

SEQ ID NO: 5964974 - DNA, 23 bp, Homo sapiens
aacatttattttttttaaagaaa

SEQ ID NO: 5964975 - DNA, 15 bp, Homo sapiens
aacatttcaagttta

SEQ ID NO: 5964976 - DNA, 21 bp, Homo sapiens
aacccaggcagctggcaggag

SEQ ID NO: 5964977 - DNA, 22 bp, Homo sapiens
aacccagggcaacaagcccgtt

SEQ ID NO: 5964978 - DNA, 19 bp, Homo sapiens
aacccagggctctgcccca

SEQ ID NO: 5964979 - DNA, 21 bp, Homo sapiens
aacccagggctctgccccagt

SEQ ID NO: 5964980 - DNA, 16 bp, Homo sapiens
aacccagtctcctctc

SEQ ID NO: 5964981 - DNA, 23 bp, Homo sapiens
aacccagttaacttactctttaa

SEQ ID NO: 5964982 - DNA, 21 bp, Homo sapiens
aacccagttacttttttacac

SEQ ID NO: 5964983 - DNA, 15 bp, Homo sapiens
aacccagttgccatc

SEQ ID NO: 5964984 - DNA, 16 bp, Homo sapiens
aacccagtttcccgtc

SEQ ID NO: 5964985 - DNA, 21 bp, Homo sapiens
aacccatacaatgtatgtaca

SEQ ID NO: 5964986 - DNA, 17 bp, Homo sapiens
aacccatattgtaaaac

SEQ ID NO: 5964987 - DNA, 19 bp, Homo sapiens
aacccatattttaaattct

SEQ ID NO: 5964988 - DNA, 17 bp, Homo sapiens
aacccatcactgtgtct

SEQ ID NO: 5964989 - DNA, 20 bp, Homo sapiens
aacccatctaaaccagaagg

SEQ ID NO: 5964990 - DNA, 17 bp, Homo sapiens
aacccatctacccctgg

SEQ ID NO: 5964991 - DNA, 20 bp, Homo sapiens
aacccatctacccctggatg

SEQ ID NO: 5964992 - DNA, 21 bp, Homo sapiens
aacccatctacccctggatga

SEQ ID NO: 5964993 - DNA, 15 bp, Homo sapiens
aacccatctgtaata

SEQ ID NO: 5964994 - DNA, 17 bp, Homo sapiens
aacccatcttccccgga

SEQ ID NO: 5964995 - DNA, 15 bp, Homo sapiens
aacccatgagattca

SEQ ID NO: 5964996 - DNA, 16 bp, Homo sapiens
aacccatgagcgtcca

SEQ ID NO: 5964997 - DNA, 23 bp, Homo sapiens
aacccatgagtgctaagagcctc

SEQ ID NO: 5964998 - DNA, 22 bp, Homo sapiens
aacccatgcatggcctcccagc

SEQ ID NO: 5964999 - DNA, 23 bp, Homo sapiens
aacccatgcatggcctcccagcc

SEQ ID NO: 5965000 - DNA, 14 bp, Homo sapiens
aacccatgccctgc

SEQ ID NO: 5965001 - DNA, 15 bp, Homo sapiens
aacccatgccctgcc

SEQ ID NO: 5965002 - DNA, 22 bp, Homo sapiens
aacccatgccctgccaagcctg

SEQ ID NO: 5965003 - DNA, 16 bp, Homo sapiens
aacccatgccctggac

SEQ ID NO: 5965004 - DNA, 14 bp, Homo sapiens
aacccatggctcta

SEQ ID NO: 5965005 - DNA, 15 bp, Homo sapiens
aacccatggctctat

SEQ ID NO: 5965006 - DNA, 22 bp, Homo sapiens
aacccatggctctatttcttct

SEQ ID NO: 5965007 - DNA, 23 bp, Homo sapiens
aacccattaaggggaagaatgaa

SEQ ID NO: 5965008 - DNA, 23 bp, Homo sapiens
aacccattaatcttttgtagttt

SEQ ID NO: 5965009 - DNA, 23 bp, Homo sapiens
aacccattccagtacagtattct

SEQ ID NO: 5965010 - DNA, 15 bp, Homo sapiens
aacccattgtcttta

SEQ ID NO: 5965011 - DNA, 18 bp, Homo sapiens
aacccatttacttaggac

SEQ ID NO: 5965012 - DNA, 23 bp, Homo sapiens
aacccatttgccatgctgctatg

SEQ ID NO: 5965013 - DNA, 16 bp, Homo sapiens
aacccattttggtgca

SEQ ID NO: 5965014 - DNA, 23 bp, Homo sapiens
aaccccaaatggttaatccaact

SEQ ID NO: 5965015 - DNA, 17 bp, Homo sapiens
aaccccaagcttcccaa

SEQ ID NO: 5965016 - DNA, 20 bp, Homo sapiens
aaccccacaagcaccactct

SEQ ID NO: 5965017 - DNA, 16 bp, Homo sapiens
aaccccacccagctcc

SEQ ID NO: 5965018 - DNA, 15 bp, Homo sapiens
aaccccaccctgttt

SEQ ID NO: 5965019 - DNA, 20 bp, Homo sapiens
aaccccacccttgcccaccc

SEQ ID NO: 5965020 - DNA, 19 bp, Homo sapiens
aaccccaccttgccaagct

SEQ ID NO: 5965021 - DNA, 15 bp, Homo sapiens
aaccccagacactgg

SEQ ID NO: 5965022 - DNA, 14 bp, Homo sapiens
aaccccagactcaa

SEQ ID NO: 5965023 - DNA, 14 bp, Homo sapiens
aaccccagcatcct

SEQ ID NO: 5965024 - DNA, 13 bp, Homo sapiens
aaccccagcccca

SEQ ID NO: 5965025 - DNA, 12 bp, Homo sapiens
aaccccagcctg

SEQ ID NO: 5965026 - DNA, 13 bp, Homo sapiens
aaccccagcctga

SEQ ID NO: 5965027 - DNA, 22 bp, Homo sapiens
aaccccagctattttctgacca

SEQ ID NO: 5965028 - DNA, 13 bp, Homo sapiens
aaccccagctggc

SEQ ID NO: 5965029 - DNA, 23 bp, Homo sapiens
aaccccagctggcctctagaaca

SEQ ID NO: 5965030 - DNA, 20 bp, Homo sapiens
aaccccagggcactgccagc

SEQ ID NO: 5965031 - DNA, 12 bp, Homo sapiens
aaccccagttct

SEQ ID NO: 5965032 - DNA, 17 bp, Homo sapiens
aaccccatacctacatt

SEQ ID NO: 5965033 - DNA, 22 bp, Homo sapiens
aaccccatcatatgacatgcca

SEQ ID NO: 5965034 - DNA, 15 bp, Homo sapiens
aacccccaaatttaa

SEQ ID NO: 5965035 - DNA, 16 bp, Homo sapiens
aacccccaaggaggaa

SEQ ID NO: 5965036 - DNA, 17 bp, Homo sapiens
aacccccaccccacact

SEQ ID NO: 5965037 - DNA, 11 bp, Homo sapiens
aacccccacct

SEQ ID NO: 5965038 - DNA, 12 bp, Homo sapiens
aacccccacctc

SEQ ID NO: 5965039 - DNA, 19 bp, Homo sapiens
aacccccagaggtggccct

SEQ ID NO: 5965040 - DNA, 20 bp, Homo sapiens
aacccccagaggtggccctt

SEQ ID NO: 5965041 - DNA, 19 bp, Homo sapiens
aacccccagcacccgggct

SEQ ID NO: 5965042 - DNA, 15 bp, Homo sapiens
aacccccaggtggcc

SEQ ID NO: 5965043 - DNA, 17 bp, Homo sapiens
aacccccagtgccacag

SEQ ID NO: 5965044 - DNA, 15 bp, Homo sapiens
aaccccccaagacca

SEQ ID NO: 5965045 - DNA, 17 bp, Homo sapiens
aaccccccactccctgc

SEQ ID NO: 5965046 - DNA, 16 bp, Homo sapiens
aaccccccagatatca

SEQ ID NO: 5965047 - DNA, 14 bp, Homo sapiens
aaccccccagcact

SEQ ID NO: 5965048 - DNA, 13 bp, Homo sapiens
aaccccccagctc

SEQ ID NO: 5965049 - DNA, 16 bp, Homo sapiens
aaccccccaggcccta

SEQ ID NO: 5965050 - DNA, 18 bp, Homo sapiens
aaccccccgactgtgctg

SEQ ID NO: 5965051 - DNA, 14 bp, Homo sapiens
aacccccctcccca

SEQ ID NO: 5965052 - DNA, 18 bp, Homo sapiens
aacccccctcctgctcct

SEQ ID NO: 5965053 - DNA, 23 bp, Homo sapiens
aacccccctcctgctcctccctg

SEQ ID NO: 5965054 - DNA, 15 bp, Homo sapiens
aacccccctgtacac

SEQ ID NO: 5965055 - DNA, 14 bp, Homo sapiens
aacccccgctccag

SEQ ID NO: 5965056 - DNA, 18 bp, Homo sapiens
aacccccgctccagatct

SEQ ID NO: 5965057 - DNA, 22 bp, Homo sapiens
aacccccgctccagatctgcac

SEQ ID NO: 5965058 - DNA, 20 bp, Homo sapiens
aaccccctgcagcccaggcc

SEQ ID NO: 5965059 - DNA, 15 bp, Homo sapiens
aacccccttccccgc

SEQ ID NO: 5965060 - DNA, 17 bp, Homo sapiens
aacccccttttcccttc

SEQ ID NO: 5965061 - DNA, 15 bp, Homo sapiens
aaccccgcagcccgt

SEQ ID NO: 5965062 - DNA, 22 bp, Homo sapiens
aaccccgcggtgctctggcggc

SEQ ID NO: 5965063 - DNA, 22 bp, Homo sapiens
aaccccgggcccgggcccccgc

SEQ ID NO: 5965064 - DNA, 16 bp, Homo sapiens
aaccccgtcaacaaat

SEQ ID NO: 5965065 - DNA, 21 bp, Homo sapiens
aacccctacatgaaacagaaa

SEQ ID NO: 5965066 - DNA, 18 bp, Homo sapiens
aacctaaagaggaaaagt

SEQ ID NO: 5965067 - DNA, 13 bp, Homo sapiens
aacctaaatactg

SEQ ID NO: 5965068 - DNA, 14 bp, Homo sapiens
aacctaacctgtgt

SEQ ID NO: 5965069 - DNA, 13 bp, Homo sapiens
aacctaactgtat

SEQ ID NO: 5965070 - DNA, 13 bp, Homo sapiens
aacctaagcaaaa

SEQ ID NO: 5965071 - DNA, 21 bp, Homo sapiens
aacctaataattgtatctaca

SEQ ID NO: 5965072 - DNA, 14 bp, Homo sapiens
aacctaatgcactc

SEQ ID NO: 5965073 - DNA, 14 bp, Homo sapiens
aacctaattaatat

SEQ ID NO: 5965074 - DNA, 15 bp, Homo sapiens
aacctaattgtggta

SEQ ID NO: 5965075 - DNA, 21 bp, Homo sapiens
aacctacaaaagcttgtgtat

SEQ ID NO: 5965076 - DNA, 16 bp, Homo sapiens
aacctacacacatacc

SEQ ID NO: 5965077 - DNA, 18 bp, Homo sapiens
aacctacacactgtcatg

SEQ ID NO: 5965078 - DNA, 16 bp, Homo sapiens
aacctacagtggaggg

SEQ ID NO: 5965079 - DNA, 15 bp, Homo sapiens
aacctacatattcca

SEQ ID NO: 5965080 - DNA, 12 bp, Homo sapiens
aacctacctgtg

SEQ ID NO: 5965081 - DNA, 15 bp, Homo sapiens
aacctacctgtgaat

SEQ ID NO: 5965082 - DNA, 21 bp, Homo sapiens
aacctaccttatagagcacaa

SEQ ID NO: 5965083 - DNA, 22 bp, Homo sapiens
aacctaccttatagagcacaat

SEQ ID NO: 5965084 - DNA, 17 bp, Homo sapiens
aacctacgaccccagag

SEQ ID NO: 5965085 - DNA, 15 bp, Homo sapiens
aacctactagacaat

SEQ ID NO: 5965086 - DNA, 12 bp, Homo sapiens
aacctactgagg

SEQ ID NO: 5965087 - DNA, 22 bp, Homo sapiens
aacctactgtctaagcagtttt

SEQ ID NO: 5965088 - DNA, 14 bp, Homo sapiens
aacctagaatgtca

SEQ ID NO: 5965089 - DNA, 11 bp, Homo sapiens
aacctagagat

SEQ ID NO: 5965090 - DNA, 12 bp, Homo sapiens
aacctaggagca

SEQ ID NO: 5965091 - DNA, 12 bp, Homo sapiens
aacctaggcagt

SEQ ID NO: 5965092 - DNA, 21 bp, Homo sapiens
aacctagggttttctatttct

SEQ ID NO: 5965093 - DNA, 13 bp, Homo sapiens
aacctagtactct

SEQ ID NO: 5965094 - DNA, 21 bp, Homo sapiens
aacctagtactctctgctcta

SEQ ID NO: 5965095 - DNA, 21 bp, Homo sapiens
aacctagttaaagaaaggaaa

SEQ ID NO: 5965096 - DNA, 15 bp, Homo sapiens
aacctataaagtgtt

SEQ ID NO: 5965097 - DNA, 15 bp, Homo sapiens
aacctatcaatcctg

SEQ ID NO: 5965098 - DNA, 15 bp, Homo sapiens
aacctatctcaggga

SEQ ID NO: 5965099 - DNA, 17 bp, Homo sapiens
aacctatctcagggagg

SEQ ID NO: 5965100 - DNA, 22 bp, Homo sapiens
aacctatgataattatttacaa

SEQ ID NO: 5965101 - DNA, 19 bp, Homo sapiens
aacctattaaaatacattt

SEQ ID NO: 5965102 - DNA, 12 bp, Homo sapiens
aacctatttctc

SEQ ID NO: 5965103 - DNA, 22 bp, Homo sapiens
aacctatttcttaaacacttgc

SEQ ID NO: 5965104 - DNA, 14 bp, Homo sapiens
aacctatttgactg

SEQ ID NO: 5965105 - DNA, 21 bp, Homo sapiens
aacctattttcatttgtacaa

SEQ ID NO: 5965106 - DNA, 22 bp, Homo sapiens
aacctattttcatttgtacaag

SEQ ID NO: 5965107 - DNA, 16 bp, Homo sapiens
aacctattttgaaagg

SEQ ID NO: 5965108 - DNA, 15 bp, Homo sapiens
aacctattttgaagt

SEQ ID NO: 5965109 - DNA, 14 bp, Homo sapiens
aacctattttgtgt

SEQ ID NO: 5965110 - DNA, 13 bp, Homo sapiens
aacctcaaactct

SEQ ID NO: 5965111 - DNA, 12 bp, Homo sapiens
aacctcaaatat

SEQ ID NO: 5965112 - DNA, 20 bp, Homo sapiens
aacctcaagtaaactcccct

SEQ ID NO: 5965113 - DNA, 15 bp, Homo sapiens
aacctcaatgccctg

SEQ ID NO: 5965114 - DNA, 20 bp, Homo sapiens
aacctcaattgacattcctt

SEQ ID NO: 5965115 - DNA, 14 bp, Homo sapiens
aacctcaatttatg

SEQ ID NO: 5965116 - DNA, 22 bp, Homo sapiens
aacctcaatttatgttaacaga

SEQ ID NO: 5965117 - DNA, 16 bp, Homo sapiens
aacctcacactactgt

SEQ ID NO: 5965118 - DNA, 16 bp, Homo sapiens
aacctcacatttgtga

SEQ ID NO: 5965119 - DNA, 20 bp, Homo sapiens
aacctcaccaactcctagtt

SEQ ID NO: 5965120 - DNA, 23 bp, Homo sapiens
aacctcaccccgaggccctgcat

SEQ ID NO: 5965121 - DNA, 18 bp, Homo sapiens
aacctcacctcccgggtt

SEQ ID NO: 5965122 - DNA, 14 bp, Homo sapiens
aacctcaccttcct

SEQ ID NO: 5965123 - DNA, 15 bp, Homo sapiens
aacctcaccttcctg

SEQ ID NO: 5965124 - DNA, 20 bp, Homo sapiens
aacctcaccttcctgtgggt

SEQ ID NO: 5965125 - DNA, 22 bp, Homo sapiens
aacctcacgcacctcccatcct

SEQ ID NO: 5965126 - DNA, 23 bp, Homo sapiens
aacctcactatggtatgctggcc

SEQ ID NO: 5965127 - DNA, 15 bp, Homo sapiens
aacctcactcttgcc

SEQ ID NO: 5965128 - DNA, 23 bp, Homo sapiens
aacctcactgccctccctcggcc

SEQ ID NO: 5965129 - DNA, 11 bp, Homo sapiens
aacctcacttg

SEQ ID NO: 5965130 - DNA, 22 bp, Homo sapiens
aacctcagacttaccaggaagc

SEQ ID NO: 5965131 - DNA, 15 bp, Homo sapiens
aacctcagaggcagc

SEQ ID NO: 5965132 - DNA, 20 bp, Homo sapiens
aacctcagcatttccttcca

SEQ ID NO: 5965133 - DNA, 17 bp, Homo sapiens
aacctcagctagctctg

SEQ ID NO: 5965134 - DNA, 15 bp, Homo sapiens
aacctcagctctggg

SEQ ID NO: 5965135 - DNA, 16 bp, Homo sapiens
aacctcaggccacatc

SEQ ID NO: 5965136 - DNA, 18 bp, Homo sapiens
aacctcaggcttccttgg

SEQ ID NO: 5965137 - DNA, 18 bp, Homo sapiens
aacctcagggctcccagg

SEQ ID NO: 5965138 - DNA, 19 bp, Homo sapiens
aacctcagggctgtcccag

SEQ ID NO: 5965139 - DNA, 22 bp, Homo sapiens
aacctcagggctgtcccagccc

SEQ ID NO: 5965140 - DNA, 14 bp, Homo sapiens
aacctcaggttcca

SEQ ID NO: 5965141 - DNA, 13 bp, Homo sapiens
aacctcagtgtca

SEQ ID NO: 5965142 - DNA, 18 bp, Homo sapiens
aacctcagtgtcatttat

SEQ ID NO: 5965143 - DNA, 21 bp, Homo sapiens
aacctcagttggcctctgccc

SEQ ID NO: 5965144 - DNA, 20 bp, Homo sapiens
aacctcatgacagccagagc

SEQ ID NO: 5965145 - DNA, 14 bp, Homo sapiens
aacctcattctggt

SEQ ID NO: 5965146 - DNA, 16 bp, Homo sapiens
aacctcattgacaaga

SEQ ID NO: 5965147 - DNA, 15 bp, Homo sapiens
aacctcattggccag

SEQ ID NO: 5965148 - DNA, 19 bp, Homo sapiens
aacctcattggccagctca

SEQ ID NO: 5965149 - DNA, 16 bp, Homo sapiens
aacctccacctcccag

SEQ ID NO: 5965150 - DNA, 18 bp, Homo sapiens
aacctccacctcctgggt

SEQ ID NO: 5965151 - DNA, 11 bp, Homo sapiens
aacctccagac

SEQ ID NO: 5965152 - DNA, 19 bp, Homo sapiens
aacctccagactcagcaga

SEQ ID NO: 5965153 - DNA, 23 bp, Homo sapiens
aacctccagcctccctgtctcca

SEQ ID NO: 5965154 - DNA, 19 bp, Homo sapiens
aacctccatcctgccagga

SEQ ID NO: 5965155 - DNA, 12 bp, Homo sapiens
aacctcccagag

SEQ ID NO: 5965156 - DNA, 13 bp, Homo sapiens
aacctcccagagg

SEQ ID NO: 5965157 - DNA, 16 bp, Homo sapiens
aaccacatgggctggg

SEQ ID NO: 5965158 - DNA, 15 bp, Homo sapiens
aaccacatgtcccag

SEQ ID NO: 5965159 - DNA, 16 bp, Homo sapiens
aaccacatgtcccaga

SEQ ID NO: 5965160 - DNA, 16 bp, Homo sapiens
aaccacattgaagaat

SEQ ID NO: 5965161 - DNA, 20 bp, Homo sapiens
aaccacatttctaagccttt

SEQ ID NO: 5965162 - DNA, 16 bp, Homo sapiens
aaccacattttaggat

SEQ ID NO: 5965163 - DNA, 21 bp, Homo sapiens
aaccaccaacagagaaaagca

SEQ ID NO: 5965164 - DNA, 18 bp, Homo sapiens
aaccaccagaagcccaga

SEQ ID NO: 5965165 - DNA, 22 bp, Homo sapiens
aaccaccagcgttcccttctcc

SEQ ID NO: 5965166 - DNA, 13 bp, Homo sapiens
aaccaccatggat

SEQ ID NO: 5965167 - DNA, 19 bp, Homo sapiens
aaccacccacaaagaaaca

SEQ ID NO: 5965168 - DNA, 20 bp, Homo sapiens
aaccaccccataccagtcac

SEQ ID NO: 5965169 - DNA, 16 bp, Homo sapiens
aaccaccctctgggga

SEQ ID NO: 5965170 - DNA, 17 bp, Homo sapiens
aaccaccctctggggac

SEQ ID NO: 5965171 - DNA, 13 bp, Homo sapiens
aaccaccctgagg

SEQ ID NO: 5965172 - DNA, 18 bp, Homo sapiens
aaccaccgcatatgcatg

SEQ ID NO: 5965173 - DNA, 20 bp, Homo sapiens
aaccaccgcatatgcatgcc

SEQ ID NO: 5965174 - DNA, 21 bp, Homo sapiens
aaccaccgcatatgcatgcca

SEQ ID NO: 5965175 - DNA, 23 bp, Homo sapiens
aaccaccgcatatgcatgccagg

SEQ ID NO: 5965176 - DNA, 21 bp, Homo sapiens
aaccacctaggcaatgaagaa

SEQ ID NO: 5965177 - DNA, 23 bp, Homo sapiens
aaccacctctctgtctttttcct

SEQ ID NO: 5965178 - DNA, 13 bp, Homo sapiens
aaccacgaatgag

SEQ ID NO: 5965179 - DNA, 14 bp, Homo sapiens
aaccacgaggctgc

SEQ ID NO: 5965180 - DNA, 19 bp, Homo sapiens
aaccacgaggctgccccca

SEQ ID NO: 5965181 - DNA, 22 bp, Homo sapiens
aaccacgcaggaagcctactat

SEQ ID NO: 5965182 - DNA, 14 bp, Homo sapiens
aaccacgccatgag

SEQ ID NO: 5965183 - DNA, 13 bp, Homo sapiens
aaccacgctggac

SEQ ID NO: 5965184 - DNA, 14 bp, Homo sapiens
aaccacggaaaaga

SEQ ID NO: 5965185 - DNA, 19 bp, Homo sapiens
aaccacggtgaaagtgctg

SEQ ID NO: 5965186 - DNA, 15 bp, Homo sapiens
aaccacgtgaaactg

SEQ ID NO: 5965187 - DNA, 19 bp, Homo sapiens
aaccacgtggagaaaatca

SEQ ID NO: 5965188 - DNA, 14 bp, Homo sapiens
aaccactaaagtat

SEQ ID NO: 5965189 - DNA, 19 bp, Homo sapiens
aaccactcctcaggaacag

SEQ ID NO: 5965190 - DNA, 14 bp, Homo sapiens
aaccactctacaga

SEQ ID NO: 5965191 - DNA, 20 bp, Homo sapiens
aaccactctgtggccagcct

SEQ ID NO: 5965192 - DNA, 23 bp, Homo sapiens
aaccactctgtggccagcctggc

SEQ ID NO: 5965193 - DNA, 16 bp, Homo sapiens
aaccactgaaaaaata

SEQ ID NO: 5965194 - DNA, 20 bp, Homo sapiens
aaccactgaaaaaatatatg

SEQ ID NO: 5965195 - DNA, 13 bp, Homo sapiens
aaccactgaatct

SEQ ID NO: 5965196 - DNA, 20 bp, Homo sapiens
aaccactgcaagtccttttg

SEQ ID NO: 5965197 - DNA, 12 bp, Homo sapiens
aaccactgcttc

SEQ ID NO: 5965198 - DNA, 20 bp, Homo sapiens
aaccactgcttctcttttga

SEQ ID NO: 5965199 - DNA, 22 bp, Homo sapiens
aaccactggaaagtttatggtt

SEQ ID NO: 5965200 - DNA, 21 bp, Homo sapiens
aaccactgggatcagctggtg

SEQ ID NO: 5965201 - DNA, 15 bp, Homo sapiens
aaccactgtaaaatg

SEQ ID NO: 5965202 - DNA, 16 bp, Homo sapiens
aaccactgtaaaatga

SEQ ID NO: 5965203 - DNA, 14 bp, Homo sapiens
aaccactgtacata

SEQ ID NO: 5965204 - DNA, 16 bp, Homo sapiens
aaccactgtacatata

SEQ ID NO: 5965205 - DNA, 17 bp, Homo sapiens
aaccactgtctagagca

SEQ ID NO: 5965206 - DNA, 21 bp, Homo sapiens
aaccactgtgaacatttttta

SEQ ID NO: 5965207 - DNA, 22 bp, Homo sapiens
aaccacttaaaatgatcaaggc

SEQ ID NO: 5965208 - DNA, 13 bp, Homo sapiens
aaccacttcattc

SEQ ID NO: 5965209 - DNA, 16 bp, Homo sapiens
aaccacttcattctgc

SEQ ID NO: 5965210 - DNA, 20 bp, Homo sapiens
aaccacttcctgctacagga

SEQ ID NO: 5965211 - DNA, 23 bp, Homo sapiens
aaccacttcctgctacaggaggg

SEQ ID NO: 5965212 - DNA, 17 bp, Homo sapiens
aaccacttctctgctgc

SEQ ID NO: 5965213 - DNA, 20 bp, Homo sapiens
aaccacttctctgctgcctc

SEQ ID NO: 5965214 - DNA, 12 bp, Homo sapiens
aaccacttgcct

SEQ ID NO: 5965215 - DNA, 13 bp, Homo sapiens
aaccacttgcctg

SEQ ID NO: 5965216 - DNA, 16 bp, Homo sapiens
aaccactttcacctgg

SEQ ID NO: 5965217 - DNA, 22 bp, Homo sapiens
aaccactttctcaggcttctca

SEQ ID NO: 5965218 - DNA, 11 bp, Homo sapiens
aaccactttgc

SEQ ID NO: 5965219 - DNA, 15 bp, Homo sapiens
aaccacttttcaatg

SEQ ID NO: 5965220 - DNA, 15 bp, Homo sapiens
aaccactttttgcag

SEQ ID NO: 5965221 - DNA, 17 bp, Homo sapiens
aaccagaaaaaataaat

SEQ ID NO: 5965222 - DNA, 12 bp, Homo sapiens
aaccagaaccca

SEQ ID NO: 5965223 - DNA, 22 bp, Homo sapiens
aaccagaagcaacagaaaaaat

SEQ ID NO: 5965224 - DNA, 22 bp, Homo sapiens
aaccagaagtgcagcccctctc

SEQ ID NO: 5965225 - DNA, 23 bp, Homo sapiens
aaccagaagtttctacattctct

SEQ ID NO: 5965226 - DNA, 17 bp, Homo sapiens
aaccagaatcataattt

SEQ ID NO: 5965227 - DNA, 18 bp, Homo sapiens
aaccagaatcataatttt

SEQ ID NO: 5965228 - DNA, 16 bp, Homo sapiens
aaccagaatccctcta

SEQ ID NO: 5965229 - DNA, 17 bp, Homo sapiens
aaccagaatgattttga

SEQ ID NO: 5965230 - DNA, 21 bp, Homo sapiens
aaccagaattgtcctcaaggc

SEQ ID NO: 5965231 - DNA, 12 bp, Homo sapiens
aaccagacacaa

SEQ ID NO: 5965232 - DNA, 12 bp, Homo sapiens
aaccagacctgg

SEQ ID NO: 5965233 - DNA, 20 bp, Homo sapiens
aaccagagaatgctttgaaa

SEQ ID NO: 5965234 - DNA, 19 bp, Homo sapiens
aaccagagcaagctttttt

SEQ ID NO: 5965235 - DNA, 13 bp, Homo sapiens
aaccagagcactg

SEQ ID NO: 5965236 - DNA, 23 bp, Homo sapiens
aaccagagggtgtggctttccag

SEQ ID NO: 5965237 - DNA, 14 bp, Homo sapiens
aaccagatcattgt

SEQ ID NO: 5965238 - DNA, 15 bp, Homo sapiens
aaccagcactcccag

SEQ ID NO: 5965239 - DNA, 14 bp, Homo sapiens
aaccagcagaaaag

SEQ ID NO: 5965240 - DNA, 18 bp, Homo sapiens
aaccagcagaaaagtgct

SEQ ID NO: 5965241 - DNA, 16 bp, Homo sapiens
aaccagcattttacta

SEQ ID NO: 5965242 - DNA, 14 bp, Homo sapiens
aaccagccacacag

SEQ ID NO: 5965243 - DNA, 20 bp, Homo sapiens
aaccagccacagtacatatg

SEQ ID NO: 5965244 - DNA, 20 bp, Homo sapiens
aaccagcccgacagtgccat

SEQ ID NO: 5965245 - DNA, 11 bp, Homo sapiens
aacctgccctg

SEQ ID NO: 5965246 - DNA, 15 bp, Homo sapiens
aacctgccctgcctg

SEQ ID NO: 5965247 - DNA, 22 bp, Homo sapiens
aacctgccgggctgttgtttta

SEQ ID NO: 5965248 - DNA, 18 bp, Homo sapiens
aacctgcctaaattaaat

SEQ ID NO: 5965249 - DNA, 14 bp, Homo sapiens
aacctgcctgtgca

SEQ ID NO: 5965250 - DNA, 14 bp, Homo sapiens
aacctgcctttgta

SEQ ID NO: 5965251 - DNA, 20 bp, Homo sapiens
aacctgcctttgtatgtgga

SEQ ID NO: 5965252 - DNA, 24 bp, Homo sapiens
aacctgctcccttcgctctgctgg

SEQ ID NO: 5965253 - DNA, 14 bp, Homo sapiens
aacctgctggtggg

SEQ ID NO: 5965254 - DNA, 13 bp, Homo sapiens
aacctgcttttgt

SEQ ID NO: 5965255 - DNA, 18 bp, Homo sapiens
aacctggaccccagcctt

SEQ ID NO: 5965256 - DNA, 15 bp, Homo sapiens
aacctggacctggaa

SEQ ID NO: 5965257 - DNA, 12 bp, Homo sapiens
aacctggacttc

SEQ ID NO: 5965258 - DNA, 19 bp, Homo sapiens
aacctggacttcctgtcat

SEQ ID NO: 5965259 - DNA, 17 bp, Homo sapiens
aacctggagatggggag

SEQ ID NO: 5965260 - DNA, 22 bp, Homo sapiens
aacctggagggctggaatctgg

SEQ ID NO: 5965261 - DNA, 20 bp, Homo sapiens
aacctggaggggctagaacc

SEQ ID NO: 5965262 - DNA, 19 bp, Homo sapiens
aacctggaggtcaatgtta

SEQ ID NO: 5965263 - DNA, 13 bp, Homo sapiens
aacctggcaggcc

SEQ ID NO: 5965264 - DNA, 17 bp, Homo sapiens
aacctggcaggccctgc

SEQ ID NO: 5965265 - DNA, 20 bp, Homo sapiens
aacctggcaggccctgccca

SEQ ID NO: 5965266 - DNA, 23 bp, Homo sapiens
aacctggcaggccctgcccagcc

SEQ ID NO: 5965267 - DNA, 11 bp, Homo sapiens
aacctggcctt

SEQ ID NO: 5965268 - DNA, 21 bp, Homo sapiens
aacctggctccctcccaccca

SEQ ID NO: 5965269 - DNA, 21 bp, Homo sapiens
aacctggctgcgaactgtgca

SEQ ID NO: 5965270 - DNA, 15 bp, Homo sapiens
aacctgggaaggcca

SEQ ID NO: 5965271 - DNA, 22 bp, Homo sapiens
aacctgggagagacttggatga

SEQ ID NO: 5965272 - DNA, 15 bp, Homo sapiens
aacctgggaggcaga

SEQ ID NO: 5965273 - DNA, 22 bp, Homo sapiens
aacctgggaggcggagagtaca

SEQ ID NO: 5965274 - DNA, 23 bp, Homo sapiens
aacctgggatcctgactaagcct

SEQ ID NO: 5965275 - DNA, 23 bp, Homo sapiens
aacctgggcttaagttttacttg

SEQ ID NO: 5965276 - DNA, 18 bp, Homo sapiens
aacctggggtgaatactt

SEQ ID NO: 5965277 - DNA, 22 bp, Homo sapiens
aacctggggtgaatacttattt

SEQ ID NO: 5965278 - DNA, 19 bp, Homo sapiens
aacctgggtccaaataaaa

SEQ ID NO: 5965279 - DNA, 13 bp, Homo sapiens
aacctgggttagg

SEQ ID NO: 5965280 - DNA, 18 bp, Homo sapiens
aacctgggttgttgcaga

SEQ ID NO: 5965281 - DNA, 22 bp, Homo sapiens
aacctggtaaattttataatgt

SEQ ID NO: 5965282 - DNA, 19 bp, Homo sapiens
aacctggtaattatcctca

SEQ ID NO: 5965283 - DNA, 20 bp, Homo sapiens
aacctggtctctacataaaa

SEQ ID NO: 5965284 - DNA, 11 bp, Homo sapiens
aacctggtgct

SEQ ID NO: 5965285 - DNA, 17 bp, Homo sapiens
aacctggtggcaccaga

SEQ ID NO: 5965286 - DNA, 13 bp, Homo sapiens
aacctggtggctg

SEQ ID NO: 5965287 - DNA, 22 bp, Homo sapiens
aacctggttcatatttatactt

SEQ ID NO: 5965288 - DNA, 13 bp, Homo sapiens
aacctggttcctg

SEQ ID NO: 5965289 - DNA, 14 bp, Homo sapiens
aacctgtaataaat

SEQ ID NO: 5965290 - DNA, 20 bp, Homo sapiens
aacctgtactgggttatttt

SEQ ID NO: 5965291 - DNA, 15 bp, Homo sapiens
aacctgtacttcaag

SEQ ID NO: 5965292 - DNA, 22 bp, Homo sapiens
aacctgtaggatcttatttgga

SEQ ID NO: 5965293 - DNA, 23 bp, Homo sapiens
aacctgtaggatcttatttggaa

SEQ ID NO: 5965294 - DNA, 19 bp, Homo sapiens
aacctgtatactcttgaat

SEQ ID NO: 5965295 - DNA, 16 bp, Homo sapiens
aacctgtatctttcta

SEQ ID NO: 5965296 - DNA, 22 bp, Homo sapiens
aacctgtattactgaataatat

SEQ ID NO: 5965297 - DNA, 13 bp, Homo sapiens
aacctgtattttt

SEQ ID NO: 5965298 - DNA, 19 bp, Homo sapiens
aacctgtcacctggcctgc

SEQ ID NO: 5965299 - DNA, 20 bp, Homo sapiens
aacctgtccaacatgtttta

SEQ ID NO: 5965300 - DNA, 15 bp, Homo sapiens
aacctgtcctaagga

SEQ ID NO: 5965301 - DNA, 15 bp, Homo sapiens
aacctgtccttactc

SEQ ID NO: 5965302 - DNA, 21 bp, Homo sapiens
aacctgtccttactcagagct

SEQ ID NO: 5965303 - DNA, 22 bp, Homo sapiens
aacctgtccttactcagagctg

SEQ ID NO: 5965304 - DNA, 15 bp, Homo sapiens
aacctgtccttgcac

SEQ ID NO: 5965305 - DNA, 14 bp, Homo sapiens
aacctgtctcctcc

SEQ ID NO: 5965306 - DNA, 16 bp, Homo sapiens
aacctgtgagtaaata

SEQ ID NO: 5965307 - DNA, 18 bp, Homo sapiens
aacctgtgatttctgtgc

SEQ ID NO: 5965308 - DNA, 11 bp, Homo sapiens
aacctgtgcaa

SEQ ID NO: 5965309 - DNA, 18 bp, Homo sapiens
aacctgtgcaaaataaaa

SEQ ID NO: 5965310 - DNA, 17 bp, Homo sapiens
aacctgtgctttcatgt

SEQ ID NO: 5965311 - DNA, 23 bp, Homo sapiens
aacctgtgctttcatgtttaaga

SEQ ID NO: 5965312 - DNA, 21 bp, Homo sapiens
aacctgtggcgctgcagcagg

SEQ ID NO: 5965313 - DNA, 14 bp, Homo sapiens
aacctgtggctcag

SEQ ID NO: 5965314 - DNA, 15 bp, Homo sapiens
aacctgtggctcagg

SEQ ID NO: 5965315 - DNA, 16 bp, Homo sapiens
aacctgtggctcaggg

SEQ ID NO: 5965316 - DNA, 20 bp, Homo sapiens
aacctgtggctcaggggagc

SEQ ID NO: 5965317 - DNA, 10 bp, Homo sapiens
aacctgtggg

SEQ ID NO: 5965318 - DNA, 12 bp, Homo sapiens
aacctgtgtctg

SEQ ID NO: 5965319 - DNA, 16 bp, Homo sapiens
aacctgtgtgcatctg

SEQ ID NO: 5965320 - DNA, 18 bp, Homo sapiens
aacctgttacactgggct

SEQ ID NO: 5965321 - DNA, 15 bp, Homo sapiens
aacctgttatttcta

SEQ ID NO: 5965322 - DNA, 16 bp, Homo sapiens
aacctgttatttctat

SEQ ID NO: 5965323 - DNA, 20 bp, Homo sapiens
aacctgttatttctatgaaa

SEQ ID NO: 5965324 - DNA, 14 bp, Homo sapiens
aacctgttcctgac

SEQ ID NO: 5965325 - DNA, 17 bp, Homo sapiens
aacctgttctgctttcc

SEQ ID NO: 5965326 - DNA, 18 bp, Homo sapiens
aacctgttcttagagtgt

SEQ ID NO: 5965327 - DNA, 22 bp, Homo sapiens
aacctgttcttagagtgtagct

SEQ ID NO: 5965328 - DNA, 20 bp, Homo sapiens
aacctgtttctacctatatg

SEQ ID NO: 5965329 - DNA, 22 bp, Homo sapiens
aacctgtttctacctatatgca

SEQ ID NO: 5965330 - DNA, 23 bp, Homo sapiens
aacctgtttctacctatatgcag

SEQ ID NO: 5965331 - DNA, 12 bp, Homo sapiens
aacctgttttgt

SEQ ID NO: 5965332 - DNA, 21 bp, Homo sapiens
aacctgttttgttaatgctct

SEQ ID NO: 5965333 - DNA, 18 bp, Homo sapiens
aacctgtttttaacatgt

SEQ ID NO: 5965334 - DNA, 18 bp, Homo sapiens
aaccttaaaaaatgtttc

SEQ ID NO: 5965335 - DNA, 20 bp, Homo sapiens
aaccttaaaagtaataaaga

SEQ ID NO: 5965336 - DNA, 13 bp, Homo sapiens
aaccatgacaaac

SEQ ID NO: 5965337 - DNA, 15 bp, Homo sapiens
aaccatgacgcaaag

SEQ ID NO: 5965338 - DNA, 20 bp, Homo sapiens
aaccatgagaattttacttc

SEQ ID NO: 5965339 - DNA, 23 bp, Homo sapiens
aaccatgagtggcatggccacca

SEQ ID NO: 5965340 - DNA, 22 bp, Homo sapiens
aaccatgcaggaaggaaaacta

SEQ ID NO: 5965341 - DNA, 22 bp, Homo sapiens
aaccatgctcttgttctgttcc

SEQ ID NO: 5965342 - DNA, 16 bp, Homo sapiens
aaccatggcacttgat

SEQ ID NO: 5965343 - DNA, 15 bp, Homo sapiens
aaccatgggctcagg

SEQ ID NO: 5965344 - DNA, 16 bp, Homo sapiens
aaccatggtgcttgtt

SEQ ID NO: 5965345 - DNA, 23 bp, Homo sapiens
aaccatgtcagcaaaaagcaaaa

SEQ ID NO: 5965346 - DNA, 22 bp, Homo sapiens
aaccatgtgactaaaaatgcat

SEQ ID NO: 5965347 - DNA, 20 bp, Homo sapiens
aaccatgtgttatgttttcg

SEQ ID NO: 5965348 - DNA, 13 bp, Homo sapiens
aaccattaaagtc

SEQ ID NO: 5965349 - DNA, 14 bp, Homo sapiens
aaccattaaagtca

SEQ ID NO: 5965350 - DNA, 15 bp, Homo sapiens
aaccattaaagtcag

SEQ ID NO: 5965351 - DNA, 22 bp, Homo sapiens
aaccattaagtcatgtgtgaac

SEQ ID NO: 5965352 - DNA, 12 bp, Homo sapiens
aaccattacaaa

SEQ ID NO: 5965353 - DNA, 23 bp, Homo sapiens
aaccattactgaggggattctct

SEQ ID NO: 5965354 - DNA, 19 bp, Homo sapiens
aaccattataaccttaatt

SEQ ID NO: 5965355 - DNA, 19 bp, Homo sapiens
aaccattatactttatatc

SEQ ID NO: 5965356 - DNA, 23 bp, Homo sapiens
aaccattatactttatatctgta

SEQ ID NO: 5965357 - DNA, 18 bp, Homo sapiens
aaccattatttaataaga

SEQ ID NO: 5965358 - DNA, 17 bp, Homo sapiens
aaccattcaaaaatttc

SEQ ID NO: 5965359 - DNA, 12 bp, Homo sapiens
aaccattcaaat

SEQ ID NO: 5965360 - DNA, 15 bp, Homo sapiens
aaccattccaacttc

SEQ ID NO: 5965361 - DNA, 17 bp, Homo sapiens
aaccattccatttccaa

SEQ ID NO: 5965362 - DNA, 19 bp, Homo sapiens
aaccattccctagtcattt

SEQ ID NO: 5965363 - DNA, 15 bp, Homo sapiens
aaccattcgaagtca

SEQ ID NO: 5965364 - DNA, 22 bp, Homo sapiens
aaccattcgaagtcagctaatt

SEQ ID NO: 5965365 - DNA, 15 bp, Homo sapiens
aaccattctaaataa

SEQ ID NO: 5965366 - DNA, 12 bp, Homo sapiens
aaccattgcttc

SEQ ID NO: 5965367 - DNA, 14 bp, Homo sapiens
aaccattgcttcac

SEQ ID NO: 5965368 - DNA, 22 bp, Homo sapiens
aaccattggacagatttcagta

SEQ ID NO: 5965369 - DNA, 18 bp, Homo sapiens
aaccattggttaatctgg

SEQ ID NO: 5965370 - DNA, 11 bp, Homo sapiens
aaccattgtaa

SEQ ID NO: 5965371 - DNA, 18 bp, Homo sapiens
aaccattgtaactattaa

SEQ ID NO: 5965372 - DNA, 23 bp, Homo sapiens
aaccattgtaactattaaccttt

SEQ ID NO: 5965373 - DNA, 13 bp, Homo sapiens
aaccattgtattt

SEQ ID NO: 5965374 - DNA, 19 bp, Homo sapiens
aaccattgtcttgttctgt

SEQ ID NO: 5965375 - DNA, 18 bp, Homo sapiens
aaccatttaagagactct

SEQ ID NO: 5965376 - DNA, 17 bp, Homo sapiens
aaccatttaataaagaa

SEQ ID NO: 5965377 - DNA, 15 bp, Homo sapiens
aaccatttaattcat

SEQ ID NO: 5965378 - DNA, 16 bp, Homo sapiens
aaccatttaattcata

SEQ ID NO: 5965379 - DNA, 11 bp, Homo sapiens
aaccatttata

SEQ ID NO: 5965380 - DNA, 12 bp, Homo sapiens
aaccatttatct

SEQ ID NO: 5965381 - DNA, 15 bp, Homo sapiens
aaccatttatcttga

SEQ ID NO: 5965382 - DNA, 19 bp, Homo sapiens
aaccatttatcttgaagga

SEQ ID NO: 5965383 - DNA, 12 bp, Homo sapiens
aaccatttccaa

SEQ ID NO: 5965384 - DNA, 12 bp, Homo sapiens
aaccatttcctc

SEQ ID NO: 5965385 - DNA, 16 bp, Homo sapiens
aaccatttcctcagac

SEQ ID NO: 5965386 - DNA, 17 bp, Homo sapiens
aaccattttataaagtg

SEQ ID NO: 5965387 - DNA, 21 bp, Homo sapiens
aaccattttattttttgggcc

SEQ ID NO: 5965388 - DNA, 21 bp, Homo sapiens
aaccattttcccatcatcctt

SEQ ID NO: 5965389 - DNA, 18 bp, Homo sapiens
aaccatttttgaacctta

SEQ ID NO: 5965390 - DNA, 22 bp, Homo sapiens
aaccatttttgttactctcttc

SEQ ID NO: 5965391 - DNA, 16 bp, Homo sapiens
aacccaaacctggaga

SEQ ID NO: 5965392 - DNA, 16 bp, Homo sapiens
aacccaaataaatgtg

SEQ ID NO: 5965393 - DNA, 21 bp, Homo sapiens
aacccaaatgtccaatataaa

SEQ ID NO: 5965394 - DNA, 23 bp, Homo sapiens
aacccaaatgttcatcaatgaat

SEQ ID NO: 5965395 - DNA, 16 bp, Homo sapiens
aacccaactctcctgg

SEQ ID NO: 5965396 - DNA, 19 bp, Homo sapiens
aacccaactgacttctgct

SEQ ID NO: 5965397 - DNA, 15 bp, Homo sapiens
aacccaagacatcat

SEQ ID NO: 5965398 - DNA, 16 bp, Homo sapiens
aacccaagcaacattt

SEQ ID NO: 5965399 - DNA, 23 bp, Homo sapiens
aacccaagcctcatattttctgt

SEQ ID NO: 5965400 - DNA, 13 bp, Homo sapiens
aacccaagctcct

SEQ ID NO: 5965401 - DNA, 14 bp, Homo sapiens
aacccaagctcctc

SEQ ID NO: 5965402 - DNA, 15 bp, Homo sapiens
aacccaagctcctcc

SEQ ID NO: 5965403 - DNA, 17 bp, Homo sapiens
aacccaagctctgggga

SEQ ID NO: 5965404 - DNA, 17 bp, Homo sapiens
aacccaaggagcacagg

SEQ ID NO: 5965405 - DNA, 14 bp, Homo sapiens
aacccaaggtgagg

SEQ ID NO: 5965406 - DNA, 14 bp, Homo sapiens
aacccaagtgctgc

SEQ ID NO: 5965407 - DNA, 22 bp, Homo sapiens
aacccaagtttatttctctctt

SEQ ID NO: 5965408 - DNA, 21 bp, Homo sapiens
aacccaatctgcacactccag

SEQ ID NO: 5965409 - DNA, 23 bp, Homo sapiens
aacccaatctgcacactccaggc

SEQ ID NO: 5965410 - DNA, 19 bp, Homo sapiens
aacccaatgacttccctgc

SEQ ID NO: 5965411 - DNA, 13 bp, Homo sapiens
aacccacacctgg

SEQ ID NO: 5965412 - DNA, 11 bp, Homo sapiens
aacccacactg

SEQ ID NO: 5965413 - DNA, 23 bp, Homo sapiens
aacccacagaaggggatgggaaa

SEQ ID NO: 5965414 - DNA, 22 bp, Homo sapiens
aacccacagacctcacacctgg

SEQ ID NO: 5965415 - DNA, 12 bp, Homo sapiens
aacccacagctc

SEQ ID NO: 5965416 - DNA, 19 bp, Homo sapiens
aacccacagctcagctgcc

SEQ ID NO: 5965417 - DNA, 19 bp, Homo sapiens
aacccacaggcccacagta

SEQ ID NO: 5965418 - DNA, 16 bp, Homo sapiens
aacccacagtttgaga

SEQ ID NO: 5965419 - DNA, 14 bp, Homo sapiens
aacccacataaaca

SEQ ID NO: 5965420 - DNA, 17 bp, Homo sapiens
aacccaccctaccacag

SEQ ID NO: 5965421 - DNA, 14 bp, Homo sapiens
aacccaccctctcc

SEQ ID NO: 5965422 - DNA, 15 bp, Homo sapiens
aacccaccctctcca

SEQ ID NO: 5965423 - DNA, 23 bp, Homo sapiens
acattcaagattaaactgagtga

SEQ ID NO: 5965424 - DNA, 15 bp, Homo sapiens
acattcaatgaatta

SEQ ID NO: 5965425 - DNA, 17 bp, Homo sapiens
acattcaatgaattata

SEQ ID NO: 5965426 - DNA, 14 bp, Homo sapiens
acattcaatttgct

SEQ ID NO: 5965427 - DNA, 14 bp, Homo sapiens
acattcacagcacg

SEQ ID NO: 5965428 - DNA, 20 bp, Homo sapiens
acattcacctgccccaactc

SEQ ID NO: 5965429 - DNA, 21 bp, Homo sapiens
acattcacctgtatatttctt

SEQ ID NO: 5965430 - DNA, 18 bp, Homo sapiens
acattcacttccagagag

SEQ ID NO: 5965431 - DNA, 14 bp, Homo sapiens
acattcacttttgt

SEQ ID NO: 5965432 - DNA, 21 bp, Homo sapiens
acattcacttttgttaacagt

SEQ ID NO: 5965433 - DNA, 15 bp, Homo sapiens
acattcagaaaactt

SEQ ID NO: 5965434 - DNA, 18 bp, Homo sapiens
acattcagactaaaaata

SEQ ID NO: 5965435 - DNA, 13 bp, Homo sapiens
acattcagctctg

SEQ ID NO: 5965436 - DNA, 17 bp, Homo sapiens
acattcagctctggaga

SEQ ID NO: 5965437 - DNA, 16 bp, Homo sapiens
acattcagtactttat

SEQ ID NO: 5965438 - DNA, 18 bp, Homo sapiens
acattcagtactttatga

SEQ ID NO: 5965439 - DNA, 14 bp, Homo sapiens
acattcataaggaa

SEQ ID NO: 5965440 - DNA, 14 bp, Homo sapiens
acattcatctggag

SEQ ID NO: 5965441 - DNA, 17 bp, Homo sapiens
acattcatctggaggct

SEQ ID NO: 5965442 - DNA, 17 bp, Homo sapiens
acattcatgtaactctc

SEQ ID NO: 5965443 - DNA, 11 bp, Homo sapiens
acattccaaaa

SEQ ID NO: 5965444 - DNA, 22 bp, Homo sapiens
acattccaacttaggctacaga

SEQ ID NO: 5965445 - DNA, 11 bp, Homo sapiens
acattccaaga

SEQ ID NO: 5965446 - DNA, 13 bp, Homo sapiens
acattccaagaca

SEQ ID NO: 5965447 - DNA, 17 bp, Homo sapiens
acattccagccaggccc

SEQ ID NO: 5965448 - DNA, 18 bp, Homo sapiens
acattccagggctggggt

SEQ ID NO: 5965449 - DNA, 17 bp, Homo sapiens
acattccatcacagcca

SEQ ID NO: 5965450 - DNA, 18 bp, Homo sapiens
acattccatcacagccag

SEQ ID NO: 5965451 - DNA, 23 bp, Homo sapiens
acattccatcacagccagcccag

SEQ ID NO: 5965452 - DNA, 19 bp, Homo sapiens
acattcccccaccagctgc

SEQ ID NO: 5965453 - DNA, 23 bp, Homo sapiens
acattcccccaccagctgcagcc

SEQ ID NO: 5965454 - DNA, 23 bp, Homo sapiens
acattcccctccccactcctctc

SEQ ID NO: 5965455 - DNA, 15 bp, Homo sapiens
acattccctatcaaa

SEQ ID NO: 5965456 - DNA, 22 bp, Homo sapiens
acattccctatcaaaacatatc

SEQ ID NO: 5965457 - DNA, 13 bp, Homo sapiens
acattccctctca

SEQ ID NO: 5965458 - DNA, 15 bp, Homo sapiens
acattccctctcctg

SEQ ID NO: 5965459 - DNA, 16 bp, Homo sapiens
acattccctggcctgg

SEQ ID NO: 5965460 - DNA, 22 bp, Homo sapiens
acattcccttgatggtctcaag

SEQ ID NO: 5965461 - DNA, 23 bp, Homo sapiens
acattccgacaaccgatgctcca

SEQ ID NO: 5965462 - DNA, 14 bp, Homo sapiens
acattcctaaaatg

SEQ ID NO: 5965463 - DNA, 17 bp, Homo sapiens
acattcctaactagaat

SEQ ID NO: 5965464 - DNA, 20 bp, Homo sapiens
acattcctaagagtggagga

SEQ ID NO: 5965465 - DNA, 19 bp, Homo sapiens
acattcctcagctgccaag

SEQ ID NO: 5965466 - DNA, 18 bp, Homo sapiens
acattcctcatgaatgta

SEQ ID NO: 5965467 - DNA, 19 bp, Homo sapiens
acattcctcatgaatgtaa

SEQ ID NO: 5965468 - DNA, 20 bp, Homo sapiens
acattcctcatgaatgtaaa

SEQ ID NO: 5965469 - DNA, 15 bp, Homo sapiens
acattcctgaacagg

SEQ ID NO: 5965470 - DNA, 13 bp, Homo sapiens
acattcctgaccc

SEQ ID NO: 5965471 - DNA, 14 bp, Homo sapiens
acattcctgagatt

SEQ ID NO: 5965472 - DNA, 15 bp, Homo sapiens
acattcctgcattca

SEQ ID NO: 5965473 - DNA, 14 bp, Homo sapiens
acattcctggcccc

SEQ ID NO: 5965474 - DNA, 19 bp, Homo sapiens
acattcctggccccgggct

SEQ ID NO: 5965475 - DNA, 11 bp, Homo sapiens
acattccttct

SEQ ID NO: 5965476 - DNA, 23 bp, Homo sapiens
acattccttctcccatctcttcc

SEQ ID NO: 5965477 - DNA, 17 bp, Homo sapiens
acattccttgcctgcac

SEQ ID NO: 5965478 - DNA, 19 bp, Homo sapiens
acattccttgtcaccagca

SEQ ID NO: 5965479 - DNA, 15 bp, Homo sapiens
acattcctttgaata

SEQ ID NO: 5965480 - DNA, 15 bp, Homo sapiens
acattcgacataccc

SEQ ID NO: 5965481 - DNA, 14 bp, Homo sapiens
acattcgatctcat

SEQ ID NO: 5965482 - DNA, 21 bp, Homo sapiens
acattcgatctcattcagtat

SEQ ID NO: 5965483 - DNA, 23 bp, Homo sapiens
acattcgatctcattcagtatta

SEQ ID NO: 5965484 - DNA, 21 bp, Homo sapiens
acattcggaggtcaagaaagc

SEQ ID NO: 5965485 - DNA, 22 bp, Homo sapiens
acattcggaggtcaagaaagca

SEQ ID NO: 5965486 - DNA, 22 bp, Homo sapiens
acattcgtgaaaaccaaccctg

SEQ ID NO: 5965487 - DNA, 18 bp, Homo sapiens
acattctaaagagagtga

SEQ ID NO: 5965488 - DNA, 16 bp, Homo sapiens
acattctaagtgtgtt

SEQ ID NO: 5965489 - DNA, 11 bp, Homo sapiens
acattctaatg

SEQ ID NO: 5965490 - DNA, 12 bp, Homo sapiens
acattctaatgc

SEQ ID NO: 5965491 - DNA, 14 bp, Homo sapiens
acattctaatgcat

SEQ ID NO: 5965492 - DNA, 17 bp, Homo sapiens
acattctaatgcatatt

SEQ ID NO: 5965493 - DNA, 13 bp, Homo sapiens
acattctacttca

SEQ ID NO: 5965494 - DNA, 22 bp, Homo sapiens
acattctagatgcaagtctctt

SEQ ID NO: 5965495 - DNA, 17 bp, Homo sapiens
acattctagttcagagc

SEQ ID NO: 5965496 - DNA, 21 bp, Homo sapiens
acattctcacaattgtaaagt

SEQ ID NO: 5965497 - DNA, 12 bp, Homo sapiens
acattctcacat

SEQ ID NO: 5965498 - DNA, 14 bp, Homo sapiens
acattctcagtttt

SEQ ID NO: 5965499 - DNA, 16 bp, Homo sapiens
acattctctaataaga

SEQ ID NO: 5965500 - DNA, 20 bp, Homo sapiens
acattctctaataagaaaac

SEQ ID NO: 5965501 - DNA, 16 bp, Homo sapiens
acattctctcatagaa

SEQ ID NO: 5965502 - DNA, 22 bp, Homo sapiens
acattctctttgataacaaaaa

SEQ ID NO: 5965503 - DNA, 20 bp, Homo sapiens
acattctgacatcttagtat

SEQ ID NO: 5965504 - DNA, 15 bp, Homo sapiens
acattctgatgagca

SEQ ID NO: 5965505 - DNA, 16 bp, Homo sapiens
acattctgatgagcaa

SEQ ID NO: 5965506 - DNA, 19 bp, Homo sapiens
acattctgatttggaaaaa

SEQ ID NO: 5965507 - DNA, 16 bp, Homo sapiens
acattctgccaggccc

SEQ ID NO: 5965508 - DNA, 12 bp, Homo sapiens
acattctgcctt

SEQ ID NO: 5965509 - DNA, 15 bp, Homo sapiens
acattctgctcccag

SEQ ID NO: 5965510 - DNA, 13 bp, Homo sapiens
acattctgctctg

SEQ ID NO: 5965511 - DNA, 21 bp, Homo sapiens
acattctgctctgcccatgcc

SEQ ID NO: 5965512 - DNA, 17 bp, Homo sapiens
acattctgctgccccca

SEQ ID NO: 5965513 - DNA, 13 bp, Homo sapiens
acattctggatct

SEQ ID NO: 5965514 - DNA, 19 bp, Homo sapiens
acattctggatctgaccct

SEQ ID NO: 5965515 - DNA, 22 bp, Homo sapiens
acattctggatctgaccctccc

SEQ ID NO: 5965516 - DNA, 20 bp, Homo sapiens
acattctggctcagggaggt

SEQ ID NO: 5965517 - DNA, 17 bp, Homo sapiens
acattctggtctcgtct

SEQ ID NO: 5965518 - DNA, 13 bp, Homo sapiens
acattctgtgtgt

SEQ ID NO: 5965519 - DNA, 22 bp, Homo sapiens
acattctgttggagttccctca

SEQ ID NO: 5965520 - DNA, 15 bp, Homo sapiens
acattcttataaata

SEQ ID NO: 5965521 - DNA, 21 bp, Homo sapiens
acattcttcactgtctgttgt

SEQ ID NO: 5965522 - DNA, 19 bp, Homo sapiens
acattcttccatcatcact

SEQ ID NO: 5965523 - DNA, 21 bp, Homo sapiens
acattcttccatcatcactgt

SEQ ID NO: 5965524 - DNA, 14 bp, Homo sapiens
acattcttgctctg

SEQ ID NO: 5965525 - DNA, 11 bp, Homo sapiens
acattcttgta

SEQ ID NO: 5965526 - DNA, 20 bp, Homo sapiens
acattctttataaaatgtat

SEQ ID NO: 5965527 - DNA, 12 bp, Homo sapiens
acattcttttaa

SEQ ID NO: 5965528 - DNA, 21 bp, Homo sapiens
acattcttttaacttctttct

SEQ ID NO: 5965529 - DNA, 19 bp, Homo sapiens
acattctttttgctctaaa

SEQ ID NO: 5965530 - DNA, 13 bp, Homo sapiens
acattgaaaacag

SEQ ID NO: 5965531 - DNA, 15 bp, Homo sapiens
acattgaaaacagat

SEQ ID NO: 5965532 - DNA, 19 bp, Homo sapiens
acattgaaatctaggaaaa

SEQ ID NO: 5965533 - DNA, 23 bp, Homo sapiens
acattgaaatctaggaaaattat

SEQ ID NO: 5965534 - DNA, 20 bp, Homo sapiens
acattgaagtaatgaatttt

SEQ ID NO: 5965535 - DNA, 14 bp, Homo sapiens
acattgaattcatt

SEQ ID NO: 5965536 - DNA, 16 bp, Homo sapiens
acattgaattcattat

SEQ ID NO: 5965537 - DNA, 22 bp, Homo sapiens
acattgacagcaattcatggtt

SEQ ID NO: 5965538 - DNA, 19 bp, Homo sapiens
acattgacccagaaatgta

SEQ ID NO: 5965539 - DNA, 20 bp, Homo sapiens
acattgacgattccttctct

SEQ ID NO: 5965540 - DNA, 14 bp, Homo sapiens
acattgactatttt

SEQ ID NO: 5965541 - DNA, 16 bp, Homo sapiens
acattgacttcttggt

SEQ ID NO: 5965542 - DNA, 22 bp, Homo sapiens
acattgagactgctagaaccaa

SEQ ID NO: 5965543 - DNA, 15 bp, Homo sapiens
acattgagcatttga

SEQ ID NO: 5965544 - DNA, 23 bp, Homo sapiens
acattgagctgatataaattctg

SEQ ID NO: 5965545 - DNA, 22 bp, Homo sapiens
acattgagtagacacatttaag

SEQ ID NO: 5965546 - DNA, 20 bp, Homo sapiens
acattgagtttacttataaa

SEQ ID NO: 5965547 - DNA, 20 bp, Homo sapiens
acattgatccagtcatttta

SEQ ID NO: 5965548 - DNA, 18 bp, Homo sapiens
acattgatctgttttaca

SEQ ID NO: 5965549 - DNA, 22 bp, Homo sapiens
acattgatctgttttacaggaa

SEQ ID NO: 5965550 - DNA, 14 bp, Homo sapiens
acattgatgaatga

SEQ ID NO: 5965551 - DNA, 21 bp, Homo sapiens
acattgatgtaaggactgtaa

SEQ ID NO: 5965552 - DNA, 22 bp, Homo sapiens
acattgatgtaaggactgtaaa

SEQ ID NO: 5965553 - DNA, 14 bp, Homo sapiens
acattgatgtgttc

SEQ ID NO: 5965554 - DNA, 16 bp, Homo sapiens
acattgattcagcctg

SEQ ID NO: 5965555 - DNA, 22 bp, Homo sapiens
acattgattggataaatgctta

SEQ ID NO: 5965556 - DNA, 22 bp, Homo sapiens
acattgattttaaaaatacatt

SEQ ID NO: 5965557 - DNA, 18 bp, Homo sapiens
acattgcactcatcatat

SEQ ID NO: 5965558 - DNA, 12 bp, Homo sapiens
acattgcagagt

SEQ ID NO: 5965559 - DNA, 19 bp, Homo sapiens
acattgcatataacttata

SEQ ID NO: 5965560 - DNA, 11 bp, Homo sapiens
acattgcattc

SEQ ID NO: 5965561 - DNA, 22 bp, Homo sapiens
acattgcattctattgccttct

SEQ ID NO: 5965562 - DNA, 14 bp, Homo sapiens
acattgcattgtga

SEQ ID NO: 5965563 - DNA, 20 bp, Homo sapiens
acattgcccatggctgggaa

SEQ ID NO: 5965564 - DNA, 15 bp, Homo sapiens
acattgccccaagat

SEQ ID NO: 5965565 - DNA, 16 bp, Homo sapiens
acattgccctgagggg

SEQ ID NO: 5965566 - DNA, 21 bp, Homo sapiens
acattgccctgaggggcctgc

SEQ ID NO: 5965567 - DNA, 22 bp, Homo sapiens
acattgccctgaggggcctgcc

SEQ ID NO: 5965568 - DNA, 11 bp, Homo sapiens
acattgcctca

SEQ ID NO: 5965569 - DNA, 12 bp, Homo sapiens
acattgcctcat

SEQ ID NO: 5965570 - DNA, 13 bp, Homo sapiens
acattgcctcatt

SEQ ID NO: 5965571 - DNA, 12 bp, Homo sapiens
acattgcctcca

SEQ ID NO: 5965572 - DNA, 19 bp, Homo sapiens
acattgcctgttctgcttc

SEQ ID NO: 5965573 - DNA, 20 bp, Homo sapiens
acattgcctgttctgcttcg

SEQ ID NO: 5965574 - DNA, 21 bp, Homo sapiens
acattgcctgttctgcttcga

SEQ ID NO: 5965575 - DNA, 13 bp, Homo sapiens
acattgccttcct

SEQ ID NO: 5965576 - DNA, 14 bp, Homo sapiens
acattgccttcctc

SEQ ID NO: 5965577 - DNA, 12 bp, Homo sapiens
acattgcctttg

SEQ ID NO: 5965578 - DNA, 17 bp, Homo sapiens
acattgcctttgaatgt

SEQ ID NO: 5965579 - DNA, 22 bp, Homo sapiens
acattgcggacagccacggcca

SEQ ID NO: 5965580 - DNA, 21 bp, Homo sapiens
acattgctagcgagccgcctc

SEQ ID NO: 5965581 - DNA, 21 bp, Homo sapiens
acattgctccaagatgttctc

SEQ ID NO: 5965582 - DNA, 15 bp, Homo sapiens
acattgctgcctttg

SEQ ID NO: 5965583 - DNA, 19 bp, Homo sapiens
acattgctttagacaaatt

SEQ ID NO: 5965584 - DNA, 14 bp, Homo sapiens
acattgcttttaaa

SEQ ID NO: 5965585 - DNA, 14 bp, Homo sapiens
acattgcttttgaa

SEQ ID NO: 5965586 - DNA, 15 bp, Homo sapiens
acattggaaagcaca

SEQ ID NO: 5965587 - DNA, 21 bp, Homo sapiens
acattggacagaaaatgcaat

SEQ ID NO: 5965588 - DNA, 22 bp, Homo sapiens
acattggagatgccatcctctt

SEQ ID NO: 5965589 - DNA, 16 bp, Homo sapiens
acattggagcctgggc

SEQ ID NO: 5965590 - DNA, 17 bp, Homo sapiens
acattgggaaatcttat

SEQ ID NO: 5965591 - DNA, 20 bp, Homo sapiens
acattgggcagcgcccttcc

SEQ ID NO: 5965592 - DNA, 22 bp, Homo sapiens
acattgggcagcgcccttcctc

SEQ ID NO: 5965593 - DNA, 23 bp, Homo sapiens
acattgggtcctgggtctttcat

SEQ ID NO: 5965594 - DNA, 16 bp, Homo sapiens
acattgggtctattcc

SEQ ID NO: 5965595 - DNA, 18 bp, Homo sapiens
acattgggtctattccag

SEQ ID NO: 5965596 - DNA, 21 bp, Homo sapiens
acattgggtctattccagctc

SEQ ID NO: 5965597 - DNA, 20 bp, Homo sapiens
acattgggtggggctcctgg

SEQ ID NO: 5965598 - DNA, 23 bp, Homo sapiens
acattgggtggggctcctgggag

SEQ ID NO: 5965599 - DNA, 18 bp, Homo sapiens
acattggttcttgtatta

SEQ ID NO: 5965600 - DNA, 22 bp, Homo sapiens
acatttctttcttgctggctct

SEQ ID NO: 5965601 - DNA, 19 bp, Homo sapiens
acatttctttgtgctttgg

SEQ ID NO: 5965602 - DNA, 14 bp, Homo sapiens
acatttcttttctt

SEQ ID NO: 5965603 - DNA, 13 bp, Homo sapiens
acataatttcagt

SEQ ID NO: 5965604 - DNA, 13 bp, Homo sapiens
acataatttctgt

SEQ ID NO: 5965605 - DNA, 11 bp, Homo sapiens
acataatttgc

SEQ ID NO: 5965606 - DNA, 13 bp, Homo sapiens
acataatttgcaa

SEQ ID NO: 5965607 - DNA, 14 bp, Homo sapiens
acataatttgcaat

SEQ ID NO: 5965608 - DNA, 14 bp, Homo sapiens
acataatttgcata

SEQ ID NO: 5965609 - DNA, 18 bp, Homo sapiens
acataatttgcataaagg

SEQ ID NO: 5965610 - DNA, 14 bp, Homo sapiens
acataatttttgta

SEQ ID NO: 5965611 - DNA, 16 bp, Homo sapiens
acataatttttgtaca

SEQ ID NO: 5965612 - DNA, 18 bp, Homo sapiens
acatacaaaaaaaatctt

SEQ ID NO: 5965613 - DNA, 20 bp, Homo sapiens
acatacaaaaaaaatcttta

SEQ ID NO: 5965614 - DNA, 21 bp, Homo sapiens
acatacaaaaattagccgggc

SEQ ID NO: 5965615 - DNA, 11 bp, Homo sapiens
acatacaaatg

SEQ ID NO: 5965616 - DNA, 17 bp, Homo sapiens
acatacaacacaaagag

SEQ ID NO: 5965617 - DNA, 19 bp, Homo sapiens
acatacaacctatgtaatt

SEQ ID NO: 5965618 - DNA, 16 bp, Homo sapiens
acatacaagaaaatgt

SEQ ID NO: 5965619 - DNA, 16 bp, Homo sapiens
acatacaattattttt

SEQ ID NO: 5965620 - DNA, 13 bp, Homo sapiens
acatacaatttgc

SEQ ID NO: 5965621 - DNA, 20 bp, Homo sapiens
acatacaatttgcactgtta

SEQ ID NO: 5965622 - DNA, 21 bp, Homo sapiens
acatacacaaggccagaaaaa

SEQ ID NO: 5965623 - DNA, 22 bp, Homo sapiens
acatacacaaggccagaaaaag

SEQ ID NO: 5965624 - DNA, 13 bp, Homo sapiens
acatacacacaca

SEQ ID NO: 5965625 - DNA, 15 bp, Homo sapiens
acatacacacacaca

SEQ ID NO: 5965626 - DNA, 16 bp, Homo sapiens
acatacacacatatgt

SEQ ID NO: 5965627 - DNA, 22 bp, Homo sapiens
acatacacccaaacacttacac

SEQ ID NO: 5965628 - DNA, 21 bp, Homo sapiens
acatacacctatgtcatttca

SEQ ID NO: 5965629 - DNA, 19 bp, Homo sapiens
acatacacttgtataaatg

SEQ ID NO: 5965630 - DNA, 18 bp, Homo sapiens
acatacagaattactgta

SEQ ID NO: 5965631 - DNA, 14 bp, Homo sapiens
acatacagacacat

SEQ ID NO: 5965632 - DNA, 23 bp, Homo sapiens
acatacagagtgggccccgggct

SEQ ID NO: 5965633 - DNA, 15 bp, Homo sapiens
acatacataatacaa

SEQ ID NO: 5965634 - DNA, 17 bp, Homo sapiens
acatacataatggtact

SEQ ID NO: 5965635 - DNA, 20 bp, Homo sapiens
acatacataatgtttttcct

SEQ ID NO: 5965636 - DNA, 14 bp, Homo sapiens
acatacatacatac

SEQ ID NO: 5965637 - DNA, 16 bp, Homo sapiens
acatacatacatacaa

SEQ ID NO: 5965638 - DNA, 16 bp, Homo sapiens
acatacatacatacat

SEQ ID NO: 5965639 - DNA, 12 bp, Homo sapiens
acatacatatat

SEQ ID NO: 5965640 - DNA, 14 bp, Homo sapiens
acatacatatatac

SEQ ID NO: 5965641 - DNA, 17 bp, Homo sapiens
acatacatatatatatc

SEQ ID NO: 5965642 - DNA, 18 bp, Homo sapiens
acatacatatatatctga

SEQ ID NO: 5965643 - DNA, 14 bp, Homo sapiens
acatacattaaaac

SEQ ID NO: 5965644 - DNA, 15 bp, Homo sapiens
acatacattaaaact

SEQ ID NO: 5965645 - DNA, 21 bp, Homo sapiens
acatacatttaaaaaacattt

SEQ ID NO: 5965646 - DNA, 14 bp, Homo sapiens
acatacattttgta

SEQ ID NO: 5965647 - DNA, 23 bp, Homo sapiens
acataccaccaccaagaaagcct

SEQ ID NO: 5965648 - DNA, 20 bp, Homo sapiens
acataccaggcaacctccca

SEQ ID NO: 5965649 - DNA, 19 bp, Homo sapiens
acatacccacacattccag

SEQ ID NO: 5965650 - DNA, 22 bp, Homo sapiens
acatacccacacattccagggc

SEQ ID NO: 5965651 - DNA, 19 bp, Homo sapiens
acataccccactgggcaca

SEQ ID NO: 5965652 - DNA, 22 bp, Homo sapiens
acataccccactgggcacacgc

SEQ ID NO: 5965653 - DNA, 20 bp, Homo sapiens
acataccccctcccccaccg

SEQ ID NO: 5965654 - DNA, 22 bp, Homo sapiens
acataccctgacctggccccct

SEQ ID NO: 5965655 - DNA, 20 bp, Homo sapiens
acataccctggccgccccct

SEQ ID NO: 5965656 - DNA, 17 bp, Homo sapiens
acatacccttctttaaa

SEQ ID NO: 5965657 - DNA, 18 bp, Homo sapiens
acatacccttctttaaat

SEQ ID NO: 5965658 - DNA, 20 bp, Homo sapiens
acatacccttctttaaatca

SEQ ID NO: 5965659 - DNA, 15 bp, Homo sapiens
acatacctaccagta

SEQ ID NO: 5965660 - DNA, 14 bp, Homo sapiens
acatacgaaacaca

SEQ ID NO: 5965661 - DNA, 18 bp, Homo sapiens
acatacgatttaaggtat

SEQ ID NO: 5965662 - DNA, 15 bp, Homo sapiens
acatacgcaaaaact

SEQ ID NO: 5965663 - DNA, 18 bp, Homo sapiens
acatacgcaattgtatat

SEQ ID NO: 5965664 - DNA, 23 bp, Homo sapiens
acatacgcaattgtatatatatg

SEQ ID NO: 5965665 - DNA, 15 bp, Homo sapiens
acatacgcttttaat

SEQ ID NO: 5965666 - DNA, 19 bp, Homo sapiens
acatacgggaagtttattt

SEQ ID NO: 5965667 - DNA, 19 bp, Homo sapiens
acatacgggctttaatagt

SEQ ID NO: 5965668 - DNA, 14 bp, Homo sapiens
acatacggtcaggt

SEQ ID NO: 5965669 - DNA, 15 bp, Homo sapiens
acatacgtaaaaatc

SEQ ID NO: 5965670 - DNA, 15 bp, Homo sapiens
acatacgtgtgcatg

SEQ ID NO: 5965671 - DNA, 21 bp, Homo sapiens
acatacgtgtgcatgtgtctt

SEQ ID NO: 5965672 - DNA, 12 bp, Homo sapiens
acatacgtgtta

SEQ ID NO: 5965673 - DNA, 18 bp, Homo sapiens
acatacgtgttaggaggc

SEQ ID NO: 5965674 - DNA, 14 bp, Homo sapiens
acatactacctaga

SEQ ID NO: 5965675 - DNA, 20 bp, Homo sapiens
acatactacctagaagtaag

SEQ ID NO: 5965676 - DNA, 14 bp, Homo sapiens
acatactatgaaat

SEQ ID NO: 5965677 - DNA, 12 bp, Homo sapiens
acatactcattt

SEQ ID NO: 5965678 - DNA, 13 bp, Homo sapiens
acatactcatttt

SEQ ID NO: 5965679 - DNA, 17 bp, Homo sapiens
acatactcatttttcat

SEQ ID NO: 5965680 - DNA, 23 bp, Homo sapiens
acatactccttaatttacctgtt

SEQ ID NO: 5965681 - DNA, 13 bp, Homo sapiens
acatactgcatgt

SEQ ID NO: 5965682 - DNA, 19 bp, Homo sapiens
acatactgcatgtaagcca

SEQ ID NO: 5965683 - DNA, 12 bp, Homo sapiens
acatactgctgt

SEQ ID NO: 5965684 - DNA, 13 bp, Homo sapiens
acatactggcctc

SEQ ID NO: 5965685 - DNA, 15 bp, Homo sapiens
acatactgtattttt

SEQ ID NO: 5965686 - DNA, 14 bp, Homo sapiens
acatacttacattt

SEQ ID NO: 5965687 - DNA, 20 bp, Homo sapiens
acatacttcaaaaataatgt

SEQ ID NO: 5965688 - DNA, 22 bp, Homo sapiens
acatacttcaaaaataatgtgc

SEQ ID NO: 5965689 - DNA, 16 bp, Homo sapiens
acatacttgaagggcc

SEQ ID NO: 5965690 - DNA, 20 bp, Homo sapiens
acatacttgaagggccagag

SEQ ID NO: 5965691 - DNA, 22 bp, Homo sapiens
acatacttgaagggccagagcc

SEQ ID NO: 5965692 - DNA, 15 bp, Homo sapiens
acatactttttcaag

SEQ ID NO: 5965693 - DNA, 20 bp, Homo sapiens
acatactttttgggtttatt

SEQ ID NO: 5965694 - DNA, 13 bp, Homo sapiens
acatagaaacata

SEQ ID NO: 5965695 - DNA, 16 bp, Homo sapiens
acatagacagaagaaa

SEQ ID NO: 5965696 - DNA, 17 bp, Homo sapiens
acatagacagaagaaac

SEQ ID NO: 5965697 - DNA, 18 bp, Homo sapiens
acatagacagaagaaaca

SEQ ID NO: 5965698 - DNA, 14 bp, Homo sapiens
acatagacagatgt

SEQ ID NO: 5965699 - DNA, 18 bp, Homo sapiens
acatagacagatgtggac

SEQ ID NO: 5965700 - DNA, 16 bp, Homo sapiens
acatagactagagaaa

SEQ ID NO: 5965701 - DNA, 21 bp, Homo sapiens
acatagactttatgcaataaa

SEQ ID NO: 5965702 - DNA, 20 bp, Homo sapiens
acatagagagggagaagaag

SEQ ID NO: 5965703 - DNA, 23 bp, Homo sapiens
acatagagagggagaagaagtca

SEQ ID NO: 5965704 - DNA, 18 bp, Homo sapiens
acatagagatatgcacac

SEQ ID NO: 5965705 - DNA, 22 bp, Homo sapiens
acatagagatcatcctttccag

SEQ ID NO: 5965706 - DNA, 22 bp, Homo sapiens
acatagagccgggtgtccccaa

SEQ ID NO: 5965707 - DNA, 18 bp, Homo sapiens
acatagatattttcacaa

SEQ ID NO: 5965708 - DNA, 20 bp, Homo sapiens
acatagatcagccattaaaa

SEQ ID NO: 5965709 - DNA, 21 bp, Homo sapiens
acatagatcagccattaaaat

SEQ ID NO: 5965710 - DNA, 14 bp, Homo sapiens
acatagatggacca

SEQ ID NO: 5965711 - DNA, 18 bp, Homo sapiens
acatagatgtatcattaa

SEQ ID NO: 5965712 - DNA, 13 bp, Homo sapiens
acatagatgtccc

SEQ ID NO: 5965713 - DNA, 15 bp, Homo sapiens
acatagatgtccctt

SEQ ID NO: 5965714 - DNA, 14 bp, Homo sapiens
acatagattaatgg

SEQ ID NO: 5965715 - DNA, 12 bp, Homo sapiens
acatagcagact

SEQ ID NO: 5965716 - DNA, 14 bp, Homo sapiens
acatagcagactag

SEQ ID NO: 5965717 - DNA, 17 bp, Homo sapiens
acatagcataggctggg

SEQ ID NO: 5965718 - DNA, 20 bp, Homo sapiens
acatagcatccaagtggcat

SEQ ID NO: 5965719 - DNA, 16 bp, Homo sapiens
acatagcatgacattt

SEQ ID NO: 5965720 - DNA, 22 bp, Homo sapiens
acatagcatgcttcctttctct

SEQ ID NO: 5965721 - DNA, 19 bp, Homo sapiens
acatagccaaaatgtgagt

SEQ ID NO: 5965722 - DNA, 18 bp, Homo sapiens
acatagccaactctccca

SEQ ID NO: 5965723 - DNA, 13 bp, Homo sapiens
acatagcccctgc

SEQ ID NO: 5965724 - DNA, 19 bp, Homo sapiens
acatagccgattctctgcc

SEQ ID NO: 5965725 - DNA, 20 bp, Homo sapiens
acatagcctatatttacagt

SEQ ID NO: 5965726 - DNA, 11 bp, Homo sapiens
acatagccttt

SEQ ID NO: 5965727 - DNA, 12 bp, Homo sapiens
acatagcctttg

SEQ ID NO: 5965728 - DNA, 22 bp, Homo sapiens
acatagcgccgtgctgtaaata

SEQ ID NO: 5965729 - DNA, 17 bp, Homo sapiens
acatagctctgaagtta

SEQ ID NO: 5965730 - DNA, 20 bp, Homo sapiens
acatagctctgaagttaaaa

SEQ ID NO: 5965731 - DNA, 21 bp, Homo sapiens
acatagcttacaagccagctg

SEQ ID NO: 5965732 - DNA, 19 bp, Homo sapiens
acataggaagggatctgag

SEQ ID NO: 5965733 - DNA, 16 bp, Homo sapiens
acataggactcaaagt

SEQ ID NO: 5965734 - DNA, 17 bp, Homo sapiens
acataggcaagaggagt

SEQ ID NO: 5965735 - DNA, 16 bp, Homo sapiens
acataggcacaggcaa

SEQ ID NO: 5965736 - DNA, 22 bp, Homo sapiens
acataggcagtagcctcctcct

SEQ ID NO: 5965737 - DNA, 20 bp, Homo sapiens
acataggccaaggcccaact

SEQ ID NO: 5965738 - DNA, 20 bp, Homo sapiens
acataggcttcaattggtgg

SEQ ID NO: 5965739 - DNA, 21 bp, Homo sapiens
acataggcttcaattggtgga

SEQ ID NO: 5965740 - DNA, 19 bp, Homo sapiens
acataggcttctattacct

SEQ ID NO: 5965741 - DNA, 20 bp, Homo sapiens
acataggcttctattaccta

SEQ ID NO: 5965742 - DNA, 16 bp, Homo sapiens
acatagggttcccacg

SEQ ID NO: 5965743 - DNA, 14 bp, Homo sapiens
acataggtataatt

SEQ ID NO: 5965744 - DNA, 22 bp, Homo sapiens
acataggtcataaagcattgga

SEQ ID NO: 5965745 - DNA, 15 bp, Homo sapiens
acataggtgtgcttc

SEQ ID NO: 5965746 - DNA, 14 bp, Homo sapiens
acatagtaaagtat

SEQ ID NO: 5965747 - DNA, 17 bp, Homo sapiens
acatagtaagttcagca

SEQ ID NO: 5965748 - DNA, 20 bp, Homo sapiens
acatagtaagttcagcactt

SEQ ID NO: 5965749 - DNA, 22 bp, Homo sapiens
acatagtaattcttaagtcttt

SEQ ID NO: 5965750 - DNA, 19 bp, Homo sapiens
acatagtcctcagggctca

SEQ ID NO: 5965751 - DNA, 15 bp, Homo sapiens
acatagtctggctgt

SEQ ID NO: 5965752 - DNA, 17 bp, Homo sapiens
acatagtctttgtttac

SEQ ID NO: 5965753 - DNA, 14 bp, Homo sapiens
acatagtgaaaatt

SEQ ID NO: 5965754 - DNA, 21 bp, Homo sapiens
acatagtgaattttaaaatgt

SEQ ID NO: 5965755 - DNA, 21 bp, Homo sapiens
acatagtgagaccctgtctct

SEQ ID NO: 5965756 - DNA, 22 bp, Homo sapiens
acatagtgagaccctgtctcta

SEQ ID NO: 5965757 - DNA, 19 bp, Homo sapiens
acatagtgcaaaactgtgt

SEQ ID NO: 5965758 - DNA, 14 bp, Homo sapiens
acatagtggatgga

SEQ ID NO: 5965759 - DNA, 23 bp, Homo sapiens
acatagtggatggacagatggac

SEQ ID NO: 5965760 - DNA, 19 bp, Homo sapiens
acatagtgggccttcatta

SEQ ID NO: 5965761 - DNA, 21 bp, Homo sapiens
acatagtggtattttaacata

SEQ ID NO: 5965762 - DNA, 17 bp, Homo sapiens
acatagtgtaggcttta

SEQ ID NO: 5965763 - DNA, 18 bp, Homo sapiens
acatagtgtcctgcccac

SEQ ID NO: 5965764 - DNA, 17 bp, Homo sapiens
acatagttcgtttacct

SEQ ID NO: 5965765 - DNA, 17 bp, Homo sapiens
acatagttctgtaataa

SEQ ID NO: 5965766 - DNA, 21 bp, Homo sapiens
acatagttctgtaataaaact

SEQ ID NO: 5965767 - DNA, 19 bp, Homo sapiens
acatagttttaaactcatt

SEQ ID NO: 5965768 - DNA, 22 bp, Homo sapiens
acatagttttcttcctttgaaa

SEQ ID NO: 5965769 - DNA, 13 bp, Homo sapiens
acatagtttttaa

SEQ ID NO: 5965770 - DNA, 15 bp, Homo sapiens
acatagtttttcctg

SEQ ID NO: 5965771 - DNA, 22 bp, Homo sapiens
acatataaaagttaaactactt

SEQ ID NO: 5965772 - DNA, 22 bp, Homo sapiens
acatataaaataatgcaaagaa

SEQ ID NO: 5965773 - DNA, 15 bp, Homo sapiens
acatataaagattaa

SEQ ID NO: 5965774 - DNA, 21 bp, Homo sapiens
acatataaagcactatacaga

SEQ ID NO: 5965775 - DNA, 21 bp, Homo sapiens
acatataaatagatgatttca

SEQ ID NO: 5965776 - DNA, 19 bp, Homo sapiens
acatataaattaatacata

SEQ ID NO: 5965777 - DNA, 11 bp, Homo sapiens
acatcagccag

SEQ ID NO: 5965778 - DNA, 12 bp, Homo sapiens
acatcagccagc

SEQ ID NO: 5965779 - DNA, 13 bp, Homo sapiens
acatcagccagct

SEQ ID NO: 5965780 - DNA, 14 bp, Homo sapiens
acatcagccatttt

SEQ ID NO: 5965781 - DNA, 17 bp, Homo sapiens
acatcagccccacagga

SEQ ID NO: 5965782 - DNA, 21 bp, Homo sapiens
acatcagcccggtgtgaggag

SEQ ID NO: 5965783 - DNA, 12 bp, Homo sapiens
acatcagccttc

SEQ ID NO: 5965784 - DNA, 18 bp, Homo sapiens
accaaaaccatccatccc

SEQ ID NO: 5965785 - DNA, 22 bp, Homo sapiens
accaaaacccatcgtggtatgt

SEQ ID NO: 5965786 - DNA, 14 bp, Homo sapiens
accaaaactgctcc

SEQ ID NO: 5965787 - DNA, 17 bp, Homo sapiens
accaaaactgtgcagag

SEQ ID NO: 5965788 - DNA, 13 bp, Homo sapiens
accaaaacttcca

SEQ ID NO: 5965789 - DNA, 14 bp, Homo sapiens
accaaaagaagtaa

SEQ ID NO: 5965790 - DNA, 14 bp, Homo sapiens
accaaaagacatta

SEQ ID NO: 5965791 - DNA, 23 bp, Homo sapiens
accaaaagacattagagaaaacc

SEQ ID NO: 5965792 - DNA, 15 bp, Homo sapiens
accaaaagatgcctt

SEQ ID NO: 5965793 - DNA, 21 bp, Homo sapiens
accaaaaggagagattattaa

SEQ ID NO: 5965794 - DNA, 23 bp, Homo sapiens
accaaaaggagagattattaaat

SEQ ID NO: 5965795 - DNA, 17 bp, Homo sapiens
accaaaagtgcattcaa

SEQ ID NO: 5965796 - DNA, 23 bp, Homo sapiens
accaaaagtgcattcaaccttac

SEQ ID NO: 5965797 - DNA, 21 bp, Homo sapiens
accaaaagttacatgtttgca

SEQ ID NO: 5965798 - DNA, 23 bp, Homo sapiens
accaaaagttacatgtttgcacc

SEQ ID NO: 5965799 - DNA, 16 bp, Homo sapiens
accaaaagttattaaa

SEQ ID NO: 5965800 - DNA, 19 bp, Homo sapiens
accaaaataaaaattgaaa

SEQ ID NO: 5965801 - DNA, 15 bp, Homo sapiens
accaaaataagaaaa

SEQ ID NO: 5965802 - DNA, 16 bp, Homo sapiens
accaaaataagaaaag

SEQ ID NO: 5965803 - DNA, 17 bp, Homo sapiens
accaaaataagaaaaga

SEQ ID NO: 5965804 - DNA, 16 bp, Homo sapiens
accaaaatactccaaa

SEQ ID NO: 5965805 - DNA, 17 bp, Homo sapiens
accaaaatccccttctc

SEQ ID NO: 5965806 - DNA, 11 bp, Homo sapiens
accaaaatgaa

SEQ ID NO: 5965807 - DNA, 12 bp, Homo sapiens
accaaaatgaca

SEQ ID NO: 5965808 - DNA, 16 bp, Homo sapiens
accaaaatgacaatga

SEQ ID NO: 5965809 - DNA, 21 bp, Homo sapiens
accaaaatgatacttactgaa

SEQ ID NO: 5965810 - DNA, 16 bp, Homo sapiens
accaaaatgtgtttca

SEQ ID NO: 5965811 - DNA, 16 bp, Homo sapiens
accaaaattagtttta

SEQ ID NO: 5965812 - DNA, 17 bp, Homo sapiens
accaaaattatttcaga

SEQ ID NO: 5965813 - DNA, 14 bp, Homo sapiens
accaaaattttaaa

SEQ ID NO: 5965814 - DNA, 22 bp, Homo sapiens
accaaaattttgtcccatctct

SEQ ID NO: 5965815 - DNA, 20 bp, Homo sapiens
accaaaatttttaggtgaag

SEQ ID NO: 5965816 - DNA, 14 bp, Homo sapiens
accaaacaaggaag

SEQ ID NO: 5965817 - DNA, 19 bp, Homo sapiens
accaaacaaggaagccaaa

SEQ ID NO: 5965818 - DNA, 15 bp, Homo sapiens
accaaacacccagag

SEQ ID NO: 5965819 - DNA, 14 bp, Homo sapiens
accaaacaccttca

SEQ ID NO: 5965820 - DNA, 15 bp, Homo sapiens
accaaacatgcttat

SEQ ID NO: 5965821 - DNA, 22 bp, Homo sapiens
accaaacatgcttataacatta

SEQ ID NO: 5965822 - DNA, 22 bp, Homo sapiens
accaaacatttctgtgaaacta

SEQ ID NO: 5965823 - DNA, 15 bp, Homo sapiens
accaaacccagccac

SEQ ID NO: 5965824 - DNA, 23 bp, Homo sapiens
accaaaccgcaaacgtgaaattc

SEQ ID NO: 5965825 - DNA, 14 bp, Homo sapiens
accaaaccttctga

SEQ ID NO: 5965826 - DNA, 17 bp, Homo sapiens
accaaactactgaatga

SEQ ID NO: 5965827 - DNA, 15 bp, Homo sapiens
accaaactacttcat

SEQ ID NO: 5965828 - DNA, 13 bp, Homo sapiens
accaaactcctgc

SEQ ID NO: 5965829 - DNA, 13 bp, Homo sapiens
accaaactctgtg

SEQ ID NO: 5965830 - DNA, 14 bp, Homo sapiens
accaaactctgtgt

SEQ ID NO: 5965831 - DNA, 19 bp, Homo sapiens
accaaactgggtcttcagc

SEQ ID NO: 5965832 - DNA, 17 bp, Homo sapiens
accaaacttcatttttt

SEQ ID NO: 5965833 - DNA, 20 bp, Homo sapiens
accaaacttcattttttaaa

SEQ ID NO: 5965834 - DNA, 16 bp, Homo sapiens
accaaacttgttcatt

SEQ ID NO: 5965835 - DNA, 18 bp, Homo sapiens
accaaacttgttcattta

SEQ ID NO: 5965836 - DNA, 13 bp, Homo sapiens
accaaagaaaatt

SEQ ID NO: 5965837 - DNA, 13 bp, Homo sapiens
accaaagaaagtg

SEQ ID NO: 5965838 - DNA, 22 bp, Homo sapiens
accaaagaacgtaataaaccag

SEQ ID NO: 5965839 - DNA, 13 bp, Homo sapiens
accaaagacatca

SEQ ID NO: 5965840 - DNA, 14 bp, Homo sapiens
accaaagaccaagt

SEQ ID NO: 5965841 - DNA, 22 bp, Homo sapiens
accaaagacgatacagcttggc

SEQ ID NO: 5965842 - DNA, 19 bp, Homo sapiens
accaaagactatttcaaaa

SEQ ID NO: 5965843 - DNA, 18 bp, Homo sapiens
accaaagagactggagca

SEQ ID NO: 5965844 - DNA, 22 bp, Homo sapiens
accaaagagactggagcatctg

SEQ ID NO: 5965845 - DNA, 16 bp, Homo sapiens
accaaagagtctctgg

SEQ ID NO: 5965846 - DNA, 19 bp, Homo sapiens
accaaagagtctctggctc

SEQ ID NO: 5965847 - DNA, 23 bp, Homo sapiens
accaaagatatatacacaggatc

SEQ ID NO: 5965848 - DNA, 17 bp, Homo sapiens
accaaagatctgctcct

SEQ ID NO: 5965849 - DNA, 18 bp, Homo sapiens
accaaagatgaatgaagc

SEQ ID NO: 5965850 - DNA, 13 bp, Homo sapiens
accaaagatgcag

SEQ ID NO: 5965851 - DNA, 11 bp, Homo sapiens
accaaagcaag

SEQ ID NO: 5965852 - DNA, 15 bp, Homo sapiens
accaaagcaatattt

SEQ ID NO: 5965853 - DNA, 13 bp, Homo sapiens
accaaagcatcaa

SEQ ID NO: 5965854 - DNA, 12 bp, Homo sapiens
accaaagccacc

SEQ ID NO: 5965855 - DNA, 14 bp, Homo sapiens
accaaagccacctg

SEQ ID NO: 5965856 - DNA, 15 bp, Homo sapiens
accaaagccacctgc

SEQ ID NO: 5965857 - DNA, 15 bp, Homo sapiens
accaaagcctcttca

SEQ ID NO: 5965858 - DNA, 16 bp, Homo sapiens
accaaagcgaatttta

SEQ ID NO: 5965859 - DNA, 10 bp, Homo sapiens
accaaagctg

SEQ ID NO: 5965860 - DNA, 23 bp, Homo sapiens
accaaagctgacgaggctgggcc

SEQ ID NO: 5965861 - DNA, 16 bp, Homo sapiens
accaaagctgcctgtg

SEQ ID NO: 5965862 - DNA, 19 bp, Homo sapiens
accaaagctgcctgtgcca

SEQ ID NO: 5965863 - DNA, 21 bp, Homo sapiens
accaaagctgcctgtgccatg

SEQ ID NO: 5965864 - DNA, 20 bp, Homo sapiens
accaaagctgctgcacagct

SEQ ID NO: 5965865 - DNA, 20 bp, Homo sapiens
accaaaggaatcgtttcaaa

SEQ ID NO: 5965866 - DNA, 17 bp, Homo sapiens
accaaaggacattatgt

SEQ ID NO: 5965867 - DNA, 19 bp, Homo sapiens
accaaaggagacatatcac

SEQ ID NO: 5965868 - DNA, 13 bp, Homo sapiens
accaaaggccagg

SEQ ID NO: 5965869 - DNA, 18 bp, Homo sapiens
accaaagtatttttttat

SEQ ID NO: 5965870 - DNA, 14 bp, Homo sapiens
accaaagtctaaac

SEQ ID NO: 5965871 - DNA, 13 bp, Homo sapiens
accaaagtctgcc

SEQ ID NO: 5965872 - DNA, 22 bp, Homo sapiens
accaaagtctgccgcccacctc

SEQ ID NO: 5965873 - DNA, 19 bp, Homo sapiens
accaaagtgtcttttgaca

SEQ ID NO: 5965874 - DNA, 20 bp, Homo sapiens
accaaagttctaataatttc

SEQ ID NO: 5965875 - DNA, 24 bp, Homo sapiens
accaaagttgttttacagctgtgt

SEQ ID NO: 5965876 - DNA, 12 bp, Homo sapiens
accaaagtttta

SEQ ID NO: 5965877 - DNA, 18 bp, Homo sapiens
accaaataaaaatattgt

SEQ ID NO: 5965878 - DNA, 14 bp, Homo sapiens
accaaataagaata

SEQ ID NO: 5965879 - DNA, 19 bp, Homo sapiens
accaaataatttcatattc

SEQ ID NO: 5965880 - DNA, 16 bp, Homo sapiens
accaaatacacatttc

SEQ ID NO: 5965881 - DNA, 12 bp, Homo sapiens
accaaataggct

SEQ ID NO: 5965882 - DNA, 19 bp, Homo sapiens
accaaatagtgattgtaac

SEQ ID NO: 5965883 - DNA, 16 bp, Homo sapiens
accaaatagtgtgaaa

SEQ ID NO: 5965884 - DNA, 21 bp, Homo sapiens
accaaatataaacttgtgtat

SEQ ID NO: 5965885 - DNA, 21 bp, Homo sapiens
accaaatatcaccaggactgt

SEQ ID NO: 5965886 - DNA, 14 bp, Homo sapiens
accaaatatgttaa

SEQ ID NO: 5965887 - DNA, 14 bp, Homo sapiens
accaaatattttag

SEQ ID NO: 5965888 - DNA, 20 bp, Homo sapiens
accaaatcacccaatcccag

SEQ ID NO: 5965889 - DNA, 16 bp, Homo sapiens
accaaatcagctgcta

SEQ ID NO: 5965890 - DNA, 13 bp, Homo sapiens
accaaatctcagt

SEQ ID NO: 5965891 - DNA, 18 bp, Homo sapiens
accaaatctgacatatta

SEQ ID NO: 5965892 - DNA, 17 bp, Homo sapiens
accaaatcttgttattg

SEQ ID NO: 5965893 - DNA, 16 bp, Homo sapiens
accaaatgaaatgcca

SEQ ID NO: 5965894 - DNA, 17 bp, Homo sapiens
accaaatgaaatgccaa

SEQ ID NO: 5965895 - DNA, 18 bp, Homo sapiens
accaaatgaaatgccaaa

SEQ ID NO: 5965896 - DNA, 15 bp, Homo sapiens
accaaatgatgccac

SEQ ID NO: 5965897 - DNA, 16 bp, Homo sapiens
accaaatgcatcaatc

SEQ ID NO: 5965898 - DNA, 19 bp, Homo sapiens
accaaatgcctctgccttg

SEQ ID NO: 5965899 - DNA, 16 bp, Homo sapiens
accaaatgcctgttgt

SEQ ID NO: 5965900 - DNA, 22 bp, Homo sapiens
accaaatgctttaaaaactatt

SEQ ID NO: 5965901 - DNA, 19 bp, Homo sapiens
accaaatggttcttacttt

SEQ ID NO: 5965902 - DNA, 13 bp, Homo sapiens
accaaatgtaaaa

SEQ ID NO: 5965903 - DNA, 17 bp, Homo sapiens
accaaatgtagttttgt

SEQ ID NO: 5965904 - DNA, 18 bp, Homo sapiens
accaaatgtttattttct

SEQ ID NO: 5965905 - DNA, 19 bp, Homo sapiens
accaaattaaaaatttttt

SEQ ID NO: 5965906 - DNA, 20 bp, Homo sapiens
accaaattaacttacttcca

SEQ ID NO: 5965907 - DNA, 16 bp, Homo sapiens
accaaattatcttgat

SEQ ID NO: 5965908 - DNA, 23 bp, Homo sapiens
accaaattcagcctactgcctcg

SEQ ID NO: 5965909 - DNA, 14 bp, Homo sapiens
accaaattccttgg

SEQ ID NO: 5965910 - DNA, 13 bp, Homo sapiens
accaaattctatc

SEQ ID NO: 5965911 - DNA, 19 bp, Homo sapiens
accaaattctatcctgtga

SEQ ID NO: 5965912 - DNA, 17 bp, Homo sapiens
accaaattgagctaggg

SEQ ID NO: 5965913 - DNA, 19 bp, Homo sapiens
accaaattgcactgaagtt

SEQ ID NO: 5965914 - DNA, 15 bp, Homo sapiens
accaaattgctgaga

SEQ ID NO: 5965915 - DNA, 17 bp, Homo sapiens
accaaattgctgagatg

SEQ ID NO: 5965916 - DNA, 23 bp, Homo sapiens
accaaattgcttctaggagtcaa

SEQ ID NO: 5965917 - DNA, 15 bp, Homo sapiens
accaaattgcttgag

SEQ ID NO: 5965918 - DNA, 14 bp, Homo sapiens
accaaattttaaaa

SEQ ID NO: 5965919 - DNA, 19 bp, Homo sapiens
accaaattttgaggtcttt

SEQ ID NO: 5965920 - DNA, 22 bp, Homo sapiens
accaacaataaatatgtattac

SEQ ID NO: 5965921 - DNA, 15 bp, Homo sapiens
accaacaatataaac

SEQ ID NO: 5965922 - DNA, 21 bp, Homo sapiens
accaacaattaggtctgcatt

SEQ ID NO: 5965923 - DNA, 11 bp, Homo sapiens
accaacaccat

SEQ ID NO: 5965924 - DNA, 16 bp, Homo sapiens
accaacaccatcacag

SEQ ID NO: 5965925 - DNA, 22 bp, Homo sapiens
accaacacccaaagcatggact

SEQ ID NO: 5965926 - DNA, 18 bp, Homo sapiens
accaacactgtaacattt

SEQ ID NO: 5965927 - DNA, 17 bp, Homo sapiens
accaacagaaacctttt

SEQ ID NO: 5965928 - DNA, 18 bp, Homo sapiens
accaacagaacccacagt

SEQ ID NO: 5965929 - DNA, 20 bp, Homo sapiens
accaacagaacccacagtag

SEQ ID NO: 5965930 - DNA, 15 bp, Homo sapiens
accaacagcttttcc

SEQ ID NO: 5965931 - DNA, 18 bp, Homo sapiens
accaacaggtttatctga

SEQ ID NO: 5965932 - DNA, 23 bp, Homo sapiens
accaacatggagaaaccctgtct

SEQ ID NO: 5965933 - DNA, 24 bp, Homo sapiens
accaacatggagaaaccctgtctc

SEQ ID NO: 5965934 - DNA, 13 bp, Homo sapiens
accaaccaggcct

SEQ ID NO: 5965935 - DNA, 14 bp, Homo sapiens
accaacccaaatat

SEQ ID NO: 5965936 - DNA, 12 bp, Homo sapiens
accaacccagcc

SEQ ID NO: 5965937 - DNA, 14 bp, Homo sapiens
accaacccagccgc

SEQ ID NO: 5965938 - DNA, 16 bp, Homo sapiens
accaacccagccgctg

SEQ ID NO: 5965939 - DNA, 13 bp, Homo sapiens
accaacccctgac

SEQ ID NO: 5965940 - DNA, 21 bp, Homo sapiens
accaaccctcagggcaaagcc

SEQ ID NO: 5965941 - DNA, 14 bp, Homo sapiens
accaaccctgggac

SEQ ID NO: 5965942 - DNA, 15 bp, Homo sapiens
accaaccctgtgggc

SEQ ID NO: 5965943 - DNA, 20 bp, Homo sapiens
accaaccgaacatgaccaaa

SEQ ID NO: 5965944 - DNA, 13 bp, Homo sapiens
accaacctccaga

SEQ ID NO: 5965945 - DNA, 18 bp, Homo sapiens
accaacctccagactcag

SEQ ID NO: 5965946 - DNA, 14 bp, Homo sapiens
accaacctgaccta

SEQ ID NO: 5965947 - DNA, 22 bp, Homo sapiens
accaacctgacctaacctagga

SEQ ID NO: 5965948 - DNA, 14 bp, Homo sapiens
accaacctgctctg

SEQ ID NO: 5965949 - DNA, 15 bp, Homo sapiens
accaacctgctctgt

SEQ ID NO: 5965950 - DNA, 22 bp, Homo sapiens
accaacctggccaacatggtga

SEQ ID NO: 5965951 - DNA, 13 bp, Homo sapiens
accaacctgtttc

SEQ ID NO: 5965952 - DNA, 17 bp, Homo sapiens
accaacctttaaaattg

SEQ ID NO: 5965953 - DNA, 14 bp, Homo sapiens
accaacctttctga

SEQ ID NO: 5965954 - DNA, 16 bp, Homo sapiens
accaacctttctgaca

SEQ ID NO: 5965955 - DNA, 23 bp, Homo sapiens
accaacgggtctgtgggactggc

SEQ ID NO: 5965956 - DNA, 15 bp, Homo sapiens
accaactaagttgta

SEQ ID NO: 5965957 - DNA, 12 bp, Homo sapiens
agaggctgagac

SEQ ID NO: 5965958 - DNA, 14 bp, Homo sapiens
agaggctgagcacc

SEQ ID NO: 5965959 - DNA, 14 bp, Homo sapiens
agaggctgagccct

SEQ ID NO: 5965960 - DNA, 15 bp, Homo sapiens
agaggctgagccctg

SEQ ID NO: 5965961 - DNA, 13 bp, Homo sapiens
agaggctgaggac

SEQ ID NO: 5965962 - DNA, 10 bp, Homo sapiens
agaggctgca

SEQ ID NO: 5965963 - DNA, 23 bp, Homo sapiens
agaggctgcacccctgggccagc

SEQ ID NO: 5965964 - DNA, 18 bp, Homo sapiens
agaggctgcactgcagcc

SEQ ID NO: 5965965 - DNA, 14 bp, Homo sapiens
agaggctgcacttg

SEQ ID NO: 5965966 - DNA, 22 bp, Homo sapiens
agaggctgcagaaggccaagaa

SEQ ID NO: 5965967 - DNA, 20 bp, Homo sapiens
agaggctgcccctctcacca

SEQ ID NO: 5965968 - DNA, 19 bp, Homo sapiens
agaggctgcctcagccagt

SEQ ID NO: 5965969 - DNA, 16 bp, Homo sapiens
agaggctgcctccgca

SEQ ID NO: 5965970 - DNA, 13 bp, Homo sapiens
agaggctgctgtc

SEQ ID NO: 5965971 - DNA, 15 bp, Homo sapiens
agaggctgctgtcac

SEQ ID NO: 5965972 - DNA, 16 bp, Homo sapiens
agaggctggaggcagg

SEQ ID NO: 5965973 - DNA, 17 bp, Homo sapiens
agaggctggaggcaggg

SEQ ID NO: 5965974 - DNA, 20 bp, Homo sapiens
agaggctggaggcagggcct

SEQ ID NO: 5965975 - DNA, 23 bp, Homo sapiens
agaggctggatgacttgctcaag

SEQ ID NO: 5965976 - DNA, 15 bp, Homo sapiens
agaggctggcaagga

SEQ ID NO: 5965977 - DNA, 22 bp, Homo sapiens
agaggctggcactgagcctgct

SEQ ID NO: 5965978 - DNA, 22 bp, Homo sapiens
agaggctgggagtccctacctg

SEQ ID NO: 5965979 - DNA, 10 bp, Homo sapiens
agaggctggt

SEQ ID NO: 5965980 - DNA, 22 bp, Homo sapiens
agaggctggtgctgtggccagg

SEQ ID NO: 5965981 - DNA, 20 bp, Homo sapiens
agaggctgtggtcagagagg

SEQ ID NO: 5965982 - DNA, 23 bp, Homo sapiens
agaggctgtggtggctgtctctg

SEQ ID NO: 5965983 - DNA, 14 bp, Homo sapiens
agaggctgtgtggc

SEQ ID NO: 5965984 - DNA, 17 bp, Homo sapiens
agaggcttccgtgtcct

SEQ ID NO: 5965985 - DNA, 16 bp, Homo sapiens
agaggcttctccgcca

SEQ ID NO: 5965986 - DNA, 21 bp, Homo sapiens
agaggcttcttcagatcagtg

SEQ ID NO: 5965987 - DNA, 18 bp, Homo sapiens
agaggcttgaaggccagc

SEQ ID NO: 5965988 - DNA, 17 bp, Homo sapiens
agaggctttcaaatgta

SEQ ID NO: 5965989 - DNA, 15 bp, Homo sapiens
agaggcttttccagt

SEQ ID NO: 5965990 - DNA, 16 bp, Homo sapiens
agaggcttttgggcca

SEQ ID NO: 5965991 - DNA, 18 bp, Homo sapiens
agagggaaaacagaaaac

SEQ ID NO: 5965992 - DNA, 13 bp, Homo sapiens
agagggaaaatgt

SEQ ID NO: 5965993 - DNA, 18 bp, Homo sapiens
agagggaaactctggaga

SEQ ID NO: 5965994 - DNA, 20 bp, Homo sapiens
agagggaaactctggagagc

SEQ ID NO: 5965995 - DNA, 18 bp, Homo sapiens
agagggaaatacaaggag

SEQ ID NO: 5965996 - DNA, 21 bp, Homo sapiens
agagggaacaaaactgttctt

SEQ ID NO: 5965997 - DNA, 15 bp, Homo sapiens
agagggaacagggcg

SEQ ID NO: 5965998 - DNA, 15 bp, Homo sapiens
agagggaagccagga

SEQ ID NO: 5965999 - DNA, 15 bp, Homo sapiens
agagggaagctgagg

SEQ ID NO: 5966000 - DNA, 13 bp, Homo sapiens
agagggaatgtga

SEQ ID NO: 5966001 - DNA, 16 bp, Homo sapiens
agagggaatgtgaaat

SEQ ID NO: 5966002 - DNA, 18 bp, Homo sapiens
agagggaatgttccctgc

SEQ ID NO: 5966003 - DNA, 18 bp, Homo sapiens
agagggacacatgcccct

SEQ ID NO: 5966004 - DNA, 17 bp, Homo sapiens
agagggacactcctcct

SEQ ID NO: 5966005 - DNA, 17 bp, Homo sapiens
agagggaccatgtgtca

SEQ ID NO: 5966006 - DNA, 17 bp, Homo sapiens
agagggactccaagccc

SEQ ID NO: 5966007 - DNA, 21 bp, Homo sapiens
agagggactgtatttctgtgg

SEQ ID NO: 5966008 - DNA, 22 bp, Homo sapiens
agagggactgttcttttgtccc

SEQ ID NO: 5966009 - DNA, 13 bp, Homo sapiens
agagggagaagaa

SEQ ID NO: 5966010 - DNA, 14 bp, Homo sapiens
agagggagaagact

SEQ ID NO: 5966011 - DNA, 17 bp, Homo sapiens
agagggagacagagatg

SEQ ID NO: 5966012 - DNA, 16 bp, Homo sapiens
agagggagactcctgg

SEQ ID NO: 5966013 - DNA, 17 bp, Homo sapiens
agagggagactcctggg

SEQ ID NO: 5966014 - DNA, 16 bp, Homo sapiens
agagggagagatgagt

SEQ ID NO: 5966015 - DNA, 12 bp, Homo sapiens
agagggagcagg

SEQ ID NO: 5966016 - DNA, 14 bp, Homo sapiens
agagggagcaggcc

SEQ ID NO: 5966017 - DNA, 23 bp, Homo sapiens
agagggagccggtttgggagaga

SEQ ID NO: 5966018 - DNA, 18 bp, Homo sapiens
agagggagctggaacccg

SEQ ID NO: 5966019 - DNA, 14 bp, Homo sapiens
agagggaggaaggg

SEQ ID NO: 5966020 - DNA, 22 bp, Homo sapiens
agagggaggaatgtgtgccttg

SEQ ID NO: 5966021 - DNA, 17 bp, Homo sapiens
agagggaggcaagccct

SEQ ID NO: 5966022 - DNA, 14 bp, Homo sapiens
agagggaggcttcc

SEQ ID NO: 5966023 - DNA, 16 bp, Homo sapiens
agagggagggagggct

SEQ ID NO: 5966024 - DNA, 20 bp, Homo sapiens
agagggagggagggctccag

SEQ ID NO: 5966025 - DNA, 21 bp, Homo sapiens
agagggagggagggctccaga

SEQ ID NO: 5966026 - DNA, 22 bp, Homo sapiens
agagggagggagggctccagac

SEQ ID NO: 5966027 - DNA, 19 bp, Homo sapiens
agagggaggggacagaggc

SEQ ID NO: 5966028 - DNA, 16 bp, Homo sapiens
agagggaggggccctg

SEQ ID NO: 5966029 - DNA, 17 bp, Homo sapiens
agagggatacaagagag

SEQ ID NO: 5966030 - DNA, 17 bp, Homo sapiens
agagggatgcagtgcct

SEQ ID NO: 5966031 - DNA, 16 bp, Homo sapiens
agagggatgggagagt

SEQ ID NO: 5966032 - DNA, 16 bp, Homo sapiens
agagggatttccctgc

SEQ ID NO: 5966033 - DNA, 22 bp, Homo sapiens
agagggatttccctgcagacct

SEQ ID NO: 5966034 - DNA, 14 bp, Homo sapiens
agagggcagaggct

SEQ ID NO: 5966035 - DNA, 11 bp, Homo sapiens
agagggcaggg

SEQ ID NO: 5966036 - DNA, 16 bp, Homo sapiens
agagggcagtacctgg

SEQ ID NO: 5966037 - DNA, 17 bp, Homo sapiens
agagggcagtacctggg

SEQ ID NO: 5966038 - DNA, 23 bp, Homo sapiens
agagggcatgcgcacaaggctga

SEQ ID NO: 5966039 - DNA, 14 bp, Homo sapiens
agagggccaagaga

SEQ ID NO: 5966040 - DNA, 19 bp, Homo sapiens
agagggccacggggaggcc

SEQ ID NO: 5966041 - DNA, 13 bp, Homo sapiens
agagggccagagc

SEQ ID NO: 5966042 - DNA, 22 bp, Homo sapiens
agagggccattgaactctgaga

SEQ ID NO: 5966043 - DNA, 16 bp, Homo sapiens
agagggcccagcccag

SEQ ID NO: 5966044 - DNA, 21 bp, Homo sapiens
agcagaggaggggccgctgcc

SEQ ID NO: 5966045 - DNA, 19 bp, Homo sapiens
agcagaggagtccagggcg

SEQ ID NO: 5966046 - DNA, 20 bp, Homo sapiens
agcagaggataattagcatc

SEQ ID NO: 5966047 - DNA, 13 bp, Homo sapiens
agcagaggcagga

SEQ ID NO: 5966048 - DNA, 15 bp, Homo sapiens
agcagaggcaggctg

SEQ ID NO: 5966049 - DNA, 14 bp, Homo sapiens
agcagaggccctgc

SEQ ID NO: 5966050 - DNA, 17 bp, Homo sapiens
agcagaggccctgcccc

SEQ ID NO: 5966051 - DNA, 21 bp, Homo sapiens
agcagaggcgtactacccagc

SEQ ID NO: 5966052 - DNA, 22 bp, Homo sapiens
agcagagggacaaccagaaggc

SEQ ID NO: 5966053 - DNA, 19 bp, Homo sapiens
agcagagggcctaggagga

SEQ ID NO: 5966054 - DNA, 16 bp, Homo sapiens
agcagagggcgccacc

SEQ ID NO: 5966055 - DNA, 20 bp, Homo sapiens
agcagaggggccaggcccag

SEQ ID NO: 5966056 - DNA, 18 bp, Homo sapiens
agcagagggggagtagcc

SEQ ID NO: 5966057 - DNA, 22 bp, Homo sapiens
agcagaggtgagaactcagaag

SEQ ID NO: 5966058 - DNA, 18 bp, Homo sapiens
agcagaggtggaaaatga

SEQ ID NO: 5966059 - DNA, 21 bp, Homo sapiens
agcagagtctgggcctctgac

SEQ ID NO: 5966060 - DNA, 16 bp, Homo sapiens
agcagagtctgtctct

SEQ ID NO: 5966061 - DNA, 17 bp, Homo sapiens
agcagagtctgtctctt

SEQ ID NO: 5966062 - DNA, 19 bp, Homo sapiens
agcagagtgcacagctgtc

SEQ ID NO: 5966063 - DNA, 18 bp, Homo sapiens
agcagagtgctggcactt

SEQ ID NO: 5966064 - DNA, 14 bp, Homo sapiens
agcagagttaaatc

SEQ ID NO: 5966065 - DNA, 18 bp, Homo sapiens
agcagagttaaatctcaa

SEQ ID NO: 5966066 - DNA, 19 bp, Homo sapiens
agcagagttattgaatctt

SEQ ID NO: 5966067 - DNA, 18 bp, Homo sapiens
agcagagttgtcttaaat

SEQ ID NO: 5966068 - DNA, 14 bp, Homo sapiens
agcagataaagaca

SEQ ID NO: 5966069 - DNA, 16 bp, Homo sapiens
agcagataaggccgag

SEQ ID NO: 5966070 - DNA, 18 bp, Homo sapiens
agcagatacctcaccctg

SEQ ID NO: 5966071 - DNA, 19 bp, Homo sapiens
agcagatacctcaccctgc

SEQ ID NO: 5966072 - DNA, 22 bp, Homo sapiens
agcagataccttgcaaagcaac

SEQ ID NO: 5966073 - DNA, 20 bp, Homo sapiens
agcagatcagtctttgtcaa

SEQ ID NO: 5966074 - DNA, 16 bp, Homo sapiens
agcagatcgtgccgtg

SEQ ID NO: 5966075 - DNA, 17 bp, Homo sapiens
agcagatcgtgccgtgg

SEQ ID NO: 5966076 - DNA, 20 bp, Homo sapiens
agcagatcgtgccgtggagc

SEQ ID NO: 5966077 - DNA, 13 bp, Homo sapiens
agcagatctgaaa

SEQ ID NO: 5966078 - DNA, 18 bp, Homo sapiens
agcagatctgttttgtgg

SEQ ID NO: 5966079 - DNA, 14 bp, Homo sapiens
agcagatgcaaaga

SEQ ID NO: 5966080 - DNA, 21 bp, Homo sapiens
agcagatgcaaagaggcaaga

SEQ ID NO: 5966081 - DNA, 12 bp, Homo sapiens
agcagatgcaga

SEQ ID NO: 5966082 - DNA, 16 bp, Homo sapiens
agcagatgcagagagc

SEQ ID NO: 5966083 - DNA, 14 bp, Homo sapiens
agcagatgccattt

SEQ ID NO: 5966084 - DNA, 13 bp, Homo sapiens
agcagatgctggt

SEQ ID NO: 5966085 - DNA, 14 bp, Homo sapiens
agcagatgctggtc

SEQ ID NO: 5966086 - DNA, 14 bp, Homo sapiens
agcagatggtccca

SEQ ID NO: 5966087 - DNA, 17 bp, Homo sapiens
agcagattacaataaat

SEQ ID NO: 5966088 - DNA, 14 bp, Homo sapiens
agcagattacctct

SEQ ID NO: 5966089 - DNA, 16 bp, Homo sapiens
agcagattattcactg

SEQ ID NO: 5966090 - DNA, 18 bp, Homo sapiens
agcagattctagcacatc

SEQ ID NO: 5966091 - DNA, 18 bp, Homo sapiens
agcagattggaaggagac

SEQ ID NO: 5966092 - DNA, 22 bp, Homo sapiens
agcagattgtttcctcttccaa

SEQ ID NO: 5966093 - DNA, 18 bp, Homo sapiens
agcagatttaacaattcc

SEQ ID NO: 5966094 - DNA, 15 bp, Homo sapiens
agcagcaaaaatata

SEQ ID NO: 5966095 - DNA, 14 bp, Homo sapiens
agcagcaaaacaaa

SEQ ID NO: 5966096 - DNA, 22 bp, Homo sapiens
agcagcaaaaccaaactgggtc

SEQ ID NO: 5966097 - DNA, 23 bp, Homo sapiens
agcagcaaaatccttacttccag

SEQ ID NO: 5966098 - DNA, 20 bp, Homo sapiens
agcagcaaatgaaagaaccg

SEQ ID NO: 5966099 - DNA, 15 bp, Homo sapiens
agcagcaaattttca

SEQ ID NO: 5966100 - DNA, 13 bp, Homo sapiens
agcagcaacagcc

SEQ ID NO: 5966101 - DNA, 16 bp, Homo sapiens
agcagcaacctgttca

SEQ ID NO: 5966102 - DNA, 17 bp, Homo sapiens
agcagcaactgaaaatg

SEQ ID NO: 5966103 - DNA, 17 bp, Homo sapiens
agcagcaactgaagaca

SEQ ID NO: 5966104 - DNA, 13 bp, Homo sapiens
agcagcaaggtgg

SEQ ID NO: 5966105 - DNA, 20 bp, Homo sapiens
agcagcaagttcatacaaca

SEQ ID NO: 5966106 - DNA, 18 bp, Homo sapiens
agcagcaatattttgtat

SEQ ID NO: 5966107 - DNA, 20 bp, Homo sapiens
agcagcacaattctgtccct

SEQ ID NO: 5966108 - DNA, 21 bp, Homo sapiens
agcagcacaattctgtccctg

SEQ ID NO: 5966109 - DNA, 14 bp, Homo sapiens
agcagcacacctca

SEQ ID NO: 5966110 - DNA, 16 bp, Homo sapiens
agcagcacacctcagc

SEQ ID NO: 5966111 - DNA, 18 bp, Homo sapiens
agcagcaccgttctgtgc

SEQ ID NO: 5966112 - DNA, 19 bp, Homo sapiens
agcagcaccgttctgtgca

SEQ ID NO: 5966113 - DNA, 14 bp, Homo sapiens
agcagcacctcctc

SEQ ID NO: 5966114 - DNA, 20 bp, Homo sapiens
agcagcacctttctctgaga

SEQ ID NO: 5966115 - DNA, 19 bp, Homo sapiens
agcagcacgattttgcaca

SEQ ID NO: 5966116 - DNA, 21 bp, Homo sapiens
agcagcacgcatgtccctcca

SEQ ID NO: 5966117 - DNA, 21 bp, Homo sapiens
agcagcacgccaaccccagca

SEQ ID NO: 5966118 - DNA, 23 bp, Homo sapiens
agcagcacgccaaccccagcagt

SEQ ID NO: 5966119 - DNA, 19 bp, Homo sapiens
agcagcactcccgctgcac

SEQ ID NO: 5966120 - DNA, 22 bp, Homo sapiens
agcagcactggaaccacctgga

SEQ ID NO: 5966121 - DNA, 15 bp, Homo sapiens
agcagcagagagccc

SEQ ID NO: 5966122 - DNA, 18 bp, Homo sapiens
agcagcagagagccctgg

SEQ ID NO: 5966123 - DNA, 22 bp, Homo sapiens
agcagcagagagccctgggtga

SEQ ID NO: 5966124 - DNA, 12 bp, Homo sapiens
agcagcagaggc

SEQ ID NO: 5966125 - DNA, 15 bp, Homo sapiens
agcagcagaggcagg

SEQ ID NO: 5966126 - DNA, 16 bp, Homo sapiens
agcagcagaggcagga

SEQ ID NO: 5966127 - DNA, 15 bp, Homo sapiens
agcagcagaggtgag

SEQ ID NO: 5966128 - DNA, 13 bp, Homo sapiens
agcagcagcacca

SEQ ID NO: 5966129 - DNA, 15 bp, Homo sapiens
agcagcagcagcagc

SEQ ID NO: 5966130 - DNA, 16 bp, Homo sapiens
agcagcagccagcacc

SEQ ID NO: 5966131 - DNA, 17 bp, Homo sapiens
agcagcagccagcacca

SEQ ID NO: 5966132 - DNA, 14 bp, Homo sapiens
agcagcagcccaag

SEQ ID NO: 5966133 - DNA, 13 bp, Homo sapiens
agcagcagcctgc

SEQ ID NO: 5966134 - DNA, 14 bp, Homo sapiens
agcagcagcctgca

SEQ ID NO: 5966135 - DNA, 11 bp, Homo sapiens
agcagcagctc

SEQ ID NO: 5966136 - DNA, 22 bp, Homo sapiens
agcagctggtcagtctttgctc

SEQ ID NO: 5966137 - DNA, 16 bp, Homo sapiens
agcagctggtcttttc

SEQ ID NO: 5966138 - DNA, 13 bp, Homo sapiens
agcagctggtgcc

SEQ ID NO: 5966139 - DNA, 16 bp, Homo sapiens
agcagctggtgcccca

SEQ ID NO: 5966140 - DNA, 21 bp, Homo sapiens
agcagctggtgccccacctgc

SEQ ID NO: 5966141 - DNA, 18 bp, Homo sapiens
agcagcttaagtccagct

SEQ ID NO: 5966142 - DNA, 18 bp, Homo sapiens
agcagcttcaccagagca

SEQ ID NO: 5966143 - DNA, 17 bp, Homo sapiens
agcagcttcagttgttt

SEQ ID NO: 5966144 - DNA, 16 bp, Homo sapiens
agcagcttccagattg

SEQ ID NO: 5966145 - DNA, 15 bp, Homo sapiens
agcagcttccttctg

SEQ ID NO: 5966146 - DNA, 19 bp, Homo sapiens
agcagcttccttctgggac

SEQ ID NO: 5966147 - DNA, 13 bp, Homo sapiens
agcagcttctcca

SEQ ID NO: 5966148 - DNA, 16 bp, Homo sapiens
agcagcttctgccact

SEQ ID NO: 5966149 - DNA, 17 bp, Homo sapiens
agcagcttctgccactt

SEQ ID NO: 5966150 - DNA, 11 bp, Homo sapiens
agcagcttctt

SEQ ID NO: 5966151 - DNA, 24 bp, Homo sapiens
agcagcttcttgggctgagtgcag

SEQ ID NO: 5966152 - DNA, 15 bp, Homo sapiens
agcagcttgctgcac

SEQ ID NO: 5966153 - DNA, 15 bp, Homo sapiens
agcagcttggctgag

SEQ ID NO: 5966154 - DNA, 13 bp, Homo sapiens
agcagctttaaaa

SEQ ID NO: 5966155 - DNA, 17 bp, Homo sapiens
agcagctttaaacaaat

SEQ ID NO: 5966156 - DNA, 19 bp, Homo sapiens
agcagctttaaactcaggg

SEQ ID NO: 5966157 - DNA, 20 bp, Homo sapiens
agcagctttaaactcaggga

SEQ ID NO: 5966158 - DNA, 17 bp, Homo sapiens
agcagctttagcaaaga

SEQ ID NO: 5966159 - DNA, 18 bp, Homo sapiens
agcagctttgggatccca

SEQ ID NO: 5966160 - DNA, 16 bp, Homo sapiens
agcagctttgtctctg

SEQ ID NO: 5966161 - DNA, 16 bp, Homo sapiens
agcagcttttggtctc

SEQ ID NO: 5966162 - DNA, 21 bp, Homo sapiens
agcaggaaaaggtccttgact

SEQ ID NO: 5966163 - DNA, 15 bp, Homo sapiens
agcaggaaataccaa

SEQ ID NO: 5966164 - DNA, 21 bp, Homo sapiens
agcaggaaatgaaaatgtctt

SEQ ID NO: 5966165 - DNA, 21 bp, Homo sapiens
agcaggaacagagactctgga

SEQ ID NO: 5966166 - DNA, 22 bp, Homo sapiens
agcaggaacctgtactgggtta

SEQ ID NO: 5966167 - DNA, 23 bp, Homo sapiens
agcaggaacttctagctcattta

SEQ ID NO: 5966168 - DNA, 19 bp, Homo sapiens
agcaggaagcaaggccagc

SEQ ID NO: 5966169 - DNA, 14 bp, Homo sapiens
agcaggaagctcag

SEQ ID NO: 5966170 - DNA, 20 bp, Homo sapiens
agcaggaagctgtgagagca

SEQ ID NO: 5966171 - DNA, 24 bp, Homo sapiens
agcaggaaggaacaaagacaggca

SEQ ID NO: 5966172 - DNA, 14 bp, Homo sapiens
agcaggaaggcctg

SEQ ID NO: 5966173 - DNA, 18 bp, Homo sapiens
agcaggaagggtgggaag

SEQ ID NO: 5966174 - DNA, 22 bp, Homo sapiens
agcaggaaggtctcatgcctga

SEQ ID NO: 5966175 - DNA, 21 bp, Homo sapiens
agcaggaatatatgtgtgcct

SEQ ID NO: 5966176 - DNA, 17 bp, Homo sapiens
agcaggacagccagcag

SEQ ID NO: 5966177 - DNA, 13 bp, Homo sapiens
agcaggacatgga

SEQ ID NO: 5966178 - DNA, 19 bp, Homo sapiens
agcaggacccagtggtcag

SEQ ID NO: 5966179 - DNA, 20 bp, Homo sapiens
agcaggacccagtggtcagc

SEQ ID NO: 5966180 - DNA, 14 bp, Homo sapiens
agcaggacctccct

SEQ ID NO: 5966181 - DNA, 16 bp, Homo sapiens
agcaggacctcccttc

SEQ ID NO: 5966182 - DNA, 22 bp, Homo sapiens
agcaggacctctgaaaccctgg

SEQ ID NO: 5966183 - DNA, 18 bp, Homo sapiens
agcaggacctgtgctttg

SEQ ID NO: 5966184 - DNA, 23 bp, Homo sapiens
agcaggactccaggcccaaggct

SEQ ID NO: 5966185 - DNA, 14 bp, Homo sapiens
agcaggactcccac

SEQ ID NO: 5966186 - DNA, 19 bp, Homo sapiens
agcaggactgatgtctcct

SEQ ID NO: 5966187 - DNA, 20 bp, Homo sapiens
agcaggactgtgcctccata

SEQ ID NO: 5966188 - DNA, 22 bp, Homo sapiens
agcaggagaagttaagaattga

SEQ ID NO: 5966189 - DNA, 21 bp, Homo sapiens
agcaggagactggcaagagct

SEQ ID NO: 5966190 - DNA, 21 bp, Homo sapiens
agcaggagagactgagcagcc

SEQ ID NO: 5966191 - DNA, 14 bp, Homo sapiens
agcaggagaggaga

SEQ ID NO: 5966192 - DNA, 17 bp, Homo sapiens
agcaggagaggagagcc

SEQ ID NO: 5966193 - DNA, 19 bp, Homo sapiens
agcaggagaggagagccag

SEQ ID NO: 5966194 - DNA, 15 bp, Homo sapiens
agcaggagattgaga

SEQ ID NO: 5966195 - DNA, 21 bp, Homo sapiens
agcaggagattgagaaggaga

SEQ ID NO: 5966196 - DNA, 10 bp, Homo sapiens
agcaggagca

SEQ ID NO: 5966197 - DNA, 15 bp, Homo sapiens
agcaggagcagaaag

SEQ ID NO: 5966198 - DNA, 16 bp, Homo sapiens
agcaggagcatggccg

SEQ ID NO: 5966199 - DNA, 14 bp, Homo sapiens
agcaggagcccctg

SEQ ID NO: 5966200 - DNA, 22 bp, Homo sapiens
agcaggagcttgggtctctctc

SEQ ID NO: 5966201 - DNA, 23 bp, Homo sapiens
agcaggaggaggaaaggtagccc

SEQ ID NO: 5966202 - DNA, 16 bp, Homo sapiens
agcaggaggcacagca

SEQ ID NO: 5966203 - DNA, 17 bp, Homo sapiens
agcaggaggcacagcag

SEQ ID NO: 5966204 - DNA, 20 bp, Homo sapiens
agcaggaggcagggctctgg

SEQ ID NO: 5966205 - DNA, 16 bp, Homo sapiens
agcaggaggccaataa

SEQ ID NO: 5966206 - DNA, 20 bp, Homo sapiens
agcaggaggccaataaaaag

SEQ ID NO: 5966207 - DNA, 23 bp, Homo sapiens
agcaggaggcccttgtcgtggga

SEQ ID NO: 5966208 - DNA, 23 bp, Homo sapiens
agcaggaggctttctgggctctg

SEQ ID NO: 5966209 - DNA, 23 bp, Homo sapiens
agcaggagggaaggacagacatc

SEQ ID NO: 5966210 - DNA, 14 bp, Homo sapiens
agcaggagggacag

SEQ ID NO: 5966211 - DNA, 18 bp, Homo sapiens
agcaggagggacagtctc

SEQ ID NO: 5966212 - DNA, 19 bp, Homo sapiens
agcaggagggacagtctca

SEQ ID NO: 5966213 - DNA, 13 bp, Homo sapiens
agcaggagggact

SEQ ID NO: 5966214 - DNA, 14 bp, Homo sapiens
agcaggagggattg

SEQ ID NO: 5966215 - DNA, 14 bp, Homo sapiens
agcaggagggggga

SEQ ID NO: 5966216 - DNA, 16 bp, Homo sapiens
agcaggaggggggagg

SEQ ID NO: 5966217 - DNA, 19 bp, Homo sapiens
agcaggaggggggctgggt

SEQ ID NO: 5966218 - DNA, 22 bp, Homo sapiens
agcaggaggttctgggcctctg

SEQ ID NO: 5966219 - DNA, 14 bp, Homo sapiens
agcaggagtggaag

SEQ ID NO: 5966220 - DNA, 22 bp, Homo sapiens
agcaggatagttgctccgcctc

SEQ ID NO: 5966221 - DNA, 21 bp, Homo sapiens
agcaggatcgaagggttttta

SEQ ID NO: 5966222 - DNA, 21 bp, Homo sapiens
agcaggatgaattttctgcag

SEQ ID NO: 5966223 - DNA, 20 bp, Homo sapiens
agcaggatgaccacgcacct

SEQ ID NO: 5966224 - DNA, 14 bp, Homo sapiens
agaggtgggagggc

SEQ ID NO: 5966225 - DNA, 20 bp, Homo sapiens
agaggtgggatcctccctca

SEQ ID NO: 5966226 - DNA, 21 bp, Homo sapiens
agaggtgggatcctccctcat

SEQ ID NO: 5966227 - DNA, 16 bp, Homo sapiens
agaggtgggcagcagc

SEQ ID NO: 5966228 - DNA, 20 bp, Homo sapiens
agaggtgggcagcagctcag

SEQ ID NO: 5966229 - DNA, 13 bp, Homo sapiens
agaggtgggcagg

SEQ ID NO: 5966230 - DNA, 21 bp, Homo sapiens
agaggtgggccagtctgtgga

SEQ ID NO: 5966231 - DNA, 11 bp, Homo sapiens
agaggtgggga

SEQ ID NO: 5966232 - DNA, 23 bp, Homo sapiens
agaggtggggaagagagcctgcc

SEQ ID NO: 5966233 - DNA, 16 bp, Homo sapiens
agaggtggggagcaga

SEQ ID NO: 5966234 - DNA, 13 bp, Homo sapiens
agaggtgggggat

SEQ ID NO: 5966235 - DNA, 21 bp, Homo sapiens
agaggtgggggatgctgagga

SEQ ID NO: 5966236 - DNA, 22 bp, Homo sapiens
agaggtgggggatgctgaggag

SEQ ID NO: 5966237 - DNA, 20 bp, Homo sapiens
agaggtggggtgaagctggg

SEQ ID NO: 5966238 - DNA, 15 bp, Homo sapiens
agaggtggggtgctg

SEQ ID NO: 5966239 - DNA, 22 bp, Homo sapiens
agaggtggggtgctggggctgc

SEQ ID NO: 5966240 - DNA, 12 bp, Homo sapiens
agaggtggtctg

SEQ ID NO: 5966241 - DNA, 13 bp, Homo sapiens
agaggtggtctgg

SEQ ID NO: 5966242 - DNA, 18 bp, Homo sapiens
agaggtggtggggaccag

SEQ ID NO: 5966243 - DNA, 19 bp, Homo sapiens
agaggtgtcgggacatggt

SEQ ID NO: 5966244 - DNA, 22 bp, Homo sapiens
agaggtgtgcaagagagggatg

SEQ ID NO: 5966245 - DNA, 16 bp, Homo sapiens
agaggttactttagtt

SEQ ID NO: 5966246 - DNA, 24 bp, Homo sapiens
agaggttactttagttagcatgcg

SEQ ID NO: 5966247 - DNA, 17 bp, Homo sapiens
agaggttatctgcctgg

SEQ ID NO: 5966248 - DNA, 22 bp, Homo sapiens
agaggttatctgcctggcctgg

SEQ ID NO: 5966249 - DNA, 19 bp, Homo sapiens
agaggttcaaagatatttt

SEQ ID NO: 5966250 - DNA, 17 bp, Homo sapiens
agaggttctaacttctg

SEQ ID NO: 5966251 - DNA, 20 bp, Homo sapiens
agaggttctgcactcctgga

SEQ ID NO: 5966252 - DNA, 15 bp, Homo sapiens
agaggttctggggag

SEQ ID NO: 5966253 - DNA, 16 bp, Homo sapiens
agaggttctggggagg

SEQ ID NO: 5966254 - DNA, 19 bp, Homo sapiens
agaggttctggggaggaag

SEQ ID NO: 5966255 - DNA, 20 bp, Homo sapiens
agaggttctggggaggaagg

SEQ ID NO: 5966256 - DNA, 14 bp, Homo sapiens
agaggttgcagtga

SEQ ID NO: 5966257 - DNA, 15 bp, Homo sapiens
agaggttgcagtgag

SEQ ID NO: 5966258 - DNA, 17 bp, Homo sapiens
agaggttgctaatgcct

SEQ ID NO: 5966259 - DNA, 20 bp, Homo sapiens
agaggttgggcttccatgcc

SEQ ID NO: 5966260 - DNA, 13 bp, Homo sapiens
agaggttggtgtg

SEQ ID NO: 5966261 - DNA, 20 bp, Homo sapiens
agaggttgtagtgagccaag

SEQ ID NO: 5966262 - DNA, 13 bp, Homo sapiens
agaggtttaaatg

SEQ ID NO: 5966263 - DNA, 13 bp, Homo sapiens
agaggtttcattt

SEQ ID NO: 5966264 - DNA, 15 bp, Homo sapiens
agaggtttcattttc

SEQ ID NO: 5966265 - DNA, 22 bp, Homo sapiens
agaggtttctagggtgggcccc

SEQ ID NO: 5966266 - DNA, 14 bp, Homo sapiens
agaggtttcttgaa

SEQ ID NO: 5966267 - DNA, 16 bp, Homo sapiens
agaggtttgtcaacac

SEQ ID NO: 5966268 - DNA, 17 bp, Homo sapiens
agaggtttgtcaacaca

SEQ ID NO: 5966269 - DNA, 19 bp, Homo sapiens
agaggtttgtcaacacaaa

SEQ ID NO: 5966270 - DNA, 19 bp, Homo sapiens
agaggttttaatgtctgtt

SEQ ID NO: 5966271 - DNA, 20 bp, Homo sapiens
agaggttttgtattgagggc

SEQ ID NO: 5966272 - DNA, 22 bp, Homo sapiens
agaggttttgttgcttgtacag

SEQ ID NO: 5966273 - DNA, 16 bp, Homo sapiens
agaggtttttctcccc

SEQ ID NO: 5966274 - DNA, 13 bp, Homo sapiens
agagtaaaagtcc

SEQ ID NO: 5966275 - DNA, 18 bp, Homo sapiens
agagtaaaattacagaag

SEQ ID NO: 5966276 - DNA, 18 bp, Homo sapiens
agagtaaaggaaatgatt

SEQ ID NO: 5966277 - DNA, 15 bp, Homo sapiens
agagtaaataaactg

SEQ ID NO: 5966278 - DNA, 16 bp, Homo sapiens
agagtaaataaactgt

SEQ ID NO: 5966279 - DNA, 18 bp, Homo sapiens
agagtaacacttgaaaag

SEQ ID NO: 5966280 - DNA, 23 bp, Homo sapiens
agagtaagcacctttagaatatt

SEQ ID NO: 5966281 - DNA, 18 bp, Homo sapiens
agagtaatcttgttggtt

SEQ ID NO: 5966282 - DNA, 18 bp, Homo sapiens
agagtaattcatctgtga

SEQ ID NO: 5966283 - DNA, 21 bp, Homo sapiens
agagtaattcatctgtgaatc

SEQ ID NO: 5966284 - DNA, 20 bp, Homo sapiens
agagtaatttgggaaaagaa

SEQ ID NO: 5966285 - DNA, 21 bp, Homo sapiens
agagtacaagctcttgtttct

SEQ ID NO: 5966286 - DNA, 12 bp, Homo sapiens
agagtacactgc

SEQ ID NO: 5966287 - DNA, 13 bp, Homo sapiens
agagtacactgcc

SEQ ID NO: 5966288 - DNA, 15 bp, Homo sapiens
agagtacactgcctg

SEQ ID NO: 5966289 - DNA, 17 bp, Homo sapiens
agagtacactgtgtctc

SEQ ID NO: 5966290 - DNA, 18 bp, Homo sapiens
agagtacagactgcagac

SEQ ID NO: 5966291 - DNA, 19 bp, Homo sapiens
agagtacaggtcttcttta

SEQ ID NO: 5966292 - DNA, 17 bp, Homo sapiens
agagtacccccctgaga

SEQ ID NO: 5966293 - DNA, 16 bp, Homo sapiens
agagtacctgtgtgtt

SEQ ID NO: 5966294 - DNA, 18 bp, Homo sapiens
agagtacgtcctgcctgg

SEQ ID NO: 5966295 - DNA, 17 bp, Homo sapiens
agagtacgttaaaagca

SEQ ID NO: 5966296 - DNA, 14 bp, Homo sapiens
agagtactgggaga

SEQ ID NO: 5966297 - DNA, 15 bp, Homo sapiens
agagtactgggagaa

SEQ ID NO: 5966298 - DNA, 18 bp, Homo sapiens
agagtagaaagcttgaaa

SEQ ID NO: 5966299 - DNA, 13 bp, Homo sapiens
agagtagaaataa

SEQ ID NO: 5966300 - DNA, 20 bp, Homo sapiens
agagtagaactttaaaagaa

SEQ ID NO: 5966301 - DNA, 13 bp, Homo sapiens
agagtagacattt

SEQ ID NO: 5966302 - DNA, 16 bp, Homo sapiens
agagtagagccaggtg

SEQ ID NO: 5966303 - DNA, 18 bp, Homo sapiens
agagtagaggtataattg

SEQ ID NO: 5966304 - DNA, 22 bp, Homo sapiens
agagtagatggtgaaatttatt

SEQ ID NO: 5966305 - DNA, 23 bp, Homo sapiens
agagtagcaagttctagagaaga

SEQ ID NO: 5966306 - DNA, 18 bp, Homo sapiens
agagtagcaccttcagaa

SEQ ID NO: 5966307 - DNA, 14 bp, Homo sapiens
agagtagcatttca

SEQ ID NO: 5966308 - DNA, 15 bp, Homo sapiens
agagtagcatttcat

SEQ ID NO: 5966309 - DNA, 23 bp, Homo sapiens
agagtagccagggtgtggccctg

SEQ ID NO: 5966310 - DNA, 20 bp, Homo sapiens
agagtagccatgaggaggca

SEQ ID NO: 5966311 - DNA, 14 bp, Homo sapiens
agagtagggccctg

SEQ ID NO: 5966312 - DNA, 17 bp, Homo sapiens
agagtggagactctgtt

SEQ ID NO: 5966313 - DNA, 20 bp, Homo sapiens
agagtggagagaagctcttc

SEQ ID NO: 5966314 - DNA, 13 bp, Homo sapiens
agagtggagccca

SEQ ID NO: 5966315 - DNA, 15 bp, Homo sapiens
agagtggagcccagg

SEQ ID NO: 5966316 - DNA, 23 bp, Homo sapiens
agagtggaggaggaggaggagcc

SEQ ID NO: 5966317 - DNA, 16 bp, Homo sapiens
agagtggagtctgagt

SEQ ID NO: 5966318 - DNA, 14 bp, Homo sapiens
agagtggcaggtgg

SEQ ID NO: 5966319 - DNA, 19 bp, Homo sapiens
agagtggccaatccctgtg

SEQ ID NO: 5966320 - DNA, 14 bp, Homo sapiens
agagtggccacggc

SEQ ID NO: 5966321 - DNA, 12 bp, Homo sapiens
agagtggcccac

SEQ ID NO: 5966322 - DNA, 15 bp, Homo sapiens
agagtggccccacct

SEQ ID NO: 5966323 - DNA, 19 bp, Homo sapiens
agagtggccccacctggcc

SEQ ID NO: 5966324 - DNA, 21 bp, Homo sapiens
agagtggccccacctggccct

SEQ ID NO: 5966325 - DNA, 17 bp, Homo sapiens
agagtggcctccctgct

SEQ ID NO: 5966326 - DNA, 20 bp, Homo sapiens
agagtggcctccctgctgtg

SEQ ID NO: 5966327 - DNA, 21 bp, Homo sapiens
agagtggcctccctgctgtgc

SEQ ID NO: 5966328 - DNA, 15 bp, Homo sapiens
agagtggcctgggtc

SEQ ID NO: 5966329 - DNA, 18 bp, Homo sapiens
agagtggcctgggtccca

SEQ ID NO: 5966330 - DNA, 14 bp, Homo sapiens
agagtggcctgtga

SEQ ID NO: 5966331 - DNA, 18 bp, Homo sapiens
agagtggcgtggcctccc

SEQ ID NO: 5966332 - DNA, 16 bp, Homo sapiens
agagtggctcactggc

SEQ ID NO: 5966333 - DNA, 19 bp, Homo sapiens
agagtggctcactggctgg

SEQ ID NO: 5966334 - DNA, 14 bp, Homo sapiens
agagtggctcctcc

SEQ ID NO: 5966335 - DNA, 19 bp, Homo sapiens
agagtggctcctcccggtg

SEQ ID NO: 5966336 - DNA, 14 bp, Homo sapiens
agagtggctggggc

SEQ ID NO: 5966337 - DNA, 22 bp, Homo sapiens
agagtgggatccacttcttggt

SEQ ID NO: 5966338 - DNA, 21 bp, Homo sapiens
agagtgggctgacatcaagtg

SEQ ID NO: 5966339 - DNA, 15 bp, Homo sapiens
agagtgggctgcctg

SEQ ID NO: 5966340 - DNA, 13 bp, Homo sapiens
agagtgggctttg

SEQ ID NO: 5966341 - DNA, 13 bp, Homo sapiens
agagtggggagag

SEQ ID NO: 5966342 - DNA, 18 bp, Homo sapiens
agagtggggctagactgg

SEQ ID NO: 5966343 - DNA, 19 bp, Homo sapiens
agagtggggctagactggg

SEQ ID NO: 5966344 - DNA, 15 bp, Homo sapiens
agagtgggggagaat

SEQ ID NO: 5966345 - DNA, 18 bp, Homo sapiens
agagtgggggagagcagg

SEQ ID NO: 5966346 - DNA, 20 bp, Homo sapiens
agagtgggggagagcaggct

SEQ ID NO: 5966347 - DNA, 22 bp, Homo sapiens
agagtgggggagagcaggctgg

SEQ ID NO: 5966348 - DNA, 15 bp, Homo sapiens
agagtggggggagga

SEQ ID NO: 5966349 - DNA, 14 bp, Homo sapiens
agagtgggttttgt

SEQ ID NO: 5966350 - DNA, 15 bp, Homo sapiens
agagtgggttttgtc

SEQ ID NO: 5966351 - DNA, 16 bp, Homo sapiens
agagtgggttttgtcc

SEQ ID NO: 5966352 - DNA, 19 bp, Homo sapiens
agagtgggttttgtccatt

SEQ ID NO: 5966353 - DNA, 17 bp, Homo sapiens
agagtggtaaaaaagaa

SEQ ID NO: 5966354 - DNA, 15 bp, Homo sapiens
agagtggtggcagct

SEQ ID NO: 5966355 - DNA, 16 bp, Homo sapiens
agagtggttgttgcca

SEQ ID NO: 5966356 - DNA, 18 bp, Homo sapiens
agagtggtttcattgcct

SEQ ID NO: 5966357 - DNA, 17 bp, Homo sapiens
agagtgtacatcatgtt

SEQ ID NO: 5966358 - DNA, 16 bp, Homo sapiens
agagtgtagaagcatt

SEQ ID NO: 5966359 - DNA, 18 bp, Homo sapiens
agagtgtagactgtggct

SEQ ID NO: 5966360 - DNA, 18 bp, Homo sapiens
agagtgtagatcagagca

SEQ ID NO: 5966361 - DNA, 20 bp, Homo sapiens
agagtgtagcctaaagggca

SEQ ID NO: 5966362 - DNA, 22 bp, Homo sapiens
agagtgtagcctaaagggcagg

SEQ ID NO: 5966363 - DNA, 23 bp, Homo sapiens
agagtgtagctgtaagggcagtg

SEQ ID NO: 5966364 - DNA, 17 bp, Homo sapiens
agagtgtatgcatacaa

SEQ ID NO: 5966365 - DNA, 15 bp, Homo sapiens
agagtgtcaaccaga

SEQ ID NO: 5966366 - DNA, 16 bp, Homo sapiens
agagtgtcactgagct

SEQ ID NO: 5966367 - DNA, 22 bp, Homo sapiens
agagtgtccctttttgcagggg

SEQ ID NO: 5966368 - DNA, 23 bp, Homo sapiens
agagtgtcctgatttgtgttaag

SEQ ID NO: 5966369 - DNA, 21 bp, Homo sapiens
agagtgtctcagggtgcagag

SEQ ID NO: 5966370 - DNA, 14 bp, Homo sapiens
agagtgtctctgat

SEQ ID NO: 5966371 - DNA, 14 bp, Homo sapiens
agagtgtctttcca

SEQ ID NO: 5966372 - DNA, 19 bp, Homo sapiens
agagtgtgaaatagacatt

SEQ ID NO: 5966373 - DNA, 12 bp, Homo sapiens
agagtgtgagca

SEQ ID NO: 5966374 - DNA, 18 bp, Homo sapiens
agagtgtgagcagggctt

SEQ ID NO: 5966375 - DNA, 20 bp, Homo sapiens
agagtgtgatgtatgtgtaa

SEQ ID NO: 5966376 - DNA, 16 bp, Homo sapiens
agagtgtgcagactga

SEQ ID NO: 5966377 - DNA, 17 bp, Homo sapiens
agagtgtgctcgggagt

SEQ ID NO: 5966378 - DNA, 20 bp, Homo sapiens
agagtgtggagtcattctca

SEQ ID NO: 5966379 - DNA, 20 bp, Homo sapiens
agagtgtgggaagggagagc

SEQ ID NO: 5966380 - DNA, 15 bp, Homo sapiens
agagtgtgtgggcag

SEQ ID NO: 5966381 - DNA, 17 bp, Homo sapiens
agagtgtgtgggcaggg

SEQ ID NO: 5966382 - DNA, 18 bp, Homo sapiens
agagtgtgttataaaata

SEQ ID NO: 5966383 - DNA, 20 bp, Homo sapiens
agagtgtgttataaaataat

SEQ ID NO: 5966384 - DNA, 22 bp, Homo sapiens
agagtgtgtttttgcactgtct

SEQ ID NO: 5966385 - DNA, 23 bp, Homo sapiens
agagtgttatcatattggtgctg

SEQ ID NO: 5966386 - DNA, 18 bp, Homo sapiens
agagtgttcctgagacag

SEQ ID NO: 5966387 - DNA, 13 bp, Homo sapiens
agagtgttgaaac

SEQ ID NO: 5966388 - DNA, 20 bp, Homo sapiens
agagtgttgttgctgaccag

SEQ ID NO: 5966389 - DNA, 13 bp, Homo sapiens
agagtgtttgtga

SEQ ID NO: 5966390 - DNA, 22 bp, Homo sapiens
agagtgtttgtgagctttttgt

SEQ ID NO: 5966391 - DNA, 12 bp, Homo sapiens
agagttaaaagt

SEQ ID NO: 5966392 - DNA, 18 bp, Homo sapiens
agagttaaaatatatata

SEQ ID NO: 5966393 - DNA, 16 bp, Homo sapiens
agagttaacaatgata

SEQ ID NO: 5966394 - DNA, 12 bp, Homo sapiens
agagttaagaag

SEQ ID NO: 5966395 - DNA, 16 bp, Homo sapiens
agagttaagaagctgt

SEQ ID NO: 5966396 - DNA, 17 bp, Homo sapiens
agagttaagaagctgtt

SEQ ID NO: 5966397 - DNA, 12 bp, Homo sapiens
agagttaagaat

SEQ ID NO: 5966398 - DNA, 13 bp, Homo sapiens
agagttaagaatg

SEQ ID NO: 5966399 - DNA, 15 bp, Homo sapiens
agagttacagttctg

SEQ ID NO: 5966400 - DNA, 22 bp, Homo sapiens
agagttactgccacggtccttt

SEQ ID NO: 5966401 - DNA, 14 bp, Homo sapiens
agagttacttgata

SEQ ID NO: 5966402 - DNA, 17 bp, Homo sapiens
agagttacttgataagg

SEQ ID NO: 5966403 - DNA, 12 bp, Homo sapiens
agagttagactg

SEQ ID NO: 5966404 - DNA, 14 bp, Homo sapiens
agagttagactgtt

SEQ ID NO: 5966405 - DNA, 22 bp, Homo sapiens
agcagtcctgcctcagcctccg

SEQ ID NO: 5966406 - DNA, 13 bp, Homo sapiens
agcagtcctgggc

SEQ ID NO: 5966407 - DNA, 15 bp, Homo sapiens
agcagtcctgggccc

SEQ ID NO: 5966408 - DNA, 16 bp, Homo sapiens
agcagtccttggcctg

SEQ ID NO: 5966409 - DNA, 22 bp, Homo sapiens
agcagtccttggcctgctaagg

SEQ ID NO: 5966410 - DNA, 21 bp, Homo sapiens
agcagtcgtgcctgtgtccat

SEQ ID NO: 5966411 - DNA, 21 bp, Homo sapiens
agcagtctacccacctcagcc

SEQ ID NO: 5966412 - DNA, 19 bp, Homo sapiens
agcagtctaccctgtcctt

SEQ ID NO: 5966413 - DNA, 17 bp, Homo sapiens
agcagtctccttcagca

SEQ ID NO: 5966414 - DNA, 18 bp, Homo sapiens
agcagtctccttcagcac

SEQ ID NO: 5966415 - DNA, 15 bp, Homo sapiens
agcagtctctgcctt

SEQ ID NO: 5966416 - DNA, 17 bp, Homo sapiens
agcagtctgataaactg

SEQ ID NO: 5966417 - DNA, 18 bp, Homo sapiens
agcagtctgataaactga

SEQ ID NO: 5966418 - DNA, 19 bp, Homo sapiens
agcagtctgataaactgac

SEQ ID NO: 5966419 - DNA, 13 bp, Homo sapiens
agcagtctgcctg

SEQ ID NO: 5966420 - DNA, 15 bp, Homo sapiens
agcagtcttgctctg

SEQ ID NO: 5966421 - DNA, 20 bp, Homo sapiens
agcagtgaaacttgtgctat

SEQ ID NO: 5966422 - DNA, 22 bp, Homo sapiens
agcagtgaaacttgtgctatag

SEQ ID NO: 5966423 - DNA, 18 bp, Homo sapiens
agcagtgaatgctagaca

SEQ ID NO: 5966424 - DNA, 17 bp, Homo sapiens
agcagtgagcactgaaa

SEQ ID NO: 5966425 - DNA, 18 bp, Homo sapiens
agcagtgagcactgaaac

SEQ ID NO: 5966426 - DNA, 21 bp, Homo sapiens
agcagtgagccaaatgtaaaa

SEQ ID NO: 5966427 - DNA, 22 bp, Homo sapiens
agcagtgagccgcatcttctcc

SEQ ID NO: 5966428 - DNA, 16 bp, Homo sapiens
agcagtgagtctcttc

SEQ ID NO: 5966429 - DNA, 23 bp, Homo sapiens
agcagtgatattctttgttaatt

SEQ ID NO: 5966430 - DNA, 20 bp, Homo sapiens
agcagtgcacatctgaccca

SEQ ID NO: 5966431 - DNA, 13 bp, Homo sapiens
agcagtgcaggca

SEQ ID NO: 5966432 - DNA, 17 bp, Homo sapiens
agcagtgcatgctgtcc

SEQ ID NO: 5966433 - DNA, 13 bp, Homo sapiens
agcagtgcccagg

SEQ ID NO: 5966434 - DNA, 14 bp, Homo sapiens
agcagtgcccaggt

SEQ ID NO: 5966435 - DNA, 20 bp, Homo sapiens
agcagtgcccaggtggctgt

SEQ ID NO: 5966436 - DNA, 16 bp, Homo sapiens
agcagtgcctcgaggc

SEQ ID NO: 5966437 - DNA, 19 bp, Homo sapiens
agcagtgcctcgaggcacc

SEQ ID NO: 5966438 - DNA, 20 bp, Homo sapiens
agcagtgcctcttgtctgag

SEQ ID NO: 5966439 - DNA, 16 bp, Homo sapiens
agcagtgccttccata

SEQ ID NO: 5966440 - DNA, 20 bp, Homo sapiens
agcagtgccttccataatta

SEQ ID NO: 5966441 - DNA, 21 bp, Homo sapiens
agcagtgctaggataaaccaa

SEQ ID NO: 5966442 - DNA, 17 bp, Homo sapiens
agcagtgctgggcccag

SEQ ID NO: 5966443 - DNA, 16 bp, Homo sapiens
agcagtgcttgtaaac

SEQ ID NO: 5966444 - DNA, 15 bp, Homo sapiens
agcagtggacaccag

SEQ ID NO: 5966445 - DNA, 18 bp, Homo sapiens
agcagtggagcccaggag

SEQ ID NO: 5966446 - DNA, 17 bp, Homo sapiens
agcagtggagtttaaaa

SEQ ID NO: 5966447 - DNA, 13 bp, Homo sapiens
agcagtggcaaaa

SEQ ID NO: 5966448 - DNA, 18 bp, Homo sapiens
agcagtggcaaaatatta

SEQ ID NO: 5966449 - DNA, 21 bp, Homo sapiens
agcagtggccgcaagcgcagg

SEQ ID NO: 5966450 - DNA, 12 bp, Homo sapiens
agcagtggcctt

SEQ ID NO: 5966451 - DNA, 19 bp, Homo sapiens
agcagtggccttattgcat

SEQ ID NO: 5966452 - DNA, 13 bp, Homo sapiens
agcagtggctggt

SEQ ID NO: 5966453 - DNA, 22 bp, Homo sapiens
agcagtggctggtccagggcta

SEQ ID NO: 5966454 - DNA, 14 bp, Homo sapiens
agcagtggcttgct

SEQ ID NO: 5966455 - DNA, 13 bp, Homo sapiens
agcagtgggcagg

SEQ ID NO: 5966456 - DNA, 16 bp, Homo sapiens
agcagtgggcaggtgg

SEQ ID NO: 5966457 - DNA, 17 bp, Homo sapiens
agcagtgggcaggtggc

SEQ ID NO: 5966458 - DNA, 18 bp, Homo sapiens
agcagtgggcaggtggcc

SEQ ID NO: 5966459 - DNA, 16 bp, Homo sapiens
agcagtgggccctggc

SEQ ID NO: 5966460 - DNA, 19 bp, Homo sapiens
agcagtgggccctggctct

SEQ ID NO: 5966461 - DNA, 13 bp, Homo sapiens
agcagtggggagc

SEQ ID NO: 5966462 - DNA, 22 bp, Homo sapiens
agcagtgggtcatgatgctctt

SEQ ID NO: 5966463 - DNA, 14 bp, Homo sapiens
agcagtgtccagag

SEQ ID NO: 5966464 - DNA, 17 bp, Homo sapiens
agcagtgtccagagacc

SEQ ID NO: 5966465 - DNA, 23 bp, Homo sapiens
agcagtgtcccctgccccagagg

SEQ ID NO: 5966466 - DNA, 21 bp, Homo sapiens
agcagtgtcgccgtccctctg

SEQ ID NO: 5966467 - DNA, 11 bp, Homo sapiens
agcagtgtgag

SEQ ID NO: 5966468 - DNA, 15 bp, Homo sapiens
agcagtgtgagggtg

SEQ ID NO: 5966469 - DNA, 16 bp, Homo sapiens
agcagtgtgagggtgc

SEQ ID NO: 5966470 - DNA, 18 bp, Homo sapiens
agcagtgtgagggtgcag

SEQ ID NO: 5966471 - DNA, 23 bp, Homo sapiens
agcagtgtgctttgcattttctg

SEQ ID NO: 5966472 - DNA, 20 bp, Homo sapiens
agcagtgtggagaccctgcc

SEQ ID NO: 5966473 - DNA, 23 bp, Homo sapiens
agcagtgtggggggacagacagg

SEQ ID NO: 5966474 - DNA, 21 bp, Homo sapiens
agcagtgtgtccttggggcac

SEQ ID NO: 5966475 - DNA, 22 bp, Homo sapiens
agcagtgtgtccttggggcaca

SEQ ID NO: 5966476 - DNA, 15 bp, Homo sapiens
agcagtgtgtctcct

SEQ ID NO: 5966477 - DNA, 19 bp, Homo sapiens
agcagtgttacttgcaggt

SEQ ID NO: 5966478 - DNA, 17 bp, Homo sapiens
agcagtgttagcttagt

SEQ ID NO: 5966479 - DNA, 18 bp, Homo sapiens
agcagtgttctcacagtg

SEQ ID NO: 5966480 - DNA, 19 bp, Homo sapiens
agcagtgttgcgtttttcc

SEQ ID NO: 5966481 - DNA, 20 bp, Homo sapiens
agcagtgttgcgtttttcct

SEQ ID NO: 5966482 - DNA, 21 bp, Homo sapiens
agcagtgttgcgtttttcctt

SEQ ID NO: 5966483 - DNA, 20 bp, Homo sapiens
agcagtgttgctcagctcct

SEQ ID NO: 5966484 - DNA, 12 bp, Homo sapiens
agcagtgtttgc

SEQ ID NO: 5966485 - DNA, 14 bp, Homo sapiens
agcagttagaaata

SEQ ID NO: 5966486 - DNA, 22 bp, Homo sapiens
agcagttataacagatgtgaaa

SEQ ID NO: 5966487 - DNA, 21 bp, Homo sapiens
agcagttatgtgacctcacgt

SEQ ID NO: 5966488 - DNA, 16 bp, Homo sapiens
agcagttcacttccta

SEQ ID NO: 5966489 - DNA, 18 bp, Homo sapiens
agcagttcagagctgccc

SEQ ID NO: 5966490 - DNA, 13 bp, Homo sapiens
agtggccaggcag

SEQ ID NO: 5966491 - DNA, 17 bp, Homo sapiens
agtggccaggcagggag

SEQ ID NO: 5966492 - DNA, 13 bp, Homo sapiens
agtggccagggct

SEQ ID NO: 5966493 - DNA, 17 bp, Homo sapiens
agtggccatcatttctg

SEQ ID NO: 5966494 - DNA, 17 bp, Homo sapiens
agtggccatctggaaat

SEQ ID NO: 5966495 - DNA, 13 bp, Homo sapiens
agtggcccaggga

SEQ ID NO: 5966496 - DNA, 23 bp, Homo sapiens
agtggcccatgtgactgtggcat

SEQ ID NO: 5966497 - DNA, 14 bp, Homo sapiens
agtggccccacctg

SEQ ID NO: 5966498 - DNA, 19 bp, Homo sapiens
agtggcccccgggcctgca

SEQ ID NO: 5966499 - DNA, 20 bp, Homo sapiens
agtggcccccgggcctgcac

SEQ ID NO: 5966500 - DNA, 21 bp, Homo sapiens
agtggcccccgggcctgcaca

SEQ ID NO: 5966501 - DNA, 22 bp, Homo sapiens
agtggcccccgggcctgcacag

SEQ ID NO: 5966502 - DNA, 16 bp, Homo sapiens
agtggccccctcctcc

SEQ ID NO: 5966503 - DNA, 22 bp, Homo sapiens
agtggcccctcacctgggcctt

SEQ ID NO: 5966504 - DNA, 23 bp, Homo sapiens
agtggcccctcgtgacctacagg

SEQ ID NO: 5966505 - DNA, 21 bp, Homo sapiens
agtggcccctgcccccaaagg

SEQ ID NO: 5966506 - DNA, 21 bp, Homo sapiens
agtggccgaaccccccactcc

SEQ ID NO: 5966507 - DNA, 20 bp, Homo sapiens
agtggccgcaagcgcaggga

SEQ ID NO: 5966508 - DNA, 16 bp, Homo sapiens
agtggccggggaagct

SEQ ID NO: 5966509 - DNA, 19 bp, Homo sapiens
agtggccggggctgaagcc

SEQ ID NO: 5966510 - DNA, 21 bp, Homo sapiens
agtggccggggctgaagccac

SEQ ID NO: 5966511 - DNA, 20 bp, Homo sapiens
agtggccggttgccactctc

SEQ ID NO: 5966512 - DNA, 17 bp, Homo sapiens
agtggcctagagcactc

SEQ ID NO: 5966513 - DNA, 20 bp, Homo sapiens
agtggcctcaaccctccctc

SEQ ID NO: 5966514 - DNA, 14 bp, Homo sapiens
agtggcctccctgc

SEQ ID NO: 5966515 - DNA, 15 bp, Homo sapiens
agtggcctccctgct

SEQ ID NO: 5966516 - DNA, 18 bp, Homo sapiens
agtggcctccctgctgtg

SEQ ID NO: 5966517 - DNA, 22 bp, Homo sapiens
agtggcctccgtcactacctgg

SEQ ID NO: 5966518 - DNA, 14 bp, Homo sapiens
agtggcctctttgt

SEQ ID NO: 5966519 - DNA, 21 bp, Homo sapiens
agtggcctgagaagagtcgag

SEQ ID NO: 5966520 - DNA, 17 bp, Homo sapiens
agtggcctgatctctgc

SEQ ID NO: 5966521 - DNA, 18 bp, Homo sapiens
agtggcctgatctctgct

SEQ ID NO: 5966522 - DNA, 20 bp, Homo sapiens
agtggcctgatctctgctcc

SEQ ID NO: 5966523 - DNA, 21 bp, Homo sapiens
agtggcctggatgcacagtgc

SEQ ID NO: 5966524 - DNA, 22 bp, Homo sapiens
agtggcctggatgcacagtgcc

SEQ ID NO: 5966525 - DNA, 18 bp, Homo sapiens
agtggcctggccaggagc

SEQ ID NO: 5966526 - DNA, 13 bp, Homo sapiens
agtggcctggccg

SEQ ID NO: 5966527 - DNA, 12 bp, Homo sapiens
agtggcctgggt

SEQ ID NO: 5966528 - DNA, 23 bp, Homo sapiens
agtggcctgggtcccagggctgg

SEQ ID NO: 5966529 - DNA, 20 bp, Homo sapiens
agtggcctgtaagtccaagc

SEQ ID NO: 5966530 - DNA, 16 bp, Homo sapiens
agtggcgagtccagac

SEQ ID NO: 5966531 - DNA, 22 bp, Homo sapiens
agtggcgagtccagacaccatc

SEQ ID NO: 5966532 - DNA, 13 bp, Homo sapiens
agtggcggggccc

SEQ ID NO: 5966533 - DNA, 17 bp, Homo sapiens
agtggcggggcccctgc

SEQ ID NO: 5966534 - DNA, 15 bp, Homo sapiens
agtggcgtggcctcc

SEQ ID NO: 5966535 - DNA, 16 bp, Homo sapiens
agtggcgtggcctccc

SEQ ID NO: 5966536 - DNA, 18 bp, Homo sapiens
agtggcgtggcctcccca

SEQ ID NO: 5966537 - DNA, 19 bp, Homo sapiens
agtggcgtggcctccccat

SEQ ID NO: 5966538 - DNA, 19 bp, Homo sapiens
agtggcgtgggagccagcc

SEQ ID NO: 5966539 - DNA, 15 bp, Homo sapiens
agtggcgttgggagg

SEQ ID NO: 5966540 - DNA, 18 bp, Homo sapiens
agtggctaaagagatgag

SEQ ID NO: 5966541 - DNA, 14 bp, Homo sapiens
agtggctagtcctc

SEQ ID NO: 5966542 - DNA, 17 bp, Homo sapiens
agtggctagtcctcact

SEQ ID NO: 5966543 - DNA, 17 bp, Homo sapiens
agtggctcacgcctgta

SEQ ID NO: 5966544 - DNA, 17 bp, Homo sapiens
agtggctcactggctgg

SEQ ID NO: 5966545 - DNA, 20 bp, Homo sapiens
agtggctcagacccctcagc

SEQ ID NO: 5966546 - DNA, 14 bp, Homo sapiens
agtggctccccacc

SEQ ID NO: 5966547 - DNA, 18 bp, Homo sapiens
agtggctccccacctgga

SEQ ID NO: 5966548 - DNA, 20 bp, Homo sapiens
agtggctccccacctggaca

SEQ ID NO: 5966549 - DNA, 23 bp, Homo sapiens
agtggctccccacctggacacac

SEQ ID NO: 5966550 - DNA, 13 bp, Homo sapiens
agtggctcctccc

SEQ ID NO: 5966551 - DNA, 17 bp, Homo sapiens
agtggctcctcccggtg

SEQ ID NO: 5966552 - DNA, 15 bp, Homo sapiens
agtggctcgccaggc

SEQ ID NO: 5966553 - DNA, 13 bp, Homo sapiens
agtggctcttggg

SEQ ID NO: 5966554 - DNA, 18 bp, Homo sapiens
agtggctgacagagcagg

SEQ ID NO: 5966555 - DNA, 18 bp, Homo sapiens
agtggctgaccaggccct

SEQ ID NO: 5966556 - DNA, 18 bp, Homo sapiens
agtggctgccacacccag

SEQ ID NO: 5966557 - DNA, 22 bp, Homo sapiens
agtggctgccccttgctggacc

SEQ ID NO: 5966558 - DNA, 15 bp, Homo sapiens
agtggctgccggagg

SEQ ID NO: 5966559 - DNA, 19 bp, Homo sapiens
agtggctgccttctttcca

SEQ ID NO: 5966560 - DNA, 18 bp, Homo sapiens
agtggctgcggtgtttgg

SEQ ID NO: 5966561 - DNA, 18 bp, Homo sapiens
agtggctgctctgggaag

SEQ ID NO: 5966562 - DNA, 11 bp, Homo sapiens
agtggctgctg

SEQ ID NO: 5966563 - DNA, 14 bp, Homo sapiens
agtggctgctgact

SEQ ID NO: 5966564 - DNA, 13 bp, Homo sapiens
agtggctgctgcc

SEQ ID NO: 5966565 - DNA, 16 bp, Homo sapiens
agtggctgctgcccag

SEQ ID NO: 5966566 - DNA, 19 bp, Homo sapiens
agtggctgctgcccaggcc

SEQ ID NO: 5966567 - DNA, 11 bp, Homo sapiens
agtggctgggg

SEQ ID NO: 5966568 - DNA, 16 bp, Homo sapiens
agtggctggggcatgg

SEQ ID NO: 5966569 - DNA, 22 bp, Homo sapiens
agtggctggggcatggaaggca

SEQ ID NO: 5966570 - DNA, 20 bp, Homo sapiens
agtggctgggggactgcttt

SEQ ID NO: 5966571 - DNA, 16 bp, Homo sapiens
agtggctggggtggag

SEQ ID NO: 5966572 - DNA, 12 bp, Homo sapiens
agtggctgggtg

SEQ ID NO: 5966573 - DNA, 23 bp, Homo sapiens
agtggctgggtgggcccagaact

SEQ ID NO: 5966574 - DNA, 15 bp, Homo sapiens
agtggctggtagaaa

SEQ ID NO: 5966575 - DNA, 15 bp, Homo sapiens
agtggctggtccagg

SEQ ID NO: 5966576 - DNA, 19 bp, Homo sapiens
agtggctggtccagggcta

SEQ ID NO: 5966577 - DNA, 15 bp, Homo sapiens
agtggctggtctgga

SEQ ID NO: 5966578 - DNA, 18 bp, Homo sapiens
agtggctggtgcccatga

SEQ ID NO: 5966579 - DNA, 17 bp, Homo sapiens
agtggctgtcatcagcc

SEQ ID NO: 5966580 - DNA, 23 bp, Homo sapiens
agtggctgtccagtgcccattcc

SEQ ID NO: 5966581 - DNA, 21 bp, Homo sapiens
agtggctgtcttaaaagatat

SEQ ID NO: 5966582 - DNA, 22 bp, Homo sapiens
agtggctgtcttaaaagatata

SEQ ID NO: 5966583 - DNA, 16 bp, Homo sapiens
agtggctgtgaaggag

SEQ ID NO: 5966584 - DNA, 15 bp, Homo sapiens
agtggctgtttcatc

SEQ ID NO: 5966585 - DNA, 18 bp, Homo sapiens
agtggcttagctgccatc

SEQ ID NO: 5966586 - DNA, 15 bp, Homo sapiens
agtggcttcagcccc

SEQ ID NO: 5966587 - DNA, 17 bp, Homo sapiens
agtggcttcatctgtca

SEQ ID NO: 5966588 - DNA, 19 bp, Homo sapiens
agtggcttcattagagcag

SEQ ID NO: 5966589 - DNA, 14 bp, Homo sapiens
agtggcttctttcc

SEQ ID NO: 5966590 - DNA, 20 bp, Homo sapiens
agtggcttcttttgaactgt

SEQ ID NO: 5966591 - DNA, 15 bp, Homo sapiens
agtggcttggagcag

SEQ ID NO: 5966592 - DNA, 20 bp, Homo sapiens
agtggcttggagcagaggtg

SEQ ID NO: 5966593 - DNA, 23 bp, Homo sapiens
agtggcttggagcagaggtgggg

SEQ ID NO: 5966594 - DNA, 21 bp, Homo sapiens
agtggcttgtgattctgggat

SEQ ID NO: 5966595 - DNA, 12 bp, Homo sapiens
agtggctttcta

SEQ ID NO: 5966596 - DNA, 19 bp, Homo sapiens
agtggcttttgccccagaa

SEQ ID NO: 5966597 - DNA, 24 bp, Homo sapiens
agtggctttttgtactgtagttca

SEQ ID NO: 5966598 - DNA, 19 bp, Homo sapiens
agtggcttttttcctcctg

SEQ ID NO: 5966599 - DNA, 17 bp, Homo sapiens
agtgggaaaaatgtagg

SEQ ID NO: 5966600 - DNA, 22 bp, Homo sapiens
agtgggaaagatacatgctaag

SEQ ID NO: 5966601 - DNA, 18 bp, Homo sapiens
agtgggaaagcattttct

SEQ ID NO: 5966602 - DNA, 16 bp, Homo sapiens
agtgggaagagctggg

SEQ ID NO: 5966603 - DNA, 22 bp, Homo sapiens
agtgggaagcccatcctgacca

SEQ ID NO: 5966604 - DNA, 18 bp, Homo sapiens
agtgggaagtgaagcccc

SEQ ID NO: 5966605 - DNA, 18 bp, Homo sapiens
agtgggaatgttctttct

SEQ ID NO: 5966606 - DNA, 20 bp, Homo sapiens
agtgggaatgttctttctgc

SEQ ID NO: 5966607 - DNA, 15 bp, Homo sapiens
agtgggacaaaccag

SEQ ID NO: 5966608 - DNA, 22 bp, Homo sapiens
agtgggacagacagcagctgga

SEQ ID NO: 5966609 - DNA, 15 bp, Homo sapiens
agtgggacagagtct

SEQ ID NO: 5966610 - DNA, 22 bp, Homo sapiens
agtgggacagcccagagcctgg

SEQ ID NO: 5966611 - DNA, 15 bp, Homo sapiens
agtgggacagttcct

SEQ ID NO: 5966612 - DNA, 23 bp, Homo sapiens
agtgggacccatagatcttctga

SEQ ID NO: 5966613 - DNA, 20 bp, Homo sapiens
agtgggactcggtgagccgg

SEQ ID NO: 5966614 - DNA, 18 bp, Homo sapiens
agtgggacttggagagca

SEQ ID NO: 5966615 - DNA, 14 bp, Homo sapiens
agtgggagaagtgg

SEQ ID NO: 5966616 - DNA, 15 bp, Homo sapiens
agtgggagaagtggc

SEQ ID NO: 5966617 - DNA, 14 bp, Homo sapiens
agtgggagaggaag

SEQ ID NO: 5966618 - DNA, 17 bp, Homo sapiens
agtgggagaggaagcca

SEQ ID NO: 5966619 - DNA, 14 bp, Homo sapiens
agtgggagaggctg

SEQ ID NO: 5966620 - DNA, 15 bp, Homo sapiens
agtgggagaggctgg

SEQ ID NO: 5966621 - DNA, 21 bp, Homo sapiens
agtgggagagtacctgtgtgt

SEQ ID NO: 5966622 - DNA, 13 bp, Homo sapiens
agtgggagcagct

SEQ ID NO: 5966623 - DNA, 14 bp, Homo sapiens
agtgggagcagctt

SEQ ID NO: 5966624 - DNA, 16 bp, Homo sapiens
agtgggagctgagctg

SEQ ID NO: 5966625 - DNA, 17 bp, Homo sapiens
agtgggagctgagctgg

SEQ ID NO: 5966626 - DNA, 16 bp, Homo sapiens
agtgggagcttcccgg

SEQ ID NO: 5966627 - DNA, 18 bp, Homo sapiens
agtgggaggagagggcag

SEQ ID NO: 5966628 - DNA, 16 bp, Homo sapiens
agtgggaggcgcgagc

SEQ ID NO: 5966629 - DNA, 11 bp, Homo sapiens
agtgggagggg

SEQ ID NO: 5966630 - DNA, 19 bp, Homo sapiens
agtgggaggggcaggctga

SEQ ID NO: 5966631 - DNA, 22 bp, Homo sapiens
agtgggagggtaccagcagaaa

SEQ ID NO: 5966632 - DNA, 23 bp, Homo sapiens
agtgggagtcaagtgtgcctgct

SEQ ID NO: 5966633 - DNA, 22 bp, Homo sapiens
agtgggatagctattgcagctt

SEQ ID NO: 5966634 - DNA, 13 bp, Homo sapiens
agtgggatgggct

SEQ ID NO: 5966635 - DNA, 16 bp, Homo sapiens
agtgggatgggctcta

SEQ ID NO: 5966636 - DNA, 20 bp, Homo sapiens
agtgggattatcgagcatgt

SEQ ID NO: 5966637 - DNA, 22 bp, Homo sapiens
agtgggatttggggcctcaaga

SEQ ID NO: 5966638 - DNA, 16 bp, Homo sapiens
agtgggcacctcagaa

SEQ ID NO: 5966639 - DNA, 22 bp, Homo sapiens
agtgggcaggaggccccaggct

SEQ ID NO: 5966640 - DNA, 23 bp, Homo sapiens
agtgggcaggaggccccaggctg

SEQ ID NO: 5966641 - DNA, 18 bp, Homo sapiens
agtgggcattttgacaac

SEQ ID NO: 5966642 - DNA, 13 bp, Homo sapiens
agtgggccaggac

SEQ ID NO: 5966643 - DNA, 15 bp, Homo sapiens
agtgggccaggacag

SEQ ID NO: 5966644 - DNA, 16 bp, Homo sapiens
agtgggccaggacagg

SEQ ID NO: 5966645 - DNA, 20 bp, Homo sapiens
ataacagctaccatgacaac

SEQ ID NO: 5966646 - DNA, 16 bp, Homo sapiens
ataacagggtaaatta

SEQ ID NO: 5966647 - DNA, 23 bp, Homo sapiens
ataacaggttattttagtttctg

SEQ ID NO: 5966648 - DNA, 15 bp, Homo sapiens
ataacagtagtgtta

SEQ ID NO: 5966649 - DNA, 15 bp, Homo sapiens
ataacagtatttcca

SEQ ID NO: 5966650 - DNA, 12 bp, Homo sapiens
ataacagtgcag

SEQ ID NO: 5966651 - DNA, 15 bp, Homo sapiens
ataacagtgccattg

SEQ ID NO: 5966652 - DNA, 21 bp, Homo sapiens
ataacagtgtctttctagcca

SEQ ID NO: 5966653 - DNA, 18 bp, Homo sapiens
ataacagttataaagaaa

SEQ ID NO: 5966654 - DNA, 13 bp, Homo sapiens
ataacagttatat

SEQ ID NO: 5966655 - DNA, 15 bp, Homo sapiens
ataacagttatattt

SEQ ID NO: 5966656 - DNA, 22 bp, Homo sapiens
ataacagttttgagtaattcaa

SEQ ID NO: 5966657 - DNA, 15 bp, Homo sapiens
ataacataaatctgt

SEQ ID NO: 5966658 - DNA, 17 bp, Homo sapiens
ataacataaatctgtga

SEQ ID NO: 5966659 - DNA, 19 bp, Homo sapiens
ataacataaatctgtgaac

SEQ ID NO: 5966660 - DNA, 23 bp, Homo sapiens
ataacataacctcagagtatctt

SEQ ID NO: 5966661 - DNA, 22 bp, Homo sapiens
ataacataagctagaaaaatta

SEQ ID NO: 5966662 - DNA, 19 bp, Homo sapiens
ataacatacaatgaccaca

SEQ ID NO: 5966663 - DNA, 12 bp, Homo sapiens
ataacatagttg

SEQ ID NO: 5966664 - DNA, 15 bp, Homo sapiens
ataacatatctaaag

SEQ ID NO: 5966665 - DNA, 16 bp, Homo sapiens
ataacatatctaaagt

SEQ ID NO: 5966666 - DNA, 15 bp, Homo sapiens
ataacatatttattg

SEQ ID NO: 5966667 - DNA, 17 bp, Homo sapiens
agtgggcttggagatgg

SEQ ID NO: 5966668 - DNA, 12 bp, Homo sapiens
agtggggaagag

SEQ ID NO: 5966669 - DNA, 17 bp, Homo sapiens
agtggggacagggaggg

SEQ ID NO: 5966670 - DNA, 19 bp, Homo sapiens
agtggggacagggaggggg

SEQ ID NO: 5966671 - DNA, 18 bp, Homo sapiens
agtggggacgggggctgc

SEQ ID NO: 5966672 - DNA, 21 bp, Homo sapiens
agtggggacgggggctgcttc

SEQ ID NO: 5966673 - DNA, 19 bp, Homo sapiens
agtggggagacacctcaga

SEQ ID NO: 5966674 - DNA, 12 bp, Homo sapiens
agtggggagagg

SEQ ID NO: 5966675 - DNA, 23 bp, Homo sapiens
agtggggagcagttttcccctgg

SEQ ID NO: 5966676 - DNA, 21 bp, Homo sapiens
agtggggagcggagcttggcc

SEQ ID NO: 5966677 - DNA, 16 bp, Homo sapiens
agtggggaggagactc

SEQ ID NO: 5966678 - DNA, 20 bp, Homo sapiens
agtggggaggggcctggcct

SEQ ID NO: 5966679 - DNA, 19 bp, Homo sapiens
agtggggcccatggcccca

SEQ ID NO: 5966680 - DNA, 17 bp, Homo sapiens
agtggggcctgccctct

SEQ ID NO: 5966681 - DNA, 12 bp, Homo sapiens
agtggggcctgg

SEQ ID NO: 5966682 - DNA, 15 bp, Homo sapiens
agtggggcctgggag

SEQ ID NO: 5966683 - DNA, 17 bp, Homo sapiens
agtggggctaaatgaag

SEQ ID NO: 5966684 - DNA, 17 bp, Homo sapiens
agtggggctagactggg

SEQ ID NO: 5966685 - DNA, 15 bp, Homo sapiens
agtggggctctctga

SEQ ID NO: 5966686 - DNA, 15 bp, Homo sapiens
agtgggggagaatgg

SEQ ID NO: 5966687 - DNA, 22 bp, Homo sapiens
agtgggggatgggtcctctaga

SEQ ID NO: 5966688 - DNA, 17 bp, Homo sapiens
agtggggggaacgccca

SEQ ID NO: 5966689 - DNA, 19 bp, Homo sapiens
agtggggggaacgcccact

SEQ ID NO: 5966690 - DNA, 15 bp, Homo sapiens
agtggggggacagag

SEQ ID NO: 5966691 - DNA, 15 bp, Homo sapiens
agtgggggtgcctgg

SEQ ID NO: 5966692 - DNA, 16 bp, Homo sapiens
agtgggggtggggggt

SEQ ID NO: 5966693 - DNA, 18 bp, Homo sapiens
agtggggtaattctgctt

SEQ ID NO: 5966694 - DNA, 20 bp, Homo sapiens
agtggggtcaagctgagctg

SEQ ID NO: 5966695 - DNA, 21 bp, Homo sapiens
agtggggtcccccctgagtgg

SEQ ID NO: 5966696 - DNA, 18 bp, Homo sapiens
agtggggtctccctctcc

SEQ ID NO: 5966697 - DNA, 19 bp, Homo sapiens
agtggggtctccctctcct

SEQ ID NO: 5966698 - DNA, 16 bp, Homo sapiens
agtggggtgaacagct

SEQ ID NO: 5966699 - DNA, 22 bp, Homo sapiens
agtggggtgaacagctggtgcc

SEQ ID NO: 5966700 - DNA, 19 bp, Homo sapiens
agtgggtatttcttatttg

SEQ ID NO: 5966701 - DNA, 20 bp, Homo sapiens
agtgggtcacctgacctctg

SEQ ID NO: 5966702 - DNA, 17 bp, Homo sapiens
agtgggtcccacttccc

SEQ ID NO: 5966703 - DNA, 21 bp, Homo sapiens
agtgggtcccacttcccctcc

SEQ ID NO: 5966704 - DNA, 22 bp, Homo sapiens
agtgggtcccacttcccctcct

SEQ ID NO: 5966705 - DNA, 18 bp, Homo sapiens
agtgggtgaataatacag

SEQ ID NO: 5966706 - DNA, 14 bp, Homo sapiens
agtgggtgaatgtg

SEQ ID NO: 5966707 - DNA, 17 bp, Homo sapiens
agtgggtgaatgtgtga

SEQ ID NO: 5966708 - DNA, 19 bp, Homo sapiens
agtgggtgacaagagcctg

SEQ ID NO: 5966709 - DNA, 15 bp, Homo sapiens
agtgggtgagaaatt

SEQ ID NO: 5966710 - DNA, 20 bp, Homo sapiens
agtgggtgagaaattttagt

SEQ ID NO: 5966711 - DNA, 22 bp, Homo sapiens
agtgggtgagatgctggagaag

SEQ ID NO: 5966712 - DNA, 14 bp, Homo sapiens
agtgggtggcacct

SEQ ID NO: 5966713 - DNA, 16 bp, Homo sapiens
agtgggtgggacacag

SEQ ID NO: 5966714 - DNA, 19 bp, Homo sapiens
agtgggtgggacacagaga

SEQ ID NO: 5966715 - DNA, 20 bp, Homo sapiens
agtgggtgggacacagagac

SEQ ID NO: 5966716 - DNA, 22 bp, Homo sapiens
agtgggtggggacagaccagcc

SEQ ID NO: 5966717 - DNA, 14 bp, Homo sapiens
agtgggtggggagt

SEQ ID NO: 5966718 - DNA, 22 bp, Homo sapiens
agtgggtggggctgtacacacc

SEQ ID NO: 5966719 - DNA, 16 bp, Homo sapiens
agtgggttatcttttt

SEQ ID NO: 5966720 - DNA, 15 bp, Homo sapiens
agtgggtttcacaag

SEQ ID NO: 5966721 - DNA, 15 bp, Homo sapiens
agtgggtttctgaca

SEQ ID NO: 5966722 - DNA, 22 bp, Homo sapiens
agtgggttttattgtccttcag

SEQ ID NO: 5966723 - DNA, 15 bp, Homo sapiens
agtgggttttttagt

SEQ ID NO: 5966724 - DNA, 22 bp, Homo sapiens
agtgggttttttagttgaattt

SEQ ID NO: 5966725 - DNA, 16 bp, Homo sapiens
agtggtaaaaaagaaa

SEQ ID NO: 5966726 - DNA, 14 bp, Homo sapiens
agtggtaacagctc

SEQ ID NO: 5966727 - DNA, 22 bp, Homo sapiens
agtggtaacagctctcttctta

SEQ ID NO: 5966728 - DNA, 18 bp, Homo sapiens
agtggtaatcatatgtgt

SEQ ID NO: 5966729 - DNA, 18 bp, Homo sapiens
agtggtacaatctggctc

SEQ ID NO: 5966730 - DNA, 20 bp, Homo sapiens
agtggtacaatctggctcac

SEQ ID NO: 5966731 - DNA, 15 bp, Homo sapiens
agtggtacaggaagg

SEQ ID NO: 5966732 - DNA, 15 bp, Homo sapiens
agtggtactagtgtg

SEQ ID NO: 5966733 - DNA, 15 bp, Homo sapiens
agtggtactctgtgt

SEQ ID NO: 5966734 - DNA, 23 bp, Homo sapiens
agtggtacttaagctcccctgcc

SEQ ID NO: 5966735 - DNA, 18 bp, Homo sapiens
agtggtagaggtgtgtgc

SEQ ID NO: 5966736 - DNA, 18 bp, Homo sapiens
agtggtagtaatttcctt

SEQ ID NO: 5966737 - DNA, 19 bp, Homo sapiens
agtggtatatacaagtaga

SEQ ID NO: 5966738 - DNA, 15 bp, Homo sapiens
agtggtatcttgcag

SEQ ID NO: 5966739 - DNA, 14 bp, Homo sapiens
agtggtatgtctct

SEQ ID NO: 5966740 - DNA, 20 bp, Homo sapiens
agtggtattatactgtagat

SEQ ID NO: 5966741 - DNA, 23 bp, Homo sapiens
agtggtattttaacatagcagct

SEQ ID NO: 5966742 - DNA, 16 bp, Homo sapiens
agtggtcaccttcctc

SEQ ID NO: 5966743 - DNA, 18 bp, Homo sapiens
agtggtcactggtcaggg

SEQ ID NO: 5966744 - DNA, 21 bp, Homo sapiens
agtggtcactggtcagggcag

SEQ ID NO: 5966745 - DNA, 22 bp, Homo sapiens
agtggtcactggtcagggcagt

SEQ ID NO: 5966746 - DNA, 21 bp, Homo sapiens
agtggtccacattctgctgcc

SEQ ID NO: 5966747 - DNA, 22 bp, Homo sapiens
agtggtccacattctgctgccc

SEQ ID NO: 5966748 - DNA, 15 bp, Homo sapiens
agtggtccagaaaca

SEQ ID NO: 5966749 - DNA, 24 bp, Homo sapiens
agtggtccagcgtcactccagtgc

SEQ ID NO: 5966750 - DNA, 21 bp, Homo sapiens
agtggtccagggtccagccct

SEQ ID NO: 5966751 - DNA, 19 bp, Homo sapiens
agtggtccatggaatgctt

SEQ ID NO: 5966752 - DNA, 13 bp, Homo sapiens
agtggtcctagag

SEQ ID NO: 5966753 - DNA, 17 bp, Homo sapiens
agtggtcctagaggccc

SEQ ID NO: 5966754 - DNA, 22 bp, Homo sapiens
agtggtcgcttactttgagtga

SEQ ID NO: 5966755 - DNA, 15 bp, Homo sapiens
agtggtctatttctc

SEQ ID NO: 5966756 - DNA, 14 bp, Homo sapiens
agtggtctcctctc

SEQ ID NO: 5966757 - DNA, 16 bp, Homo sapiens
agtggtctctactgtg

SEQ ID NO: 5966758 - DNA, 21 bp, Homo sapiens
agtggtctctactgtggcaaa

SEQ ID NO: 5966759 - DNA, 15 bp, Homo sapiens
agtggtctctgctgg

SEQ ID NO: 5966760 - DNA, 14 bp, Homo sapiens
agtggtctgtgtga

SEQ ID NO: 5966761 - DNA, 23 bp, Homo sapiens
agtggtcttaagaaatgtataaa

SEQ ID NO: 5966762 - DNA, 13 bp, Homo sapiens
agtggtctttctg

SEQ ID NO: 5966763 - DNA, 16 bp, Homo sapiens
agtggtctttctggag

SEQ ID NO: 5966764 - DNA, 20 bp, Homo sapiens
agtggtctttgtaagagtgt

SEQ ID NO: 5966765 - DNA, 24 bp, Homo sapiens
agtggtctttgtaagagtgtagaa

SEQ ID NO: 5966766 - DNA, 19 bp, Homo sapiens
agtggtgaggggccactgg

SEQ ID NO: 5966767 - DNA, 11 bp, Homo sapiens
agtggtgccta

SEQ ID NO: 5966768 - DNA, 16 bp, Homo sapiens
agtggtgcgatctggg

SEQ ID NO: 5966769 - DNA, 23 bp, Homo sapiens
agtggtgcgtttataattggctt

SEQ ID NO: 5966770 - DNA, 19 bp, Homo sapiens
agtggtgctataagtttta

SEQ ID NO: 5966771 - DNA, 20 bp, Homo sapiens
agtggtgctcagttgtagaa

SEQ ID NO: 5966772 - DNA, 16 bp, Homo sapiens
agtggtggcagggcct

SEQ ID NO: 5966773 - DNA, 16 bp, Homo sapiens
agtggtggctctgaga

SEQ ID NO: 5966774 - DNA, 16 bp, Homo sapiens
agtggtggcttctcca

SEQ ID NO: 5966775 - DNA, 16 bp, Homo sapiens
agtggtgggcggggag

SEQ ID NO: 5966776 - DNA, 22 bp, Homo sapiens
agtggtgggtaattgtacaata

SEQ ID NO: 5966777 - DNA, 24 bp, Homo sapiens
agtggtggttcctttgcaccctgt

SEQ ID NO: 5966778 - DNA, 18 bp, Homo sapiens
agtggtggttttctgttc

SEQ ID NO: 5966779 - DNA, 21 bp, Homo sapiens
agtggtggttttctgttcttt

SEQ ID NO: 5966780 - DNA, 21 bp, Homo sapiens
agtggtgtcatttttgaatgc

SEQ ID NO: 5966781 - DNA, 21 bp, Homo sapiens
agtggtgttggcagtgtttgt

SEQ ID NO: 5966782 - DNA, 22 bp, Homo sapiens
agtggtgttttaaagagaatgt

SEQ ID NO: 5966783 - DNA, 15 bp, Homo sapiens
agtggttaagaatgt

SEQ ID NO: 5966784 - DNA, 15 bp, Homo sapiens
agtggttactttgtg

SEQ ID NO: 5966785 - DNA, 14 bp, Homo sapiens
agtggttaggcagc

SEQ ID NO: 5966786 - DNA, 17 bp, Homo sapiens
agtggttattcattatt

SEQ ID NO: 5966787 - DNA, 21 bp, Homo sapiens
agtggttcaatacctgtttag

SEQ ID NO: 5966788 - DNA, 18 bp, Homo sapiens
agtggttcagtctagaag

SEQ ID NO: 5966789 - DNA, 15 bp, Homo sapiens
agtggttctggatat

SEQ ID NO: 5966790 - DNA, 15 bp, Homo sapiens
agtggttctgtgcct

SEQ ID NO: 5966791 - DNA, 16 bp, Homo sapiens
agtggttctgtgcctc

SEQ ID NO: 5966792 - DNA, 13 bp, Homo sapiens
agtggttgaatat

SEQ ID NO: 5966793 - DNA, 18 bp, Homo sapiens
agtggttgaatatgatta

SEQ ID NO: 5966794 - DNA, 14 bp, Homo sapiens
agtggttgttgcca

SEQ ID NO: 5966795 - DNA, 23 bp, Homo sapiens
agtggtttaggctatttgtaaat

SEQ ID NO: 5966796 - DNA, 16 bp, Homo sapiens
agtggtttcggaaaaa

SEQ ID NO: 5966797 - DNA, 20 bp, Homo sapiens
agtggtttctgcgtgtgtat

SEQ ID NO: 5966798 - DNA, 13 bp, Homo sapiens
agtggtttgcttt

SEQ ID NO: 5966799 - DNA, 18 bp, Homo sapiens
agtggtttgtagacttcc

SEQ ID NO: 5966800 - DNA, 16 bp, Homo sapiens
agtggttttaataaaa

SEQ ID NO: 5966801 - DNA, 20 bp, Homo sapiens
agtggttttaggatacttaa

SEQ ID NO: 5966802 - DNA, 23 bp, Homo sapiens
agtggtttttgctctagggccct

SEQ ID NO: 5966803 - DNA, 16 bp, Homo sapiens
agtgtaaaaatgagaa

SEQ ID NO: 5966804 - DNA, 17 bp, Homo sapiens
agtgtaaaatagaatgt

SEQ ID NO: 5966805 - DNA, 22 bp, Homo sapiens
agtgtaaaatattttaaaataa

SEQ ID NO: 5966806 - DNA, 15 bp, Homo sapiens
agtgtaaaatgtata

SEQ ID NO: 5966807 - DNA, 16 bp, Homo sapiens
agtgtaaaattgttaa

SEQ ID NO: 5966808 - DNA, 17 bp, Homo sapiens
agtgtaaagaataaatg

SEQ ID NO: 5966809 - DNA, 14 bp, Homo sapiens
agtgtaaagcattc

SEQ ID NO: 5966810 - DNA, 18 bp, Homo sapiens
agtgtaaagcattccaac

SEQ ID NO: 5966811 - DNA, 17 bp, Homo sapiens
agtgtaaataattttaa

SEQ ID NO: 5966812 - DNA, 21 bp, Homo sapiens
agtgtaaatcctttttcttta

SEQ ID NO: 5966813 - DNA, 17 bp, Homo sapiens
agtgtaacaagaaagga

SEQ ID NO: 5966814 - DNA, 20 bp, Homo sapiens
agtgtaacaagaaaggagag

SEQ ID NO: 5966815 - DNA, 18 bp, Homo sapiens
agtgtaacaattgtgtag

SEQ ID NO: 5966816 - DNA, 23 bp, Homo sapiens
agtgtaacaattgtgtagccttt

SEQ ID NO: 5966817 - DNA, 16 bp, Homo sapiens
agtgtaacagtactct

SEQ ID NO: 5966818 - DNA, 13 bp, Homo sapiens
agtgtaacctcag

SEQ ID NO: 5966819 - DNA, 23 bp, Homo sapiens
agtgtaacctcagtatttatgta

SEQ ID NO: 5966820 - DNA, 21 bp, Homo sapiens
agtgtaactggctgctccctg

SEQ ID NO: 5966821 - DNA, 21 bp, Homo sapiens
agtgtaagaactgtacattgt

SEQ ID NO: 5966822 - DNA, 17 bp, Homo sapiens
agtgtaagctagaagaa

SEQ ID NO: 5966823 - DNA, 13 bp, Homo sapiens
agtgtaagtgtga

SEQ ID NO: 5966824 - DNA, 18 bp, Homo sapiens
ataagcgtatttagactg

SEQ ID NO: 5966825 - DNA, 13 bp, Homo sapiens
ataagcgtttaat

SEQ ID NO: 5966826 - DNA, 13 bp, Homo sapiens
ataagctaagcct

SEQ ID NO: 5966827 - DNA, 22 bp, Homo sapiens
ataagctacctgaatggagaat

SEQ ID NO: 5966828 - DNA, 17 bp, Homo sapiens
ataagctactagcaaaa

SEQ ID NO: 5966829 - DNA, 23 bp, Homo sapiens
ataagctagatacgaaatcagtt

SEQ ID NO: 5966830 - DNA, 17 bp, Homo sapiens
ataagctagttgaatac

SEQ ID NO: 5966831 - DNA, 20 bp, Homo sapiens
ataagctagttgaatacttg

SEQ ID NO: 5966832 - DNA, 22 bp, Homo sapiens
ataagctagttgaatacttgaa

SEQ ID NO: 5966833 - DNA, 21 bp, Homo sapiens
ataagctatcacctagcagcc

SEQ ID NO: 5966834 - DNA, 20 bp, Homo sapiens
ataagctatgagttgaaatg

SEQ ID NO: 5966835 - DNA, 16 bp, Homo sapiens
ataagctatttgatgt

SEQ ID NO: 5966836 - DNA, 18 bp, Homo sapiens
ataagctatttgatgtaa

SEQ ID NO: 5966837 - DNA, 23 bp, Homo sapiens
ataagctatttgatgtaatactt

SEQ ID NO: 5966838 - DNA, 14 bp, Homo sapiens
ataagctctagttc

SEQ ID NO: 5966839 - DNA, 15 bp, Homo sapiens
ataagctgaaattgt

SEQ ID NO: 5966840 - DNA, 19 bp, Homo sapiens
ataagctggactagtgtcc

SEQ ID NO: 5966841 - DNA, 14 bp, Homo sapiens
ataagctgtaatat

SEQ ID NO: 5966842 - DNA, 16 bp, Homo sapiens
ataagctgttctggtg

SEQ ID NO: 5966843 - DNA, 14 bp, Homo sapiens
ctccagcctgggca

SEQ ID NO: 5966844 - DNA, 20 bp, Homo sapiens
ctccagcctgggcaacacag

SEQ ID NO: 5966845 - DNA, 13 bp, Homo sapiens
ctccagcctgggg

SEQ ID NO: 5966846 - DNA, 14 bp, Homo sapiens
ctccagcctgggga

SEQ ID NO: 5966847 - DNA, 16 bp, Homo sapiens
ctccagcctggggacc

SEQ ID NO: 5966848 - DNA, 21 bp, Homo sapiens
ctccagcctgggtcacagagt

SEQ ID NO: 5966849 - DNA, 15 bp, Homo sapiens
ctccagcctgggtga

SEQ ID NO: 5966850 - DNA, 22 bp, Homo sapiens
ctccagcctgggtgacagagca

SEQ ID NO: 5966851 - DNA, 12 bp, Homo sapiens
ctccagcctggt

SEQ ID NO: 5966852 - DNA, 14 bp, Homo sapiens
ctccagcctggtgg

SEQ ID NO: 5966853 - DNA, 21 bp, Homo sapiens
ctccagcctggtggcccagct

SEQ ID NO: 5966854 - DNA, 22 bp, Homo sapiens
ctccagcctggtggcccagcta

SEQ ID NO: 5966855 - DNA, 23 bp, Homo sapiens
ctccagcctggtggcccagctat

SEQ ID NO: 5966856 - DNA, 11 bp, Homo sapiens
ctccagcctgt

SEQ ID NO: 5966857 - DNA, 16 bp, Homo sapiens
ctccagcctgtcggcc

SEQ ID NO: 5966858 - DNA, 20 bp, Homo sapiens
ctccagcctgtcggccacac

SEQ ID NO: 5966859 - DNA, 24 bp, Homo sapiens
ctccagccttctctctctggtcag

SEQ ID NO: 5966860 - DNA, 18 bp, Homo sapiens
ctccagcctttgctccct

SEQ ID NO: 5966861 - DNA, 23 bp, Homo sapiens
ctccagcctttgctccctccccg

SEQ ID NO: 5966862 - DNA, 17 bp, Homo sapiens
ctccagcgatggtgctg

SEQ ID NO: 5966863 - DNA, 13 bp, Homo sapiens
ctccagcgctgag

SEQ ID NO: 5966864 - DNA, 17 bp, Homo sapiens
ctccagcggctgggtgg

SEQ ID NO: 5966865 - DNA, 23 bp, Homo sapiens
ctccagcgggacaccctggttcc

SEQ ID NO: 5966866 - DNA, 19 bp, Homo sapiens
ctccagcgtcagctgctcc

SEQ ID NO: 5966867 - DNA, 23 bp, Homo sapiens
ctccagcgtcagctgctccctgg

SEQ ID NO: 5966868 - DNA, 20 bp, Homo sapiens
ctccagcgtcatcggactct

SEQ ID NO: 5966869 - DNA, 20 bp, Homo sapiens
ctccagcgtcctcagcaccc

SEQ ID NO: 5966870 - DNA, 15 bp, Homo sapiens
ctccagcgtttgcct

SEQ ID NO: 5966871 - DNA, 20 bp, Homo sapiens
ctccagctaactgtggagaa

SEQ ID NO: 5966872 - DNA, 14 bp, Homo sapiens
ctccagctcaccag

SEQ ID NO: 5966873 - DNA, 19 bp, Homo sapiens
ctccagctcaccagcccca

SEQ ID NO: 5966874 - DNA, 21 bp, Homo sapiens
ctccagctcagaacccagggc

SEQ ID NO: 5966875 - DNA, 19 bp, Homo sapiens
ctccagctcatgacactgt

SEQ ID NO: 5966876 - DNA, 13 bp, Homo sapiens
ctccagctccaag

SEQ ID NO: 5966877 - DNA, 21 bp, Homo sapiens
ctccagctccaagacctgttg

SEQ ID NO: 5966878 - DNA, 19 bp, Homo sapiens
ctccagctccagtttccaa

SEQ ID NO: 5966879 - DNA, 13 bp, Homo sapiens
ctccagctccctg

SEQ ID NO: 5966880 - DNA, 23 bp, Homo sapiens
ctccagctcctcccacggggtcc

SEQ ID NO: 5966881 - DNA, 13 bp, Homo sapiens
ctccagctctggc

SEQ ID NO: 5966882 - DNA, 16 bp, Homo sapiens
ctccagctctggcaca

SEQ ID NO: 5966883 - DNA, 16 bp, Homo sapiens
ctccagctctggcatg

SEQ ID NO: 5966884 - DNA, 15 bp, Homo sapiens
ctgcccagagctgag

SEQ ID NO: 5966885 - DNA, 18 bp, Homo sapiens
ctgcccagagctgctggt

SEQ ID NO: 5966886 - DNA, 15 bp, Homo sapiens
ctgcccagagctggg

SEQ ID NO: 5966887 - DNA, 22 bp, Homo sapiens
ctgcccagagttgctgggagct

SEQ ID NO: 5966888 - DNA, 20 bp, Homo sapiens
ctgcccagatcagccagaag

SEQ ID NO: 5966889 - DNA, 18 bp, Homo sapiens
ctgcccagatgccctttg

SEQ ID NO: 5966890 - DNA, 16 bp, Homo sapiens
ctgcccagatgtttta

SEQ ID NO: 5966891 - DNA, 13 bp, Homo sapiens
ctgcccagcagcc

SEQ ID NO: 5966892 - DNA, 21 bp, Homo sapiens
ctgcccagcagcccctgagag

SEQ ID NO: 5966893 - DNA, 19 bp, Homo sapiens
ctgcccagccacccctcag

SEQ ID NO: 5966894 - DNA, 19 bp, Homo sapiens
ctgcccagccactccaagc

SEQ ID NO: 5966895 - DNA, 13 bp, Homo sapiens
ctgcccagccagc

SEQ ID NO: 5966896 - DNA, 17 bp, Homo sapiens
ctgcccagccccctggt

SEQ ID NO: 5966897 - DNA, 19 bp, Homo sapiens
ctgcccagccccgctcagg

SEQ ID NO: 5966898 - DNA, 21 bp, Homo sapiens
ctgcccagccccgctcaggcc

SEQ ID NO: 5966899 - DNA, 18 bp, Homo sapiens
ctgcccagccctctgtgg

SEQ ID NO: 5966900 - DNA, 21 bp, Homo sapiens
ctgcccagccctctgtggcca

SEQ ID NO: 5966901 - DNA, 14 bp, Homo sapiens
ctgcccagccctgg

SEQ ID NO: 5966902 - DNA, 20 bp, Homo sapiens
ctgcccagcctcgcatgcca

SEQ ID NO: 5966903 - DNA, 19 bp, Homo sapiens
ctgcccagcctgccccagc

SEQ ID NO: 5966904 - DNA, 17 bp, Homo sapiens
ctgcccagcctgctctc

SEQ ID NO: 5966905 - DNA, 18 bp, Homo sapiens
ctgcccagcctgctctcc

SEQ ID NO: 5966906 - DNA, 13 bp, Homo sapiens
ctgcccagcctgg

SEQ ID NO: 5966907 - DNA, 14 bp, Homo sapiens
ctgcccagcctggg

SEQ ID NO: 5966908 - DNA, 13 bp, Homo sapiens
ctgcccagcctgt

SEQ ID NO: 5966909 - DNA, 22 bp, Homo sapiens
ctgcccagcggacagtggcagg

SEQ ID NO: 5966910 - DNA, 16 bp, Homo sapiens
ctgcccagctcctcac

SEQ ID NO: 5966911 - DNA, 21 bp, Homo sapiens
ctgcccagctctgaccctgat

SEQ ID NO: 5966912 - DNA, 13 bp, Homo sapiens
ctgcccagcttgg

SEQ ID NO: 5966913 - DNA, 14 bp, Homo sapiens
ctgcccagcttggg

SEQ ID NO: 5966914 - DNA, 21 bp, Homo sapiens
ctgcccagcttgggcccagct

SEQ ID NO: 5966915 - DNA, 18 bp, Homo sapiens
ctgcccaggagagccagc

SEQ ID NO: 5966916 - DNA, 21 bp, Homo sapiens
ctgcccaggcagtctttgctc

SEQ ID NO: 5966917 - DNA, 17 bp, Homo sapiens
ctgcccaggccacagag

SEQ ID NO: 5966918 - DNA, 13 bp, Homo sapiens
ctgcccaggcccc

SEQ ID NO: 5966919 - DNA, 12 bp, Homo sapiens
ctgcccaggctc

SEQ ID NO: 5966920 - DNA, 18 bp, Homo sapiens
ctgcccaggctctgctga

SEQ ID NO: 5966921 - DNA, 18 bp, Homo sapiens
ctgcccaggctgtgcagc

SEQ ID NO: 5966922 - DNA, 17 bp, Homo sapiens
ctgcccaggggagccct

SEQ ID NO: 5966923 - DNA, 22 bp, Homo sapiens
ctgcccaggggagccctccacg

SEQ ID NO: 5966924 - DNA, 16 bp, Homo sapiens
ctgcccaggggtgccc

SEQ ID NO: 5966925 - DNA, 18 bp, Homo sapiens
ctgcccaggggtgccccc

SEQ ID NO: 5966926 - DNA, 15 bp, Homo sapiens
ctgcccaggtggggt

SEQ ID NO: 5966927 - DNA, 23 bp, Homo sapiens
ctgcccaggtggggtttcctgca

SEQ ID NO: 5966928 - DNA, 14 bp, Homo sapiens
ctgcccagtccccc

SEQ ID NO: 5966929 - DNA, 23 bp, Homo sapiens
ctgcccagtcgaccccaaaggaa

SEQ ID NO: 5966930 - DNA, 13 bp, Homo sapiens
ctgcccagtctgg

SEQ ID NO: 5966931 - DNA, 17 bp, Homo sapiens
ctgcccagtctggaaga

SEQ ID NO: 5966932 - DNA, 21 bp, Homo sapiens
ctgcccagtctttggagagct

SEQ ID NO: 5966933 - DNA, 22 bp, Homo sapiens
ctgcccagtgcaaaccacttct

SEQ ID NO: 5966934 - DNA, 20 bp, Homo sapiens
ctgcccagtgttgtttgtaa

SEQ ID NO: 5966935 - DNA, 20 bp, Homo sapiens
ctgcccagttagcccggcca

SEQ ID NO: 5966936 - DNA, 21 bp, Homo sapiens
ctgcccagttagcccggccaa

SEQ ID NO: 5966937 - DNA, 22 bp, Homo sapiens
ctgcccatacccctgcctgggt

SEQ ID NO: 5966938 - DNA, 17 bp, Homo sapiens
ctgcccatactgagcct

SEQ ID NO: 5966939 - DNA, 22 bp, Homo sapiens
ctgcccatcacagggttgggcc

SEQ ID NO: 5966940 - DNA, 15 bp, Homo sapiens
ctgcccatcccaccc

SEQ ID NO: 5966941 - DNA, 13 bp, Homo sapiens
ctgcccatcccag

SEQ ID NO: 5966942 - DNA, 20 bp, Homo sapiens
ctgcccatcccagtccctcg

SEQ ID NO: 5966943 - DNA, 15 bp, Homo sapiens
ctgcccatccgtctg

SEQ ID NO: 5966944 - DNA, 18 bp, Homo sapiens
ctgcccatctgggaaaat

SEQ ID NO: 5966945 - DNA, 18 bp, Homo sapiens
ctgcccatgcctaaagcc

SEQ ID NO: 5966946 - DNA, 18 bp, Homo sapiens
ctgcccatttcatattct

SEQ ID NO: 5966947 - DNA, 15 bp, Homo sapiens
ctgccccaaacaaat

SEQ ID NO: 5966948 - DNA, 16 bp, Homo sapiens
ctgccccaactcctgg

SEQ ID NO: 5966949 - DNA, 24 bp, Homo sapiens
ctgccccaactccttccagctagt

SEQ ID NO: 5966950 - DNA, 13 bp, Homo sapiens
ctgccccaagagc

SEQ ID NO: 5966951 - DNA, 12 bp, Homo sapiens
ctgccccaagca

SEQ ID NO: 5966952 - DNA, 18 bp, Homo sapiens
ctgccccaagcagccagc

SEQ ID NO: 5966953 - DNA, 22 bp, Homo sapiens
ctgccccaagcagccagccagt

SEQ ID NO: 5966954 - DNA, 14 bp, Homo sapiens
ctgccccaagcccc

SEQ ID NO: 5966955 - DNA, 22 bp, Homo sapiens
ctgccccaaggccccagggaca

SEQ ID NO: 5966956 - DNA, 19 bp, Homo sapiens
ctgccccaagggcccagac

SEQ ID NO: 5966957 - DNA, 15 bp, Homo sapiens
ctgccccaatcgggt

SEQ ID NO: 5966958 - DNA, 17 bp, Homo sapiens
ctgccccacacaggcct

SEQ ID NO: 5966959 - DNA, 20 bp, Homo sapiens
ctgccccacacaggcctggc

SEQ ID NO: 5966960 - DNA, 16 bp, Homo sapiens
ctgccccacacctcct

SEQ ID NO: 5966961 - DNA, 20 bp, Homo sapiens
ctgccccacacctcctctca

SEQ ID NO: 5966962 - DNA, 16 bp, Homo sapiens
ctgccccacaggccac

SEQ ID NO: 5966963 - DNA, 14 bp, Homo sapiens
ctgccccacatgca

SEQ ID NO: 5966964 - DNA, 14 bp, Homo sapiens
ctgccccaccagcc

SEQ ID NO: 5966965 - DNA, 16 bp, Homo sapiens
ctgccccaccccacct

SEQ ID NO: 5966966 - DNA, 22 bp, Homo sapiens
ctgccccaccccatccagccag

SEQ ID NO: 5966967 - DNA, 23 bp, Homo sapiens
ctgccccacccctccccattagc

SEQ ID NO: 5966968 - DNA, 12 bp, Homo sapiens
ctgccccaccct

SEQ ID NO: 5966969 - DNA, 14 bp, Homo sapiens
ctgccccaccctca

SEQ ID NO: 5966970 - DNA, 14 bp, Homo sapiens
ctgccccacggaga

SEQ ID NO: 5966971 - DNA, 17 bp, Homo sapiens
ctgccccacttctggca

SEQ ID NO: 5966972 - DNA, 19 bp, Homo sapiens
ctgccccacttctggcatg

SEQ ID NO: 5966973 - DNA, 13 bp, Homo sapiens
ctgccccagaaca

SEQ ID NO: 5966974 - DNA, 19 bp, Homo sapiens
ctgccccagagaagcctca

SEQ ID NO: 5966975 - DNA, 13 bp, Homo sapiens
ctgccccagaggc

SEQ ID NO: 5966976 - DNA, 19 bp, Homo sapiens
ctgccccagagtgggtctt

SEQ ID NO: 5966977 - DNA, 13 bp, Homo sapiens
ctgccccagccaa

SEQ ID NO: 5966978 - DNA, 15 bp, Homo sapiens
ctgccccagccccta

SEQ ID NO: 5966979 - DNA, 16 bp, Homo sapiens
ctgccccagcccctaa

SEQ ID NO: 5966980 - DNA, 19 bp, Homo sapiens
ctgccccagcccctaagcc

SEQ ID NO: 5966981 - DNA, 21 bp, Homo sapiens
ctgccccagcctactccacct

SEQ ID NO: 5966982 - DNA, 14 bp, Homo sapiens
ctgccccagcctgt

SEQ ID NO: 5966983 - DNA, 18 bp, Homo sapiens
ctgccccagcctgtcctt

SEQ ID NO: 5966984 - DNA, 14 bp, Homo sapiens
ctgccccagcgcgg

SEQ ID NO: 5966985 - DNA, 20 bp, Homo sapiens
ctgccccagcgcggcttggc

SEQ ID NO: 5966986 - DNA, 22 bp, Homo sapiens
ctgccccagctactaaggtgct

SEQ ID NO: 5966987 - DNA, 13 bp, Homo sapiens
ctgccccagctcc

SEQ ID NO: 5966988 - DNA, 14 bp, Homo sapiens
ctgccccagctccg

SEQ ID NO: 5966989 - DNA, 16 bp, Homo sapiens
ctgccccagctctggc

SEQ ID NO: 5966990 - DNA, 13 bp, Homo sapiens
ctgccccagctgg

SEQ ID NO: 5966991 - DNA, 19 bp, Homo sapiens
ctgccccaggccggagccc

SEQ ID NO: 5966992 - DNA, 14 bp, Homo sapiens
ctgccccaggcctg

SEQ ID NO: 5966993 - DNA, 15 bp, Homo sapiens
ctgccccaggcctga

SEQ ID NO: 5966994 - DNA, 17 bp, Homo sapiens
ctgccccaggcctggac

SEQ ID NO: 5966995 - DNA, 20 bp, Homo sapiens
ctgccccaggtacacctccc

SEQ ID NO: 5966996 - DNA, 19 bp, Homo sapiens
ctgccccagtagtcagaag

SEQ ID NO: 5966997 - DNA, 18 bp, Homo sapiens
ctgccccatcacttacag

SEQ ID NO: 5966998 - DNA, 16 bp, Homo sapiens
ctgccccatcctccag

SEQ ID NO: 5966999 - DNA, 17 bp, Homo sapiens
ctgccccatcctccagc

SEQ ID NO: 5967000 - DNA, 13 bp, Homo sapiens
ctgccccatctcc

SEQ ID NO: 5967001 - DNA, 15 bp, Homo sapiens
ctgccccatgtgtcc

SEQ ID NO: 5967002 - DNA, 17 bp, Homo sapiens
ctgccccattccagctc

SEQ ID NO: 5967003 - DNA, 19 bp, Homo sapiens
ctgccccattccagctctc

SEQ ID NO: 5967004 - DNA, 16 bp, Homo sapiens
ctgccccattgagatc

SEQ ID NO: 5967005 - DNA, 22 bp, Homo sapiens
ctgccccattgagatcttcctg

SEQ ID NO: 5967006 - DNA, 14 bp, Homo sapiens
ctgcccccaacact

SEQ ID NO: 5967007 - DNA, 20 bp, Homo sapiens
ctgcccccaacactccaggc

SEQ ID NO: 5967008 - DNA, 22 bp, Homo sapiens
ctgcccccaacactccaggccc

SEQ ID NO: 5967009 - DNA, 23 bp, Homo sapiens
ctgcccccaaggaggcagcctgg

SEQ ID NO: 5967010 - DNA, 13 bp, Homo sapiens
ctgcccccacacc

SEQ ID NO: 5967011 - DNA, 14 bp, Homo sapiens
ctgcccccacaccc

SEQ ID NO: 5967012 - DNA, 19 bp, Homo sapiens
ctgcccccacacctggccc

SEQ ID NO: 5967013 - DNA, 15 bp, Homo sapiens
ctgcccccacagatc

SEQ ID NO: 5967014 - DNA, 17 bp, Homo sapiens
ctgcccccacagatcca

SEQ ID NO: 5967015 - DNA, 13 bp, Homo sapiens
ctgcccccacagc

SEQ ID NO: 5967016 - DNA, 17 bp, Homo sapiens
ctgcccccacagctcct

SEQ ID NO: 5967017 - DNA, 19 bp, Homo sapiens
ctgcccccaccacggccac

SEQ ID NO: 5967018 - DNA, 21 bp, Homo sapiens
ctgcccccaccccttcctgtc

SEQ ID NO: 5967019 - DNA, 15 bp, Homo sapiens
ctgcccccagaaagc

SEQ ID NO: 5967020 - DNA, 15 bp, Homo sapiens
ctgcccccagacccc

SEQ ID NO: 5967021 - DNA, 19 bp, Homo sapiens
ctgcccgggagctcaggaa

SEQ ID NO: 5967022 - DNA, 18 bp, Homo sapiens
ctgcccgggccccttgct

SEQ ID NO: 5967023 - DNA, 13 bp, Homo sapiens
ctgcccgggctcc

SEQ ID NO: 5967024 - DNA, 15 bp, Homo sapiens
ctgcccgggctccca

SEQ ID NO: 5967025 - DNA, 16 bp, Homo sapiens
ctgcccgggctcccac

SEQ ID NO: 5967026 - DNA, 19 bp, Homo sapiens
ctgcccggggagctgcaga

SEQ ID NO: 5967027 - DNA, 13 bp, Homo sapiens
ctgcccggggcag

SEQ ID NO: 5967028 - DNA, 20 bp, Homo sapiens
ctgcccggggcagctgccag

SEQ ID NO: 5967029 - DNA, 22 bp, Homo sapiens
ctgcccggggtggggtgcactc

SEQ ID NO: 5967030 - DNA, 19 bp, Homo sapiens
ctgcccggttgccatggag

SEQ ID NO: 5967031 - DNA, 17 bp, Homo sapiens
ctgcccgtcttcagcct

SEQ ID NO: 5967032 - DNA, 15 bp, Homo sapiens
ctgcccgtgtacata

SEQ ID NO: 5967033 - DNA, 23 bp, Homo sapiens
ctgcccgttgccgggcctggact

SEQ ID NO: 5967034 - DNA, 17 bp, Homo sapiens
ctgccctaacctgacag

SEQ ID NO: 5967035 - DNA, 19 bp, Homo sapiens
ctgccctaagcccccaggg

SEQ ID NO: 5967036 - DNA, 21 bp, Homo sapiens
ctgccctaagcccccagggcc

SEQ ID NO: 5967037 - DNA, 21 bp, Homo sapiens
ctgccctaatgcgcaggctgg

SEQ ID NO: 5967038 - DNA, 21 bp, Homo sapiens
ctgccctagagcacactgtag

SEQ ID NO: 5967039 - DNA, 19 bp, Homo sapiens
ctgccctagcagtttgcct

SEQ ID NO: 5967040 - DNA, 22 bp, Homo sapiens
ctgccctagcagtttgcctctg

SEQ ID NO: 5967041 - DNA, 23 bp, Homo sapiens
ctgccctagcagtttgcctctgc

SEQ ID NO: 5967042 - DNA, 21 bp, Homo sapiens
ctgccctagcgctctcttcca

SEQ ID NO: 5967043 - DNA, 16 bp, Homo sapiens
ctgccctagctccaca

SEQ ID NO: 5967044 - DNA, 12 bp, Homo sapiens
ctgccctagctg

SEQ ID NO: 5967045 - DNA, 17 bp, Homo sapiens
ctgccctagctgacccc

SEQ ID NO: 5967046 - DNA, 12 bp, Homo sapiens
ctgccctaggct

SEQ ID NO: 5967047 - DNA, 18 bp, Homo sapiens
ctgccctaggctccgtca

SEQ ID NO: 5967048 - DNA, 18 bp, Homo sapiens
ctgccctcacctcccttt

SEQ ID NO: 5967049 - DNA, 18 bp, Homo sapiens
ctgccctcactccactcc

SEQ ID NO: 5967050 - DNA, 17 bp, Homo sapiens
ctgccctcagcttggat

SEQ ID NO: 5967051 - DNA, 20 bp, Homo sapiens
ctgccctcagggactgcacc

SEQ ID NO: 5967052 - DNA, 22 bp, Homo sapiens
ctgccctcagggactgcaccct

SEQ ID NO: 5967053 - DNA, 12 bp, Homo sapiens
ctgccctcatgg

SEQ ID NO: 5967054 - DNA, 21 bp, Homo sapiens
ctgccctcattactgggcctt

SEQ ID NO: 5967055 - DNA, 23 bp, Homo sapiens
ctgccctcattactgggccttag

SEQ ID NO: 5967056 - DNA, 22 bp, Homo sapiens
ctgccctccagctgctgctctc

SEQ ID NO: 5967057 - DNA, 14 bp, Homo sapiens
ctgccctccagggc

SEQ ID NO: 5967058 - DNA, 18 bp, Homo sapiens
ctgccctccatcccttcc

SEQ ID NO: 5967059 - DNA, 21 bp, Homo sapiens
ctgccctccatcccttcccca

SEQ ID NO: 5967060 - DNA, 10 bp, Homo sapiens
ctgccctccc

SEQ ID NO: 5967061 - DNA, 12 bp, Homo sapiens
ctgccctcccaa

SEQ ID NO: 5967062 - DNA, 14 bp, Homo sapiens
ctgccctcccaagt

SEQ ID NO: 5967063 - DNA, 18 bp, Homo sapiens
ctgccctcccaagtccca

SEQ ID NO: 5967064 - DNA, 20 bp, Homo sapiens
ctgccctcccacagcctcct

SEQ ID NO: 5967065 - DNA, 15 bp, Homo sapiens
ctccagtctcctgac

SEQ ID NO: 5967066 - DNA, 16 bp, Homo sapiens
ctccagtctcctgaca

SEQ ID NO: 5967067 - DNA, 15 bp, Homo sapiens
ctccagtctgttctc

SEQ ID NO: 5967068 - DNA, 19 bp, Homo sapiens
ctccagtcttccacctgga

SEQ ID NO: 5967069 - DNA, 13 bp, Homo sapiens
ctccagtgaaact

SEQ ID NO: 5967070 - DNA, 16 bp, Homo sapiens
ctccagtgagctggaa

SEQ ID NO: 5967071 - DNA, 19 bp, Homo sapiens
ctccagtgagtacctgcaa

SEQ ID NO: 5967072 - DNA, 21 bp, Homo sapiens
ctccagtgagtacctgcaaaa

SEQ ID NO: 5967073 - DNA, 13 bp, Homo sapiens
ctccagtgcagtc

SEQ ID NO: 5967074 - DNA, 18 bp, Homo sapiens
ctccagtgccagcaatga

SEQ ID NO: 5967075 - DNA, 13 bp, Homo sapiens
ctccagtgccgct

SEQ ID NO: 5967076 - DNA, 13 bp, Homo sapiens
ctccagtgctcag

SEQ ID NO: 5967077 - DNA, 14 bp, Homo sapiens
ctccagtgctcagc

SEQ ID NO: 5967078 - DNA, 14 bp, Homo sapiens
ctccagtgctggct

SEQ ID NO: 5967079 - DNA, 15 bp, Homo sapiens
ctccagtgctggctg

SEQ ID NO: 5967080 - DNA, 19 bp, Homo sapiens
ctccagtgctggctgctgg

SEQ ID NO: 5967081 - DNA, 20 bp, Homo sapiens
ctccagtgctggctgctggc

SEQ ID NO: 5967082 - DNA, 14 bp, Homo sapiens
ctccagtgcttggc

SEQ ID NO: 5967083 - DNA, 15 bp, Homo sapiens
ctccagtgcttggct

SEQ ID NO: 5967084 - DNA, 19 bp, Homo sapiens
ctccagtgcttggctgccc

SEQ ID NO: 5967085 - DNA, 20 bp, Homo sapiens
ctccagtgctttatccacat

SEQ ID NO: 5967086 - DNA, 18 bp, Homo sapiens
ctccagtgggaggacaga

SEQ ID NO: 5967087 - DNA, 22 bp, Homo sapiens
ctccagtgggctgatgctggga

SEQ ID NO: 5967088 - DNA, 20 bp, Homo sapiens
ctccagtggggcaagatttt

SEQ ID NO: 5967089 - DNA, 23 bp, Homo sapiens
ctccagtggggcaagattttcct

SEQ ID NO: 5967090 - DNA, 14 bp, Homo sapiens
ctccagtgtacata

SEQ ID NO: 5967091 - DNA, 16 bp, Homo sapiens
ctccagtgtcagggtc

SEQ ID NO: 5967092 - DNA, 14 bp, Homo sapiens
ctccagtgtcctga

SEQ ID NO: 5967093 - DNA, 17 bp, Homo sapiens
ctccagtgtcctgagct

SEQ ID NO: 5967094 - DNA, 20 bp, Homo sapiens
ctccagtgtcctgagctcag

SEQ ID NO: 5967095 - DNA, 22 bp, Homo sapiens
ctccagtgtcctgagctcagcg

SEQ ID NO: 5967096 - DNA, 23 bp, Homo sapiens
ctccagtgtgaatatatggtctg

SEQ ID NO: 5967097 - DNA, 14 bp, Homo sapiens
ctccagtgtgcgtt

SEQ ID NO: 5967098 - DNA, 19 bp, Homo sapiens
ctccagtgttgcctcctcc

SEQ ID NO: 5967099 - DNA, 21 bp, Homo sapiens
ctccagttagaatgcaccatg

SEQ ID NO: 5967100 - DNA, 14 bp, Homo sapiens
ctccagttgattat

SEQ ID NO: 5967101 - DNA, 19 bp, Homo sapiens
ctccagttgggactcagga

SEQ ID NO: 5967102 - DNA, 16 bp, Homo sapiens
ctccagtttcagaagc

SEQ ID NO: 5967103 - DNA, 22 bp, Homo sapiens
ctccagtttctcttaagctgcc

SEQ ID NO: 5967104 - DNA, 17 bp, Homo sapiens
ctccagtttgcacctgt

SEQ ID NO: 5967105 - DNA, 18 bp, Homo sapiens
ctccagtttgcacctgtc

SEQ ID NO: 5967106 - DNA, 21 bp, Homo sapiens
ctccagtttgcacctgtcccc

SEQ ID NO: 5967107 - DNA, 21 bp, Homo sapiens
ctccagtttgcccaccacaac

SEQ ID NO: 5967108 - DNA, 23 bp, Homo sapiens
ctccagttttcgtattgcaaata

SEQ ID NO: 5967109 - DNA, 23 bp, Homo sapiens
ctccagttttctcctctgcttct

SEQ ID NO: 5967110 - DNA, 20 bp, Homo sapiens
ctccagtttttgtttttgca

SEQ ID NO: 5967111 - DNA, 17 bp, Homo sapiens
ctccataaaaagaaagc

SEQ ID NO: 5967112 - DNA, 15 bp, Homo sapiens
ctccataaacagact

SEQ ID NO: 5967113 - DNA, 22 bp, Homo sapiens
ctccataaacatgaaaacactt

SEQ ID NO: 5967114 - DNA, 16 bp, Homo sapiens
ctccataagtaagaaa

SEQ ID NO: 5967115 - DNA, 13 bp, Homo sapiens
ctccataagttta

SEQ ID NO: 5967116 - DNA, 15 bp, Homo sapiens
ctccataatgccact

SEQ ID NO: 5967117 - DNA, 17 bp, Homo sapiens
ctccataattgcaaggg

SEQ ID NO: 5967118 - DNA, 20 bp, Homo sapiens
ctccataatttggtcatttg

SEQ ID NO: 5967119 - DNA, 16 bp, Homo sapiens
ctccatacagcctcta

SEQ ID NO: 5967120 - DNA, 21 bp, Homo sapiens
ctccatacagcctctacagcc

SEQ ID NO: 5967121 - DNA, 13 bp, Homo sapiens
ctccatacatccc

SEQ ID NO: 5967122 - DNA, 21 bp, Homo sapiens
ctccatacccacaatctgagc

SEQ ID NO: 5967123 - DNA, 22 bp, Homo sapiens
ctccatacccacaatctgagca

SEQ ID NO: 5967124 - DNA, 14 bp, Homo sapiens
ctccataccttttc

SEQ ID NO: 5967125 - DNA, 14 bp, Homo sapiens
ctccatactccact

SEQ ID NO: 5967126 - DNA, 16 bp, Homo sapiens
ctccatactccactcc

SEQ ID NO: 5967127 - DNA, 19 bp, Homo sapiens
ctccatactccactccaag

SEQ ID NO: 5967128 - DNA, 19 bp, Homo sapiens
ctccatactgggctaagga

SEQ ID NO: 5967129 - DNA, 12 bp, Homo sapiens
ctccatactttg

SEQ ID NO: 5967130 - DNA, 14 bp, Homo sapiens
ctccatagagcagt

SEQ ID NO: 5967131 - DNA, 18 bp, Homo sapiens
ctccatagctccttccca

SEQ ID NO: 5967132 - DNA, 17 bp, Homo sapiens
ctccataggagggaagg

SEQ ID NO: 5967133 - DNA, 21 bp, Homo sapiens
ctccatagtttggcatttgca

SEQ ID NO: 5967134 - DNA, 17 bp, Homo sapiens
ctccatatcagctctct

SEQ ID NO: 5967135 - DNA, 14 bp, Homo sapiens
ctccatatctcctt

SEQ ID NO: 5967136 - DNA, 16 bp, Homo sapiens
ctccatatctccttcc

SEQ ID NO: 5967137 - DNA, 17 bp, Homo sapiens
ctccatatctccttccc

SEQ ID NO: 5967138 - DNA, 13 bp, Homo sapiens
ctccatatttccg

SEQ ID NO: 5967139 - DNA, 15 bp, Homo sapiens
ctccatcactgagag

SEQ ID NO: 5967140 - DNA, 19 bp, Homo sapiens
ctccatcagttagagctga

SEQ ID NO: 5967141 - DNA, 18 bp, Homo sapiens
ctccatcataggctgaca

SEQ ID NO: 5967142 - DNA, 18 bp, Homo sapiens
ctccatcatatgcctgac

SEQ ID NO: 5967143 - DNA, 14 bp, Homo sapiens
ctccatccaaggcc

SEQ ID NO: 5967144 - DNA, 22 bp, Homo sapiens
ctccatccacccctctggcacc

SEQ ID NO: 5967145 - DNA, 19 bp, Homo sapiens
ctccatccacgtggcctct

SEQ ID NO: 5967146 - DNA, 13 bp, Homo sapiens
ctccatccatcct

SEQ ID NO: 5967147 - DNA, 21 bp, Homo sapiens
ctccatccatctgtccgtcca

SEQ ID NO: 5967148 - DNA, 16 bp, Homo sapiens
ctccatccatgtgttc

SEQ ID NO: 5967149 - DNA, 16 bp, Homo sapiens
ctccatccccatcggc

SEQ ID NO: 5967150 - DNA, 14 bp, Homo sapiens
ctccatccccatgt

SEQ ID NO: 5967151 - DNA, 13 bp, Homo sapiens
ctccatcccctcc

SEQ ID NO: 5967152 - DNA, 23 bp, Homo sapiens
ctccatcccctccctgcctgctc

SEQ ID NO: 5967153 - DNA, 15 bp, Homo sapiens
ctccatccctctaat

SEQ ID NO: 5967154 - DNA, 22 bp, Homo sapiens
ctccatccctctaatgagactg

SEQ ID NO: 5967155 - DNA, 11 bp, Homo sapiens
ctccatccctg

SEQ ID NO: 5967156 - DNA, 15 bp, Homo sapiens
ctccatccctgctct

SEQ ID NO: 5967157 - DNA, 18 bp, Homo sapiens
ctccatccctgctctggt

SEQ ID NO: 5967158 - DNA, 16 bp, Homo sapiens
ctccatccctggcccc

SEQ ID NO: 5967159 - DNA, 19 bp, Homo sapiens
ctccatccctggccccctc

SEQ ID NO: 5967160 - DNA, 20 bp, Homo sapiens
ctccatccgtgcctcttttt

SEQ ID NO: 5967161 - DNA, 16 bp, Homo sapiens
ctccatccgtgctgca

SEQ ID NO: 5967162 - DNA, 20 bp, Homo sapiens
ctccatcctatccactgggc

SEQ ID NO: 5967163 - DNA, 17 bp, Homo sapiens
ctccatcctcatctctc

SEQ ID NO: 5967164 - DNA, 14 bp, Homo sapiens
ctccatcctccatg

SEQ ID NO: 5967165 - DNA, 13 bp, Homo sapiens
ctccatcctgagg

SEQ ID NO: 5967166 - DNA, 14 bp, Homo sapiens
ctccatcctgaggc

SEQ ID NO: 5967167 - DNA, 15 bp, Homo sapiens
ctccatcctgcagat

SEQ ID NO: 5967168 - DNA, 14 bp, Homo sapiens
ctccatcctgccag

SEQ ID NO: 5967169 - DNA, 16 bp, Homo sapiens
ctccatccttctcccc

SEQ ID NO: 5967170 - DNA, 19 bp, Homo sapiens
ctccatccttgcatcactg

SEQ ID NO: 5967171 - DNA, 18 bp, Homo sapiens
ctccatcgccatcttctt

SEQ ID NO: 5967172 - DNA, 20 bp, Homo sapiens
ctccatcgcccaggcctggg

SEQ ID NO: 5967173 - DNA, 22 bp, Homo sapiens
ctccatcgcgccagcgacctct

SEQ ID NO: 5967174 - DNA, 19 bp, Homo sapiens
ctccatcgtctcatcctcc

SEQ ID NO: 5967175 - DNA, 20 bp, Homo sapiens
ctccatcgtctcatcctcct

SEQ ID NO: 5967176 - DNA, 17 bp, Homo sapiens
ctccatctaaactgccc

SEQ ID NO: 5967177 - DNA, 16 bp, Homo sapiens
ctccatctcaaaacaa

SEQ ID NO: 5967178 - DNA, 14 bp, Homo sapiens
ctccatctcatgta

SEQ ID NO: 5967179 - DNA, 16 bp, Homo sapiens
ctccatctcccaaggc

SEQ ID NO: 5967180 - DNA, 21 bp, Homo sapiens
ctccatctcccaaggctgcca

SEQ ID NO: 5967181 - DNA, 23 bp, Homo sapiens
ctccatctcccaaggctgccaga

SEQ ID NO: 5967182 - DNA, 17 bp, Homo sapiens
ctccatctccgcctcca

SEQ ID NO: 5967183 - DNA, 23 bp, Homo sapiens
ctccatctcctgctcaccacctg

SEQ ID NO: 5967184 - DNA, 20 bp, Homo sapiens
ctccatctctcatcctccag

SEQ ID NO: 5967185 - DNA, 21 bp, Homo sapiens
ctccatctctcatcctccagt

SEQ ID NO: 5967186 - DNA, 12 bp, Homo sapiens
ctccatctctgg

SEQ ID NO: 5967187 - DNA, 13 bp, Homo sapiens
ctccatctctggt

SEQ ID NO: 5967188 - DNA, 12 bp, Homo sapiens
ctccatctcttc

SEQ ID NO: 5967189 - DNA, 15 bp, Homo sapiens
ctccatctcttctgc

SEQ ID NO: 5967190 - DNA, 23 bp, Homo sapiens
ctccatctcttctgcaagcctca

SEQ ID NO: 5967191 - DNA, 20 bp, Homo sapiens
ctccatctcttgtaccagcc

SEQ ID NO: 5967192 - DNA, 22 bp, Homo sapiens
ctccatctcttgtaccagccca

SEQ ID NO: 5967193 - DNA, 23 bp, Homo sapiens
ctccatctctttaaaaacaaaca

SEQ ID NO: 5967194 - DNA, 17 bp, Homo sapiens
ctccatctggggatgga

SEQ ID NO: 5967195 - DNA, 19 bp, Homo sapiens
ctccatcttactctgccct

SEQ ID NO: 5967196 - DNA, 13 bp, Homo sapiens
ctccatcttcaat

SEQ ID NO: 5967197 - DNA, 16 bp, Homo sapiens
ctccatcttctttgca

SEQ ID NO: 5967198 - DNA, 17 bp, Homo sapiens
ctgcccttgttgcctgc

SEQ ID NO: 5967199 - DNA, 18 bp, Homo sapiens
ctgcccttgttgcctgca

SEQ ID NO: 5967200 - DNA, 20 bp, Homo sapiens
ctgcccttgttgcctgcacc

SEQ ID NO: 5967201 - DNA, 18 bp, Homo sapiens
ctgccctttcaaagcact

SEQ ID NO: 5967202 - DNA, 15 bp, Homo sapiens
ctgccctttctcagg

SEQ ID NO: 5967203 - DNA, 22 bp, Homo sapiens
ctgccctttgcagtgtgcaggg

SEQ ID NO: 5967204 - DNA, 17 bp, Homo sapiens
ctgcccttttaaatggc

SEQ ID NO: 5967205 - DNA, 18 bp, Homo sapiens
ctgcccttttaaatggca

SEQ ID NO: 5967206 - DNA, 18 bp, Homo sapiens
ctgccgaaacccttgact

SEQ ID NO: 5967207 - DNA, 19 bp, Homo sapiens
ctgccgaagaattgtcttg

SEQ ID NO: 5967208 - DNA, 15 bp, Homo sapiens
ctgccgacctcgtcc

SEQ ID NO: 5967209 - DNA, 16 bp, Homo sapiens
ctgccgacggagccac

SEQ ID NO: 5967210 - DNA, 17 bp, Homo sapiens
ctgccgacggagccact

SEQ ID NO: 5967211 - DNA, 18 bp, Homo sapiens
ctgccgacggagccactg

SEQ ID NO: 5967212 - DNA, 23 bp, Homo sapiens
ctgccgacttggagactcctggt

SEQ ID NO: 5967213 - DNA, 16 bp, Homo sapiens
ctgccgagcaaccgtg

SEQ ID NO: 5967214 - DNA, 12 bp, Homo sapiens
ctgccgagccac

SEQ ID NO: 5967215 - DNA, 20 bp, Homo sapiens
ctgccgagccaccatgcttg

SEQ ID NO: 5967216 - DNA, 19 bp, Homo sapiens
ctgccgagggctggccggg

SEQ ID NO: 5967217 - DNA, 22 bp, Homo sapiens
ctgccgagtaatgacgtgtgtg

SEQ ID NO: 5967218 - DNA, 14 bp, Homo sapiens
ctgccgatgcccaa

SEQ ID NO: 5967219 - DNA, 22 bp, Homo sapiens
ctgccgatgcccaatccaggcc

SEQ ID NO: 5967220 - DNA, 15 bp, Homo sapiens
ctgccgattttgtaa

SEQ ID NO: 5967221 - DNA, 17 bp, Homo sapiens
ctgccgattttgtaaat

SEQ ID NO: 5967222 - DNA, 16 bp, Homo sapiens
ctgccgcaaggccctg

SEQ ID NO: 5967223 - DNA, 21 bp, Homo sapiens
ctgccgcaaggccctgtccca

SEQ ID NO: 5967224 - DNA, 17 bp, Homo sapiens
ctgccgcaatacaggaa

SEQ ID NO: 5967225 - DNA, 16 bp, Homo sapiens
ctgccgcaccccagag

SEQ ID NO: 5967226 - DNA, 21 bp, Homo sapiens
ctgccgcagacgggcacagac

SEQ ID NO: 5967227 - DNA, 14 bp, Homo sapiens
ctgccgcagagctg

SEQ ID NO: 5967228 - DNA, 16 bp, Homo sapiens
ctgccgcagagctggc

SEQ ID NO: 5967229 - DNA, 18 bp, Homo sapiens
ctgccgcagagctggccg

SEQ ID NO: 5967230 - DNA, 13 bp, Homo sapiens
ctgccgcagccct

SEQ ID NO: 5967231 - DNA, 17 bp, Homo sapiens
ctgccgcagccctgcag

SEQ ID NO: 5967232 - DNA, 18 bp, Homo sapiens
ctgccgcagccctgcaga

SEQ ID NO: 5967233 - DNA, 21 bp, Homo sapiens
ctgccgcagccctgcagaggg

SEQ ID NO: 5967234 - DNA, 12 bp, Homo sapiens
ctgccgcatctg

SEQ ID NO: 5967235 - DNA, 17 bp, Homo sapiens
ctgccgcatgctccctc

SEQ ID NO: 5967236 - DNA, 20 bp, Homo sapiens
ctgccgccactggctgtgcc

SEQ ID NO: 5967237 - DNA, 16 bp, Homo sapiens
ctgccgcccacctcgc

SEQ ID NO: 5967238 - DNA, 16 bp, Homo sapiens
ctgccgccccacccag

SEQ ID NO: 5967239 - DNA, 16 bp, Homo sapiens
ctgccgcccccgcctg

SEQ ID NO: 5967240 - DNA, 18 bp, Homo sapiens
ctgccgcccttcctggag

SEQ ID NO: 5967241 - DNA, 22 bp, Homo sapiens
ctgccgcccttcctggaggctg

SEQ ID NO: 5967242 - DNA, 15 bp, Homo sapiens
ctgccgccgcccgct

SEQ ID NO: 5967243 - DNA, 15 bp, Homo sapiens
ctgccgcctcacctt

SEQ ID NO: 5967244 - DNA, 15 bp, Homo sapiens
ctgccgcctcccagc

SEQ ID NO: 5967245 - DNA, 20 bp, Homo sapiens
ctccatggctaagaccacag

SEQ ID NO: 5967246 - DNA, 17 bp, Homo sapiens
ctccatggcttcctcct

SEQ ID NO: 5967247 - DNA, 19 bp, Homo sapiens
ctccatggcttcctcctcc

SEQ ID NO: 5967248 - DNA, 24 bp, Homo sapiens
ctccatgggccaccgcccagctca

SEQ ID NO: 5967249 - DNA, 18 bp, Homo sapiens
ctccatggggttcgagac

SEQ ID NO: 5967250 - DNA, 23 bp, Homo sapiens
ctccatggggttcgagactccat

SEQ ID NO: 5967251 - DNA, 18 bp, Homo sapiens
ctccatggtgcctctgga

SEQ ID NO: 5967252 - DNA, 15 bp, Homo sapiens
ctccatgtaccttgt

SEQ ID NO: 5967253 - DNA, 14 bp, Homo sapiens
ctccatgtcatccg

SEQ ID NO: 5967254 - DNA, 22 bp, Homo sapiens
ctccatgtctctgagcattaga

SEQ ID NO: 5967255 - DNA, 21 bp, Homo sapiens
ctccatgtgagaatatttttc

SEQ ID NO: 5967256 - DNA, 15 bp, Homo sapiens
ctccatgtgcatata

SEQ ID NO: 5967257 - DNA, 17 bp, Homo sapiens
ctccatgtgcatataaa

SEQ ID NO: 5967258 - DNA, 18 bp, Homo sapiens
ctccatgttggcctgtca

SEQ ID NO: 5967259 - DNA, 20 bp, Homo sapiens
ctccatgttggtcaggctgg

SEQ ID NO: 5967260 - DNA, 19 bp, Homo sapiens
ctccatgtttccaccaaat

SEQ ID NO: 5967261 - DNA, 23 bp, Homo sapiens
ctccatgtttccaccaaatgaat

SEQ ID NO: 5967262 - DNA, 19 bp, Homo sapiens
ctccattaaacttctactg

SEQ ID NO: 5967263 - DNA, 20 bp, Homo sapiens
ctccattaaacttctactga

SEQ ID NO: 5967264 - DNA, 14 bp, Homo sapiens
ctccattaaagtct

SEQ ID NO: 5967265 - DNA, 14 bp, Homo sapiens
ctccattactgtga

SEQ ID NO: 5967266 - DNA, 21 bp, Homo sapiens
ctccattcaatttcaggctcc

SEQ ID NO: 5967267 - DNA, 15 bp, Homo sapiens
ctccattcactccca

SEQ ID NO: 5967268 - DNA, 13 bp, Homo sapiens
ctccattcatcct

SEQ ID NO: 5967269 - DNA, 15 bp, Homo sapiens
ctccattcccacccc

SEQ ID NO: 5967270 - DNA, 17 bp, Homo sapiens
ctccattcccacccctc

SEQ ID NO: 5967271 - DNA, 18 bp, Homo sapiens
ctccattcccatcactgc

SEQ ID NO: 5967272 - DNA, 20 bp, Homo sapiens
ctccattcccatcactgctg

SEQ ID NO: 5967273 - DNA, 13 bp, Homo sapiens
ctccattccctag

SEQ ID NO: 5967274 - DNA, 14 bp, Homo sapiens
ctccattccctcca

SEQ ID NO: 5967275 - DNA, 21 bp, Homo sapiens
ctccattcctaggtcacttga

SEQ ID NO: 5967276 - DNA, 22 bp, Homo sapiens
ctccattcctgctctcccactg

SEQ ID NO: 5967277 - DNA, 21 bp, Homo sapiens
ctccattcctggagcccgagg

SEQ ID NO: 5967278 - DNA, 23 bp, Homo sapiens
ctccattctgaaaatagcaggac

SEQ ID NO: 5967279 - DNA, 14 bp, Homo sapiens
ctccattctgctcc

SEQ ID NO: 5967280 - DNA, 16 bp, Homo sapiens
ctccattctgctcctt

SEQ ID NO: 5967281 - DNA, 14 bp, Homo sapiens
ctccattgcacatg

SEQ ID NO: 5967282 - DNA, 18 bp, Homo sapiens
ctccattgcattcatgta

SEQ ID NO: 5967283 - DNA, 16 bp, Homo sapiens
ctccattgctgttgtt

SEQ ID NO: 5967284 - DNA, 20 bp, Homo sapiens
ctccattggctcccaagtca

SEQ ID NO: 5967285 - DNA, 23 bp, Homo sapiens
ctccattggtcctttttttttct

SEQ ID NO: 5967286 - DNA, 22 bp, Homo sapiens
ctccattgtgtgatccagccct

SEQ ID NO: 5967287 - DNA, 18 bp, Homo sapiens
ctccatttaaacagatgt

SEQ ID NO: 5967288 - DNA, 19 bp, Homo sapiens
ctccatttataaccccagc

SEQ ID NO: 5967289 - DNA, 11 bp, Homo sapiens
ctccatttcaa

SEQ ID NO: 5967290 - DNA, 18 bp, Homo sapiens
ctccatttcaactccaga

SEQ ID NO: 5967291 - DNA, 23 bp, Homo sapiens
ctccatttcccaaagtcctctgc

SEQ ID NO: 5967292 - DNA, 17 bp, Homo sapiens
ctccatttctggcttct

SEQ ID NO: 5967293 - DNA, 21 bp, Homo sapiens
ctccatttcttggttttgtat

SEQ ID NO: 5967294 - DNA, 17 bp, Homo sapiens
ctccatttctttcttcc

SEQ ID NO: 5967295 - DNA, 18 bp, Homo sapiens
ctccatttctttcttcca

SEQ ID NO: 5967296 - DNA, 18 bp, Homo sapiens
ctccatttggaattacaa

SEQ ID NO: 5967297 - DNA, 18 bp, Homo sapiens
ctccatttggtcctttct

SEQ ID NO: 5967298 - DNA, 20 bp, Homo sapiens
ctccatttggtcctttctcc

SEQ ID NO: 5967299 - DNA, 20 bp, Homo sapiens
ctccatttgtcatcgttccc

SEQ ID NO: 5967300 - DNA, 16 bp, Homo sapiens
ctccattttcaagctg

SEQ ID NO: 5967301 - DNA, 14 bp, Homo sapiens
ctccattttcttgt

SEQ ID NO: 5967302 - DNA, 15 bp, Homo sapiens
ctccattttcttgtc

SEQ ID NO: 5967303 - DNA, 16 bp, Homo sapiens
ctccattttcttgtca

SEQ ID NO: 5967304 - DNA, 21 bp, Homo sapiens
ctccattttggtgtctttctc

SEQ ID NO: 5967305 - DNA, 13 bp, Homo sapiens
ctccatttttccc

SEQ ID NO: 5967306 - DNA, 17 bp, Homo sapiens
ctccatttttcccagga

SEQ ID NO: 5967307 - DNA, 23 bp, Homo sapiens
ctccatttttcccaggacaggaa

SEQ ID NO: 5967308 - DNA, 20 bp, Homo sapiens
ctccatttttctcccaagaa

SEQ ID NO: 5967309 - DNA, 23 bp, Homo sapiens
ctccattttttcttcccttttcc

SEQ ID NO: 5967310 - DNA, 15 bp, Homo sapiens
ctcccaaaacatttt

SEQ ID NO: 5967311 - DNA, 13 bp, Homo sapiens
ctcccaaaagaat

SEQ ID NO: 5967312 - DNA, 15 bp, Homo sapiens
ctcccaaaagaatgg

SEQ ID NO: 5967313 - DNA, 16 bp, Homo sapiens
ctcccaaaagctagaa

SEQ ID NO: 5967314 - DNA, 20 bp, Homo sapiens
ctcccaaacgccctttcctc

SEQ ID NO: 5967315 - DNA, 15 bp, Homo sapiens
ctcccaaactccaag

SEQ ID NO: 5967316 - DNA, 15 bp, Homo sapiens
ctcccaaactgacaa

SEQ ID NO: 5967317 - DNA, 22 bp, Homo sapiens
ctcccaaagtgctgagattaca

SEQ ID NO: 5967318 - DNA, 23 bp, Homo sapiens
ctcccaaagtgctgagattacag

SEQ ID NO: 5967319 - DNA, 15 bp, Homo sapiens
ctcccaaagtgctgg

SEQ ID NO: 5967320 - DNA, 18 bp, Homo sapiens
ctcccaaagtgctgggat

SEQ ID NO: 5967321 - DNA, 22 bp, Homo sapiens
ctcccaaagtgctgggattaca

SEQ ID NO: 5967322 - DNA, 22 bp, Homo sapiens
ctcccaaagtgctgggattata

SEQ ID NO: 5967323 - DNA, 22 bp, Homo sapiens
ctcccaaagtgttaggattaca

SEQ ID NO: 5967324 - DNA, 18 bp, Homo sapiens
ctcccaaataaactcctt

SEQ ID NO: 5967325 - DNA, 20 bp, Homo sapiens
ctcccaaatgcagcttcagg

SEQ ID NO: 5967326 - DNA, 15 bp, Homo sapiens
ctcccaaatttgagt

SEQ ID NO: 5967327 - DNA, 23 bp, Homo sapiens
ctcccaacaacatgaaactgcct

SEQ ID NO: 5967328 - DNA, 18 bp, Homo sapiens
ctcccaacagaggcctcc

SEQ ID NO: 5967329 - DNA, 17 bp, Homo sapiens
ctcccaaccccagggcc

SEQ ID NO: 5967330 - DNA, 18 bp, Homo sapiens
ctcccaacccccctcctg

SEQ ID NO: 5967331 - DNA, 19 bp, Homo sapiens
ctcccaacccccctcctgc

SEQ ID NO: 5967332 - DNA, 12 bp, Homo sapiens
ctcccaaccctg

SEQ ID NO: 5967333 - DNA, 22 bp, Homo sapiens
ctcccaaccctgggctggggag

SEQ ID NO: 5967334 - DNA, 16 bp, Homo sapiens
ctcccaacctcaatgc

SEQ ID NO: 5967335 - DNA, 22 bp, Homo sapiens
ctcccaacctcaatgccctgcc

SEQ ID NO: 5967336 - DNA, 15 bp, Homo sapiens
ctcccaacgctgaag

SEQ ID NO: 5967337 - DNA, 20 bp, Homo sapiens
ctcccaacgctgaagcggtc

SEQ ID NO: 5967338 - DNA, 19 bp, Homo sapiens
ctcccaactataaaactag

SEQ ID NO: 5967339 - DNA, 17 bp, Homo sapiens
ctcccaactcaccccag

SEQ ID NO: 5967340 - DNA, 22 bp, Homo sapiens
ctcccaactcaccccagcccca

SEQ ID NO: 5967341 - DNA, 13 bp, Homo sapiens
ctcccaactcagc

SEQ ID NO: 5967342 - DNA, 15 bp, Homo sapiens
ctcccaactcagcct

SEQ ID NO: 5967343 - DNA, 16 bp, Homo sapiens
ctcccaactcagcctg

SEQ ID NO: 5967344 - DNA, 14 bp, Homo sapiens
ctcccaacttcttc

SEQ ID NO: 5967345 - DNA, 22 bp, Homo sapiens
ctcccaagacttcattgtccct

SEQ ID NO: 5967346 - DNA, 21 bp, Homo sapiens
ctcccaagcacccagagcttt

SEQ ID NO: 5967347 - DNA, 22 bp, Homo sapiens
ctcccaagcacctgggattaca

SEQ ID NO: 5967348 - DNA, 15 bp, Homo sapiens
ctcccaagcagctga

SEQ ID NO: 5967349 - DNA, 17 bp, Homo sapiens
ctcccaagcgttcctgg

SEQ ID NO: 5967350 - DNA, 23 bp, Homo sapiens
ctcccaagctcagagcagcctct

SEQ ID NO: 5967351 - DNA, 21 bp, Homo sapiens
ctcccaagctgatggacatga

SEQ ID NO: 5967352 - DNA, 19 bp, Homo sapiens
ctcccaagctgattttatt

SEQ ID NO: 5967353 - DNA, 17 bp, Homo sapiens
ctcccaagctggctggg

SEQ ID NO: 5967354 - DNA, 14 bp, Homo sapiens
ctcccaagctgtgc

SEQ ID NO: 5967355 - DNA, 16 bp, Homo sapiens
ctcccaagctgtgctg

SEQ ID NO: 5967356 - DNA, 17 bp, Homo sapiens
ctcccaagctgtgctgg

SEQ ID NO: 5967357 - DNA, 21 bp, Homo sapiens
ctcccaaggagggcaccatct

SEQ ID NO: 5967358 - DNA, 23 bp, Homo sapiens
ctcccaaggagggcaccatctta

SEQ ID NO: 5967359 - DNA, 22 bp, Homo sapiens
ctcccaaggcattctcccagct

SEQ ID NO: 5967360 - DNA, 14 bp, Homo sapiens
ctcccaagggaggc

SEQ ID NO: 5967361 - DNA, 22 bp, Homo sapiens
ctcccaaggggcccaaattctt

SEQ ID NO: 5967362 - DNA, 16 bp, Homo sapiens
ctcccaagtagctggg

SEQ ID NO: 5967363 - DNA, 13 bp, Homo sapiens
ctcccaagtggtg

SEQ ID NO: 5967364 - DNA, 19 bp, Homo sapiens
ctcccaagtttccatagca

SEQ ID NO: 5967365 - DNA, 20 bp, Homo sapiens
ctcccaagttttaggacaaa

SEQ ID NO: 5967366 - DNA, 16 bp, Homo sapiens
ctcccaataaagctgg

SEQ ID NO: 5967367 - DNA, 18 bp, Homo sapiens
ctcccaataaagctggac

SEQ ID NO: 5967368 - DNA, 17 bp, Homo sapiens
ctcccaatatccaattt

SEQ ID NO: 5967369 - DNA, 13 bp, Homo sapiens
ctcccaatcagct

SEQ ID NO: 5967370 - DNA, 22 bp, Homo sapiens
ctcccaatctcaatacagcctg

SEQ ID NO: 5967371 - DNA, 19 bp, Homo sapiens
ctcccaatttcagactccc

SEQ ID NO: 5967372 - DNA, 15 bp, Homo sapiens
ctcccacaagcctct

SEQ ID NO: 5967373 - DNA, 21 bp, Homo sapiens
ctcccacaagcctctgcccag

SEQ ID NO: 5967374 - DNA, 15 bp, Homo sapiens
ctgcctcagcctcct

SEQ ID NO: 5967375 - DNA, 18 bp, Homo sapiens
ctgcctcagcctcctgaa

SEQ ID NO: 5967376 - DNA, 16 bp, Homo sapiens
ctgcctcagccttcca

SEQ ID NO: 5967377 - DNA, 15 bp, Homo sapiens
ctgcctcagctacct

SEQ ID NO: 5967378 - DNA, 12 bp, Homo sapiens
ctgcctcagctg

SEQ ID NO: 5967379 - DNA, 16 bp, Homo sapiens
ctgcctcagctgaccc

SEQ ID NO: 5967380 - DNA, 22 bp, Homo sapiens
ctgcctcagctgacccggcctc

SEQ ID NO: 5967381 - DNA, 14 bp, Homo sapiens
ctgcctcagctgct

SEQ ID NO: 5967382 - DNA, 22 bp, Homo sapiens
ctgcctcagctgctcgcacaga

SEQ ID NO: 5967383 - DNA, 10 bp, Homo sapiens
ctgcctcagg

SEQ ID NO: 5967384 - DNA, 14 bp, Homo sapiens
ctgcctcaggaggt

SEQ ID NO: 5967385 - DNA, 16 bp, Homo sapiens
ctgcctcaggcctctg

SEQ ID NO: 5967386 - DNA, 18 bp, Homo sapiens
ctgcctcaggttcctatg

SEQ ID NO: 5967387 - DNA, 22 bp, Homo sapiens
ctgcctcagtggcagcatcctc

SEQ ID NO: 5967388 - DNA, 19 bp, Homo sapiens
ctgcctcagtggctctggg

SEQ ID NO: 5967389 - DNA, 12 bp, Homo sapiens
ctgcctcatcct

SEQ ID NO: 5967390 - DNA, 23 bp, Homo sapiens
ctgcctcatgaccctcctgtcca

SEQ ID NO: 5967391 - DNA, 18 bp, Homo sapiens
ctgcctccaacccagcag

SEQ ID NO: 5967392 - DNA, 22 bp, Homo sapiens
ctgcctccaagatttcagaagc

SEQ ID NO: 5967393 - DNA, 12 bp, Homo sapiens
ctgcctccaagt

SEQ ID NO: 5967394 - DNA, 17 bp, Homo sapiens
ctgcctccaagtcatgg

SEQ ID NO: 5967395 - DNA, 22 bp, Homo sapiens
ctgcctccaagtcatgggagaa

SEQ ID NO: 5967396 - DNA, 13 bp, Homo sapiens
ctgcctccaccag

SEQ ID NO: 5967397 - DNA, 15 bp, Homo sapiens
ctgcctccaccagca

SEQ ID NO: 5967398 - DNA, 18 bp, Homo sapiens
ctgcctccaccagcaagg

SEQ ID NO: 5967399 - DNA, 22 bp, Homo sapiens
ctgcctccagccaaacgggagc

SEQ ID NO: 5967400 - DNA, 15 bp, Homo sapiens
ctgcctccagccgcc

SEQ ID NO: 5967401 - DNA, 22 bp, Homo sapiens
ctgcctccagccgccggctgtg

SEQ ID NO: 5967402 - DNA, 14 bp, Homo sapiens
ctgcctccagcctg

SEQ ID NO: 5967403 - DNA, 16 bp, Homo sapiens
ctgcctccagcctggt

SEQ ID NO: 5967404 - DNA, 19 bp, Homo sapiens
ctgcctccagcctggtggc

SEQ ID NO: 5967405 - DNA, 20 bp, Homo sapiens
ctgcctccagcctggtggcc

SEQ ID NO: 5967406 - DNA, 14 bp, Homo sapiens
ctgcctccagctgt

SEQ ID NO: 5967407 - DNA, 18 bp, Homo sapiens
ctgcctccagctgtcagc

SEQ ID NO: 5967408 - DNA, 13 bp, Homo sapiens
ctgcctccaggag

SEQ ID NO: 5967409 - DNA, 17 bp, Homo sapiens
ctgcctccaggagctgc

SEQ ID NO: 5967410 - DNA, 14 bp, Homo sapiens
ctgcctccaggagg

SEQ ID NO: 5967411 - DNA, 19 bp, Homo sapiens
ctgcctccaggagggcatc

SEQ ID NO: 5967412 - DNA, 15 bp, Homo sapiens
ctgcctccagggctg

SEQ ID NO: 5967413 - DNA, 16 bp, Homo sapiens
ctgcctccagggctgg

SEQ ID NO: 5967414 - DNA, 18 bp, Homo sapiens
ctgcctccagggctggac

SEQ ID NO: 5967415 - DNA, 12 bp, Homo sapiens
ctgcctccaggt

SEQ ID NO: 5967416 - DNA, 19 bp, Homo sapiens
ctgcctccaggttgcctca

SEQ ID NO: 5967417 - DNA, 14 bp, Homo sapiens
ctgcctccatccta

SEQ ID NO: 5967418 - DNA, 14 bp, Homo sapiens
ctgcctccatggca

SEQ ID NO: 5967419 - DNA, 21 bp, Homo sapiens
ctgcctccatggcagcagcca

SEQ ID NO: 5967420 - DNA, 14 bp, Homo sapiens
ctgcctcccaaagt

SEQ ID NO: 5967421 - DNA, 20 bp, Homo sapiens
ctgcctcccaagcagctgaa

SEQ ID NO: 5967422 - DNA, 22 bp, Homo sapiens
ctcccacccccatctctccctc

SEQ ID NO: 5967423 - DNA, 23 bp, Homo sapiens
ctcccacccccttctctgctcca

SEQ ID NO: 5967424 - DNA, 16 bp, Homo sapiens
ctcccaccccggcctc

SEQ ID NO: 5967425 - DNA, 18 bp, Homo sapiens
ctcccaccccggcctcca

SEQ ID NO: 5967426 - DNA, 19 bp, Homo sapiens
ctcccaccccggcctccac

SEQ ID NO: 5967427 - DNA, 20 bp, Homo sapiens
ctcccaccccggcctccact

SEQ ID NO: 5967428 - DNA, 23 bp, Homo sapiens
ctcccaccccttgattcccataa

SEQ ID NO: 5967429 - DNA, 23 bp, Homo sapiens
ctcccacccggccacagctgctg

SEQ ID NO: 5967430 - DNA, 17 bp, Homo sapiens
ctcccacccggctgcag

SEQ ID NO: 5967431 - DNA, 19 bp, Homo sapiens
ctcccaccctaagggcagc

SEQ ID NO: 5967432 - DNA, 21 bp, Homo sapiens
ctcccaccctaagggcagccc

SEQ ID NO: 5967433 - DNA, 22 bp, Homo sapiens
ctcccaccctaagggcagccct

SEQ ID NO: 5967434 - DNA, 15 bp, Homo sapiens
ctcccaccctacccc

SEQ ID NO: 5967435 - DNA, 20 bp, Homo sapiens
ctcccaccctcttcctactg

SEQ ID NO: 5967436 - DNA, 21 bp, Homo sapiens
ctcccaccctcttcctactgg

SEQ ID NO: 5967437 - DNA, 20 bp, Homo sapiens
ctcccaccctgcgggccagg

SEQ ID NO: 5967438 - DNA, 12 bp, Homo sapiens
ctcccaccctgt

SEQ ID NO: 5967439 - DNA, 13 bp, Homo sapiens
ctcccaccctgta

SEQ ID NO: 5967440 - DNA, 20 bp, Homo sapiens
ctcccaccctgtacctcatc

SEQ ID NO: 5967441 - DNA, 19 bp, Homo sapiens
ctcccaccgcagcgtcccc

SEQ ID NO: 5967442 - DNA, 22 bp, Homo sapiens
ctcccaccgcccccaccccttc

SEQ ID NO: 5967443 - DNA, 15 bp, Homo sapiens
ctcccaccggtgcca

SEQ ID NO: 5967444 - DNA, 15 bp, Homo sapiens
ctcccacctagtgcc

SEQ ID NO: 5967445 - DNA, 20 bp, Homo sapiens
ctcccacctagtgccccaga

SEQ ID NO: 5967446 - DNA, 24 bp, Homo sapiens
ctcccacctatccgccctgcagca

SEQ ID NO: 5967447 - DNA, 14 bp, Homo sapiens
ctcccacctcaccc

SEQ ID NO: 5967448 - DNA, 15 bp, Homo sapiens
ctcccacctcacccg

SEQ ID NO: 5967449 - DNA, 21 bp, Homo sapiens
ctcccacctcacccggcctct

SEQ ID NO: 5967450 - DNA, 12 bp, Homo sapiens
ctcccacctccc

SEQ ID NO: 5967451 - DNA, 23 bp, Homo sapiens
ctcccacctccccctcccccttc

SEQ ID NO: 5967452 - DNA, 13 bp, Homo sapiens
ctcccacctccct

SEQ ID NO: 5967453 - DNA, 17 bp, Homo sapiens
ctcccacctctgtgacc

SEQ ID NO: 5967454 - DNA, 14 bp, Homo sapiens
ctcccacctggctc

SEQ ID NO: 5967455 - DNA, 22 bp, Homo sapiens
ctcccacctggctctgtggcga

SEQ ID NO: 5967456 - DNA, 16 bp, Homo sapiens
ctcccacctgtttctg

SEQ ID NO: 5967457 - DNA, 21 bp, Homo sapiens
ctcccacctgtttctggaaga

SEQ ID NO: 5967458 - DNA, 15 bp, Homo sapiens
ctcccaccttggcct

SEQ ID NO: 5967459 - DNA, 19 bp, Homo sapiens
ctcccacgatgtcaaggac

SEQ ID NO: 5967460 - DNA, 11 bp, Homo sapiens
ctcccacgccc

SEQ ID NO: 5967461 - DNA, 21 bp, Homo sapiens
ctcccacgcctgtcctcctgg

SEQ ID NO: 5967462 - DNA, 18 bp, Homo sapiens
ctcccacggcacctcggg

SEQ ID NO: 5967463 - DNA, 13 bp, Homo sapiens
ctcccacgggacc

SEQ ID NO: 5967464 - DNA, 20 bp, Homo sapiens
ctcccacggggaccactggg

SEQ ID NO: 5967465 - DNA, 22 bp, Homo sapiens
ctcccacggggaccactgggcc

SEQ ID NO: 5967466 - DNA, 14 bp, Homo sapiens
ctcccacgtgggag

SEQ ID NO: 5967467 - DNA, 16 bp, Homo sapiens
ctcccactcccatctc

SEQ ID NO: 5967468 - DNA, 15 bp, Homo sapiens
ctcccactcccatgg

SEQ ID NO: 5967469 - DNA, 16 bp, Homo sapiens
ctcccactcccatggc

SEQ ID NO: 5967470 - DNA, 16 bp, Homo sapiens
ctcccactccctttcc

SEQ ID NO: 5967471 - DNA, 17 bp, Homo sapiens
ctcccactccctttcca

SEQ ID NO: 5967472 - DNA, 11 bp, Homo sapiens
ctcccactcct

SEQ ID NO: 5967473 - DNA, 13 bp, Homo sapiens
ctcccactcctaa

SEQ ID NO: 5967474 - DNA, 20 bp, Homo sapiens
ctcccactgcaacttgtgaa

SEQ ID NO: 5967475 - DNA, 15 bp, Homo sapiens
ctcccactgcccact

SEQ ID NO: 5967476 - DNA, 21 bp, Homo sapiens
ctcccactgggactcccagca

SEQ ID NO: 5967477 - DNA, 22 bp, Homo sapiens
ctcccactgggactcccagcag

SEQ ID NO: 5967478 - DNA, 15 bp, Homo sapiens
ctcccacttcctcct

SEQ ID NO: 5967479 - DNA, 19 bp, Homo sapiens
ctcccacttgacctgagat

SEQ ID NO: 5967480 - DNA, 13 bp, Homo sapiens
ctcccacttggcc

SEQ ID NO: 5967481 - DNA, 20 bp, Homo sapiens
ctcccactttgtctgtacat

SEQ ID NO: 5967482 - DNA, 16 bp, Homo sapiens
ctcccagaacacactc

SEQ ID NO: 5967483 - DNA, 12 bp, Homo sapiens
ctcccagaacct

SEQ ID NO: 5967484 - DNA, 13 bp, Homo sapiens
ctcccagaacctc

SEQ ID NO: 5967485 - DNA, 19 bp, Homo sapiens
ctcccagaactattctggg

SEQ ID NO: 5967486 - DNA, 17 bp, Homo sapiens
ctcccagaatcccagcc

SEQ ID NO: 5967487 - DNA, 19 bp, Homo sapiens
ctcccagaatcccagccgg

SEQ ID NO: 5967488 - DNA, 13 bp, Homo sapiens
ctcccagacaggc

SEQ ID NO: 5967489 - DNA, 18 bp, Homo sapiens
ctcccagacaggccctcc

SEQ ID NO: 5967490 - DNA, 16 bp, Homo sapiens
ctcccagaccacctcc

SEQ ID NO: 5967491 - DNA, 13 bp, Homo sapiens
ctcccagacccag

SEQ ID NO: 5967492 - DNA, 17 bp, Homo sapiens
ctcccagacccccttgc

SEQ ID NO: 5967493 - DNA, 18 bp, Homo sapiens
ctcccagacccccttgcc

SEQ ID NO: 5967494 - DNA, 19 bp, Homo sapiens
ctcccagacccccttgccc

SEQ ID NO: 5967495 - DNA, 15 bp, Homo sapiens
ctcccagacttgttt

SEQ ID NO: 5967496 - DNA, 17 bp, Homo sapiens
ctcccagacttgtttcc

SEQ ID NO: 5967497 - DNA, 17 bp, Homo sapiens
ctcccagagctggtgga

SEQ ID NO: 5967498 - DNA, 15 bp, Homo sapiens
ctcccagaggctcct

SEQ ID NO: 5967499 - DNA, 17 bp, Homo sapiens
ctcccagaggctcctgg

SEQ ID NO: 5967500 - DNA, 22 bp, Homo sapiens
ctcccagaggctcctggagcca

SEQ ID NO: 5967501 - DNA, 15 bp, Homo sapiens
ctcccagaggtccag

SEQ ID NO: 5967502 - DNA, 18 bp, Homo sapiens
ctcccagaggtccagccc

SEQ ID NO: 5967503 - DNA, 22 bp, Homo sapiens
ctcccagaggtccagcccatct

SEQ ID NO: 5967504 - DNA, 17 bp, Homo sapiens
ctcccagagtgctagga

SEQ ID NO: 5967505 - DNA, 22 bp, Homo sapiens
ctcccagagtgctgggattaca

SEQ ID NO: 5967506 - DNA, 13 bp, Homo sapiens
ctcccagatgctg

SEQ ID NO: 5967507 - DNA, 17 bp, Homo sapiens
ctcccagatgctgggga

SEQ ID NO: 5967508 - DNA, 14 bp, Homo sapiens
ctcccagatgtaaa

SEQ ID NO: 5967509 - DNA, 22 bp, Homo sapiens
ctcccagatttcagtcttttcc

SEQ ID NO: 5967510 - DNA, 21 bp, Homo sapiens
ctcccagcaacacaagctgga

SEQ ID NO: 5967511 - DNA, 19 bp, Homo sapiens
ctcccagcaagtttcacct

SEQ ID NO: 5967512 - DNA, 22 bp, Homo sapiens
ctcccagcaatcgcatcccggc

SEQ ID NO: 5967513 - DNA, 14 bp, Homo sapiens
ctcccagcactccc

SEQ ID NO: 5967514 - DNA, 19 bp, Homo sapiens
ctcccagcactccccttgc

SEQ ID NO: 5967515 - DNA, 18 bp, Homo sapiens
ctcccagcactgcctcct

SEQ ID NO: 5967516 - DNA, 20 bp, Homo sapiens
ctcccagcactgcctcctgt

SEQ ID NO: 5967517 - DNA, 14 bp, Homo sapiens
ctcccagcagagcc

SEQ ID NO: 5967518 - DNA, 20 bp, Homo sapiens
ctcccagcagagcccaccag

SEQ ID NO: 5967519 - DNA, 23 bp, Homo sapiens
ctcccagcagagcccaccagcca

SEQ ID NO: 5967520 - DNA, 14 bp, Homo sapiens
ctcccagcagaggc

SEQ ID NO: 5967521 - DNA, 15 bp, Homo sapiens
ctcccagcagaggcc

SEQ ID NO: 5967522 - DNA, 19 bp, Homo sapiens
ctcccagcagccctaagga

SEQ ID NO: 5967523 - DNA, 19 bp, Homo sapiens
ctcccagcatcgcactctg

SEQ ID NO: 5967524 - DNA, 12 bp, Homo sapiens
ctcccagccacc

SEQ ID NO: 5967525 - DNA, 15 bp, Homo sapiens
ctcccagccaccacc

SEQ ID NO: 5967526 - DNA, 16 bp, Homo sapiens
ctcccagccaccacca

SEQ ID NO: 5967527 - DNA, 20 bp, Homo sapiens
ctcccagccaccaccactgt

SEQ ID NO: 5967528 - DNA, 22 bp, Homo sapiens
ctcccagccacccggatctcca

SEQ ID NO: 5967529 - DNA, 11 bp, Homo sapiens
ctcccagccca

SEQ ID NO: 5967530 - DNA, 16 bp, Homo sapiens
ctcccagcccacctca

SEQ ID NO: 5967531 - DNA, 16 bp, Homo sapiens
ctcccagcccattgct

SEQ ID NO: 5967532 - DNA, 18 bp, Homo sapiens
ctcccagccccaggggtg

SEQ ID NO: 5967533 - DNA, 16 bp, Homo sapiens
ctcccagccctatgga

SEQ ID NO: 5967534 - DNA, 18 bp, Homo sapiens
ctcccagccctatggatg

SEQ ID NO: 5967535 - DNA, 21 bp, Homo sapiens
ctcccagccctatggatgtgg

SEQ ID NO: 5967536 - DNA, 12 bp, Homo sapiens
ctcccagccctg

SEQ ID NO: 5967537 - DNA, 14 bp, Homo sapiens
ctcccagccctgag

SEQ ID NO: 5967538 - DNA, 15 bp, Homo sapiens
ctcccagccctgagg

SEQ ID NO: 5967539 - DNA, 16 bp, Homo sapiens
ctcccagccctgaggg

SEQ ID NO: 5967540 - DNA, 18 bp, Homo sapiens
ctcccagccctgccagga

SEQ ID NO: 5967541 - DNA, 20 bp, Homo sapiens
ctcccagccctgcccagagt

SEQ ID NO: 5967542 - DNA, 15 bp, Homo sapiens
ctcccagcctaaggg

SEQ ID NO: 5967543 - DNA, 14 bp, Homo sapiens
ctcccagcctgctg

SEQ ID NO: 5967544 - DNA, 12 bp, Homo sapiens
ctcccagcgtgt

SEQ ID NO: 5967545 - DNA, 16 bp, Homo sapiens
ctcccagctagggggc

SEQ ID NO: 5967546 - DNA, 23 bp, Homo sapiens
ctcccagctcctttctcctgtga

SEQ ID NO: 5967547 - DNA, 17 bp, Homo sapiens
ctcccagctctaaaatt

SEQ ID NO: 5967548 - DNA, 23 bp, Homo sapiens
ctcccagctgacagtcctctcca

SEQ ID NO: 5967549 - DNA, 16 bp, Homo sapiens
ctcccagctgacggca

SEQ ID NO: 5967550 - DNA, 11 bp, Homo sapiens
ctcccagctgc

SEQ ID NO: 5967551 - DNA, 24 bp, Homo sapiens
ctcccagctgtaccggccactgca

SEQ ID NO: 5967552 - DNA, 14 bp, Homo sapiens
gaagcaaagtgccc

SEQ ID NO: 5967553 - DNA, 15 bp, Homo sapiens
gaagcaaataaatat

SEQ ID NO: 5967554 - DNA, 17 bp, Homo sapiens
gaagcaaatacaattca

SEQ ID NO: 5967555 - DNA, 17 bp, Homo sapiens
gaagcaaataccaaagc

SEQ ID NO: 5967556 - DNA, 19 bp, Homo sapiens
gaagcaaataccaaagcag

SEQ ID NO: 5967557 - DNA, 21 bp, Homo sapiens
gaagcaaatgtcatgctgcct

SEQ ID NO: 5967558 - DNA, 23 bp, Homo sapiens
gaagcaaatgtcatgctgcctta

SEQ ID NO: 5967559 - DNA, 22 bp, Homo sapiens
gaagcaacgataaaattacaaa

SEQ ID NO: 5967560 - DNA, 22 bp, Homo sapiens
gaagcaactccgtgtgcctggg

SEQ ID NO: 5967561 - DNA, 17 bp, Homo sapiens
gaagcaactgtgaattc

SEQ ID NO: 5967562 - DNA, 15 bp, Homo sapiens
gaagcaagaaagagg

SEQ ID NO: 5967563 - DNA, 17 bp, Homo sapiens
gaagcaagaagaattga

SEQ ID NO: 5967564 - DNA, 17 bp, Homo sapiens
gaagcaagacacgtggc

SEQ ID NO: 5967565 - DNA, 13 bp, Homo sapiens
gaagcaagacgta

SEQ ID NO: 5967566 - DNA, 21 bp, Homo sapiens
gaagcaagacgtcctggaatg

SEQ ID NO: 5967567 - DNA, 23 bp, Homo sapiens
gaagcaagacgtcctggaatgaa

SEQ ID NO: 5967568 - DNA, 22 bp, Homo sapiens
gaagcaagaggcaagctgaaat

SEQ ID NO: 5967569 - DNA, 19 bp, Homo sapiens
gaagcaagatcgctgtgct

SEQ ID NO: 5967570 - DNA, 15 bp, Homo sapiens
gaagcaagcagatga

SEQ ID NO: 5967571 - DNA, 17 bp, Homo sapiens
gaagcaagccagaccta

SEQ ID NO: 5967572 - DNA, 16 bp, Homo sapiens
gaagcaagctggatgc

SEQ ID NO: 5967573 - DNA, 12 bp, Homo sapiens
gaagcaagctgt

SEQ ID NO: 5967574 - DNA, 14 bp, Homo sapiens
gaagcaagctgtgt

SEQ ID NO: 5967575 - DNA, 14 bp, Homo sapiens
gaagcaaggaagta

SEQ ID NO: 5967576 - DNA, 15 bp, Homo sapiens
gaagcaaggccagcc

SEQ ID NO: 5967577 - DNA, 12 bp, Homo sapiens
gaagcaaggctg

SEQ ID NO: 5967578 - DNA, 15 bp, Homo sapiens
gaagcaagggcaaga

SEQ ID NO: 5967579 - DNA, 16 bp, Homo sapiens
gaagcaaggtctcaga

SEQ ID NO: 5967580 - DNA, 18 bp, Homo sapiens
gaagcaaggtctcagact

SEQ ID NO: 5967581 - DNA, 18 bp, Homo sapiens
gaagcaataaagaagagt

SEQ ID NO: 5967582 - DNA, 11 bp, Homo sapiens
gaagcaataac

SEQ ID NO: 5967583 - DNA, 12 bp, Homo sapiens
gaagcaataact

SEQ ID NO: 5967584 - DNA, 14 bp, Homo sapiens
gaagcaataactcc

SEQ ID NO: 5967585 - DNA, 17 bp, Homo sapiens
gaagcaataactccaag

SEQ ID NO: 5967586 - DNA, 18 bp, Homo sapiens
gaagcaataactccaagc

SEQ ID NO: 5967587 - DNA, 19 bp, Homo sapiens
gaagcaataactccaagca

SEQ ID NO: 5967588 - DNA, 19 bp, Homo sapiens
gaagcaattatttaaagaa

SEQ ID NO: 5967589 - DNA, 20 bp, Homo sapiens
gaagcaattatttaaagaaa

SEQ ID NO: 5967590 - DNA, 21 bp, Homo sapiens
gaagcaattatttaaagaaag

SEQ ID NO: 5967591 - DNA, 22 bp, Homo sapiens
gaagcaattatttaaagaaagt

SEQ ID NO: 5967592 - DNA, 16 bp, Homo sapiens
gaagcaattgaaaagg

SEQ ID NO: 5967593 - DNA, 17 bp, Homo sapiens
gaagcacaagaagtggg

SEQ ID NO: 5967594 - DNA, 20 bp, Homo sapiens
gaagcacaagaagtgggagt

SEQ ID NO: 5967595 - DNA, 13 bp, Homo sapiens
gaagcacaagttc

SEQ ID NO: 5967596 - DNA, 23 bp, Homo sapiens
gaagcacactgcagggctgctgt

SEQ ID NO: 5967597 - DNA, 20 bp, Homo sapiens
gaagcacagagggctaggga

SEQ ID NO: 5967598 - DNA, 22 bp, Homo sapiens
gaagcacagcaccgggggagag

SEQ ID NO: 5967599 - DNA, 14 bp, Homo sapiens
gaagcacagcaggt

SEQ ID NO: 5967600 - DNA, 18 bp, Homo sapiens
gaagcacagcctcgggga

SEQ ID NO: 5967601 - DNA, 19 bp, Homo sapiens
gaagcacagctcctgccag

SEQ ID NO: 5967602 - DNA, 23 bp, Homo sapiens
gaagcacaggtccaaggctggtc

SEQ ID NO: 5967603 - DNA, 20 bp, Homo sapiens
gaagcaccagggagaggcct

SEQ ID NO: 5967604 - DNA, 20 bp, Homo sapiens
gaagcacccattatgcgctg

SEQ ID NO: 5967605 - DNA, 16 bp, Homo sapiens
gaagcaccccatgcca

SEQ ID NO: 5967606 - DNA, 14 bp, Homo sapiens
gaagcacctctcag

SEQ ID NO: 5967607 - DNA, 20 bp, Homo sapiens
gaagcactacaccttgcctt

SEQ ID NO: 5967608 - DNA, 17 bp, Homo sapiens
gaagcactctgctggcg

SEQ ID NO: 5967609 - DNA, 18 bp, Homo sapiens
gaagcactctgctggcgg

SEQ ID NO: 5967610 - DNA, 19 bp, Homo sapiens
gaagcactgttccagcctg

SEQ ID NO: 5967611 - DNA, 15 bp, Homo sapiens
gaagcacttctgctg

SEQ ID NO: 5967612 - DNA, 18 bp, Homo sapiens
gaagcacttctgctgcat

SEQ ID NO: 5967613 - DNA, 19 bp, Homo sapiens
gaagcacttgctcaaaatc

SEQ ID NO: 5967614 - DNA, 18 bp, Homo sapiens
gaagcagaaccagctcta

SEQ ID NO: 5967615 - DNA, 12 bp, Homo sapiens
gaagcagaataa

SEQ ID NO: 5967616 - DNA, 16 bp, Homo sapiens
gaagcagaataaagca

SEQ ID NO: 5967617 - DNA, 23 bp, Homo sapiens
gaagcagaccattggggctccca

SEQ ID NO: 5967618 - DNA, 22 bp, Homo sapiens
gaagcagacgtccatagctcct

SEQ ID NO: 5967619 - DNA, 12 bp, Homo sapiens
gaagcagagaga

SEQ ID NO: 5967620 - DNA, 16 bp, Homo sapiens
gaagcagagcctgggg

SEQ ID NO: 5967621 - DNA, 19 bp, Homo sapiens
gaagcagagcctggggtgg

SEQ ID NO: 5967622 - DNA, 13 bp, Homo sapiens
gaagcagaggaag

SEQ ID NO: 5967623 - DNA, 15 bp, Homo sapiens
gaagcagaggccctg

SEQ ID NO: 5967624 - DNA, 17 bp, Homo sapiens
gaagcagaggccctgcc

SEQ ID NO: 5967625 - DNA, 19 bp, Homo sapiens
gaagcagaggccctgcccc

SEQ ID NO: 5967626 - DNA, 20 bp, Homo sapiens
gaagcagaggccctgccccc

SEQ ID NO: 5967627 - DNA, 15 bp, Homo sapiens
gaagcagagggacaa

SEQ ID NO: 5967628 - DNA, 20 bp, Homo sapiens
gaagcagatgcaaagaggca

SEQ ID NO: 5967629 - DNA, 21 bp, Homo sapiens
gaagcagatgcaaagaggcaa

SEQ ID NO: 5967630 - DNA, 19 bp, Homo sapiens
gaagcagcaacttgtccta

SEQ ID NO: 5967631 - DNA, 22 bp, Homo sapiens
gaagcagcagccaccagggagt

SEQ ID NO: 5967632 - DNA, 20 bp, Homo sapiens
gaagcagcatcaacctagga

SEQ ID NO: 5967633 - DNA, 22 bp, Homo sapiens
gaagcagcatcaacctaggagc

SEQ ID NO: 5967634 - DNA, 13 bp, Homo sapiens
gaagcagccagct

SEQ ID NO: 5967635 - DNA, 17 bp, Homo sapiens
gaagcagcccctcgagg

SEQ ID NO: 5967636 - DNA, 13 bp, Homo sapiens
gaagcagcctcct

SEQ ID NO: 5967637 - DNA, 14 bp, Homo sapiens
gaagcagcctccta

SEQ ID NO: 5967638 - DNA, 21 bp, Homo sapiens
gaagcagcctccttatatttg

SEQ ID NO: 5967639 - DNA, 23 bp, Homo sapiens
gaagcagctaaaccaaggactga

SEQ ID NO: 5967640 - DNA, 12 bp, Homo sapiens
gaagcagctctg

SEQ ID NO: 5967641 - DNA, 16 bp, Homo sapiens
gaagcagctctgcctt

SEQ ID NO: 5967642 - DNA, 17 bp, Homo sapiens
gaagcagctctgccttc

SEQ ID NO: 5967643 - DNA, 15 bp, Homo sapiens
gaagcaggacagaca

SEQ ID NO: 5967644 - DNA, 10 bp, Homo sapiens
gaagcaggca

SEQ ID NO: 5967645 - DNA, 12 bp, Homo sapiens
gaagcaggcagg

SEQ ID NO: 5967646 - DNA, 14 bp, Homo sapiens
gaagcaggcagggc

SEQ ID NO: 5967647 - DNA, 14 bp, Homo sapiens
gaagcaggctacac

SEQ ID NO: 5967648 - DNA, 13 bp, Homo sapiens
gaagcaggctgga

SEQ ID NO: 5967649 - DNA, 12 bp, Homo sapiens
gaagcaggtgct

SEQ ID NO: 5967650 - DNA, 16 bp, Homo sapiens
gaagcagtaataatca

SEQ ID NO: 5967651 - DNA, 15 bp, Homo sapiens
gaagcagtcttgctc

SEQ ID NO: 5967652 - DNA, 15 bp, Homo sapiens
gaagcagtgcccagg

SEQ ID NO: 5967653 - DNA, 18 bp, Homo sapiens
gaagcagtgcccaggtgg

SEQ ID NO: 5967654 - DNA, 16 bp, Homo sapiens
gaagcagtgcctcgag

SEQ ID NO: 5967655 - DNA, 22 bp, Homo sapiens
gaagcagtggggtaggctgctg

SEQ ID NO: 5967656 - DNA, 19 bp, Homo sapiens
gaagcagtgtcgccgtccc

SEQ ID NO: 5967657 - DNA, 14 bp, Homo sapiens
gaagcagttggggc

SEQ ID NO: 5967658 - DNA, 15 bp, Homo sapiens
gaagcagttggggcc

SEQ ID NO: 5967659 - DNA, 20 bp, Homo sapiens
gaagcagttggggccctctt

SEQ ID NO: 5967660 - DNA, 20 bp, Homo sapiens
gaagcagtttcagataaatc

SEQ ID NO: 5967661 - DNA, 21 bp, Homo sapiens
gaagcagtttcagataaatca

SEQ ID NO: 5967662 - DNA, 22 bp, Homo sapiens
gaagcagtttcagataaatcat

SEQ ID NO: 5967663 - DNA, 15 bp, Homo sapiens
gaagcataaacatca

SEQ ID NO: 5967664 - DNA, 15 bp, Homo sapiens
gaagcataatttgtt

SEQ ID NO: 5967665 - DNA, 22 bp, Homo sapiens
gaagcataatttgtttaaaatt

SEQ ID NO: 5967666 - DNA, 14 bp, Homo sapiens
gaagcatcctccac

SEQ ID NO: 5967667 - DNA, 16 bp, Homo sapiens
gaagcatcctccacat

SEQ ID NO: 5967668 - DNA, 18 bp, Homo sapiens
gaagcatcctccacatcc

SEQ ID NO: 5967669 - DNA, 17 bp, Homo sapiens
gaagcatcctccccacc

SEQ ID NO: 5967670 - DNA, 23 bp, Homo sapiens
gaagcatcctccccaccagagct

SEQ ID NO: 5967671 - DNA, 18 bp, Homo sapiens
gaagcatgctttgctgct

SEQ ID NO: 5967672 - DNA, 19 bp, Homo sapiens
gaagcatgctttgctgcta

SEQ ID NO: 5967673 - DNA, 16 bp, Homo sapiens
gaagcatggctgtctg

SEQ ID NO: 5967674 - DNA, 23 bp, Homo sapiens
gaagcatggctgtctgcacagag

SEQ ID NO: 5967675 - DNA, 16 bp, Homo sapiens
cttaatgctttcctcc

SEQ ID NO: 5967676 - DNA, 19 bp, Homo sapiens
cttaatggatgaaatcata

SEQ ID NO: 5967677 - DNA, 23 bp, Homo sapiens
cttaatggtatcctactgagcat

SEQ ID NO: 5967678 - DNA, 13 bp, Homo sapiens
cttaatgtacata

SEQ ID NO: 5967679 - DNA, 18 bp, Homo sapiens
cttaatgtatcaaactgt

SEQ ID NO: 5967680 - DNA, 14 bp, Homo sapiens
cttaatgtatgtta

SEQ ID NO: 5967681 - DNA, 15 bp, Homo sapiens
cttaatgtctggtgt

SEQ ID NO: 5967682 - DNA, 21 bp, Homo sapiens
cttaatgtctggtgtttgtca

SEQ ID NO: 5967683 - DNA, 16 bp, Homo sapiens
cttaatgtctgtcaga

SEQ ID NO: 5967684 - DNA, 24 bp, Homo sapiens
cttaatgtctgtcagaagacacta

SEQ ID NO: 5967685 - DNA, 14 bp, Homo sapiens
cttaatgtggccgg

SEQ ID NO: 5967686 - DNA, 14 bp, Homo sapiens
cttaatgttcttat

SEQ ID NO: 5967687 - DNA, 16 bp, Homo sapiens
cttaatgttgaatgta

SEQ ID NO: 5967688 - DNA, 12 bp, Homo sapiens
cttaatgtttat

SEQ ID NO: 5967689 - DNA, 14 bp, Homo sapiens
cttaatgtttattc

SEQ ID NO: 5967690 - DNA, 15 bp, Homo sapiens
cttaatgtttattcc

SEQ ID NO: 5967691 - DNA, 23 bp, Homo sapiens
cttaattacagttaaagaagcaa

SEQ ID NO: 5967692 - DNA, 14 bp, Homo sapiens
cttaattactttca

SEQ ID NO: 5967693 - DNA, 11 bp, Homo sapiens
cttaattatta

SEQ ID NO: 5967694 - DNA, 21 bp, Homo sapiens
cttaattcagtctcagctgct

SEQ ID NO: 5967695 - DNA, 14 bp, Homo sapiens
cttaattctccttc

SEQ ID NO: 5967696 - DNA, 15 bp, Homo sapiens
cttaattctccttcc

SEQ ID NO: 5967697 - DNA, 12 bp, Homo sapiens
cttaattctgtt

SEQ ID NO: 5967698 - DNA, 18 bp, Homo sapiens
cttaattcttacctcatt

SEQ ID NO: 5967699 - DNA, 20 bp, Homo sapiens
cttaattcttacctcatttg

SEQ ID NO: 5967700 - DNA, 15 bp, Homo sapiens
cttaattctttgttc

SEQ ID NO: 5967701 - DNA, 17 bp, Homo sapiens
cttaattctttgttctg

SEQ ID NO: 5967702 - DNA, 17 bp, Homo sapiens
cttaattctttgtttcc

SEQ ID NO: 5967703 - DNA, 18 bp, Homo sapiens
cttaattgatgcaaataa

SEQ ID NO: 5967704 - DNA, 14 bp, Homo sapiens
cttaattgcaagtc

SEQ ID NO: 5967705 - DNA, 18 bp, Homo sapiens
cttaattgcaagtctgcc

SEQ ID NO: 5967706 - DNA, 20 bp, Homo sapiens
cttaattgccacctctaaca

SEQ ID NO: 5967707 - DNA, 13 bp, Homo sapiens
cttaattgtgttt

SEQ ID NO: 5967708 - DNA, 15 bp, Homo sapiens
cttaattgtgtttat

SEQ ID NO: 5967709 - DNA, 19 bp, Homo sapiens
cttaattgttcattttgag

SEQ ID NO: 5967710 - DNA, 16 bp, Homo sapiens
cttaattgttctgctt

SEQ ID NO: 5967711 - DNA, 21 bp, Homo sapiens
cttaattgttctgctttttct

SEQ ID NO: 5967712 - DNA, 20 bp, Homo sapiens
cttaatttaagtttgtagtt

SEQ ID NO: 5967713 - DNA, 23 bp, Homo sapiens
cttaatttaatgtattaatctgt

SEQ ID NO: 5967714 - DNA, 16 bp, Homo sapiens
cttaatttaattgctt

SEQ ID NO: 5967715 - DNA, 21 bp, Homo sapiens
cttaatttaattgctttgaag

SEQ ID NO: 5967716 - DNA, 20 bp, Homo sapiens
cttaatttacttaagtgttc

SEQ ID NO: 5967717 - DNA, 21 bp, Homo sapiens
cttaatttacttaagtgttca

SEQ ID NO: 5967718 - DNA, 17 bp, Homo sapiens
cttaatttagaaactga

SEQ ID NO: 5967719 - DNA, 18 bp, Homo sapiens
cttaatttagaaactgaa

SEQ ID NO: 5967720 - DNA, 16 bp, Homo sapiens
cttaatttatgtaagg

SEQ ID NO: 5967721 - DNA, 23 bp, Homo sapiens
cttaatttatttcttaacctttg

SEQ ID NO: 5967722 - DNA, 19 bp, Homo sapiens
cttaatttcaaatctgtaa

SEQ ID NO: 5967723 - DNA, 13 bp, Homo sapiens
cttaatttccttt

SEQ ID NO: 5967724 - DNA, 22 bp, Homo sapiens
cttaatttcctttttgacactg

SEQ ID NO: 5967725 - DNA, 23 bp, Homo sapiens
cttaatttcctttttgacactga

SEQ ID NO: 5967726 - DNA, 12 bp, Homo sapiens
cttaatttctaa

SEQ ID NO: 5967727 - DNA, 20 bp, Homo sapiens
cttaatttctgcctttcccc

SEQ ID NO: 5967728 - DNA, 14 bp, Homo sapiens
cttaatttgaaatc

SEQ ID NO: 5967729 - DNA, 15 bp, Homo sapiens
cttaatttgaaatct

SEQ ID NO: 5967730 - DNA, 12 bp, Homo sapiens
cttacctctgga

SEQ ID NO: 5967731 - DNA, 16 bp, Homo sapiens
cttacctgacacaaga

SEQ ID NO: 5967732 - DNA, 19 bp, Homo sapiens
cttacctgacctcttgctg

SEQ ID NO: 5967733 - DNA, 20 bp, Homo sapiens
cttacctgacctcttgctgt

SEQ ID NO: 5967734 - DNA, 12 bp, Homo sapiens
cttacctgggca

SEQ ID NO: 5967735 - DNA, 19 bp, Homo sapiens
cttacctgggcattcttgt

SEQ ID NO: 5967736 - DNA, 17 bp, Homo sapiens
cttacctgtctctctct

SEQ ID NO: 5967737 - DNA, 12 bp, Homo sapiens
cttacctgtgag

SEQ ID NO: 5967738 - DNA, 19 bp, Homo sapiens
cttacctgttcagtactct

SEQ ID NO: 5967739 - DNA, 18 bp, Homo sapiens
cttaccttcaataaagta

SEQ ID NO: 5967740 - DNA, 13 bp, Homo sapiens
cttaccttctgct

SEQ ID NO: 5967741 - DNA, 12 bp, Homo sapiens
cttaccttgttt

SEQ ID NO: 5967742 - DNA, 19 bp, Homo sapiens
cttaccttgttttgccagt

SEQ ID NO: 5967743 - DNA, 16 bp, Homo sapiens
cttacgaatattttca

SEQ ID NO: 5967744 - DNA, 17 bp, Homo sapiens
cttacgaatattttcag

SEQ ID NO: 5967745 - DNA, 21 bp, Homo sapiens
cttacgatcaggcacaggtca

SEQ ID NO: 5967746 - DNA, 19 bp, Homo sapiens
cttacgcccaacccttccc

SEQ ID NO: 5967747 - DNA, 21 bp, Homo sapiens
cttacgccctgttcccttcct

SEQ ID NO: 5967748 - DNA, 18 bp, Homo sapiens
cttacggccatctctttg

SEQ ID NO: 5967749 - DNA, 14 bp, Homo sapiens
cttacggttttaaa

SEQ ID NO: 5967750 - DNA, 15 bp, Homo sapiens
cttacgtttaagctt

SEQ ID NO: 5967751 - DNA, 16 bp, Homo sapiens
cttacgtttttctggt

SEQ ID NO: 5967752 - DNA, 21 bp, Homo sapiens
cttactaaaaagtataaaata

SEQ ID NO: 5967753 - DNA, 15 bp, Homo sapiens
cttactaaaatatat

SEQ ID NO: 5967754 - DNA, 12 bp, Homo sapiens
cttactaaatat

SEQ ID NO: 5967755 - DNA, 14 bp, Homo sapiens
cttactaaatcttc

SEQ ID NO: 5967756 - DNA, 20 bp, Homo sapiens
cttactaaccaccatttccc

SEQ ID NO: 5967757 - DNA, 23 bp, Homo sapiens
cttactaagctttgccagctgct

SEQ ID NO: 5967758 - DNA, 24 bp, Homo sapiens
cttactaagctttgccagctgctg

SEQ ID NO: 5967759 - DNA, 17 bp, Homo sapiens
cttactaataggtctgg

SEQ ID NO: 5967760 - DNA, 16 bp, Homo sapiens
cttactacactgagga

SEQ ID NO: 5967761 - DNA, 18 bp, Homo sapiens
cttactacttcttggaaa

SEQ ID NO: 5967762 - DNA, 14 bp, Homo sapiens
cttactactttaaa

SEQ ID NO: 5967763 - DNA, 20 bp, Homo sapiens
cttactagtactatttctta

SEQ ID NO: 5967764 - DNA, 19 bp, Homo sapiens
cttactagtttcccttgca

SEQ ID NO: 5967765 - DNA, 22 bp, Homo sapiens
cttactatgaccttccaagttt

SEQ ID NO: 5967766 - DNA, 22 bp, Homo sapiens
cttactatttctgggtcttttg

SEQ ID NO: 5967767 - DNA, 14 bp, Homo sapiens
cttactcaaacatg

SEQ ID NO: 5967768 - DNA, 20 bp, Homo sapiens
cttactcaagtgttaaatta

SEQ ID NO: 5967769 - DNA, 15 bp, Homo sapiens
cttactcacctctct

SEQ ID NO: 5967770 - DNA, 20 bp, Homo sapiens
cttactcagagctgcgggct

SEQ ID NO: 5967771 - DNA, 13 bp, Homo sapiens
cttactcattact

SEQ ID NO: 5967772 - DNA, 12 bp, Homo sapiens
cttactcctcct

SEQ ID NO: 5967773 - DNA, 14 bp, Homo sapiens
cttactcctgtggg

SEQ ID NO: 5967774 - DNA, 16 bp, Homo sapiens
cttactcctgtgggag

SEQ ID NO: 5967775 - DNA, 12 bp, Homo sapiens
cttactctaaga

SEQ ID NO: 5967776 - DNA, 20 bp, Homo sapiens
cttactctaagatcttagat

SEQ ID NO: 5967777 - DNA, 14 bp, Homo sapiens
cttactctgagccc

SEQ ID NO: 5967778 - DNA, 16 bp, Homo sapiens
cttactctgtccattt

SEQ ID NO: 5967779 - DNA, 17 bp, Homo sapiens
cttactctgtccattta

SEQ ID NO: 5967780 - DNA, 24 bp, Homo sapiens
cttactctgtctcccaggctgctg

SEQ ID NO: 5967781 - DNA, 15 bp, Homo sapiens
cttactcttcttgaa

SEQ ID NO: 5967782 - DNA, 16 bp, Homo sapiens
cttactctttcctatt

SEQ ID NO: 5967783 - DNA, 23 bp, Homo sapiens
cttactctttcctatttcagtgt

SEQ ID NO: 5967784 - DNA, 22 bp, Homo sapiens
cttactgaagaaatctttccag

SEQ ID NO: 5967785 - DNA, 12 bp, Homo sapiens
cttactgaaggt

SEQ ID NO: 5967786 - DNA, 17 bp, Homo sapiens
cttactgactttgcatt

SEQ ID NO: 5967787 - DNA, 21 bp, Homo sapiens
cttactgataaacctaatatt

SEQ ID NO: 5967788 - DNA, 19 bp, Homo sapiens
cttactgatatattttaca

SEQ ID NO: 5967789 - DNA, 21 bp, Homo sapiens
cttactgatatattttacaat

SEQ ID NO: 5967790 - DNA, 17 bp, Homo sapiens
cttactgattattttct

SEQ ID NO: 5967791 - DNA, 22 bp, Homo sapiens
cttactgcctgaccttggaatc

SEQ ID NO: 5967792 - DNA, 22 bp, Homo sapiens
cttactgcgactaaacttaatt

SEQ ID NO: 5967793 - DNA, 11 bp, Homo sapiens
cttactgcttg

SEQ ID NO: 5967794 - DNA, 12 bp, Homo sapiens
cttactggcact

SEQ ID NO: 5967795 - DNA, 13 bp, Homo sapiens
cttactggcactg

SEQ ID NO: 5967796 - DNA, 19 bp, Homo sapiens
cttactgggtgaggaaatc

SEQ ID NO: 5967797 - DNA, 22 bp, Homo sapiens
cttactggtccttaccagagac

SEQ ID NO: 5967798 - DNA, 23 bp, Homo sapiens
cttactggtttccccagggaagg

SEQ ID NO: 5967799 - DNA, 18 bp, Homo sapiens
cttactgtacctgttcct

SEQ ID NO: 5967800 - DNA, 23 bp, Homo sapiens
cttactgtacctgttccttagac

SEQ ID NO: 5967801 - DNA, 17 bp, Homo sapiens
cttactgtagcctcaga

SEQ ID NO: 5967802 - DNA, 17 bp, Homo sapiens
cttactgtatatgtatt

SEQ ID NO: 5967803 - DNA, 21 bp, Homo sapiens
cttactgtccaccagtttata

SEQ ID NO: 5967804 - DNA, 12 bp, Homo sapiens
cttactgtctct

SEQ ID NO: 5967805 - DNA, 23 bp, Homo sapiens
cttactgtctctcttgtcacatg

SEQ ID NO: 5967806 - DNA, 16 bp, Homo sapiens
cttactgtcttcttca

SEQ ID NO: 5967807 - DNA, 15 bp, Homo sapiens
cttactgtgcaccta

SEQ ID NO: 5967808 - DNA, 22 bp, Homo sapiens
cttactgtgcacctagagcttt

SEQ ID NO: 5967809 - DNA, 17 bp, Homo sapiens
cttactgtgtttcagca

SEQ ID NO: 5967810 - DNA, 21 bp, Homo sapiens
cttactgttaaaactgtacct

SEQ ID NO: 5967811 - DNA, 15 bp, Homo sapiens
cttactgtttctgtc

SEQ ID NO: 5967812 - DNA, 19 bp, Homo sapiens
cttactgtttctgtcagga

SEQ ID NO: 5967813 - DNA, 14 bp, Homo sapiens
cttacttaccctca

SEQ ID NO: 5967814 - DNA, 16 bp, Homo sapiens
cttacttactaaaata

SEQ ID NO: 5967815 - DNA, 19 bp, Homo sapiens
cttacttactaaaatatat

SEQ ID NO: 5967816 - DNA, 19 bp, Homo sapiens
cttacttagaatttatcct

SEQ ID NO: 5967817 - DNA, 13 bp, Homo sapiens
cttacttagagat

SEQ ID NO: 5967818 - DNA, 18 bp, Homo sapiens
cttacttagcatgcacaa

SEQ ID NO: 5967819 - DNA, 17 bp, Homo sapiens
cttacttcaaagtgcct

SEQ ID NO: 5967820 - DNA, 19 bp, Homo sapiens
cttacttcaaagtgcctgg

SEQ ID NO: 5967821 - DNA, 20 bp, Homo sapiens
cttacttcaaagtgcctggg

SEQ ID NO: 5967822 - DNA, 18 bp, Homo sapiens
cttacttcacccggctgg

SEQ ID NO: 5967823 - DNA, 13 bp, Homo sapiens
cttacttccagca

SEQ ID NO: 5967824 - DNA, 15 bp, Homo sapiens
cttacttccagcaaa

SEQ ID NO: 5967825 - DNA, 16 bp, Homo sapiens
cttacttccagcaaaa

SEQ ID NO: 5967826 - DNA, 21 bp, Homo sapiens
cttacttccagcaaaatccaa

SEQ ID NO: 5967827 - DNA, 16 bp, Homo sapiens
cttacttcctggcctc

SEQ ID NO: 5967828 - DNA, 17 bp, Homo sapiens
cttacttcctggcctct

SEQ ID NO: 5967829 - DNA, 19 bp, Homo sapiens
cttacttcggttcctctga

SEQ ID NO: 5967830 - DNA, 14 bp, Homo sapiens
cttacttcttgccc

SEQ ID NO: 5967831 - DNA, 14 bp, Homo sapiens
cttacttgcactgt

SEQ ID NO: 5967832 - DNA, 18 bp, Homo sapiens
cttacttggctttttact

SEQ ID NO: 5967833 - DNA, 17 bp, Homo sapiens
cttacttgtctgtacag

SEQ ID NO: 5967834 - DNA, 21 bp, Homo sapiens
cttactttaattactggaatt

SEQ ID NO: 5967835 - DNA, 14 bp, Homo sapiens
cttactttcagttt

SEQ ID NO: 5967836 - DNA, 15 bp, Homo sapiens
cttactttcagtttt

SEQ ID NO: 5967837 - DNA, 18 bp, Homo sapiens
cttactttcctgaaaata

SEQ ID NO: 5967838 - DNA, 21 bp, Homo sapiens
cttactttcctttccccagcc

SEQ ID NO: 5967839 - DNA, 13 bp, Homo sapiens
cttactttgcttg

SEQ ID NO: 5967840 - DNA, 20 bp, Homo sapiens
cttactttgtaaattctgat

SEQ ID NO: 5967841 - DNA, 18 bp, Homo sapiens
cttactttgtatgatatt

SEQ ID NO: 5967842 - DNA, 12 bp, Homo sapiens
cttactttgtgc

SEQ ID NO: 5967843 - DNA, 13 bp, Homo sapiens
cttactttgtgca

SEQ ID NO: 5967844 - DNA, 15 bp, Homo sapiens
cttactttgtgcaaa

SEQ ID NO: 5967845 - DNA, 19 bp, Homo sapiens
cttactttgtgcaaaagca

SEQ ID NO: 5967846 - DNA, 14 bp, Homo sapiens
cttactttgttaat

SEQ ID NO: 5967847 - DNA, 17 bp, Homo sapiens
cttactttgttaattta

SEQ ID NO: 5967848 - DNA, 12 bp, Homo sapiens
cttacttttaaa

SEQ ID NO: 5967849 - DNA, 15 bp, Homo sapiens
cttacttttaaaata

SEQ ID NO: 5967850 - DNA, 16 bp, Homo sapiens
cttacttttaaaataa

SEQ ID NO: 5967851 - DNA, 20 bp, Homo sapiens
cttacttttattattttaat

SEQ ID NO: 5967852 - DNA, 14 bp, Homo sapiens
cttactttttatat

SEQ ID NO: 5967853 - DNA, 15 bp, Homo sapiens
cttactttttgtaaa

SEQ ID NO: 5967854 - DNA, 16 bp, Homo sapiens
cttactttttgtaaat

SEQ ID NO: 5967855 - DNA, 17 bp, Homo sapiens
cttactttttgtaaatg

SEQ ID NO: 5967856 - DNA, 16 bp, Homo sapiens
cttagaaaaaaaaaga

SEQ ID NO: 5967857 - DNA, 20 bp, Homo sapiens
gaagccttcaagctctgagg

SEQ ID NO: 5967858 - DNA, 17 bp, Homo sapiens
gaagccttcagctccag

SEQ ID NO: 5967859 - DNA, 10 bp, Homo sapiens
gaagccttcc

SEQ ID NO: 5967860 - DNA, 14 bp, Homo sapiens
gaagccttccccca

SEQ ID NO: 5967861 - DNA, 16 bp, Homo sapiens
gaagccttctgacctg

SEQ ID NO: 5967862 - DNA, 15 bp, Homo sapiens
gaagccttctgcagc

SEQ ID NO: 5967863 - DNA, 20 bp, Homo sapiens
gaagccttctgcagcaggaa

SEQ ID NO: 5967864 - DNA, 15 bp, Homo sapiens
gaagccttcttctgc

SEQ ID NO: 5967865 - DNA, 21 bp, Homo sapiens
gaagccttgcactaggttgca

SEQ ID NO: 5967866 - DNA, 21 bp, Homo sapiens
gaagccttgctgaactaagtt

SEQ ID NO: 5967867 - DNA, 10 bp, Homo sapiens
gaagcctttg

SEQ ID NO: 5967868 - DNA, 13 bp, Homo sapiens
gaagcctttggga

SEQ ID NO: 5967869 - DNA, 11 bp, Homo sapiens
gaagcctttgt

SEQ ID NO: 5967870 - DNA, 15 bp, Homo sapiens
gaagccttttgcaaa

SEQ ID NO: 5967871 - DNA, 13 bp, Homo sapiens
gaagcgaacatct

SEQ ID NO: 5967872 - DNA, 14 bp, Homo sapiens
gaagcgaacatctt

SEQ ID NO: 5967873 - DNA, 17 bp, Homo sapiens
gaagcgaacatcttcat

SEQ ID NO: 5967874 - DNA, 16 bp, Homo sapiens
gaagcgacccagggga

SEQ ID NO: 5967875 - DNA, 22 bp, Homo sapiens
gaagcgacttttgttctcttct

SEQ ID NO: 5967876 - DNA, 23 bp, Homo sapiens
gaagcgacttttgttctcttctg

SEQ ID NO: 5967877 - DNA, 17 bp, Homo sapiens
gaagcgcagcagcggga

SEQ ID NO: 5967878 - DNA, 19 bp, Homo sapiens
gaagcgccaggctggagat

SEQ ID NO: 5967879 - DNA, 20 bp, Homo sapiens
gaagcgccaggctggagata

SEQ ID NO: 5967880 - DNA, 18 bp, Homo sapiens
gaagcgccgactccctga

SEQ ID NO: 5967881 - DNA, 22 bp, Homo sapiens
gaagcgcctcagttacacagga

SEQ ID NO: 5967882 - DNA, 14 bp, Homo sapiens
gaagcgctcatctg

SEQ ID NO: 5967883 - DNA, 14 bp, Homo sapiens
gaagcgctgttgcc

SEQ ID NO: 5967884 - DNA, 16 bp, Homo sapiens
gaagcgcttctgcacc

SEQ ID NO: 5967885 - DNA, 17 bp, Homo sapiens
gaagcggagagagccaa

SEQ ID NO: 5967886 - DNA, 21 bp, Homo sapiens
gaagcggagagagccaagacg

SEQ ID NO: 5967887 - DNA, 19 bp, Homo sapiens
gaagcggagcttgcagtga

SEQ ID NO: 5967888 - DNA, 16 bp, Homo sapiens
gaagcgtcagcgggcg

SEQ ID NO: 5967889 - DNA, 16 bp, Homo sapiens
gaagcgtctcccttgg

SEQ ID NO: 5967890 - DNA, 24 bp, Homo sapiens
gaagcgtctcccttggccacggcc

SEQ ID NO: 5967891 - DNA, 13 bp, Homo sapiens
gaagcgttgtcct

SEQ ID NO: 5967892 - DNA, 14 bp, Homo sapiens
gaagctaaaacact

SEQ ID NO: 5967893 - DNA, 15 bp, Homo sapiens
gaagctaacagggaa

SEQ ID NO: 5967894 - DNA, 20 bp, Homo sapiens
gaagctaacgttagaatagt

SEQ ID NO: 5967895 - DNA, 22 bp, Homo sapiens
gaagctaatgaactctttcaaa

SEQ ID NO: 5967896 - DNA, 21 bp, Homo sapiens
gaagctaattattttaattag

SEQ ID NO: 5967897 - DNA, 22 bp, Homo sapiens
gaagctaattattttaattagg

SEQ ID NO: 5967898 - DNA, 15 bp, Homo sapiens
gaagctaatttgcat

SEQ ID NO: 5967899 - DNA, 16 bp, Homo sapiens
gaagctaatttgcatt

SEQ ID NO: 5967900 - DNA, 14 bp, Homo sapiens
gaagctacaggtta

SEQ ID NO: 5967901 - DNA, 15 bp, Homo sapiens
gaagctactgcatga

SEQ ID NO: 5967902 - DNA, 20 bp, Homo sapiens
gaagctactgtgtgtgtgaa

SEQ ID NO: 5967903 - DNA, 17 bp, Homo sapiens
gaagctagatgcccctg

SEQ ID NO: 5967904 - DNA, 14 bp, Homo sapiens
gaagctagtctttt

SEQ ID NO: 5967905 - DNA, 17 bp, Homo sapiens
gaagctataaagaaaag

SEQ ID NO: 5967906 - DNA, 19 bp, Homo sapiens
gaagctataaattcctctt

SEQ ID NO: 5967907 - DNA, 19 bp, Homo sapiens
gaagctatgtctctagcag

SEQ ID NO: 5967908 - DNA, 19 bp, Homo sapiens
gaagctatgtttttaaagt

SEQ ID NO: 5967909 - DNA, 19 bp, Homo sapiens
gcatggtgttttcattccc

SEQ ID NO: 5967910 - DNA, 17 bp, Homo sapiens
gcatggttccttccctg

SEQ ID NO: 5967911 - DNA, 18 bp, Homo sapiens
gcatggttccttccctgg

SEQ ID NO: 5967912 - DNA, 21 bp, Homo sapiens
gcatggttccttccctgggaa

SEQ ID NO: 5967913 - DNA, 17 bp, Homo sapiens
gcatggtttgcatgact

SEQ ID NO: 5967914 - DNA, 21 bp, Homo sapiens
gcatggttttgtgccatctgt

SEQ ID NO: 5967915 - DNA, 22 bp, Homo sapiens
gcatgtaaaagcctaggtctat

SEQ ID NO: 5967916 - DNA, 19 bp, Homo sapiens
gcatgtaaaatcttcagct

SEQ ID NO: 5967917 - DNA, 21 bp, Homo sapiens
gcatgtaaaatcttcagctgg

SEQ ID NO: 5967918 - DNA, 22 bp, Homo sapiens
gcatgtaaaatgcagtccagaa

SEQ ID NO: 5967919 - DNA, 19 bp, Homo sapiens
gcatgtaaacacgcctgca

SEQ ID NO: 5967920 - DNA, 17 bp, Homo sapiens
gcatgtaaatgtaaact

SEQ ID NO: 5967921 - DNA, 15 bp, Homo sapiens
gcatgtaagtgttaa

SEQ ID NO: 5967922 - DNA, 19 bp, Homo sapiens
gcatgtaatcccagctact

SEQ ID NO: 5967923 - DNA, 21 bp, Homo sapiens
gcatgtacggattttcagtta

SEQ ID NO: 5967924 - DNA, 16 bp, Homo sapiens
gcatgtacttgaagga

SEQ ID NO: 5967925 - DNA, 21 bp, Homo sapiens
gcatgtactttatattttcta

SEQ ID NO: 5967926 - DNA, 20 bp, Homo sapiens
gagagcttcaggccccagga

SEQ ID NO: 5967927 - DNA, 15 bp, Homo sapiens
gagagcttcctgttt

SEQ ID NO: 5967928 - DNA, 17 bp, Homo sapiens
gagagcttcctgtttct

SEQ ID NO: 5967929 - DNA, 14 bp, Homo sapiens
gagagctttctgcc

SEQ ID NO: 5967930 - DNA, 15 bp, Homo sapiens
gagagctttctgcct

SEQ ID NO: 5967931 - DNA, 16 bp, Homo sapiens
gagaggaaaagccagt

SEQ ID NO: 5967932 - DNA, 20 bp, Homo sapiens
gagaggaaaagctgcctctg

SEQ ID NO: 5967933 - DNA, 20 bp, Homo sapiens
gagaggaaaagtaaggtgca

SEQ ID NO: 5967934 - DNA, 14 bp, Homo sapiens
gagaggaagcacac

SEQ ID NO: 5967935 - DNA, 21 bp, Homo sapiens
gagaggaagccacgtgctgga

SEQ ID NO: 5967936 - DNA, 12 bp, Homo sapiens
gagaggaagcct

SEQ ID NO: 5967937 - DNA, 19 bp, Homo sapiens
gagaggaatgcctgtgtga

SEQ ID NO: 5967938 - DNA, 20 bp, Homo sapiens
gagaggacaaaataaagtgt

SEQ ID NO: 5967939 - DNA, 10 bp, Homo sapiens
gagaggacag

SEQ ID NO: 5967940 - DNA, 16 bp, Homo sapiens
gagaggacagaatgga

SEQ ID NO: 5967941 - DNA, 19 bp, Homo sapiens
gagaggacggccctgcctg

SEQ ID NO: 5967942 - DNA, 17 bp, Homo sapiens
gagaggacgtgggcggc

SEQ ID NO: 5967943 - DNA, 19 bp, Homo sapiens
gagaggactggttctgagg

SEQ ID NO: 5967944 - DNA, 23 bp, Homo sapiens
gagaggactggttctgaggccag

SEQ ID NO: 5967945 - DNA, 14 bp, Homo sapiens
gagaggagaaacac

SEQ ID NO: 5967946 - DNA, 14 bp, Homo sapiens
gagaggagatcagg

SEQ ID NO: 5967947 - DNA, 13 bp, Homo sapiens
gagaggaggcaac

SEQ ID NO: 5967948 - DNA, 13 bp, Homo sapiens
gagaggaggcagc

SEQ ID NO: 5967949 - DNA, 17 bp, Homo sapiens
gagaggaggggtaaata

SEQ ID NO: 5967950 - DNA, 13 bp, Homo sapiens
gagaggagggttc

SEQ ID NO: 5967951 - DNA, 18 bp, Homo sapiens
gagaggagggttcctctt

SEQ ID NO: 5967952 - DNA, 20 bp, Homo sapiens
gagaggaggtgtggagtgga

SEQ ID NO: 5967953 - DNA, 17 bp, Homo sapiens
gagaggagttcaatgat

SEQ ID NO: 5967954 - DNA, 20 bp, Homo sapiens
gagaggagttctttggctct

SEQ ID NO: 5967955 - DNA, 15 bp, Homo sapiens
gagaggatacattta

SEQ ID NO: 5967956 - DNA, 16 bp, Homo sapiens
gagaggatacatttaa

SEQ ID NO: 5967957 - DNA, 14 bp, Homo sapiens
gagaggatgaatgt

SEQ ID NO: 5967958 - DNA, 18 bp, Homo sapiens
gagaggatgagagcccag

SEQ ID NO: 5967959 - DNA, 21 bp, Homo sapiens
gagaggatgagagcccagagg

SEQ ID NO: 5967960 - DNA, 20 bp, Homo sapiens
gagaggatttggctcgctgt

SEQ ID NO: 5967961 - DNA, 23 bp, Homo sapiens
gagaggcaataaataaatgtttt

SEQ ID NO: 5967962 - DNA, 13 bp, Homo sapiens
gagaggcaccagt

SEQ ID NO: 5967963 - DNA, 16 bp, Homo sapiens
gagaggcacctgctgg

SEQ ID NO: 5967964 - DNA, 15 bp, Homo sapiens
gagaggcagaaaggg

SEQ ID NO: 5967965 - DNA, 20 bp, Homo sapiens
gagaggcagaagaaccctgg

SEQ ID NO: 5967966 - DNA, 14 bp, Homo sapiens
gagaggcagaggca

SEQ ID NO: 5967967 - DNA, 23 bp, Homo sapiens
gagaggcagcaaggtggccacag

SEQ ID NO: 5967968 - DNA, 18 bp, Homo sapiens
gagaggcagcatgcttgg

SEQ ID NO: 5967969 - DNA, 20 bp, Homo sapiens
gagaggcagccagacccaga

SEQ ID NO: 5967970 - DNA, 17 bp, Homo sapiens
gagaggcaggaatgggg

SEQ ID NO: 5967971 - DNA, 15 bp, Homo sapiens
gagaggcatggctgg

SEQ ID NO: 5967972 - DNA, 18 bp, Homo sapiens
gagaggcatgggggccca

SEQ ID NO: 5967973 - DNA, 17 bp, Homo sapiens
gagaggccaaaggctgg

SEQ ID NO: 5967974 - DNA, 12 bp, Homo sapiens
gagaggccatga

SEQ ID NO: 5967975 - DNA, 15 bp, Homo sapiens
gagaggcccgcccgc

SEQ ID NO: 5967976 - DNA, 16 bp, Homo sapiens
gagaggccctctggag

SEQ ID NO: 5967977 - DNA, 20 bp, Homo sapiens
gagaggccctctggagtggc

SEQ ID NO: 5967978 - DNA, 12 bp, Homo sapiens
gagaggccctgg

SEQ ID NO: 5967979 - DNA, 24 bp, Homo sapiens
gagaggccctggatcagcgtggcc

SEQ ID NO: 5967980 - DNA, 13 bp, Homo sapiens
gagaggcctccct

SEQ ID NO: 5967981 - DNA, 22 bp, Homo sapiens
gagaggcctggggtgggacagg

SEQ ID NO: 5967982 - DNA, 14 bp, Homo sapiens
gagaggcctgggtg

SEQ ID NO: 5967983 - DNA, 18 bp, Homo sapiens
gagaggccttttggaatg

SEQ ID NO: 5967984 - DNA, 18 bp, Homo sapiens
gagaggcgagtcaccctc

SEQ ID NO: 5967985 - DNA, 16 bp, Homo sapiens
gagaggcgcgtctgcc

SEQ ID NO: 5967986 - DNA, 16 bp, Homo sapiens
gagaggcggcctcgtg

SEQ ID NO: 5967987 - DNA, 20 bp, Homo sapiens
gagaggctaaaatgttttca

SEQ ID NO: 5967988 - DNA, 21 bp, Homo sapiens
gagaggctaaaatgttttcag

SEQ ID NO: 5967989 - DNA, 22 bp, Homo sapiens
gagaggctaaaatgttttcagc

SEQ ID NO: 5967990 - DNA, 16 bp, Homo sapiens
gagaggctgcctcagc

SEQ ID NO: 5967991 - DNA, 21 bp, Homo sapiens
gagaggctgcctcagccagtg

SEQ ID NO: 5967992 - DNA, 20 bp, Homo sapiens
gagaggctgcctccgcacct

SEQ ID NO: 5967993 - DNA, 21 bp, Homo sapiens
gagaggctggatgacttgctc

SEQ ID NO: 5967994 - DNA, 12 bp, Homo sapiens
gagaggctggga

SEQ ID NO: 5967995 - DNA, 14 bp, Homo sapiens
gagaggctgggagg

SEQ ID NO: 5967996 - DNA, 14 bp, Homo sapiens
gagaggctgggctg

SEQ ID NO: 5967997 - DNA, 24 bp, Homo sapiens
gagaggctgtcatatatcaaagca

SEQ ID NO: 5967998 - DNA, 14 bp, Homo sapiens
gagaggctgtgtcc

SEQ ID NO: 5967999 - DNA, 16 bp, Homo sapiens
gagaggctgtgtccct

SEQ ID NO: 5968000 - DNA, 21 bp, Homo sapiens
gagagggaaaaggcaggtgct

SEQ ID NO: 5968001 - DNA, 17 bp, Homo sapiens
gagagggaaaatcttca

SEQ ID NO: 5968002 - DNA, 18 bp, Homo sapiens
gagagggaaacgtgccct

SEQ ID NO: 5968003 - DNA, 15 bp, Homo sapiens
gagagggaagatgac

SEQ ID NO: 5968004 - DNA, 23 bp, Homo sapiens
gagagggaagatgacctgcccca

SEQ ID NO: 5968005 - DNA, 16 bp, Homo sapiens
gagagggaagctggct

SEQ ID NO: 5968006 - DNA, 14 bp, Homo sapiens
gagagggacacatg

SEQ ID NO: 5968007 - DNA, 16 bp, Homo sapiens
gagagggacacatgcc

SEQ ID NO: 5968008 - DNA, 18 bp, Homo sapiens
gagagggacacatgcccc

SEQ ID NO: 5968009 - DNA, 19 bp, Homo sapiens
gagagggacactcctcctc

SEQ ID NO: 5968010 - DNA, 19 bp, Homo sapiens
gagagggacagcccactga

SEQ ID NO: 5968011 - DNA, 17 bp, Homo sapiens
gagagggacgaagaaag

SEQ ID NO: 5968012 - DNA, 20 bp, Homo sapiens
gagagggactcaagggaaag

SEQ ID NO: 5968013 - DNA, 9 bp, Homo sapiens
gagagggag

SEQ ID NO: 5968014 - DNA, 23 bp, Homo sapiens
gagagggagaagaagtcagagag

SEQ ID NO: 5968015 - DNA, 14 bp, Homo sapiens
gagagggagagaga

SEQ ID NO: 5968016 - DNA, 17 bp, Homo sapiens
gagagggagcaagcctt

SEQ ID NO: 5968017 - DNA, 18 bp, Homo sapiens
gagagggaggcaagccct

SEQ ID NO: 5968018 - DNA, 13 bp, Homo sapiens
gagagggagggag

SEQ ID NO: 5968019 - DNA, 13 bp, Homo sapiens
gagagggagtcag

SEQ ID NO: 5968020 - DNA, 23 bp, Homo sapiens
gagagggatttccctgcagacct

SEQ ID NO: 5968021 - DNA, 21 bp, Homo sapiens
gagagggcaatctttgccttt

SEQ ID NO: 5968022 - DNA, 16 bp, Homo sapiens
gagagggcaggcatga

SEQ ID NO: 5968023 - DNA, 19 bp, Homo sapiens
gagagggcccagctgtagc

SEQ ID NO: 5968024 - DNA, 19 bp, Homo sapiens
gagagggcccaggtcccaa

SEQ ID NO: 5968025 - DNA, 19 bp, Homo sapiens
gagagggcgcccagcccag

SEQ ID NO: 5968026 - DNA, 20 bp, Homo sapiens
gagagggcgcccagcccagg

SEQ ID NO: 5968027 - DNA, 21 bp, Homo sapiens
gagagggcgcccagcccaggc

SEQ ID NO: 5968028 - DNA, 22 bp, Homo sapiens
gagagggcgcccagcccaggcc

SEQ ID NO: 5968029 - DNA, 12 bp, Homo sapiens
gagagggctgag

SEQ ID NO: 5968030 - DNA, 14 bp, Homo sapiens
gagagggctgagcc

SEQ ID NO: 5968031 - DNA, 17 bp, Homo sapiens
gagagggctgagccatg

SEQ ID NO: 5968032 - DNA, 22 bp, Homo sapiens
gagagggctgagcccctcctct

SEQ ID NO: 5968033 - DNA, 15 bp, Homo sapiens
gagagggctggtcct

SEQ ID NO: 5968034 - DNA, 21 bp, Homo sapiens
gagagggctgtggctgggtgg

SEQ ID NO: 5968035 - DNA, 21 bp, Homo sapiens
gagagggctgttggacagctg

SEQ ID NO: 5968036 - DNA, 18 bp, Homo sapiens
gagaggggaacagactgg

SEQ ID NO: 5968037 - DNA, 19 bp, Homo sapiens
gagaggggaacagactgga

SEQ ID NO: 5968038 - DNA, 14 bp, Homo sapiens
gagaggggaagaat

SEQ ID NO: 5968039 - DNA, 17 bp, Homo sapiens
gagaggggaagaattta

SEQ ID NO: 5968040 - DNA, 18 bp, Homo sapiens
gagaggggaagagtgtac

SEQ ID NO: 5968041 - DNA, 21 bp, Homo sapiens
gagaggggaagagtgtactgg

SEQ ID NO: 5968042 - DNA, 22 bp, Homo sapiens
gagaggggaagagtgtactggg

SEQ ID NO: 5968043 - DNA, 21 bp, Homo sapiens
gagaggggacaaaacccacct

SEQ ID NO: 5968044 - DNA, 12 bp, Homo sapiens
gagaggggacgc

SEQ ID NO: 5968045 - DNA, 21 bp, Homo sapiens
gagaggggacgcaggcccctc

SEQ ID NO: 5968046 - DNA, 18 bp, Homo sapiens
gagaggggagagctgaac

SEQ ID NO: 5968047 - DNA, 14 bp, Homo sapiens
gagaggggaggcca

SEQ ID NO: 5968048 - DNA, 16 bp, Homo sapiens
gagaggggaggccaag

SEQ ID NO: 5968049 - DNA, 14 bp, Homo sapiens
gagaggggagggag

SEQ ID NO: 5968050 - DNA, 15 bp, Homo sapiens
gagaggggagggctc

SEQ ID NO: 5968051 - DNA, 21 bp, Homo sapiens
gagaggggagggctcctgggg

SEQ ID NO: 5968052 - DNA, 20 bp, Homo sapiens
gagaggggccgatgcccaga

SEQ ID NO: 5968053 - DNA, 14 bp, Homo sapiens
gagaggggcctgca

SEQ ID NO: 5968054 - DNA, 22 bp, Homo sapiens
gagaggggcctgggaaaggaaa

SEQ ID NO: 5968055 - DNA, 23 bp, Homo sapiens
gagagggggcactgtggtcaggc

SEQ ID NO: 5968056 - DNA, 14 bp, Homo sapiens
gagagggggccgga

SEQ ID NO: 5968057 - DNA, 19 bp, Homo sapiens
gagagggggctggtgggtg

SEQ ID NO: 5968058 - DNA, 17 bp, Homo sapiens
gagaggggtcacaccca

SEQ ID NO: 5968059 - DNA, 13 bp, Homo sapiens
gagaggggtgaga

SEQ ID NO: 5968060 - DNA, 18 bp, Homo sapiens
gagagggtctggagaagc

SEQ ID NO: 5968061 - DNA, 23 bp, Homo sapiens
gagagggtgagtcctccagaact

SEQ ID NO: 5968062 - DNA, 23 bp, Homo sapiens
gagagggtggcatcaggagctgc

SEQ ID NO: 5968063 - DNA, 16 bp, Homo sapiens
gagagggtgggagtgg

SEQ ID NO: 5968064 - DNA, 21 bp, Homo sapiens
gagagggtgggagtgggccca

SEQ ID NO: 5968065 - DNA, 16 bp, Homo sapiens
gagaggtagcgagctg

SEQ ID NO: 5968066 - DNA, 19 bp, Homo sapiens
gagaggtcaagcccaggag

SEQ ID NO: 5968067 - DNA, 21 bp, Homo sapiens
gagaggtcaccagctgctgtg

SEQ ID NO: 5968068 - DNA, 15 bp, Homo sapiens
gagaggtcagccttg

SEQ ID NO: 5968069 - DNA, 17 bp, Homo sapiens
gagaggtccagagtcct

SEQ ID NO: 5968070 - DNA, 23 bp, Homo sapiens
gagaggtccagagtcctggccct

SEQ ID NO: 5968071 - DNA, 19 bp, Homo sapiens
gagaggtgattctcagggc

SEQ ID NO: 5968072 - DNA, 14 bp, Homo sapiens
gagaggtgccagca

SEQ ID NO: 5968073 - DNA, 21 bp, Homo sapiens
gagaggtgccagcaactgaat

SEQ ID NO: 5968074 - DNA, 17 bp, Homo sapiens
gagaggtggatcctgta

SEQ ID NO: 5968075 - DNA, 13 bp, Homo sapiens
gagaggtggccac

SEQ ID NO: 5968076 - DNA, 14 bp, Homo sapiens
gagaggtgggccag

SEQ ID NO: 5968077 - DNA, 14 bp, Homo sapiens
gagaggttagaatg

SEQ ID NO: 5968078 - DNA, 22 bp, Homo sapiens
gagaggttgaggaaaagactgt

SEQ ID NO: 5968079 - DNA, 21 bp, Homo sapiens
gagaggttgaggatgcactgg

SEQ ID NO: 5968080 - DNA, 17 bp, Homo sapiens
gagaggtttctggggcc

SEQ ID NO: 5968081 - DNA, 13 bp, Homo sapiens
gagaggtttgtca

SEQ ID NO: 5968082 - DNA, 11 bp, Homo sapiens
gagagtaactt

SEQ ID NO: 5968083 - DNA, 14 bp, Homo sapiens
gagagtaagcacgt

SEQ ID NO: 5968084 - DNA, 17 bp, Homo sapiens
gagagtaatgaggcttg

SEQ ID NO: 5968085 - DNA, 16 bp, Homo sapiens
gagagtacactgtgtc

SEQ ID NO: 5968086 - DNA, 14 bp, Homo sapiens
gagatgcagctgga

SEQ ID NO: 5968087 - DNA, 16 bp, Homo sapiens
gagatgcagtgccagg

SEQ ID NO: 5968088 - DNA, 22 bp, Homo sapiens
gagatgcatctgtggcctgggg

SEQ ID NO: 5968089 - DNA, 17 bp, Homo sapiens
gagatgccagcccttca

SEQ ID NO: 5968090 - DNA, 14 bp, Homo sapiens
gagatgcggccaag

SEQ ID NO: 5968091 - DNA, 21 bp, Homo sapiens
gagatgctactgtcagtgtcc

SEQ ID NO: 5968092 - DNA, 15 bp, Homo sapiens
gagatgctctctgag

SEQ ID NO: 5968093 - DNA, 16 bp, Homo sapiens
gagatgctggagaaga

SEQ ID NO: 5968094 - DNA, 18 bp, Homo sapiens
gagatgctgggaccctcg

SEQ ID NO: 5968095 - DNA, 23 bp, Homo sapiens
gagatgctgggagggctgaaccc

SEQ ID NO: 5968096 - DNA, 15 bp, Homo sapiens
gagatgctgtgcccc

SEQ ID NO: 5968097 - DNA, 17 bp, Homo sapiens
gagatgctgtgcccctg

SEQ ID NO: 5968098 - DNA, 15 bp, Homo sapiens
gagatgcttctctcc

SEQ ID NO: 5968099 - DNA, 20 bp, Homo sapiens
gagatgcttctctccttgcc

SEQ ID NO: 5968100 - DNA, 18 bp, Homo sapiens
gagatggaaacaatgtgg

SEQ ID NO: 5968101 - DNA, 23 bp, Homo sapiens
gagatggaacccttttggccccc

SEQ ID NO: 5968102 - DNA, 15 bp, Homo sapiens
gagatggaagagtca

SEQ ID NO: 5968103 - DNA, 15 bp, Homo sapiens
gagatggaagcttgt

SEQ ID NO: 5968104 - DNA, 20 bp, Homo sapiens
gagatggaagttgcagtgag

SEQ ID NO: 5968105 - DNA, 22 bp, Homo sapiens
gagatggactaattgacttgca

SEQ ID NO: 5968106 - DNA, 21 bp, Homo sapiens
gcattcatgtaataaacaggt

SEQ ID NO: 5968107 - DNA, 15 bp, Homo sapiens
gcattcatgttttaa

SEQ ID NO: 5968108 - DNA, 23 bp, Homo sapiens
gcattcattttctgacatgcatt

SEQ ID NO: 5968109 - DNA, 15 bp, Homo sapiens
gcattcatttttata

SEQ ID NO: 5968110 - DNA, 14 bp, Homo sapiens
gcattccacaggat

SEQ ID NO: 5968111 - DNA, 21 bp, Homo sapiens
gcattccactttttgttacat

SEQ ID NO: 5968112 - DNA, 11 bp, Homo sapiens
gcattccagaa

SEQ ID NO: 5968113 - DNA, 16 bp, Homo sapiens
gcattccagacttcaa

SEQ ID NO: 5968114 - DNA, 12 bp, Homo sapiens
gcattccagagc

SEQ ID NO: 5968115 - DNA, 14 bp, Homo sapiens
gcattccagagtta

SEQ ID NO: 5968116 - DNA, 22 bp, Homo sapiens
gcattccagagttaaaatgttt

SEQ ID NO: 5968117 - DNA, 12 bp, Homo sapiens
gcattccaggct

SEQ ID NO: 5968118 - DNA, 17 bp, Homo sapiens
gcattccatgattttac

SEQ ID NO: 5968119 - DNA, 22 bp, Homo sapiens
gcattccatgattttacagaga

SEQ ID NO: 5968120 - DNA, 12 bp, Homo sapiens
gcattcccacca

SEQ ID NO: 5968121 - DNA, 15 bp, Homo sapiens
gcattcccagaggtg

SEQ ID NO: 5968122 - DNA, 14 bp, Homo sapiens
gcattcccagggac

SEQ ID NO: 5968123 - DNA, 21 bp, Homo sapiens
gcattcccaggtaggccaagg

SEQ ID NO: 5968124 - DNA, 18 bp, Homo sapiens
gcattccccaggaggcca

SEQ ID NO: 5968125 - DNA, 19 bp, Homo sapiens
gcattccccaggaggccag

SEQ ID NO: 5968126 - DNA, 22 bp, Homo sapiens
gcattccccaggaggccagcct

SEQ ID NO: 5968127 - DNA, 14 bp, Homo sapiens
gcattccctgagtc

SEQ ID NO: 5968128 - DNA, 16 bp, Homo sapiens
gcattcctacaaagat

SEQ ID NO: 5968129 - DNA, 19 bp, Homo sapiens
gcattcctacaaagatgtt

SEQ ID NO: 5968130 - DNA, 22 bp, Homo sapiens
gcattcctgatatgatttaaaa

SEQ ID NO: 5968131 - DNA, 14 bp, Homo sapiens
gcattcctgtgccc

SEQ ID NO: 5968132 - DNA, 17 bp, Homo sapiens
gcattccttacttgcac

SEQ ID NO: 5968133 - DNA, 19 bp, Homo sapiens
gcattccttagcagctcag

SEQ ID NO: 5968134 - DNA, 15 bp, Homo sapiens
gcattccttctttga

SEQ ID NO: 5968135 - DNA, 22 bp, Homo sapiens
gcattccttctttgataatgtt

SEQ ID NO: 5968136 - DNA, 16 bp, Homo sapiens
gcattcctttgtcttc

SEQ ID NO: 5968137 - DNA, 17 bp, Homo sapiens
gcattcgcactggggga

SEQ ID NO: 5968138 - DNA, 22 bp, Homo sapiens
gcattcgcagtgcccagtgatg

SEQ ID NO: 5968139 - DNA, 23 bp, Homo sapiens
gcattcgctgtaccctttaagat

SEQ ID NO: 5968140 - DNA, 16 bp, Homo sapiens
gcattcgggccacagg

SEQ ID NO: 5968141 - DNA, 17 bp, Homo sapiens
gcattcgggccacaggg

SEQ ID NO: 5968142 - DNA, 22 bp, Homo sapiens
gcattcgttgtgttttttaaga

SEQ ID NO: 5968143 - DNA, 17 bp, Homo sapiens
gcattctaacctggagg

SEQ ID NO: 5968144 - DNA, 15 bp, Homo sapiens
gcattctagtgcaga

SEQ ID NO: 5968145 - DNA, 22 bp, Homo sapiens
gcattctatcgttattataaat

SEQ ID NO: 5968146 - DNA, 18 bp, Homo sapiens
gcattctcactcctacct

SEQ ID NO: 5968147 - DNA, 14 bp, Homo sapiens
gcattctcatggag

SEQ ID NO: 5968148 - DNA, 13 bp, Homo sapiens
gcattctcccagc

SEQ ID NO: 5968149 - DNA, 14 bp, Homo sapiens
gcattctcccagct

SEQ ID NO: 5968150 - DNA, 16 bp, Homo sapiens
gcattctcctggatgc

SEQ ID NO: 5968151 - DNA, 23 bp, Homo sapiens
gcattctctccatttcactggct

SEQ ID NO: 5968152 - DNA, 17 bp, Homo sapiens
gcattctctcccatcct

SEQ ID NO: 5968153 - DNA, 19 bp, Homo sapiens
gcattctctcccatcctgg

SEQ ID NO: 5968154 - DNA, 21 bp, Homo sapiens
gcattctctcccatcctgggg

SEQ ID NO: 5968155 - DNA, 19 bp, Homo sapiens
gcattctgataggaggggg

SEQ ID NO: 5968156 - DNA, 22 bp, Homo sapiens
gcattctgccgtgtgccctcgg

SEQ ID NO: 5968157 - DNA, 17 bp, Homo sapiens
gcattctgcctgcctgg

SEQ ID NO: 5968158 - DNA, 19 bp, Homo sapiens
gcattctgcctgcctggga

SEQ ID NO: 5968159 - DNA, 19 bp, Homo sapiens
gcattctggacctctgggt

SEQ ID NO: 5968160 - DNA, 17 bp, Homo sapiens
gcattctggccaagggg

SEQ ID NO: 5968161 - DNA, 19 bp, Homo sapiens
gcattctgtttcctcttga

SEQ ID NO: 5968162 - DNA, 22 bp, Homo sapiens
gcattcttagcctgtggcagta

SEQ ID NO: 5968163 - DNA, 13 bp, Homo sapiens
gcattcttctctg

SEQ ID NO: 5968164 - DNA, 14 bp, Homo sapiens
gcattcttctctgt

SEQ ID NO: 5968165 - DNA, 14 bp, Homo sapiens
gcattcttctgatc

SEQ ID NO: 5968166 - DNA, 19 bp, Homo sapiens
gcattcttgtcacaataaa

SEQ ID NO: 5968167 - DNA, 22 bp, Homo sapiens
gcattcttgtcacaataaatgt

SEQ ID NO: 5968168 - DNA, 12 bp, Homo sapiens
gcattctttccc

SEQ ID NO: 5968169 - DNA, 18 bp, Homo sapiens
gcattctttctgtattga

SEQ ID NO: 5968170 - DNA, 20 bp, Homo sapiens
gcattctttggtaatttttt

SEQ ID NO: 5968171 - DNA, 16 bp, Homo sapiens
gcattcttttaaaaga

SEQ ID NO: 5968172 - DNA, 20 bp, Homo sapiens
gcattcttttaaaagacaag

SEQ ID NO: 5968173 - DNA, 13 bp, Homo sapiens
gcattgaaataat

SEQ ID NO: 5968174 - DNA, 11 bp, Homo sapiens
gcattgaaatt

SEQ ID NO: 5968175 - DNA, 18 bp, Homo sapiens
gcattgaacacaaactgt

SEQ ID NO: 5968176 - DNA, 17 bp, Homo sapiens
gcattgaactctacaac

SEQ ID NO: 5968177 - DNA, 21 bp, Homo sapiens
gcattgaagtatggtgtgttc

SEQ ID NO: 5968178 - DNA, 21 bp, Homo sapiens
gcattgaatgacaagcatcag

SEQ ID NO: 5968179 - DNA, 19 bp, Homo sapiens
gcattgaatggctatgttt

SEQ ID NO: 5968180 - DNA, 16 bp, Homo sapiens
gcattgacaaatctgt

SEQ ID NO: 5968181 - DNA, 20 bp, Homo sapiens
gcattgacaaatctgtgtat

SEQ ID NO: 5968182 - DNA, 13 bp, Homo sapiens
gcattgacattat

SEQ ID NO: 5968183 - DNA, 16 bp, Homo sapiens
gcattgaccttcatga

SEQ ID NO: 5968184 - DNA, 23 bp, Homo sapiens
gcattgactggtttacaggccct

SEQ ID NO: 5968185 - DNA, 22 bp, Homo sapiens
gcattgactttcagtaaacata

SEQ ID NO: 5968186 - DNA, 17 bp, Homo sapiens
gcattgactttccccac

SEQ ID NO: 5968187 - DNA, 18 bp, Homo sapiens
gcattgagaaactgaata

SEQ ID NO: 5968188 - DNA, 21 bp, Homo sapiens
gcattgagaactgcatatgtt

SEQ ID NO: 5968189 - DNA, 13 bp, Homo sapiens
gcattgagctgcc

SEQ ID NO: 5968190 - DNA, 18 bp, Homo sapiens
gcattgaggaagagtctt

SEQ ID NO: 5968191 - DNA, 17 bp, Homo sapiens
gcattgagtattgttta

SEQ ID NO: 5968192 - DNA, 17 bp, Homo sapiens
gcattgatattgtgaac

SEQ ID NO: 5968193 - DNA, 17 bp, Homo sapiens
gcattgatggggaagga

SEQ ID NO: 5968194 - DNA, 16 bp, Homo sapiens
gcattgattcagtatt

SEQ ID NO: 5968195 - DNA, 16 bp, Homo sapiens
gcattgcacagagtga

SEQ ID NO: 5968196 - DNA, 15 bp, Homo sapiens
gcattgcactaaaag

SEQ ID NO: 5968197 - DNA, 23 bp, Homo sapiens
gcattgcactaaaagtgatgtga

SEQ ID NO: 5968198 - DNA, 23 bp, Homo sapiens
gcattgcagaacatgagtgctga

SEQ ID NO: 5968199 - DNA, 12 bp, Homo sapiens
gcattgcagcct

SEQ ID NO: 5968200 - DNA, 14 bp, Homo sapiens
gcattgcagccttg

SEQ ID NO: 5968201 - DNA, 15 bp, Homo sapiens
gcattgcagccttgc

SEQ ID NO: 5968202 - DNA, 12 bp, Homo sapiens
gcattgcattta

SEQ ID NO: 5968203 - DNA, 17 bp, Homo sapiens
gcattgccatgtggaag

SEQ ID NO: 5968204 - DNA, 22 bp, Homo sapiens
gcattgccgaagtccagctttc

SEQ ID NO: 5968205 - DNA, 21 bp, Homo sapiens
gcattgcctcggctggctccc

SEQ ID NO: 5968206 - DNA, 16 bp, Homo sapiens
gcattgcctggactga

SEQ ID NO: 5968207 - DNA, 20 bp, Homo sapiens
gcattgcctggccttcctgt

SEQ ID NO: 5968208 - DNA, 17 bp, Homo sapiens
gcattgctagataaaag

SEQ ID NO: 5968209 - DNA, 18 bp, Homo sapiens
gcattgctagataaaagc

SEQ ID NO: 5968210 - DNA, 15 bp, Homo sapiens
gcattgctcagcccg

SEQ ID NO: 5968211 - DNA, 16 bp, Homo sapiens
gcattgctcagcccgc

SEQ ID NO: 5968212 - DNA, 16 bp, Homo sapiens
gcattgctctggatct

SEQ ID NO: 5968213 - DNA, 14 bp, Homo sapiens
gcattgctggacta

SEQ ID NO: 5968214 - DNA, 13 bp, Homo sapiens
gcattgctggttc

SEQ ID NO: 5968215 - DNA, 14 bp, Homo sapiens
gcattgctgtgtga

SEQ ID NO: 5968216 - DNA, 20 bp, Homo sapiens
gcattgctttctgaaattag

SEQ ID NO: 5968217 - DNA, 14 bp, Homo sapiens
gcattgctttgccc

SEQ ID NO: 5968218 - DNA, 22 bp, Homo sapiens
gcattgctttgccctggagcag

SEQ ID NO: 5968219 - DNA, 18 bp, Homo sapiens
gcattgcttttggacaag

SEQ ID NO: 5968220 - DNA, 16 bp, Homo sapiens
gcattggaactggagg

SEQ ID NO: 5968221 - DNA, 16 bp, Homo sapiens
gcattggaagacccca

SEQ ID NO: 5968222 - DNA, 15 bp, Homo sapiens
gcattggaagagccc

SEQ ID NO: 5968223 - DNA, 16 bp, Homo sapiens
gcattggaagagcccg

SEQ ID NO: 5968224 - DNA, 22 bp, Homo sapiens
gcattggaattctactggaaaa

SEQ ID NO: 5968225 - DNA, 20 bp, Homo sapiens
gcattggatacagcagtaga

SEQ ID NO: 5968226 - DNA, 12 bp, Homo sapiens
gcattggatatt

SEQ ID NO: 5968227 - DNA, 18 bp, Homo sapiens
gcattggatattttttac

SEQ ID NO: 5968228 - DNA, 20 bp, Homo sapiens
gcattggcagcaggtgctgc

SEQ ID NO: 5968229 - DNA, 21 bp, Homo sapiens
gcattggcagcaggtgctgct

SEQ ID NO: 5968230 - DNA, 17 bp, Homo sapiens
gcattggcatctgcttt

SEQ ID NO: 5968231 - DNA, 16 bp, Homo sapiens
gcattggcccctgagc

SEQ ID NO: 5968232 - DNA, 15 bp, Homo sapiens
gcattggcctctgta

SEQ ID NO: 5968233 - DNA, 16 bp, Homo sapiens
gcattggcctctgtac

SEQ ID NO: 5968234 - DNA, 13 bp, Homo sapiens
gcattggcctggc

SEQ ID NO: 5968235 - DNA, 15 bp, Homo sapiens
gcattgggctgacac

SEQ ID NO: 5968236 - DNA, 20 bp, Homo sapiens
gcattgggctgacacctacc

SEQ ID NO: 5968237 - DNA, 19 bp, Homo sapiens
gcattggggatgtttttct

SEQ ID NO: 5968238 - DNA, 17 bp, Homo sapiens
gcattggggttcctctg

SEQ ID NO: 5968239 - DNA, 23 bp, Homo sapiens
gcattggggttcctctgtacagc

SEQ ID NO: 5968240 - DNA, 13 bp, Homo sapiens
gcattggtctgct

SEQ ID NO: 5968241 - DNA, 13 bp, Homo sapiens
gcattggtgactc

SEQ ID NO: 5968242 - DNA, 14 bp, Homo sapiens
gcattggtgactca

SEQ ID NO: 5968243 - DNA, 16 bp, Homo sapiens
gcattggttttccatg

SEQ ID NO: 5968244 - DNA, 20 bp, Homo sapiens
gcattgtaaaagcattttgt

SEQ ID NO: 5968245 - DNA, 22 bp, Homo sapiens
gcattgtaagcgtatggcttta

SEQ ID NO: 5968246 - DNA, 18 bp, Homo sapiens
gcattgtatctgtctttc

SEQ ID NO: 5968247 - DNA, 19 bp, Homo sapiens
gcattgtatctgtctttcc

SEQ ID NO: 5968248 - DNA, 14 bp, Homo sapiens
gcattgtcctgtga

SEQ ID NO: 5968249 - DNA, 11 bp, Homo sapiens
gcattgtcctt

SEQ ID NO: 5968250 - DNA, 18 bp, Homo sapiens
gcattgtctgcaatggtg

SEQ ID NO: 5968251 - DNA, 12 bp, Homo sapiens
gcattgtctgtt

SEQ ID NO: 5968252 - DNA, 22 bp, Homo sapiens
gcattgtcttgttctgtccctt

SEQ ID NO: 5968253 - DNA, 17 bp, Homo sapiens
gcattgtctttgctgta

SEQ ID NO: 5968254 - DNA, 17 bp, Homo sapiens
gcattgtgaactgacag

SEQ ID NO: 5968255 - DNA, 18 bp, Homo sapiens
gcattgtgaattgcctgc

SEQ ID NO: 5968256 - DNA, 22 bp, Homo sapiens
gcattgtgaattgcctgccatg

SEQ ID NO: 5968257 - DNA, 23 bp, Homo sapiens
gcattgtgaattgcctgccatgg

SEQ ID NO: 5968258 - DNA, 23 bp, Homo sapiens
gcattgtgagtaaatcagatgtt

SEQ ID NO: 5968259 - DNA, 22 bp, Homo sapiens
gcattgtgattggcctgtagag

SEQ ID NO: 5968260 - DNA, 19 bp, Homo sapiens
gcattgtggctgtcagcag

SEQ ID NO: 5968261 - DNA, 22 bp, Homo sapiens
gcattgtgtgtgcagacttcag

SEQ ID NO: 5968262 - DNA, 13 bp, Homo sapiens
gcattgttattta

SEQ ID NO: 5968263 - DNA, 23 bp, Homo sapiens
gagcaagacgctgtgctgccctg

SEQ ID NO: 5968264 - DNA, 14 bp, Homo sapiens
gagcaagagagcag

SEQ ID NO: 5968265 - DNA, 15 bp, Homo sapiens
gagcaagagagcagc

SEQ ID NO: 5968266 - DNA, 13 bp, Homo sapiens
gagcaagagccag

SEQ ID NO: 5968267 - DNA, 14 bp, Homo sapiens
gagcaagagctggc

SEQ ID NO: 5968268 - DNA, 15 bp, Homo sapiens
gagcaagaggaggcc

SEQ ID NO: 5968269 - DNA, 20 bp, Homo sapiens
gagcaagccggcaagcgagc

SEQ ID NO: 5968270 - DNA, 16 bp, Homo sapiens
gagcaagcctttgacc

SEQ ID NO: 5968271 - DNA, 20 bp, Homo sapiens
gagcaagctctgccctggct

SEQ ID NO: 5968272 - DNA, 13 bp, Homo sapiens
gagcaagctcttc

SEQ ID NO: 5968273 - DNA, 13 bp, Homo sapiens
gagcaagcttttt

SEQ ID NO: 5968274 - DNA, 17 bp, Homo sapiens
gagcaagcttttttatt

SEQ ID NO: 5968275 - DNA, 13 bp, Homo sapiens
gagcaaggacatt

SEQ ID NO: 5968276 - DNA, 20 bp, Homo sapiens
gagcaaggacattgccccaa

SEQ ID NO: 5968277 - DNA, 17 bp, Homo sapiens
gagcaaggcaagaagtg

SEQ ID NO: 5968278 - DNA, 20 bp, Homo sapiens
gagcaaggcaagaagtggga

SEQ ID NO: 5968279 - DNA, 15 bp, Homo sapiens
gagcaaggcatttgg

SEQ ID NO: 5968280 - DNA, 16 bp, Homo sapiens
gagcaaggctgccctg

SEQ ID NO: 5968281 - DNA, 13 bp, Homo sapiens
gagcaaggctgct

SEQ ID NO: 5968282 - DNA, 23 bp, Homo sapiens
gagcaagggcacaaactgcagct

SEQ ID NO: 5968283 - DNA, 12 bp, Homo sapiens
gagcaagggctt

SEQ ID NO: 5968284 - DNA, 13 bp, Homo sapiens
gagcaagtctgca

SEQ ID NO: 5968285 - DNA, 21 bp, Homo sapiens
gagcaagtctgcaggtgcacc

SEQ ID NO: 5968286 - DNA, 16 bp, Homo sapiens
gagcaagtgaggccgg

SEQ ID NO: 5968287 - DNA, 23 bp, Homo sapiens
gccaaaataaacctgttcttcct

SEQ ID NO: 5968288 - DNA, 21 bp, Homo sapiens
gccaaaataaagtctgtcatg

SEQ ID NO: 5968289 - DNA, 17 bp, Homo sapiens
gccaaaataccaaatgc

SEQ ID NO: 5968290 - DNA, 22 bp, Homo sapiens
gccaaaataccaaatgcctgtt

SEQ ID NO: 5968291 - DNA, 21 bp, Homo sapiens
gccaaaatcctgaactttctc

SEQ ID NO: 5968292 - DNA, 19 bp, Homo sapiens
gccaaaatgtcaattttta

SEQ ID NO: 5968293 - DNA, 11 bp, Homo sapiens
gccaaacaaaa

SEQ ID NO: 5968294 - DNA, 23 bp, Homo sapiens
gccaaacaaaatgagatctcatt

SEQ ID NO: 5968295 - DNA, 13 bp, Homo sapiens
gccaaacaagcct

SEQ ID NO: 5968296 - DNA, 13 bp, Homo sapiens
gccaaacacacag

SEQ ID NO: 5968297 - DNA, 20 bp, Homo sapiens
gccaaacaccactttgtaaa

SEQ ID NO: 5968298 - DNA, 22 bp, Homo sapiens
gccaaacactttacagttctgg

SEQ ID NO: 5968299 - DNA, 14 bp, Homo sapiens
gccaaacagagcct

SEQ ID NO: 5968300 - DNA, 15 bp, Homo sapiens
gccaaacagagcctt

SEQ ID NO: 5968301 - DNA, 15 bp, Homo sapiens
gccaaacagccacac

SEQ ID NO: 5968302 - DNA, 11 bp, Homo sapiens
gccaaacagga

SEQ ID NO: 5968303 - DNA, 23 bp, Homo sapiens
gccaaacagttgtaccactgcta

SEQ ID NO: 5968304 - DNA, 18 bp, Homo sapiens
gccaaacatggccagact

SEQ ID NO: 5968305 - DNA, 11 bp, Homo sapiens
gccaaacatta

SEQ ID NO: 5968306 - DNA, 19 bp, Homo sapiens
gccaaacattaatgttgat

SEQ ID NO: 5968307 - DNA, 23 bp, Homo sapiens
gccaaacattaatgttgatttct

SEQ ID NO: 5968308 - DNA, 16 bp, Homo sapiens
gccaaacattcttatt

SEQ ID NO: 5968309 - DNA, 17 bp, Homo sapiens
gccaaaccaagcaaatt

SEQ ID NO: 5968310 - DNA, 18 bp, Homo sapiens
gccaaaccacaagactct

SEQ ID NO: 5968311 - DNA, 21 bp, Homo sapiens
gccaaaccaggaccctgtcca

SEQ ID NO: 5968312 - DNA, 19 bp, Homo sapiens
gccaaacccagcccctgcg

SEQ ID NO: 5968313 - DNA, 22 bp, Homo sapiens
gccaaacccctagagacagtga

SEQ ID NO: 5968314 - DNA, 15 bp, Homo sapiens
gccaaaccctgtctg

SEQ ID NO: 5968315 - DNA, 17 bp, Homo sapiens
gccaaacccttgctttc

SEQ ID NO: 5968316 - DNA, 19 bp, Homo sapiens
gccaaacccttgctttcct

SEQ ID NO: 5968317 - DNA, 17 bp, Homo sapiens
gccaaacctcaccaact

SEQ ID NO: 5968318 - DNA, 18 bp, Homo sapiens
gccaaacctcctgtcagt

SEQ ID NO: 5968319 - DNA, 16 bp, Homo sapiens
gccaaacctctgttca

SEQ ID NO: 5968320 - DNA, 17 bp, Homo sapiens
gccaaacctgggacccc

SEQ ID NO: 5968321 - DNA, 16 bp, Homo sapiens
gccaaactcaggccca

SEQ ID NO: 5968322 - DNA, 17 bp, Homo sapiens
gccaaactcaggcccag

SEQ ID NO: 5968323 - DNA, 19 bp, Homo sapiens
gccaaactcaggcccagaa

SEQ ID NO: 5968324 - DNA, 23 bp, Homo sapiens
gccaaactgctggacgtctttct

SEQ ID NO: 5968325 - DNA, 18 bp, Homo sapiens
gccaaactgtccctccct

SEQ ID NO: 5968326 - DNA, 19 bp, Homo sapiens
gccaaagaaacaagctgtg

SEQ ID NO: 5968327 - DNA, 20 bp, Homo sapiens
gccaaagaaacaagctgtgc

SEQ ID NO: 5968328 - DNA, 13 bp, Homo sapiens
gccaaagaaactc

SEQ ID NO: 5968329 - DNA, 14 bp, Homo sapiens
gccaaagaaactca

SEQ ID NO: 5968330 - DNA, 21 bp, Homo sapiens
gccaaagaaactcagaagagt

SEQ ID NO: 5968331 - DNA, 17 bp, Homo sapiens
gccaaagaaatgaacat

SEQ ID NO: 5968332 - DNA, 17 bp, Homo sapiens
gccaaagaaatgggcct

SEQ ID NO: 5968333 - DNA, 17 bp, Homo sapiens
gccaaagaatgccttga

SEQ ID NO: 5968334 - DNA, 12 bp, Homo sapiens
gccaaagacaaa

SEQ ID NO: 5968335 - DNA, 19 bp, Homo sapiens
gccaaagagcctcccacca

SEQ ID NO: 5968336 - DNA, 19 bp, Homo sapiens
gccaaagagcctttccaaa

SEQ ID NO: 5968337 - DNA, 16 bp, Homo sapiens
gccaaagataatctct

SEQ ID NO: 5968338 - DNA, 16 bp, Homo sapiens
gccaaagcaaaagaag

SEQ ID NO: 5968339 - DNA, 14 bp, Homo sapiens
gccaaagcacagct

SEQ ID NO: 5968340 - DNA, 17 bp, Homo sapiens
gccaaagcacagctggg

SEQ ID NO: 5968341 - DNA, 14 bp, Homo sapiens
gccaaagcagacat

SEQ ID NO: 5968342 - DNA, 13 bp, Homo sapiens
gccaaagcagatt

SEQ ID NO: 5968343 - DNA, 18 bp, Homo sapiens
gccaaagcagattttcct

SEQ ID NO: 5968344 - DNA, 13 bp, Homo sapiens
gccaaagccaaag

SEQ ID NO: 5968345 - DNA, 17 bp, Homo sapiens
gccaaagccagagtggc

SEQ ID NO: 5968346 - DNA, 16 bp, Homo sapiens
gccaaagccccatgtg

SEQ ID NO: 5968347 - DNA, 13 bp, Homo sapiens
gccaaagctgctt

SEQ ID NO: 5968348 - DNA, 19 bp, Homo sapiens
gccaaagctgctttcttct

SEQ ID NO: 5968349 - DNA, 23 bp, Homo sapiens
gccaaagctgctttcttctctgc

SEQ ID NO: 5968350 - DNA, 19 bp, Homo sapiens
gccaaagctggctttttgt

SEQ ID NO: 5968351 - DNA, 12 bp, Homo sapiens
gccaaaggaagc

SEQ ID NO: 5968352 - DNA, 20 bp, Homo sapiens
gccaaaggaagcacatgcct

SEQ ID NO: 5968353 - DNA, 18 bp, Homo sapiens
gccaaaggccgtgcctgg

SEQ ID NO: 5968354 - DNA, 13 bp, Homo sapiens
gccaaaggggagc

SEQ ID NO: 5968355 - DNA, 16 bp, Homo sapiens
gccaaaggtctagaaa

SEQ ID NO: 5968356 - DNA, 16 bp, Homo sapiens
gccaaaggttcagaaa

SEQ ID NO: 5968357 - DNA, 19 bp, Homo sapiens
gccaaaggttcagaaaatt

SEQ ID NO: 5968358 - DNA, 15 bp, Homo sapiens
gccaaagtacagaat

SEQ ID NO: 5968359 - DNA, 23 bp, Homo sapiens
gccaaagtcagtaggagaggatg

SEQ ID NO: 5968360 - DNA, 20 bp, Homo sapiens
gccaaagtgcagcccttcct

SEQ ID NO: 5968361 - DNA, 13 bp, Homo sapiens
gccaaagtgcctg

SEQ ID NO: 5968362 - DNA, 16 bp, Homo sapiens
gccaaagtgcctggga

SEQ ID NO: 5968363 - DNA, 22 bp, Homo sapiens
gccaaataaaaaacagaaaccg

SEQ ID NO: 5968364 - DNA, 18 bp, Homo sapiens
gccaaataaacagctatt

SEQ ID NO: 5968365 - DNA, 12 bp, Homo sapiens
gccaaataaagt

SEQ ID NO: 5968366 - DNA, 13 bp, Homo sapiens
gccaaataaagtc

SEQ ID NO: 5968367 - DNA, 20 bp, Homo sapiens
gccaaataaatcatcctcat

SEQ ID NO: 5968368 - DNA, 13 bp, Homo sapiens
gccaaatacctag

SEQ ID NO: 5968369 - DNA, 21 bp, Homo sapiens
gccaaatagccccagactggg

SEQ ID NO: 5968370 - DNA, 19 bp, Homo sapiens
gccaaataggagggagact

SEQ ID NO: 5968371 - DNA, 15 bp, Homo sapiens
gccaaatatattctc

SEQ ID NO: 5968372 - DNA, 15 bp, Homo sapiens
gccaaatatgcactt

SEQ ID NO: 5968373 - DNA, 16 bp, Homo sapiens
gccaaatatgcacttt

SEQ ID NO: 5968374 - DNA, 20 bp, Homo sapiens
gccaaatatgcactttccct

SEQ ID NO: 5968375 - DNA, 17 bp, Homo sapiens
gccaaatatgtcctggg

SEQ ID NO: 5968376 - DNA, 21 bp, Homo sapiens
gccaaatatgtttaggaaccg

SEQ ID NO: 5968377 - DNA, 16 bp, Homo sapiens
gccaaatattgatctg

SEQ ID NO: 5968378 - DNA, 14 bp, Homo sapiens
gccaaatccatcct

SEQ ID NO: 5968379 - DNA, 22 bp, Homo sapiens
gccaaatccatcctgctcttcc

SEQ ID NO: 5968380 - DNA, 23 bp, Homo sapiens
gccaaatccgctctcttcctgcc

SEQ ID NO: 5968381 - DNA, 22 bp, Homo sapiens
gccaaatcctgggcatccccag

SEQ ID NO: 5968382 - DNA, 11 bp, Homo sapiens
gccaaatctga

SEQ ID NO: 5968383 - DNA, 20 bp, Homo sapiens
gccaaatgaccgagccctgg

SEQ ID NO: 5968384 - DNA, 13 bp, Homo sapiens
gccaaatgctggg

SEQ ID NO: 5968385 - DNA, 16 bp, Homo sapiens
gccaaatgctggggca

SEQ ID NO: 5968386 - DNA, 21 bp, Homo sapiens
gccaaatgctggggcaggggg

SEQ ID NO: 5968387 - DNA, 12 bp, Homo sapiens
gccaaattaaaa

SEQ ID NO: 5968388 - DNA, 23 bp, Homo sapiens
gccaaattaaaaaagataaacac

SEQ ID NO: 5968389 - DNA, 11 bp, Homo sapiens
gccaaattatt

SEQ ID NO: 5968390 - DNA, 23 bp, Homo sapiens
gccaaattatttgtgtaatagaa

SEQ ID NO: 5968391 - DNA, 18 bp, Homo sapiens
gccaaattgcagaagaaa

SEQ ID NO: 5968392 - DNA, 15 bp, Homo sapiens
gccaaattgctgcat

SEQ ID NO: 5968393 - DNA, 14 bp, Homo sapiens
gccaaatttatatg

SEQ ID NO: 5968394 - DNA, 17 bp, Homo sapiens
gccaaattttagattta

SEQ ID NO: 5968395 - DNA, 14 bp, Homo sapiens
gccaaattttatct

SEQ ID NO: 5968396 - DNA, 14 bp, Homo sapiens
gccaaattttggcc

SEQ ID NO: 5968397 - DNA, 13 bp, Homo sapiens
gccaacaaagctg

SEQ ID NO: 5968398 - DNA, 15 bp, Homo sapiens
gccaacaaagctgtt

SEQ ID NO: 5968399 - DNA, 19 bp, Homo sapiens
gccaacaagaatgcattga

SEQ ID NO: 5968400 - DNA, 21 bp, Homo sapiens
gccaacaagaccgccccaggg

SEQ ID NO: 5968401 - DNA, 17 bp, Homo sapiens
gccaacacgcacctgcc

SEQ ID NO: 5968402 - DNA, 20 bp, Homo sapiens
gccaacacgcacctgcctca

SEQ ID NO: 5968403 - DNA, 16 bp, Homo sapiens
gccaacactcaagaag

SEQ ID NO: 5968404 - DNA, 20 bp, Homo sapiens
gccaacactcaagaagcagg

SEQ ID NO: 5968405 - DNA, 15 bp, Homo sapiens
gccaacactgtgggt

SEQ ID NO: 5968406 - DNA, 13 bp, Homo sapiens
gccaacagccccc

SEQ ID NO: 5968407 - DNA, 22 bp, Homo sapiens
gccaacaggtggcaggaccagg

SEQ ID NO: 5968408 - DNA, 13 bp, Homo sapiens
gccaacagttgta

SEQ ID NO: 5968409 - DNA, 22 bp, Homo sapiens
gccaacatacccttctttaaat

SEQ ID NO: 5968410 - DNA, 22 bp, Homo sapiens
gccaacatcgtgaaaccctgtc

SEQ ID NO: 5968411 - DNA, 16 bp, Homo sapiens
gccaacatgaggacag

SEQ ID NO: 5968412 - DNA, 18 bp, Homo sapiens
gccaacatgaggacagaa

SEQ ID NO: 5968413 - DNA, 22 bp, Homo sapiens
gccaacatgaggacagaaggac

SEQ ID NO: 5968414 - DNA, 15 bp, Homo sapiens
gccaaccaagagcac

SEQ ID NO: 5968415 - DNA, 18 bp, Homo sapiens
gccaaccacctctggccc

SEQ ID NO: 5968416 - DNA, 13 bp, Homo sapiens
gccaaccagcctt

SEQ ID NO: 5968417 - DNA, 15 bp, Homo sapiens
gccaaccagcttgtc

SEQ ID NO: 5968418 - DNA, 13 bp, Homo sapiens
gccaaccaggacc

SEQ ID NO: 5968419 - DNA, 18 bp, Homo sapiens
gccaaccaggacccaggg

SEQ ID NO: 5968420 - DNA, 18 bp, Homo sapiens
gccaaccaggctacagtt

SEQ ID NO: 5968421 - DNA, 23 bp, Homo sapiens
gccaaccatcatgtgtagagccc

SEQ ID NO: 5968422 - DNA, 20 bp, Homo sapiens
gccaaccccacccagctcca

SEQ ID NO: 5968423 - DNA, 17 bp, Homo sapiens
gccaaccccagcagtcc

SEQ ID NO: 5968424 - DNA, 21 bp, Homo sapiens
gccaaccccagcagtcctggg

SEQ ID NO: 5968425 - DNA, 18 bp, Homo sapiens
gccaaccccatcctcaca

SEQ ID NO: 5968426 - DNA, 23 bp, Homo sapiens
gccaaccccgccctaggcctggc

SEQ ID NO: 5968427 - DNA, 20 bp, Homo sapiens
gccaaccctgcctgccgctg

SEQ ID NO: 5968428 - DNA, 23 bp, Homo sapiens
gccaaccctgcctgccgctgcac

SEQ ID NO: 5968429 - DNA, 22 bp, Homo sapiens
gccaaccctggaaaaggagttc

SEQ ID NO: 5968430 - DNA, 14 bp, Homo sapiens
gccaaccctgggct

SEQ ID NO: 5968431 - DNA, 22 bp, Homo sapiens
gccaacccttctcctcttgtaa

SEQ ID NO: 5968432 - DNA, 19 bp, Homo sapiens
gccaaccgcatctgctcat

SEQ ID NO: 5968433 - DNA, 15 bp, Homo sapiens
gccaacctattttga

SEQ ID NO: 5968434 - DNA, 17 bp, Homo sapiens
gccaacctcaggctcct

SEQ ID NO: 5968435 - DNA, 21 bp, Homo sapiens
gccaacctcaggctcctaaag

SEQ ID NO: 5968436 - DNA, 15 bp, Homo sapiens
gccaacctcgctcca

SEQ ID NO: 5968437 - DNA, 21 bp, Homo sapiens
gccaacctcggcttgtgggct

SEQ ID NO: 5968438 - DNA, 20 bp, Homo sapiens
gccaacctggacttcctgtc

SEQ ID NO: 5968439 - DNA, 16 bp, Homo sapiens
gccaacctgtaataaa

SEQ ID NO: 5968440 - DNA, 19 bp, Homo sapiens
gccaaccttcaaagaaact

SEQ ID NO: 5968441 - DNA, 14 bp, Homo sapiens
ggcagcgccactgt

SEQ ID NO: 5968442 - DNA, 22 bp, Homo sapiens
ggcagcgcccagcctggcccca

SEQ ID NO: 5968443 - DNA, 23 bp, Homo sapiens
ggcagcgcccagcctggccccaa

SEQ ID NO: 5968444 - DNA, 20 bp, Homo sapiens
ggcagcgcccttcctctcca

SEQ ID NO: 5968445 - DNA, 20 bp, Homo sapiens
ggcagcgcctcccgccgcct

SEQ ID NO: 5968446 - DNA, 21 bp, Homo sapiens
ggcagcgcctcccgccgcctc

SEQ ID NO: 5968447 - DNA, 22 bp, Homo sapiens
ggcagcgcctcccgccgcctcg

SEQ ID NO: 5968448 - DNA, 16 bp, Homo sapiens
ggcagcgcctcgcccc

SEQ ID NO: 5968449 - DNA, 23 bp, Homo sapiens
ggcagcgcctcgccccagccaag

SEQ ID NO: 5968450 - DNA, 19 bp, Homo sapiens
ggcagcgcctgtcccctca

SEQ ID NO: 5968451 - DNA, 21 bp, Homo sapiens
ggcagcgcctgtcccctcaca

SEQ ID NO: 5968452 - DNA, 15 bp, Homo sapiens
ggcagcggccccgca

SEQ ID NO: 5968453 - DNA, 16 bp, Homo sapiens
ggcagcggccccgcac

SEQ ID NO: 5968454 - DNA, 21 bp, Homo sapiens
ggcagcggccccgcacccctc

SEQ ID NO: 5968455 - DNA, 13 bp, Homo sapiens
ggcagcgggccag

SEQ ID NO: 5968456 - DNA, 18 bp, Homo sapiens
ggcagcggggctggccat

SEQ ID NO: 5968457 - DNA, 18 bp, Homo sapiens
ggcagcgtgccgagccag

SEQ ID NO: 5968458 - DNA, 19 bp, Homo sapiens
ggcagcgtgccgagccagc

SEQ ID NO: 5968459 - DNA, 22 bp, Homo sapiens
ggcagctaaaagcatccctgtg

SEQ ID NO: 5968460 - DNA, 23 bp, Homo sapiens
ggcagctaaaagcatccctgtga

SEQ ID NO: 5968461 - DNA, 21 bp, Homo sapiens
ggcagctaagatagaaagctg

SEQ ID NO: 5968462 - DNA, 14 bp, Homo sapiens
ggcagctagactgg

SEQ ID NO: 5968463 - DNA, 18 bp, Homo sapiens
ggcagctagactggagtg

SEQ ID NO: 5968464 - DNA, 15 bp, Homo sapiens
ggcagctaggcaggg

SEQ ID NO: 5968465 - DNA, 16 bp, Homo sapiens
ggcagctaggcaggga

SEQ ID NO: 5968466 - DNA, 16 bp, Homo sapiens
ggcagctagtgccttt

SEQ ID NO: 5968467 - DNA, 17 bp, Homo sapiens
ggcagctatttcagcct

SEQ ID NO: 5968468 - DNA, 20 bp, Homo sapiens
ggcagctatttcagcctcct

SEQ ID NO: 5968469 - DNA, 14 bp, Homo sapiens
ggcagctcacccct

SEQ ID NO: 5968470 - DNA, 21 bp, Homo sapiens
ggcagctcacccctgggcagg

SEQ ID NO: 5968471 - DNA, 21 bp, Homo sapiens
ggcagctcacctctcccttgg

SEQ ID NO: 5968472 - DNA, 12 bp, Homo sapiens
ggcagctcagct

SEQ ID NO: 5968473 - DNA, 15 bp, Homo sapiens
ggcagctcaggatag

SEQ ID NO: 5968474 - DNA, 23 bp, Homo sapiens
ggcagctcatagagtcccccctc

SEQ ID NO: 5968475 - DNA, 15 bp, Homo sapiens
ggcagctcatctctg

SEQ ID NO: 5968476 - DNA, 18 bp, Homo sapiens
ggcagctccaacagcttg

SEQ ID NO: 5968477 - DNA, 22 bp, Homo sapiens
ggcagctccaacagcttgacca

SEQ ID NO: 5968478 - DNA, 14 bp, Homo sapiens
ggcagctccagctg

SEQ ID NO: 5968479 - DNA, 23 bp, Homo sapiens
ggcagctccagctgttacctgag

SEQ ID NO: 5968480 - DNA, 13 bp, Homo sapiens
ggcagctccctcc

SEQ ID NO: 5968481 - DNA, 18 bp, Homo sapiens
ggcagctcctccctgtgc

SEQ ID NO: 5968482 - DNA, 19 bp, Homo sapiens
ggcagctcctctccttggg

SEQ ID NO: 5968483 - DNA, 13 bp, Homo sapiens
ggcagctcctgac

SEQ ID NO: 5968484 - DNA, 14 bp, Homo sapiens
ggcagctcctgacc

SEQ ID NO: 5968485 - DNA, 17 bp, Homo sapiens
ggcagctcctgaccaaa

SEQ ID NO: 5968486 - DNA, 18 bp, Homo sapiens
ggcagctcctgaccaaag

SEQ ID NO: 5968487 - DNA, 13 bp, Homo sapiens
ggcagctcgagca

SEQ ID NO: 5968488 - DNA, 11 bp, Homo sapiens
ggcagctctcc

SEQ ID NO: 5968489 - DNA, 13 bp, Homo sapiens
ggcagctctccag

SEQ ID NO: 5968490 - DNA, 16 bp, Homo sapiens
ggcagctctgagccgc

SEQ ID NO: 5968491 - DNA, 15 bp, Homo sapiens
ggcagctctggacag

SEQ ID NO: 5968492 - DNA, 12 bp, Homo sapiens
ggcagctcttct

SEQ ID NO: 5968493 - DNA, 15 bp, Homo sapiens
ggcagctcttctgga

SEQ ID NO: 5968494 - DNA, 20 bp, Homo sapiens
ggcagctgagaccagggtct

SEQ ID NO: 5968495 - DNA, 18 bp, Homo sapiens
ggcagctgagagccctgc

SEQ ID NO: 5968496 - DNA, 22 bp, Homo sapiens
ggcagctgagagccctgctgtg

SEQ ID NO: 5968497 - DNA, 15 bp, Homo sapiens
ggcagctgccagaga

SEQ ID NO: 5968498 - DNA, 18 bp, Homo sapiens
ggcagctgcccctcctgg

SEQ ID NO: 5968499 - DNA, 19 bp, Homo sapiens
ggcagctgcccctcctgga

SEQ ID NO: 5968500 - DNA, 21 bp, Homo sapiens
ggcagctgcctcccctcctct

SEQ ID NO: 5968501 - DNA, 13 bp, Homo sapiens
ggcagctgcctct

SEQ ID NO: 5968502 - DNA, 19 bp, Homo sapiens
ggcagctgcctctgctccc

SEQ ID NO: 5968503 - DNA, 21 bp, Homo sapiens
ggcagctgcctggccatgctg

SEQ ID NO: 5968504 - DNA, 24 bp, Homo sapiens
ggcagctgcggtccacccaggagc

SEQ ID NO: 5968505 - DNA, 22 bp, Homo sapiens
ggcagctgctatttattttcct

SEQ ID NO: 5968506 - DNA, 15 bp, Homo sapiens
ggcagctgctcttag

SEQ ID NO: 5968507 - DNA, 11 bp, Homo sapiens
ggcagctgctg

SEQ ID NO: 5968508 - DNA, 21 bp, Homo sapiens
ggcagctgctggctgtgacaa

SEQ ID NO: 5968509 - DNA, 16 bp, Homo sapiens
ggcagctggatgagac

SEQ ID NO: 5968510 - DNA, 14 bp, Homo sapiens
ggcagctggcagga

SEQ ID NO: 5968511 - DNA, 15 bp, Homo sapiens
ggcagctggcaggag

SEQ ID NO: 5968512 - DNA, 18 bp, Homo sapiens
ggcagctggcaggagaga

SEQ ID NO: 5968513 - DNA, 12 bp, Homo sapiens
ggcagctggccc

SEQ ID NO: 5968514 - DNA, 16 bp, Homo sapiens
ggcagctggcccccag

SEQ ID NO: 5968515 - DNA, 20 bp, Homo sapiens
ggcagctggcccccagccct

SEQ ID NO: 5968516 - DNA, 21 bp, Homo sapiens
ggcagctggcccccagccctg

SEQ ID NO: 5968517 - DNA, 11 bp, Homo sapiens
ggcagctggct

SEQ ID NO: 5968518 - DNA, 12 bp, Homo sapiens
ggcagctggctc

SEQ ID NO: 5968519 - DNA, 14 bp, Homo sapiens
ggcagctggctctg

SEQ ID NO: 5968520 - DNA, 15 bp, Homo sapiens
ggcagctggctctga

SEQ ID NO: 5968521 - DNA, 14 bp, Homo sapiens
ggcagctgggccca

SEQ ID NO: 5968522 - DNA, 18 bp, Homo sapiens
ggcagctgggcccacagc

SEQ ID NO: 5968523 - DNA, 19 bp, Homo sapiens
ggcagctgggcccacagcc

SEQ ID NO: 5968524 - DNA, 20 bp, Homo sapiens
ggcagctgggccccacctac

SEQ ID NO: 5968525 - DNA, 21 bp, Homo sapiens
ggcagctgggccccacctact

SEQ ID NO: 5968526 - DNA, 13 bp, Homo sapiens
ggcagctggggcc

SEQ ID NO: 5968527 - DNA, 17 bp, Homo sapiens
ggcagctggggccggag

SEQ ID NO: 5968528 - DNA, 21 bp, Homo sapiens
ggcagctggggggctgtcctg

SEQ ID NO: 5968529 - DNA, 23 bp, Homo sapiens
ggcagctgtcatggaaaagccca

SEQ ID NO: 5968530 - DNA, 23 bp, Homo sapiens
ggcagctgtcctgtgatgtcagc

SEQ ID NO: 5968531 - DNA, 14 bp, Homo sapiens
ggcagctgtttctc

SEQ ID NO: 5968532 - DNA, 18 bp, Homo sapiens
ggcagctgtttctcatga

SEQ ID NO: 5968533 - DNA, 19 bp, Homo sapiens
ggcagctgtttctcatgaa

SEQ ID NO: 5968534 - DNA, 22 bp, Homo sapiens
ggcagctgtttctcatgaagct

SEQ ID NO: 5968535 - DNA, 21 bp, Homo sapiens
ggcagcttaacattgacttct

SEQ ID NO: 5968536 - DNA, 15 bp, Homo sapiens
ggcagcttagggccc

SEQ ID NO: 5968537 - DNA, 16 bp, Homo sapiens
ggcagcttcaagtgcc

SEQ ID NO: 5968538 - DNA, 20 bp, Homo sapiens
ggcagcttcagtctctgcag

SEQ ID NO: 5968539 - DNA, 21 bp, Homo sapiens
ggcagcttccctgaacactca

SEQ ID NO: 5968540 - DNA, 22 bp, Homo sapiens
ggcagcttctgccccctgcaga

SEQ ID NO: 5968541 - DNA, 23 bp, Homo sapiens
ggcagcttctgccccctgcagaa

SEQ ID NO: 5968542 - DNA, 22 bp, Homo sapiens
ggcagcttctgttggcagagct

SEQ ID NO: 5968543 - DNA, 20 bp, Homo sapiens
gcctctcattccagaggaag

SEQ ID NO: 5968544 - DNA, 22 bp, Homo sapiens
gcctctccaaccactgtgccac

SEQ ID NO: 5968545 - DNA, 23 bp, Homo sapiens
gcctctccaggcaccatctccct

SEQ ID NO: 5968546 - DNA, 21 bp, Homo sapiens
gcctctccagtttgcacctgt

SEQ ID NO: 5968547 - DNA, 10 bp, Homo sapiens
gcctctccca

SEQ ID NO: 5968548 - DNA, 12 bp, Homo sapiens
gcctctcccacc

SEQ ID NO: 5968549 - DNA, 22 bp, Homo sapiens
gcctctcccacccggccacagc

SEQ ID NO: 5968550 - DNA, 13 bp, Homo sapiens
gcctctcccaggc

SEQ ID NO: 5968551 - DNA, 17 bp, Homo sapiens
gcctctcccaggcaggg

SEQ ID NO: 5968552 - DNA, 14 bp, Homo sapiens
gcctctccccagga

SEQ ID NO: 5968553 - DNA, 18 bp, Homo sapiens
gcctctccccgctctgga

SEQ ID NO: 5968554 - DNA, 13 bp, Homo sapiens
gcctctcccggct

SEQ ID NO: 5968555 - DNA, 16 bp, Homo sapiens
gcctctcccggctgcc

SEQ ID NO: 5968556 - DNA, 19 bp, Homo sapiens
gcctctcccgtcagggccc

SEQ ID NO: 5968557 - DNA, 14 bp, Homo sapiens
gcctctccctcctc

SEQ ID NO: 5968558 - DNA, 22 bp, Homo sapiens
gcctctccctcctccaggaagc

SEQ ID NO: 5968559 - DNA, 20 bp, Homo sapiens
gcctctccctctggtcccac

SEQ ID NO: 5968560 - DNA, 12 bp, Homo sapiens
gcctctccctgc

SEQ ID NO: 5968561 - DNA, 15 bp, Homo sapiens
gcctctccctgcctg

SEQ ID NO: 5968562 - DNA, 18 bp, Homo sapiens
gcctctccctgcctgtgg

SEQ ID NO: 5968563 - DNA, 21 bp, Homo sapiens
gcctctccctgctgctcctag

SEQ ID NO: 5968564 - DNA, 15 bp, Homo sapiens
gcctctccctggccc

SEQ ID NO: 5968565 - DNA, 19 bp, Homo sapiens
gcctctccctgggtctggg

SEQ ID NO: 5968566 - DNA, 21 bp, Homo sapiens
gcctctccgcccctgagccca

SEQ ID NO: 5968567 - DNA, 22 bp, Homo sapiens
gcctctccgcccctgagcccac

SEQ ID NO: 5968568 - DNA, 12 bp, Homo sapiens
gcctctcctcct

SEQ ID NO: 5968569 - DNA, 23 bp, Homo sapiens
gcctctcctccttgggcagggtc

SEQ ID NO: 5968570 - DNA, 16 bp, Homo sapiens
gcctctcctgccctct

SEQ ID NO: 5968571 - DNA, 17 bp, Homo sapiens
gcctctcctgccctctg

SEQ ID NO: 5968572 - DNA, 19 bp, Homo sapiens
gcctctcctgccctctgct

SEQ ID NO: 5968573 - DNA, 22 bp, Homo sapiens
gcctctccttgtggcctgggcc

SEQ ID NO: 5968574 - DNA, 15 bp, Homo sapiens
gcctctcctttgtag

SEQ ID NO: 5968575 - DNA, 16 bp, Homo sapiens
gcctctcctttgtata

SEQ ID NO: 5968576 - DNA, 23 bp, Homo sapiens
gcctctcctttgtatattatttc

SEQ ID NO: 5968577 - DNA, 19 bp, Homo sapiens
gcctctccttttctccact

SEQ ID NO: 5968578 - DNA, 22 bp, Homo sapiens
gcctctcgctcctcaacccctc

SEQ ID NO: 5968579 - DNA, 22 bp, Homo sapiens
gcctctcggttgaaacctgtat

SEQ ID NO: 5968580 - DNA, 14 bp, Homo sapiens
gcctctctcaggcc

SEQ ID NO: 5968581 - DNA, 16 bp, Homo sapiens
gcctctctcaggccaa

SEQ ID NO: 5968582 - DNA, 13 bp, Homo sapiens
gcctctctccact

SEQ ID NO: 5968583 - DNA, 19 bp, Homo sapiens
gcctctctccactaccccg

SEQ ID NO: 5968584 - DNA, 12 bp, Homo sapiens
gcctctctccca

SEQ ID NO: 5968585 - DNA, 13 bp, Homo sapiens
gcctctctcccag

SEQ ID NO: 5968586 - DNA, 15 bp, Homo sapiens
gcctctctcccagtc

SEQ ID NO: 5968587 - DNA, 14 bp, Homo sapiens
gcctctctctccct

SEQ ID NO: 5968588 - DNA, 20 bp, Homo sapiens
gcctctctctctctcctcag

SEQ ID NO: 5968589 - DNA, 21 bp, Homo sapiens
gcctctctctctctcctcagg

SEQ ID NO: 5968590 - DNA, 16 bp, Homo sapiens
gcctctctctgcctga

SEQ ID NO: 5968591 - DNA, 16 bp, Homo sapiens
gcctctctctgctcca

SEQ ID NO: 5968592 - DNA, 18 bp, Homo sapiens
gcctctctgcaggtccct

SEQ ID NO: 5968593 - DNA, 22 bp, Homo sapiens
gcctctctgccccacccaagcc

SEQ ID NO: 5968594 - DNA, 13 bp, Homo sapiens
gcctctctgctcc

SEQ ID NO: 5968595 - DNA, 15 bp, Homo sapiens
gcctctctgctccag

SEQ ID NO: 5968596 - DNA, 10 bp, Homo sapiens
gcctctctgg

SEQ ID NO: 5968597 - DNA, 17 bp, Homo sapiens
gcctctctggaaagagg

SEQ ID NO: 5968598 - DNA, 21 bp, Homo sapiens
gcctctctggaaagaggctct

SEQ ID NO: 5968599 - DNA, 19 bp, Homo sapiens
gcctctctggaagagggag

SEQ ID NO: 5968600 - DNA, 12 bp, Homo sapiens
gcctctctggcc

SEQ ID NO: 5968601 - DNA, 15 bp, Homo sapiens
gcctctctggcctcc

SEQ ID NO: 5968602 - DNA, 16 bp, Homo sapiens
gcctctctggcctccc

SEQ ID NO: 5968603 - DNA, 22 bp, Homo sapiens
gcctctctggctcagcccggga

SEQ ID NO: 5968604 - DNA, 18 bp, Homo sapiens
gcctctctggctggtctt

SEQ ID NO: 5968605 - DNA, 12 bp, Homo sapiens
gcctctctgggg

SEQ ID NO: 5968606 - DNA, 16 bp, Homo sapiens
gcctctcttcactgct

SEQ ID NO: 5968607 - DNA, 21 bp, Homo sapiens
gcctctcttcctatcccatcc

SEQ ID NO: 5968608 - DNA, 14 bp, Homo sapiens
gcctctcttgcccc

SEQ ID NO: 5968609 - DNA, 18 bp, Homo sapiens
gcctctcttggaccctgg

SEQ ID NO: 5968610 - DNA, 16 bp, Homo sapiens
gcctctcttttccccg

SEQ ID NO: 5968611 - DNA, 15 bp, Homo sapiens
gcctctgaaaatatt

SEQ ID NO: 5968612 - DNA, 16 bp, Homo sapiens
gcctctgacacacagc

SEQ ID NO: 5968613 - DNA, 18 bp, Homo sapiens
gcctctgacacacagctc

SEQ ID NO: 5968614 - DNA, 20 bp, Homo sapiens
gcctctgacagcagcctgtg

SEQ ID NO: 5968615 - DNA, 22 bp, Homo sapiens
gcctctgacagcagcctgtgag

SEQ ID NO: 5968616 - DNA, 23 bp, Homo sapiens
gcctctgacagcagcctgtgagg

SEQ ID NO: 5968617 - DNA, 18 bp, Homo sapiens
gcctctgacagtccacag

SEQ ID NO: 5968618 - DNA, 15 bp, Homo sapiens
ggcaggtctgggcca

SEQ ID NO: 5968619 - DNA, 16 bp, Homo sapiens
ggcaggtctgggccag

SEQ ID NO: 5968620 - DNA, 16 bp, Homo sapiens
ggcaggtgacagtgag

SEQ ID NO: 5968621 - DNA, 17 bp, Homo sapiens
ggcaggtgacagtgagg

SEQ ID NO: 5968622 - DNA, 18 bp, Homo sapiens
ggcaggtgagaacccaga

SEQ ID NO: 5968623 - DNA, 21 bp, Homo sapiens
ggcaggtgccatgtctgggaa

SEQ ID NO: 5968624 - DNA, 14 bp, Homo sapiens
ggcaggtgcctcca

SEQ ID NO: 5968625 - DNA, 18 bp, Homo sapiens
ggcaggtgcctccaggtg

SEQ ID NO: 5968626 - DNA, 10 bp, Homo sapiens
ggcaggtgct

SEQ ID NO: 5968627 - DNA, 21 bp, Homo sapiens
ggcaggtgctggagcactggg

SEQ ID NO: 5968628 - DNA, 21 bp, Homo sapiens
ggcaggtggactgactgtgtt

SEQ ID NO: 5968629 - DNA, 20 bp, Homo sapiens
ggcaggtggatcacgaggtc

SEQ ID NO: 5968630 - DNA, 20 bp, Homo sapiens
ggcaggtggatcatgaggtc

SEQ ID NO: 5968631 - DNA, 11 bp, Homo sapiens
ggcaggtggcc

SEQ ID NO: 5968632 - DNA, 16 bp, Homo sapiens
ggcaggtgggagctga

SEQ ID NO: 5968633 - DNA, 18 bp, Homo sapiens
ggcaggtgggctgcctgc

SEQ ID NO: 5968634 - DNA, 13 bp, Homo sapiens
ggcaggtgggggt

SEQ ID NO: 5968635 - DNA, 19 bp, Homo sapiens
ggcaggtgggggtgggctg

SEQ ID NO: 5968636 - DNA, 17 bp, Homo sapiens
ggcaggtgggtggtaag

SEQ ID NO: 5968637 - DNA, 16 bp, Homo sapiens
ggcaggtgtcttggac

SEQ ID NO: 5968638 - DNA, 19 bp, Homo sapiens
ggcaggtgtgtgtggaccc

SEQ ID NO: 5968639 - DNA, 22 bp, Homo sapiens
ggcaggtgttgggacctgctgc

SEQ ID NO: 5968640 - DNA, 14 bp, Homo sapiens
ggcaggttcctggg

SEQ ID NO: 5968641 - DNA, 15 bp, Homo sapiens
ggcaggttcctgggg

SEQ ID NO: 5968642 - DNA, 17 bp, Homo sapiens
ggcaggttcctggggcc

SEQ ID NO: 5968643 - DNA, 22 bp, Homo sapiens
ggcaggttgatcacctgaggtc

SEQ ID NO: 5968644 - DNA, 19 bp, Homo sapiens
ggcaggttggatgggagtg

SEQ ID NO: 5968645 - DNA, 15 bp, Homo sapiens
ggcagtaaagagaaa

SEQ ID NO: 5968646 - DNA, 13 bp, Homo sapiens
ggcagtacctggg

SEQ ID NO: 5968647 - DNA, 23 bp, Homo sapiens
ggcagtacctgggcaagctggcg

SEQ ID NO: 5968648 - DNA, 23 bp, Homo sapiens
ggcagtactcctccctgggggcg

SEQ ID NO: 5968649 - DNA, 21 bp, Homo sapiens
ggcagtagaactccaggccct

SEQ ID NO: 5968650 - DNA, 13 bp, Homo sapiens
ggcagtagcagct

SEQ ID NO: 5968651 - DNA, 20 bp, Homo sapiens
ggcagtagcctcctcctggg

SEQ ID NO: 5968652 - DNA, 14 bp, Homo sapiens
ggcagtaggccggt

SEQ ID NO: 5968653 - DNA, 21 bp, Homo sapiens
ggcagtaggggaacctaggag

SEQ ID NO: 5968654 - DNA, 22 bp, Homo sapiens
ggcagtatcctgtttgaggaaa

SEQ ID NO: 5968655 - DNA, 13 bp, Homo sapiens
ggcagtatggcgg

SEQ ID NO: 5968656 - DNA, 14 bp, Homo sapiens
ggcagtattttctg

SEQ ID NO: 5968657 - DNA, 17 bp, Homo sapiens
ggcagtcaccacccagc

SEQ ID NO: 5968658 - DNA, 20 bp, Homo sapiens
ggcagtcaccacccagccct

SEQ ID NO: 5968659 - DNA, 15 bp, Homo sapiens
ggcagtcagtggagg

SEQ ID NO: 5968660 - DNA, 20 bp, Homo sapiens
ggcagtcattggctgtctcc

SEQ ID NO: 5968661 - DNA, 15 bp, Homo sapiens
ggcagtccagagctt

SEQ ID NO: 5968662 - DNA, 14 bp, Homo sapiens
ggcagtccagccag

SEQ ID NO: 5968663 - DNA, 15 bp, Homo sapiens
ggcagtccagccagc

SEQ ID NO: 5968664 - DNA, 16 bp, Homo sapiens
ggcagtccagccagct

SEQ ID NO: 5968665 - DNA, 15 bp, Homo sapiens
ggcagtccaggcctc

SEQ ID NO: 5968666 - DNA, 15 bp, Homo sapiens
ggcagtccatctagg

SEQ ID NO: 5968667 - DNA, 15 bp, Homo sapiens
ggcagtcctggaggc

SEQ ID NO: 5968668 - DNA, 17 bp, Homo sapiens
ggcagtcgcacacacat

SEQ ID NO: 5968669 - DNA, 15 bp, Homo sapiens
ggcagtcgctgcagg

SEQ ID NO: 5968670 - DNA, 19 bp, Homo sapiens
ggcagtcgggggctggcct

SEQ ID NO: 5968671 - DNA, 21 bp, Homo sapiens
ggcagtcgggggctggcctag

SEQ ID NO: 5968672 - DNA, 22 bp, Homo sapiens
ggcagtcgggggctggcctagg

SEQ ID NO: 5968673 - DNA, 22 bp, Homo sapiens
ggcagtcgtaagggttgcggcg

SEQ ID NO: 5968674 - DNA, 19 bp, Homo sapiens
ggcagtctccccttcctgg

SEQ ID NO: 5968675 - DNA, 14 bp, Homo sapiens
ggcagtctctctct

SEQ ID NO: 5968676 - DNA, 21 bp, Homo sapiens
ggcagtctgaacccttgtgct

SEQ ID NO: 5968677 - DNA, 15 bp, Homo sapiens
ggcagtctgctctgc

SEQ ID NO: 5968678 - DNA, 16 bp, Homo sapiens
ggcagtctgctctgct

SEQ ID NO: 5968679 - DNA, 17 bp, Homo sapiens
ggcagtctgctctgctg

SEQ ID NO: 5968680 - DNA, 23 bp, Homo sapiens
ggcagtgaacacactcagcagcc

SEQ ID NO: 5968681 - DNA, 24 bp, Homo sapiens
ggcagtgaacacactcagcagccc

SEQ ID NO: 5968682 - DNA, 18 bp, Homo sapiens
ggcagtgactccccagcc

SEQ ID NO: 5968683 - DNA, 19 bp, Homo sapiens
ggcagtgactccccagccc

SEQ ID NO: 5968684 - DNA, 13 bp, Homo sapiens
ggcagtgactggc

SEQ ID NO: 5968685 - DNA, 17 bp, Homo sapiens
ggcagtgactggcaggt

SEQ ID NO: 5968686 - DNA, 22 bp, Homo sapiens
ggcagtgagctatgagcccagc

SEQ ID NO: 5968687 - DNA, 16 bp, Homo sapiens
ggcagtgagggagggc

SEQ ID NO: 5968688 - DNA, 16 bp, Homo sapiens
ggcagtgagtgagcct

SEQ ID NO: 5968689 - DNA, 19 bp, Homo sapiens
ggcagtgagtgagcctggc

SEQ ID NO: 5968690 - DNA, 20 bp, Homo sapiens
ggcagtgagtgccatgcttt

SEQ ID NO: 5968691 - DNA, 21 bp, Homo sapiens
ggcagtgatggttgccaggac

SEQ ID NO: 5968692 - DNA, 14 bp, Homo sapiens
ggcagtgattctgt

SEQ ID NO: 5968693 - DNA, 17 bp, Homo sapiens
ggcagtgattctgtttg

SEQ ID NO: 5968694 - DNA, 16 bp, Homo sapiens
ggcagtgcacccccta

SEQ ID NO: 5968695 - DNA, 17 bp, Homo sapiens
ggcagtgcacgcggctt

SEQ ID NO: 5968696 - DNA, 15 bp, Homo sapiens
ggcagtgccacagcc

SEQ ID NO: 5968697 - DNA, 18 bp, Homo sapiens
ggcagtgccacagcctgc

SEQ ID NO: 5968698 - DNA, 21 bp, Homo sapiens
ggcagtgccacagcctgctgg

SEQ ID NO: 5968699 - DNA, 23 bp, Homo sapiens
ggcagtgccacagcctgctggca

SEQ ID NO: 5968700 - DNA, 15 bp, Homo sapiens
ggcagtgccagccaa

SEQ ID NO: 5968701 - DNA, 13 bp, Homo sapiens
ggcagtgccatgg

SEQ ID NO: 5968702 - DNA, 15 bp, Homo sapiens
ggcagtgcccaccat

SEQ ID NO: 5968703 - DNA, 22 bp, Homo sapiens
ggcagtgcccaccatgcacccc

SEQ ID NO: 5968704 - DNA, 12 bp, Homo sapiens
ggcagtgcccca

SEQ ID NO: 5968705 - DNA, 14 bp, Homo sapiens
ggcagtgccccagg

SEQ ID NO: 5968706 - DNA, 16 bp, Homo sapiens
ggcagtgccccaggga

SEQ ID NO: 5968707 - DNA, 18 bp, Homo sapiens
ggcagtgccccagggagt

SEQ ID NO: 5968708 - DNA, 14 bp, Homo sapiens
ggcagtgccctttg

SEQ ID NO: 5968709 - DNA, 21 bp, Homo sapiens
ggcagtgccctttgagatctg

SEQ ID NO: 5968710 - DNA, 18 bp, Homo sapiens
ggcagtgcctcctgggac

SEQ ID NO: 5968711 - DNA, 15 bp, Homo sapiens
ggcagtgctgaaggg

SEQ ID NO: 5968712 - DNA, 18 bp, Homo sapiens
ggcagtgctgaagggggc

SEQ ID NO: 5968713 - DNA, 18 bp, Homo sapiens
ggcagtgctgagggaccg

SEQ ID NO: 5968714 - DNA, 23 bp, Homo sapiens
ggcagtgctgatccggctgctcc

SEQ ID NO: 5968715 - DNA, 17 bp, Homo sapiens
ggcagtgcttggcccag

SEQ ID NO: 5968716 - DNA, 18 bp, Homo sapiens
ggcagtgcttggcccagg

SEQ ID NO: 5968717 - DNA, 22 bp, Homo sapiens
ggcagtgcttggcccaggagtt

SEQ ID NO: 5968718 - DNA, 16 bp, Homo sapiens
ggcagtggacgtgctg

SEQ ID NO: 5968719 - DNA, 11 bp, Homo sapiens
ggcagtggagg

SEQ ID NO: 5968720 - DNA, 19 bp, Homo sapiens
ggcagtggaggctgctgtg

SEQ ID NO: 5968721 - DNA, 23 bp, Homo sapiens
ggcagtggccaagcctgctgtgt

SEQ ID NO: 5968722 - DNA, 12 bp, Homo sapiens
ggcagtggccac

SEQ ID NO: 5968723 - DNA, 21 bp, Homo sapiens
ggcagtggcccctattgagaa

SEQ ID NO: 5968724 - DNA, 12 bp, Homo sapiens
ggcagtggcctg

SEQ ID NO: 5968725 - DNA, 22 bp, Homo sapiens
gcctgactcagctaatgtcaca

SEQ ID NO: 5968726 - DNA, 14 bp, Homo sapiens
gcctgactcccatg

SEQ ID NO: 5968727 - DNA, 14 bp, Homo sapiens
gcctgactccccca

SEQ ID NO: 5968728 - DNA, 23 bp, Homo sapiens
gcctgactcccccagtccccttc

SEQ ID NO: 5968729 - DNA, 17 bp, Homo sapiens
gcctgactcctgggtgg

SEQ ID NO: 5968730 - DNA, 16 bp, Homo sapiens
gcctgactctgtgctg

SEQ ID NO: 5968731 - DNA, 14 bp, Homo sapiens
gcctgactctgttg

SEQ ID NO: 5968732 - DNA, 12 bp, Homo sapiens
gcctgactgctc

SEQ ID NO: 5968733 - DNA, 17 bp, Homo sapiens
gcctgactgttgccccc

SEQ ID NO: 5968734 - DNA, 16 bp, Homo sapiens
gcctgacttcacatct

SEQ ID NO: 5968735 - DNA, 19 bp, Homo sapiens
gcctgacttctgctggcat

SEQ ID NO: 5968736 - DNA, 13 bp, Homo sapiens
gcctgacttgagc

SEQ ID NO: 5968737 - DNA, 17 bp, Homo sapiens
gcctgacttgagccact

SEQ ID NO: 5968738 - DNA, 21 bp, Homo sapiens
gcctgacttgagccactcctt

SEQ ID NO: 5968739 - DNA, 21 bp, Homo sapiens
gcctgactttggggacaccct

SEQ ID NO: 5968740 - DNA, 22 bp, Homo sapiens
gcctgactttggggacaccctc

SEQ ID NO: 5968741 - DNA, 12 bp, Homo sapiens
gcctgagaaaca

SEQ ID NO: 5968742 - DNA, 15 bp, Homo sapiens
gcctgagaaacacta

SEQ ID NO: 5968743 - DNA, 20 bp, Homo sapiens
gcctgagaagaagtggctgc

SEQ ID NO: 5968744 - DNA, 18 bp, Homo sapiens
gcctgagaagccccgaca

SEQ ID NO: 5968745 - DNA, 13 bp, Homo sapiens
gcctgagaatgac

SEQ ID NO: 5968746 - DNA, 20 bp, Homo sapiens
gcctgagaatgttaccagac

SEQ ID NO: 5968747 - DNA, 21 bp, Homo sapiens
gcctgagaatgttaccagact

SEQ ID NO: 5968748 - DNA, 12 bp, Homo sapiens
gcctgagacagc

SEQ ID NO: 5968749 - DNA, 15 bp, Homo sapiens
gcctgagacagcacc

SEQ ID NO: 5968750 - DNA, 17 bp, Homo sapiens
gcctgagacagcaccac

SEQ ID NO: 5968751 - DNA, 20 bp, Homo sapiens
gcctgagacagcaccactgc

SEQ ID NO: 5968752 - DNA, 22 bp, Homo sapiens
gcctgagacagcaccactgctg

SEQ ID NO: 5968753 - DNA, 23 bp, Homo sapiens
gcctgagaccagggtggccacac

SEQ ID NO: 5968754 - DNA, 21 bp, Homo sapiens
gcctgagaggagcgtgtccta

SEQ ID NO: 5968755 - DNA, 18 bp, Homo sapiens
gcctgagaggcaggcata

SEQ ID NO: 5968756 - DNA, 22 bp, Homo sapiens
gcctgagatacaaggcccagaa

SEQ ID NO: 5968757 - DNA, 23 bp, Homo sapiens
gcctgagatacaaggcccagaag

SEQ ID NO: 5968758 - DNA, 17 bp, Homo sapiens
gcctgagatgcaggtga

SEQ ID NO: 5968759 - DNA, 13 bp, Homo sapiens
gcctgagatgcct

SEQ ID NO: 5968760 - DNA, 20 bp, Homo sapiens
gcctgagatggatggacaga

SEQ ID NO: 5968761 - DNA, 12 bp, Homo sapiens
gcctgagattct

SEQ ID NO: 5968762 - DNA, 19 bp, Homo sapiens
gcctgagattctttaagga

SEQ ID NO: 5968763 - DNA, 22 bp, Homo sapiens
gcctgagatttcatctgctctc

SEQ ID NO: 5968764 - DNA, 22 bp, Homo sapiens
gcctgagcaacagagtgagacc

SEQ ID NO: 5968765 - DNA, 13 bp, Homo sapiens
gcctgagcaacat

SEQ ID NO: 5968766 - DNA, 20 bp, Homo sapiens
gcctgagcaacatctcggga

SEQ ID NO: 5968767 - DNA, 20 bp, Homo sapiens
gcctgagcaagacgccctct

SEQ ID NO: 5968768 - DNA, 19 bp, Homo sapiens
gcctgagcacctcccagcc

SEQ ID NO: 5968769 - DNA, 23 bp, Homo sapiens
gcctgagcacctcccagcccctg

SEQ ID NO: 5968770 - DNA, 14 bp, Homo sapiens
gcctgagcaggcag

SEQ ID NO: 5968771 - DNA, 19 bp, Homo sapiens
gcctgagcaggcaggggct

SEQ ID NO: 5968772 - DNA, 15 bp, Homo sapiens
gcctgagcccaggga

SEQ ID NO: 5968773 - DNA, 18 bp, Homo sapiens
gcctgagcccagggaggc

SEQ ID NO: 5968774 - DNA, 11 bp, Homo sapiens
gcctgagcccc

SEQ ID NO: 5968775 - DNA, 16 bp, Homo sapiens
gcctgagcctggccag

SEQ ID NO: 5968776 - DNA, 17 bp, Homo sapiens
gcctgagcctggccagc

SEQ ID NO: 5968777 - DNA, 22 bp, Homo sapiens
gcctgagcgctcctgccgcaga

SEQ ID NO: 5968778 - DNA, 18 bp, Homo sapiens
gcctgagcggaggctcgg

SEQ ID NO: 5968779 - DNA, 23 bp, Homo sapiens
gcctgagctcactcggcaccctg

SEQ ID NO: 5968780 - DNA, 17 bp, Homo sapiens
gcctgagctccaccctc

SEQ ID NO: 5968781 - DNA, 18 bp, Homo sapiens
gcctgagctccaccctcc

SEQ ID NO: 5968782 - DNA, 22 bp, Homo sapiens
gcctgagctccaccctcccctc

SEQ ID NO: 5968783 - DNA, 17 bp, Homo sapiens
gcctgagctcctgctgc

SEQ ID NO: 5968784 - DNA, 19 bp, Homo sapiens
gcctgagctcctgctgcgg

SEQ ID NO: 5968785 - DNA, 12 bp, Homo sapiens
gcctgagctgct

SEQ ID NO: 5968786 - DNA, 13 bp, Homo sapiens
gcctgagctgctt

SEQ ID NO: 5968787 - DNA, 22 bp, Homo sapiens
gcctgagctgcttcactaggga

SEQ ID NO: 5968788 - DNA, 12 bp, Homo sapiens
gcctgagctggg

SEQ ID NO: 5968789 - DNA, 10 bp, Homo sapiens
gcctgaggag

SEQ ID NO: 5968790 - DNA, 13 bp, Homo sapiens
gcctgaggagcag

SEQ ID NO: 5968791 - DNA, 19 bp, Homo sapiens
gcctgaggaggaggacaca

SEQ ID NO: 5968792 - DNA, 20 bp, Homo sapiens
gcctgaggatgagctggaag

SEQ ID NO: 5968793 - DNA, 15 bp, Homo sapiens
gcctgaggcaggaga

SEQ ID NO: 5968794 - DNA, 13 bp, Homo sapiens
gcctgaggccttc

SEQ ID NO: 5968795 - DNA, 18 bp, Homo sapiens
gcctgaggctcaagaggc

SEQ ID NO: 5968796 - DNA, 15 bp, Homo sapiens
caggaattctcaaga

SEQ ID NO: 5968797 - DNA, 23 bp, Homo sapiens
caggaattctcaagacctgagta

SEQ ID NO: 5968798 - DNA, 15 bp, Homo sapiens
caggaattctccctg

SEQ ID NO: 5968799 - DNA, 19 bp, Homo sapiens
caggaattctccctggcat

SEQ ID NO: 5968800 - DNA, 17 bp, Homo sapiens
caggaattgatacgttt

SEQ ID NO: 5968801 - DNA, 16 bp, Homo sapiens
caggaatttaagaatt

SEQ ID NO: 5968802 - DNA, 23 bp, Homo sapiens
caggaatttagaccttttccctg

SEQ ID NO: 5968803 - DNA, 17 bp, Homo sapiens
caggaatttcccaggac

SEQ ID NO: 5968804 - DNA, 20 bp, Homo sapiens
caggaatttgaagctgcagt

SEQ ID NO: 5968805 - DNA, 20 bp, Homo sapiens
caggaatttgggaccctgct

SEQ ID NO: 5968806 - DNA, 16 bp, Homo sapiens
caggacaaaggctgac

SEQ ID NO: 5968807 - DNA, 16 bp, Homo sapiens
caggacaaagggaggg

SEQ ID NO: 5968808 - DNA, 15 bp, Homo sapiens
caggacaacacagct

SEQ ID NO: 5968809 - DNA, 21 bp, Homo sapiens
caggacaacacttcattttca

SEQ ID NO: 5968810 - DNA, 18 bp, Homo sapiens
caggacaacgaggaagcc

SEQ ID NO: 5968811 - DNA, 16 bp, Homo sapiens
caggacaagctactta

SEQ ID NO: 5968812 - DNA, 22 bp, Homo sapiens
caggacaatgaaatactccagc

SEQ ID NO: 5968813 - DNA, 23 bp, Homo sapiens
caggacaatgaaatactccagca

SEQ ID NO: 5968814 - DNA, 24 bp, Homo sapiens
caggacaatgaaatactccagcac

SEQ ID NO: 5968815 - DNA, 17 bp, Homo sapiens
caggacaatgtctgaac

SEQ ID NO: 5968816 - DNA, 13 bp, Homo sapiens
caggacacactga

SEQ ID NO: 5968817 - DNA, 18 bp, Homo sapiens
caggacacaggcctgtgt

SEQ ID NO: 5968818 - DNA, 19 bp, Homo sapiens
caggacacaggcctgtgta

SEQ ID NO: 5968819 - DNA, 14 bp, Homo sapiens
caggacacatcaca

SEQ ID NO: 5968820 - DNA, 22 bp, Homo sapiens
caggacacatcccggcctcttc

SEQ ID NO: 5968821 - DNA, 19 bp, Homo sapiens
caggacaccacacccagcc

SEQ ID NO: 5968822 - DNA, 20 bp, Homo sapiens
caggacaccacacccagcct

SEQ ID NO: 5968823 - DNA, 21 bp, Homo sapiens
caggacaccacgattctccca

SEQ ID NO: 5968824 - DNA, 20 bp, Homo sapiens
caggacaccagtccaggtag

SEQ ID NO: 5968825 - DNA, 13 bp, Homo sapiens
caggacacctgcc

SEQ ID NO: 5968826 - DNA, 14 bp, Homo sapiens
caggacacctgccc

SEQ ID NO: 5968827 - DNA, 18 bp, Homo sapiens
caggacacctgccccagc

SEQ ID NO: 5968828 - DNA, 19 bp, Homo sapiens
caggacacctggccgcctc

SEQ ID NO: 5968829 - DNA, 18 bp, Homo sapiens
caggacactaccctgaga

SEQ ID NO: 5968830 - DNA, 13 bp, Homo sapiens
caggacactgcct

SEQ ID NO: 5968831 - DNA, 14 bp, Homo sapiens
caggacactgcctt

SEQ ID NO: 5968832 - DNA, 17 bp, Homo sapiens
caggacactgcctttgc

SEQ ID NO: 5968833 - DNA, 12 bp, Homo sapiens
caggacagagtt

SEQ ID NO: 5968834 - DNA, 14 bp, Homo sapiens
caggacagagttca

SEQ ID NO: 5968835 - DNA, 18 bp, Homo sapiens
caggacagagttcacagg

SEQ ID NO: 5968836 - DNA, 20 bp, Homo sapiens
caggacagagttcacaggag

SEQ ID NO: 5968837 - DNA, 21 bp, Homo sapiens
caggacagagttcacaggagg

SEQ ID NO: 5968838 - DNA, 22 bp, Homo sapiens
caggacagagttcacaggaggc

SEQ ID NO: 5968839 - DNA, 17 bp, Homo sapiens
caggacagatgccacac

SEQ ID NO: 5968840 - DNA, 13 bp, Homo sapiens
caggacagcacac

SEQ ID NO: 5968841 - DNA, 16 bp, Homo sapiens
caggacagcacacggt

SEQ ID NO: 5968842 - DNA, 18 bp, Homo sapiens
caggacagcacacggtga

SEQ ID NO: 5968843 - DNA, 15 bp, Homo sapiens
caggacagcatggtg

SEQ ID NO: 5968844 - DNA, 23 bp, Homo sapiens
caggacagcatggtgcatgccgc

SEQ ID NO: 5968845 - DNA, 17 bp, Homo sapiens
caggacagccagcagca

SEQ ID NO: 5968846 - DNA, 24 bp, Homo sapiens
caggacagcccttctttccacaga

SEQ ID NO: 5968847 - DNA, 14 bp, Homo sapiens
caggacagcgggaa

SEQ ID NO: 5968848 - DNA, 17 bp, Homo sapiens
caggacagcgggaaaaa

SEQ ID NO: 5968849 - DNA, 12 bp, Homo sapiens
caggacagctcc

SEQ ID NO: 5968850 - DNA, 12 bp, Homo sapiens
caggacagctgc

SEQ ID NO: 5968851 - DNA, 19 bp, Homo sapiens
caggacagctgcttctgtg

SEQ ID NO: 5968852 - DNA, 18 bp, Homo sapiens
caggacagctggctgctg

SEQ ID NO: 5968853 - DNA, 14 bp, Homo sapiens
caggacaggaaaaa

SEQ ID NO: 5968854 - DNA, 13 bp, Homo sapiens
caggacaggaaat

SEQ ID NO: 5968855 - DNA, 21 bp, Homo sapiens
caggacaggaggcggcccggc

SEQ ID NO: 5968856 - DNA, 21 bp, Homo sapiens
caggacaggggttccttctgg

SEQ ID NO: 5968857 - DNA, 17 bp, Homo sapiens
caggacagttgatggag

SEQ ID NO: 5968858 - DNA, 21 bp, Homo sapiens
caggacagttgatggagcccc

SEQ ID NO: 5968859 - DNA, 17 bp, Homo sapiens
caggacataggcacagg

SEQ ID NO: 5968860 - DNA, 13 bp, Homo sapiens
caggacatctcct

SEQ ID NO: 5968861 - DNA, 16 bp, Homo sapiens
caggacatctcctggc

SEQ ID NO: 5968862 - DNA, 16 bp, Homo sapiens
caggacatgatactga

SEQ ID NO: 5968863 - DNA, 18 bp, Homo sapiens
caggacatgcggtagcca

SEQ ID NO: 5968864 - DNA, 22 bp, Homo sapiens
caggacatgcggtagccagcac

SEQ ID NO: 5968865 - DNA, 17 bp, Homo sapiens
caggacatgtactgaga

SEQ ID NO: 5968866 - DNA, 17 bp, Homo sapiens
caggacatttacctctt

SEQ ID NO: 5968867 - DNA, 15 bp, Homo sapiens
caggaccaagccaca

SEQ ID NO: 5968868 - DNA, 21 bp, Homo sapiens
caggaccaagcttaaggagag

SEQ ID NO: 5968869 - DNA, 17 bp, Homo sapiens
caggaccaagggcagag

SEQ ID NO: 5968870 - DNA, 19 bp, Homo sapiens
caggaccaagggcagaggg

SEQ ID NO: 5968871 - DNA, 14 bp, Homo sapiens
caggaccaaggggg

SEQ ID NO: 5968872 - DNA, 22 bp, Homo sapiens
caggaccaagggggcggggact

SEQ ID NO: 5968873 - DNA, 17 bp, Homo sapiens
caggaccacaggctcag

SEQ ID NO: 5968874 - DNA, 18 bp, Homo sapiens
caggaccacaggctcagg

SEQ ID NO: 5968875 - DNA, 19 bp, Homo sapiens
caggaccacaggctcaggc

SEQ ID NO: 5968876 - DNA, 15 bp, Homo sapiens
caggaccaccctgcc

SEQ ID NO: 5968877 - DNA, 18 bp, Homo sapiens
caggaccaccctgccaag

SEQ ID NO: 5968878 - DNA, 24 bp, Homo sapiens
caggaccacctcctctgccagcag

SEQ ID NO: 5968879 - DNA, 23 bp, Homo sapiens
caggaccacctcgtcctcgtggc

SEQ ID NO: 5968880 - DNA, 23 bp, Homo sapiens
caggaccactagctaagcaagcc

SEQ ID NO: 5968881 - DNA, 13 bp, Homo sapiens
caggaccagaagg

SEQ ID NO: 5968882 - DNA, 17 bp, Homo sapiens
caggaccagagaaggga

SEQ ID NO: 5968883 - DNA, 13 bp, Homo sapiens
caggaccagatgt

SEQ ID NO: 5968884 - DNA, 21 bp, Homo sapiens
caggaccagcccacgctgact

SEQ ID NO: 5968885 - DNA, 13 bp, Homo sapiens
caggaccagctca

SEQ ID NO: 5968886 - DNA, 16 bp, Homo sapiens
caggaccagctcagga

SEQ ID NO: 5968887 - DNA, 16 bp, Homo sapiens
caggaccaggacccag

SEQ ID NO: 5968888 - DNA, 14 bp, Homo sapiens
caggaccaggagcc

SEQ ID NO: 5968889 - DNA, 18 bp, Homo sapiens
caggaccaggagccaggt

SEQ ID NO: 5968890 - DNA, 18 bp, Homo sapiens
caggaccaggcaatgtga

SEQ ID NO: 5968891 - DNA, 13 bp, Homo sapiens
caggaccaggggc

SEQ ID NO: 5968892 - DNA, 21 bp, Homo sapiens
caggaccagtcaacctgggca

SEQ ID NO: 5968893 - DNA, 12 bp, Homo sapiens
caggaccagttt

SEQ ID NO: 5968894 - DNA, 17 bp, Homo sapiens
caggaccatcctggagg

SEQ ID NO: 5968895 - DNA, 13 bp, Homo sapiens
caggaccatggcc

SEQ ID NO: 5968896 - DNA, 18 bp, Homo sapiens
caggaccattttagaaga

SEQ ID NO: 5968897 - DNA, 16 bp, Homo sapiens
caggacccaccactgg

SEQ ID NO: 5968898 - DNA, 12 bp, Homo sapiens
caggacccaggc

SEQ ID NO: 5968899 - DNA, 18 bp, Homo sapiens
caggacccaggccctcca

SEQ ID NO: 5968900 - DNA, 18 bp, Homo sapiens
caggacccagggtcccct

SEQ ID NO: 5968901 - DNA, 21 bp, Homo sapiens
caggacccatcacgcctgtgc

SEQ ID NO: 5968902 - DNA, 20 bp, Homo sapiens
caggacccatccctgcctgg

SEQ ID NO: 5968903 - DNA, 22 bp, Homo sapiens
caggacccatccctgcctggag

SEQ ID NO: 5968904 - DNA, 23 bp, Homo sapiens
caggacccatccctgcctggagg

SEQ ID NO: 5968905 - DNA, 21 bp, Homo sapiens
caggaccccagagggaccagc

SEQ ID NO: 5968906 - DNA, 18 bp, Homo sapiens
caggaccccagctctgcg

SEQ ID NO: 5968907 - DNA, 14 bp, Homo sapiens
caggaccccaggtc

SEQ ID NO: 5968908 - DNA, 16 bp, Homo sapiens
caggaccccaggtcag

SEQ ID NO: 5968909 - DNA, 18 bp, Homo sapiens
caggaccccaggtcaggg

SEQ ID NO: 5968910 - DNA, 12 bp, Homo sapiens
caggaccccatc

SEQ ID NO: 5968911 - DNA, 18 bp, Homo sapiens
caggaccccatctgctga

SEQ ID NO: 5968912 - DNA, 20 bp, Homo sapiens
caggacccccccagtccgcc

SEQ ID NO: 5968913 - DNA, 21 bp, Homo sapiens
caggacccccccagtccgccc

SEQ ID NO: 5968914 - DNA, 23 bp, Homo sapiens
caggacccccccagtccgccccg

SEQ ID NO: 5968915 - DNA, 14 bp, Homo sapiens
caggacccccgagg

SEQ ID NO: 5968916 - DNA, 12 bp, Homo sapiens
caggacccctgc

SEQ ID NO: 5968917 - DNA, 20 bp, Homo sapiens
caggacccctgcagttcccc

SEQ ID NO: 5968918 - DNA, 15 bp, Homo sapiens
caggacccgcctgct

SEQ ID NO: 5968919 - DNA, 20 bp, Homo sapiens
caggacccgcctgctcccat

SEQ ID NO: 5968920 - DNA, 17 bp, Homo sapiens
caggaccctcacctctc

SEQ ID NO: 5968921 - DNA, 20 bp, Homo sapiens
caggaccctcagccctggcc

SEQ ID NO: 5968922 - DNA, 15 bp, Homo sapiens
caggaccctcaggaa

SEQ ID NO: 5968923 - DNA, 21 bp, Homo sapiens
caggaccctccactcactgct

SEQ ID NO: 5968924 - DNA, 13 bp, Homo sapiens
caggaccctcgcc

SEQ ID NO: 5968925 - DNA, 13 bp, Homo sapiens
caggaccctgagg

SEQ ID NO: 5968926 - DNA, 18 bp, Homo sapiens
caggaccctgccaggcac

SEQ ID NO: 5968927 - DNA, 20 bp, Homo sapiens
caggaccctgccaggcacag

SEQ ID NO: 5968928 - DNA, 22 bp, Homo sapiens
caggaccctgccaggcacaggc

SEQ ID NO: 5968929 - DNA, 17 bp, Homo sapiens
caggaccctggacctga

SEQ ID NO: 5968930 - DNA, 19 bp, Homo sapiens
caggaccctgggtcacctt

SEQ ID NO: 5968931 - DNA, 15 bp, Homo sapiens
caggaccctgtcagg

SEQ ID NO: 5968932 - DNA, 20 bp, Homo sapiens
caggacctccaagccactga

SEQ ID NO: 5968933 - DNA, 18 bp, Homo sapiens
caggacctcgtgccaccc

SEQ ID NO: 5968934 - DNA, 14 bp, Homo sapiens
caggacctctgctt

SEQ ID NO: 5968935 - DNA, 19 bp, Homo sapiens
caggacctctgtaggcagc

SEQ ID NO: 5968936 - DNA, 16 bp, Homo sapiens
caggacctgagcctgg

SEQ ID NO: 5968937 - DNA, 15 bp, Homo sapiens
caggacctgccaaga

SEQ ID NO: 5968938 - DNA, 13 bp, Homo sapiens
caggacctgcctg

SEQ ID NO: 5968939 - DNA, 14 bp, Homo sapiens
caggacctggcatc

SEQ ID NO: 5968940 - DNA, 17 bp, Homo sapiens
caggacctggctgccat

SEQ ID NO: 5968941 - DNA, 15 bp, Homo sapiens
caggacctgggacag

SEQ ID NO: 5968942 - DNA, 17 bp, Homo sapiens
caggacctgtgctttga

SEQ ID NO: 5968943 - DNA, 17 bp, Homo sapiens
caggacctgtggccaag

SEQ ID NO: 5968944 - DNA, 14 bp, Homo sapiens
caggaccttccttc

SEQ ID NO: 5968945 - DNA, 21 bp, Homo sapiens
caggaccttcgggctgtgccc

SEQ ID NO: 5968946 - DNA, 13 bp, Homo sapiens
caggaccttgggc

SEQ ID NO: 5968947 - DNA, 14 bp, Homo sapiens
caggacgaatgcat

SEQ ID NO: 5968948 - DNA, 15 bp, Homo sapiens
caggacgaatgcata

SEQ ID NO: 5968949 - DNA, 23 bp, Homo sapiens
caggacgactgttttcccaacac

SEQ ID NO: 5968950 - DNA, 15 bp, Homo sapiens
caggacgcagggaga

SEQ ID NO: 5968951 - DNA, 17 bp, Homo sapiens
caggacgcatgcagggc

SEQ ID NO: 5968952 - DNA, 19 bp, Homo sapiens
caggacgcatgcagggccc

SEQ ID NO: 5968953 - DNA, 12 bp, Homo sapiens
caggacgccact

SEQ ID NO: 5968954 - DNA, 19 bp, Homo sapiens
caggacgccactcatttca

SEQ ID NO: 5968955 - DNA, 15 bp, Homo sapiens
caggacgcttctgaa

SEQ ID NO: 5968956 - DNA, 13 bp, Homo sapiens
caggacggctcct

SEQ ID NO: 5968957 - DNA, 16 bp, Homo sapiens
caggacggctcctcag

SEQ ID NO: 5968958 - DNA, 21 bp, Homo sapiens
caggacggctcctcagagcgc

SEQ ID NO: 5968959 - DNA, 16 bp, Homo sapiens
caggacgtccttccat

SEQ ID NO: 5968960 - DNA, 23 bp, Homo sapiens
caggacgtccttccatatccctg

SEQ ID NO: 5968961 - DNA, 17 bp, Homo sapiens
caggacgtgggctgggc

SEQ ID NO: 5968962 - DNA, 23 bp, Homo sapiens
caggacgttgctttttcactgtt

SEQ ID NO: 5968963 - DNA, 15 bp, Homo sapiens
caggactaacaactg

SEQ ID NO: 5968964 - DNA, 20 bp, Homo sapiens
caggactaacactcagaagc

SEQ ID NO: 5968965 - DNA, 16 bp, Homo sapiens
caggactatagcccag

SEQ ID NO: 5968966 - DNA, 18 bp, Homo sapiens
caggactcagaagcctct

SEQ ID NO: 5968967 - DNA, 20 bp, Homo sapiens
caggactcagaagcctctgg

SEQ ID NO: 5968968 - DNA, 22 bp, Homo sapiens
caggactccaaccaagaggatt

SEQ ID NO: 5968969 - DNA, 21 bp, Homo sapiens
caggactccactggacagacc

SEQ ID NO: 5968970 - DNA, 13 bp, Homo sapiens
caggactccagcc

SEQ ID NO: 5968971 - DNA, 17 bp, Homo sapiens
caggactccagcccatt

SEQ ID NO: 5968972 - DNA, 21 bp, Homo sapiens
caggactccaggcccaaggct

SEQ ID NO: 5968973 - DNA, 22 bp, Homo sapiens
caggagggcaggctgaggtggg

SEQ ID NO: 5968974 - DNA, 12 bp, Homo sapiens
caggagggcagt

SEQ ID NO: 5968975 - DNA, 23 bp, Homo sapiens
caggagggcatcagctttccctg

SEQ ID NO: 5968976 - DNA, 16 bp, Homo sapiens
caggagggcatccata

SEQ ID NO: 5968977 - DNA, 19 bp, Homo sapiens
caggagggccagcgctgtg

SEQ ID NO: 5968978 - DNA, 20 bp, Homo sapiens
caggagggctttgtgtctgg

SEQ ID NO: 5968979 - DNA, 19 bp, Homo sapiens
caggaggggaaaaaattaa

SEQ ID NO: 5968980 - DNA, 17 bp, Homo sapiens
caggaggggaactgagt

SEQ ID NO: 5968981 - DNA, 20 bp, Homo sapiens
caggaggggaactgagtcac

SEQ ID NO: 5968982 - DNA, 16 bp, Homo sapiens
caggaggggaagaggc

SEQ ID NO: 5968983 - DNA, 22 bp, Homo sapiens
caggaggggagtgaggcaggtg

SEQ ID NO: 5968984 - DNA, 19 bp, Homo sapiens
caggaggggcccacaatgg

SEQ ID NO: 5968985 - DNA, 21 bp, Homo sapiens
caggaggggcctgggcagccc

SEQ ID NO: 5968986 - DNA, 15 bp, Homo sapiens
caggaggggcttctg

SEQ ID NO: 5968987 - DNA, 20 bp, Homo sapiens
caggagggtcaccctggcct

SEQ ID NO: 5968988 - DNA, 16 bp, Homo sapiens
caggagggtccccagc

SEQ ID NO: 5968989 - DNA, 21 bp, Homo sapiens
caggagggtccccagctggtc

SEQ ID NO: 5968990 - DNA, 20 bp, Homo sapiens
caggagggtctatggggaga

SEQ ID NO: 5968991 - DNA, 22 bp, Homo sapiens
caggagggtctcgaactcctgg

SEQ ID NO: 5968992 - DNA, 22 bp, Homo sapiens
caggagggtgacgcccagctcc

SEQ ID NO: 5968993 - DNA, 17 bp, Homo sapiens
caggagggtgaggaggt

SEQ ID NO: 5968994 - DNA, 15 bp, Homo sapiens
caggagggttggagt

SEQ ID NO: 5968995 - DNA, 21 bp, Homo sapiens
caggaggtactgtgaggaaga

SEQ ID NO: 5968996 - DNA, 22 bp, Homo sapiens
caggaggtcaagatcagcctgg

SEQ ID NO: 5968997 - DNA, 15 bp, Homo sapiens
caggaggtcctcctc

SEQ ID NO: 5968998 - DNA, 17 bp, Homo sapiens
caggaggtgccactgga

SEQ ID NO: 5968999 - DNA, 15 bp, Homo sapiens
caggaggtgcctgag

SEQ ID NO: 5969000 - DNA, 16 bp, Homo sapiens
caggaggtgcctgaga

SEQ ID NO: 5969001 - DNA, 16 bp, Homo sapiens
caggaggtgcttgagg

SEQ ID NO: 5969002 - DNA, 17 bp, Homo sapiens
caggaggtgcttgaggc

SEQ ID NO: 5969003 - DNA, 19 bp, Homo sapiens
caggaggtgcttgaggccc

SEQ ID NO: 5969004 - DNA, 21 bp, Homo sapiens
caggaggtgcttgaggccccg

SEQ ID NO: 5969005 - DNA, 20 bp, Homo sapiens
caggaggtggaggttacagt

SEQ ID NO: 5969006 - DNA, 19 bp, Homo sapiens
caggaggtggaggttgcag

SEQ ID NO: 5969007 - DNA, 20 bp, Homo sapiens
caggaggtggaggttgcagt

SEQ ID NO: 5969008 - DNA, 19 bp, Homo sapiens
caggaggttcccccgacca

SEQ ID NO: 5969009 - DNA, 20 bp, Homo sapiens
caggaggttctgggcctctg

SEQ ID NO: 5969010 - DNA, 23 bp, Homo sapiens
caggaggttgtggatgctccagg

SEQ ID NO: 5969011 - DNA, 15 bp, Homo sapiens
caggagtaagcccaa

SEQ ID NO: 5969012 - DNA, 14 bp, Homo sapiens
caggagtagctgag

SEQ ID NO: 5969013 - DNA, 20 bp, Homo sapiens
caggagtagctgagctcaca

SEQ ID NO: 5969014 - DNA, 14 bp, Homo sapiens
caggagtagtctca

SEQ ID NO: 5969015 - DNA, 15 bp, Homo sapiens
caggagtagtgaaga

SEQ ID NO: 5969016 - DNA, 21 bp, Homo sapiens
caggagtcacagatgaggccc

SEQ ID NO: 5969017 - DNA, 22 bp, Homo sapiens
caggagtcacagatgaggcccc

SEQ ID NO: 5969018 - DNA, 17 bp, Homo sapiens
caggagtcaccatgcaa

SEQ ID NO: 5969019 - DNA, 18 bp, Homo sapiens
caggagtcaccatgcaag

SEQ ID NO: 5969020 - DNA, 13 bp, Homo sapiens
caggagtcagtgt

SEQ ID NO: 5969021 - DNA, 18 bp, Homo sapiens
caggagtcagtgtctggc

SEQ ID NO: 5969022 - DNA, 17 bp, Homo sapiens
caggagtccaaaccttc

SEQ ID NO: 5969023 - DNA, 23 bp, Homo sapiens
caggagtccaaaccttctaccct

SEQ ID NO: 5969024 - DNA, 18 bp, Homo sapiens
caggagtccactgcctcc

SEQ ID NO: 5969025 - DNA, 22 bp, Homo sapiens
caggagtccactgcctccatga

SEQ ID NO: 5969026 - DNA, 14 bp, Homo sapiens
caggagtccacttt

SEQ ID NO: 5969027 - DNA, 12 bp, Homo sapiens
caggagtccaga

SEQ ID NO: 5969028 - DNA, 14 bp, Homo sapiens
caggagtccagacc

SEQ ID NO: 5969029 - DNA, 15 bp, Homo sapiens
caggagtccagcccc

SEQ ID NO: 5969030 - DNA, 20 bp, Homo sapiens
caggagtccagcccctcctc

SEQ ID NO: 5969031 - DNA, 15 bp, Homo sapiens
caggagtcccaagga

SEQ ID NO: 5969032 - DNA, 15 bp, Homo sapiens
caggagtccctggta

SEQ ID NO: 5969033 - DNA, 16 bp, Homo sapiens
caggagtctctgccac

SEQ ID NO: 5969034 - DNA, 17 bp, Homo sapiens
caggagtctctgccacc

SEQ ID NO: 5969035 - DNA, 21 bp, Homo sapiens
caggagtctctgccacccact

SEQ ID NO: 5969036 - DNA, 22 bp, Homo sapiens
caggagtctctggtagcctgca

SEQ ID NO: 5969037 - DNA, 15 bp, Homo sapiens
caggagtctgtgctc

SEQ ID NO: 5969038 - DNA, 17 bp, Homo sapiens
caggagtctgtgctctt

SEQ ID NO: 5969039 - DNA, 22 bp, Homo sapiens
caggagtctttcaactgtttca

SEQ ID NO: 5969040 - DNA, 23 bp, Homo sapiens
caggagtctttgtaatgcttgta

SEQ ID NO: 5969041 - DNA, 15 bp, Homo sapiens
caggagtgactctgg

SEQ ID NO: 5969042 - DNA, 23 bp, Homo sapiens
caggagtgactctggctgccaag

SEQ ID NO: 5969043 - DNA, 12 bp, Homo sapiens
caggagtgagca

SEQ ID NO: 5969044 - DNA, 14 bp, Homo sapiens
caggagtgccagga

SEQ ID NO: 5969045 - DNA, 15 bp, Homo sapiens
caggagtgccaggac

SEQ ID NO: 5969046 - DNA, 16 bp, Homo sapiens
caggagtgccaggacc

SEQ ID NO: 5969047 - DNA, 18 bp, Homo sapiens
caggagtgccaggaccag

SEQ ID NO: 5969048 - DNA, 19 bp, Homo sapiens
caggagtgccaggaccagc

SEQ ID NO: 5969049 - DNA, 22 bp, Homo sapiens
caggagtgggaaaacactgcca

SEQ ID NO: 5969050 - DNA, 14 bp, Homo sapiens
caggagtggggaga

SEQ ID NO: 5969051 - DNA, 17 bp, Homo sapiens
caggagtgggtgggaca

SEQ ID NO: 5969052 - DNA, 24 bp, Homo sapiens
caggagtgggtgggacacagagac

SEQ ID NO: 5969053 - DNA, 16 bp, Homo sapiens
caggagtgggtgggga

SEQ ID NO: 5969054 - DNA, 18 bp, Homo sapiens
caggagtgggtggggagt

SEQ ID NO: 5969055 - DNA, 17 bp, Homo sapiens
caggagtgggttgattt

SEQ ID NO: 5969056 - DNA, 22 bp, Homo sapiens
caggagtgggtttccctgcgtc

SEQ ID NO: 5969057 - DNA, 24 bp, Homo sapiens
caggagtggtgcagacagaagtct

SEQ ID NO: 5969058 - DNA, 19 bp, Homo sapiens
caggagtgtcctcttccct

SEQ ID NO: 5969059 - DNA, 14 bp, Homo sapiens
caggagtgtcctgc

SEQ ID NO: 5969060 - DNA, 18 bp, Homo sapiens
caggagtgtcctggctgt

SEQ ID NO: 5969061 - DNA, 13 bp, Homo sapiens
caggagtgtgtgt

SEQ ID NO: 5969062 - DNA, 17 bp, Homo sapiens
caggagttagaggccag

SEQ ID NO: 5969063 - DNA, 14 bp, Homo sapiens
caggagttcaagac

SEQ ID NO: 5969064 - DNA, 19 bp, Homo sapiens
caggagttcaagaccagcc

SEQ ID NO: 5969065 - DNA, 20 bp, Homo sapiens
caggagttcaagaccagcct

SEQ ID NO: 5969066 - DNA, 21 bp, Homo sapiens
caggagttcaagactagcctg

SEQ ID NO: 5969067 - DNA, 19 bp, Homo sapiens
caggagttcccaaatgtga

SEQ ID NO: 5969068 - DNA, 13 bp, Homo sapiens
caggagttccttt

SEQ ID NO: 5969069 - DNA, 14 bp, Homo sapiens
caggagttcctttc

SEQ ID NO: 5969070 - DNA, 19 bp, Homo sapiens
caggagttcgagaccagcc

SEQ ID NO: 5969071 - DNA, 20 bp, Homo sapiens
caggagttcgagaccagcct

SEQ ID NO: 5969072 - DNA, 21 bp, Homo sapiens
caggagttcgagaccagcctg

SEQ ID NO: 5969073 - DNA, 16 bp, Homo sapiens
caggagttcgaggcga

SEQ ID NO: 5969074 - DNA, 22 bp, Homo sapiens
caggagttcgaggcgagcctgg

SEQ ID NO: 5969075 - DNA, 14 bp, Homo sapiens
caggagttctgctc

SEQ ID NO: 5969076 - DNA, 21 bp, Homo sapiens
caggagttggagaccaggcct

SEQ ID NO: 5969077 - DNA, 15 bp, Homo sapiens
caggagttggagtta

SEQ ID NO: 5969078 - DNA, 16 bp, Homo sapiens
caggagttgtgagccc

SEQ ID NO: 5969079 - DNA, 14 bp, Homo sapiens
caggagttgtgtct

SEQ ID NO: 5969080 - DNA, 23 bp, Homo sapiens
caggagtttatctatcggaagaa

SEQ ID NO: 5969081 - DNA, 11 bp, Homo sapiens
caggagtttca

SEQ ID NO: 5969082 - DNA, 20 bp, Homo sapiens
caggagtttgagacaagccc

SEQ ID NO: 5969083 - DNA, 24 bp, Homo sapiens
caggagtttgagacaagccctggc

SEQ ID NO: 5969084 - DNA, 22 bp, Homo sapiens
caggagtttgagaccaacctgg

SEQ ID NO: 5969085 - DNA, 20 bp, Homo sapiens
caggagtttgagaccaggct

SEQ ID NO: 5969086 - DNA, 23 bp, Homo sapiens
caggagtttgagaccaggctggg

SEQ ID NO: 5969087 - DNA, 19 bp, Homo sapiens
caggagtttgaggctgcaa

SEQ ID NO: 5969088 - DNA, 20 bp, Homo sapiens
caggagtttgaggctgcagc

SEQ ID NO: 5969089 - DNA, 21 bp, Homo sapiens
caggagtttgaggctgcagcg

SEQ ID NO: 5969090 - DNA, 22 bp, Homo sapiens
caggagtttgaggctgcagcga

SEQ ID NO: 5969091 - DNA, 14 bp, Homo sapiens
caggagtttggcca

SEQ ID NO: 5969092 - DNA, 15 bp, Homo sapiens
caggagtttggccag

SEQ ID NO: 5969093 - DNA, 17 bp, Homo sapiens
caggagtttggccagaa

SEQ ID NO: 5969094 - DNA, 18 bp, Homo sapiens
caggataaactgaaaact

SEQ ID NO: 5969095 - DNA, 23 bp, Homo sapiens
caggataagaaagcctaaaattg

SEQ ID NO: 5969096 - DNA, 18 bp, Homo sapiens
caggataataaagtgttt

SEQ ID NO: 5969097 - DNA, 19 bp, Homo sapiens
caggataatatatttgcag

SEQ ID NO: 5969098 - DNA, 19 bp, Homo sapiens
caggatactcaaagtggaa

SEQ ID NO: 5969099 - DNA, 17 bp, Homo sapiens
caggatactctgtcaga

SEQ ID NO: 5969100 - DNA, 18 bp, Homo sapiens
caggatactctgtcagat

SEQ ID NO: 5969101 - DNA, 15 bp, Homo sapiens
caggatactggcaca

SEQ ID NO: 5969102 - DNA, 19 bp, Homo sapiens
caggatagagactggaaca

SEQ ID NO: 5969103 - DNA, 18 bp, Homo sapiens
caggatagataactcttt

SEQ ID NO: 5969104 - DNA, 17 bp, Homo sapiens
caggatatattttattt

SEQ ID NO: 5969105 - DNA, 23 bp, Homo sapiens
caggatatcacattggagtcact

SEQ ID NO: 5969106 - DNA, 19 bp, Homo sapiens
caggatatcacctgaatta

SEQ ID NO: 5969107 - DNA, 16 bp, Homo sapiens
caggatatccccaggg

SEQ ID NO: 5969108 - DNA, 17 bp, Homo sapiens
caggatatccccaggga

SEQ ID NO: 5969109 - DNA, 16 bp, Homo sapiens
caggatatctgaaaat

SEQ ID NO: 5969110 - DNA, 22 bp, Homo sapiens
caggatatgctttaagacagaa

SEQ ID NO: 5969111 - DNA, 23 bp, Homo sapiens
caggatatgggctaccaggaaga

SEQ ID NO: 5969112 - DNA, 18 bp, Homo sapiens
caggatatttactattac

SEQ ID NO: 5969113 - DNA, 18 bp, Homo sapiens
caggatcaagcatgaaag

SEQ ID NO: 5969114 - DNA, 13 bp, Homo sapiens
caggatcactctc

SEQ ID NO: 5969115 - DNA, 17 bp, Homo sapiens
caggatcactctctgct

SEQ ID NO: 5969116 - DNA, 18 bp, Homo sapiens
caggatcactctctgctg

SEQ ID NO: 5969117 - DNA, 14 bp, Homo sapiens
caggatcagctttg

SEQ ID NO: 5969118 - DNA, 14 bp, Homo sapiens
caggatcaggggtt

SEQ ID NO: 5969119 - DNA, 14 bp, Homo sapiens
caggatcagtctga

SEQ ID NO: 5969120 - DNA, 16 bp, Homo sapiens
caggatcatggtgtaa

SEQ ID NO: 5969121 - DNA, 19 bp, Homo sapiens
caggatcatggtgtaataa

SEQ ID NO: 5969122 - DNA, 16 bp, Homo sapiens
caggatccagtgacat

SEQ ID NO: 5969123 - DNA, 18 bp, Homo sapiens
caggatccagtgacatga

SEQ ID NO: 5969124 - DNA, 16 bp, Homo sapiens
caggatcccaagcgtc

SEQ ID NO: 5969125 - DNA, 22 bp, Homo sapiens
caggatcccaggggcccaaggc

SEQ ID NO: 5969126 - DNA, 14 bp, Homo sapiens
caggatccccctct

SEQ ID NO: 5969127 - DNA, 21 bp, Homo sapiens
cactggctctccaagtgccag

SEQ ID NO: 5969128 - DNA, 21 bp, Homo sapiens
cactggctctcctggccctgg

SEQ ID NO: 5969129 - DNA, 15 bp, Homo sapiens
cactggctctctcca

SEQ ID NO: 5969130 - DNA, 16 bp, Homo sapiens
cactggctctctccag

SEQ ID NO: 5969131 - DNA, 17 bp, Homo sapiens
cactggctctctccagg

SEQ ID NO: 5969132 - DNA, 18 bp, Homo sapiens
cactggctctctccagga

SEQ ID NO: 5969133 - DNA, 22 bp, Homo sapiens
cactggctgagaatctgggggt

SEQ ID NO: 5969134 - DNA, 18 bp, Homo sapiens
cactggctgccagctatt

SEQ ID NO: 5969135 - DNA, 14 bp, Homo sapiens
cactggctgcctcc

SEQ ID NO: 5969136 - DNA, 23 bp, Homo sapiens
cactggctgcctccactcccact

SEQ ID NO: 5969137 - DNA, 13 bp, Homo sapiens
cactggctgctct

SEQ ID NO: 5969138 - DNA, 17 bp, Homo sapiens
cactggctgctctgtct

SEQ ID NO: 5969139 - DNA, 18 bp, Homo sapiens
cactggctgctctgtctt

SEQ ID NO: 5969140 - DNA, 19 bp, Homo sapiens
cactggctggactggaggc

SEQ ID NO: 5969141 - DNA, 11 bp, Homo sapiens
cactggctggc

SEQ ID NO: 5969142 - DNA, 18 bp, Homo sapiens
cactggctggctcctagg

SEQ ID NO: 5969143 - DNA, 23 bp, Homo sapiens
cactggctgggagtccttacctc

SEQ ID NO: 5969144 - DNA, 14 bp, Homo sapiens
cactggctggggca

SEQ ID NO: 5969145 - DNA, 15 bp, Homo sapiens
cactggctggggcag

SEQ ID NO: 5969146 - DNA, 16 bp, Homo sapiens
cactggctgtgcctcc

SEQ ID NO: 5969147 - DNA, 18 bp, Homo sapiens
cactggctgtgcctcccc

SEQ ID NO: 5969148 - DNA, 16 bp, Homo sapiens
ccaacaacagtcagcc

SEQ ID NO: 5969149 - DNA, 17 bp, Homo sapiens
ccaacaacagtcagcca

SEQ ID NO: 5969150 - DNA, 22 bp, Homo sapiens
ccaacaactcagaatgggggct

SEQ ID NO: 5969151 - DNA, 18 bp, Homo sapiens
ccaacaactccaggaaaa

SEQ ID NO: 5969152 - DNA, 18 bp, Homo sapiens
ccaacaactctgccttta

SEQ ID NO: 5969153 - DNA, 15 bp, Homo sapiens
ccaacaacttttccc

SEQ ID NO: 5969154 - DNA, 21 bp, Homo sapiens
ccaacaacttttccctcactg

SEQ ID NO: 5969155 - DNA, 12 bp, Homo sapiens
ccaacaagaatg

SEQ ID NO: 5969156 - DNA, 13 bp, Homo sapiens
ccaacaagaatgc

SEQ ID NO: 5969157 - DNA, 16 bp, Homo sapiens
ccaacaagaatgcatt

SEQ ID NO: 5969158 - DNA, 21 bp, Homo sapiens
ccaacaagaccgccccagggc

SEQ ID NO: 5969159 - DNA, 18 bp, Homo sapiens
ccaacaagcaccccgctt

SEQ ID NO: 5969160 - DNA, 14 bp, Homo sapiens
ccaacaagcagctg

SEQ ID NO: 5969161 - DNA, 18 bp, Homo sapiens
ccaacaagccagaatcag

SEQ ID NO: 5969162 - DNA, 17 bp, Homo sapiens
ccaacaagcctcaaagt

SEQ ID NO: 5969163 - DNA, 16 bp, Homo sapiens
ccaacaaggaaataga

SEQ ID NO: 5969164 - DNA, 15 bp, Homo sapiens
ccaacaagggcagtg

SEQ ID NO: 5969165 - DNA, 18 bp, Homo sapiens
ccaacaaggttggcaccc

SEQ ID NO: 5969166 - DNA, 22 bp, Homo sapiens
ccaacaaggttggcaccccagc

SEQ ID NO: 5969167 - DNA, 23 bp, Homo sapiens
ccaacaaggttggcaccccagct

SEQ ID NO: 5969168 - DNA, 22 bp, Homo sapiens
ccaacaataaacaggaatttta

SEQ ID NO: 5969169 - DNA, 23 bp, Homo sapiens
ccaacaataaacaggaattttat

SEQ ID NO: 5969170 - DNA, 16 bp, Homo sapiens
ccaacaataaagagct

SEQ ID NO: 5969171 - DNA, 17 bp, Homo sapiens
ccaacaataaagagctc

SEQ ID NO: 5969172 - DNA, 14 bp, Homo sapiens
ccaacaatggggtg

SEQ ID NO: 5969173 - DNA, 14 bp, Homo sapiens
ccaacacacacaac

SEQ ID NO: 5969174 - DNA, 14 bp, Homo sapiens
ccaacacacaggaa

SEQ ID NO: 5969175 - DNA, 17 bp, Homo sapiens
ccaacacagttgggacc

SEQ ID NO: 5969176 - DNA, 19 bp, Homo sapiens
ccaacaccaagcacagcag

SEQ ID NO: 5969177 - DNA, 22 bp, Homo sapiens
ccaacaccaagcacagcagcct

SEQ ID NO: 5969178 - DNA, 14 bp, Homo sapiens
ccaacaccacagac

SEQ ID NO: 5969179 - DNA, 15 bp, Homo sapiens
ccaacaccacagaca

SEQ ID NO: 5969180 - DNA, 13 bp, Homo sapiens
ccaacaccagccc

SEQ ID NO: 5969181 - DNA, 15 bp, Homo sapiens
ccaacaccagcccct

SEQ ID NO: 5969182 - DNA, 18 bp, Homo sapiens
ccaacaccatcacagctt

SEQ ID NO: 5969183 - DNA, 20 bp, Homo sapiens
ccaacaccatcacagcttgt

SEQ ID NO: 5969184 - DNA, 20 bp, Homo sapiens
ccaacacccaaagcatggac

SEQ ID NO: 5969185 - DNA, 15 bp, Homo sapiens
ccaacaccccatatg

SEQ ID NO: 5969186 - DNA, 18 bp, Homo sapiens
ccaacaccccgcctgcct

SEQ ID NO: 5969187 - DNA, 14 bp, Homo sapiens
ccaacacccctccc

SEQ ID NO: 5969188 - DNA, 17 bp, Homo sapiens
ccaacacctgctgcgct

SEQ ID NO: 5969189 - DNA, 14 bp, Homo sapiens
ccaacacgagcagg

SEQ ID NO: 5969190 - DNA, 21 bp, Homo sapiens
ccaacacgagcaggctactgt

SEQ ID NO: 5969191 - DNA, 16 bp, Homo sapiens
ccaacacgcacctgcc

SEQ ID NO: 5969192 - DNA, 21 bp, Homo sapiens
ccaacacgcacctgcctcagg

SEQ ID NO: 5969193 - DNA, 13 bp, Homo sapiens
ccaacacgcagga

SEQ ID NO: 5969194 - DNA, 22 bp, Homo sapiens
ccaacactcacttaattctcat

SEQ ID NO: 5969195 - DNA, 17 bp, Homo sapiens
cccagaccccagggcag

SEQ ID NO: 5969196 - DNA, 14 bp, Homo sapiens
cccagaccccatcc

SEQ ID NO: 5969197 - DNA, 21 bp, Homo sapiens
cccagaccccatccagccagg

SEQ ID NO: 5969198 - DNA, 11 bp, Homo sapiens
cccagaccccc

SEQ ID NO: 5969199 - DNA, 16 bp, Homo sapiens
cccagacccccagtgt

SEQ ID NO: 5969200 - DNA, 22 bp, Homo sapiens
cccagacccccttgcccaggcc

SEQ ID NO: 5969201 - DNA, 23 bp, Homo sapiens
cccagacccccttgcccaggcct

SEQ ID NO: 5969202 - DNA, 14 bp, Homo sapiens
cccagacccctctc

SEQ ID NO: 5969203 - DNA, 13 bp, Homo sapiens
cccagaccctggg

SEQ ID NO: 5969204 - DNA, 14 bp, Homo sapiens
cccagacctaggga

SEQ ID NO: 5969205 - DNA, 18 bp, Homo sapiens
cccagacctcccctcttc

SEQ ID NO: 5969206 - DNA, 13 bp, Homo sapiens
cccagacctctga

SEQ ID NO: 5969207 - DNA, 12 bp, Homo sapiens
cccagacctggc

SEQ ID NO: 5969208 - DNA, 22 bp, Homo sapiens
cccagaccttaagacactgtga

SEQ ID NO: 5969209 - DNA, 20 bp, Homo sapiens
cccagacgcctgatattgaa

SEQ ID NO: 5969210 - DNA, 19 bp, Homo sapiens
cccagacgcctggctgctg

SEQ ID NO: 5969211 - DNA, 24 bp, Homo sapiens
cccagactaaaggatccagagagc

SEQ ID NO: 5969212 - DNA, 22 bp, Homo sapiens
cccagactactattttcttttt

SEQ ID NO: 5969213 - DNA, 18 bp, Homo sapiens
cccagactagatttcaag

SEQ ID NO: 5969214 - DNA, 20 bp, Homo sapiens
cccagactcagacattggca

SEQ ID NO: 5969215 - DNA, 16 bp, Homo sapiens
cccagactcagagacc

SEQ ID NO: 5969216 - DNA, 14 bp, Homo sapiens
cccagactcagctc

SEQ ID NO: 5969217 - DNA, 19 bp, Homo sapiens
cccagactctttttttgag

SEQ ID NO: 5969218 - DNA, 15 bp, Homo sapiens
cccagactgagctct

SEQ ID NO: 5969219 - DNA, 19 bp, Homo sapiens
cccagactgagctctccag

SEQ ID NO: 5969220 - DNA, 20 bp, Homo sapiens
cccagactgagctctccagg

SEQ ID NO: 5969221 - DNA, 17 bp, Homo sapiens
cccagactgatgagcac

SEQ ID NO: 5969222 - DNA, 19 bp, Homo sapiens
cccagactgatgagcacat

SEQ ID NO: 5969223 - DNA, 20 bp, Homo sapiens
cccagactgggcccaggcag

SEQ ID NO: 5969224 - DNA, 21 bp, Homo sapiens
cccagactgggcccaggcagg

SEQ ID NO: 5969225 - DNA, 22 bp, Homo sapiens
cccagactgtagagatttttat

SEQ ID NO: 5969226 - DNA, 19 bp, Homo sapiens
cccagactgtctccacggc

SEQ ID NO: 5969227 - DNA, 17 bp, Homo sapiens
cccagacttgcactggg

SEQ ID NO: 5969228 - DNA, 20 bp, Homo sapiens
cccagacttgcactggggtg

SEQ ID NO: 5969229 - DNA, 23 bp, Homo sapiens
cccagacttgttggcgtaggcta

SEQ ID NO: 5969230 - DNA, 12 bp, Homo sapiens
cccagactttag

SEQ ID NO: 5969231 - DNA, 20 bp, Homo sapiens
cccagactttagtgccctgc

SEQ ID NO: 5969232 - DNA, 21 bp, Homo sapiens
cccagactttagtgccctgcc

SEQ ID NO: 5969233 - DNA, 22 bp, Homo sapiens
cccagactttagtgccctgccc

SEQ ID NO: 5969234 - DNA, 19 bp, Homo sapiens
cccagactttctacacctg

SEQ ID NO: 5969235 - DNA, 17 bp, Homo sapiens
cccagagaacagcgaag

SEQ ID NO: 5969236 - DNA, 17 bp, Homo sapiens
cccagagaagcctcagt

SEQ ID NO: 5969237 - DNA, 20 bp, Homo sapiens
cccagagaagcctcagtccc

SEQ ID NO: 5969238 - DNA, 21 bp, Homo sapiens
cccagagaagctggaagcctg

SEQ ID NO: 5969239 - DNA, 23 bp, Homo sapiens
cccagagaagctggaagcctgcc

SEQ ID NO: 5969240 - DNA, 13 bp, Homo sapiens
cccagagacagga

SEQ ID NO: 5969241 - DNA, 22 bp, Homo sapiens
cccagagacatacttgaagggc

SEQ ID NO: 5969242 - DNA, 15 bp, Homo sapiens
cccagagacattcat

SEQ ID NO: 5969243 - DNA, 20 bp, Homo sapiens
cccagagaccaggctgtgtc

SEQ ID NO: 5969244 - DNA, 17 bp, Homo sapiens
cccagagaccccttcct

SEQ ID NO: 5969245 - DNA, 13 bp, Homo sapiens
cccagagaccttt

SEQ ID NO: 5969246 - DNA, 20 bp, Homo sapiens
cccagagacctttgcccaca

SEQ ID NO: 5969247 - DNA, 21 bp, Homo sapiens
cccagagacctttgcccacac

SEQ ID NO: 5969248 - DNA, 13 bp, Homo sapiens
cccagagactgcc

SEQ ID NO: 5969249 - DNA, 14 bp, Homo sapiens
cccagagactgccc

SEQ ID NO: 5969250 - DNA, 20 bp, Homo sapiens
cccagagactgcccaccctg

SEQ ID NO: 5969251 - DNA, 23 bp, Homo sapiens
cccagagactgcccaccctgggc

SEQ ID NO: 5969252 - DNA, 17 bp, Homo sapiens
cccagagagaagagccc

SEQ ID NO: 5969253 - DNA, 18 bp, Homo sapiens
cccagagagaagagcccc

SEQ ID NO: 5969254 - DNA, 19 bp, Homo sapiens
cccagagagaagagcccca

SEQ ID NO: 5969255 - DNA, 15 bp, Homo sapiens
cccagagagaccctg

SEQ ID NO: 5969256 - DNA, 22 bp, Homo sapiens
cccagagagaccctgcaagacc

SEQ ID NO: 5969257 - DNA, 18 bp, Homo sapiens
cccagagagagctctgca

SEQ ID NO: 5969258 - DNA, 15 bp, Homo sapiens
cccagagagaggagg

SEQ ID NO: 5969259 - DNA, 22 bp, Homo sapiens
cccagagagaggatgtggaaag

SEQ ID NO: 5969260 - DNA, 18 bp, Homo sapiens
cccagagagcaggcaggg

SEQ ID NO: 5969261 - DNA, 22 bp, Homo sapiens
cccagagaggcactcagtgagc

SEQ ID NO: 5969262 - DNA, 12 bp, Homo sapiens
cccagagaggga

SEQ ID NO: 5969263 - DNA, 22 bp, Homo sapiens
cccagagaggggacatttccct

SEQ ID NO: 5969264 - DNA, 14 bp, Homo sapiens
cccagagatgccag

SEQ ID NO: 5969265 - DNA, 16 bp, Homo sapiens
cccagagatgccagcc

SEQ ID NO: 5969266 - DNA, 14 bp, Homo sapiens
cccagagatgcctc

SEQ ID NO: 5969267 - DNA, 18 bp, Homo sapiens
cccagagatgcctccacc

SEQ ID NO: 5969268 - DNA, 21 bp, Homo sapiens
cccagagatggctccttggga

SEQ ID NO: 5969269 - DNA, 20 bp, Homo sapiens
cccagagatgggactgggag

SEQ ID NO: 5969270 - DNA, 21 bp, Homo sapiens
cccagagcacaagaaggccag

SEQ ID NO: 5969271 - DNA, 18 bp, Homo sapiens
cccagagcacaagttcca

SEQ ID NO: 5969272 - DNA, 16 bp, Homo sapiens
cccagagcacaggagc

SEQ ID NO: 5969273 - DNA, 15 bp, Homo sapiens
cccagagcactttag

SEQ ID NO: 5969274 - DNA, 14 bp, Homo sapiens
cccagagcaggaag

SEQ ID NO: 5969275 - DNA, 23 bp, Homo sapiens
cccagagcaggaggcccctggcc

SEQ ID NO: 5969276 - DNA, 14 bp, Homo sapiens
cccagagcagggtc

SEQ ID NO: 5969277 - DNA, 14 bp, Homo sapiens
cccagagcagggtg

SEQ ID NO: 5969278 - DNA, 13 bp, Homo sapiens
cccagagcatctg

SEQ ID NO: 5969279 - DNA, 19 bp, Homo sapiens
cccagagcatctgccccag

SEQ ID NO: 5969280 - DNA, 21 bp, Homo sapiens
cccagagcattacgtgagcca

SEQ ID NO: 5969281 - DNA, 15 bp, Homo sapiens
cccagagccacacat

SEQ ID NO: 5969282 - DNA, 14 bp, Homo sapiens
cccagagccacagt

SEQ ID NO: 5969283 - DNA, 13 bp, Homo sapiens
cccagagccacct

SEQ ID NO: 5969284 - DNA, 22 bp, Homo sapiens
cccagagccagggctgtcctta

SEQ ID NO: 5969285 - DNA, 10 bp, Homo sapiens
cccagagccc

SEQ ID NO: 5969286 - DNA, 17 bp, Homo sapiens
cccagagcccagctcca

SEQ ID NO: 5969287 - DNA, 18 bp, Homo sapiens
cccagagcccagctcttg

SEQ ID NO: 5969288 - DNA, 14 bp, Homo sapiens
cccagagcccaggc

SEQ ID NO: 5969289 - DNA, 16 bp, Homo sapiens
cccagagccccactcc

SEQ ID NO: 5969290 - DNA, 19 bp, Homo sapiens
cccagagcccgtcagcgtg

SEQ ID NO: 5969291 - DNA, 17 bp, Homo sapiens
cccagagccctggacct

SEQ ID NO: 5969292 - DNA, 17 bp, Homo sapiens
cccagagccttctcctg

SEQ ID NO: 5969293 - DNA, 23 bp, Homo sapiens
cccagagccttctcctgcctaca

SEQ ID NO: 5969294 - DNA, 19 bp, Homo sapiens
cccagagctcatcccccct

SEQ ID NO: 5969295 - DNA, 23 bp, Homo sapiens
cccagagctcatcccccctgctg

SEQ ID NO: 5969296 - DNA, 10 bp, Homo sapiens
cccagagctg

SEQ ID NO: 5969297 - DNA, 21 bp, Homo sapiens
cccagagctgagttgggggtg

SEQ ID NO: 5969298 - DNA, 13 bp, Homo sapiens
cccagagctgctg

SEQ ID NO: 5969299 - DNA, 13 bp, Homo sapiens
cccagagctggcg

SEQ ID NO: 5969300 - DNA, 23 bp, Homo sapiens
cccagagctggcgctcagcagcc

SEQ ID NO: 5969301 - DNA, 18 bp, Homo sapiens
cccagagctgggtgagtg

SEQ ID NO: 5969302 - DNA, 19 bp, Homo sapiens
cccagagctggtggaccca

SEQ ID NO: 5969303 - DNA, 13 bp, Homo sapiens
cccagagctgtgc

SEQ ID NO: 5969304 - DNA, 15 bp, Homo sapiens
cccagagctgtgcca

SEQ ID NO: 5969305 - DNA, 21 bp, Homo sapiens
cccagagctgtttatggcctc

SEQ ID NO: 5969306 - DNA, 22 bp, Homo sapiens
cccagagctgtttatggcctca

SEQ ID NO: 5969307 - DNA, 23 bp, Homo sapiens
cccagagctgtttatggcctcag

SEQ ID NO: 5969308 - DNA, 18 bp, Homo sapiens
cccagagcttattggcca

SEQ ID NO: 5969309 - DNA, 20 bp, Homo sapiens
cccagagcttattggccact

SEQ ID NO: 5969310 - DNA, 18 bp, Homo sapiens
cccagagcttcccaggat

SEQ ID NO: 5969311 - DNA, 23 bp, Homo sapiens
cccagaggaaggggccagaggct

SEQ ID NO: 5969312 - DNA, 20 bp, Homo sapiens
cccagaggagaggagacaga

SEQ ID NO: 5969313 - DNA, 20 bp, Homo sapiens
cccagaggagccaccagttc

SEQ ID NO: 5969314 - DNA, 17 bp, Homo sapiens
cccagaggagcccagcg

SEQ ID NO: 5969315 - DNA, 10 bp, Homo sapiens
cccagaggca

SEQ ID NO: 5969316 - DNA, 14 bp, Homo sapiens
cccagaggccctgg

SEQ ID NO: 5969317 - DNA, 16 bp, Homo sapiens
cccagaggccctggag

SEQ ID NO: 5969318 - DNA, 17 bp, Homo sapiens
cccagaggccctggagg

SEQ ID NO: 5969319 - DNA, 20 bp, Homo sapiens
cccagaggccgagagctatg

SEQ ID NO: 5969320 - DNA, 20 bp, Homo sapiens
cccagaggccgctgcccctg

SEQ ID NO: 5969321 - DNA, 21 bp, Homo sapiens
cccagaggccgctgcccctga

SEQ ID NO: 5969322 - DNA, 24 bp, Homo sapiens
cccagaggcgtcccgcacctgtct

SEQ ID NO: 5969323 - DNA, 14 bp, Homo sapiens
cccagaggctcctg

SEQ ID NO: 5969324 - DNA, 18 bp, Homo sapiens
cccagcctccaagctcca

SEQ ID NO: 5969325 - DNA, 14 bp, Homo sapiens
cccagcctccaggc

SEQ ID NO: 5969326 - DNA, 11 bp, Homo sapiens
cccagcctccc

SEQ ID NO: 5969327 - DNA, 15 bp, Homo sapiens
cccagcctcccccag

SEQ ID NO: 5969328 - DNA, 17 bp, Homo sapiens
cccagcctcccccaggc

SEQ ID NO: 5969329 - DNA, 19 bp, Homo sapiens
cccagcctcccccaggctg

SEQ ID NO: 5969330 - DNA, 23 bp, Homo sapiens
cccagcctcccccaggctgcgcc

SEQ ID NO: 5969331 - DNA, 16 bp, Homo sapiens
cccagcctccctgaag

SEQ ID NO: 5969332 - DNA, 17 bp, Homo sapiens
cccagcctccctgaagc

SEQ ID NO: 5969333 - DNA, 13 bp, Homo sapiens
cccagcctcgcct

SEQ ID NO: 5969334 - DNA, 14 bp, Homo sapiens
cccagcctcgcctg

SEQ ID NO: 5969335 - DNA, 18 bp, Homo sapiens
cccagcctcgcctgtcac

SEQ ID NO: 5969336 - DNA, 16 bp, Homo sapiens
cccagcctcgttggag

SEQ ID NO: 5969337 - DNA, 23 bp, Homo sapiens
cccagcctctccccgctctggat

SEQ ID NO: 5969338 - DNA, 12 bp, Homo sapiens
cccagcctctgc

SEQ ID NO: 5969339 - DNA, 15 bp, Homo sapiens
cccagcctctggggc

SEQ ID NO: 5969340 - DNA, 13 bp, Homo sapiens
cccagcctctgtc

SEQ ID NO: 5969341 - DNA, 13 bp, Homo sapiens
cccagcctctttc

SEQ ID NO: 5969342 - DNA, 19 bp, Homo sapiens
cccagcctgaaagatacag

SEQ ID NO: 5969343 - DNA, 19 bp, Homo sapiens
cccagcctgacctgagact

SEQ ID NO: 5969344 - DNA, 12 bp, Homo sapiens
cccagcctgact

SEQ ID NO: 5969345 - DNA, 23 bp, Homo sapiens
cccagcctgactagaactcctgt

SEQ ID NO: 5969346 - DNA, 15 bp, Homo sapiens
cccagcctgcatact

SEQ ID NO: 5969347 - DNA, 12 bp, Homo sapiens
cccagcctgccc

SEQ ID NO: 5969348 - DNA, 16 bp, Homo sapiens
cccagcctgccctcca

SEQ ID NO: 5969349 - DNA, 23 bp, Homo sapiens
cccagcctgccctccagctgctg

SEQ ID NO: 5969350 - DNA, 19 bp, Homo sapiens
cccagcctgcgcctgctgc

SEQ ID NO: 5969351 - DNA, 22 bp, Homo sapiens
cccagcctgcgcctgctgcatg

SEQ ID NO: 5969352 - DNA, 12 bp, Homo sapiens
cccagcctgcta

SEQ ID NO: 5969353 - DNA, 14 bp, Homo sapiens
cccagcctgctagc

SEQ ID NO: 5969354 - DNA, 22 bp, Homo sapiens
cccagcctgctcagcaggttga

SEQ ID NO: 5969355 - DNA, 19 bp, Homo sapiens
cccagcctgctgagagccc

SEQ ID NO: 5969356 - DNA, 20 bp, Homo sapiens
cccagcctgctgagagcccc

SEQ ID NO: 5969357 - DNA, 22 bp, Homo sapiens
cccagcctgctgagagccccca

SEQ ID NO: 5969358 - DNA, 10 bp, Homo sapiens
cccagcctgg

SEQ ID NO: 5969359 - DNA, 11 bp, Homo sapiens
cccagcctgga

SEQ ID NO: 5969360 - DNA, 18 bp, Homo sapiens
cccagcctggatgccatc

SEQ ID NO: 5969361 - DNA, 19 bp, Homo sapiens
cccagcctggatgccatcc

SEQ ID NO: 5969362 - DNA, 18 bp, Homo sapiens
cccagcctggccagacaa

SEQ ID NO: 5969363 - DNA, 13 bp, Homo sapiens
cccagcctggccc

SEQ ID NO: 5969364 - DNA, 16 bp, Homo sapiens
cccagcctggcccagc

SEQ ID NO: 5969365 - DNA, 17 bp, Homo sapiens
cccagcctggcccagct

SEQ ID NO: 5969366 - DNA, 19 bp, Homo sapiens
cccagcctggcccagctcc

SEQ ID NO: 5969367 - DNA, 20 bp, Homo sapiens
cccagcctggcccagctccc

SEQ ID NO: 5969368 - DNA, 17 bp, Homo sapiens
cccagcctggcctgtgg

SEQ ID NO: 5969369 - DNA, 22 bp, Homo sapiens
cccagcctggcctgtggctgcc

SEQ ID NO: 5969370 - DNA, 18 bp, Homo sapiens
cccagcctgggagcccag

SEQ ID NO: 5969371 - DNA, 12 bp, Homo sapiens
cccagcctgggc

SEQ ID NO: 5969372 - DNA, 15 bp, Homo sapiens
cccagcctgggccca

SEQ ID NO: 5969373 - DNA, 15 bp, Homo sapiens
cccagcctgggccta

SEQ ID NO: 5969374 - DNA, 19 bp, Homo sapiens
cccagcctgggcctatgga

SEQ ID NO: 5969375 - DNA, 19 bp, Homo sapiens
cccagcctgggctcctctg

SEQ ID NO: 5969376 - DNA, 22 bp, Homo sapiens
ccaagacagtggcagcaaagga

SEQ ID NO: 5969377 - DNA, 12 bp, Homo sapiens
ccaagacattgt

SEQ ID NO: 5969378 - DNA, 22 bp, Homo sapiens
ccaagaccaagcttagtcctgg

SEQ ID NO: 5969379 - DNA, 22 bp, Homo sapiens
ccaagaccaagtcctcaaagca

SEQ ID NO: 5969380 - DNA, 17 bp, Homo sapiens
ccaagaccaccagggtc

SEQ ID NO: 5969381 - DNA, 22 bp, Homo sapiens
ccaagaccatttgtagtgagcg

SEQ ID NO: 5969382 - DNA, 15 bp, Homo sapiens
ccaagacctgactca

SEQ ID NO: 5969383 - DNA, 14 bp, Homo sapiens
ccaagacctggtgt

SEQ ID NO: 5969384 - DNA, 17 bp, Homo sapiens
ccaagacggaggagggg

SEQ ID NO: 5969385 - DNA, 20 bp, Homo sapiens
ccaagacggaggaggggaag

SEQ ID NO: 5969386 - DNA, 16 bp, Homo sapiens
ccaagactccagccct

SEQ ID NO: 5969387 - DNA, 14 bp, Homo sapiens
ccaagactcccatg

SEQ ID NO: 5969388 - DNA, 19 bp, Homo sapiens
ccaagactcccatgaggga

SEQ ID NO: 5969389 - DNA, 23 bp, Homo sapiens
ccaagactccctcgtcgagctgg

SEQ ID NO: 5969390 - DNA, 14 bp, Homo sapiens
ccaagactcctgca

SEQ ID NO: 5969391 - DNA, 13 bp, Homo sapiens
ccaagactctaga

SEQ ID NO: 5969392 - DNA, 15 bp, Homo sapiens
ccaagactctagagt

SEQ ID NO: 5969393 - DNA, 22 bp, Homo sapiens
ccaagactctagagtccaaggt

SEQ ID NO: 5969394 - DNA, 13 bp, Homo sapiens
ccaagactgaaga

SEQ ID NO: 5969395 - DNA, 14 bp, Homo sapiens
ccaagactgaagac

SEQ ID NO: 5969396 - DNA, 18 bp, Homo sapiens
ccaagactgctccctttt

SEQ ID NO: 5969397 - DNA, 14 bp, Homo sapiens
ccaagactgggctg

SEQ ID NO: 5969398 - DNA, 21 bp, Homo sapiens
ccaagacttattttcacatgt

SEQ ID NO: 5969399 - DNA, 20 bp, Homo sapiens
ccaagacttggtgtcctttc

SEQ ID NO: 5969400 - DNA, 21 bp, Homo sapiens
ccaagacttggtgtcctttcc

SEQ ID NO: 5969401 - DNA, 22 bp, Homo sapiens
ccaagacttggtgtcctttccc

SEQ ID NO: 5969402 - DNA, 21 bp, Homo sapiens
ccaagagaaaggcctgcacac

SEQ ID NO: 5969403 - DNA, 22 bp, Homo sapiens
ccaagagaaaggcctgcacaca

SEQ ID NO: 5969404 - DNA, 23 bp, Homo sapiens
ccaagagaactcgcgctcagtaa

SEQ ID NO: 5969405 - DNA, 19 bp, Homo sapiens
ccaagagacacaattacgc

SEQ ID NO: 5969406 - DNA, 12 bp, Homo sapiens
ccaagagaccag

SEQ ID NO: 5969407 - DNA, 13 bp, Homo sapiens
ccaagagagaaag

SEQ ID NO: 5969408 - DNA, 12 bp, Homo sapiens
ccaagagagaca

SEQ ID NO: 5969409 - DNA, 14 bp, Homo sapiens
ccaagagagacagc

SEQ ID NO: 5969410 - DNA, 20 bp, Homo sapiens
ccaagagagacagcacaggc

SEQ ID NO: 5969411 - DNA, 23 bp, Homo sapiens
ccaagagagacagcacaggcagc

SEQ ID NO: 5969412 - DNA, 21 bp, Homo sapiens
ccaagagagacattgcctcca

SEQ ID NO: 5969413 - DNA, 15 bp, Homo sapiens
ccaagagaggaagga

SEQ ID NO: 5969414 - DNA, 23 bp, Homo sapiens
ccaagagaggaaggacccctcac

SEQ ID NO: 5969415 - DNA, 15 bp, Homo sapiens
ccaagagatctgtgt

SEQ ID NO: 5969416 - DNA, 17 bp, Homo sapiens
ccaagagatctgtgtgg

SEQ ID NO: 5969417 - DNA, 21 bp, Homo sapiens
ccaagagatctgtgtggctcc

SEQ ID NO: 5969418 - DNA, 18 bp, Homo sapiens
ccaagagatgaacatctg

SEQ ID NO: 5969419 - DNA, 20 bp, Homo sapiens
ccaagagcaaggaaggtaaa

SEQ ID NO: 5969420 - DNA, 20 bp, Homo sapiens
ccaagagcacattcttaaag

SEQ ID NO: 5969421 - DNA, 19 bp, Homo sapiens
ccaagagcagagtctgggc

SEQ ID NO: 5969422 - DNA, 23 bp, Homo sapiens
ccaagagcagagtctgggcctct

SEQ ID NO: 5969423 - DNA, 16 bp, Homo sapiens
ccaagagcatcatgcc

SEQ ID NO: 5969424 - DNA, 23 bp, Homo sapiens
ccaagagcatcatgcctctgagg

SEQ ID NO: 5969425 - DNA, 23 bp, Homo sapiens
ccaagagcccgtgccacccccag

SEQ ID NO: 5969426 - DNA, 16 bp, Homo sapiens
ccaagagccgacaatg

SEQ ID NO: 5969427 - DNA, 12 bp, Homo sapiens
ccaagagcctga

SEQ ID NO: 5969428 - DNA, 16 bp, Homo sapiens
ccaagagcctgagagt

SEQ ID NO: 5969429 - DNA, 13 bp, Homo sapiens
ccaagagcttcca

SEQ ID NO: 5969430 - DNA, 21 bp, Homo sapiens
ccaagaggaaaaacagggaaa

SEQ ID NO: 5969431 - DNA, 17 bp, Homo sapiens
ccaagaggactgagact

SEQ ID NO: 5969432 - DNA, 18 bp, Homo sapiens
ccaagaggactgagactg

SEQ ID NO: 5969433 - DNA, 14 bp, Homo sapiens
ccaagaggctagcc

SEQ ID NO: 5969434 - DNA, 15 bp, Homo sapiens
ccaagaggctgagga

SEQ ID NO: 5969435 - DNA, 16 bp, Homo sapiens
ccaagaggctgcagcc

SEQ ID NO: 5969436 - DNA, 14 bp, Homo sapiens
ccaagaggctggtt

SEQ ID NO: 5969437 - DNA, 23 bp, Homo sapiens
ccaagaggctggttttggcatct

SEQ ID NO: 5969438 - DNA, 21 bp, Homo sapiens
ccaagaggctgttcccaccag

SEQ ID NO: 5969439 - DNA, 11 bp, Homo sapiens
ccaagagggac

SEQ ID NO: 5969440 - DNA, 18 bp, Homo sapiens
ccaagagggctcctcact

SEQ ID NO: 5969441 - DNA, 19 bp, Homo sapiens
ccaagaggggcgggctcag

SEQ ID NO: 5969442 - DNA, 23 bp, Homo sapiens
ccaagaggggcgggctcagagct

SEQ ID NO: 5969443 - DNA, 13 bp, Homo sapiens
ccaagagggtgga

SEQ ID NO: 5969444 - DNA, 14 bp, Homo sapiens
ccaagaggtctgag

SEQ ID NO: 5969445 - DNA, 19 bp, Homo sapiens
ccaagaggtctgagccctg

SEQ ID NO: 5969446 - DNA, 13 bp, Homo sapiens
ccaagaggtgggg

SEQ ID NO: 5969447 - DNA, 21 bp, Homo sapiens
ccaagaggtttggctcctgcc

SEQ ID NO: 5969448 - DNA, 15 bp, Homo sapiens
ccaagagtaacttta

SEQ ID NO: 5969449 - DNA, 20 bp, Homo sapiens
ccaagagtcacttctaataa

SEQ ID NO: 5969450 - DNA, 15 bp, Homo sapiens
ccaagagtctaaaga

SEQ ID NO: 5969451 - DNA, 13 bp, Homo sapiens
ccaagagtggccc

SEQ ID NO: 5969452 - DNA, 14 bp, Homo sapiens
ccaagataaaagaa

SEQ ID NO: 5969453 - DNA, 13 bp, Homo sapiens
ccaagataagcct

SEQ ID NO: 5969454 - DNA, 14 bp, Homo sapiens
ccaagataagcctg

SEQ ID NO: 5969455 - DNA, 16 bp, Homo sapiens
ccaagataagcctgag

SEQ ID NO: 5969456 - DNA, 17 bp, Homo sapiens
ccaagataagcctgagc

SEQ ID NO: 5969457 - DNA, 22 bp, Homo sapiens
ccaagatagcatcccatctcag

SEQ ID NO: 5969458 - DNA, 19 bp, Homo sapiens
ccaagataggagttctctg

SEQ ID NO: 5969459 - DNA, 22 bp, Homo sapiens
ccaagataggagttctctgatg

SEQ ID NO: 5969460 - DNA, 17 bp, Homo sapiens
ccaagatcaattccctc

SEQ ID NO: 5969461 - DNA, 17 bp, Homo sapiens
ccaagatcacagtggcc

SEQ ID NO: 5969462 - DNA, 21 bp, Homo sapiens
ccaagatcattctacaagtaa

SEQ ID NO: 5969463 - DNA, 18 bp, Homo sapiens
ccaagatctacaggacaa

SEQ ID NO: 5969464 - DNA, 13 bp, Homo sapiens
ccaagatctataa

SEQ ID NO: 5969465 - DNA, 14 bp, Homo sapiens
ccaagatctgccag

SEQ ID NO: 5969466 - DNA, 17 bp, Homo sapiens
ccaagatctgccagacc

SEQ ID NO: 5969467 - DNA, 13 bp, Homo sapiens
ccaagatgaatta

SEQ ID NO: 5969468 - DNA, 19 bp, Homo sapiens
ccaagatgagctgcagccc

SEQ ID NO: 5969469 - DNA, 18 bp, Homo sapiens
ccaagatgcttttcaaac

SEQ ID NO: 5969470 - DNA, 19 bp, Homo sapiens
ccaagatggagaggaagaa

SEQ ID NO: 5969471 - DNA, 21 bp, Homo sapiens
ccaagatggagaggaagaaac

SEQ ID NO: 5969472 - DNA, 16 bp, Homo sapiens
ccaagatggctgctgc

SEQ ID NO: 5969473 - DNA, 18 bp, Homo sapiens
ccaagatggctgctgcct

SEQ ID NO: 5969474 - DNA, 20 bp, Homo sapiens
ccaagatggctgctgcctgc

SEQ ID NO: 5969475 - DNA, 17 bp, Homo sapiens
ccaagatgggcacatga

SEQ ID NO: 5969476 - DNA, 20 bp, Homo sapiens
ccaagatgggcacatgagga

SEQ ID NO: 5969477 - DNA, 16 bp, Homo sapiens
ccaagatgtggccttt

SEQ ID NO: 5969478 - DNA, 13 bp, Homo sapiens
ccaagattccgga

SEQ ID NO: 5969479 - DNA, 20 bp, Homo sapiens
ccaagattccggatcctaag

SEQ ID NO: 5969480 - DNA, 22 bp, Homo sapiens
ccaagattctactcttgtcatt

SEQ ID NO: 5969481 - DNA, 13 bp, Homo sapiens
ccaagattctaga

SEQ ID NO: 5969482 - DNA, 17 bp, Homo sapiens
ccaagattctagatgat

SEQ ID NO: 5969483 - DNA, 13 bp, Homo sapiens
ccaagattcttca

SEQ ID NO: 5969484 - DNA, 21 bp, Homo sapiens
ccaagattggcctgaggctgc

SEQ ID NO: 5969485 - DNA, 20 bp, Homo sapiens
ccaagatttaaaattaaatt

SEQ ID NO: 5969486 - DNA, 17 bp, Homo sapiens
ccaagatttaaatgcca

SEQ ID NO: 5969487 - DNA, 20 bp, Homo sapiens
ccaagattttcctcttgtga

SEQ ID NO: 5969488 - DNA, 18 bp, Homo sapiens
ccaagattttgaaggaaa

SEQ ID NO: 5969489 - DNA, 17 bp, Homo sapiens
ccaagcaaaatcatgga

SEQ ID NO: 5969490 - DNA, 10 bp, Homo sapiens
ccaagcaaac

SEQ ID NO: 5969491 - DNA, 14 bp, Homo sapiens
ccaagcaaatgcct

SEQ ID NO: 5969492 - DNA, 14 bp, Homo sapiens
ccaagcaaatgtta

SEQ ID NO: 5969493 - DNA, 19 bp, Homo sapiens
ccaagcaaattaggaacct

SEQ ID NO: 5969494 - DNA, 13 bp, Homo sapiens
ccaagcaacattt

SEQ ID NO: 5969495 - DNA, 17 bp, Homo sapiens
ccaagcaacatttgtat

SEQ ID NO: 5969496 - DNA, 17 bp, Homo sapiens
ccaagcaacctgggtcc

SEQ ID NO: 5969497 - DNA, 14 bp, Homo sapiens
ccaagcaagtagct

SEQ ID NO: 5969498 - DNA, 22 bp, Homo sapiens
ccaagcaagtagctttccacat

SEQ ID NO: 5969499 - DNA, 14 bp, Homo sapiens
ccaagcacagagcc

SEQ ID NO: 5969500 - DNA, 16 bp, Homo sapiens
ccaagcacagagcctg

SEQ ID NO: 5969501 - DNA, 12 bp, Homo sapiens
ccaagcacagca

SEQ ID NO: 5969502 - DNA, 16 bp, Homo sapiens
ccaagcacagtggtgg

SEQ ID NO: 5969503 - DNA, 20 bp, Homo sapiens
cgcaccctgcctacgccagg

SEQ ID NO: 5969504 - DNA, 13 bp, Homo sapiens
cgcaccctggcct

SEQ ID NO: 5969505 - DNA, 13 bp, Homo sapiens
cgcaccctggctg

SEQ ID NO: 5969506 - DNA, 22 bp, Homo sapiens
cgcaccgccatgcatgatgggt

SEQ ID NO: 5969507 - DNA, 21 bp, Homo sapiens
cgcaccggcctggctgcagct

SEQ ID NO: 5969508 - DNA, 17 bp, Homo sapiens
cgcaccgggccctcctt

SEQ ID NO: 5969509 - DNA, 14 bp, Homo sapiens
cgcacctccacgcc

SEQ ID NO: 5969510 - DNA, 19 bp, Homo sapiens
cgcacctccacgccactgc

SEQ ID NO: 5969511 - DNA, 12 bp, Homo sapiens
cgcacctccatc

SEQ ID NO: 5969512 - DNA, 18 bp, Homo sapiens
cgcacctcccatcctaat

SEQ ID NO: 5969513 - DNA, 19 bp, Homo sapiens
cgcacctgaccgctgccca

SEQ ID NO: 5969514 - DNA, 21 bp, Homo sapiens
cgcacctgaccgctgcccagg

SEQ ID NO: 5969515 - DNA, 13 bp, Homo sapiens
cgcacctgcttcc

SEQ ID NO: 5969516 - DNA, 23 bp, Homo sapiens
cgcacctgcttcccccacttcac

SEQ ID NO: 5969517 - DNA, 14 bp, Homo sapiens
cgcacctgtacagt

SEQ ID NO: 5969518 - DNA, 14 bp, Homo sapiens
cgcaccttcctcct

SEQ ID NO: 5969519 - DNA, 15 bp, Homo sapiens
cgcaccttgctgcag

SEQ ID NO: 5969520 - DNA, 16 bp, Homo sapiens
cgcacgacgtcagcct

SEQ ID NO: 5969521 - DNA, 13 bp, Homo sapiens
cgcacgcacacac

SEQ ID NO: 5969522 - DNA, 14 bp, Homo sapiens
cgcacgcacacaca

SEQ ID NO: 5969523 - DNA, 16 bp, Homo sapiens
cgcacgcacacacaca

SEQ ID NO: 5969524 - DNA, 15 bp, Homo sapiens
cgcacgcacccacac

SEQ ID NO: 5969525 - DNA, 24 bp, Homo sapiens
cgcacgcggatgctactactgcag

SEQ ID NO: 5969526 - DNA, 16 bp, Homo sapiens
cgcacggcagccacag

SEQ ID NO: 5969527 - DNA, 20 bp, Homo sapiens
cgcacggccccgaagggccc

SEQ ID NO: 5969528 - DNA, 13 bp, Homo sapiens
cgcacggcttcct

SEQ ID NO: 5969529 - DNA, 17 bp, Homo sapiens
cgcacgggctgtctggg

SEQ ID NO: 5969530 - DNA, 19 bp, Homo sapiens
cgcacgggctgtctgggtg

SEQ ID NO: 5969531 - DNA, 18 bp, Homo sapiens
cgcactagcctccctctc

SEQ ID NO: 5969532 - DNA, 20 bp, Homo sapiens
cgcactcagccgtgggcccg

SEQ ID NO: 5969533 - DNA, 22 bp, Homo sapiens
cgcactcaggagcacagccata

SEQ ID NO: 5969534 - DNA, 16 bp, Homo sapiens
cgcactccatgagcac

SEQ ID NO: 5969535 - DNA, 12 bp, Homo sapiens
cgcactctggcg

SEQ ID NO: 5969536 - DNA, 18 bp, Homo sapiens
cgcactgcccacatggga

SEQ ID NO: 5969537 - DNA, 16 bp, Homo sapiens
cgcactggacagcatc

SEQ ID NO: 5969538 - DNA, 12 bp, Homo sapiens
cgcactgggagc

SEQ ID NO: 5969539 - DNA, 18 bp, Homo sapiens
cgcactgggccacggagg

SEQ ID NO: 5969540 - DNA, 13 bp, Homo sapiens
cgcactgggcttg

SEQ ID NO: 5969541 - DNA, 17 bp, Homo sapiens
cgcactgggcttgggga

SEQ ID NO: 5969542 - DNA, 17 bp, Homo sapiens
cgcactgtcccagtagc

SEQ ID NO: 5969543 - DNA, 22 bp, Homo sapiens
cgcactgtgacccccagctccg

SEQ ID NO: 5969544 - DNA, 14 bp, Homo sapiens
cgcacttacaagtg

SEQ ID NO: 5969545 - DNA, 15 bp, Homo sapiens
cgcacttacaagtgg

SEQ ID NO: 5969546 - DNA, 17 bp, Homo sapiens
cgcacttaccgccctgc

SEQ ID NO: 5969547 - DNA, 22 bp, Homo sapiens
cgcacttaccgccctgcgggcc

SEQ ID NO: 5969548 - DNA, 16 bp, Homo sapiens
cgcacttatggtaatc

SEQ ID NO: 5969549 - DNA, 22 bp, Homo sapiens
cgcacttcagaattccatatct

SEQ ID NO: 5969550 - DNA, 23 bp, Homo sapiens
cgcacttcgggaggtcgaggcag

SEQ ID NO: 5969551 - DNA, 15 bp, Homo sapiens
cgcacttctggggcc

SEQ ID NO: 5969552 - DNA, 22 bp, Homo sapiens
cgcacttgcagaggagcccagt

SEQ ID NO: 5969553 - DNA, 17 bp, Homo sapiens
cgcactttcctcctggc

SEQ ID NO: 5969554 - DNA, 23 bp, Homo sapiens
cgcagaacgaaccttggcctggg

SEQ ID NO: 5969555 - DNA, 13 bp, Homo sapiens
cgcagaaggaagg

SEQ ID NO: 5969556 - DNA, 16 bp, Homo sapiens
cgcagacacacacaca

SEQ ID NO: 5969557 - DNA, 14 bp, Homo sapiens
cgcagacaggacca

SEQ ID NO: 5969558 - DNA, 17 bp, Homo sapiens
cgcagacgggcacagac

SEQ ID NO: 5969559 - DNA, 22 bp, Homo sapiens
cgcagagaagtgacggttccta

SEQ ID NO: 5969560 - DNA, 14 bp, Homo sapiens
cgcagagccccgga

SEQ ID NO: 5969561 - DNA, 16 bp, Homo sapiens
cgcagagccccggagc

SEQ ID NO: 5969562 - DNA, 13 bp, Homo sapiens
cgcagagccctcc

SEQ ID NO: 5969563 - DNA, 16 bp, Homo sapiens
cgcagagccctccagg

SEQ ID NO: 5969564 - DNA, 21 bp, Homo sapiens
cgcagagccctccaggcctgc

SEQ ID NO: 5969565 - DNA, 22 bp, Homo sapiens
cgcagagccctccaggcctgca

SEQ ID NO: 5969566 - DNA, 13 bp, Homo sapiens
cgcagagcgcgcc

SEQ ID NO: 5969567 - DNA, 14 bp, Homo sapiens
cgcagagcgggctc

SEQ ID NO: 5969568 - DNA, 14 bp, Homo sapiens
cgcagagctccctt

SEQ ID NO: 5969569 - DNA, 16 bp, Homo sapiens
cgcagagcttttcaga

SEQ ID NO: 5969570 - DNA, 21 bp, Homo sapiens
cgcagaggatccatcacagac

SEQ ID NO: 5969571 - DNA, 11 bp, Homo sapiens
cgcagaggcag

SEQ ID NO: 5969572 - DNA, 12 bp, Homo sapiens
cgcagaggcaga

SEQ ID NO: 5969573 - DNA, 11 bp, Homo sapiens
cgcagaggcgg

SEQ ID NO: 5969574 - DNA, 19 bp, Homo sapiens
cgcagagggaatttttccc

SEQ ID NO: 5969575 - DNA, 13 bp, Homo sapiens
cgcagaggtccca

SEQ ID NO: 5969576 - DNA, 16 bp, Homo sapiens
cgcagaggtggggtgc

SEQ ID NO: 5969577 - DNA, 15 bp, Homo sapiens
cgcagatctgtgcct

SEQ ID NO: 5969578 - DNA, 15 bp, Homo sapiens
cgcagatgaggggcc

SEQ ID NO: 5969579 - DNA, 16 bp, Homo sapiens
cgcagatgaggggcca

SEQ ID NO: 5969580 - DNA, 22 bp, Homo sapiens
cgcagatgaggggccactgacc

SEQ ID NO: 5969581 - DNA, 17 bp, Homo sapiens
cgcagatgtgcagcaga

SEQ ID NO: 5969582 - DNA, 22 bp, Homo sapiens
cgcagatttttatgttttgaaa

SEQ ID NO: 5969583 - DNA, 17 bp, Homo sapiens
cgcagcaccagcctgag

SEQ ID NO: 5969584 - DNA, 18 bp, Homo sapiens
cgcagcaccctgcagagc

SEQ ID NO: 5969585 - DNA, 22 bp, Homo sapiens
cgcagcacccttctcggagacc

SEQ ID NO: 5969586 - DNA, 15 bp, Homo sapiens
cgcagcagggaagct

SEQ ID NO: 5969587 - DNA, 19 bp, Homo sapiens
cgcagcaggtgcaagagac

SEQ ID NO: 5969588 - DNA, 18 bp, Homo sapiens
cgcagcatccgaccaggt

SEQ ID NO: 5969589 - DNA, 13 bp, Homo sapiens
cgcagcatgtggg

SEQ ID NO: 5969590 - DNA, 21 bp, Homo sapiens
cgcagccaaggccgaagctct

SEQ ID NO: 5969591 - DNA, 17 bp, Homo sapiens
cgcagccacacagtggc

SEQ ID NO: 5969592 - DNA, 22 bp, Homo sapiens
cgcagccacaccgctggctccg

SEQ ID NO: 5969593 - DNA, 12 bp, Homo sapiens
cgcagccaccct

SEQ ID NO: 5969594 - DNA, 16 bp, Homo sapiens
cgcagccaccctgagg

SEQ ID NO: 5969595 - DNA, 22 bp, Homo sapiens
cgcagccaccctgaggagtctg

SEQ ID NO: 5969596 - DNA, 13 bp, Homo sapiens
cgcagccaggaca

SEQ ID NO: 5969597 - DNA, 14 bp, Homo sapiens
cgcagccaggacac

SEQ ID NO: 5969598 - DNA, 15 bp, Homo sapiens
cgcagccaggacacc

SEQ ID NO: 5969599 - DNA, 12 bp, Homo sapiens
cgcagccccatc

SEQ ID NO: 5969600 - DNA, 13 bp, Homo sapiens
cgcagccccatct

SEQ ID NO: 5969601 - DNA, 18 bp, Homo sapiens
cgcagccccatctgtgca

SEQ ID NO: 5969602 - DNA, 12 bp, Homo sapiens
cgcagcccccac

SEQ ID NO: 5969603 - DNA, 16 bp, Homo sapiens
cgcagcccccactgac

SEQ ID NO: 5969604 - DNA, 20 bp, Homo sapiens
cgcagcccccactgacctgc

SEQ ID NO: 5969605 - DNA, 22 bp, Homo sapiens
cgcagcccccactgacctgccc

SEQ ID NO: 5969606 - DNA, 16 bp, Homo sapiens
cgcagccccccacgct

SEQ ID NO: 5969607 - DNA, 17 bp, Homo sapiens
cgcagcccgtgaagcag

SEQ ID NO: 5969608 - DNA, 20 bp, Homo sapiens
cgcagcccgtgaagcagtgc

SEQ ID NO: 5969609 - DNA, 21 bp, Homo sapiens
cgcagcccgtgaagcagtgcc

SEQ ID NO: 5969610 - DNA, 22 bp, Homo sapiens
cgcagccctagagcctgcctgg

SEQ ID NO: 5969611 - DNA, 14 bp, Homo sapiens
cgcagccctctcca

SEQ ID NO: 5969612 - DNA, 18 bp, Homo sapiens
cgcagccctctccaccca

SEQ ID NO: 5969613 - DNA, 21 bp, Homo sapiens
cgcagccctctccacccagag

SEQ ID NO: 5969614 - DNA, 14 bp, Homo sapiens
cgcagccctgcaga

SEQ ID NO: 5969615 - DNA, 17 bp, Homo sapiens
cgcagccctgcagaggg

SEQ ID NO: 5969616 - DNA, 24 bp, Homo sapiens
cgcagccctgctttgggctgccct

SEQ ID NO: 5969617 - DNA, 16 bp, Homo sapiens
cgcagccctggcaggg

SEQ ID NO: 5969618 - DNA, 23 bp, Homo sapiens
cgcagccctggcagggggcatgc

SEQ ID NO: 5969619 - DNA, 21 bp, Homo sapiens
cgcagccctgggggccagctg

SEQ ID NO: 5969620 - DNA, 16 bp, Homo sapiens
cgcagccgcgctctgc

SEQ ID NO: 5969621 - DNA, 17 bp, Homo sapiens
cgcagccgcgctctgcc

SEQ ID NO: 5969622 - DNA, 17 bp, Homo sapiens
cgcagccggagggaggc

SEQ ID NO: 5969623 - DNA, 13 bp, Homo sapiens
cgcagcctctgcc

SEQ ID NO: 5969624 - DNA, 18 bp, Homo sapiens
cgcagcctgaagcctgga

SEQ ID NO: 5969625 - DNA, 13 bp, Homo sapiens
cgcagcctgagaa

SEQ ID NO: 5969626 - DNA, 15 bp, Homo sapiens
cgcagcctgagaatg

SEQ ID NO: 5969627 - DNA, 19 bp, Homo sapiens
cgcagcctggcggggcagg

SEQ ID NO: 5969628 - DNA, 17 bp, Homo sapiens
cgcagcgcctccaccct

SEQ ID NO: 5969629 - DNA, 22 bp, Homo sapiens
cgcagcggcgtcagacttttct

SEQ ID NO: 5969630 - DNA, 21 bp, Homo sapiens
cgcagcgggcgcgggacagga

SEQ ID NO: 5969631 - DNA, 19 bp, Homo sapiens
cgcagcggtgggaaggaaa

SEQ ID NO: 5969632 - DNA, 20 bp, Homo sapiens
cgcagcggtgggaaggaaag

SEQ ID NO: 5969633 - DNA, 15 bp, Homo sapiens
cgcagctaccctcag

SEQ ID NO: 5969634 - DNA, 19 bp, Homo sapiens
cgcagctaccctcagcctc

SEQ ID NO: 5969635 - DNA, 19 bp, Homo sapiens
cgcagctcttgcccttccc

SEQ ID NO: 5969636 - DNA, 17 bp, Homo sapiens
cgcagctgaagcctgga

SEQ ID NO: 5969637 - DNA, 21 bp, Homo sapiens
cgcagctgaagcctggacgca

SEQ ID NO: 5969638 - DNA, 12 bp, Homo sapiens
cgcagctgaagt

SEQ ID NO: 5969639 - DNA, 20 bp, Homo sapiens
cgcagctgctgccactctgc

SEQ ID NO: 5969640 - DNA, 24 bp, Homo sapiens
cgcagctgctgccactctgctgcc

SEQ ID NO: 5969641 - DNA, 13 bp, Homo sapiens
cgcagctggactc

SEQ ID NO: 5969642 - DNA, 15 bp, Homo sapiens
cgcagctggcagaga

SEQ ID NO: 5969643 - DNA, 23 bp, Homo sapiens
cctccctgtaatgcactcctgcc

SEQ ID NO: 5969644 - DNA, 19 bp, Homo sapiens
cctccctgtatcaccccct

SEQ ID NO: 5969645 - DNA, 23 bp, Homo sapiens
cctccctgtcaaagctgtcactt

SEQ ID NO: 5969646 - DNA, 14 bp, Homo sapiens
cctccctgtccacc

SEQ ID NO: 5969647 - DNA, 15 bp, Homo sapiens
cctccctgtccaccc

SEQ ID NO: 5969648 - DNA, 14 bp, Homo sapiens
cctccctgtcctcc

SEQ ID NO: 5969649 - DNA, 16 bp, Homo sapiens
cctccctgtcctcctc

SEQ ID NO: 5969650 - DNA, 14 bp, Homo sapiens
cctccctgtctcca

SEQ ID NO: 5969651 - DNA, 16 bp, Homo sapiens
cctccctgtctccagg

SEQ ID NO: 5969652 - DNA, 16 bp, Homo sapiens
cctccctgtctgtctg

SEQ ID NO: 5969653 - DNA, 18 bp, Homo sapiens
cctccctgtgcccccagc

SEQ ID NO: 5969654 - DNA, 20 bp, Homo sapiens
cctccctgtgcccccagcct

SEQ ID NO: 5969655 - DNA, 22 bp, Homo sapiens
cctccctgttaataaacagctc

SEQ ID NO: 5969656 - DNA, 22 bp, Homo sapiens
cctccctgttcacggtgacaca

SEQ ID NO: 5969657 - DNA, 19 bp, Homo sapiens
cctccctgttccccagaga

SEQ ID NO: 5969658 - DNA, 21 bp, Homo sapiens
cctccctgttgaagctctggt

SEQ ID NO: 5969659 - DNA, 22 bp, Homo sapiens
cctccctgttgacgaagtctct

SEQ ID NO: 5969660 - DNA, 13 bp, Homo sapiens
cctcccttacaga

SEQ ID NO: 5969661 - DNA, 11 bp, Homo sapiens
cctcccttccc

SEQ ID NO: 5969662 - DNA, 13 bp, Homo sapiens
cctcccttcccag

SEQ ID NO: 5969663 - DNA, 17 bp, Homo sapiens
cctcccttcccagtggg

SEQ ID NO: 5969664 - DNA, 17 bp, Homo sapiens
cctcccttccccactct

SEQ ID NO: 5969665 - DNA, 23 bp, Homo sapiens
cctcccttccgaccctctgggaa

SEQ ID NO: 5969666 - DNA, 13 bp, Homo sapiens
cctcccttcctcc

SEQ ID NO: 5969667 - DNA, 13 bp, Homo sapiens
cctcccttccttt

SEQ ID NO: 5969668 - DNA, 16 bp, Homo sapiens
cctcccttccttttcc

SEQ ID NO: 5969669 - DNA, 16 bp, Homo sapiens
cctcccttctactgct

SEQ ID NO: 5969670 - DNA, 19 bp, Homo sapiens
cctcccttctactgcttct

SEQ ID NO: 5969671 - DNA, 14 bp, Homo sapiens
cctcccttctccct

SEQ ID NO: 5969672 - DNA, 16 bp, Homo sapiens
cctcccttctgctact

SEQ ID NO: 5969673 - DNA, 14 bp, Homo sapiens
cctcccttcttgtg

SEQ ID NO: 5969674 - DNA, 14 bp, Homo sapiens
cctcccttctttgc

SEQ ID NO: 5969675 - DNA, 17 bp, Homo sapiens
cctcccttgccccaggc

SEQ ID NO: 5969676 - DNA, 18 bp, Homo sapiens
cctcccttgccccaggcc

SEQ ID NO: 5969677 - DNA, 19 bp, Homo sapiens
cctcccttggaaacctgcc

SEQ ID NO: 5969678 - DNA, 22 bp, Homo sapiens
cctcccttggaaacctgccctg

SEQ ID NO: 5969679 - DNA, 15 bp, Homo sapiens
cctcccttggcgtgg

SEQ ID NO: 5969680 - DNA, 19 bp, Homo sapiens
cctccctttcctccgcctg

SEQ ID NO: 5969681 - DNA, 16 bp, Homo sapiens
cctccctttgccagcc

SEQ ID NO: 5969682 - DNA, 16 bp, Homo sapiens
cgccccgggccgcgag

SEQ ID NO: 5969683 - DNA, 14 bp, Homo sapiens
cgccccgggctggc

SEQ ID NO: 5969684 - DNA, 16 bp, Homo sapiens
cgccccgtccccccat

SEQ ID NO: 5969685 - DNA, 17 bp, Homo sapiens
cgccccgtgctcctctg

SEQ ID NO: 5969686 - DNA, 12 bp, Homo sapiens
cgcccctccaaa

SEQ ID NO: 5969687 - DNA, 22 bp, Homo sapiens
cgcccctccaaacctccagcct

SEQ ID NO: 5969688 - DNA, 14 bp, Homo sapiens
cgcccctccagtgt

SEQ ID NO: 5969689 - DNA, 16 bp, Homo sapiens
cgcccctcccctcagc

SEQ ID NO: 5969690 - DNA, 11 bp, Homo sapiens
cgcccctcctc

SEQ ID NO: 5969691 - DNA, 13 bp, Homo sapiens
cgcccctcctcgg

SEQ ID NO: 5969692 - DNA, 20 bp, Homo sapiens
cgcccctccttttggcctgg

SEQ ID NO: 5969693 - DNA, 20 bp, Homo sapiens
cgcccctcgctgctgctact

SEQ ID NO: 5969694 - DNA, 13 bp, Homo sapiens
cgcccctctgcgc

SEQ ID NO: 5969695 - DNA, 21 bp, Homo sapiens
cgcccctctgcgccccagcga

SEQ ID NO: 5969696 - DNA, 14 bp, Homo sapiens
cgcccctgagccca

SEQ ID NO: 5969697 - DNA, 18 bp, Homo sapiens
cgcccctgagcccactgt

SEQ ID NO: 5969698 - DNA, 12 bp, Homo sapiens
cgcccctgcatg

SEQ ID NO: 5969699 - DNA, 12 bp, Homo sapiens
cgcccctgccca

SEQ ID NO: 5969700 - DNA, 18 bp, Homo sapiens
cgcccctgcccagcacct

SEQ ID NO: 5969701 - DNA, 15 bp, Homo sapiens
cgcccctgcctgcca

SEQ ID NO: 5969702 - DNA, 18 bp, Homo sapiens
cgcccctgctgtcttccc

SEQ ID NO: 5969703 - DNA, 19 bp, Homo sapiens
cgcccctgggctaccatct

SEQ ID NO: 5969704 - DNA, 20 bp, Homo sapiens
cgcccctgggctaccatctg

SEQ ID NO: 5969705 - DNA, 13 bp, Homo sapiens
cgcccctgtggcc

SEQ ID NO: 5969706 - DNA, 14 bp, Homo sapiens
cgcccctgtggcca

SEQ ID NO: 5969707 - DNA, 15 bp, Homo sapiens
cgcccctgttttttg

SEQ ID NO: 5969708 - DNA, 14 bp, Homo sapiens
cgccccttccctct

SEQ ID NO: 5969709 - DNA, 21 bp, Homo sapiens
cgccccttccctctctccctg

SEQ ID NO: 5969710 - DNA, 19 bp, Homo sapiens
cgcccgactagcaggcatg

SEQ ID NO: 5969711 - DNA, 15 bp, Homo sapiens
cgcccgagcccctgc

SEQ ID NO: 5969712 - DNA, 15 bp, Homo sapiens
cgcccgagctgttta

SEQ ID NO: 5969713 - DNA, 21 bp, Homo sapiens
cgcccgcacagctcccggcgg

SEQ ID NO: 5969714 - DNA, 14 bp, Homo sapiens
cgcccgcacccccg

SEQ ID NO: 5969715 - DNA, 16 bp, Homo sapiens
cgcccgcccacacggc

SEQ ID NO: 5969716 - DNA, 20 bp, Homo sapiens
cgcccgcccaccccgctgcc

SEQ ID NO: 5969717 - DNA, 23 bp, Homo sapiens
cgcccgcccaccccgctgcctgg

SEQ ID NO: 5969718 - DNA, 14 bp, Homo sapiens
cgcccgcccactgt

SEQ ID NO: 5969719 - DNA, 18 bp, Homo sapiens
cgcccgcccactgtcctg

SEQ ID NO: 5969720 - DNA, 16 bp, Homo sapiens
cgcccgccggttggcc

SEQ ID NO: 5969721 - DNA, 21 bp, Homo sapiens
cgcccgccggttggccggctg

SEQ ID NO: 5969722 - DNA, 18 bp, Homo sapiens
cgcccgctcccttcctgc

SEQ ID NO: 5969723 - DNA, 14 bp, Homo sapiens
cgcccgctgagctg

SEQ ID NO: 5969724 - DNA, 14 bp, Homo sapiens
cgcccgctgggctg

SEQ ID NO: 5969725 - DNA, 23 bp, Homo sapiens
cgcccgctgggctgagcccctac

SEQ ID NO: 5969726 - DNA, 13 bp, Homo sapiens
cgcccgctgggga

SEQ ID NO: 5969727 - DNA, 13 bp, Homo sapiens
cgcccggcccaag

SEQ ID NO: 5969728 - DNA, 19 bp, Homo sapiens
cgcccggctaatgtttgta

SEQ ID NO: 5969729 - DNA, 13 bp, Homo sapiens
cgcccgggcccag

SEQ ID NO: 5969730 - DNA, 14 bp, Homo sapiens
cgcccgggcccaga

SEQ ID NO: 5969731 - DNA, 18 bp, Homo sapiens
cgcccgtagatcatcccc

SEQ ID NO: 5969732 - DNA, 12 bp, Homo sapiens
cgcccgtcctgc

SEQ ID NO: 5969733 - DNA, 17 bp, Homo sapiens
cgcccgtggcctcgtgc

SEQ ID NO: 5969734 - DNA, 16 bp, Homo sapiens
cgccctaccctcactc

SEQ ID NO: 5969735 - DNA, 16 bp, Homo sapiens
cgccctactccactgc

SEQ ID NO: 5969736 - DNA, 22 bp, Homo sapiens
cgccctactccactgccctggc

SEQ ID NO: 5969737 - DNA, 15 bp, Homo sapiens
cgccctaggcctggc

SEQ ID NO: 5969738 - DNA, 16 bp, Homo sapiens
cgccctaggcctggca

SEQ ID NO: 5969739 - DNA, 13 bp, Homo sapiens
cgccctcacctgc

SEQ ID NO: 5969740 - DNA, 13 bp, Homo sapiens
cgccctcaggggc

SEQ ID NO: 5969741 - DNA, 14 bp, Homo sapiens
cgccctcaggggcc

SEQ ID NO: 5969742 - DNA, 13 bp, Homo sapiens
cgccctccaccca

SEQ ID NO: 5969743 - DNA, 12 bp, Homo sapiens
cgccctcccagg

SEQ ID NO: 5969744 - DNA, 13 bp, Homo sapiens
cgccctcccaggc

SEQ ID NO: 5969745 - DNA, 14 bp, Homo sapiens
cgccctcccggaga

SEQ ID NO: 5969746 - DNA, 18 bp, Homo sapiens
cgccctccctccctccac

SEQ ID NO: 5969747 - DNA, 16 bp, Homo sapiens
cgccctccctccgcct

SEQ ID NO: 5969748 - DNA, 22 bp, Homo sapiens
cgccctccctgctagcacagag

SEQ ID NO: 5969749 - DNA, 14 bp, Homo sapiens
cgccctccgacctc

SEQ ID NO: 5969750 - DNA, 20 bp, Homo sapiens
cgccctccgtcgggcccctg

SEQ ID NO: 5969751 - DNA, 21 bp, Homo sapiens
cgccctccgtcgggcccctgc

SEQ ID NO: 5969752 - DNA, 24 bp, Homo sapiens
cgccctccgtcgggcccctgcctg

SEQ ID NO: 5969753 - DNA, 12 bp, Homo sapiens
cgccctcctcca

SEQ ID NO: 5969754 - DNA, 14 bp, Homo sapiens
cgccctcctccctc

SEQ ID NO: 5969755 - DNA, 18 bp, Homo sapiens
cgccctcctcgctgtgcc

SEQ ID NO: 5969756 - DNA, 19 bp, Homo sapiens
cgccctcctcgctgtgcca

SEQ ID NO: 5969757 - DNA, 13 bp, Homo sapiens
cgccctcctctgc

SEQ ID NO: 5969758 - DNA, 12 bp, Homo sapiens
cgccctcctgat

SEQ ID NO: 5969759 - DNA, 20 bp, Homo sapiens
cgccctctcctttgttcccg

SEQ ID NO: 5969760 - DNA, 16 bp, Homo sapiens
cgccctctctgctcct

SEQ ID NO: 5969761 - DNA, 17 bp, Homo sapiens
cgccctctctgctcctt

SEQ ID NO: 5969762 - DNA, 22 bp, Homo sapiens
cgccctctctgctccttcactg

SEQ ID NO: 5969763 - DNA, 21 bp, Homo sapiens
cgccctctgcgtcccccagcc

SEQ ID NO: 5969764 - DNA, 22 bp, Homo sapiens
cgccctctgcgtcccccagccc

SEQ ID NO: 5969765 - DNA, 17 bp, Homo sapiens
cgccctctgtgcctaat

SEQ ID NO: 5969766 - DNA, 13 bp, Homo sapiens
cgccctcttcctg

SEQ ID NO: 5969767 - DNA, 19 bp, Homo sapiens
cgccctgagcatcctggtt

SEQ ID NO: 5969768 - DNA, 15 bp, Homo sapiens
cgccctgatttgctg

SEQ ID NO: 5969769 - DNA, 12 bp, Homo sapiens
cgccctgcactc

SEQ ID NO: 5969770 - DNA, 15 bp, Homo sapiens
cgccctgcagaccct

SEQ ID NO: 5969771 - DNA, 21 bp, Homo sapiens
cgccctgcagaccctgccctt

SEQ ID NO: 5969772 - DNA, 11 bp, Homo sapiens
cgccctgccac

SEQ ID NO: 5969773 - DNA, 14 bp, Homo sapiens
cgccctgccactca

SEQ ID NO: 5969774 - DNA, 15 bp, Homo sapiens
cgccctgcccttccc

SEQ ID NO: 5969775 - DNA, 12 bp, Homo sapiens
cgccctgcctcc

SEQ ID NO: 5969776 - DNA, 15 bp, Homo sapiens
cgccctgcgggccac

SEQ ID NO: 5969777 - DNA, 19 bp, Homo sapiens
cgccctgcgttggagccac

SEQ ID NO: 5969778 - DNA, 17 bp, Homo sapiens
cgccctgctcctccctg

SEQ ID NO: 5969779 - DNA, 18 bp, Homo sapiens
cgccctgctcctccctgg

SEQ ID NO: 5969780 - DNA, 16 bp, Homo sapiens
cgccctggaagccggc

SEQ ID NO: 5969781 - DNA, 22 bp, Homo sapiens
cgccctggaagccggcggccca

SEQ ID NO: 5969782 - DNA, 21 bp, Homo sapiens
cgccctggagtcccctgggcc

SEQ ID NO: 5969783 - DNA, 17 bp, Homo sapiens
cgccctggccagggcct

SEQ ID NO: 5969784 - DNA, 15 bp, Homo sapiens
cgccctggcccccac

SEQ ID NO: 5969785 - DNA, 18 bp, Homo sapiens
cgccctgttcacgctcac

SEQ ID NO: 5969786 - DNA, 11 bp, Homo sapiens
cgccctgttcc

SEQ ID NO: 5969787 - DNA, 20 bp, Homo sapiens
cgcccttacttcttgccctg

SEQ ID NO: 5969788 - DNA, 19 bp, Homo sapiens
cgcccttagtcccccaact

SEQ ID NO: 5969789 - DNA, 20 bp, Homo sapiens
cgcccttccctgacactgtc

SEQ ID NO: 5969790 - DNA, 13 bp, Homo sapiens
cgcccttcctgga

SEQ ID NO: 5969791 - DNA, 14 bp, Homo sapiens
cgcccttccttccc

SEQ ID NO: 5969792 - DNA, 14 bp, Homo sapiens
cgcccttctcccgg

SEQ ID NO: 5969793 - DNA, 19 bp, Homo sapiens
cgcccttctcccggccctc

SEQ ID NO: 5969794 - DNA, 14 bp, Homo sapiens
cgcccttggagcct

SEQ ID NO: 5969795 - DNA, 17 bp, Homo sapiens
cgccctttcctcctcag

SEQ ID NO: 5969796 - DNA, 13 bp, Homo sapiens
cgccctttccttg

SEQ ID NO: 5969797 - DNA, 19 bp, Homo sapiens
cgccctttccttgccttct

SEQ ID NO: 5969798 - DNA, 22 bp, Homo sapiens
cgccctttccttgccttcttta

SEQ ID NO: 5969799 - DNA, 15 bp, Homo sapiens
cgccctttttgtcct

SEQ ID NO: 5969800 - DNA, 17 bp, Homo sapiens
cgccgaagggcagcccc

SEQ ID NO: 5969801 - DNA, 12 bp, Homo sapiens
cgccgactccct

SEQ ID NO: 5969802 - DNA, 13 bp, Homo sapiens
cgccgagggcagc

SEQ ID NO: 5969803 - DNA, 14 bp, Homo sapiens
cgccgagggcagcc

SEQ ID NO: 5969804 - DNA, 17 bp, Homo sapiens
cgccgatcccaggtgcg

SEQ ID NO: 5969805 - DNA, 19 bp, Homo sapiens
cgccgcaaaccacactgga

SEQ ID NO: 5969806 - DNA, 22 bp, Homo sapiens
cgccgcagaagcagcccctcga

SEQ ID NO: 5969807 - DNA, 13 bp, Homo sapiens
cgccgccaccgcg

SEQ ID NO: 5969808 - DNA, 13 bp, Homo sapiens
cgccgccaggact

SEQ ID NO: 5969809 - DNA, 21 bp, Homo sapiens
cgccgcccacgccggcctctg

SEQ ID NO: 5969810 - DNA, 15 bp, Homo sapiens
cgccgcccagcccac

SEQ ID NO: 5969811 - DNA, 16 bp, Homo sapiens
cgccgcccgcccctca

SEQ ID NO: 5969812 - DNA, 16 bp, Homo sapiens
cgccgccgcgcgcccc

SEQ ID NO: 5969813 - DNA, 22 bp, Homo sapiens
cgccgccggagtccactcccag

SEQ ID NO: 5969814 - DNA, 18 bp, Homo sapiens
cgccgcctcgggccgcct

SEQ ID NO: 5969815 - DNA, 20 bp, Homo sapiens
cgccgcctggtactcaagcc

SEQ ID NO: 5969816 - DNA, 19 bp, Homo sapiens
cgccgcgtggacagccgga

SEQ ID NO: 5969817 - DNA, 14 bp, Homo sapiens
cgccggaggccagc

SEQ ID NO: 5969818 - DNA, 23 bp, Homo sapiens
cgccggaggccagctatctgcct

SEQ ID NO: 5969819 - DNA, 22 bp, Homo sapiens
cgccggcaaaactttggcactg

SEQ ID NO: 5969820 - DNA, 22 bp, Homo sapiens
cgccggcaataaaagcccagga

SEQ ID NO: 5969821 - DNA, 12 bp, Homo sapiens
cgccggcagggg

SEQ ID NO: 5969822 - DNA, 12 bp, Homo sapiens
cgccggcctctg

SEQ ID NO: 5969823 - DNA, 18 bp, Homo sapiens
cgccggcctctgctgccc

SEQ ID NO: 5969824 - DNA, 13 bp, Homo sapiens
cgccggcgccccg

SEQ ID NO: 5969825 - DNA, 18 bp, Homo sapiens
cgccggcgggcgggccgg

SEQ ID NO: 5969826 - DNA, 12 bp, Homo sapiens
cgccggctttca

SEQ ID NO: 5969827 - DNA, 17 bp, Homo sapiens
cgccggggacagaggcc

SEQ ID NO: 5969828 - DNA, 22 bp, Homo sapiens
cgccggggacagaggcctgccc

SEQ ID NO: 5969829 - DNA, 15 bp, Homo sapiens
cgccggggctggccc

SEQ ID NO: 5969830 - DNA, 19 bp, Homo sapiens
cctcctgccgactcctggg

SEQ ID NO: 5969831 - DNA, 19 bp, Homo sapiens
cctcctgccggctccttgg

SEQ ID NO: 5969832 - DNA, 13 bp, Homo sapiens
cctcctgcctcag

SEQ ID NO: 5969833 - DNA, 13 bp, Homo sapiens
cctcctgcctcga

SEQ ID NO: 5969834 - DNA, 24 bp, Homo sapiens
cctcctgcctgcgcagctccttcc

SEQ ID NO: 5969835 - DNA, 22 bp, Homo sapiens
cctcctgcgcaggccatgcatg

SEQ ID NO: 5969836 - DNA, 18 bp, Homo sapiens
cctcctgcgcgcatgtgc

SEQ ID NO: 5969837 - DNA, 23 bp, Homo sapiens
cctcctgcggctcagccttgcac

SEQ ID NO: 5969838 - DNA, 12 bp, Homo sapiens
cctcctgctcct

SEQ ID NO: 5969839 - DNA, 15 bp, Homo sapiens
cctcctgctcctcac

SEQ ID NO: 5969840 - DNA, 20 bp, Homo sapiens
cctcctgctcctcacccctg

SEQ ID NO: 5969841 - DNA, 16 bp, Homo sapiens
cctcctgctcctccct

SEQ ID NO: 5969842 - DNA, 19 bp, Homo sapiens
cctcctgctcctccctgcc

SEQ ID NO: 5969843 - DNA, 13 bp, Homo sapiens
cctcctgctctgg

SEQ ID NO: 5969844 - DNA, 16 bp, Homo sapiens
cctcctgctctgggac

SEQ ID NO: 5969845 - DNA, 13 bp, Homo sapiens
cctcctgctgagc

SEQ ID NO: 5969846 - DNA, 14 bp, Homo sapiens
cctcctgctgagct

SEQ ID NO: 5969847 - DNA, 14 bp, Homo sapiens
cctcctgctgagtg

SEQ ID NO: 5969848 - DNA, 17 bp, Homo sapiens
cctcctgctgcagaggg

SEQ ID NO: 5969849 - DNA, 18 bp, Homo sapiens
cctcctgctgcagagggg

SEQ ID NO: 5969850 - DNA, 14 bp, Homo sapiens
cctcctgctgctca

SEQ ID NO: 5969851 - DNA, 22 bp, Homo sapiens
cctcctgctggctgaggcttgg

SEQ ID NO: 5969852 - DNA, 22 bp, Homo sapiens
cctcctgctgtagtcctttctg

SEQ ID NO: 5969853 - DNA, 13 bp, Homo sapiens
cctcctgctgtgc

SEQ ID NO: 5969854 - DNA, 13 bp, Homo sapiens
cctcctgctttta

SEQ ID NO: 5969855 - DNA, 18 bp, Homo sapiens
cctcctggaaccttgctg

SEQ ID NO: 5969856 - DNA, 20 bp, Homo sapiens
cctcctggaaccttgctgtc

SEQ ID NO: 5969857 - DNA, 20 bp, Homo sapiens
cctcctggaatcagtatttc

SEQ ID NO: 5969858 - DNA, 12 bp, Homo sapiens
cctcctggacac

SEQ ID NO: 5969859 - DNA, 12 bp, Homo sapiens
cctcctggaccc

SEQ ID NO: 5969860 - DNA, 13 bp, Homo sapiens
cctcctggactcc

SEQ ID NO: 5969861 - DNA, 18 bp, Homo sapiens
cctcctggagcagcagct

SEQ ID NO: 5969862 - DNA, 11 bp, Homo sapiens
cctcctggcac

SEQ ID NO: 5969863 - DNA, 13 bp, Homo sapiens
tatcaaaagactt

SEQ ID NO: 5969864 - DNA, 16 bp, Homo sapiens
tatcaaaaggaagatt

SEQ ID NO: 5969865 - DNA, 12 bp, Homo sapiens
tatcaaaagtga

SEQ ID NO: 5969866 - DNA, 19 bp, Homo sapiens
tatcaaaataggatttctt

SEQ ID NO: 5969867 - DNA, 14 bp, Homo sapiens
tatcaaaatagtct

SEQ ID NO: 5969868 - DNA, 23 bp, Homo sapiens
tatcaaaatcactatctttctga

SEQ ID NO: 5969869 - DNA, 14 bp, Homo sapiens
tatcaaaatgctct

SEQ ID NO: 5969870 - DNA, 14 bp, Homo sapiens
tatcaaaattgcct

SEQ ID NO: 5969871 - DNA, 19 bp, Homo sapiens
tatcaaaccctagccttgc

SEQ ID NO: 5969872 - DNA, 20 bp, Homo sapiens
tatcaaaccctagccttgct

SEQ ID NO: 5969873 - DNA, 20 bp, Homo sapiens
tatcaaactactttttaaca

SEQ ID NO: 5969874 - DNA, 22 bp, Homo sapiens
tatcaaactcgtctgatgtttt

SEQ ID NO: 5969875 - DNA, 21 bp, Homo sapiens
tatcaaagaccttgtgtgtat

SEQ ID NO: 5969876 - DNA, 20 bp, Homo sapiens
tatcaaagagaagatgcctg

SEQ ID NO: 5969877 - DNA, 14 bp, Homo sapiens
tatcaaagagcact

SEQ ID NO: 5969878 - DNA, 15 bp, Homo sapiens
tatcaaagagcactt

SEQ ID NO: 5969879 - DNA, 18 bp, Homo sapiens
tatcaaaggcagaaagga

SEQ ID NO: 5969880 - DNA, 23 bp, Homo sapiens
tatcaaaggcagaaaggagatca

SEQ ID NO: 5969881 - DNA, 22 bp, Homo sapiens
tatcaaagggtgaaaattattt

SEQ ID NO: 5969882 - DNA, 18 bp, Homo sapiens
tatcaaagtcattaaaga

SEQ ID NO: 5969883 - DNA, 16 bp, Homo sapiens
tatcaaataatattca

SEQ ID NO: 5969884 - DNA, 14 bp, Homo sapiens
tatcaaatcattca

SEQ ID NO: 5969885 - DNA, 15 bp, Homo sapiens
tatcaaatcattcaa

SEQ ID NO: 5969886 - DNA, 14 bp, Homo sapiens
tatcaaatgaaaca

SEQ ID NO: 5969887 - DNA, 23 bp, Homo sapiens
tatcaaatgcagtatatttcttc

SEQ ID NO: 5969888 - DNA, 13 bp, Homo sapiens
tatcaaatgcttg

SEQ ID NO: 5969889 - DNA, 17 bp, Homo sapiens
tatcaaatgttacagtt

SEQ ID NO: 5969890 - DNA, 20 bp, Homo sapiens
tatcaaattaattgtgtgaa

SEQ ID NO: 5969891 - DNA, 17 bp, Homo sapiens
tatcaaattatcttcac

SEQ ID NO: 5969892 - DNA, 21 bp, Homo sapiens
tatcaaattatttttaagttt

SEQ ID NO: 5969893 - DNA, 15 bp, Homo sapiens
tatcaacaacaagtt

SEQ ID NO: 5969894 - DNA, 16 bp, Homo sapiens
tatcaacagcttccct

SEQ ID NO: 5969895 - DNA, 22 bp, Homo sapiens
tatcaacatctttttcctccct

SEQ ID NO: 5969896 - DNA, 14 bp, Homo sapiens
tatcaactctgaag

SEQ ID NO: 5969897 - DNA, 16 bp, Homo sapiens
tatcaactgcttgtaa

SEQ ID NO: 5969898 - DNA, 19 bp, Homo sapiens
tatcaacttcctaaatatt

SEQ ID NO: 5969899 - DNA, 12 bp, Homo sapiens
tatcaactttag

SEQ ID NO: 5969900 - DNA, 12 bp, Homo sapiens
tatcaagaaagt

SEQ ID NO: 5969901 - DNA, 20 bp, Homo sapiens
tatcaagacgtttaactgca

SEQ ID NO: 5969902 - DNA, 21 bp, Homo sapiens
tatcaagcagagacctttgtt

SEQ ID NO: 5969903 - DNA, 22 bp, Homo sapiens
tatcaagcagagacctttgttg

SEQ ID NO: 5969904 - DNA, 19 bp, Homo sapiens
tatcaagctaccagctttg

SEQ ID NO: 5969905 - DNA, 21 bp, Homo sapiens
tatcaagcttaatatgtgctg

SEQ ID NO: 5969906 - DNA, 22 bp, Homo sapiens
tatcaaggaagaaatggttcag

SEQ ID NO: 5969907 - DNA, 15 bp, Homo sapiens
tatcaaggaagtctt

SEQ ID NO: 5969908 - DNA, 20 bp, Homo sapiens
tatcaaggaagtcttcaaat

SEQ ID NO: 5969909 - DNA, 21 bp, Homo sapiens
tatcaaggagatatatcagtg

SEQ ID NO: 5969910 - DNA, 22 bp, Homo sapiens
tatcaaggctgcctggagaaag

SEQ ID NO: 5969911 - DNA, 16 bp, Homo sapiens
tatcaaggtggaaatg

SEQ ID NO: 5969912 - DNA, 15 bp, Homo sapiens
tatcaagtactacat

SEQ ID NO: 5969913 - DNA, 21 bp, Homo sapiens
tatcaagtactacattttctt

SEQ ID NO: 5969914 - DNA, 15 bp, Homo sapiens
tatcaagtatagaaa

SEQ ID NO: 5969915 - DNA, 16 bp, Homo sapiens
tatcaagtatagaaaa

SEQ ID NO: 5969916 - DNA, 19 bp, Homo sapiens
tatcaagtatagaaaatct

SEQ ID NO: 5969917 - DNA, 17 bp, Homo sapiens
tatcaagtcaatcattt

SEQ ID NO: 5969918 - DNA, 18 bp, Homo sapiens
tatcaagtcccgaggcag

SEQ ID NO: 5969919 - DNA, 18 bp, Homo sapiens
tatcaagtggcatgtgct

SEQ ID NO: 5969920 - DNA, 18 bp, Homo sapiens
tatcaataaaattctgta

SEQ ID NO: 5969921 - DNA, 19 bp, Homo sapiens
tatcaataaaattctgtaa

SEQ ID NO: 5969922 - DNA, 16 bp, Homo sapiens
tatcaataaagcacta

SEQ ID NO: 5969923 - DNA, 18 bp, Homo sapiens
tatcaataaattccatgt

SEQ ID NO: 5969924 - DNA, 22 bp, Homo sapiens
tatcaatacagtttataaagcc

SEQ ID NO: 5969925 - DNA, 20 bp, Homo sapiens
tatcaatagtcaagaaaaat

SEQ ID NO: 5969926 - DNA, 14 bp, Homo sapiens
tatcaatatctaat

SEQ ID NO: 5969927 - DNA, 20 bp, Homo sapiens
tatcaatccaaattccctct

SEQ ID NO: 5969928 - DNA, 22 bp, Homo sapiens
tatcaatgtgtctttctaagaa

SEQ ID NO: 5969929 - DNA, 19 bp, Homo sapiens
tatcaattgcaaaatgcgt

SEQ ID NO: 5969930 - DNA, 15 bp, Homo sapiens
tatcaatttctaatg

SEQ ID NO: 5969931 - DNA, 19 bp, Homo sapiens
tatcaatttgtcattttga

SEQ ID NO: 5969932 - DNA, 20 bp, Homo sapiens
tatcaatttgtcattttgaa

SEQ ID NO: 5969933 - DNA, 17 bp, Homo sapiens
tatcaattttaaggaaa

SEQ ID NO: 5969934 - DNA, 20 bp, Homo sapiens
tatcaatttttcccagtatt

SEQ ID NO: 5969935 - DNA, 22 bp, Homo sapiens
tatcaatttttcccagtatttt

SEQ ID NO: 5969936 - DNA, 22 bp, Homo sapiens
tatcacaatgtactatatgtat

SEQ ID NO: 5969937 - DNA, 15 bp, Homo sapiens
tatcacacaatatag

SEQ ID NO: 5969938 - DNA, 13 bp, Homo sapiens
tatcacacacatt

SEQ ID NO: 5969939 - DNA, 21 bp, Homo sapiens
tatcacacactttctgactgc

SEQ ID NO: 5969940 - DNA, 17 bp, Homo sapiens
tatcacaccagttactt

SEQ ID NO: 5969941 - DNA, 17 bp, Homo sapiens
tatcacacttctgtgag

SEQ ID NO: 5969942 - DNA, 16 bp, Homo sapiens
tatcacactttaatgt

SEQ ID NO: 5969943 - DNA, 21 bp, Homo sapiens
tatcacagactctgctagtga

SEQ ID NO: 5969944 - DNA, 13 bp, Homo sapiens
tatcacaggccag

SEQ ID NO: 5969945 - DNA, 17 bp, Homo sapiens
tatcacagtattatctg

SEQ ID NO: 5969946 - DNA, 18 bp, Homo sapiens
tatcacagtattatctgt

SEQ ID NO: 5969947 - DNA, 20 bp, Homo sapiens
tatcacagtattatctgtgt

SEQ ID NO: 5969948 - DNA, 16 bp, Homo sapiens
tatcacagtctaattt

SEQ ID NO: 5969949 - DNA, 20 bp, Homo sapiens
tatcacagtctaatttttat

SEQ ID NO: 5969950 - DNA, 15 bp, Homo sapiens
tatcacatacaattt

SEQ ID NO: 5969951 - DNA, 21 bp, Homo sapiens
tatcacatgtatgttttggta

SEQ ID NO: 5969952 - DNA, 22 bp, Homo sapiens
tatcacatgtcagccactgtga

SEQ ID NO: 5969953 - DNA, 18 bp, Homo sapiens
tatcacattaatctcaaa

SEQ ID NO: 5969954 - DNA, 13 bp, Homo sapiens
tatcacattgaat

SEQ ID NO: 5969955 - DNA, 23 bp, Homo sapiens
tatcacattttattaaacacagg

SEQ ID NO: 5969956 - DNA, 17 bp, Homo sapiens
tatcaccagctgcctct

SEQ ID NO: 5969957 - DNA, 16 bp, Homo sapiens
tatcaccatagttttg

SEQ ID NO: 5969958 - DNA, 18 bp, Homo sapiens
tatcacccagaagaaaat

SEQ ID NO: 5969959 - DNA, 16 bp, Homo sapiens
gttttcaggtccagag

SEQ ID NO: 5969960 - DNA, 22 bp, Homo sapiens
gttttcaggttgcccatttata

SEQ ID NO: 5969961 - DNA, 17 bp, Homo sapiens
gttttcagtgtacatgg

SEQ ID NO: 5969962 - DNA, 17 bp, Homo sapiens
gttttcatattgcttct

SEQ ID NO: 5969963 - DNA, 18 bp, Homo sapiens
gttttcatattgcttctc

SEQ ID NO: 5969964 - DNA, 13 bp, Homo sapiens
gttttcatcattt

SEQ ID NO: 5969965 - DNA, 16 bp, Homo sapiens
gttttcatcctggcct

SEQ ID NO: 5969966 - DNA, 18 bp, Homo sapiens
gttttcatcctggcctcc

SEQ ID NO: 5969967 - DNA, 16 bp, Homo sapiens
gttttcatgagctgag

SEQ ID NO: 5969968 - DNA, 16 bp, Homo sapiens
gttttcattatgttca

SEQ ID NO: 5969969 - DNA, 22 bp, Homo sapiens
gttttcattatgttcatgtaag

SEQ ID NO: 5969970 - DNA, 17 bp, Homo sapiens
gttttcatttacaggaa

SEQ ID NO: 5969971 - DNA, 12 bp, Homo sapiens
gttttcatttgc

SEQ ID NO: 5969972 - DNA, 17 bp, Homo sapiens
gttttcatttggttcat

SEQ ID NO: 5969973 - DNA, 15 bp, Homo sapiens
gttttccaaaagaac

SEQ ID NO: 5969974 - DNA, 18 bp, Homo sapiens
gttttccaaagataatgt

SEQ ID NO: 5969975 - DNA, 17 bp, Homo sapiens
gttttccaagccctcag

SEQ ID NO: 5969976 - DNA, 23 bp, Homo sapiens
gttttccacccataatcctttct

SEQ ID NO: 5969977 - DNA, 14 bp, Homo sapiens
gttttccaccctgg

SEQ ID NO: 5969978 - DNA, 16 bp, Homo sapiens
gttttccaccctggaa

SEQ ID NO: 5969979 - DNA, 15 bp, Homo sapiens
gttttccactgtgct

SEQ ID NO: 5969980 - DNA, 20 bp, Homo sapiens
gttttccaggtcctcagatg

SEQ ID NO: 5969981 - DNA, 20 bp, Homo sapiens
gttttccaggtttaagctgt

SEQ ID NO: 5969982 - DNA, 14 bp, Homo sapiens
gttttccatgaaaa

SEQ ID NO: 5969983 - DNA, 22 bp, Homo sapiens
gttttcccacacatattcaaat

SEQ ID NO: 5969984 - DNA, 23 bp, Homo sapiens
gttttccccacattctatagcca

SEQ ID NO: 5969985 - DNA, 15 bp, Homo sapiens
gttttccccatgaca

SEQ ID NO: 5969986 - DNA, 17 bp, Homo sapiens
gttttcccctccctggg

SEQ ID NO: 5969987 - DNA, 14 bp, Homo sapiens
gttttcccctggcc

SEQ ID NO: 5969988 - DNA, 14 bp, Homo sapiens
gttttccctctgct

SEQ ID NO: 5969989 - DNA, 18 bp, Homo sapiens
gttttccctgttctggac

SEQ ID NO: 5969990 - DNA, 18 bp, Homo sapiens
gttttccgaagtctctga

SEQ ID NO: 5969991 - DNA, 21 bp, Homo sapiens
gttttccgcattctttgtaca

SEQ ID NO: 5969992 - DNA, 22 bp, Homo sapiens
gttttcctcatcctttccctct

SEQ ID NO: 5969993 - DNA, 23 bp, Homo sapiens
gttttcctcctgattctcttaaa

SEQ ID NO: 5969994 - DNA, 17 bp, Homo sapiens
gttttcctctcaataaa

SEQ ID NO: 5969995 - DNA, 19 bp, Homo sapiens
gttttcctgctttacaaaa

SEQ ID NO: 5969996 - DNA, 18 bp, Homo sapiens
gttttcctgtataggaat

SEQ ID NO: 5969997 - DNA, 16 bp, Homo sapiens
gttttccttcttccca

SEQ ID NO: 5969998 - DNA, 22 bp, Homo sapiens
gttttccttgaccactggccct

SEQ ID NO: 5969999 - DNA, 19 bp, Homo sapiens
gttttccttgtgactaagt

SEQ ID NO: 5970000 - DNA, 17 bp, Homo sapiens
gttttcctttctcaccg

SEQ ID NO: 5970001 - DNA, 20 bp, Homo sapiens
gttttccttttattcacata

SEQ ID NO: 5970002 - DNA, 14 bp, Homo sapiens
gttttcgaaaatca

SEQ ID NO: 5970003 - DNA, 16 bp, Homo sapiens
gttttcgaaaatcaaa

SEQ ID NO: 5970004 - DNA, 16 bp, Homo sapiens
gttttcgcaaatgttg

SEQ ID NO: 5970005 - DNA, 22 bp, Homo sapiens
gttttcggtgccatcagtgccc

SEQ ID NO: 5970006 - DNA, 23 bp, Homo sapiens
gttttcgtcacaggagtctttgt

SEQ ID NO: 5970007 - DNA, 15 bp, Homo sapiens
gttttctaaagccag

SEQ ID NO: 5970008 - DNA, 22 bp, Homo sapiens
gttttctaaaggatgctgctgt

SEQ ID NO: 5970009 - DNA, 14 bp, Homo sapiens
gttttctaaattta

SEQ ID NO: 5970010 - DNA, 20 bp, Homo sapiens
gttttctaactgtaaatcac

SEQ ID NO: 5970011 - DNA, 23 bp, Homo sapiens
gttttctaactgtaaatcacttg

SEQ ID NO: 5970012 - DNA, 14 bp, Homo sapiens
gttttctaattgct

SEQ ID NO: 5970013 - DNA, 15 bp, Homo sapiens
gttttctaattgtac

SEQ ID NO: 5970014 - DNA, 13 bp, Homo sapiens
gttttctactttg

SEQ ID NO: 5970015 - DNA, 14 bp, Homo sapiens
gttttctactttga

SEQ ID NO: 5970016 - DNA, 15 bp, Homo sapiens
gttttctactttgaa

SEQ ID NO: 5970017 - DNA, 16 bp, Homo sapiens
gttttctatcagacgt

SEQ ID NO: 5970018 - DNA, 15 bp, Homo sapiens
gttttctatgaatct

SEQ ID NO: 5970019 - DNA, 15 bp, Homo sapiens
gttttctatgtgact

SEQ ID NO: 5970020 - DNA, 23 bp, Homo sapiens
gttttctcaacaaatggaatgcc

SEQ ID NO: 5970021 - DNA, 17 bp, Homo sapiens
gttttctcagaacagct

SEQ ID NO: 5970022 - DNA, 17 bp, Homo sapiens
gttttctcctctgcttc

SEQ ID NO: 5970023 - DNA, 20 bp, Homo sapiens
gttttctccttcccttcttt

SEQ ID NO: 5970024 - DNA, 21 bp, Homo sapiens
gttttctccttcccttctttg

SEQ ID NO: 5970025 - DNA, 14 bp, Homo sapiens
gttttctctctgga

SEQ ID NO: 5970026 - DNA, 17 bp, Homo sapiens
gttttctctctggatgg

SEQ ID NO: 5970027 - DNA, 21 bp, Homo sapiens
gttttctcttccttgtgattg

SEQ ID NO: 5970028 - DNA, 19 bp, Homo sapiens
gttttctcttgagagggtg

SEQ ID NO: 5970029 - DNA, 20 bp, Homo sapiens
gttttctctttgtggggctt

SEQ ID NO: 5970030 - DNA, 16 bp, Homo sapiens
gttttctgagaaagac

SEQ ID NO: 5970031 - DNA, 22 bp, Homo sapiens
gttttctgagaaagactattca

SEQ ID NO: 5970032 - DNA, 16 bp, Homo sapiens
gttttctgagggaaag

SEQ ID NO: 5970033 - DNA, 22 bp, Homo sapiens
gttttctgatggccaaaatacc

SEQ ID NO: 5970034 - DNA, 23 bp, Homo sapiens
gttttctgatggccaaaatacca

SEQ ID NO: 5970035 - DNA, 13 bp, Homo sapiens
gttttctgctgtt

SEQ ID NO: 5970036 - DNA, 15 bp, Homo sapiens
gttttctgctgttta

SEQ ID NO: 5970037 - DNA, 16 bp, Homo sapiens
gttttctgctttaaat

SEQ ID NO: 5970038 - DNA, 18 bp, Homo sapiens
gttttctggctggagcct

SEQ ID NO: 5970039 - DNA, 21 bp, Homo sapiens
gtttttacctaccacagtgtc

SEQ ID NO: 5970040 - DNA, 20 bp, Homo sapiens
gtttttacctgtcacattgc

SEQ ID NO: 5970041 - DNA, 21 bp, Homo sapiens
gtttttacctgtcacattgca

SEQ ID NO: 5970042 - DNA, 15 bp, Homo sapiens
gtttttactagaaat

SEQ ID NO: 5970043 - DNA, 22 bp, Homo sapiens
gtttttactcaaccaaattaaa

SEQ ID NO: 5970044 - DNA, 23 bp, Homo sapiens
gtttttagaacatgtaaaatgtt

SEQ ID NO: 5970045 - DNA, 21 bp, Homo sapiens
gtttttagaggggcaaaaata

SEQ ID NO: 5970046 - DNA, 17 bp, Homo sapiens
gtttttagctttgtgtt

SEQ ID NO: 5970047 - DNA, 20 bp, Homo sapiens
gtttttaggctgttccttgt

SEQ ID NO: 5970048 - DNA, 17 bp, Homo sapiens
gtttttagttctgactt

SEQ ID NO: 5970049 - DNA, 19 bp, Homo sapiens
gtttttagttctgactttg

SEQ ID NO: 5970050 - DNA, 11 bp, Homo sapiens
gtttttagttt

SEQ ID NO: 5970051 - DNA, 18 bp, Homo sapiens
gtttttataaaaaatggt

SEQ ID NO: 5970052 - DNA, 17 bp, Homo sapiens
gtttttataaaaacatt

SEQ ID NO: 5970053 - DNA, 17 bp, Homo sapiens
gtttttataatattcat

SEQ ID NO: 5970054 - DNA, 20 bp, Homo sapiens
gtttttatatagtctacagt

SEQ ID NO: 5970055 - DNA, 16 bp, Homo sapiens
gtttttatctttgacc

SEQ ID NO: 5970056 - DNA, 12 bp, Homo sapiens
gtttttatgaac

SEQ ID NO: 5970057 - DNA, 17 bp, Homo sapiens
gtttttatgagaaactt

SEQ ID NO: 5970058 - DNA, 20 bp, Homo sapiens
gtttttatgatatccctgat

SEQ ID NO: 5970059 - DNA, 23 bp, Homo sapiens
gtttttatggcttttgtgcatta

SEQ ID NO: 5970060 - DNA, 16 bp, Homo sapiens
gtttttattaaaacat

SEQ ID NO: 5970061 - DNA, 17 bp, Homo sapiens
gtttttattaaaaggaa

SEQ ID NO: 5970062 - DNA, 17 bp, Homo sapiens
gtttttattaatttata

SEQ ID NO: 5970063 - DNA, 15 bp, Homo sapiens
gtttttattattaac

SEQ ID NO: 5970064 - DNA, 17 bp, Homo sapiens
gtttttattcaaagcag

SEQ ID NO: 5970065 - DNA, 16 bp, Homo sapiens
gtttttattccttgtg

SEQ ID NO: 5970066 - DNA, 23 bp, Homo sapiens
gtttttatttcaattgtttatat

SEQ ID NO: 5970067 - DNA, 16 bp, Homo sapiens
gtttttatttctcctt

SEQ ID NO: 5970068 - DNA, 17 bp, Homo sapiens
gtttttatttctccttt

SEQ ID NO: 5970069 - DNA, 13 bp, Homo sapiens
gtttttatttctt

SEQ ID NO: 5970070 - DNA, 16 bp, Homo sapiens
gtttttatttctttta

SEQ ID NO: 5970071 - DNA, 15 bp, Homo sapiens
gtttttcaattaaac

SEQ ID NO: 5970072 - DNA, 16 bp, Homo sapiens
gtttttcaattaaacg

SEQ ID NO: 5970073 - DNA, 17 bp, Homo sapiens
gtttttcaattaaacgg

SEQ ID NO: 5970074 - DNA, 19 bp, Homo sapiens
gtttttcaattaaacggat

SEQ ID NO: 5970075 - DNA, 20 bp, Homo sapiens
gtttttcaccacttcactga

SEQ ID NO: 5970076 - DNA, 14 bp, Homo sapiens
gtttttcacttcta

SEQ ID NO: 5970077 - DNA, 11 bp, Homo sapiens
gtttttcagaa

SEQ ID NO: 5970078 - DNA, 20 bp, Homo sapiens
gtttttcagcacccccaccc

SEQ ID NO: 5970079 - DNA, 20 bp, Homo sapiens
gtttttcagttcaaagtcat

SEQ ID NO: 5970080 - DNA, 14 bp, Homo sapiens
gtttttcagttttc

SEQ ID NO: 5970081 - DNA, 21 bp, Homo sapiens
gtttttcatactcttaagtgt

SEQ ID NO: 5970082 - DNA, 21 bp, Homo sapiens
gtttttcatactgtacacatt

SEQ ID NO: 5970083 - DNA, 20 bp, Homo sapiens
gtttttcatcttttgaagag

SEQ ID NO: 5970084 - DNA, 13 bp, Homo sapiens
gtttttcatgttt

SEQ ID NO: 5970085 - DNA, 21 bp, Homo sapiens
gtttttcatgttttagcattt

SEQ ID NO: 5970086 - DNA, 12 bp, Homo sapiens
gtttttcattca

SEQ ID NO: 5970087 - DNA, 15 bp, Homo sapiens
gtttttcatttgttt

SEQ ID NO: 5970088 - DNA, 21 bp, Homo sapiens
gtttttcatttgttttgcttt

SEQ ID NO: 5970089 - DNA, 16 bp, Homo sapiens
gtttttcattttaaaa

SEQ ID NO: 5970090 - DNA, 17 bp, Homo sapiens
gtttttccactactgct

SEQ ID NO: 5970091 - DNA, 23 bp, Homo sapiens
gtttttcccacgtctaactggaa

SEQ ID NO: 5970092 - DNA, 16 bp, Homo sapiens
gtttttccctccccag

SEQ ID NO: 5970093 - DNA, 13 bp, Homo sapiens
gtttttcctccca

SEQ ID NO: 5970094 - DNA, 14 bp, Homo sapiens
gtttttcctggaat

SEQ ID NO: 5970095 - DNA, 14 bp, Homo sapiens
gtttttcctttaaa

SEQ ID NO: 5970096 - DNA, 13 bp, Homo sapiens
gtttttcctttct

SEQ ID NO: 5970097 - DNA, 14 bp, Homo sapiens
gtttttcctttctt

SEQ ID NO: 5970098 - DNA, 16 bp, Homo sapiens
gtttttcggacagttt

SEQ ID NO: 5970099 - DNA, 12 bp, Homo sapiens
gtttttctacta

SEQ ID NO: 5970100 - DNA, 11 bp, Homo sapiens
gtttttctatt

SEQ ID NO: 5970101 - DNA, 21 bp, Homo sapiens
gtttttctattaaaagactca

SEQ ID NO: 5970102 - DNA, 11 bp, Homo sapiens
gtttttctcaa

SEQ ID NO: 5970103 - DNA, 17 bp, Homo sapiens
gtttttctcatgtatct

SEQ ID NO: 5970104 - DNA, 16 bp, Homo sapiens
gtttttctccagtgct

SEQ ID NO: 5970105 - DNA, 15 bp, Homo sapiens
gtttttctgatatgt

SEQ ID NO: 5970106 - DNA, 20 bp, Homo sapiens
gtttttctgtgtgtcagttt

SEQ ID NO: 5970107 - DNA, 20 bp, Homo sapiens
gtttttcttaaataataaag

SEQ ID NO: 5970108 - DNA, 22 bp, Homo sapiens
gtttttcttcaacatcaatgtt

SEQ ID NO: 5970109 - DNA, 14 bp, Homo sapiens
gtttttcttcagca

SEQ ID NO: 5970110 - DNA, 21 bp, Homo sapiens
gtttttctttaatatgattct

SEQ ID NO: 5970111 - DNA, 20 bp, Homo sapiens
gtttttcttttcttggacac

SEQ ID NO: 5970112 - DNA, 19 bp, Homo sapiens
gtttttgaaaaaaagtgct

SEQ ID NO: 5970113 - DNA, 14 bp, Homo sapiens
gtttttgaaacaga

SEQ ID NO: 5970114 - DNA, 17 bp, Homo sapiens
gtttttgaaacagaacc

SEQ ID NO: 5970115 - DNA, 18 bp, Homo sapiens
gtttttgaaacccacagt

SEQ ID NO: 5970116 - DNA, 18 bp, Homo sapiens
gtttttgacatttatatt

SEQ ID NO: 5970117 - DNA, 12 bp, Homo sapiens
gtttttgagact

SEQ ID NO: 5970118 - DNA, 13 bp, Homo sapiens
gtttttgagactg

SEQ ID NO: 5970119 - DNA, 18 bp, Homo sapiens
gtttttgatagctttatt

SEQ ID NO: 5970120 - DNA, 15 bp, Homo sapiens
gtttttgcactgtct

SEQ ID NO: 5970121 - DNA, 12 bp, Homo sapiens
gtttttgcattt

SEQ ID NO: 5970122 - DNA, 18 bp, Homo sapiens
gtttttgccactgattta

SEQ ID NO: 5970123 - DNA, 17 bp, Homo sapiens
gtttttgcccatcctcc

SEQ ID NO: 5970124 - DNA, 13 bp, Homo sapiens
gtttttgctgcag

SEQ ID NO: 5970125 - DNA, 17 bp, Homo sapiens
gtttttgctgcagagaa

SEQ ID NO: 5970126 - DNA, 13 bp, Homo sapiens
gtttttgctggct

SEQ ID NO: 5970127 - DNA, 11 bp, Homo sapiens
gtttttgctgt

SEQ ID NO: 5970128 - DNA, 15 bp, Homo sapiens
gtttttgcttcaagt

SEQ ID NO: 5970129 - DNA, 23 bp, Homo sapiens
gtttttgctttctgaaattcaca

SEQ ID NO: 5970130 - DNA, 17 bp, Homo sapiens
gtttttggaaaaacctt

SEQ ID NO: 5970131 - DNA, 17 bp, Homo sapiens
gtttttggaaaatgtat

SEQ ID NO: 5970132 - DNA, 24 bp, Homo sapiens
gtttttggatggtgttacatatta

SEQ ID NO: 5970133 - DNA, 19 bp, Homo sapiens
gtttttggattgtcaaaga

SEQ ID NO: 5970134 - DNA, 12 bp, Homo sapiens
gtttttggctga

SEQ ID NO: 5970135 - DNA, 17 bp, Homo sapiens
gtttttgggatgtctta

SEQ ID NO: 5970136 - DNA, 16 bp, Homo sapiens
gtttttggggacactg

SEQ ID NO: 5970137 - DNA, 18 bp, Homo sapiens
gtttttggtttttaaaac

SEQ ID NO: 5970138 - DNA, 19 bp, Homo sapiens
gtttttgtaaagaaaaata

SEQ ID NO: 5970139 - DNA, 15 bp, Homo sapiens
gtttttgtaaagtgt

SEQ ID NO: 5970140 - DNA, 13 bp, Homo sapiens
tatcatctttgcc

SEQ ID NO: 5970141 - DNA, 17 bp, Homo sapiens
tatcatgaaacacttct

SEQ ID NO: 5970142 - DNA, 23 bp, Homo sapiens
tatcatgaaacacttctcatcat

SEQ ID NO: 5970143 - DNA, 16 bp, Homo sapiens
tatcatgaagcctgtg

SEQ ID NO: 5970144 - DNA, 19 bp, Homo sapiens
tatcatgaattttaaagta

SEQ ID NO: 5970145 - DNA, 16 bp, Homo sapiens
tatcatgacaaagact

SEQ ID NO: 5970146 - DNA, 13 bp, Homo sapiens
tatcatgcaaaat

SEQ ID NO: 5970147 - DNA, 15 bp, Homo sapiens
tatcatgcaaaatat

SEQ ID NO: 5970148 - DNA, 18 bp, Homo sapiens
tatcatgcccctgtactc

SEQ ID NO: 5970149 - DNA, 19 bp, Homo sapiens
tatcatgcttctactccat

SEQ ID NO: 5970150 - DNA, 18 bp, Homo sapiens
tatcatggaaatattatg

SEQ ID NO: 5970151 - DNA, 15 bp, Homo sapiens
tatcatggaagaaaa

SEQ ID NO: 5970152 - DNA, 15 bp, Homo sapiens
tatcatggaatattt

SEQ ID NO: 5970153 - DNA, 22 bp, Homo sapiens
tatcatggaatttccattgaca

SEQ ID NO: 5970154 - DNA, 16 bp, Homo sapiens
tatcatggtaatgaca

SEQ ID NO: 5970155 - DNA, 19 bp, Homo sapiens
tatcatggtatttgaccat

SEQ ID NO: 5970156 - DNA, 19 bp, Homo sapiens
tatcatggtcctgaatgta

SEQ ID NO: 5970157 - DNA, 12 bp, Homo sapiens
tatcatggtctc

SEQ ID NO: 5970158 - DNA, 12 bp, Homo sapiens
tatcatgtacct

SEQ ID NO: 5970159 - DNA, 14 bp, Homo sapiens
tatcatgtatctct

SEQ ID NO: 5970160 - DNA, 12 bp, Homo sapiens
tatcatgtatgg

SEQ ID NO: 5970161 - DNA, 18 bp, Homo sapiens
tatcatgtcttgtgcata

SEQ ID NO: 5970162 - DNA, 17 bp, Homo sapiens
tatcatgtgaaatcatt

SEQ ID NO: 5970163 - DNA, 13 bp, Homo sapiens
tatcatgtgtttc

SEQ ID NO: 5970164 - DNA, 15 bp, Homo sapiens
tatcatgttaaatta

SEQ ID NO: 5970165 - DNA, 16 bp, Homo sapiens
tatcatgttagtaata

SEQ ID NO: 5970166 - DNA, 20 bp, Homo sapiens
tatcatgttagtaatacctc

SEQ ID NO: 5970167 - DNA, 18 bp, Homo sapiens
tatcatgttttataattt

SEQ ID NO: 5970168 - DNA, 16 bp, Homo sapiens
tatcattaaaaattac

SEQ ID NO: 5970169 - DNA, 18 bp, Homo sapiens
tatcattaaaagaacata

SEQ ID NO: 5970170 - DNA, 22 bp, Homo sapiens
tatcattaaaatatatgttctg

SEQ ID NO: 5970171 - DNA, 16 bp, Homo sapiens
tatcattaaacatgaa

SEQ ID NO: 5970172 - DNA, 14 bp, Homo sapiens
tatcattaaagttc

SEQ ID NO: 5970173 - DNA, 19 bp, Homo sapiens
tatcattaatttttaattg

SEQ ID NO: 5970174 - DNA, 18 bp, Homo sapiens
tatcattatctttgctgt

SEQ ID NO: 5970175 - DNA, 18 bp, Homo sapiens
tatcattcattcttagct

SEQ ID NO: 5970176 - DNA, 14 bp, Homo sapiens
tatcattccaaagg

SEQ ID NO: 5970177 - DNA, 19 bp, Homo sapiens
tatcattccaattctaaat

SEQ ID NO: 5970178 - DNA, 21 bp, Homo sapiens
tatcattcttataacattgta

SEQ ID NO: 5970179 - DNA, 22 bp, Homo sapiens
tatcattcttataacattgtat

SEQ ID NO: 5970180 - DNA, 18 bp, Homo sapiens
tatcattctttgtatctt

SEQ ID NO: 5970181 - DNA, 19 bp, Homo sapiens
tatcattctttgtatctta

SEQ ID NO: 5970182 - DNA, 18 bp, Homo sapiens
tatcattgaaacatttat

SEQ ID NO: 5970183 - DNA, 19 bp, Homo sapiens
tatcattgaaacatttata

SEQ ID NO: 5970184 - DNA, 19 bp, Homo sapiens
tatcattgcttcctcctcc

SEQ ID NO: 5970185 - DNA, 19 bp, Homo sapiens
tatcatttaataatatact

SEQ ID NO: 5970186 - DNA, 17 bp, Homo sapiens
tatcatttcataaaaat

SEQ ID NO: 5970187 - DNA, 14 bp, Homo sapiens
tatcatttcatgct

SEQ ID NO: 5970188 - DNA, 13 bp, Homo sapiens
tatcatttctact

SEQ ID NO: 5970189 - DNA, 17 bp, Homo sapiens
tatcatttcttaaccca

SEQ ID NO: 5970190 - DNA, 18 bp, Homo sapiens
tatcatttgagtgaatgt

SEQ ID NO: 5970191 - DNA, 23 bp, Homo sapiens
tatcatttggccgagtcagcacg

SEQ ID NO: 5970192 - DNA, 14 bp, Homo sapiens
tatcatttgtgaag

SEQ ID NO: 5970193 - DNA, 14 bp, Homo sapiens
tatcattttaaaaa

SEQ ID NO: 5970194 - DNA, 21 bp, Homo sapiens
tatcattttaaaaactttatt

SEQ ID NO: 5970195 - DNA, 18 bp, Homo sapiens
tatcattttaaaatgtct

SEQ ID NO: 5970196 - DNA, 20 bp, Homo sapiens
tatcattttaaaatgtcttg

SEQ ID NO: 5970197 - DNA, 21 bp, Homo sapiens
tatcattttccaattaattat

SEQ ID NO: 5970198 - DNA, 15 bp, Homo sapiens
tatcatttttgtaca

SEQ ID NO: 5970199 - DNA, 17 bp, Homo sapiens
tatcatttttgtataaa

SEQ ID NO: 5970200 - DNA, 18 bp, Homo sapiens
tatcatttttgtataaaa

SEQ ID NO: 5970201 - DNA, 19 bp, Homo sapiens
tatcatttttgtataaaaa

SEQ ID NO: 5970202 - DNA, 17 bp, Homo sapiens
tatcatttttgtgcaca

SEQ ID NO: 5970203 - DNA, 13 bp, Homo sapiens
tatccaaaagctt

SEQ ID NO: 5970204 - DNA, 18 bp, Homo sapiens
tatccaaaatgtgtattt

SEQ ID NO: 5970205 - DNA, 22 bp, Homo sapiens
tatccaaaatgtgtatttctta

SEQ ID NO: 5970206 - DNA, 19 bp, Homo sapiens
tatccaaaccaaataaaaa

SEQ ID NO: 5970207 - DNA, 20 bp, Homo sapiens
tatccaaagaacttgatttg

SEQ ID NO: 5970208 - DNA, 18 bp, Homo sapiens
tatccaaagactgtactg

SEQ ID NO: 5970209 - DNA, 21 bp, Homo sapiens
tatccaaagactgtactggcc

SEQ ID NO: 5970210 - DNA, 17 bp, Homo sapiens
tatccaaatctgaagat

SEQ ID NO: 5970211 - DNA, 21 bp, Homo sapiens
tatccaaggaaacattttatc

SEQ ID NO: 5970212 - DNA, 20 bp, Homo sapiens
tatccaagtaccaatgctgt

SEQ ID NO: 5970213 - DNA, 14 bp, Homo sapiens
tatccaatgaaata

SEQ ID NO: 5970214 - DNA, 17 bp, Homo sapiens
tatccaattcattatgt

SEQ ID NO: 5970215 - DNA, 15 bp, Homo sapiens
tatccaattgctgct

SEQ ID NO: 5970216 - DNA, 17 bp, Homo sapiens
tatccaattttgatctt

SEQ ID NO: 5970217 - DNA, 19 bp, Homo sapiens
tatccaattttgatctttt

SEQ ID NO: 5970218 - DNA, 19 bp, Homo sapiens
tctatgactgaagtactgg

SEQ ID NO: 5970219 - DNA, 22 bp, Homo sapiens
tctatgagaacaagtcacagct

SEQ ID NO: 5970220 - DNA, 18 bp, Homo sapiens
tctatgagtctagatgtt

SEQ ID NO: 5970221 - DNA, 20 bp, Homo sapiens
tctatgagttggacttcagt

SEQ ID NO: 5970222 - DNA, 15 bp, Homo sapiens
tctatgatatacaac

SEQ ID NO: 5970223 - DNA, 13 bp, Homo sapiens
tctatgatcagaa

SEQ ID NO: 5970224 - DNA, 19 bp, Homo sapiens
tctatgatccttttttgtc

SEQ ID NO: 5970225 - DNA, 15 bp, Homo sapiens
tctatgatgctgttg

SEQ ID NO: 5970226 - DNA, 12 bp, Homo sapiens
tctatgatgttg

SEQ ID NO: 5970227 - DNA, 14 bp, Homo sapiens
tctatgatgttgct

SEQ ID NO: 5970228 - DNA, 15 bp, Homo sapiens
tcaacttatttcata

SEQ ID NO: 5970229 - DNA, 17 bp, Homo sapiens
tcaacttatttcataat

SEQ ID NO: 5970230 - DNA, 16 bp, Homo sapiens
tcaacttctggctcct

SEQ ID NO: 5970231 - DNA, 18 bp, Homo sapiens
tcaacttctggctcctca

SEQ ID NO: 5970232 - DNA, 13 bp, Homo sapiens
tcaacttcttcta

SEQ ID NO: 5970233 - DNA, 16 bp, Homo sapiens
tcaacttgacaccact

SEQ ID NO: 5970234 - DNA, 20 bp, Homo sapiens
tcaacttgagcatgttactg

SEQ ID NO: 5970235 - DNA, 17 bp, Homo sapiens
tcaacttggaaaaagaa

SEQ ID NO: 5970236 - DNA, 14 bp, Homo sapiens
tcaactttactgta

SEQ ID NO: 5970237 - DNA, 20 bp, Homo sapiens
tcaactttactgtaatataa

SEQ ID NO: 5970238 - DNA, 15 bp, Homo sapiens
tcaactttcatttga

SEQ ID NO: 5970239 - DNA, 23 bp, Homo sapiens
tcaactttctgttggattccatg

SEQ ID NO: 5970240 - DNA, 18 bp, Homo sapiens
tcaactttgaataaagaa

SEQ ID NO: 5970241 - DNA, 13 bp, Homo sapiens
tcaactttgtaaa

SEQ ID NO: 5970242 - DNA, 14 bp, Homo sapiens
tcaacttttgaaat

SEQ ID NO: 5970243 - DNA, 20 bp, Homo sapiens
tcaactttttattgccttct

SEQ ID NO: 5970244 - DNA, 14 bp, Homo sapiens
tcaacttttttccc

SEQ ID NO: 5970245 - DNA, 23 bp, Homo sapiens
tcaagaaaaaataaatggaaatc

SEQ ID NO: 5970246 - DNA, 17 bp, Homo sapiens
tcaagaaaacaacttca

SEQ ID NO: 5970247 - DNA, 19 bp, Homo sapiens
tcaagaaaacaggcactgc

SEQ ID NO: 5970248 - DNA, 22 bp, Homo sapiens
tcaagaaaagcatgaaaactga

SEQ ID NO: 5970249 - DNA, 14 bp, Homo sapiens
tcaagaaaataagt

SEQ ID NO: 5970250 - DNA, 17 bp, Homo sapiens
tcaagaaaattttgcag

SEQ ID NO: 5970251 - DNA, 12 bp, Homo sapiens
tcaagaaacagc

SEQ ID NO: 5970252 - DNA, 20 bp, Homo sapiens
tcaagaaacagccagcaaga

SEQ ID NO: 5970253 - DNA, 13 bp, Homo sapiens
tcaagaaactgag

SEQ ID NO: 5970254 - DNA, 17 bp, Homo sapiens
tcaagaaagccagtctt

SEQ ID NO: 5970255 - DNA, 13 bp, Homo sapiens
tcaagaaaggaaa

SEQ ID NO: 5970256 - DNA, 19 bp, Homo sapiens
tcaagaaaggcaagagctc

SEQ ID NO: 5970257 - DNA, 15 bp, Homo sapiens
tcaagaaaggcccgg

SEQ ID NO: 5970258 - DNA, 22 bp, Homo sapiens
tcaagaaataaaaggaagccaa

SEQ ID NO: 5970259 - DNA, 22 bp, Homo sapiens
tcaagaaatatactctcccaga

SEQ ID NO: 5970260 - DNA, 11 bp, Homo sapiens
tcaagaaatga

SEQ ID NO: 5970261 - DNA, 14 bp, Homo sapiens
tcaagaaatgaaga

SEQ ID NO: 5970262 - DNA, 15 bp, Homo sapiens
tcaagaaatgaagag

SEQ ID NO: 5970263 - DNA, 16 bp, Homo sapiens
tcaagaaatgaagagc

SEQ ID NO: 5970264 - DNA, 22 bp, Homo sapiens
tcaagaaatgacagtcaaaaga

SEQ ID NO: 5970265 - DNA, 17 bp, Homo sapiens
tcaagaaatgagtctgt

SEQ ID NO: 5970266 - DNA, 23 bp, Homo sapiens
tcaagaaatgctcgtcatacagt

SEQ ID NO: 5970267 - DNA, 16 bp, Homo sapiens
tcaagaaatgtctctg

SEQ ID NO: 5970268 - DNA, 20 bp, Homo sapiens
tcaagaacaaacactgcagt

SEQ ID NO: 5970269 - DNA, 14 bp, Homo sapiens
tcaagaactatata

SEQ ID NO: 5970270 - DNA, 19 bp, Homo sapiens
tcaagaagacatggagact

SEQ ID NO: 5970271 - DNA, 18 bp, Homo sapiens
tcaagaagatagttgtaa

SEQ ID NO: 5970272 - DNA, 23 bp, Homo sapiens
tcaagaagatagttgtaaagata

SEQ ID NO: 5970273 - DNA, 15 bp, Homo sapiens
tcaagaagggctgca

SEQ ID NO: 5970274 - DNA, 18 bp, Homo sapiens
tcaagaagggctgcatga

SEQ ID NO: 5970275 - DNA, 20 bp, Homo sapiens
tcaagaagggctgcatgatg

SEQ ID NO: 5970276 - DNA, 21 bp, Homo sapiens
tcaagaagtatttttttaatt

SEQ ID NO: 5970277 - DNA, 21 bp, Homo sapiens
tcaagaataatcacgctttcc

SEQ ID NO: 5970278 - DNA, 19 bp, Homo sapiens
tcaagaatagcattgtaaa

SEQ ID NO: 5970279 - DNA, 15 bp, Homo sapiens
tcaagaatattcaaa

SEQ ID NO: 5970280 - DNA, 14 bp, Homo sapiens
tcaagaatcattga

SEQ ID NO: 5970281 - DNA, 14 bp, Homo sapiens
tcaagaatcctctg

SEQ ID NO: 5970282 - DNA, 20 bp, Homo sapiens
tcaagaatctagaagatgtg

SEQ ID NO: 5970283 - DNA, 23 bp, Homo sapiens
tcaagaatctagaagatgtgtaa

SEQ ID NO: 5970284 - DNA, 15 bp, Homo sapiens
tcaagaatcttttgt

SEQ ID NO: 5970285 - DNA, 21 bp, Homo sapiens
tcaagaatgaaaaatataatg

SEQ ID NO: 5970286 - DNA, 16 bp, Homo sapiens
tcaagaatgcagtact

SEQ ID NO: 5970287 - DNA, 22 bp, Homo sapiens
tcaagaatggggatcacagaga

SEQ ID NO: 5970288 - DNA, 12 bp, Homo sapiens
tcaagaatgttt

SEQ ID NO: 5970289 - DNA, 15 bp, Homo sapiens
tcaagacaagagctg

SEQ ID NO: 5970290 - DNA, 16 bp, Homo sapiens
tcaagacaagagctgt

SEQ ID NO: 5970291 - DNA, 20 bp, Homo sapiens
tcaagacagatgagcaggag

SEQ ID NO: 5970292 - DNA, 21 bp, Homo sapiens
tcaagacagattgtgaagatt

SEQ ID NO: 5970293 - DNA, 14 bp, Homo sapiens
tcaagaccagagac

SEQ ID NO: 5970294 - DNA, 18 bp, Homo sapiens
tcaagaccagcctgtcca

SEQ ID NO: 5970295 - DNA, 20 bp, Homo sapiens
tcaagaccaggctgcagcct

SEQ ID NO: 5970296 - DNA, 22 bp, Homo sapiens
tcaagaccaggctgcagcctcc

SEQ ID NO: 5970297 - DNA, 18 bp, Homo sapiens
tcaagacctgagtatttt

SEQ ID NO: 5970298 - DNA, 16 bp, Homo sapiens
tcaagaccttctcccc

SEQ ID NO: 5970299 - DNA, 21 bp, Homo sapiens
tcaagacggatccacagtaat

SEQ ID NO: 5970300 - DNA, 15 bp, Homo sapiens
tcaagactatctaca

SEQ ID NO: 5970301 - DNA, 22 bp, Homo sapiens
tcaagactgactggcaccaaca

SEQ ID NO: 5970302 - DNA, 23 bp, Homo sapiens
tcaagactgactggcaccaacac

SEQ ID NO: 5970303 - DNA, 23 bp, Homo sapiens
tcaagactgtggtattggggtct

SEQ ID NO: 5970304 - DNA, 19 bp, Homo sapiens
tcaagactttagcttttcc

SEQ ID NO: 5970305 - DNA, 12 bp, Homo sapiens
tcaagactttga

SEQ ID NO: 5970306 - DNA, 14 bp, Homo sapiens
tcaagactttgatc

SEQ ID NO: 5970307 - DNA, 16 bp, Homo sapiens
tcaagactttgatcct

SEQ ID NO: 5970308 - DNA, 17 bp, Homo sapiens
tcaagactttgatcctt

SEQ ID NO: 5970309 - DNA, 20 bp, Homo sapiens
tcaagactttgatccttgga

SEQ ID NO: 5970310 - DNA, 13 bp, Homo sapiens
tcaagagaaaatg

SEQ ID NO: 5970311 - DNA, 11 bp, Homo sapiens
tcaagagaaac

SEQ ID NO: 5970312 - DNA, 12 bp, Homo sapiens
tcaagagaaact

SEQ ID NO: 5970313 - DNA, 16 bp, Homo sapiens
tcaagagaaacttcaa

SEQ ID NO: 5970314 - DNA, 15 bp, Homo sapiens
tcaagagaagaaaaa

SEQ ID NO: 5970315 - DNA, 17 bp, Homo sapiens
tcaagagaagaaaaaat

SEQ ID NO: 5970316 - DNA, 23 bp, Homo sapiens
tcaagagaagaaaaaattaagag

SEQ ID NO: 5970317 - DNA, 21 bp, Homo sapiens
tcaagagatctttctttccaa

SEQ ID NO: 5970318 - DNA, 18 bp, Homo sapiens
tcaagagatttaattaat

SEQ ID NO: 5970319 - DNA, 17 bp, Homo sapiens
tcaagagcatgcacatg

SEQ ID NO: 5970320 - DNA, 22 bp, Homo sapiens
tcaagagccctgtcagtagagt

SEQ ID NO: 5970321 - DNA, 16 bp, Homo sapiens
tcaagagccttaaaac

SEQ ID NO: 5970322 - DNA, 13 bp, Homo sapiens
tcaagagctgccc

SEQ ID NO: 5970323 - DNA, 20 bp, Homo sapiens
tcaagagcttccagaaatgc

SEQ ID NO: 5970324 - DNA, 17 bp, Homo sapiens
tcaagaggaaaagctaa

SEQ ID NO: 5970325 - DNA, 20 bp, Homo sapiens
tcaagaggaaaggcgccccc

SEQ ID NO: 5970326 - DNA, 23 bp, Homo sapiens
tcaagaggaaaggcgcccccgcc

SEQ ID NO: 5970327 - DNA, 15 bp, Homo sapiens
tcaagaggaatctgt

SEQ ID NO: 5970328 - DNA, 22 bp, Homo sapiens
tcaagaggaatctgtttctctg

SEQ ID NO: 5970329 - DNA, 23 bp, Homo sapiens
tcaagaggaatctgtttctctgc

SEQ ID NO: 5970330 - DNA, 21 bp, Homo sapiens
tcaagaggacaatctagctct

SEQ ID NO: 5970331 - DNA, 18 bp, Homo sapiens
tcaagaggcaaaggaatc

SEQ ID NO: 5970332 - DNA, 13 bp, Homo sapiens
tcaagaggcccag

SEQ ID NO: 5970333 - DNA, 15 bp, Homo sapiens
tcaagaggcccaggg

SEQ ID NO: 5970334 - DNA, 16 bp, Homo sapiens
tcaagaggcccaggga

SEQ ID NO: 5970335 - DNA, 17 bp, Homo sapiens
tcaagaggcccagggag

SEQ ID NO: 5970336 - DNA, 16 bp, Homo sapiens
tcaagaggcgtgtgca

SEQ ID NO: 5970337 - DNA, 21 bp, Homo sapiens
tcaagagggcactggtggccc

SEQ ID NO: 5970338 - DNA, 17 bp, Homo sapiens
tcaagagggtctgagga

SEQ ID NO: 5970339 - DNA, 21 bp, Homo sapiens
tcaagaggttctcgactggag

SEQ ID NO: 5970340 - DNA, 20 bp, Homo sapiens
tcaagagtgaattccctcac

SEQ ID NO: 5970341 - DNA, 18 bp, Homo sapiens
tcaagagtggggggagga

SEQ ID NO: 5970342 - DNA, 16 bp, Homo sapiens
tcaagagttaaactta

SEQ ID NO: 5970343 - DNA, 18 bp, Homo sapiens
tcaagagtttattattgt

SEQ ID NO: 5970344 - DNA, 15 bp, Homo sapiens
tcaagataaggagaa

SEQ ID NO: 5970345 - DNA, 18 bp, Homo sapiens
tcaagatacacttgtaaa

SEQ ID NO: 5970346 - DNA, 14 bp, Homo sapiens
tcaagatacatgtt

SEQ ID NO: 5970347 - DNA, 13 bp, Homo sapiens
tcaagatagaaag

SEQ ID NO: 5970348 - DNA, 15 bp, Homo sapiens
tcaagatattaaaat

SEQ ID NO: 5970349 - DNA, 15 bp, Homo sapiens
tcaagatattcaggt

SEQ ID NO: 5970350 - DNA, 24 bp, Homo sapiens
tcaagatcaaaaaggcttataaaa

SEQ ID NO: 5970351 - DNA, 15 bp, Homo sapiens
tcaagatcaacattc

SEQ ID NO: 5970352 - DNA, 15 bp, Homo sapiens
tcaagatcatgtacc

SEQ ID NO: 5970353 - DNA, 13 bp, Homo sapiens
tcaagatccaaat

SEQ ID NO: 5970354 - DNA, 19 bp, Homo sapiens
tcaagatctaaatcatata

SEQ ID NO: 5970355 - DNA, 17 bp, Homo sapiens
tcaagatgacagctctt

SEQ ID NO: 5970356 - DNA, 18 bp, Homo sapiens
tcaagatgagcctgggct

SEQ ID NO: 5970357 - DNA, 20 bp, Homo sapiens
tcaagatggattaaagactt

SEQ ID NO: 5970358 - DNA, 19 bp, Homo sapiens
tcaagatgggggcagggct

SEQ ID NO: 5970359 - DNA, 20 bp, Homo sapiens
tcaagatgggggcagggctg

SEQ ID NO: 5970360 - DNA, 21 bp, Homo sapiens
tcaagatgggggcagggctgt

SEQ ID NO: 5970361 - DNA, 14 bp, Homo sapiens
tcaagatgttatat

SEQ ID NO: 5970362 - DNA, 19 bp, Homo sapiens
tcaagatgttatattaaag

SEQ ID NO: 5970363 - DNA, 13 bp, Homo sapiens
tcaagattaatta

SEQ ID NO: 5970364 - DNA, 22 bp, Homo sapiens
tcaagattatattataataatg

SEQ ID NO: 5970365 - DNA, 13 bp, Homo sapiens
tcaagattcagct

SEQ ID NO: 5970366 - DNA, 22 bp, Homo sapiens
tcaagattcccaggagttctgc

SEQ ID NO: 5970367 - DNA, 14 bp, Homo sapiens
tcaagattctaaag

SEQ ID NO: 5970368 - DNA, 17 bp, Homo sapiens
tcaagattctaaagctc

SEQ ID NO: 5970369 - DNA, 14 bp, Homo sapiens
tcaagattgcaaag

SEQ ID NO: 5970370 - DNA, 18 bp, Homo sapiens
tcaagatttgaccaaatc

SEQ ID NO: 5970371 - DNA, 22 bp, Homo sapiens
tcaagattttagggcttttatt

SEQ ID NO: 5970372 - DNA, 18 bp, Homo sapiens
tcaagattttgaatgctt

SEQ ID NO: 5970373 - DNA, 19 bp, Homo sapiens
tcaagattttgaatgcttc

SEQ ID NO: 5970374 - DNA, 21 bp, Homo sapiens
tcaagattttttttgtaactt

SEQ ID NO: 5970375 - DNA, 12 bp, Homo sapiens
tcaagcaaacat

SEQ ID NO: 5970376 - DNA, 20 bp, Homo sapiens
tcaagcaaagacagtttctt

SEQ ID NO: 5970377 - DNA, 23 bp, Homo sapiens
tcaagcaaagacagtttcttgca

SEQ ID NO: 5970378 - DNA, 17 bp, Homo sapiens
tcaagcaagatttcaga

SEQ ID NO: 5970379 - DNA, 20 bp, Homo sapiens
tcaagcaagtttaatcaatg

SEQ ID NO: 5970380 - DNA, 14 bp, Homo sapiens
tcaagcaataattg

SEQ ID NO: 5970381 - DNA, 17 bp, Homo sapiens
tcaagcaataattgttt

SEQ ID NO: 5970382 - DNA, 21 bp, Homo sapiens
tcaagcaatccacctgccttg

SEQ ID NO: 5970383 - DNA, 15 bp, Homo sapiens
tcaagcaatcctcct

SEQ ID NO: 5970384 - DNA, 16 bp, Homo sapiens
tcaagcaatcctcctg

SEQ ID NO: 5970385 - DNA, 20 bp, Homo sapiens
tcaagcaatcctcctgcctc

SEQ ID NO: 5970386 - DNA, 23 bp, Homo sapiens
tcaagcaatcctcctgcctcagc

SEQ ID NO: 5970387 - DNA, 20 bp, Homo sapiens
tcaagcacaacccaccacaa

SEQ ID NO: 5970388 - DNA, 15 bp, Homo sapiens
tcaagcacactggaa

SEQ ID NO: 5970389 - DNA, 14 bp, Homo sapiens
tcaagcacatgtaa

SEQ ID NO: 5970390 - DNA, 16 bp, Homo sapiens
tcaagcacatgtaata

SEQ ID NO: 5970391 - DNA, 20 bp, Homo sapiens
tcaagcacatgtaataaatt

SEQ ID NO: 5970392 - DNA, 21 bp, Homo sapiens
tcaagcacatgtaataaattc

SEQ ID NO: 5970393 - DNA, 15 bp, Homo sapiens
tcaagcaccacgccc

SEQ ID NO: 5970394 - DNA, 15 bp, Homo sapiens
tcaagcaccaggaag

SEQ ID NO: 5970395 - DNA, 14 bp, Homo sapiens
tctcaatatgctta

SEQ ID NO: 5970396 - DNA, 17 bp, Homo sapiens
tctcaatattcaataaa

SEQ ID NO: 5970397 - DNA, 13 bp, Homo sapiens
tctcaatcagtgc

SEQ ID NO: 5970398 - DNA, 15 bp, Homo sapiens
tctcaatcagtgcag

SEQ ID NO: 5970399 - DNA, 20 bp, Homo sapiens
tctcaatcattgtcagagat

SEQ ID NO: 5970400 - DNA, 18 bp, Homo sapiens
tctcaatcctgcagtggg

SEQ ID NO: 5970401 - DNA, 12 bp, Homo sapiens
tctcaatgaaaa

SEQ ID NO: 5970402 - DNA, 13 bp, Homo sapiens
tctcaatgaaaaa

SEQ ID NO: 5970403 - DNA, 14 bp, Homo sapiens
tctcaatgaaaaat

SEQ ID NO: 5970404 - DNA, 13 bp, Homo sapiens
tctcaatgaaata

SEQ ID NO: 5970405 - DNA, 14 bp, Homo sapiens
tctcaatgaaatag

SEQ ID NO: 5970406 - DNA, 21 bp, Homo sapiens
tctcaatgaaccataaattca

SEQ ID NO: 5970407 - DNA, 17 bp, Homo sapiens
tctcaatgaagccagct

SEQ ID NO: 5970408 - DNA, 16 bp, Homo sapiens
tctcaatgcttttcta

SEQ ID NO: 5970409 - DNA, 17 bp, Homo sapiens
tctcaatggcatgggtg

SEQ ID NO: 5970410 - DNA, 21 bp, Homo sapiens
tcaagggcagctttgctcata

SEQ ID NO: 5970411 - DNA, 23 bp, Homo sapiens
tcaagggcagctttgctcatatt

SEQ ID NO: 5970412 - DNA, 15 bp, Homo sapiens
tcaagggctgtcatt

SEQ ID NO: 5970413 - DNA, 17 bp, Homo sapiens
tcaagggcttactattt

SEQ ID NO: 5970414 - DNA, 21 bp, Homo sapiens
tcaagggctttcctgtgccag

SEQ ID NO: 5970415 - DNA, 14 bp, Homo sapiens
tcaaggggctggaa

SEQ ID NO: 5970416 - DNA, 19 bp, Homo sapiens
tcaagggggctgctctgca

SEQ ID NO: 5970417 - DNA, 18 bp, Homo sapiens
tcaaggggttcccactgg

SEQ ID NO: 5970418 - DNA, 13 bp, Homo sapiens
tcaagggtcaggc

SEQ ID NO: 5970419 - DNA, 15 bp, Homo sapiens
tcaagggtccagaag

SEQ ID NO: 5970420 - DNA, 17 bp, Homo sapiens
tcaaggtaaaatgtagc

SEQ ID NO: 5970421 - DNA, 15 bp, Homo sapiens
tcaaggtcactgttt

SEQ ID NO: 5970422 - DNA, 21 bp, Homo sapiens
tcaaggtcacttaaagggtct

SEQ ID NO: 5970423 - DNA, 14 bp, Homo sapiens
tcaaggtccattat

SEQ ID NO: 5970424 - DNA, 15 bp, Homo sapiens
tcaaggtcgtttttt

SEQ ID NO: 5970425 - DNA, 14 bp, Homo sapiens
tcaaggtctgcttt

SEQ ID NO: 5970426 - DNA, 22 bp, Homo sapiens
tcaaggtgagaattaagtttta

SEQ ID NO: 5970427 - DNA, 22 bp, Homo sapiens
tcaaggtgatatataatttcct

SEQ ID NO: 5970428 - DNA, 13 bp, Homo sapiens
tcaaggtgctcaa

SEQ ID NO: 5970429 - DNA, 16 bp, Homo sapiens
tcaaggtggctggaga

SEQ ID NO: 5970430 - DNA, 13 bp, Homo sapiens
tcaaggtgtggaa

SEQ ID NO: 5970431 - DNA, 16 bp, Homo sapiens
tcaaggtgtggaaggg

SEQ ID NO: 5970432 - DNA, 11 bp, Homo sapiens
tcaaggttcta

SEQ ID NO: 5970433 - DNA, 22 bp, Homo sapiens
tcaaggtttaaccttaaaatta

SEQ ID NO: 5970434 - DNA, 22 bp, Homo sapiens
tcaaggtttagtttaacttcca

SEQ ID NO: 5970435 - DNA, 18 bp, Homo sapiens
tcaaggttttaaaacagt

SEQ ID NO: 5970436 - DNA, 13 bp, Homo sapiens
tcaagtaaaacaa

SEQ ID NO: 5970437 - DNA, 14 bp, Homo sapiens
tcaagtaaaacaaa

SEQ ID NO: 5970438 - DNA, 15 bp, Homo sapiens
tcaagtaaaacaaat

SEQ ID NO: 5970439 - DNA, 16 bp, Homo sapiens
tcaagtaaaacaaatg

SEQ ID NO: 5970440 - DNA, 17 bp, Homo sapiens
tcaagtaaaacaaatga

SEQ ID NO: 5970441 - DNA, 21 bp, Homo sapiens
tcaagtaatacgttttgacat

SEQ ID NO: 5970442 - DNA, 15 bp, Homo sapiens
tcaagtaattgtgaa

SEQ ID NO: 5970443 - DNA, 18 bp, Homo sapiens
tcaagtaattttcatatt

SEQ ID NO: 5970444 - DNA, 24 bp, Homo sapiens
tcaagtacataaagtacataacaa

SEQ ID NO: 5970445 - DNA, 22 bp, Homo sapiens
tcaagtaccaccaagggatctg

SEQ ID NO: 5970446 - DNA, 21 bp, Homo sapiens
tcaagtagaaaatttcttata

SEQ ID NO: 5970447 - DNA, 17 bp, Homo sapiens
tcaagtagactactgtt

SEQ ID NO: 5970448 - DNA, 19 bp, Homo sapiens
tcaagtagactactgttca

SEQ ID NO: 5970449 - DNA, 14 bp, Homo sapiens
tcaagtagatcatg

SEQ ID NO: 5970450 - DNA, 13 bp, Homo sapiens
tcaagtagcattt

SEQ ID NO: 5970451 - DNA, 18 bp, Homo sapiens
tcaagtagctgggactac

SEQ ID NO: 5970452 - DNA, 17 bp, Homo sapiens
tcaagtaggagttttat

SEQ ID NO: 5970453 - DNA, 15 bp, Homo sapiens
tcaagtatagaaaat

SEQ ID NO: 5970454 - DNA, 17 bp, Homo sapiens
tcaagtatagaaaatct

SEQ ID NO: 5970455 - DNA, 23 bp, Homo sapiens
tcaagtatccaattcagggtccc

SEQ ID NO: 5970456 - DNA, 16 bp, Homo sapiens
tcaagtatcttctatt

SEQ ID NO: 5970457 - DNA, 19 bp, Homo sapiens
tcaagtattaagcagttca

SEQ ID NO: 5970458 - DNA, 11 bp, Homo sapiens
tcaagtattat

SEQ ID NO: 5970459 - DNA, 14 bp, Homo sapiens
tcaagtattataaa

SEQ ID NO: 5970460 - DNA, 15 bp, Homo sapiens
tcaagtattataaac

SEQ ID NO: 5970461 - DNA, 15 bp, Homo sapiens
tcaagtattatacct

SEQ ID NO: 5970462 - DNA, 18 bp, Homo sapiens
tcaagtattgagaacctg

SEQ ID NO: 5970463 - DNA, 12 bp, Homo sapiens
tcaagtatttgg

SEQ ID NO: 5970464 - DNA, 15 bp, Homo sapiens
tcaagtcatgatgga

SEQ ID NO: 5970465 - DNA, 23 bp, Homo sapiens
tcaagtcatgatggagacttcag

SEQ ID NO: 5970466 - DNA, 21 bp, Homo sapiens
tcaagtcatggcaggtacagt

SEQ ID NO: 5970467 - DNA, 14 bp, Homo sapiens
tcaagtccagagcc

SEQ ID NO: 5970468 - DNA, 23 bp, Homo sapiens
tcaagtcccccagcagaaccagc

SEQ ID NO: 5970469 - DNA, 15 bp, Homo sapiens
tcaagtcccgaggca

SEQ ID NO: 5970470 - DNA, 13 bp, Homo sapiens
tcaagtcctctgg

SEQ ID NO: 5970471 - DNA, 22 bp, Homo sapiens
tcaagtcctcttttctgagagg

SEQ ID NO: 5970472 - DNA, 21 bp, Homo sapiens
tcaagtcctgactgggctggg

SEQ ID NO: 5970473 - DNA, 23 bp, Homo sapiens
tcaagtcctgactgggctgggtt

SEQ ID NO: 5970474 - DNA, 19 bp, Homo sapiens
tcaagtcctgcctcttaaa

SEQ ID NO: 5970475 - DNA, 20 bp, Homo sapiens
tcaagtcctgcctcttaaat

SEQ ID NO: 5970476 - DNA, 18 bp, Homo sapiens
tcaagtccttacctcttc

SEQ ID NO: 5970477 - DNA, 15 bp, Homo sapiens
tcaagtctaccaacc

SEQ ID NO: 5970478 - DNA, 22 bp, Homo sapiens
tcaagtctaccaacctgttcaa

SEQ ID NO: 5970479 - DNA, 17 bp, Homo sapiens
tcaagtctctgctggcc

SEQ ID NO: 5970480 - DNA, 19 bp, Homo sapiens
tcaagtctctgctggccca

SEQ ID NO: 5970481 - DNA, 11 bp, Homo sapiens
tcaagtctgtg

SEQ ID NO: 5970482 - DNA, 17 bp, Homo sapiens
tcaagtctgtgcctgga

SEQ ID NO: 5970483 - DNA, 21 bp, Homo sapiens
tcaagtctgtgcctggagctc

SEQ ID NO: 5970484 - DNA, 17 bp, Homo sapiens
tcaagtctgttttggga

SEQ ID NO: 5970485 - DNA, 20 bp, Homo sapiens
tcaagtctttctctttccct

SEQ ID NO: 5970486 - DNA, 18 bp, Homo sapiens
tcaagtgaaagacttgaa

SEQ ID NO: 5970487 - DNA, 16 bp, Homo sapiens
tcaagtgagacccaaa

SEQ ID NO: 5970488 - DNA, 16 bp, Homo sapiens
tcaagtgagtggcatg

SEQ ID NO: 5970489 - DNA, 13 bp, Homo sapiens
tcaagtgatatat

SEQ ID NO: 5970490 - DNA, 16 bp, Homo sapiens
tcaagtgatatatgta

SEQ ID NO: 5970491 - DNA, 18 bp, Homo sapiens
tcaagtgatatatgtatt

SEQ ID NO: 5970492 - DNA, 17 bp, Homo sapiens
tcaagtgatccacctgc

SEQ ID NO: 5970493 - DNA, 12 bp, Homo sapiens
tcaagtgattct

SEQ ID NO: 5970494 - DNA, 20 bp, Homo sapiens
tcaagtgattctcatgcctc

SEQ ID NO: 5970495 - DNA, 17 bp, Homo sapiens
tcaagtgattctcctgc

SEQ ID NO: 5970496 - DNA, 15 bp, Homo sapiens
tcaagtgattctctt

SEQ ID NO: 5970497 - DNA, 18 bp, Homo sapiens
tcaagtgcaatgccccct

SEQ ID NO: 5970498 - DNA, 21 bp, Homo sapiens
tcaagtgcaatgccccctccc

SEQ ID NO: 5970499 - DNA, 16 bp, Homo sapiens
tcaagtgcatttctgg

SEQ ID NO: 5970500 - DNA, 17 bp, Homo sapiens
tcaagtgcatttctggg

SEQ ID NO: 5970501 - DNA, 13 bp, Homo sapiens
tcaagtgccaaac

SEQ ID NO: 5970502 - DNA, 19 bp, Homo sapiens
tcaagtgccattcatcctt

SEQ ID NO: 5970503 - DNA, 17 bp, Homo sapiens
tcaagtgcctcttgttg

SEQ ID NO: 5970504 - DNA, 16 bp, Homo sapiens
tcaagtgcttaaaaat

SEQ ID NO: 5970505 - DNA, 12 bp, Homo sapiens
tcaagtggcagc

SEQ ID NO: 5970506 - DNA, 13 bp, Homo sapiens
tcaagtgtaatta

SEQ ID NO: 5970507 - DNA, 22 bp, Homo sapiens
tcaagtgtaattagcttttgga

SEQ ID NO: 5970508 - DNA, 20 bp, Homo sapiens
tcaagtgtagaagaaaatat

SEQ ID NO: 5970509 - DNA, 12 bp, Homo sapiens
tcaagtgtcacc

SEQ ID NO: 5970510 - DNA, 18 bp, Homo sapiens
tcaagtgtcacctccttc

SEQ ID NO: 5970511 - DNA, 21 bp, Homo sapiens
tcaagtgtcacctccttcccc

SEQ ID NO: 5970512 - DNA, 15 bp, Homo sapiens
tcaagtgtcatatgt

SEQ ID NO: 5970513 - DNA, 15 bp, Homo sapiens
tcaagtgtgcctgct

SEQ ID NO: 5970514 - DNA, 21 bp, Homo sapiens
tcaagtgttaaattatttttt

SEQ ID NO: 5970515 - DNA, 23 bp, Homo sapiens
tcaagtgttaaattattttttct

SEQ ID NO: 5970516 - DNA, 14 bp, Homo sapiens
tcaagtgttacaga

SEQ ID NO: 5970517 - DNA, 16 bp, Homo sapiens
tcaagttaacaaggaa

SEQ ID NO: 5970518 - DNA, 15 bp, Homo sapiens
tcaagttattcaaat

SEQ ID NO: 5970519 - DNA, 19 bp, Homo sapiens
tcaagttattcagaaatat

SEQ ID NO: 5970520 - DNA, 15 bp, Homo sapiens
tcaagttatttcctt

SEQ ID NO: 5970521 - DNA, 11 bp, Homo sapiens
tcaagttcaat

SEQ ID NO: 5970522 - DNA, 13 bp, Homo sapiens
tcaagttcacacc

SEQ ID NO: 5970523 - DNA, 19 bp, Homo sapiens
tcaagttccagtgcagaga

SEQ ID NO: 5970524 - DNA, 13 bp, Homo sapiens
tcaagttcccaac

SEQ ID NO: 5970525 - DNA, 23 bp, Homo sapiens
tcaagttcccaactgagtcatct

SEQ ID NO: 5970526 - DNA, 22 bp, Homo sapiens
tcaagttctggacctgggcatg

SEQ ID NO: 5970527 - DNA, 15 bp, Homo sapiens
tcaagttgagatttt

SEQ ID NO: 5970528 - DNA, 17 bp, Homo sapiens
tcaagttgagattttta

SEQ ID NO: 5970529 - DNA, 16 bp, Homo sapiens
tcaagttgattagaaa

SEQ ID NO: 5970530 - DNA, 17 bp, Homo sapiens
tcaagttggacttgttt

SEQ ID NO: 5970531 - DNA, 16 bp, Homo sapiens
tcaagttgtaaaaatg

SEQ ID NO: 5970532 - DNA, 21 bp, Homo sapiens
tcaagttgtaacttatattga

SEQ ID NO: 5970533 - DNA, 14 bp, Homo sapiens
tcaagttgtgcttg

SEQ ID NO: 5970534 - DNA, 17 bp, Homo sapiens
tcaagttgtgtctgaaa

SEQ ID NO: 5970535 - DNA, 15 bp, Homo sapiens
tcaagttgtgtgcta

SEQ ID NO: 5970536 - DNA, 13 bp, Homo sapiens
tcaagttgtttaa

SEQ ID NO: 5970537 - DNA, 16 bp, Homo sapiens
tcaagttgtttaactg

SEQ ID NO: 5970538 - DNA, 13 bp, Homo sapiens
tcaagtttaaagt

SEQ ID NO: 5970539 - DNA, 15 bp, Homo sapiens
tcaagtttaaagtca

SEQ ID NO: 5970540 - DNA, 12 bp, Homo sapiens
tcaagtttacac

SEQ ID NO: 5970541 - DNA, 17 bp, Homo sapiens
tcaagtttacacttcat

SEQ ID NO: 5970542 - DNA, 11 bp, Homo sapiens
tcaagtttact

SEQ ID NO: 5970543 - DNA, 18 bp, Homo sapiens
tcaagtttccaagcaaat

SEQ ID NO: 5970544 - DNA, 23 bp, Homo sapiens
tcaagtttccaagcaaatgttac

SEQ ID NO: 5970545 - DNA, 19 bp, Homo sapiens
tcaagtttgaccagtgcag

SEQ ID NO: 5970546 - DNA, 20 bp, Homo sapiens
tcaagtttgggtctgtgctg

SEQ ID NO: 5970547 - DNA, 21 bp, Homo sapiens
tcaagttttaagtgaaagtga

SEQ ID NO: 5970548 - DNA, 21 bp, Homo sapiens
tcaagttttgggggtgggctg

SEQ ID NO: 5970549 - DNA, 21 bp, Homo sapiens
tcaagttttgggtatgtttaa

SEQ ID NO: 5970550 - DNA, 15 bp, Homo sapiens
tcaagtttttacaaa

SEQ ID NO: 5970551 - DNA, 16 bp, Homo sapiens
tcaagtttttacaaaa

SEQ ID NO: 5970552 - DNA, 16 bp, Homo sapiens
tcaagtttttcatact

SEQ ID NO: 5970553 - DNA, 21 bp, Homo sapiens
tcaagtttttcatactgtaca

SEQ ID NO: 5970554 - DNA, 22 bp, Homo sapiens
tcaagtttttcatactgtacac

SEQ ID NO: 5970555 - DNA, 16 bp, Homo sapiens
tcaagtttttctctca

SEQ ID NO: 5970556 - DNA, 16 bp, Homo sapiens
tcaagtttttttcaaa

SEQ ID NO: 5970557 - DNA, 22 bp, Homo sapiens
tcaataaaaaaaagaaatgaaa

SEQ ID NO: 5970558 - DNA, 18 bp, Homo sapiens
tcaataaaaaacaaatat

SEQ ID NO: 5970559 - DNA, 20 bp, Homo sapiens
tcaataaaaaacaaatatat

SEQ ID NO: 5970560 - DNA, 16 bp, Homo sapiens
tcaataaaaaattatg

SEQ ID NO: 5970561 - DNA, 19 bp, Homo sapiens
tcaataaaaaattatgaca

SEQ ID NO: 5970562 - DNA, 16 bp, Homo sapiens
tcaataaaagagctgt

SEQ ID NO: 5970563 - DNA, 22 bp, Homo sapiens
tcaataaaagagctgtctgact

SEQ ID NO: 5970564 - DNA, 18 bp, Homo sapiens
tcaataaaagcctttgaa

SEQ ID NO: 5970565 - DNA, 20 bp, Homo sapiens
tcaataaaagcctttgaaaa

SEQ ID NO: 5970566 - DNA, 21 bp, Homo sapiens
tcaataaaagcctttgaaaat

SEQ ID NO: 5970567 - DNA, 13 bp, Homo sapiens
tcaataaaatcat

SEQ ID NO: 5970568 - DNA, 18 bp, Homo sapiens
tcaataaaatcatgtaca

SEQ ID NO: 5970569 - DNA, 23 bp, Homo sapiens
tcaataaaatgaacctgatcact

SEQ ID NO: 5970570 - DNA, 14 bp, Homo sapiens
tcaataaaatgtga

SEQ ID NO: 5970571 - DNA, 17 bp, Homo sapiens
tcaataaaattatagct

SEQ ID NO: 5970572 - DNA, 14 bp, Homo sapiens
tcaataaaattctg

SEQ ID NO: 5970573 - DNA, 16 bp, Homo sapiens
tcaataaaattctgta

SEQ ID NO: 5970574 - DNA, 14 bp, Homo sapiens
tctgggccagaatt

SEQ ID NO: 5970575 - DNA, 14 bp, Homo sapiens
tctgggcccccact

SEQ ID NO: 5970576 - DNA, 23 bp, Homo sapiens
tctgggccctgcaggaggcctgg

SEQ ID NO: 5970577 - DNA, 23 bp, Homo sapiens
tctgggccctgtcgcccctcctt

SEQ ID NO: 5970578 - DNA, 14 bp, Homo sapiens
tctgggcctctgac

SEQ ID NO: 5970579 - DNA, 15 bp, Homo sapiens
tctgggcctcttttt

SEQ ID NO: 5970580 - DNA, 21 bp, Homo sapiens
tctgggcctctttttgccctt

SEQ ID NO: 5970581 - DNA, 13 bp, Homo sapiens
tctgggcctgagg

SEQ ID NO: 5970582 - DNA, 22 bp, Homo sapiens
tctgggcctgagggtccacctg

SEQ ID NO: 5970583 - DNA, 13 bp, Homo sapiens
tctgggcctgggg

SEQ ID NO: 5970584 - DNA, 13 bp, Homo sapiens
tctgggcctgtgt

SEQ ID NO: 5970585 - DNA, 17 bp, Homo sapiens
tctgggcctgtgtgtgg

SEQ ID NO: 5970586 - DNA, 14 bp, Homo sapiens
tctgggcctgttct

SEQ ID NO: 5970587 - DNA, 20 bp, Homo sapiens
tctgggccttggcctggagc

SEQ ID NO: 5970588 - DNA, 23 bp, Homo sapiens
tctgggctactgccactgtgtgc

SEQ ID NO: 5970589 - DNA, 20 bp, Homo sapiens
tctgggctaggtagaaaaag

SEQ ID NO: 5970590 - DNA, 19 bp, Homo sapiens
tctgggctcaagctttccc

SEQ ID NO: 5970591 - DNA, 19 bp, Homo sapiens
tctgggctcacaccagccc

SEQ ID NO: 5970592 - DNA, 21 bp, Homo sapiens
tctgggctcacaccagccctg

SEQ ID NO: 5970593 - DNA, 22 bp, Homo sapiens
tctgggctcacaccagccctgg

SEQ ID NO: 5970594 - DNA, 19 bp, Homo sapiens
tctgggctcagacatccac

SEQ ID NO: 5970595 - DNA, 12 bp, Homo sapiens
tctgggctcagg

SEQ ID NO: 5970596 - DNA, 13 bp, Homo sapiens
tctgggctcaggg

SEQ ID NO: 5970597 - DNA, 14 bp, Homo sapiens
tctgggctcagggc

SEQ ID NO: 5970598 - DNA, 20 bp, Homo sapiens
tctgggctcagggctggagt

SEQ ID NO: 5970599 - DNA, 17 bp, Homo sapiens
tctgggctctggactcc

SEQ ID NO: 5970600 - DNA, 21 bp, Homo sapiens
tctgggctgagcctactgtct

SEQ ID NO: 5970601 - DNA, 22 bp, Homo sapiens
tctgggctgagcctactgtctc

SEQ ID NO: 5970602 - DNA, 22 bp, Homo sapiens
tctgggctgcgggaggccctgg

SEQ ID NO: 5970603 - DNA, 11 bp, Homo sapiens
tctgggctgga

SEQ ID NO: 5970604 - DNA, 20 bp, Homo sapiens
tctgggctggatgagctccc

SEQ ID NO: 5970605 - DNA, 23 bp, Homo sapiens
tctgggctgtaacgtggcactgg

SEQ ID NO: 5970606 - DNA, 21 bp, Homo sapiens
tctgggcttatatctggcctc

SEQ ID NO: 5970607 - DNA, 18 bp, Homo sapiens
tctgggcttcctggagca

SEQ ID NO: 5970608 - DNA, 19 bp, Homo sapiens
tctgggcttcctggagcag

SEQ ID NO: 5970609 - DNA, 15 bp, Homo sapiens
tctgggctttctcct

SEQ ID NO: 5970610 - DNA, 16 bp, Homo sapiens
tctgggctttctcctg

SEQ ID NO: 5970611 - DNA, 21 bp, Homo sapiens
tctgggctttctcctggagat

SEQ ID NO: 5970612 - DNA, 15 bp, Homo sapiens
tctgggcttttcctt

SEQ ID NO: 5970613 - DNA, 21 bp, Homo sapiens
tctggggaaaaaaaagagact

SEQ ID NO: 5970614 - DNA, 22 bp, Homo sapiens
tctggggaaaaaaaagagactg

SEQ ID NO: 5970615 - DNA, 20 bp, Homo sapiens
tctggggaaagacactgcct

SEQ ID NO: 5970616 - DNA, 20 bp, Homo sapiens
tctggggaagaggttttatt

SEQ ID NO: 5970617 - DNA, 17 bp, Homo sapiens
tctggggacagcttcct

SEQ ID NO: 5970618 - DNA, 23 bp, Homo sapiens
tctggggacagcttcctcacacc

SEQ ID NO: 5970619 - DNA, 13 bp, Homo sapiens
tctggggaccagc

SEQ ID NO: 5970620 - DNA, 22 bp, Homo sapiens
tctggggactgcattggactga

SEQ ID NO: 5970621 - DNA, 16 bp, Homo sapiens
tctggggagagcggct

SEQ ID NO: 5970622 - DNA, 19 bp, Homo sapiens
tctggggagcgggtctgct

SEQ ID NO: 5970623 - DNA, 13 bp, Homo sapiens
tctggggaggaag

SEQ ID NO: 5970624 - DNA, 18 bp, Homo sapiens
tctggggatactggcaaa

SEQ ID NO: 5970625 - DNA, 16 bp, Homo sapiens
tctggggatgggtggg

SEQ ID NO: 5970626 - DNA, 17 bp, Homo sapiens
tctggggatgggtgggg

SEQ ID NO: 5970627 - DNA, 14 bp, Homo sapiens
tctggggcagagga

SEQ ID NO: 5970628 - DNA, 15 bp, Homo sapiens
tctggggcagatccc

SEQ ID NO: 5970629 - DNA, 20 bp, Homo sapiens
tctggggcaggaccactagc

SEQ ID NO: 5970630 - DNA, 21 bp, Homo sapiens
tctggggccagcccctccccg

SEQ ID NO: 5970631 - DNA, 15 bp, Homo sapiens
tctggggcccaggaa

SEQ ID NO: 5970632 - DNA, 21 bp, Homo sapiens
tctggggcccaggaagcccac

SEQ ID NO: 5970633 - DNA, 19 bp, Homo sapiens
tctggggcccgcctgccac

SEQ ID NO: 5970634 - DNA, 21 bp, Homo sapiens
tctggggcccgcctgccacct

SEQ ID NO: 5970635 - DNA, 14 bp, Homo sapiens
tctggggccctggg

SEQ ID NO: 5970636 - DNA, 16 bp, Homo sapiens
tctggggccctgggcc

SEQ ID NO: 5970637 - DNA, 18 bp, Homo sapiens
tctggggccctgggcctc

SEQ ID NO: 5970638 - DNA, 12 bp, Homo sapiens
tctggggccctt

SEQ ID NO: 5970639 - DNA, 20 bp, Homo sapiens
tctggggcctaataaaactg

SEQ ID NO: 5970640 - DNA, 21 bp, Homo sapiens
tctggggcctaataaaactga

SEQ ID NO: 5970641 - DNA, 16 bp, Homo sapiens
tctggggcctttatca

SEQ ID NO: 5970642 - DNA, 16 bp, Homo sapiens
tctggggctctgggat

SEQ ID NO: 5970643 - DNA, 15 bp, Homo sapiens
tctggggctgtgtta

SEQ ID NO: 5970644 - DNA, 15 bp, Homo sapiens
tctgggggaaaaagc

SEQ ID NO: 5970645 - DNA, 19 bp, Homo sapiens
tctgggggagacatgctct

SEQ ID NO: 5970646 - DNA, 19 bp, Homo sapiens
tctgggggaggcagggctg

SEQ ID NO: 5970647 - DNA, 15 bp, Homo sapiens
tctgggggagtggaa

SEQ ID NO: 5970648 - DNA, 13 bp, Homo sapiens
tctgggggcagat

SEQ ID NO: 5970649 - DNA, 16 bp, Homo sapiens
tctgggggcagctgtc

SEQ ID NO: 5970650 - DNA, 14 bp, Homo sapiens
tctgggggctctgg

SEQ ID NO: 5970651 - DNA, 18 bp, Homo sapiens
tctgggggctctggccaa

SEQ ID NO: 5970652 - DNA, 19 bp, Homo sapiens
tctgggggctgaggagcag

SEQ ID NO: 5970653 - DNA, 15 bp, Homo sapiens
tctgggggctggttg

SEQ ID NO: 5970654 - DNA, 18 bp, Homo sapiens
tctggggggacccagtgc

SEQ ID NO: 5970655 - DNA, 22 bp, Homo sapiens
tctggggggagaaaaaaaaagc

SEQ ID NO: 5970656 - DNA, 17 bp, Homo sapiens
tctggggggtggccagg

SEQ ID NO: 5970657 - DNA, 19 bp, Homo sapiens
tctggggggtggccaggcc

SEQ ID NO: 5970658 - DNA, 19 bp, Homo sapiens
tctggggggtggggaggag

SEQ ID NO: 5970659 - DNA, 14 bp, Homo sapiens
tctgggggtcctct

SEQ ID NO: 5970660 - DNA, 17 bp, Homo sapiens
tctgggggtcctctctg

SEQ ID NO: 5970661 - DNA, 24 bp, Homo sapiens
tctgggggtcctctctgagtcaaa

SEQ ID NO: 5970662 - DNA, 17 bp, Homo sapiens
tctgggggtgggaagtg

SEQ ID NO: 5970663 - DNA, 15 bp, Homo sapiens
tctggggtaggctgc

SEQ ID NO: 5970664 - DNA, 17 bp, Homo sapiens
tctggggtcaggtgcca

SEQ ID NO: 5970665 - DNA, 15 bp, Homo sapiens
tctggggtccccagg

SEQ ID NO: 5970666 - DNA, 19 bp, Homo sapiens
tctggggtccccagggctg

SEQ ID NO: 5970667 - DNA, 21 bp, Homo sapiens
tgcgccctggatcctcacact

SEQ ID NO: 5970668 - DNA, 21 bp, Homo sapiens
tgcgcccttgaggggccccag

SEQ ID NO: 5970669 - DNA, 24 bp, Homo sapiens
tgcgccgagtctgtctctgtcatg

SEQ ID NO: 5970670 - DNA, 16 bp, Homo sapiens
tgcgcctaatgtgttt

SEQ ID NO: 5970671 - DNA, 16 bp, Homo sapiens
tgcgcctcagccctca

SEQ ID NO: 5970672 - DNA, 13 bp, Homo sapiens
tgcgcctccagag

SEQ ID NO: 5970673 - DNA, 15 bp, Homo sapiens
tgcgcctccatccat

SEQ ID NO: 5970674 - DNA, 20 bp, Homo sapiens
tgcgcctccatccatctgtc

SEQ ID NO: 5970675 - DNA, 17 bp, Homo sapiens
tgcgcctgagtgagtgt

SEQ ID NO: 5970676 - DNA, 12 bp, Homo sapiens
tgcgcctgcagg

SEQ ID NO: 5970677 - DNA, 15 bp, Homo sapiens
tgcgcctgcaggcag

SEQ ID NO: 5970678 - DNA, 17 bp, Homo sapiens
tgcgcctgcaggcagag

SEQ ID NO: 5970679 - DNA, 20 bp, Homo sapiens
tgcgcctgcaggcagagctg

SEQ ID NO: 5970680 - DNA, 17 bp, Homo sapiens
tgcgcctgcgcctcctc

SEQ ID NO: 5970681 - DNA, 19 bp, Homo sapiens
tgcgcctgcgcctcctcct

SEQ ID NO: 5970682 - DNA, 16 bp, Homo sapiens
tgcgccttcgtgcctg

SEQ ID NO: 5970683 - DNA, 19 bp, Homo sapiens
tgcgccttcgtgcctgaga

SEQ ID NO: 5970684 - DNA, 17 bp, Homo sapiens
tgcgccttgtagaatgc

SEQ ID NO: 5970685 - DNA, 14 bp, Homo sapiens
tgcgcctttgtatt

SEQ ID NO: 5970686 - DNA, 19 bp, Homo sapiens
tgcgcctttgtattataaa

SEQ ID NO: 5970687 - DNA, 22 bp, Homo sapiens
tgcgcgcatgtaatcccagcta

SEQ ID NO: 5970688 - DNA, 23 bp, Homo sapiens
tgcgcgctgtgggcaattgttac

SEQ ID NO: 5970689 - DNA, 13 bp, Homo sapiens
tgcgcggactgtc

SEQ ID NO: 5970690 - DNA, 15 bp, Homo sapiens
tgcgcgtgtgggtct

SEQ ID NO: 5970691 - DNA, 18 bp, Homo sapiens
tgcgcgttctgaaatatt

SEQ ID NO: 5970692 - DNA, 21 bp, Homo sapiens
tgcgctagagcattctggggt

SEQ ID NO: 5970693 - DNA, 14 bp, Homo sapiens
tgcgctagcagccc

SEQ ID NO: 5970694 - DNA, 15 bp, Homo sapiens
tgcgctagcagccct

SEQ ID NO: 5970695 - DNA, 16 bp, Homo sapiens
tgcgctagcagccctt

SEQ ID NO: 5970696 - DNA, 16 bp, Homo sapiens
tgcgctcacctgcagc

SEQ ID NO: 5970697 - DNA, 18 bp, Homo sapiens
tgcgctcacctgcagccc

SEQ ID NO: 5970698 - DNA, 17 bp, Homo sapiens
tgcgctcccgcatttct

SEQ ID NO: 5970699 - DNA, 14 bp, Homo sapiens
tgcgctcctctgca

SEQ ID NO: 5970700 - DNA, 16 bp, Homo sapiens
tgcgctcctctgcagc

SEQ ID NO: 5970701 - DNA, 20 bp, Homo sapiens
tgcgctcctctgcagcctga

SEQ ID NO: 5970702 - DNA, 14 bp, Homo sapiens
tgcgctcctggccc

SEQ ID NO: 5970703 - DNA, 14 bp, Homo sapiens
tgcgctcggcagga

SEQ ID NO: 5970704 - DNA, 23 bp, Homo sapiens
tgcgctcggcaggaaggagcggc

SEQ ID NO: 5970705 - DNA, 14 bp, Homo sapiens
tgcgctctcaagac

SEQ ID NO: 5970706 - DNA, 15 bp, Homo sapiens
tgcgctcttcaccag

SEQ ID NO: 5970707 - DNA, 18 bp, Homo sapiens
tgcgctcttcaccaggaa

SEQ ID NO: 5970708 - DNA, 19 bp, Homo sapiens
tgcgctcttcaccaggaag

SEQ ID NO: 5970709 - DNA, 21 bp, Homo sapiens
tgcgctcttggtccctggtcc

SEQ ID NO: 5970710 - DNA, 12 bp, Homo sapiens
tgcgctgcctgg

SEQ ID NO: 5970711 - DNA, 14 bp, Homo sapiens
tgcgctgcctggcc

SEQ ID NO: 5970712 - DNA, 16 bp, Homo sapiens
tgcgctgggcacttcc

SEQ ID NO: 5970713 - DNA, 17 bp, Homo sapiens
tgcgctgggcacttccc

SEQ ID NO: 5970714 - DNA, 20 bp, Homo sapiens
tgcgctggttccgccaggcg

SEQ ID NO: 5970715 - DNA, 21 bp, Homo sapiens
tgcgctggttccgccaggcgc

SEQ ID NO: 5970716 - DNA, 14 bp, Homo sapiens
tgcgctgtcccagg

SEQ ID NO: 5970717 - DNA, 12 bp, Homo sapiens
tgcgctgtgctc

SEQ ID NO: 5970718 - DNA, 18 bp, Homo sapiens
tgcgctgtgctccagcag

SEQ ID NO: 5970719 - DNA, 14 bp, Homo sapiens
tgcgctgtgctggt

SEQ ID NO: 5970720 - DNA, 16 bp, Homo sapiens
tgcgctgtgctggtct

SEQ ID NO: 5970721 - DNA, 22 bp, Homo sapiens
tgcgctgtgtacaatgtgagat

SEQ ID NO: 5970722 - DNA, 11 bp, Homo sapiens
tgcgcttcact

SEQ ID NO: 5970723 - DNA, 16 bp, Homo sapiens
tgcgcttcacttgggt

SEQ ID NO: 5970724 - DNA, 22 bp, Homo sapiens
tgcgcttgaccatgttgcactg

SEQ ID NO: 5970725 - DNA, 15 bp, Homo sapiens
tgcgcttgagacctt

SEQ ID NO: 5970726 - DNA, 14 bp, Homo sapiens
tgcgcttgcttttc

SEQ ID NO: 5970727 - DNA, 23 bp, Homo sapiens
tgcgctttattgcccatgggata

SEQ ID NO: 5970728 - DNA, 16 bp, Homo sapiens
tgcgctttgaacgtgc

SEQ ID NO: 5970729 - DNA, 20 bp, Homo sapiens
tgcgctttgaacgtgccagc

SEQ ID NO: 5970730 - DNA, 20 bp, Homo sapiens
tgcgctttgcaatatttatt

SEQ ID NO: 5970731 - DNA, 17 bp, Homo sapiens
tgcgcttttgctggtca

SEQ ID NO: 5970732 - DNA, 14 bp, Homo sapiens
tgcggaaaggtatt

SEQ ID NO: 5970733 - DNA, 13 bp, Homo sapiens
tgcggaagccaaa

SEQ ID NO: 5970734 - DNA, 15 bp, Homo sapiens
tgcggaagccacagg

SEQ ID NO: 5970735 - DNA, 22 bp, Homo sapiens
tgcggaagccatagggggctgc

SEQ ID NO: 5970736 - DNA, 15 bp, Homo sapiens
tgcggaatcagcttc

SEQ ID NO: 5970737 - DNA, 24 bp, Homo sapiens
tgcggacaccatgttcccagctca

SEQ ID NO: 5970738 - DNA, 18 bp, Homo sapiens
tgcggacagccacggcca

SEQ ID NO: 5970739 - DNA, 22 bp, Homo sapiens
tgcggaccaccctcactggctc

SEQ ID NO: 5970740 - DNA, 18 bp, Homo sapiens
tgcggaccggagcggctg

SEQ ID NO: 5970741 - DNA, 20 bp, Homo sapiens
tgcggaccggagcggctgag

SEQ ID NO: 5970742 - DNA, 23 bp, Homo sapiens
tgcggaccggagcggctgaggac

SEQ ID NO: 5970743 - DNA, 14 bp, Homo sapiens
tgcggacgggctgt

SEQ ID NO: 5970744 - DNA, 14 bp, Homo sapiens
tgcggagcagcctc

SEQ ID NO: 5970745 - DNA, 22 bp, Homo sapiens
tgcggagcagcctccagtgctg

SEQ ID NO: 5970746 - DNA, 15 bp, Homo sapiens
tgcggagcagccttt

SEQ ID NO: 5970747 - DNA, 18 bp, Homo sapiens
tgcggagccagcgcctgc

SEQ ID NO: 5970748 - DNA, 17 bp, Homo sapiens
tgcggagcttctccagc

SEQ ID NO: 5970749 - DNA, 22 bp, Homo sapiens
tgcggaggcggtggcagactag

SEQ ID NO: 5970750 - DNA, 16 bp, Homo sapiens
tgcggagtgaagaggg

SEQ ID NO: 5970751 - DNA, 17 bp, Homo sapiens
tctgtagcctggtctgt

SEQ ID NO: 5970752 - DNA, 22 bp, Homo sapiens
tctgtagcctggtctgtgcatt

SEQ ID NO: 5970753 - DNA, 20 bp, Homo sapiens
tctgtagctataatgagcat

SEQ ID NO: 5970754 - DNA, 16 bp, Homo sapiens
tctgtagctccctcct

SEQ ID NO: 5970755 - DNA, 22 bp, Homo sapiens
tctgtagcttaaaccaacaata

SEQ ID NO: 5970756 - DNA, 19 bp, Homo sapiens
tctgtagcttctaatgttc

SEQ ID NO: 5970757 - DNA, 15 bp, Homo sapiens
tctgtagctttctgg

SEQ ID NO: 5970758 - DNA, 17 bp, Homo sapiens
tctgtaggagagactgg

SEQ ID NO: 5970759 - DNA, 16 bp, Homo sapiens
tctgtagggctggacc

SEQ ID NO: 5970760 - DNA, 20 bp, Homo sapiens
tctgtagggtaattagtaac

SEQ ID NO: 5970761 - DNA, 19 bp, Homo sapiens
tctgtaggtgtctctgggc

SEQ ID NO: 5970762 - DNA, 15 bp, Homo sapiens
tctgtaggttgcaca

SEQ ID NO: 5970763 - DNA, 16 bp, Homo sapiens
tctgtaggttgcacac

SEQ ID NO: 5970764 - DNA, 23 bp, Homo sapiens
tctgtaggttgcacactttggta

SEQ ID NO: 5970765 - DNA, 22 bp, Homo sapiens
tctgtaggtttctctcttccct

SEQ ID NO: 5970766 - DNA, 20 bp, Homo sapiens
tctgtagtaaaatgttttca

SEQ ID NO: 5970767 - DNA, 15 bp, Homo sapiens
tctgtagtaatttat

SEQ ID NO: 5970768 - DNA, 24 bp, Homo sapiens
tctgtagtaatttattgtctgtct

SEQ ID NO: 5970769 - DNA, 23 bp, Homo sapiens
tctgtagtactccttaagaacac

SEQ ID NO: 5970770 - DNA, 19 bp, Homo sapiens
tctgtagtcatttactaaa

SEQ ID NO: 5970771 - DNA, 21 bp, Homo sapiens
tctgtagtggccccctcctcc

SEQ ID NO: 5970772 - DNA, 15 bp, Homo sapiens
tctgtagtgtattaa

SEQ ID NO: 5970773 - DNA, 19 bp, Homo sapiens
tctgtagttcaatttcatg

SEQ ID NO: 5970774 - DNA, 21 bp, Homo sapiens
tctgtagttttatcacatgta

SEQ ID NO: 5970775 - DNA, 16 bp, Homo sapiens
tctgtataaaaatgta

SEQ ID NO: 5970776 - DNA, 23 bp, Homo sapiens
tctgtataaagcctgtattctca

SEQ ID NO: 5970777 - DNA, 12 bp, Homo sapiens
tctgtataaata

SEQ ID NO: 5970778 - DNA, 15 bp, Homo sapiens
tctgtataaatgtct

SEQ ID NO: 5970779 - DNA, 17 bp, Homo sapiens
tctgtataacagccttt

SEQ ID NO: 5970780 - DNA, 18 bp, Homo sapiens
tctgtataagtaagaaaa

SEQ ID NO: 5970781 - DNA, 16 bp, Homo sapiens
tctgtatactcctgtc

SEQ ID NO: 5970782 - DNA, 14 bp, Homo sapiens
tctgtatactgtaa

SEQ ID NO: 5970783 - DNA, 19 bp, Homo sapiens
tctgtatactgtaaaagtt

SEQ ID NO: 5970784 - DNA, 14 bp, Homo sapiens
tctgtatagaaatc

SEQ ID NO: 5970785 - DNA, 22 bp, Homo sapiens
tctgtatagaaatctaaaagaa

SEQ ID NO: 5970786 - DNA, 17 bp, Homo sapiens
tctgtatagattagaat

SEQ ID NO: 5970787 - DNA, 22 bp, Homo sapiens
tctgtatataaaatattttcat

SEQ ID NO: 5970788 - DNA, 22 bp, Homo sapiens
tctgtatataaatatattttct

SEQ ID NO: 5970789 - DNA, 19 bp, Homo sapiens
tctgtatataagttgctgt

SEQ ID NO: 5970790 - DNA, 21 bp, Homo sapiens
tctgtatataagttgctgtgt

SEQ ID NO: 5970791 - DNA, 14 bp, Homo sapiens
tctgtatatacatt

SEQ ID NO: 5970792 - DNA, 17 bp, Homo sapiens
tctgtatatacatttca

SEQ ID NO: 5970793 - DNA, 16 bp, Homo sapiens
tctgtatatagggcac

SEQ ID NO: 5970794 - DNA, 16 bp, Homo sapiens
tctgtatatatatata

SEQ ID NO: 5970795 - DNA, 16 bp, Homo sapiens
tctgtatatcagctct

SEQ ID NO: 5970796 - DNA, 18 bp, Homo sapiens
tctgtatatcagctctaa

SEQ ID NO: 5970797 - DNA, 16 bp, Homo sapiens
tctgtatatgatatat

SEQ ID NO: 5970798 - DNA, 22 bp, Homo sapiens
tctgtatatgatatatattatc

SEQ ID NO: 5970799 - DNA, 16 bp, Homo sapiens
tctgtatatgattctc

SEQ ID NO: 5970800 - DNA, 15 bp, Homo sapiens
tctgtatatttatga

SEQ ID NO: 5970801 - DNA, 19 bp, Homo sapiens
tctgtatatttatgaccag

SEQ ID NO: 5970802 - DNA, 16 bp, Homo sapiens
tctgtatatttgtcat

SEQ ID NO: 5970803 - DNA, 21 bp, Homo sapiens
tctgtatcaagcccctgtcta

SEQ ID NO: 5970804 - DNA, 16 bp, Homo sapiens
tctgtatcatcagtgc

SEQ ID NO: 5970805 - DNA, 20 bp, Homo sapiens
tctgtatccaaataatgaat

SEQ ID NO: 5970806 - DNA, 18 bp, Homo sapiens
tctgtatccccagtgccc

SEQ ID NO: 5970807 - DNA, 20 bp, Homo sapiens
tctgtatccgtgaattgctt

SEQ ID NO: 5970808 - DNA, 20 bp, Homo sapiens
tctgtatcctggaacaatat

SEQ ID NO: 5970809 - DNA, 13 bp, Homo sapiens
tctgtatctctct

SEQ ID NO: 5970810 - DNA, 16 bp, Homo sapiens
tctgtatgaatgtgat

SEQ ID NO: 5970811 - DNA, 13 bp, Homo sapiens
tctgtatgcatca

SEQ ID NO: 5970812 - DNA, 20 bp, Homo sapiens
tctgtatgggtcattctcac

SEQ ID NO: 5970813 - DNA, 13 bp, Homo sapiens
tctgtatgtatta

SEQ ID NO: 5970814 - DNA, 14 bp, Homo sapiens
tctgtatgtattag

SEQ ID NO: 5970815 - DNA, 17 bp, Homo sapiens
tctgtatgtattagtga

SEQ ID NO: 5970816 - DNA, 15 bp, Homo sapiens
tctgtatgtcatgga

SEQ ID NO: 5970817 - DNA, 22 bp, Homo sapiens
tctgtattaagctccagtgctt

SEQ ID NO: 5970818 - DNA, 21 bp, Homo sapiens
tctgtattaatccccatcatt

SEQ ID NO: 5970819 - DNA, 23 bp, Homo sapiens
tctgtattaattataccagtgtt

SEQ ID NO: 5970820 - DNA, 15 bp, Homo sapiens
tctgtattggcagca

SEQ ID NO: 5970821 - DNA, 19 bp, Homo sapiens
tctgtattggcagcacagc

SEQ ID NO: 5970822 - DNA, 20 bp, Homo sapiens
tctgtattggcagcacagct

SEQ ID NO: 5970823 - DNA, 15 bp, Homo sapiens
tctgtatttattatt

SEQ ID NO: 5970824 - DNA, 20 bp, Homo sapiens
tctgtatttattatttgaag

SEQ ID NO: 5970825 - DNA, 16 bp, Homo sapiens
tctgtatttcactctt

SEQ ID NO: 5970826 - DNA, 15 bp, Homo sapiens
tctgtatttcatgtg

SEQ ID NO: 5970827 - DNA, 13 bp, Homo sapiens
tctgtatttcctt

SEQ ID NO: 5970828 - DNA, 14 bp, Homo sapiens
tctgtatttctagg

SEQ ID NO: 5970829 - DNA, 22 bp, Homo sapiens
tctgtatttgaaagtgcctttg

SEQ ID NO: 5970830 - DNA, 14 bp, Homo sapiens
tctgtattttcaaa

SEQ ID NO: 5970831 - DNA, 16 bp, Homo sapiens
tctgtattttcaaaga

SEQ ID NO: 5970832 - DNA, 20 bp, Homo sapiens
tctgtattttcatttaacta

SEQ ID NO: 5970833 - DNA, 22 bp, Homo sapiens
tctgtatttttaaattctgctc

SEQ ID NO: 5970834 - DNA, 21 bp, Homo sapiens
tctgtattttttgtttgtatt

SEQ ID NO: 5970835 - DNA, 19 bp, Homo sapiens
tctgtcaaaacactgtgga

SEQ ID NO: 5970836 - DNA, 24 bp, Homo sapiens
tctgtcaaatgtttccttaaacat

SEQ ID NO: 5970837 - DNA, 22 bp, Homo sapiens
tctgtcaagagtagttatataa

SEQ ID NO: 5970838 - DNA, 13 bp, Homo sapiens
tctgtcaagctta

SEQ ID NO: 5970839 - DNA, 20 bp, Homo sapiens
tctgtcaatcacagtctcag

SEQ ID NO: 5970840 - DNA, 14 bp, Homo sapiens
tctgtcaatgaaaa

SEQ ID NO: 5970841 - DNA, 11 bp, Homo sapiens
tctgtcacaat

SEQ ID NO: 5970842 - DNA, 14 bp, Homo sapiens
tctgtcacaataaa

SEQ ID NO: 5970843 - DNA, 21 bp, Homo sapiens
tctgtcacaataaatggccag

SEQ ID NO: 5970844 - DNA, 16 bp, Homo sapiens
tctgtcacaggctggg

SEQ ID NO: 5970845 - DNA, 18 bp, Homo sapiens
tctgtcacaggctgggtc

SEQ ID NO: 5970846 - DNA, 18 bp, Homo sapiens
tctgtcacagtaaaaata

SEQ ID NO: 5970847 - DNA, 22 bp, Homo sapiens
tctgtcacagtaaaaataaaat

SEQ ID NO: 5970848 - DNA, 12 bp, Homo sapiens
tgctaaggactt

SEQ ID NO: 5970849 - DNA, 13 bp, Homo sapiens
tgctaaggacttg

SEQ ID NO: 5970850 - DNA, 19 bp, Homo sapiens
tgctaaggagaagctaata

SEQ ID NO: 5970851 - DNA, 13 bp, Homo sapiens
tgctaaggttcta

SEQ ID NO: 5970852 - DNA, 18 bp, Homo sapiens
tgctaaggttctaaggcc

SEQ ID NO: 5970853 - DNA, 20 bp, Homo sapiens
tgctaagtaaatctcttctg

SEQ ID NO: 5970854 - DNA, 21 bp, Homo sapiens
tgctaagtaaatctcttctgt

SEQ ID NO: 5970855 - DNA, 16 bp, Homo sapiens
tgctaagtctttccca

SEQ ID NO: 5970856 - DNA, 22 bp, Homo sapiens
tgctaagtggaagacagagatg

SEQ ID NO: 5970857 - DNA, 16 bp, Homo sapiens
tgctaagtgtgaactg

SEQ ID NO: 5970858 - DNA, 19 bp, Homo sapiens
tgctaagtgtgaactggac

SEQ ID NO: 5970859 - DNA, 18 bp, Homo sapiens
tgctaagtgtgcttagtt

SEQ ID NO: 5970860 - DNA, 22 bp, Homo sapiens
tgctaagttctcccaacaacat

SEQ ID NO: 5970861 - DNA, 12 bp, Homo sapiens
tgctaataaaac

SEQ ID NO: 5970862 - DNA, 20 bp, Homo sapiens
tgctaataaacactggctct

SEQ ID NO: 5970863 - DNA, 23 bp, Homo sapiens
tgctaataaacactggctctggg

SEQ ID NO: 5970864 - DNA, 17 bp, Homo sapiens
tgctaataaactgtttt

SEQ ID NO: 5970865 - DNA, 19 bp, Homo sapiens
tgctaataaatattgtcct

SEQ ID NO: 5970866 - DNA, 14 bp, Homo sapiens
tgctaataaatgac

SEQ ID NO: 5970867 - DNA, 15 bp, Homo sapiens
tgctaataaatgacc

SEQ ID NO: 5970868 - DNA, 19 bp, Homo sapiens
tgctaataaatgaccagtt

SEQ ID NO: 5970869 - DNA, 21 bp, Homo sapiens
tgctaataaatgaccagttta

SEQ ID NO: 5970870 - DNA, 19 bp, Homo sapiens
tgctaataagtttgaaata

SEQ ID NO: 5970871 - DNA, 16 bp, Homo sapiens
tgctaataatttgcca

SEQ ID NO: 5970872 - DNA, 19 bp, Homo sapiens
tgctaataatttgccatta

SEQ ID NO: 5970873 - DNA, 20 bp, Homo sapiens
tgctaataatttgccattat

SEQ ID NO: 5970874 - DNA, 17 bp, Homo sapiens
tgctaataccaactatt

SEQ ID NO: 5970875 - DNA, 21 bp, Homo sapiens
tgctaataccaactatttcaa

SEQ ID NO: 5970876 - DNA, 17 bp, Homo sapiens
tgctaatagaaaactgt

SEQ ID NO: 5970877 - DNA, 21 bp, Homo sapiens
tgctaatataagtttctttgc

SEQ ID NO: 5970878 - DNA, 21 bp, Homo sapiens
tgctaatatactttttttgtt

SEQ ID NO: 5970879 - DNA, 13 bp, Homo sapiens
tgctaatattaaa

SEQ ID NO: 5970880 - DNA, 16 bp, Homo sapiens
tgctaatattaaaagt

SEQ ID NO: 5970881 - DNA, 19 bp, Homo sapiens
tgctaatattttatttgaa

SEQ ID NO: 5970882 - DNA, 20 bp, Homo sapiens
tgctaatattttcctcctga

SEQ ID NO: 5970883 - DNA, 13 bp, Homo sapiens
tgctaatcagtgt

SEQ ID NO: 5970884 - DNA, 17 bp, Homo sapiens
tgctaatcttcagggca

SEQ ID NO: 5970885 - DNA, 13 bp, Homo sapiens
tgctaatcttctt

SEQ ID NO: 5970886 - DNA, 22 bp, Homo sapiens
tgctaatcttcttatgcaattt

SEQ ID NO: 5970887 - DNA, 22 bp, Homo sapiens
tgctaatgaattttaaaagcat

SEQ ID NO: 5970888 - DNA, 15 bp, Homo sapiens
tgctaatgtaatcat

SEQ ID NO: 5970889 - DNA, 22 bp, Homo sapiens
tgctaatgtaatcatttatctt

SEQ ID NO: 5970890 - DNA, 13 bp, Homo sapiens
tgctaatgtataa

SEQ ID NO: 5970891 - DNA, 16 bp, Homo sapiens
tgctaatgtataatgt

SEQ ID NO: 5970892 - DNA, 20 bp, Homo sapiens
tgctaatgtgtctgtggacc

SEQ ID NO: 5970893 - DNA, 22 bp, Homo sapiens
tgctaatgtgtctgtggaccct

SEQ ID NO: 5970894 - DNA, 13 bp, Homo sapiens
tgctaatgttgat

SEQ ID NO: 5970895 - DNA, 13 bp, Homo sapiens
tgctaattaaata

SEQ ID NO: 5970896 - DNA, 18 bp, Homo sapiens
tgctaattaaataataca

SEQ ID NO: 5970897 - DNA, 14 bp, Homo sapiens
tgctaattctgagg

SEQ ID NO: 5970898 - DNA, 14 bp, Homo sapiens
tgctaattctttgc

SEQ ID NO: 5970899 - DNA, 17 bp, Homo sapiens
tgctaattctttgcaaa

SEQ ID NO: 5970900 - DNA, 22 bp, Homo sapiens
tgctaattctttgcaaaaatcc

SEQ ID NO: 5970901 - DNA, 20 bp, Homo sapiens
tgctaattgctgttgaaagc

SEQ ID NO: 5970902 - DNA, 21 bp, Homo sapiens
tgctaattgctgttgaaagca

SEQ ID NO: 5970903 - DNA, 14 bp, Homo sapiens
tgctaattgtgtat

SEQ ID NO: 5970904 - DNA, 16 bp, Homo sapiens
tgctaatttaaagaga

SEQ ID NO: 5970905 - DNA, 17 bp, Homo sapiens
tgctaatttaaagagac

SEQ ID NO: 5970906 - DNA, 17 bp, Homo sapiens
tgctaatttaaaggagc

SEQ ID NO: 5970907 - DNA, 14 bp, Homo sapiens
tgctaatttagaga

SEQ ID NO: 5970908 - DNA, 21 bp, Homo sapiens
tgctaatttctgtccagaaaa

SEQ ID NO: 5970909 - DNA, 13 bp, Homo sapiens
tgctaatttgttt

SEQ ID NO: 5970910 - DNA, 19 bp, Homo sapiens
tgctaattttgaaaaactg

SEQ ID NO: 5970911 - DNA, 16 bp, Homo sapiens
tgctacaaaaacacag

SEQ ID NO: 5970912 - DNA, 18 bp, Homo sapiens
tgctacaaaacaccttgt

SEQ ID NO: 5970913 - DNA, 21 bp, Homo sapiens
tgctacaacatcactaatttg

SEQ ID NO: 5970914 - DNA, 15 bp, Homo sapiens
tgctacaacatgtga

SEQ ID NO: 5970915 - DNA, 15 bp, Homo sapiens
tgctacaagtgtttt

SEQ ID NO: 5970916 - DNA, 19 bp, Homo sapiens
tgctacaagtgttttagat

SEQ ID NO: 5970917 - DNA, 12 bp, Homo sapiens
tgctacaataaa

SEQ ID NO: 5970918 - DNA, 13 bp, Homo sapiens
tgctacaataaat

SEQ ID NO: 5970919 - DNA, 21 bp, Homo sapiens
tgctacaatcccaaagcgctc

SEQ ID NO: 5970920 - DNA, 12 bp, Homo sapiens
tgctacaatgtc

SEQ ID NO: 5970921 - DNA, 14 bp, Homo sapiens
tgctacaattttaa

SEQ ID NO: 5970922 - DNA, 12 bp, Homo sapiens
tgctacacacac

SEQ ID NO: 5970923 - DNA, 13 bp, Homo sapiens
tgctacacacaca

SEQ ID NO: 5970924 - DNA, 16 bp, Homo sapiens
tgctacacaggcagga

SEQ ID NO: 5970925 - DNA, 17 bp, Homo sapiens
tgctacaccccttttcc

SEQ ID NO: 5970926 - DNA, 21 bp, Homo sapiens
tgctacaccttagcagctctt

SEQ ID NO: 5970927 - DNA, 20 bp, Homo sapiens
tgctacagatgatagaggat

SEQ ID NO: 5970928 - DNA, 16 bp, Homo sapiens
tggatgtggacttttt

SEQ ID NO: 5970929 - DNA, 14 bp, Homo sapiens
tggatgtgtgtgtg

SEQ ID NO: 5970930 - DNA, 16 bp, Homo sapiens
tggatgttatgaacag

SEQ ID NO: 5970931 - DNA, 15 bp, Homo sapiens
tggatgttgtgtgta

SEQ ID NO: 5970932 - DNA, 14 bp, Homo sapiens
tggatgtttcttct

SEQ ID NO: 5970933 - DNA, 13 bp, Homo sapiens
tggatgttttaat

SEQ ID NO: 5970934 - DNA, 20 bp, Homo sapiens
tggatgttttaattccatga

SEQ ID NO: 5970935 - DNA, 22 bp, Homo sapiens
tggatgtttttagttctgactt

SEQ ID NO: 5970936 - DNA, 12 bp, Homo sapiens
tggattaaaaca

SEQ ID NO: 5970937 - DNA, 14 bp, Homo sapiens
tggattaaaccttt

SEQ ID NO: 5970938 - DNA, 14 bp, Homo sapiens
tggattaaacttat

SEQ ID NO: 5970939 - DNA, 18 bp, Homo sapiens
tggattaaacttatgaat

SEQ ID NO: 5970940 - DNA, 15 bp, Homo sapiens
tggattaaatggcac

SEQ ID NO: 5970941 - DNA, 22 bp, Homo sapiens
tggattaaatggcacctgtata

SEQ ID NO: 5970942 - DNA, 18 bp, Homo sapiens
tggattaaattctgggtg

SEQ ID NO: 5970943 - DNA, 13 bp, Homo sapiens
tggattaaattta

SEQ ID NO: 5970944 - DNA, 15 bp, Homo sapiens
tggattaaatttaat

SEQ ID NO: 5970945 - DNA, 16 bp, Homo sapiens
tggattacgatgtaaa

SEQ ID NO: 5970946 - DNA, 16 bp, Homo sapiens
tggattagaaatttaa

SEQ ID NO: 5970947 - DNA, 15 bp, Homo sapiens
tggattaggtctctg

SEQ ID NO: 5970948 - DNA, 23 bp, Homo sapiens
tggattataagttctattttact

SEQ ID NO: 5970949 - DNA, 17 bp, Homo sapiens
tggattatattatgaag

SEQ ID NO: 5970950 - DNA, 14 bp, Homo sapiens
tggattatcctgag

SEQ ID NO: 5970951 - DNA, 22 bp, Homo sapiens
tggattatgttgacattttctt

SEQ ID NO: 5970952 - DNA, 13 bp, Homo sapiens
tggattatttaat

SEQ ID NO: 5970953 - DNA, 16 bp, Homo sapiens
tggattatttaataac

SEQ ID NO: 5970954 - DNA, 13 bp, Homo sapiens
tggattatttcat

SEQ ID NO: 5970955 - DNA, 18 bp, Homo sapiens
tggattcaaatgtcagtt

SEQ ID NO: 5970956 - DNA, 18 bp, Homo sapiens
tggattcacccccctctg

SEQ ID NO: 5970957 - DNA, 13 bp, Homo sapiens
tggattcagaaat

SEQ ID NO: 5970958 - DNA, 13 bp, Homo sapiens
tggattcagcctt

SEQ ID NO: 5970959 - DNA, 14 bp, Homo sapiens
tggattcatattta

SEQ ID NO: 5970960 - DNA, 13 bp, Homo sapiens
tggattcatcagc

SEQ ID NO: 5970961 - DNA, 18 bp, Homo sapiens
tggattcattacagctta

SEQ ID NO: 5970962 - DNA, 23 bp, Homo sapiens
tggattcattctcataattccta

SEQ ID NO: 5970963 - DNA, 13 bp, Homo sapiens
tggattcatttcc

SEQ ID NO: 5970964 - DNA, 18 bp, Homo sapiens
tggattcatttcctgccc

SEQ ID NO: 5970965 - DNA, 20 bp, Homo sapiens
tggattcatttcctgccctt

SEQ ID NO: 5970966 - DNA, 16 bp, Homo sapiens
tggattccactgaaat

SEQ ID NO: 5970967 - DNA, 16 bp, Homo sapiens
tggattccagcatttg

SEQ ID NO: 5970968 - DNA, 15 bp, Homo sapiens
tggattccatgctaa

SEQ ID NO: 5970969 - DNA, 23 bp, Homo sapiens
tggattcccccccctttcctaaa

SEQ ID NO: 5970970 - DNA, 21 bp, Homo sapiens
tggattccctattcgtagcca

SEQ ID NO: 5970971 - DNA, 13 bp, Homo sapiens
tggattccctttt

SEQ ID NO: 5970972 - DNA, 17 bp, Homo sapiens
tggattcccttttgact

SEQ ID NO: 5970973 - DNA, 21 bp, Homo sapiens
tggattcctaaatattttcaa

SEQ ID NO: 5970974 - DNA, 23 bp, Homo sapiens
tggattcctaaatattttcaaga

SEQ ID NO: 5970975 - DNA, 16 bp, Homo sapiens
tggattcctaagcagt

SEQ ID NO: 5970976 - DNA, 12 bp, Homo sapiens
tggattcctccc

SEQ ID NO: 5970977 - DNA, 18 bp, Homo sapiens
tggattcctccccaccct

SEQ ID NO: 5970978 - DNA, 22 bp, Homo sapiens
tggattcctccccaccctgtcc

SEQ ID NO: 5970979 - DNA, 24 bp, Homo sapiens
tggattcctccccaccctgtccca

SEQ ID NO: 5970980 - DNA, 13 bp, Homo sapiens
tggattctaaaat

SEQ ID NO: 5970981 - DNA, 15 bp, Homo sapiens
tggattctcagatat

SEQ ID NO: 5970982 - DNA, 19 bp, Homo sapiens
tggattctcagatatttat

SEQ ID NO: 5970983 - DNA, 16 bp, Homo sapiens
tggattctgagagctg

SEQ ID NO: 5970984 - DNA, 14 bp, Homo sapiens
tggattctttccat

SEQ ID NO: 5970985 - DNA, 12 bp, Homo sapiens
tggattgagtaa

SEQ ID NO: 5970986 - DNA, 18 bp, Homo sapiens
tggattgcagtccccagt

SEQ ID NO: 5970987 - DNA, 16 bp, Homo sapiens
tggattgccacagctc

SEQ ID NO: 5970988 - DNA, 23 bp, Homo sapiens
tggattgcccgcgctcaggaggt

SEQ ID NO: 5970989 - DNA, 16 bp, Homo sapiens
tggattgcctctgaaa

SEQ ID NO: 5970990 - DNA, 18 bp, Homo sapiens
tggattgcgcctttgtat

SEQ ID NO: 5970991 - DNA, 20 bp, Homo sapiens
tggattggaatgcagaggtc

SEQ ID NO: 5970992 - DNA, 20 bp, Homo sapiens
tggattggagatagggaaag

SEQ ID NO: 5970993 - DNA, 15 bp, Homo sapiens
tggattggattattt

SEQ ID NO: 5970994 - DNA, 17 bp, Homo sapiens
tggattggattatttaa

SEQ ID NO: 5970995 - DNA, 23 bp, Homo sapiens
tggattggattatttaataacat

SEQ ID NO: 5970996 - DNA, 13 bp, Homo sapiens
tggattggatttg

SEQ ID NO: 5970997 - DNA, 17 bp, Homo sapiens
tggattggcaggtgtgg

SEQ ID NO: 5970998 - DNA, 21 bp, Homo sapiens
tggattgggggggccaaaagg

SEQ ID NO: 5970999 - DNA, 14 bp, Homo sapiens
tggattgtagaact

SEQ ID NO: 5971000 - DNA, 18 bp, Homo sapiens
tggattgtattgtgagat

SEQ ID NO: 5971001 - DNA, 15 bp, Homo sapiens
tggattgtatttaag

SEQ ID NO: 5971002 - DNA, 16 bp, Homo sapiens
tggattgtatttaaga

SEQ ID NO: 5971003 - DNA, 18 bp, Homo sapiens
tggattgtatttaagaca

SEQ ID NO: 5971004 - DNA, 21 bp, Homo sapiens
tggattgtatttaagacataa

SEQ ID NO: 5971005 - DNA, 14 bp, Homo sapiens
tggattgtcaaaga

SEQ ID NO: 5971006 - DNA, 20 bp, Homo sapiens
tggattgtgcctaatgtgtt

SEQ ID NO: 5971007 - DNA, 21 bp, Homo sapiens
tggattgttaatttcagtcct

SEQ ID NO: 5971008 - DNA, 18 bp, Homo sapiens
tggatttaaaagcctgct

SEQ ID NO: 5971009 - DNA, 23 bp, Homo sapiens
tggatttaagagtattttaagaa

SEQ ID NO: 5971010 - DNA, 18 bp, Homo sapiens
tggatttacgactgaaga

SEQ ID NO: 5971011 - DNA, 19 bp, Homo sapiens
tggatttacgactgaagaa

SEQ ID NO: 5971012 - DNA, 17 bp, Homo sapiens
tggatttactgagagaa

SEQ ID NO: 5971013 - DNA, 15 bp, Homo sapiens
tggatttagtttcag

SEQ ID NO: 5971014 - DNA, 20 bp, Homo sapiens
tggatttataaatgctattt

SEQ ID NO: 5971015 - DNA, 22 bp, Homo sapiens
tggatttatagtatgtgacttt

SEQ ID NO: 5971016 - DNA, 22 bp, Homo sapiens
tggatttatgttgtatagatta

SEQ ID NO: 5971017 - DNA, 21 bp, Homo sapiens
tggatttccagtttttcttta

SEQ ID NO: 5971018 - DNA, 20 bp, Homo sapiens
tggatttcctagtggagttt

SEQ ID NO: 5971019 - DNA, 18 bp, Homo sapiens
tggatttcctattttaaa

SEQ ID NO: 5971020 - DNA, 14 bp, Homo sapiens
tggatttctggtct

SEQ ID NO: 5971021 - DNA, 15 bp, Homo sapiens
tggatttctgtgaag

SEQ ID NO: 5971022 - DNA, 14 bp, Homo sapiens
tggatttcttccta

SEQ ID NO: 5971023 - DNA, 18 bp, Homo sapiens
tggatttctttatataag

SEQ ID NO: 5971024 - DNA, 20 bp, Homo sapiens
tggatttctttatataaggt

SEQ ID NO: 5971025 - DNA, 15 bp, Homo sapiens
tggatttctttgaaa

SEQ ID NO: 5971026 - DNA, 18 bp, Homo sapiens
tggatttctttgaaaaaa

SEQ ID NO: 5971027 - DNA, 14 bp, Homo sapiens
tggatttcttttgt

SEQ ID NO: 5971028 - DNA, 23 bp, Homo sapiens
tggatttgacacactcaccattt

SEQ ID NO: 5971029 - DNA, 24 bp, Homo sapiens
tggatttgatgagttaactgtgaa

SEQ ID NO: 5971030 - DNA, 18 bp, Homo sapiens
tggatttgcctgtgccac

SEQ ID NO: 5971031 - DNA, 12 bp, Homo sapiens
tggatttgctgt

SEQ ID NO: 5971032 - DNA, 17 bp, Homo sapiens
tggatttggactcgaaa

SEQ ID NO: 5971033 - DNA, 17 bp, Homo sapiens
tggatttggagagaaat

SEQ ID NO: 5971034 - DNA, 20 bp, Homo sapiens
tggatttggagagaaatatt

SEQ ID NO: 5971035 - DNA, 18 bp, Homo sapiens
tggatttggcactagcca

SEQ ID NO: 5971036 - DNA, 14 bp, Homo sapiens
tggatttgtccaaa

SEQ ID NO: 5971037 - DNA, 17 bp, Homo sapiens
tggatttgtccaaacag

SEQ ID NO: 5971038 - DNA, 21 bp, Homo sapiens
tggatttgtccaaacaggtgc

SEQ ID NO: 5971039 - DNA, 23 bp, Homo sapiens
tggatttgtccaaacaggtgctg

SEQ ID NO: 5971040 - DNA, 15 bp, Homo sapiens
tggatttgtttaaaa

SEQ ID NO: 5971041 - DNA, 18 bp, Homo sapiens
tggattttaaaaaatcaa

SEQ ID NO: 5971042 - DNA, 19 bp, Homo sapiens
tggattttaaaaattggaa

SEQ ID NO: 5971043 - DNA, 18 bp, Homo sapiens
tggattttaaacaaaatt

SEQ ID NO: 5971044 - DNA, 14 bp, Homo sapiens
tggattttaaatgt

SEQ ID NO: 5971045 - DNA, 23 bp, Homo sapiens
tggattttcaaagattgttggca

SEQ ID NO: 5971046 - DNA, 19 bp, Homo sapiens
tggattttcccctgaagac

SEQ ID NO: 5971047 - DNA, 14 bp, Homo sapiens
tggattttcctgaa

SEQ ID NO: 5971048 - DNA, 20 bp, Homo sapiens
tggattttctattgttactc

SEQ ID NO: 5971049 - DNA, 14 bp, Homo sapiens
tggattttctttct

SEQ ID NO: 5971050 - DNA, 17 bp, Homo sapiens
tggattttctttctatg

SEQ ID NO: 5971051 - DNA, 15 bp, Homo sapiens
tggattttgaattag

SEQ ID NO: 5971052 - DNA, 17 bp, Homo sapiens
tggattttggcagggcg

SEQ ID NO: 5971053 - DNA, 14 bp, Homo sapiens
tggattttgtattt

SEQ ID NO: 5971054 - DNA, 17 bp, Homo sapiens
tggatttttaattaaaa

SEQ ID NO: 5971055 - DNA, 14 bp, Homo sapiens
tggatttttacaaa

SEQ ID NO: 5971056 - DNA, 16 bp, Homo sapiens
tggatttttacaagat

SEQ ID NO: 5971057 - DNA, 13 bp, Homo sapiens
tggatttttacca

SEQ ID NO: 5971058 - DNA, 23 bp, Homo sapiens
tggattttttccattatgttcat

SEQ ID NO: 5971059 - DNA, 23 bp, Homo sapiens
tggattttttccttcaaagttta

SEQ ID NO: 5971060 - DNA, 18 bp, Homo sapiens
tggattttttttttcagg

SEQ ID NO: 5971061 - DNA, 18 bp, Homo sapiens
tggcaaaaaaaaaaaagc

SEQ ID NO: 5971062 - DNA, 15 bp, Homo sapiens
tggcaaaaaagaaca

SEQ ID NO: 5971063 - DNA, 18 bp, Homo sapiens
tggcaaaaaggagccttt

SEQ ID NO: 5971064 - DNA, 12 bp, Homo sapiens
tggcaaaaaggc

SEQ ID NO: 5971065 - DNA, 17 bp, Homo sapiens
tggcaaaacagccctca

SEQ ID NO: 5971066 - DNA, 22 bp, Homo sapiens
tggcaaaaccagtagcttccca

SEQ ID NO: 5971067 - DNA, 20 bp, Homo sapiens
tggcaaaactctacttaatc

SEQ ID NO: 5971068 - DNA, 15 bp, Homo sapiens
tggcaaaagccttgt

SEQ ID NO: 5971069 - DNA, 20 bp, Homo sapiens
tggcaaaagtaatcatgttt

SEQ ID NO: 5971070 - DNA, 24 bp, Homo sapiens
tggcaaacagggcctctgcggagc

SEQ ID NO: 5971071 - DNA, 14 bp, Homo sapiens
tggcaaacatgtgc

SEQ ID NO: 5971072 - DNA, 22 bp, Homo sapiens
tggcaaacatgtgcaactcttg

SEQ ID NO: 5971073 - DNA, 18 bp, Homo sapiens
tggcaaaccccaaagaga

SEQ ID NO: 5971074 - DNA, 14 bp, Homo sapiens
tggcaaaccctccc

SEQ ID NO: 5971075 - DNA, 20 bp, Homo sapiens
tggcaaaccctcccagaaac

SEQ ID NO: 5971076 - DNA, 16 bp, Homo sapiens
tggcaaacgagacttt

SEQ ID NO: 5971077 - DNA, 20 bp, Homo sapiens
tggcaaacgagactttctcc

SEQ ID NO: 5971078 - DNA, 24 bp, Homo sapiens
tggcaaacgctaaagagcccttgc

SEQ ID NO: 5971079 - DNA, 17 bp, Homo sapiens
tggcaaacttcagactg

SEQ ID NO: 5971080 - DNA, 17 bp, Homo sapiens
tggcaaagatgtgggga

SEQ ID NO: 5971081 - DNA, 13 bp, Homo sapiens
tggcaaagcagaa

SEQ ID NO: 5971082 - DNA, 18 bp, Homo sapiens
tggcaaagcagaatgtga

SEQ ID NO: 5971083 - DNA, 20 bp, Homo sapiens
tggcaaagcggttgcttctg

SEQ ID NO: 5971084 - DNA, 20 bp, Homo sapiens
tggcaaagctgttcttcctg

SEQ ID NO: 5971085 - DNA, 18 bp, Homo sapiens
tggcaaagcttttagaaa

SEQ ID NO: 5971086 - DNA, 21 bp, Homo sapiens
tggcaaaggacccttgagtaa

SEQ ID NO: 5971087 - DNA, 20 bp, Homo sapiens
tggcaaagtgacaaagcaat

SEQ ID NO: 5971088 - DNA, 15 bp, Homo sapiens
tggcaaatattttgt

SEQ ID NO: 5971089 - DNA, 16 bp, Homo sapiens
tggcaaatcaggggcc

SEQ ID NO: 5971090 - DNA, 23 bp, Homo sapiens
tggcaaatcctgtcggtctccag

SEQ ID NO: 5971091 - DNA, 14 bp, Homo sapiens
tggcaaatgatgat

SEQ ID NO: 5971092 - DNA, 18 bp, Homo sapiens
tggcaaatgcacacacct

SEQ ID NO: 5971093 - DNA, 22 bp, Homo sapiens
tggcaaatgccaactgttggaa

SEQ ID NO: 5971094 - DNA, 17 bp, Homo sapiens
tggcaaattaacttgag

SEQ ID NO: 5971095 - DNA, 15 bp, Homo sapiens
tggcaaattttaaaa

SEQ ID NO: 5971096 - DNA, 14 bp, Homo sapiens
ttacagattaaaga

SEQ ID NO: 5971097 - DNA, 19 bp, Homo sapiens
ttacagattatcacattaa

SEQ ID NO: 5971098 - DNA, 17 bp, Homo sapiens
ttacagattgcctcctt

SEQ ID NO: 5971099 - DNA, 21 bp, Homo sapiens
ttacagatttattcctttgtt

SEQ ID NO: 5971100 - DNA, 15 bp, Homo sapiens
ttacagcaaatcctt

SEQ ID NO: 5971101 - DNA, 13 bp, Homo sapiens
ttacagcagcaat

SEQ ID NO: 5971102 - DNA, 19 bp, Homo sapiens
ttacagcagttgactcaga

SEQ ID NO: 5971103 - DNA, 17 bp, Homo sapiens
ttacagctctgacttta

SEQ ID NO: 5971104 - DNA, 21 bp, Homo sapiens
ttacagctctgactttacact

SEQ ID NO: 5971105 - DNA, 21 bp, Homo sapiens
ttacctgcatgtgttgtacaa

SEQ ID NO: 5971106 - DNA, 22 bp, Homo sapiens
ttacctgcatgtgttgtacaat

SEQ ID NO: 5971107 - DNA, 18 bp, Homo sapiens
ttacctgccaattgctac

SEQ ID NO: 5971108 - DNA, 20 bp, Homo sapiens
ttacctgccaattgctaccg

SEQ ID NO: 5971109 - DNA, 16 bp, Homo sapiens
ttacctggaaaccaga

SEQ ID NO: 5971110 - DNA, 12 bp, Homo sapiens
ttacctgggaaa

SEQ ID NO: 5971111 - DNA, 13 bp, Homo sapiens
ttacctggtgctc

SEQ ID NO: 5971112 - DNA, 15 bp, Homo sapiens
ttacctgtatacagt

SEQ ID NO: 5971113 - DNA, 19 bp, Homo sapiens
ttacctgtatacagtgcag

SEQ ID NO: 5971114 - DNA, 11 bp, Homo sapiens
ttacctgtcac

SEQ ID NO: 5971115 - DNA, 19 bp, Homo sapiens
ttacctgtcattttgcact

SEQ ID NO: 5971116 - DNA, 21 bp, Homo sapiens
ttacctgtcattttgcactgt

SEQ ID NO: 5971117 - DNA, 13 bp, Homo sapiens
ttacctgtgtgct

SEQ ID NO: 5971118 - DNA, 22 bp, Homo sapiens
ttacctgttctctagttttcca

SEQ ID NO: 5971119 - DNA, 17 bp, Homo sapiens
ttacctgttgtctgaaa

SEQ ID NO: 5971120 - DNA, 21 bp, Homo sapiens
ttacctgttgtctgaaacata

SEQ ID NO: 5971121 - DNA, 23 bp, Homo sapiens
ttaccttaaaactaggcatttgt

SEQ ID NO: 5971122 - DNA, 14 bp, Homo sapiens
ttaccttaaatctg

SEQ ID NO: 5971123 - DNA, 15 bp, Homo sapiens
ttaccttaagatttt

SEQ ID NO: 5971124 - DNA, 23 bp, Homo sapiens
ttaccttattgagcgtgattctg

SEQ ID NO: 5971125 - DNA, 14 bp, Homo sapiens
ttaccttcaataaa

SEQ ID NO: 5971126 - DNA, 15 bp, Homo sapiens
ttaccttcaataaag

SEQ ID NO: 5971127 - DNA, 19 bp, Homo sapiens
ttaccttcaataaagtatc

SEQ ID NO: 5971128 - DNA, 14 bp, Homo sapiens
ttaccttcccgcct

SEQ ID NO: 5971129 - DNA, 13 bp, Homo sapiens
ttaccttctaaaa

SEQ ID NO: 5971130 - DNA, 14 bp, Homo sapiens
ttaccttctttcta

SEQ ID NO: 5971131 - DNA, 18 bp, Homo sapiens
ttaccttgaactgaaggc

SEQ ID NO: 5971132 - DNA, 18 bp, Homo sapiens
ttaccttgactgttgatg

SEQ ID NO: 5971133 - DNA, 16 bp, Homo sapiens
ttaccttggttaactt

SEQ ID NO: 5971134 - DNA, 15 bp, Homo sapiens
ttaccttgttattta

SEQ ID NO: 5971135 - DNA, 16 bp, Homo sapiens
ttacctttacataatt

SEQ ID NO: 5971136 - DNA, 20 bp, Homo sapiens
ttacctttatctttcacctt

SEQ ID NO: 5971137 - DNA, 20 bp, Homo sapiens
ttacctttattaatgaactg

SEQ ID NO: 5971138 - DNA, 13 bp, Homo sapiens
ttacctttcatac

SEQ ID NO: 5971139 - DNA, 20 bp, Homo sapiens
ttacctttccagtatgaaaa

SEQ ID NO: 5971140 - DNA, 23 bp, Homo sapiens
ttacctttcccatgctgaattat

SEQ ID NO: 5971141 - DNA, 19 bp, Homo sapiens
ttaccttttaattaatgaa

SEQ ID NO: 5971142 - DNA, 17 bp, Homo sapiens
ttaccttttctataagt

SEQ ID NO: 5971143 - DNA, 18 bp, Homo sapiens
ttacctttttatttgcat

SEQ ID NO: 5971144 - DNA, 20 bp, Homo sapiens
ttacctttttatttgcatgt

SEQ ID NO: 5971145 - DNA, 23 bp, Homo sapiens
ttacctttttgaaaaagaaaaca

SEQ ID NO: 5971146 - DNA, 22 bp, Homo sapiens
ttaccttttttatacataaaca

SEQ ID NO: 5971147 - DNA, 17 bp, Homo sapiens
ttaccttttttgataaa

SEQ ID NO: 5971148 - DNA, 23 bp, Homo sapiens
ttacgaaaaaatggtagcatttt

SEQ ID NO: 5971149 - DNA, 13 bp, Homo sapiens
ttacgaagacaaa

SEQ ID NO: 5971150 - DNA, 18 bp, Homo sapiens
ttacgacactttggttta

SEQ ID NO: 5971151 - DNA, 16 bp, Homo sapiens
ttacgataaggaagaa

SEQ ID NO: 5971152 - DNA, 18 bp, Homo sapiens
ttacgataaggaagaaac

SEQ ID NO: 5971153 - DNA, 15 bp, Homo sapiens
ttacgatcaggcaca

SEQ ID NO: 5971154 - DNA, 14 bp, Homo sapiens
ttacgatctgtttc

SEQ ID NO: 5971155 - DNA, 17 bp, Homo sapiens
ttacgatttcactagga

SEQ ID NO: 5971156 - DNA, 18 bp, Homo sapiens
ttacgcccaacccttccc

SEQ ID NO: 5971157 - DNA, 18 bp, Homo sapiens
ttacgctgctctcctgac

SEQ ID NO: 5971158 - DNA, 15 bp, Homo sapiens
ttacgctttgattca

SEQ ID NO: 5971159 - DNA, 22 bp, Homo sapiens
ttacggactctggatatttgca

SEQ ID NO: 5971160 - DNA, 15 bp, Homo sapiens
ttacggaggaacaga

SEQ ID NO: 5971161 - DNA, 22 bp, Homo sapiens
ttacgggtaacagtgaggctgg

SEQ ID NO: 5971162 - DNA, 15 bp, Homo sapiens
ttacggtgatattgt

SEQ ID NO: 5971163 - DNA, 20 bp, Homo sapiens
ttacgtaaacctgaaatata

SEQ ID NO: 5971164 - DNA, 19 bp, Homo sapiens
ttacgtactgtaactgctc

SEQ ID NO: 5971165 - DNA, 21 bp, Homo sapiens
ttacgtagtgtagatttgttt

SEQ ID NO: 5971166 - DNA, 15 bp, Homo sapiens
ttacgtatatttcat

SEQ ID NO: 5971167 - DNA, 22 bp, Homo sapiens
ttacgtatgcaagtctgtgagt

SEQ ID NO: 5971168 - DNA, 18 bp, Homo sapiens
ttacgtgaagaaataaat

SEQ ID NO: 5971169 - DNA, 12 bp, Homo sapiens
ttacgtgagcca

SEQ ID NO: 5971170 - DNA, 15 bp, Homo sapiens
ttacgtgagccaggt

SEQ ID NO: 5971171 - DNA, 14 bp, Homo sapiens
ttacgtgagtcctg

SEQ ID NO: 5971172 - DNA, 17 bp, Homo sapiens
ttacgtgcaaacaacct

SEQ ID NO: 5971173 - DNA, 20 bp, Homo sapiens
ttacgtgcaaacaacctgaa

SEQ ID NO: 5971174 - DNA, 21 bp, Homo sapiens
ttacgtgcaaacaacctgaat

SEQ ID NO: 5971175 - DNA, 12 bp, Homo sapiens
ttacgtgcattt

SEQ ID NO: 5971176 - DNA, 17 bp, Homo sapiens
ttacgtgcatttaaact

SEQ ID NO: 5971177 - DNA, 19 bp, Homo sapiens
ttacgtgcatttaaactct

SEQ ID NO: 5971178 - DNA, 21 bp, Homo sapiens
ttacgttcatcacctgctaga

SEQ ID NO: 5971179 - DNA, 21 bp, Homo sapiens
ttacgttggttaaataaactt

SEQ ID NO: 5971180 - DNA, 19 bp, Homo sapiens
ttacgttgtttcttataga

SEQ ID NO: 5971181 - DNA, 21 bp, Homo sapiens
ttacgtttaagcttaacattt

SEQ ID NO: 5971182 - DNA, 13 bp, Homo sapiens
ttacgtttgtcct

SEQ ID NO: 5971183 - DNA, 16 bp, Homo sapiens
ttacgtttttctggtg

SEQ ID NO: 5971184 - DNA, 18 bp, Homo sapiens
ttactaaaaaaaagatga

SEQ ID NO: 5971185 - DNA, 14 bp, Homo sapiens
ttactaaaaagtac

SEQ ID NO: 5971186 - DNA, 15 bp, Homo sapiens
ttactaaaaagtata

SEQ ID NO: 5971187 - DNA, 14 bp, Homo sapiens
ttactaaaatatat

SEQ ID NO: 5971188 - DNA, 21 bp, Homo sapiens
ttactaaaatttacacatctt

SEQ ID NO: 5971189 - DNA, 21 bp, Homo sapiens
ttactaaacattttgttattg

SEQ ID NO: 5971190 - DNA, 18 bp, Homo sapiens
ttactaaagaaaatatct

SEQ ID NO: 5971191 - DNA, 22 bp, Homo sapiens
ttactaaagaaaatatctgaaa

SEQ ID NO: 5971192 - DNA, 13 bp, Homo sapiens
ttactaaagcagt

SEQ ID NO: 5971193 - DNA, 17 bp, Homo sapiens
ttactaaagcagtgttt

SEQ ID NO: 5971194 - DNA, 12 bp, Homo sapiens
ttactaaagtca

SEQ ID NO: 5971195 - DNA, 12 bp, Homo sapiens
ttactaaatcta

SEQ ID NO: 5971196 - DNA, 22 bp, Homo sapiens
ttactaacagtaactgccattt

SEQ ID NO: 5971197 - DNA, 16 bp, Homo sapiens
ttactaaccaccattt

SEQ ID NO: 5971198 - DNA, 11 bp, Homo sapiens
ttactaacttc

SEQ ID NO: 5971199 - DNA, 15 bp, Homo sapiens
ttactaacttctaaa

SEQ ID NO: 5971200 - DNA, 21 bp, Homo sapiens
ttactaacttctaaaactgta

SEQ ID NO: 5971201 - DNA, 22 bp, Homo sapiens
ttactaagaagaaaattgctgt

SEQ ID NO: 5971202 - DNA, 22 bp, Homo sapiens
ttactaagatgacattgctaag

SEQ ID NO: 5971203 - DNA, 22 bp, Homo sapiens
ttactaagcactgtgtttatat

SEQ ID NO: 5971204 - DNA, 17 bp, Homo sapiens
ttactaagccacaagaa

SEQ ID NO: 5971205 - DNA, 21 bp, Homo sapiens
ttactaagccacaagaaattt

SEQ ID NO: 5971206 - DNA, 22 bp, Homo sapiens
ttactaagctttgccagctgct

SEQ ID NO: 5971207 - DNA, 18 bp, Homo sapiens
ttactaataaaatgtgaa

SEQ ID NO: 5971208 - DNA, 16 bp, Homo sapiens
ttactaatagacaatt

SEQ ID NO: 5971209 - DNA, 12 bp, Homo sapiens
ttactaatatat

SEQ ID NO: 5971210 - DNA, 17 bp, Homo sapiens
ttactaatgaggtacgc

SEQ ID NO: 5971211 - DNA, 15 bp, Homo sapiens
ttactaatgatttag

SEQ ID NO: 5971212 - DNA, 17 bp, Homo sapiens
ttactaattatactact

SEQ ID NO: 5971213 - DNA, 21 bp, Homo sapiens
ttactaattctatttctctat

SEQ ID NO: 5971214 - DNA, 22 bp, Homo sapiens
ttactaatttaaagatgctgtc

SEQ ID NO: 5971215 - DNA, 20 bp, Homo sapiens
ttactaatttgtataaccca

SEQ ID NO: 5971216 - DNA, 17 bp, Homo sapiens
ttactacaatatgtaca

SEQ ID NO: 5971217 - DNA, 23 bp, Homo sapiens
ttactacacagtttggttacagg

SEQ ID NO: 5971218 - DNA, 19 bp, Homo sapiens
ttactacactggtgtgtcc

SEQ ID NO: 5971219 - DNA, 20 bp, Homo sapiens
ttactacactggtgtgtccc

SEQ ID NO: 5971220 - DNA, 13 bp, Homo sapiens
ttactacagttgt

SEQ ID NO: 5971221 - DNA, 15 bp, Homo sapiens
ttactacagttttta

SEQ ID NO: 5971222 - DNA, 23 bp, Homo sapiens
ttactacataattaaattttaat

SEQ ID NO: 5971223 - DNA, 14 bp, Homo sapiens
ttactacatgcact

SEQ ID NO: 5971224 - DNA, 18 bp, Homo sapiens
ttactacatgtgggagct

SEQ ID NO: 5971225 - DNA, 20 bp, Homo sapiens
ttactacccaaatctaaata

SEQ ID NO: 5971226 - DNA, 22 bp, Homo sapiens
ttactaccctcaccctttacct

SEQ ID NO: 5971227 - DNA, 13 bp, Homo sapiens
ttactaccttatc

SEQ ID NO: 5971228 - DNA, 14 bp, Homo sapiens
ttactactcctttg

SEQ ID NO: 5971229 - DNA, 17 bp, Homo sapiens
ttactactgagggaaat

SEQ ID NO: 5971230 - DNA, 14 bp, Homo sapiens
ttactactgcaagt

SEQ ID NO: 5971231 - DNA, 18 bp, Homo sapiens
ttactactgcaagttcaa

SEQ ID NO: 5971232 - DNA, 20 bp, Homo sapiens
ttactacttcttggaaaaaa

SEQ ID NO: 5971233 - DNA, 16 bp, Homo sapiens
ttactacttgttacct

SEQ ID NO: 5971234 - DNA, 19 bp, Homo sapiens
ttactacttgttacctttc

SEQ ID NO: 5971235 - DNA, 20 bp, Homo sapiens
ttactacttgttacctttcc

SEQ ID NO: 5971236 - DNA, 15 bp, Homo sapiens
ttactagaaatatat

SEQ ID NO: 5971237 - DNA, 19 bp, Homo sapiens
ttactagaaatatattcat

SEQ ID NO: 5971238 - DNA, 12 bp, Homo sapiens
ttactagaaatg

SEQ ID NO: 5971239 - DNA, 21 bp, Homo sapiens
ttactagaaatgggaatcatg

SEQ ID NO: 5971240 - DNA, 20 bp, Homo sapiens
ttactagaacacagaaagcc

SEQ ID NO: 5971241 - DNA, 22 bp, Homo sapiens
ttactagaaggcgtccatgttt

SEQ ID NO: 5971242 - DNA, 21 bp, Homo sapiens
ttactagagaatgttcccaat

SEQ ID NO: 5971243 - DNA, 16 bp, Homo sapiens
ttactagataaaatgt

SEQ ID NO: 5971244 - DNA, 15 bp, Homo sapiens
ttactagcttttcaa

SEQ ID NO: 5971245 - DNA, 20 bp, Homo sapiens
ttactagggatccctcatct

SEQ ID NO: 5971246 - DNA, 16 bp, Homo sapiens
ttactaggtgacatgt

SEQ ID NO: 5971247 - DNA, 17 bp, Homo sapiens
ttactagtactatttct

SEQ ID NO: 5971248 - DNA, 21 bp, Homo sapiens
ttactagtactatttcttaat

SEQ ID NO: 5971249 - DNA, 17 bp, Homo sapiens
ttactagtttcccttgc

SEQ ID NO: 5971250 - DNA, 15 bp, Homo sapiens
ttactataagaactt

SEQ ID NO: 5971251 - DNA, 20 bp, Homo sapiens
ttactataagaactttgagc

SEQ ID NO: 5971252 - DNA, 15 bp, Homo sapiens
ttactatagcaaagt

SEQ ID NO: 5971253 - DNA, 18 bp, Homo sapiens
ttactatagcaaagtagt

SEQ ID NO: 5971254 - DNA, 15 bp, Homo sapiens
ttactatagtggtga

SEQ ID NO: 5971255 - DNA, 20 bp, Homo sapiens
ttactatatagaatttcctg

SEQ ID NO: 5971256 - DNA, 22 bp, Homo sapiens
ttactatatatatatgcctttt

SEQ ID NO: 5971257 - DNA, 21 bp, Homo sapiens
ttactatcatgtcaaacgtga

SEQ ID NO: 5971258 - DNA, 17 bp, Homo sapiens
ttactatctgttgaaaa

SEQ ID NO: 5971259 - DNA, 20 bp, Homo sapiens
ttactatctgttgaaaaggt

SEQ ID NO: 5971260 - DNA, 13 bp, Homo sapiens
ttactatgcacaa

SEQ ID NO: 5971261 - DNA, 18 bp, Homo sapiens
ttactatgcctgtgtctt

SEQ ID NO: 5971262 - DNA, 19 bp, Homo sapiens
ttactatggccctggccta

SEQ ID NO: 5971263 - DNA, 17 bp, Homo sapiens
ttactatgtaaatgctt

SEQ ID NO: 5971264 - DNA, 22 bp, Homo sapiens
ttactatgtgccagttcctgta

SEQ ID NO: 5971265 - DNA, 15 bp, Homo sapiens
ttactattaacatga

SEQ ID NO: 5971266 - DNA, 16 bp, Homo sapiens
ttactattaacatgat

SEQ ID NO: 5971267 - DNA, 23 bp, Homo sapiens
ttactattaactctgcatagaca

SEQ ID NO: 5971268 - DNA, 23 bp, Homo sapiens
ttactattaagcagtaaaaactg

SEQ ID NO: 5971269 - DNA, 17 bp, Homo sapiens
ttactattatctgtgct

SEQ ID NO: 5971270 - DNA, 19 bp, Homo sapiens
ttactattatttgctatat

SEQ ID NO: 5971271 - DNA, 18 bp, Homo sapiens
ttactattcggtgtgttt

SEQ ID NO: 5971272 - DNA, 21 bp, Homo sapiens
ttactattcttggttcttatt

SEQ ID NO: 5971273 - DNA, 14 bp, Homo sapiens
ttactattgaactg

SEQ ID NO: 5971274 - DNA, 12 bp, Homo sapiens
ttactatttctt

SEQ ID NO: 5971275 - DNA, 15 bp, Homo sapiens
ttactatttcttgtg

SEQ ID NO: 5971276 - DNA, 18 bp, Homo sapiens
aagatcaccttgtattct

SEQ ID NO: 5971277 - DNA, 16 bp, Homo sapiens
aagatcacgctccccg

SEQ ID NO: 5971278 - DNA, 17 bp, Homo sapiens
aagatcacgctccccgc

SEQ ID NO: 5971279 - DNA, 20 bp, Homo sapiens
aagatcactgccagagataa

SEQ ID NO: 5971280 - DNA, 14 bp, Homo sapiens
aagatcactgttta

SEQ ID NO: 5971281 - DNA, 20 bp, Homo sapiens
aagatcactgtttagatttg

SEQ ID NO: 5971282 - DNA, 13 bp, Homo sapiens
ttcatcttttcat

SEQ ID NO: 5971283 - DNA, 21 bp, Homo sapiens
ttcatcttttgaggcttctgt

SEQ ID NO: 5971284 - DNA, 22 bp, Homo sapiens
ttcatgaaaaagctgcttctta

SEQ ID NO: 5971285 - DNA, 22 bp, Homo sapiens
ttcatgaaaatagctctttcag

SEQ ID NO: 5971286 - DNA, 15 bp, Homo sapiens
ttcatgaaagattca

SEQ ID NO: 5971287 - DNA, 18 bp, Homo sapiens
ttcatgaaagattcaatg

SEQ ID NO: 5971288 - DNA, 12 bp, Homo sapiens
ttcatgaaatgc

SEQ ID NO: 5971289 - DNA, 20 bp, Homo sapiens
ttcatgaaatgctatgtcat

SEQ ID NO: 5971290 - DNA, 12 bp, Homo sapiens
ttcatgaagaaa

SEQ ID NO: 5971291 - DNA, 23 bp, Homo sapiens
ttcatgaagaaaaaattttaaaa

SEQ ID NO: 5971292 - DNA, 22 bp, Homo sapiens
ttcatgaataggaatattcaag

SEQ ID NO: 5971293 - DNA, 17 bp, Homo sapiens
ttcatgaatattttcaa

SEQ ID NO: 5971294 - DNA, 22 bp, Homo sapiens
ttcatgaatattttcaagtttt

SEQ ID NO: 5971295 - DNA, 23 bp, Homo sapiens
ttcatgaatctttcatacatata

SEQ ID NO: 5971296 - DNA, 21 bp, Homo sapiens
ttcatgaattagaagaaaatg

SEQ ID NO: 5971297 - DNA, 15 bp, Homo sapiens
ttcatgaatttctcc

SEQ ID NO: 5971298 - DNA, 15 bp, Homo sapiens
ttcatgaccttacat

SEQ ID NO: 5971299 - DNA, 23 bp, Homo sapiens
ttcatgacttttccatgtatcta

SEQ ID NO: 5971300 - DNA, 19 bp, Homo sapiens
ttcatgagatgcagtattg

SEQ ID NO: 5971301 - DNA, 23 bp, Homo sapiens
ttcatgagcattcataattaaaa

SEQ ID NO: 5971302 - DNA, 12 bp, Homo sapiens
ttcatgagccca

SEQ ID NO: 5971303 - DNA, 13 bp, Homo sapiens
ttcatgagcccaa

SEQ ID NO: 5971304 - DNA, 17 bp, Homo sapiens
ttcatgagtattcctag

SEQ ID NO: 5971305 - DNA, 16 bp, Homo sapiens
ttcatgagtggatgga

SEQ ID NO: 5971306 - DNA, 15 bp, Homo sapiens
ttcatgataatgaac

SEQ ID NO: 5971307 - DNA, 19 bp, Homo sapiens
ttcatgatagaaagaataa

SEQ ID NO: 5971308 - DNA, 14 bp, Homo sapiens
ttcatgatgcagtc

SEQ ID NO: 5971309 - DNA, 14 bp, Homo sapiens
ttcatgattagaca

SEQ ID NO: 5971310 - DNA, 16 bp, Homo sapiens
ttcatgattagacaat

SEQ ID NO: 5971311 - DNA, 21 bp, Homo sapiens
ttcatgattggcttaaagtga

SEQ ID NO: 5971312 - DNA, 17 bp, Homo sapiens
ttcatgatttcaagatg

SEQ ID NO: 5971313 - DNA, 23 bp, Homo sapiens
ttcatgatttcatttcaactgtt

SEQ ID NO: 5971314 - DNA, 20 bp, Homo sapiens
ttcatgcaaactctttggtc

SEQ ID NO: 5971315 - DNA, 17 bp, Homo sapiens
ttcatgcacttaaagaa

SEQ ID NO: 5971316 - DNA, 23 bp, Homo sapiens
ttcatgcacttaaagaagtattt

SEQ ID NO: 5971317 - DNA, 21 bp, Homo sapiens
ttcatgcagacaaagccctgt

SEQ ID NO: 5971318 - DNA, 16 bp, Homo sapiens
ttcatgcagtgctctt

SEQ ID NO: 5971319 - DNA, 13 bp, Homo sapiens
ttcatgcatggaa

SEQ ID NO: 5971320 - DNA, 22 bp, Homo sapiens
ttcatgccaccatggccagcca

SEQ ID NO: 5971321 - DNA, 21 bp, Homo sapiens
ttcatgccattttatttcttt

SEQ ID NO: 5971322 - DNA, 14 bp, Homo sapiens
ttcatgcccactgc

SEQ ID NO: 5971323 - DNA, 16 bp, Homo sapiens
ttcatgcccttctgat

SEQ ID NO: 5971324 - DNA, 17 bp, Homo sapiens
ttcatgcctgatgaaag

SEQ ID NO: 5971325 - DNA, 15 bp, Homo sapiens
ttcatgcctggggtg

SEQ ID NO: 5971326 - DNA, 17 bp, Homo sapiens
ttcatgcctttcatagt

SEQ ID NO: 5971327 - DNA, 14 bp, Homo sapiens
ttcatgcctttttt

SEQ ID NO: 5971328 - DNA, 17 bp, Homo sapiens
ttcatgctatctctgtg

SEQ ID NO: 5971329 - DNA, 17 bp, Homo sapiens
ttcatgctctcatatat

SEQ ID NO: 5971330 - DNA, 21 bp, Homo sapiens
ttcatgctgaatccacctcgg

SEQ ID NO: 5971331 - DNA, 19 bp, Homo sapiens
ttcatgctgcctgccatgt

SEQ ID NO: 5971332 - DNA, 20 bp, Homo sapiens
ttcatgctgcctgccatgtg

SEQ ID NO: 5971333 - DNA, 16 bp, Homo sapiens
ttcatgcttctactgt

SEQ ID NO: 5971334 - DNA, 22 bp, Homo sapiens
ttcatgcttctactgtgacact

SEQ ID NO: 5971335 - DNA, 15 bp, Homo sapiens
ttcatgcttgacata

SEQ ID NO: 5971336 - DNA, 19 bp, Homo sapiens
ttcatgcttgacataccta

SEQ ID NO: 5971337 - DNA, 21 bp, Homo sapiens
ttcatgcttgatttgaccact

SEQ ID NO: 5971338 - DNA, 22 bp, Homo sapiens
ttcatgcttgatttgaccactg

SEQ ID NO: 5971339 - DNA, 23 bp, Homo sapiens
ttcatgcttgatttgaccactga

SEQ ID NO: 5971340 - DNA, 22 bp, Homo sapiens
ttcatgcttgccatctgttcat

SEQ ID NO: 5971341 - DNA, 14 bp, Homo sapiens
ttcatgctttctcc

SEQ ID NO: 5971342 - DNA, 19 bp, Homo sapiens
ttcatgctttgatttacac

SEQ ID NO: 5971343 - DNA, 20 bp, Homo sapiens
ttcatggaacgcgttgaaat

SEQ ID NO: 5971344 - DNA, 21 bp, Homo sapiens
ttcatggaacgcgttgaaatt

SEQ ID NO: 5971345 - DNA, 22 bp, Homo sapiens
ttcatggaacgcgttgaaattg

SEQ ID NO: 5971346 - DNA, 21 bp, Homo sapiens
ttcatggaactttcatacgta

SEQ ID NO: 5971347 - DNA, 20 bp, Homo sapiens
ttcatggaatggacatcctg

SEQ ID NO: 5971348 - DNA, 16 bp, Homo sapiens
ttcatggacactttga

SEQ ID NO: 5971349 - DNA, 17 bp, Homo sapiens
ttcatggaccactgttt

SEQ ID NO: 5971350 - DNA, 20 bp, Homo sapiens
ttcatggaccactgtttctt

SEQ ID NO: 5971351 - DNA, 13 bp, Homo sapiens
ttcatggatcaga

SEQ ID NO: 5971352 - DNA, 16 bp, Homo sapiens
ttcatggatcagatct

SEQ ID NO: 5971353 - DNA, 17 bp, Homo sapiens
ttcatggcaatgaaaat

SEQ ID NO: 5971354 - DNA, 23 bp, Homo sapiens
ttcatggcaatgaaaattttaag

SEQ ID NO: 5971355 - DNA, 18 bp, Homo sapiens
ttcatggctgctgttgct

SEQ ID NO: 5971356 - DNA, 13 bp, Homo sapiens
ttcatgggcacct

SEQ ID NO: 5971357 - DNA, 20 bp, Homo sapiens
ttcatgggcctggatgcaga

SEQ ID NO: 5971358 - DNA, 21 bp, Homo sapiens
ttcatggggtgatgctgggct

SEQ ID NO: 5971359 - DNA, 16 bp, Homo sapiens
ttcatggttcaagtat

SEQ ID NO: 5971360 - DNA, 22 bp, Homo sapiens
ttcatggttcaagtattaagca

SEQ ID NO: 5971361 - DNA, 21 bp, Homo sapiens
ttttcttggtttctggataaa

SEQ ID NO: 5971362 - DNA, 14 bp, Homo sapiens
ttttcttgtaaatg

SEQ ID NO: 5971363 - DNA, 15 bp, Homo sapiens
ttttcttgtaaatgt

SEQ ID NO: 5971364 - DNA, 14 bp, Homo sapiens
ttttcttgtatgat

SEQ ID NO: 5971365 - DNA, 18 bp, Homo sapiens
ttttcttgtctctgaggc

SEQ ID NO: 5971366 - DNA, 13 bp, Homo sapiens
ttttcttgtttaa

SEQ ID NO: 5971367 - DNA, 12 bp, Homo sapiens
ttttctttaaaa

SEQ ID NO: 5971368 - DNA, 16 bp, Homo sapiens
ttttctttaaaagaat

SEQ ID NO: 5971369 - DNA, 17 bp, Homo sapiens
ttttctttaaagccagt

SEQ ID NO: 5971370 - DNA, 14 bp, Homo sapiens
ttttctttaactgc

SEQ ID NO: 5971371 - DNA, 12 bp, Homo sapiens
ttttctttaata

SEQ ID NO: 5971372 - DNA, 16 bp, Homo sapiens
ttttctttaatcaaaa

SEQ ID NO: 5971373 - DNA, 18 bp, Homo sapiens
ttttctttaatcaaaagt

SEQ ID NO: 5971374 - DNA, 12 bp, Homo sapiens
ttttctttacag

SEQ ID NO: 5971375 - DNA, 16 bp, Homo sapiens
ttttctttacagtctt

SEQ ID NO: 5971376 - DNA, 17 bp, Homo sapiens
ttttctttacttatctc

SEQ ID NO: 5971377 - DNA, 13 bp, Homo sapiens
ttttctttataat

SEQ ID NO: 5971378 - DNA, 14 bp, Homo sapiens
ttttctttcaaaag

SEQ ID NO: 5971379 - DNA, 14 bp, Homo sapiens
ttttctttcataca

SEQ ID NO: 5971380 - DNA, 13 bp, Homo sapiens
ttttctttccaaa

SEQ ID NO: 5971381 - DNA, 14 bp, Homo sapiens
ttttctttcctcct

SEQ ID NO: 5971382 - DNA, 23 bp, Homo sapiens
ttttctttcctgtaaagaaacat

SEQ ID NO: 5971383 - DNA, 12 bp, Homo sapiens
ttttctttcctt

SEQ ID NO: 5971384 - DNA, 14 bp, Homo sapiens
ttttctttctatgt

SEQ ID NO: 5971385 - DNA, 18 bp, Homo sapiens
ttttctttctatgtagaa

SEQ ID NO: 5971386 - DNA, 18 bp, Homo sapiens
ttttctttctttttctgg

SEQ ID NO: 5971387 - DNA, 13 bp, Homo sapiens
ttttctttgaata

SEQ ID NO: 5971388 - DNA, 19 bp, Homo sapiens
ttttctttgaccagatctt

SEQ ID NO: 5971389 - DNA, 16 bp, Homo sapiens
ttttctttggacaaca

SEQ ID NO: 5971390 - DNA, 12 bp, Homo sapiens
ttttctttgtat

SEQ ID NO: 5971391 - DNA, 14 bp, Homo sapiens
ttttctttgtgttt

SEQ ID NO: 5971392 - DNA, 12 bp, Homo sapiens
ttttctttgttt

SEQ ID NO: 5971393 - DNA, 21 bp, Homo sapiens
ttttcttttaaagatttgttt

SEQ ID NO: 5971394 - DNA, 15 bp, Homo sapiens
ttttcttttaatttt

SEQ ID NO: 5971395 - DNA, 16 bp, Homo sapiens
ttttcttttatatctg

SEQ ID NO: 5971396 - DNA, 17 bp, Homo sapiens
ttttcttttatatctgt

SEQ ID NO: 5971397 - DNA, 15 bp, Homo sapiens
ttttcttttccatta

SEQ ID NO: 5971398 - DNA, 14 bp, Homo sapiens
ttttcttttctatg

SEQ ID NO: 5971399 - DNA, 19 bp, Homo sapiens
ttttcttttgaataatgta

SEQ ID NO: 5971400 - DNA, 13 bp, Homo sapiens
ttttcttttgtaa

SEQ ID NO: 5971401 - DNA, 21 bp, Homo sapiens
ttttcttttgtaagtgctaca

SEQ ID NO: 5971402 - DNA, 15 bp, Homo sapiens
ttttcttttgttact

SEQ ID NO: 5971403 - DNA, 20 bp, Homo sapiens
ttttcttttgttactgttct

SEQ ID NO: 5971404 - DNA, 20 bp, Homo sapiens
ttttcttttgttttttgaag

SEQ ID NO: 5971405 - DNA, 17 bp, Homo sapiens
ttttctttttaacttta

SEQ ID NO: 5971406 - DNA, 16 bp, Homo sapiens
ttttctttttctttct

SEQ ID NO: 5971407 - DNA, 22 bp, Homo sapiens
ttttcttttttaaagtaaactt

SEQ ID NO: 5971408 - DNA, 21 bp, Homo sapiens
ttttcttttttaaattaatat

SEQ ID NO: 5971409 - DNA, 19 bp, Homo sapiens
ttttcttttttcccctttc

SEQ ID NO: 5971410 - DNA, 21 bp, Homo sapiens
ttttcttttttttaatgtttc

SEQ ID NO: 5971411 - DNA, 22 bp, Homo sapiens
ttttctttttttttaagttctt

SEQ ID NO: 5971412 - DNA, 18 bp, Homo sapiens
ttttgaaaaaaaagtttt

SEQ ID NO: 5971413 - DNA, 13 bp, Homo sapiens
ttttgaaaaactg

SEQ ID NO: 5971414 - DNA, 19 bp, Homo sapiens
ttttgaaaaatattgctaa

SEQ ID NO: 5971415 - DNA, 22 bp, Homo sapiens
ttttgaaaaatgcactgggaaa

SEQ ID NO: 5971416 - DNA, 23 bp, Homo sapiens
ttttgaaaaattacctgtataat

SEQ ID NO: 5971417 - DNA, 13 bp, Homo sapiens
ttttgaaaacact

SEQ ID NO: 5971418 - DNA, 16 bp, Homo sapiens
ttttgaaaagctatta

SEQ ID NO: 5971419 - DNA, 17 bp, Homo sapiens
ttttgaaaagcttctta

SEQ ID NO: 5971420 - DNA, 22 bp, Homo sapiens
ttttgaaaatatgtactgtata

SEQ ID NO: 5971421 - DNA, 14 bp, Homo sapiens
ttttgaaaatcaag

SEQ ID NO: 5971422 - DNA, 22 bp, Homo sapiens
ttttgaaacaaagtactcttta

SEQ ID NO: 5971423 - DNA, 21 bp, Homo sapiens
ttttgaaaccatgaagagatt

SEQ ID NO: 5971424 - DNA, 17 bp, Homo sapiens
ttttgaaacccacagtt

SEQ ID NO: 5971425 - DNA, 16 bp, Homo sapiens
ttttgaaactagaagt

SEQ ID NO: 5971426 - DNA, 16 bp, Homo sapiens
ttttgaaagatggtaa

SEQ ID NO: 5971427 - DNA, 19 bp, Homo sapiens
ttttgaaaggtcagaattt

SEQ ID NO: 5971428 - DNA, 16 bp, Homo sapiens
ttttgaaataaaaatg

SEQ ID NO: 5971429 - DNA, 13 bp, Homo sapiens
ttttgaaatacct

SEQ ID NO: 5971430 - DNA, 10 bp, Homo sapiens
ttttgaaatc

SEQ ID NO: 5971431 - DNA, 13 bp, Homo sapiens
ttttgaaatgctg

SEQ ID NO: 5971432 - DNA, 22 bp, Homo sapiens
ttttgaaatgtggttttcctga

SEQ ID NO: 5971433 - DNA, 16 bp, Homo sapiens
ttttgaaatttactgt

SEQ ID NO: 5971434 - DNA, 18 bp, Homo sapiens
ttttgaaccaacatcttt

SEQ ID NO: 5971435 - DNA, 20 bp, Homo sapiens
ttttgaactaataaaagcat

SEQ ID NO: 5971436 - DNA, 17 bp, Homo sapiens
ttttgaactcttctcat

SEQ ID NO: 5971437 - DNA, 17 bp, Homo sapiens
ttttgaacttttcattc

SEQ ID NO: 5971438 - DNA, 21 bp, Homo sapiens
ttttgaagaaaacacaacatt

SEQ ID NO: 5971439 - DNA, 16 bp, Homo sapiens
ttttgaagaagggaaa

SEQ ID NO: 5971440 - DNA, 18 bp, Homo sapiens
ttttgaagaagggaaatt

SEQ ID NO: 5971441 - DNA, 22 bp, Homo sapiens
ttttgaagaagggaaattcaca

SEQ ID NO: 5971442 - DNA, 17 bp, Homo sapiens
ttttgaagaatatttaa

SEQ ID NO: 5971443 - DNA, 18 bp, Homo sapiens
ttttgaagaatatttaag

SEQ ID NO: 5971444 - DNA, 21 bp, Homo sapiens
ttttgaagattctatgttaat

SEQ ID NO: 5971445 - DNA, 17 bp, Homo sapiens
ttttgaagccttttgtt

SEQ ID NO: 5971446 - DNA, 21 bp, Homo sapiens
ttttgaagctaattattttaa

SEQ ID NO: 5971447 - DNA, 22 bp, Homo sapiens
ttttgaagctaattattttaat

SEQ ID NO: 5971448 - DNA, 15 bp, Homo sapiens
ttttgaagctgttgc

SEQ ID NO: 5971449 - DNA, 14 bp, Homo sapiens
ttttgaaggaatac

SEQ ID NO: 5971450 - DNA, 13 bp, Homo sapiens
ttttgaaggcaaa

SEQ ID NO: 5971451 - DNA, 16 bp, Homo sapiens
ttttgaaggtttcaga

SEQ ID NO: 5971452 - DNA, 21 bp, Homo sapiens
ttttgaaggtttcagatgagg

SEQ ID NO: 5971453 - DNA, 14 bp, Homo sapiens
ttttgaagtattta

SEQ ID NO: 5971454 - DNA, 16 bp, Homo sapiens
ttttgaagtcttccct

SEQ ID NO: 5971455 - DNA, 20 bp, Homo sapiens
ttttgaagtcttccctcaga

SEQ ID NO: 5971456 - DNA, 13 bp, Homo sapiens
ttttgaagtcttg

SEQ ID NO: 5971457 - DNA, 11 bp, Homo sapiens
ttttgaagtgt

SEQ ID NO: 5971458 - DNA, 18 bp, Homo sapiens
ttttgaagtgttttagtc

SEQ ID NO: 5971459 - DNA, 17 bp, Homo sapiens
ttttgaagtttacattt

SEQ ID NO: 5971460 - DNA, 20 bp, Homo sapiens
ttttgtattacatctaatgc

SEQ ID NO: 5971461 - DNA, 21 bp, Homo sapiens
ttttgtattacatctaatgct

SEQ ID NO: 5971462 - DNA, 20 bp, Homo sapiens
ttttgtattatttcaccagc

SEQ ID NO: 5971463 - DNA, 18 bp, Homo sapiens
ttttgtattctttactaa

SEQ ID NO: 5971464 - DNA, 16 bp, Homo sapiens
ttttgtatttctttta

SEQ ID NO: 5971465 - DNA, 19 bp, Homo sapiens
ttttgtatttcttttatat

SEQ ID NO: 5971466 - DNA, 15 bp, Homo sapiens
ttttgtatttttagt

SEQ ID NO: 5971467 - DNA, 16 bp, Homo sapiens
ttttgtattttttcct

SEQ ID NO: 5971468 - DNA, 19 bp, Homo sapiens
ttttgtcacagctcttgtt

SEQ ID NO: 5971469 - DNA, 12 bp, Homo sapiens
ttttgtcagttt

SEQ ID NO: 5971470 - DNA, 21 bp, Homo sapiens
ttttgtcatgttatgcagtga

SEQ ID NO: 5971471 - DNA, 18 bp, Homo sapiens
ttttgtccaagttcacag

SEQ ID NO: 5971472 - DNA, 15 bp, Homo sapiens
ttttgtcctgcctct

SEQ ID NO: 5971473 - DNA, 15 bp, Homo sapiens
ttttgtcctgttatt

SEQ ID NO: 5971474 - DNA, 22 bp, Homo sapiens
ttttgtcgaatttttattattt

SEQ ID NO: 5971475 - DNA, 12 bp, Homo sapiens
ttttgtctctgc

SEQ ID NO: 5971476 - DNA, 10 bp, Homo sapiens
ttttgtctgt

SEQ ID NO: 5971477 - DNA, 17 bp, Homo sapiens
ttttgtcttaagtgttt

SEQ ID NO: 5971478 - DNA, 21 bp, Homo sapiens
ttttgtcttaagtgtttctca

SEQ ID NO: 5971479 - DNA, 22 bp, Homo sapiens
ttttgtcttaagtgtttctcaa

SEQ ID NO: 5971480 - DNA, 13 bp, Homo sapiens
ttttgtcttatat

SEQ ID NO: 5971481 - DNA, 13 bp, Homo sapiens
ttttgtcttgcat

SEQ ID NO: 5971482 - DNA, 13 bp, Homo sapiens
ttttgtcttgtgt

SEQ ID NO: 5971483 - DNA, 17 bp, Homo sapiens
ttttgtgaaatttcatg

SEQ ID NO: 5971484 - DNA, 14 bp, Homo sapiens
ttttgtgaactttt

SEQ ID NO: 5971485 - DNA, 19 bp, Homo sapiens
ttttgtgaagtgaaggatt

SEQ ID NO: 5971486 - DNA, 21 bp, Homo sapiens
ttttgtgaagtttaattgact

SEQ ID NO: 5971487 - DNA, 16 bp, Homo sapiens
ttttgtgaattatact

SEQ ID NO: 5971488 - DNA, 19 bp, Homo sapiens
ttttgtgaatttgggtagg

SEQ ID NO: 5971489 - DNA, 23 bp, Homo sapiens
ttttgtgactatatagagatgtt

SEQ ID NO: 5971490 - DNA, 22 bp, Homo sapiens
ttttgtgagcctctttgtaata

SEQ ID NO: 5971491 - DNA, 19 bp, Homo sapiens
ttttgtgagctttacttct

SEQ ID NO: 5971492 - DNA, 14 bp, Homo sapiens
ttttgtgagtttgt

SEQ ID NO: 5971493 - DNA, 13 bp, Homo sapiens
ttttgtgatgaac

SEQ ID NO: 5971494 - DNA, 15 bp, Homo sapiens
ttttgtgatgaacat

SEQ ID NO: 5971495 - DNA, 19 bp, Homo sapiens
ttttgtgatggagtgctgt

SEQ ID NO: 5971496 - DNA, 21 bp, Homo sapiens
ttttgtgatgtcccaacttgt

SEQ ID NO: 5971497 - DNA, 16 bp, Homo sapiens
ttttgtgatttagaac

SEQ ID NO: 5971498 - DNA, 23 bp, Homo sapiens
ttttgtgcaaaaaggactggaaa

SEQ ID NO: 5971499 - DNA, 11 bp, Homo sapiens
ttttgtgcagt

SEQ ID NO: 5971500 - DNA, 17 bp, Homo sapiens
ttttgtgcattatctag

SEQ ID NO: 5971501 - DNA, 20 bp, Homo sapiens
ttttgtgcattatctagata

SEQ ID NO: 5971502 - DNA, 23 bp, Homo sapiens
ttttgtgcattatctagatactg

SEQ ID NO: 5971503 - DNA, 14 bp, Homo sapiens
ttttgtgcattgga

SEQ ID NO: 5971504 - DNA, 22 bp, Homo sapiens
ttttgtgcttagttaaatcttt

SEQ ID NO: 5971505 - DNA, 20 bp, Homo sapiens
ttttgtgcttggcaaatgag

SEQ ID NO: 5971506 - DNA, 15 bp, Homo sapiens
ttttgtggaggggag

SEQ ID NO: 5971507 - DNA, 19 bp, Homo sapiens
ttttgtggcagattcaata

SEQ ID NO: 5971508 - DNA, 21 bp, Homo sapiens
ttttgtggcatgttgtaacat

SEQ ID NO: 5971509 - DNA, 22 bp, Homo sapiens
ttttgtggcttcaatctacgat

SEQ ID NO: 5971510 - DNA, 18 bp, Homo sapiens
ttttgtgggctggttgct

SEQ ID NO: 5971511 - DNA, 21 bp, Homo sapiens
ttttgtgggctggttgctgta

SEQ ID NO: 5971512 - DNA, 17 bp, Homo sapiens
ttttgtgtacagtatgt

SEQ ID NO: 5971513 - DNA, 19 bp, Homo sapiens
ttttgtgtacagtatgtgt

SEQ ID NO: 5971514 - DNA, 12 bp, Homo sapiens
ttttgtgtactt

SEQ ID NO: 5971515 - DNA, 16 bp, Homo sapiens
ttttgtgtaggtgtct

SEQ ID NO: 5971516 - DNA, 16 bp, Homo sapiens
ttttgtgtatattggt

SEQ ID NO: 5971517 - DNA, 20 bp, Homo sapiens
ttttgtgtatccagtatgca

SEQ ID NO: 5971518 - DNA, 13 bp, Homo sapiens
ttttgtgtattct

SEQ ID NO: 5971519 - DNA, 16 bp, Homo sapiens
ttttgtgtattctgtg

SEQ ID NO: 5971520 - DNA, 11 bp, Homo sapiens
ttttgtgtctt

SEQ ID NO: 5971521 - DNA, 18 bp, Homo sapiens
ttttgtgtcttaagaaaa

SEQ ID NO: 5971522 - DNA, 22 bp, Homo sapiens
ttttgtgtgagacttaaaacat

SEQ ID NO: 5971523 - DNA, 13 bp, Homo sapiens
ttttgtgttgtac

SEQ ID NO: 5971524 - DNA, 22 bp, Homo sapiens
ttttgttaacaatggcaggttt

SEQ ID NO: 5971525 - DNA, 13 bp, Homo sapiens
ttttgttaacagt

SEQ ID NO: 5971526 - DNA, 16 bp, Homo sapiens
ttttgttaacagtatt

SEQ ID NO: 5971527 - DNA, 17 bp, Homo sapiens
ttttgttaataataaga

SEQ ID NO: 5971528 - DNA, 16 bp, Homo sapiens
ttttgttaatattaaa

SEQ ID NO: 5971529 - DNA, 16 bp, Homo sapiens
ttttgttaatgcattg

SEQ ID NO: 5971530 - DNA, 14 bp, Homo sapiens
ttttgttaatgctc

SEQ ID NO: 5971531 - DNA, 13 bp, Homo sapiens
ttttgttaccaca

SEQ ID NO: 5971532 - DNA, 16 bp, Homo sapiens
ttttgttactgttctt

SEQ ID NO: 5971533 - DNA, 18 bp, Homo sapiens
ttttgttactgttcttgc

SEQ ID NO: 5971534 - DNA, 19 bp, Homo sapiens
ttttgttactgttcttgct

SEQ ID NO: 5971535 - DNA, 16 bp, Homo sapiens
ttttgttagcaaagat

SEQ ID NO: 5971536 - DNA, 13 bp, Homo sapiens
ttttgttagttta

SEQ ID NO: 5971537 - DNA, 12 bp, Homo sapiens
ttttgttataga

SEQ ID NO: 5971538 - DNA, 15 bp, Homo sapiens
ttttgttatgttcaa

SEQ ID NO: 5971539 - DNA, 22 bp, Homo sapiens
ttttgttattaaaaaaacacaa

SEQ ID NO: 5971540 - DNA, 16 bp, Homo sapiens
ttttgttcaaagccag

SEQ ID NO: 5971541 - DNA, 14 bp, Homo sapiens
ttttgttcaaagtt

SEQ ID NO: 5971542 - DNA, 16 bp, Homo sapiens
ttttgttcaatgttcc

SEQ ID NO: 5971543 - DNA, 15 bp, Homo sapiens
ttttgttcacaacct

SEQ ID NO: 5971544 - DNA, 14 bp, Homo sapiens
ttttgttcatacat

SEQ ID NO: 5971545 - DNA, 15 bp, Homo sapiens
ttttgttccacaagt

SEQ ID NO: 5971546 - DNA, 14 bp, Homo sapiens
ttttgttctagact

SEQ ID NO: 5971547 - DNA, 14 bp, Homo sapiens
ttttgttctgtata

SEQ ID NO: 5971548 - DNA, 15 bp, Homo sapiens
ttttgttctgtatat

SEQ ID NO: 5971549 - DNA, 15 bp, Homo sapiens
ttttgttctgtattt

SEQ ID NO: 5971550 - DNA, 19 bp, Homo sapiens
ttttgttcttaaaaatgca

SEQ ID NO: 5971551 - DNA, 17 bp, Homo sapiens
ttttgttcttggtctcc

SEQ ID NO: 5971552 - DNA, 11 bp, Homo sapiens
ttttgttgaaa

SEQ ID NO: 5971553 - DNA, 18 bp, Homo sapiens
ttttgttgacattctgaa

SEQ ID NO: 5971554 - DNA, 18 bp, Homo sapiens
ttttgttgagtctctgaa

SEQ ID NO: 5971555 - DNA, 19 bp, Homo sapiens
ttttgttgattaaaacatt

SEQ ID NO: 5971556 - DNA, 15 bp, Homo sapiens
ttttgttgcactgaa

SEQ ID NO: 5971557 - DNA, 18 bp, Homo sapiens
ttttgttgcactgaagtt

SEQ ID NO: 5971558 - DNA, 14 bp, Homo sapiens
ttttgttgctttct

SEQ ID NO: 5971559 - DNA, 22 bp, Homo sapiens
ttttgttggcttgcttgcttta

SEQ ID NO: 5971560 - DNA, 17 bp, Homo sapiens
ttttgttgtatgggatt

SEQ ID NO: 5971561 - DNA, 15 bp, Homo sapiens
ttttgttgtgtatat

SEQ ID NO: 5971562 - DNA, 20 bp, Homo sapiens
ttttgttgtgttctgttgaa

SEQ ID NO: 5971563 - DNA, 13 bp, Homo sapiens
ttttgttgtttct

SEQ ID NO: 5971564 - DNA, 19 bp, Homo sapiens
ttttgttgtttcttaaata

SEQ ID NO: 5971565 - DNA, 23 bp, Homo sapiens
ttttgttgtttcttaatttggaa

SEQ ID NO: 5971566 - DNA, 17 bp, Homo sapiens
ttttgtttaaaactcag

SEQ ID NO: 5971567 - DNA, 17 bp, Homo sapiens
ttttgtttataaaaaac

SEQ ID NO: 5971568 - DNA, 12 bp, Homo sapiens
ttttgtttcata

SEQ ID NO: 5971569 - DNA, 22 bp, Homo sapiens
ttttgtttgcttcatgtgtccc

SEQ ID NO: 5971570 - DNA, 19 bp, Homo sapiens
ttttgtttggtattgtatt

SEQ ID NO: 5971571 - DNA, 13 bp, Homo sapiens
ttttgtttggtta

SEQ ID NO: 5971572 - DNA, 16 bp, Homo sapiens
ttttgtttggttatat

SEQ ID NO: 5971573 - DNA, 14 bp, Homo sapiens
ttttgtttgtattg

SEQ ID NO: 5971574 - DNA, 12 bp, Homo sapiens
ttttgtttgtct

SEQ ID NO: 5971575 - DNA, 17 bp, Homo sapiens
ttttgtttgtctctcct

SEQ ID NO: 5971576 - DNA, 15 bp, Homo sapiens
ttttgtttgtggcat

SEQ ID NO: 5971577 - DNA, 16 bp, Homo sapiens
ttttgtttgtttcttt

SEQ ID NO: 5971578 - DNA, 21 bp, Homo sapiens
ttttgtttgtttctttgtgtt

SEQ ID NO: 5971579 - DNA, 20 bp, Homo sapiens
ttttgtttgtttgagacagg

SEQ ID NO: 5971580 - DNA, 18 bp, Homo sapiens
ttttgtttgtttgtttat

SEQ ID NO: 5971581 - DNA, 22 bp, Homo sapiens
ttttgttttaaaactggacctg

SEQ ID NO: 5971582 - DNA, 12 bp, Homo sapiens
ttttgttttaat

SEQ ID NO: 5971583 - DNA, 14 bp, Homo sapiens
ttttgttttaatct

SEQ ID NO: 5971584 - DNA, 12 bp, Homo sapiens
ttttgttttcat

SEQ ID NO: 5971585 - DNA, 22 bp, Homo sapiens
ttttgttttcattaaagagcca

SEQ ID NO: 5971586 - DNA, 15 bp, Homo sapiens
ttttgttttctaaga

SEQ ID NO: 5971587 - DNA, 15 bp, Homo sapiens
ttttgttttgttgca

SEQ ID NO: 5971588 - DNA, 22 bp, Homo sapiens
ttttgtttttactgtatgtttt

SEQ ID NO: 5971589 - DNA, 20 bp, Homo sapiens
ttttgtttttattttcaaga

SEQ ID NO: 5971590 - DNA, 17 bp, Homo sapiens
ttttgtttttcattcag

SEQ ID NO: 5971591 - DNA, 15 bp, Homo sapiens
ttttgtttttccagt

SEQ ID NO: 5971592 - DNA, 16 bp, Homo sapiens
ttttgtttttgtaatg

SEQ ID NO: 5971593 - DNA, 14 bp, Homo sapiens
ttttgtttttgtta

SEQ ID NO: 5971594 - DNA, 22 bp, Homo sapiens
ttttgttttttaagttttgcac

SEQ ID NO: 5971595 - DNA, 23 bp, Homo sapiens
ttttgttttttaagttttgcact

SEQ ID NO: 5971596 - DNA, 19 bp, Homo sapiens
ttttgttttttcaaaatag

SEQ ID NO: 5971597 - DNA, 23 bp, Homo sapiens
tttttaaaaaaaaaaacaaagca

SEQ ID NO: 5971598 - DNA, 19 bp, Homo sapiens
tttttaaaaaaaatgtgaa

SEQ ID NO: 5971599 - DNA, 20 bp, Homo sapiens
tttttaaaaaaaatgtgaaa

SEQ ID NO: 5971600 - DNA, 19 bp, Homo sapiens
tttttaaaaaaaatttgtg

SEQ ID NO: 5971601 - DNA, 18 bp, Homo sapiens
tttttaaaaaaactggat

SEQ ID NO: 5971602 - DNA, 17 bp, Homo sapiens
tttttaaaaaaagaaaa

SEQ ID NO: 5971603 - DNA, 21 bp, Homo sapiens
tttttaaaaaacaattggttg

SEQ ID NO: 5971604 - DNA, 17 bp, Homo sapiens
tttttaaaaaagcttaa

SEQ ID NO: 5971605 - DNA, 23 bp, Homo sapiens
tttttaaaaaagcttaaaacttt

SEQ ID NO: 5971606 - DNA, 19 bp, Homo sapiens
tttttaaaaaatattttct

SEQ ID NO: 5971607 - DNA, 14 bp, Homo sapiens
tttttaaaaagcaa

SEQ ID NO: 5971608 - DNA, 23 bp, Homo sapiens
tttttaaaaaggcctttgggatt

SEQ ID NO: 5971609 - DNA, 23 bp, Homo sapiens
tttttaaaaatcataaactgtgt

SEQ ID NO: 5971610 - DNA, 22 bp, Homo sapiens
tttttaaaaatgtgtcaaaata

SEQ ID NO: 5971611 - DNA, 17 bp, Homo sapiens
tttttaaaacaaaagag

SEQ ID NO: 5971612 - DNA, 15 bp, Homo sapiens
tttttaaaactcaga

SEQ ID NO: 5971613 - DNA, 18 bp, Homo sapiens
tttttaaaactcagattt

SEQ ID NO: 5971614 - DNA, 12 bp, Homo sapiens
tttttaaaactg

SEQ ID NO: 5971615 - DNA, 23 bp, Homo sapiens
tttttaaaagatcttcaaaagta

SEQ ID NO: 5971616 - DNA, 23 bp, Homo sapiens
tttttaaaagttgttaccaaata

SEQ ID NO: 5971617 - DNA, 15 bp, Homo sapiens
tttttaaaataaaat

SEQ ID NO: 5971618 - DNA, 18 bp, Homo sapiens
tttttaaaataaactgta

SEQ ID NO: 5971619 - DNA, 19 bp, Homo sapiens
tttttaaaataaactgtaa

SEQ ID NO: 5971620 - DNA, 23 bp, Homo sapiens
tttttaaaataaactgtaaacta

SEQ ID NO: 5971621 - DNA, 14 bp, Homo sapiens
tttttaaaataatt

SEQ ID NO: 5971622 - DNA, 19 bp, Homo sapiens
tttttaaaatatattgctg

SEQ ID NO: 5971623 - DNA, 12 bp, Homo sapiens
tttttaaaatct

SEQ ID NO: 5971624 - DNA, 13 bp, Homo sapiens
tttttaaaatctt

SEQ ID NO: 5971625 - DNA, 14 bp, Homo sapiens
tttttaaaattctg

SEQ ID NO: 5971626 - DNA, 12 bp, Homo sapiens
tttttaaaattg

SEQ ID NO: 5971627 - DNA, 13 bp, Homo sapiens
tttttaaaattgg

SEQ ID NO: 5971628 - DNA, 21 bp, Homo sapiens
tttttaaaattgtgttcttaa

SEQ ID NO: 5971629 - DNA, 16 bp, Homo sapiens
tttttaaaattttaat

SEQ ID NO: 5971630 - DNA, 21 bp, Homo sapiens
tttttaaactaagatctgtta

SEQ ID NO: 5971631 - DNA, 13 bp, Homo sapiens
tttttaaactagt

SEQ ID NO: 5971632 - DNA, 15 bp, Homo sapiens
tttttaaacttcagt

SEQ ID NO: 5971633 - DNA, 12 bp, Homo sapiens
tttttaaacttg

SEQ ID NO: 5971634 - DNA, 11 bp, Homo sapiens
tttttaaagaa

SEQ ID NO: 5971635 - DNA, 21 bp, Homo sapiens
tttttaaagaaaatgtgtctg

SEQ ID NO: 5971636 - DNA, 22 bp, Homo sapiens
tttttaaagaaaatgtgtctgc

SEQ ID NO: 5971637 - DNA, 18 bp, Homo sapiens
tttttaaagacttttatg

SEQ ID NO: 5971638 - DNA, 12 bp, Homo sapiens
tttttaaagatc

SEQ ID NO: 5971639 - DNA, 21 bp, Homo sapiens
acggcccggcccctcaccctc

SEQ ID NO: 5971640 - DNA, 22 bp, Homo sapiens
acggccctcatctatgaggaaa

SEQ ID NO: 5971641 - DNA, 19 bp, Homo sapiens
acggccctgcaggagcagg

SEQ ID NO: 5971642 - DNA, 23 bp, Homo sapiens
acggccctgccccatcctgggcc

SEQ ID NO: 5971643 - DNA, 16 bp, Homo sapiens
acggccctgcctgcct

SEQ ID NO: 5971644 - DNA, 14 bp, Homo sapiens
acggccgctccagg

SEQ ID NO: 5971645 - DNA, 20 bp, Homo sapiens
acggccggccggacctctga

SEQ ID NO: 5971646 - DNA, 21 bp, Homo sapiens
acggccggccggacctctgag

SEQ ID NO: 5971647 - DNA, 22 bp, Homo sapiens
acggcctaggggtggcgctcag

SEQ ID NO: 5971648 - DNA, 15 bp, Homo sapiens
acggcctccaggagg

SEQ ID NO: 5971649 - DNA, 19 bp, Homo sapiens
acggcctccaggaggggcc

SEQ ID NO: 5971650 - DNA, 23 bp, Homo sapiens
acggcctgagaggagcgtgtcct

SEQ ID NO: 5971651 - DNA, 22 bp, Homo sapiens
acggcctgcccagtcgacccca

SEQ ID NO: 5971652 - DNA, 11 bp, Homo sapiens
acggcctggca

SEQ ID NO: 5971653 - DNA, 12 bp, Homo sapiens
acggcctggctg

SEQ ID NO: 5971654 - DNA, 13 bp, Homo sapiens
acggcctgggagg

SEQ ID NO: 5971655 - DNA, 17 bp, Homo sapiens
acggcgcccccagtgtg

SEQ ID NO: 5971656 - DNA, 16 bp, Homo sapiens
acggcgcctttttggc

SEQ ID NO: 5971657 - DNA, 17 bp, Homo sapiens
acggcgctgcctcaggc

SEQ ID NO: 5971658 - DNA, 14 bp, Homo sapiens
acggcggcagggtg

SEQ ID NO: 5971659 - DNA, 14 bp, Homo sapiens
acggcggccaggca

SEQ ID NO: 5971660 - DNA, 17 bp, Homo sapiens
acggcggccaggcacag

SEQ ID NO: 5971661 - DNA, 20 bp, Homo sapiens
acggcggccaggcacagggc

SEQ ID NO: 5971662 - DNA, 21 bp, Homo sapiens
acggcgtggtgtgtccctgga

SEQ ID NO: 5971663 - DNA, 19 bp, Homo sapiens
acggcgttgtacctgtagg

SEQ ID NO: 5971664 - DNA, 15 bp, Homo sapiens
acggctaagaggctg

SEQ ID NO: 5971665 - DNA, 18 bp, Homo sapiens
acggctaagaggctgctg

SEQ ID NO: 5971666 - DNA, 20 bp, Homo sapiens
acggctaccacactcatggg

SEQ ID NO: 5971667 - DNA, 22 bp, Homo sapiens
acggctccactaggacttcaaa

SEQ ID NO: 5971668 - DNA, 15 bp, Homo sapiens
acggctcccccaggc

SEQ ID NO: 5971669 - DNA, 17 bp, Homo sapiens
acggctcccccaggcct

SEQ ID NO: 5971670 - DNA, 18 bp, Homo sapiens
acggctcccccaggcctg

SEQ ID NO: 5971671 - DNA, 23 bp, Homo sapiens
acggctcccccaggcctgagctg

SEQ ID NO: 5971672 - DNA, 22 bp, Homo sapiens
acggctcctcagagcgccagga

SEQ ID NO: 5971673 - DNA, 18 bp, Homo sapiens
acggctcctccccgatcc

SEQ ID NO: 5971674 - DNA, 18 bp, Homo sapiens
acggctcgatttctccag

SEQ ID NO: 5971675 - DNA, 19 bp, Homo sapiens
acggctctaggtggggcgg

SEQ ID NO: 5971676 - DNA, 13 bp, Homo sapiens
acggctctgtgcc

SEQ ID NO: 5971677 - DNA, 14 bp, Homo sapiens
acggctctgtgccc

SEQ ID NO: 5971678 - DNA, 17 bp, Homo sapiens
acggctgcacctgcagg

SEQ ID NO: 5971679 - DNA, 16 bp, Homo sapiens
acggctggacctgcac

SEQ ID NO: 5971680 - DNA, 20 bp, Homo sapiens
acggctggggacccacccag

SEQ ID NO: 5971681 - DNA, 20 bp, Homo sapiens
acggctgtgtatttctgtag

SEQ ID NO: 5971682 - DNA, 23 bp, Homo sapiens
acggctgtgtatttctgtagaat

SEQ ID NO: 5971683 - DNA, 23 bp, Homo sapiens
acggcttcctcattccttgtctt

SEQ ID NO: 5971684 - DNA, 20 bp, Homo sapiens
acggcttctcacgctttgtt

SEQ ID NO: 5971685 - DNA, 23 bp, Homo sapiens
acggcttctcacgctttgtttac

SEQ ID NO: 5971686 - DNA, 16 bp, Homo sapiens
acggcttgctttcctg

SEQ ID NO: 5971687 - DNA, 19 bp, Homo sapiens
acgggaagcaacctcccaa

SEQ ID NO: 5971688 - DNA, 21 bp, Homo sapiens
acgggacagcggcccggccca

SEQ ID NO: 5971689 - DNA, 19 bp, Homo sapiens
acgggacatcacagggtgg

SEQ ID NO: 5971690 - DNA, 22 bp, Homo sapiens
acgggaccctgcccagagctga

SEQ ID NO: 5971691 - DNA, 15 bp, Homo sapiens
acgggaccgggccgc

SEQ ID NO: 5971692 - DNA, 15 bp, Homo sapiens
acgggactgacgcaa

SEQ ID NO: 5971693 - DNA, 20 bp, Homo sapiens
acgggagcattggcccctga

SEQ ID NO: 5971694 - DNA, 15 bp, Homo sapiens
acgggagcctcctct

SEQ ID NO: 5971695 - DNA, 16 bp, Homo sapiens
acgggagcctcctctg

SEQ ID NO: 5971696 - DNA, 22 bp, Homo sapiens
acgggagcctcctctgcttgca

SEQ ID NO: 5971697 - DNA, 12 bp, Homo sapiens
acgggaggcccc

SEQ ID NO: 5971698 - DNA, 19 bp, Homo sapiens
acgggaggccccagctctg

SEQ ID NO: 5971699 - DNA, 16 bp, Homo sapiens
acgggaggcctcagtt

SEQ ID NO: 5971700 - DNA, 12 bp, Homo sapiens
acgggaggctgg

SEQ ID NO: 5971701 - DNA, 16 bp, Homo sapiens
acgggaggctgggcac

SEQ ID NO: 5971702 - DNA, 19 bp, Homo sapiens
acgggatgacctccagaag

SEQ ID NO: 5971703 - DNA, 15 bp, Homo sapiens
acgggatgctcttta

SEQ ID NO: 5971704 - DNA, 19 bp, Homo sapiens
acgggatgctctttaaata

SEQ ID NO: 5971705 - DNA, 15 bp, Homo sapiens
acgggcaaagaaaac

SEQ ID NO: 5971706 - DNA, 22 bp, Homo sapiens
acgggcaacactcactgcctgc

SEQ ID NO: 5971707 - DNA, 18 bp, Homo sapiens
acgggcaagaagctgctt

SEQ ID NO: 5971708 - DNA, 18 bp, Homo sapiens
acgggcaagtgagagggg

SEQ ID NO: 5971709 - DNA, 19 bp, Homo sapiens
acgggcaagtgagagggga

SEQ ID NO: 5971710 - DNA, 10 bp, Homo sapiens
acgggcagcc

SEQ ID NO: 5971711 - DNA, 16 bp, Homo sapiens
acgggcagccacagga

SEQ ID NO: 5971712 - DNA, 22 bp, Homo sapiens
acgggcagcctggctcccagga

SEQ ID NO: 5971713 - DNA, 12 bp, Homo sapiens
acgggcaggggt

SEQ ID NO: 5971714 - DNA, 15 bp, Homo sapiens
acgggcagtctgctc

SEQ ID NO: 5971715 - DNA, 15 bp, Homo sapiens
acgggcatgggcctc

SEQ ID NO: 5971716 - DNA, 21 bp, Homo sapiens
acgggcatgggcctctctggg

SEQ ID NO: 5971717 - DNA, 14 bp, Homo sapiens
acgggcatgtatta

SEQ ID NO: 5971718 - DNA, 16 bp, Homo sapiens
acgggccacacgtggc

SEQ ID NO: 5971719 - DNA, 15 bp, Homo sapiens
acgggccaggccctg

SEQ ID NO: 5971720 - DNA, 21 bp, Homo sapiens
acgggccaggccctggagggc

SEQ ID NO: 5971721 - DNA, 22 bp, Homo sapiens
acgggccagtttctctgccttc

SEQ ID NO: 5971722 - DNA, 22 bp, Homo sapiens
acgggcccgctcaacctctcag

SEQ ID NO: 5971723 - DNA, 23 bp, Homo sapiens
acgggcccgctcaacctctcaga

SEQ ID NO: 5971724 - DNA, 21 bp, Homo sapiens
acgggcccgggttgggtcacc

SEQ ID NO: 5971725 - DNA, 12 bp, Homo sapiens
acgggccctgcc

SEQ ID NO: 5971726 - DNA, 22 bp, Homo sapiens
acgggccctgccccagccccta

SEQ ID NO: 5971727 - DNA, 17 bp, Homo sapiens
acgggccgcaggaggga

SEQ ID NO: 5971728 - DNA, 20 bp, Homo sapiens
acgggccgcaggagggaggc

SEQ ID NO: 5971729 - DNA, 11 bp, Homo sapiens
acgggccggcc

SEQ ID NO: 5971730 - DNA, 14 bp, Homo sapiens
acgggccggccagc

SEQ ID NO: 5971731 - DNA, 16 bp, Homo sapiens
acgggccggccagctg

SEQ ID NO: 5971732 - DNA, 12 bp, Homo sapiens
acgggcctcccc

SEQ ID NO: 5971733 - DNA, 14 bp, Homo sapiens
acgggctccttccc

SEQ ID NO: 5971734 - DNA, 16 bp, Homo sapiens
acgggctccttcccct

SEQ ID NO: 5971735 - DNA, 18 bp, Homo sapiens
acgggctctatgcctgca

SEQ ID NO: 5971736 - DNA, 19 bp, Homo sapiens
acgggctctatgcctgcac

SEQ ID NO: 5971737 - DNA, 15 bp, Homo sapiens
acggggacacggcct

SEQ ID NO: 5971738 - DNA, 18 bp, Homo sapiens
acggggaccactgggccc

SEQ ID NO: 5971739 - DNA, 23 bp, Homo sapiens
acggggaccactgggcccctcag

SEQ ID NO: 5971740 - DNA, 14 bp, Homo sapiens
acggggaggccaag

SEQ ID NO: 5971741 - DNA, 19 bp, Homo sapiens
acggggatggttccccagg

SEQ ID NO: 5971742 - DNA, 12 bp, Homo sapiens
acggggcagagc

SEQ ID NO: 5971743 - DNA, 14 bp, Homo sapiens
acggggcagagctg

SEQ ID NO: 5971744 - DNA, 14 bp, Homo sapiens
acggggcagtcaga

SEQ ID NO: 5971745 - DNA, 19 bp, Homo sapiens
acggggcagttagagcagc

SEQ ID NO: 5971746 - DNA, 23 bp, Homo sapiens
acggggccacgtgtgctgtggcc

SEQ ID NO: 5971747 - DNA, 17 bp, Homo sapiens
acggggccagcatccat

SEQ ID NO: 5971748 - DNA, 21 bp, Homo sapiens
acggggccgacattgtctccc

SEQ ID NO: 5971749 - DNA, 14 bp, Homo sapiens
acggggccggccag

SEQ ID NO: 5971750 - DNA, 15 bp, Homo sapiens
acggggccggccagg

SEQ ID NO: 5971751 - DNA, 18 bp, Homo sapiens
acggggccggccaggtgg

SEQ ID NO: 5971752 - DNA, 11 bp, Homo sapiens
acggggcctcc

SEQ ID NO: 5971753 - DNA, 23 bp, Homo sapiens
acggggcgggccctgcctgaggg

SEQ ID NO: 5971754 - DNA, 15 bp, Homo sapiens
acggggctcttctca

SEQ ID NO: 5971755 - DNA, 18 bp, Homo sapiens
acggggctcttctcattt

SEQ ID NO: 5971756 - DNA, 19 bp, Homo sapiens
acgggggagctttcccaga

SEQ ID NO: 5971757 - DNA, 20 bp, Homo sapiens
acgggggaggccgaggcagg

SEQ ID NO: 5971758 - DNA, 21 bp, Homo sapiens
acgggggaggccgaggcaggg

SEQ ID NO: 5971759 - DNA, 23 bp, Homo sapiens
acgggggctgtggctctgggtgg

SEQ ID NO: 5971760 - DNA, 16 bp, Homo sapiens
acggggggctcctgcc

SEQ ID NO: 5971761 - DNA, 17 bp, Homo sapiens
acggggggctcctgccc

SEQ ID NO: 5971762 - DNA, 20 bp, Homo sapiens
acggggggctcctgcccagg

SEQ ID NO: 5971763 - DNA, 13 bp, Homo sapiens
acggggggctgcg

SEQ ID NO: 5971764 - DNA, 18 bp, Homo sapiens
acgggggtgcggcaggag

SEQ ID NO: 5971765 - DNA, 21 bp, Homo sapiens
acggggtcggacggggcaggc

SEQ ID NO: 5971766 - DNA, 17 bp, Homo sapiens
acggggtggggagggtg

SEQ ID NO: 5971767 - DNA, 16 bp, Homo sapiens
acggggtgtgtggccc

SEQ ID NO: 5971768 - DNA, 22 bp, Homo sapiens
acgggtgcccgtaatcccagct

SEQ ID NO: 5971769 - DNA, 14 bp, Homo sapiens
acgggtggtccccg

SEQ ID NO: 5971770 - DNA, 18 bp, Homo sapiens
acgggtgtcacggccagg

SEQ ID NO: 5971771 - DNA, 19 bp, Homo sapiens
acgggttgaaagacatcaa

SEQ ID NO: 5971772 - DNA, 20 bp, Homo sapiens
acgggttgaaagacatcaat

SEQ ID NO: 5971773 - DNA, 13 bp, Homo sapiens
acgggtttccctc

SEQ ID NO: 5971774 - DNA, 21 bp, Homo sapiens
acggtacttggtaagagggag

SEQ ID NO: 5971775 - DNA, 17 bp, Homo sapiens
acggtagtgatgaaatt

SEQ ID NO: 5971776 - DNA, 19 bp, Homo sapiens
acggtatcctccctgccca

SEQ ID NO: 5971777 - DNA, 22 bp, Homo sapiens
acggtatcctccctgcccatcc

SEQ ID NO: 5971778 - DNA, 20 bp, Homo sapiens
acggtatgacttaattttag

SEQ ID NO: 5971779 - DNA, 14 bp, Homo sapiens
acggtattatgctt

SEQ ID NO: 5971780 - DNA, 22 bp, Homo sapiens
acggtcacacctcactgtcatc

SEQ ID NO: 5971781 - DNA, 16 bp, Homo sapiens
acggtcaggtttaaca

SEQ ID NO: 5971782 - DNA, 17 bp, Homo sapiens
acggtcaggtttaacat

SEQ ID NO: 5971783 - DNA, 13 bp, Homo sapiens
acggtcagtttgg

SEQ ID NO: 5971784 - DNA, 21 bp, Homo sapiens
acggtcccacactggtgactg

SEQ ID NO: 5971785 - DNA, 16 bp, Homo sapiens
acggtccccacccctc

SEQ ID NO: 5971786 - DNA, 18 bp, Homo sapiens
acggtcctttaggcagcc

SEQ ID NO: 5971787 - DNA, 20 bp, Homo sapiens
acggtcctttaggcagcctg

SEQ ID NO: 5971788 - DNA, 15 bp, Homo sapiens
acggtctggaggccg

SEQ ID NO: 5971789 - DNA, 15 bp, Homo sapiens
acggtctgtgcccga

SEQ ID NO: 5971790 - DNA, 19 bp, Homo sapiens
acggtctgtgtgctgtttg

SEQ ID NO: 5971791 - DNA, 13 bp, Homo sapiens
acggtcttctgca

SEQ ID NO: 5971792 - DNA, 14 bp, Homo sapiens
acggtgacacaggt

SEQ ID NO: 5971793 - DNA, 19 bp, Homo sapiens
acggtgactctgtccagct

SEQ ID NO: 5971794 - DNA, 16 bp, Homo sapiens
acggtgatattgtgca

SEQ ID NO: 5971795 - DNA, 16 bp, Homo sapiens
acggtgcaacagaagg

SEQ ID NO: 5971796 - DNA, 23 bp, Homo sapiens
acggtggctcacacctgtaatcc

SEQ ID NO: 5971797 - DNA, 17 bp, Homo sapiens
acggtgggccttgctgg

SEQ ID NO: 5971798 - DNA, 21 bp, Homo sapiens
acggtggtcactggaactcag

SEQ ID NO: 5971799 - DNA, 22 bp, Homo sapiens
acggtggtccccaaaacactgt

SEQ ID NO: 5971800 - DNA, 16 bp, Homo sapiens
acggtgtacagtttaa

SEQ ID NO: 5971801 - DNA, 16 bp, Homo sapiens
acggtgttaattttgc

SEQ ID NO: 5971802 - DNA, 16 bp, Homo sapiens
acggttcaatggtaga

SEQ ID NO: 5971803 - DNA, 22 bp, Homo sapiens
acggttccctgcctaggagctg

SEQ ID NO: 5971804 - DNA, 10 bp, Homo sapiens
acggttccta

SEQ ID NO: 5971805 - DNA, 11 bp, Homo sapiens
acggttcctgg

SEQ ID NO: 5971806 - DNA, 19 bp, Homo sapiens
acggttcctggtgactcct

SEQ ID NO: 5971807 - DNA, 15 bp, Homo sapiens
acggttgcttcacct

SEQ ID NO: 5971808 - DNA, 16 bp, Homo sapiens
acggtttaactgtccc

SEQ ID NO: 5971809 - DNA, 16 bp, Homo sapiens
acggtttatgctgggc

SEQ ID NO: 5971810 - DNA, 13 bp, Homo sapiens
acggttttaaatg

SEQ ID NO: 5971811 - DNA, 22 bp, Homo sapiens
acggtttttttctttggctgca

SEQ ID NO: 5971812 - DNA, 18 bp, Homo sapiens
acgtaaacctgaaatata

SEQ ID NO: 5971813 - DNA, 19 bp, Homo sapiens
acgtaaacctgaaatatat

SEQ ID NO: 5971814 - DNA, 19 bp, Homo sapiens
acgtaaagaattttcatcc

SEQ ID NO: 5971815 - DNA, 21 bp, Homo sapiens
acgtaaagccttgttttctct

SEQ ID NO: 5971816 - DNA, 22 bp, Homo sapiens
actacacgtttcaacctctcta

SEQ ID NO: 5971817 - DNA, 18 bp, Homo sapiens
actacactccagcctgag

SEQ ID NO: 5971818 - DNA, 18 bp, Homo sapiens
actacagaaagcaaatca

SEQ ID NO: 5971819 - DNA, 19 bp, Homo sapiens
actacagaaagcaaatcag

SEQ ID NO: 5971820 - DNA, 14 bp, Homo sapiens
actacagaaatgag

SEQ ID NO: 5971821 - DNA, 15 bp, Homo sapiens
actacagaagtggaa

SEQ ID NO: 5971822 - DNA, 17 bp, Homo sapiens
actacagaataatgtgt

SEQ ID NO: 5971823 - DNA, 17 bp, Homo sapiens
actacagaatattaaat

SEQ ID NO: 5971824 - DNA, 12 bp, Homo sapiens
actacagaattg

SEQ ID NO: 5971825 - DNA, 18 bp, Homo sapiens
actacagacattaaataa

SEQ ID NO: 5971826 - DNA, 17 bp, Homo sapiens
actacagacctgctttt

SEQ ID NO: 5971827 - DNA, 18 bp, Homo sapiens
actacagacctgcttttt

SEQ ID NO: 5971828 - DNA, 21 bp, Homo sapiens
actacagagtctgacaggaag

SEQ ID NO: 5971829 - DNA, 18 bp, Homo sapiens
actacagagtgttataac

SEQ ID NO: 5971830 - DNA, 12 bp, Homo sapiens
actacagatcag

SEQ ID NO: 5971831 - DNA, 14 bp, Homo sapiens
actacagcataaat

SEQ ID NO: 5971832 - DNA, 20 bp, Homo sapiens
actacagccaaattgcagaa

SEQ ID NO: 5971833 - DNA, 21 bp, Homo sapiens
actacagccaaattgcagaag

SEQ ID NO: 5971834 - DNA, 22 bp, Homo sapiens
actacagccaaattgcagaaga

SEQ ID NO: 5971835 - DNA, 15 bp, Homo sapiens
actacagccagaagc

SEQ ID NO: 5971836 - DNA, 19 bp, Homo sapiens
actacagctcttaaatgta

SEQ ID NO: 5971837 - DNA, 17 bp, Homo sapiens
actacagctggggtgca

SEQ ID NO: 5971838 - DNA, 21 bp, Homo sapiens
actacagctggggtgcaggga

SEQ ID NO: 5971839 - DNA, 23 bp, Homo sapiens
actacagctggggtgcagggatg

SEQ ID NO: 5971840 - DNA, 17 bp, Homo sapiens
actacagcttcagtgat

SEQ ID NO: 5971841 - DNA, 12 bp, Homo sapiens
actacaggacaa

SEQ ID NO: 5971842 - DNA, 15 bp, Homo sapiens
actacaggcacccac

SEQ ID NO: 5971843 - DNA, 11 bp, Homo sapiens
actacaggccc

SEQ ID NO: 5971844 - DNA, 17 bp, Homo sapiens
actacaggcgtgagcca

SEQ ID NO: 5971845 - DNA, 15 bp, Homo sapiens
actacagtcaggaaa

SEQ ID NO: 5971846 - DNA, 15 bp, Homo sapiens
actacagtcctccca

SEQ ID NO: 5971847 - DNA, 14 bp, Homo sapiens
actacagtttgtta

SEQ ID NO: 5971848 - DNA, 13 bp, Homo sapiens
actacataaactg

SEQ ID NO: 5971849 - DNA, 17 bp, Homo sapiens
actacataatctctgga

SEQ ID NO: 5971850 - DNA, 22 bp, Homo sapiens
actacataattaaattttaatg

SEQ ID NO: 5971851 - DNA, 17 bp, Homo sapiens
actacataggttaattt

SEQ ID NO: 5971852 - DNA, 16 bp, Homo sapiens
actacatattgaatag

SEQ ID NO: 5971853 - DNA, 15 bp, Homo sapiens
actacatattgtctg

SEQ ID NO: 5971854 - DNA, 18 bp, Homo sapiens
actacatcccacattagt

SEQ ID NO: 5971855 - DNA, 13 bp, Homo sapiens
actacatctggga

SEQ ID NO: 5971856 - DNA, 15 bp, Homo sapiens
actacatctgggact

SEQ ID NO: 5971857 - DNA, 20 bp, Homo sapiens
actacatgaaataatgcact

SEQ ID NO: 5971858 - DNA, 20 bp, Homo sapiens
actacatgagaacaaacaga

SEQ ID NO: 5971859 - DNA, 12 bp, Homo sapiens
actacatgcact

SEQ ID NO: 5971860 - DNA, 21 bp, Homo sapiens
actacatgcataaactaaaaa

SEQ ID NO: 5971861 - DNA, 18 bp, Homo sapiens
actacatgggccagccct

SEQ ID NO: 5971862 - DNA, 12 bp, Homo sapiens
actacattaaaa

SEQ ID NO: 5971863 - DNA, 16 bp, Homo sapiens
actacattaaaagctt

SEQ ID NO: 5971864 - DNA, 19 bp, Homo sapiens
actacattaggttgtgaat

SEQ ID NO: 5971865 - DNA, 19 bp, Homo sapiens
actacattccaaagaaaca

SEQ ID NO: 5971866 - DNA, 14 bp, Homo sapiens
actacattctgtta

SEQ ID NO: 5971867 - DNA, 15 bp, Homo sapiens
actacattctgttaa

SEQ ID NO: 5971868 - DNA, 16 bp, Homo sapiens
actacatttagcccct

SEQ ID NO: 5971869 - DNA, 20 bp, Homo sapiens
actacatttagcccctctct

SEQ ID NO: 5971870 - DNA, 21 bp, Homo sapiens
actacatttagcccctctctt

SEQ ID NO: 5971871 - DNA, 11 bp, Homo sapiens
actacatttat

SEQ ID NO: 5971872 - DNA, 12 bp, Homo sapiens
actacatttgca

SEQ ID NO: 5971873 - DNA, 16 bp, Homo sapiens
actacatttgcatgcc

SEQ ID NO: 5971874 - DNA, 14 bp, Homo sapiens
actacattttaaca

SEQ ID NO: 5971875 - DNA, 21 bp, Homo sapiens
actacattttgaggttttgta

SEQ ID NO: 5971876 - DNA, 16 bp, Homo sapiens
actacattttgctctg

SEQ ID NO: 5971877 - DNA, 14 bp, Homo sapiens
actacattttttca

SEQ ID NO: 5971878 - DNA, 18 bp, Homo sapiens
actacattttttctaata

SEQ ID NO: 5971879 - DNA, 15 bp, Homo sapiens
actaccaaaagacat

SEQ ID NO: 5971880 - DNA, 21 bp, Homo sapiens
actaccaagaggccctgtctg

SEQ ID NO: 5971881 - DNA, 14 bp, Homo sapiens
actaccaagtgacc

SEQ ID NO: 5971882 - DNA, 14 bp, Homo sapiens
actaccacaaggaa

SEQ ID NO: 5971883 - DNA, 15 bp, Homo sapiens
actaccacaaggaaa

SEQ ID NO: 5971884 - DNA, 16 bp, Homo sapiens
actaccaccctcgctg

SEQ ID NO: 5971885 - DNA, 20 bp, Homo sapiens
actaccaccctcgctgccac

SEQ ID NO: 5971886 - DNA, 17 bp, Homo sapiens
actaccacctcaggtga

SEQ ID NO: 5971887 - DNA, 15 bp, Homo sapiens
actaccagaagggct

SEQ ID NO: 5971888 - DNA, 13 bp, Homo sapiens
actaccagccagc

SEQ ID NO: 5971889 - DNA, 21 bp, Homo sapiens
actaccagggtctctcaggga

SEQ ID NO: 5971890 - DNA, 21 bp, Homo sapiens
actaccaggtgtgcctggaag

SEQ ID NO: 5971891 - DNA, 13 bp, Homo sapiens
actaccatacaga

SEQ ID NO: 5971892 - DNA, 19 bp, Homo sapiens
actaccatacagacagcac

SEQ ID NO: 5971893 - DNA, 20 bp, Homo sapiens
actacccaaaacaagcctgg

SEQ ID NO: 5971894 - DNA, 19 bp, Homo sapiens
actacccaggttaagaaaa

SEQ ID NO: 5971895 - DNA, 20 bp, Homo sapiens
actacccatcggtgtccatt

SEQ ID NO: 5971896 - DNA, 16 bp, Homo sapiens
actaccccacaccagc

SEQ ID NO: 5971897 - DNA, 21 bp, Homo sapiens
actaccccagaacgcatgcag

SEQ ID NO: 5971898 - DNA, 21 bp, Homo sapiens
actaccccaggatgcatgcag

SEQ ID NO: 5971899 - DNA, 18 bp, Homo sapiens
actacccccttttcagct

SEQ ID NO: 5971900 - DNA, 21 bp, Homo sapiens
actaccccttgattttccatc

SEQ ID NO: 5971901 - DNA, 20 bp, Homo sapiens
actacccgagcccagctaca

SEQ ID NO: 5971902 - DNA, 15 bp, Homo sapiens
actaccctagttcaa

SEQ ID NO: 5971903 - DNA, 16 bp, Homo sapiens
actaccctagttcaaa

SEQ ID NO: 5971904 - DNA, 18 bp, Homo sapiens
actaccctattctctctt

SEQ ID NO: 5971905 - DNA, 15 bp, Homo sapiens
actacccttaattac

SEQ ID NO: 5971906 - DNA, 16 bp, Homo sapiens
actacccttctccttt

SEQ ID NO: 5971907 - DNA, 22 bp, Homo sapiens
actacccttctcctttccttcc

SEQ ID NO: 5971908 - DNA, 16 bp, Homo sapiens
actaccgaatgtgtct

SEQ ID NO: 5971909 - DNA, 17 bp, Homo sapiens
actaccgaatgtgtctt

SEQ ID NO: 5971910 - DNA, 18 bp, Homo sapiens
actaccgaatgtgtcttt

SEQ ID NO: 5971911 - DNA, 23 bp, Homo sapiens
actaccgaatgtgtctttagata

SEQ ID NO: 5971912 - DNA, 14 bp, Homo sapiens
actaccgcaggccc

SEQ ID NO: 5971913 - DNA, 15 bp, Homo sapiens
actaccgcaggcccg

SEQ ID NO: 5971914 - DNA, 14 bp, Homo sapiens
actacctaaaataa

SEQ ID NO: 5971915 - DNA, 21 bp, Homo sapiens
actacctacgtttgcaccgcc

SEQ ID NO: 5971916 - DNA, 14 bp, Homo sapiens
actacctactggtg

SEQ ID NO: 5971917 - DNA, 21 bp, Homo sapiens
actacctagaagtaagaagag

SEQ ID NO: 5971918 - DNA, 14 bp, Homo sapiens
actacctataaatg

SEQ ID NO: 5971919 - DNA, 15 bp, Homo sapiens
actacctataaatgg

SEQ ID NO: 5971920 - DNA, 18 bp, Homo sapiens
actacctatattccttgt

SEQ ID NO: 5971921 - DNA, 19 bp, Homo sapiens
actacctcctcagggatgg

SEQ ID NO: 5971922 - DNA, 16 bp, Homo sapiens
actacctcctctcctg

SEQ ID NO: 5971923 - DNA, 17 bp, Homo sapiens
actacctcctctcctga

SEQ ID NO: 5971924 - DNA, 15 bp, Homo sapiens
actacctctggacag

SEQ ID NO: 5971925 - DNA, 15 bp, Homo sapiens
actacctctgtgcct

SEQ ID NO: 5971926 - DNA, 19 bp, Homo sapiens
actacctcttaagtcccag

SEQ ID NO: 5971927 - DNA, 14 bp, Homo sapiens
actacctggctgcg

SEQ ID NO: 5971928 - DNA, 23 bp, Homo sapiens
actacctgtatttaaaaatagaa

SEQ ID NO: 5971929 - DNA, 19 bp, Homo sapiens
actacctgtgagcatggga

SEQ ID NO: 5971930 - DNA, 21 bp, Homo sapiens
actacctttatagctcatcac

SEQ ID NO: 5971931 - DNA, 18 bp, Homo sapiens
actacctttatagctctc

SEQ ID NO: 5971932 - DNA, 20 bp, Homo sapiens
actacctttatagctctcat

SEQ ID NO: 5971933 - DNA, 16 bp, Homo sapiens
actacgcacagctgcc

SEQ ID NO: 5971934 - DNA, 15 bp, Homo sapiens
actacgtgactgtgg

SEQ ID NO: 5971935 - DNA, 18 bp, Homo sapiens
actactacagaaattctg

SEQ ID NO: 5971936 - DNA, 16 bp, Homo sapiens
actactactgttatca

SEQ ID NO: 5971937 - DNA, 14 bp, Homo sapiens
actactagggaaat

SEQ ID NO: 5971938 - DNA, 13 bp, Homo sapiens
actactagtgtga

SEQ ID NO: 5971939 - DNA, 17 bp, Homo sapiens
actactagtgtgactcc

SEQ ID NO: 5971940 - DNA, 18 bp, Homo sapiens
actactagtgtgactcct

SEQ ID NO: 5971941 - DNA, 20 bp, Homo sapiens
actactagtgtgactcctta

SEQ ID NO: 5971942 - DNA, 15 bp, Homo sapiens
actactcaaatggca

SEQ ID NO: 5971943 - DNA, 18 bp, Homo sapiens
actactcaatactacctc

SEQ ID NO: 5971944 - DNA, 23 bp, Homo sapiens
actactcaatactacctctgaat

SEQ ID NO: 5971945 - DNA, 13 bp, Homo sapiens
actactcacttct

SEQ ID NO: 5971946 - DNA, 13 bp, Homo sapiens
actactcagcatg

SEQ ID NO: 5971947 - DNA, 17 bp, Homo sapiens
actactcccccaggtgg

SEQ ID NO: 5971948 - DNA, 15 bp, Homo sapiens
actactcctaattat

SEQ ID NO: 5971949 - DNA, 16 bp, Homo sapiens
actactcctaattatt

SEQ ID NO: 5971950 - DNA, 16 bp, Homo sapiens
actactcctagactga

SEQ ID NO: 5971951 - DNA, 14 bp, Homo sapiens
actactcctctgca

SEQ ID NO: 5971952 - DNA, 21 bp, Homo sapiens
actactcgagcccacccagca

SEQ ID NO: 5971953 - DNA, 11 bp, Homo sapiens
actactctcca

SEQ ID NO: 5971954 - DNA, 14 bp, Homo sapiens
actactctcttcct

SEQ ID NO: 5971955 - DNA, 13 bp, Homo sapiens
actactctgtgcc

SEQ ID NO: 5971956 - DNA, 15 bp, Homo sapiens
actactctttgattt

SEQ ID NO: 5971957 - DNA, 13 bp, Homo sapiens
actactgaaattt

SEQ ID NO: 5971958 - DNA, 18 bp, Homo sapiens
actactgaacacatgtgt

SEQ ID NO: 5971959 - DNA, 19 bp, Homo sapiens
actactgaacacatgtgta

SEQ ID NO: 5971960 - DNA, 16 bp, Homo sapiens
actactgaactgttac

SEQ ID NO: 5971961 - DNA, 15 bp, Homo sapiens
actactgacagggag

SEQ ID NO: 5971962 - DNA, 14 bp, Homo sapiens
actactgcaagttc

SEQ ID NO: 5971963 - DNA, 18 bp, Homo sapiens
actactgcagtctttatt

SEQ ID NO: 5971964 - DNA, 11 bp, Homo sapiens
actactgcctt

SEQ ID NO: 5971965 - DNA, 17 bp, Homo sapiens
actactgccttgtactt

SEQ ID NO: 5971966 - DNA, 12 bp, Homo sapiens
actactgccttt

SEQ ID NO: 5971967 - DNA, 17 bp, Homo sapiens
actactgcctttcaaag

SEQ ID NO: 5971968 - DNA, 18 bp, Homo sapiens
actactgcctttcaaagt

SEQ ID NO: 5971969 - DNA, 21 bp, Homo sapiens
actactgctaatgttgatcag

SEQ ID NO: 5971970 - DNA, 16 bp, Homo sapiens
actactgctgcaaagt

SEQ ID NO: 5971971 - DNA, 18 bp, Homo sapiens
actactgctgcaaagtgc

SEQ ID NO: 5971972 - DNA, 19 bp, Homo sapiens
actactgctgcaaagtgca

SEQ ID NO: 5971973 - DNA, 21 bp, Homo sapiens
actactgctgcaaagtgcaaa

SEQ ID NO: 5971974 - DNA, 18 bp, Homo sapiens
actactgggcaaagagtg

SEQ ID NO: 5971975 - DNA, 17 bp, Homo sapiens
actactgggtgtcattt

SEQ ID NO: 5971976 - DNA, 20 bp, Homo sapiens
actactgggtgtcatttcat

SEQ ID NO: 5971977 - DNA, 14 bp, Homo sapiens
actactggtctgta

SEQ ID NO: 5971978 - DNA, 14 bp, Homo sapiens
actactgtaaatgt

SEQ ID NO: 5971979 - DNA, 15 bp, Homo sapiens
actactgtaaatgta

SEQ ID NO: 5971980 - DNA, 16 bp, Homo sapiens
actactgtaaatgtat

SEQ ID NO: 5971981 - DNA, 11 bp, Homo sapiens
actactgtaat

SEQ ID NO: 5971982 - DNA, 14 bp, Homo sapiens
actactgtaattaa

SEQ ID NO: 5971983 - DNA, 13 bp, Homo sapiens
actactgtacttt

SEQ ID NO: 5971984 - DNA, 18 bp, Homo sapiens
actactgtagaactgcaa

SEQ ID NO: 5971985 - DNA, 20 bp, Homo sapiens
actactgtagaagaagtgaa

SEQ ID NO: 5971986 - DNA, 19 bp, Homo sapiens
actactgtatctgatgttt

SEQ ID NO: 5971987 - DNA, 16 bp, Homo sapiens
actactgtggaaagac

SEQ ID NO: 5971988 - DNA, 13 bp, Homo sapiens
actactgtgttcc

SEQ ID NO: 5971989 - DNA, 21 bp, Homo sapiens
actactgttaggaacagcagt

SEQ ID NO: 5971990 - DNA, 15 bp, Homo sapiens
actacttacaggtga

SEQ ID NO: 5971991 - DNA, 15 bp, Homo sapiens
actacttaccatttg

SEQ ID NO: 5971992 - DNA, 22 bp, Homo sapiens
actacttagcatcctaagaaat

SEQ ID NO: 5971993 - DNA, 15 bp, Homo sapiens
actacttatctctaa

SEQ ID NO: 5971994 - DNA, 16 bp, Homo sapiens
actacttcttggaaaa

SEQ ID NO: 5971995 - DNA, 14 bp, Homo sapiens
actacttgaccatt

SEQ ID NO: 5971996 - DNA, 22 bp, Homo sapiens
atcattgaaacatttataaact

SEQ ID NO: 5971997 - DNA, 12 bp, Homo sapiens
atcattgaaatc

SEQ ID NO: 5971998 - DNA, 15 bp, Homo sapiens
atcattgaaatcttt

SEQ ID NO: 5971999 - DNA, 20 bp, Homo sapiens
atcattgaaatctttttgct

SEQ ID NO: 5972000 - DNA, 20 bp, Homo sapiens
atcattgagaaataaagcac

SEQ ID NO: 5972001 - DNA, 20 bp, Homo sapiens
atcattgatgatcactgtga

SEQ ID NO: 5972002 - DNA, 13 bp, Homo sapiens
atcattgatttta

SEQ ID NO: 5972003 - DNA, 12 bp, Homo sapiens
atcattgcaaac

SEQ ID NO: 5972004 - DNA, 23 bp, Homo sapiens
atcattgctcccctgatagaaga

SEQ ID NO: 5972005 - DNA, 22 bp, Homo sapiens
atcattgctgtctgcagccttg

SEQ ID NO: 5972006 - DNA, 19 bp, Homo sapiens
atcattgcttcctcctccc

SEQ ID NO: 5972007 - DNA, 18 bp, Homo sapiens
atcattgctttgaagcag

SEQ ID NO: 5972008 - DNA, 23 bp, Homo sapiens
atcattgctttgaagcagttgtg

SEQ ID NO: 5972009 - DNA, 18 bp, Homo sapiens
atcattggaatacaggaa

SEQ ID NO: 5972010 - DNA, 17 bp, Homo sapiens
atcattggagtttagga

SEQ ID NO: 5972011 - DNA, 22 bp, Homo sapiens
atcattggattctgagagctgt

SEQ ID NO: 5972012 - DNA, 16 bp, Homo sapiens
atcattgtaaacatta

SEQ ID NO: 5972013 - DNA, 13 bp, Homo sapiens
atcattgtaaatt

SEQ ID NO: 5972014 - DNA, 16 bp, Homo sapiens
atcattgtacagtttg

SEQ ID NO: 5972015 - DNA, 14 bp, Homo sapiens
atcattgtatggat

SEQ ID NO: 5972016 - DNA, 20 bp, Homo sapiens
atcattgtgcttaataatac

SEQ ID NO: 5972017 - DNA, 16 bp, Homo sapiens
atcattgttataaaga

SEQ ID NO: 5972018 - DNA, 23 bp, Homo sapiens
atcattgtttaggggtgaaggag

SEQ ID NO: 5972019 - DNA, 20 bp, Homo sapiens
atcattgtttggcattgaaa

SEQ ID NO: 5972020 - DNA, 21 bp, Homo sapiens
atcattgtttgtcctttatgt

SEQ ID NO: 5972021 - DNA, 21 bp, Homo sapiens
atcatttaataatatacttgt

SEQ ID NO: 5972022 - DNA, 21 bp, Homo sapiens
atcatttaggatactcttaat

SEQ ID NO: 5972023 - DNA, 16 bp, Homo sapiens
atcatttattctgctt

SEQ ID NO: 5972024 - DNA, 17 bp, Homo sapiens
atcatttattttaagca

SEQ ID NO: 5972025 - DNA, 16 bp, Homo sapiens
atcatttcacttgtca

SEQ ID NO: 5972026 - DNA, 12 bp, Homo sapiens
atcatttcagcc

SEQ ID NO: 5972027 - DNA, 14 bp, Homo sapiens
atcatttcagccaa

SEQ ID NO: 5972028 - DNA, 16 bp, Homo sapiens
atcatttcagccaaag

SEQ ID NO: 5972029 - DNA, 23 bp, Homo sapiens
atcatttcagtatcatctccatc

SEQ ID NO: 5972030 - DNA, 16 bp, Homo sapiens
atcatttcatgctttg

SEQ ID NO: 5972031 - DNA, 17 bp, Homo sapiens
atcatttccagcaaaat

SEQ ID NO: 5972032 - DNA, 19 bp, Homo sapiens
atcatttccagcaaaatat

SEQ ID NO: 5972033 - DNA, 21 bp, Homo sapiens
atcatttccagcaaaatatat

SEQ ID NO: 5972034 - DNA, 14 bp, Homo sapiens
atcatttcccctcc

SEQ ID NO: 5972035 - DNA, 19 bp, Homo sapiens
atcatttcctgggagaaag

SEQ ID NO: 5972036 - DNA, 18 bp, Homo sapiens
atcatttctattaaatga

SEQ ID NO: 5972037 - DNA, 15 bp, Homo sapiens
atcatttctcactgt

SEQ ID NO: 5972038 - DNA, 20 bp, Homo sapiens
atcatttctgcatcagctgc

SEQ ID NO: 5972039 - DNA, 14 bp, Homo sapiens
atcatttctgccat

SEQ ID NO: 5972040 - DNA, 22 bp, Homo sapiens
atcatttctgccatgatgttta

SEQ ID NO: 5972041 - DNA, 11 bp, Homo sapiens
atcatttctgt

SEQ ID NO: 5972042 - DNA, 19 bp, Homo sapiens
atcatttcttgggccctcc

SEQ ID NO: 5972043 - DNA, 17 bp, Homo sapiens
atcatttgaacaactag

SEQ ID NO: 5972044 - DNA, 23 bp, Homo sapiens
atcatttgagatttttggttttt

SEQ ID NO: 5972045 - DNA, 16 bp, Homo sapiens
atcatttgcagctgct

SEQ ID NO: 5972046 - DNA, 19 bp, Homo sapiens
atcatttgcagctgctggt

SEQ ID NO: 5972047 - DNA, 13 bp, Homo sapiens
atcatttgctttt

SEQ ID NO: 5972048 - DNA, 19 bp, Homo sapiens
atcatttggaaatcagcat

SEQ ID NO: 5972049 - DNA, 12 bp, Homo sapiens
atcatttgttca

SEQ ID NO: 5972050 - DNA, 19 bp, Homo sapiens
atcatttgttctgggagta

SEQ ID NO: 5972051 - DNA, 20 bp, Homo sapiens
atcattttaaaatgtcttgg

SEQ ID NO: 5972052 - DNA, 12 bp, Homo sapiens
atcattttaaga

SEQ ID NO: 5972053 - DNA, 22 bp, Homo sapiens
atcattttaagaagacatgaca

SEQ ID NO: 5972054 - DNA, 14 bp, Homo sapiens
atcattttaattat

SEQ ID NO: 5972055 - DNA, 13 bp, Homo sapiens
atcattttacagt

SEQ ID NO: 5972056 - DNA, 15 bp, Homo sapiens
atcattttacagtga

SEQ ID NO: 5972057 - DNA, 20 bp, Homo sapiens
atcattttacctttgacaaa

SEQ ID NO: 5972058 - DNA, 15 bp, Homo sapiens
atcattttagacact

SEQ ID NO: 5972059 - DNA, 18 bp, Homo sapiens
atcattttagtatagttt

SEQ ID NO: 5972060 - DNA, 19 bp, Homo sapiens
atcattttatatgtcaaag

SEQ ID NO: 5972061 - DNA, 13 bp, Homo sapiens
atcattttattca

SEQ ID NO: 5972062 - DNA, 15 bp, Homo sapiens
atcattttattcaca

SEQ ID NO: 5972063 - DNA, 14 bp, Homo sapiens
atcattttcacctc

SEQ ID NO: 5972064 - DNA, 15 bp, Homo sapiens
atcattttcattaaa

SEQ ID NO: 5972065 - DNA, 14 bp, Homo sapiens
atcattttccaatt

SEQ ID NO: 5972066 - DNA, 15 bp, Homo sapiens
atcattttcccccca

SEQ ID NO: 5972067 - DNA, 22 bp, Homo sapiens
atcattttctccccttggcagt

SEQ ID NO: 5972068 - DNA, 22 bp, Homo sapiens
atcattttcttatcttctgcaa

SEQ ID NO: 5972069 - DNA, 13 bp, Homo sapiens
atcattttgatgt

SEQ ID NO: 5972070 - DNA, 13 bp, Homo sapiens
atcattttgcatt

SEQ ID NO: 5972071 - DNA, 17 bp, Homo sapiens
atcattttgcattcaaa

SEQ ID NO: 5972072 - DNA, 13 bp, Homo sapiens
atcatttttaatt

SEQ ID NO: 5972073 - DNA, 20 bp, Homo sapiens
atcatttttacactattgtg

SEQ ID NO: 5972074 - DNA, 14 bp, Homo sapiens
atcatttttccagg

SEQ ID NO: 5972075 - DNA, 17 bp, Homo sapiens
atcatttttccaggact

SEQ ID NO: 5972076 - DNA, 17 bp, Homo sapiens
atcatttttgagcaact

SEQ ID NO: 5972077 - DNA, 12 bp, Homo sapiens
atcatttttgta

SEQ ID NO: 5972078 - DNA, 13 bp, Homo sapiens
atcatttttgtac

SEQ ID NO: 5972079 - DNA, 15 bp, Homo sapiens
atcatttttgtagga

SEQ ID NO: 5972080 - DNA, 23 bp, Homo sapiens
atcatttttgtaggaagcatttt

SEQ ID NO: 5972081 - DNA, 19 bp, Homo sapiens
atcatttttgtataaaaag

SEQ ID NO: 5972082 - DNA, 14 bp, Homo sapiens
atcatttttgtatc

SEQ ID NO: 5972083 - DNA, 16 bp, Homo sapiens
atcattttttatatat

SEQ ID NO: 5972084 - DNA, 18 bp, Homo sapiens
atcattttttatatatat

SEQ ID NO: 5972085 - DNA, 21 bp, Homo sapiens
atcattttttcctgtttggga

SEQ ID NO: 5972086 - DNA, 17 bp, Homo sapiens
atccaaaaagctctgaa

SEQ ID NO: 5972087 - DNA, 18 bp, Homo sapiens
atccaaaaagctctgaaa

SEQ ID NO: 5972088 - DNA, 19 bp, Homo sapiens
atccaaaaagctctgaaaa

SEQ ID NO: 5972089 - DNA, 13 bp, Homo sapiens
atccaaaagacaa

SEQ ID NO: 5972090 - DNA, 23 bp, Homo sapiens
atccaaaagcaggaacccatcta

SEQ ID NO: 5972091 - DNA, 13 bp, Homo sapiens
atccaaaagcttt

SEQ ID NO: 5972092 - DNA, 17 bp, Homo sapiens
atccaaaataaagatca

SEQ ID NO: 5972093 - DNA, 13 bp, Homo sapiens
atccaaaatattt

SEQ ID NO: 5972094 - DNA, 17 bp, Homo sapiens
atccaaaatgtgtattt

SEQ ID NO: 5972095 - DNA, 23 bp, Homo sapiens
atccaaacaagactgctcatgca

SEQ ID NO: 5972096 - DNA, 12 bp, Homo sapiens
atccaaactgct

SEQ ID NO: 5972097 - DNA, 13 bp, Homo sapiens
atccaaactgctg

SEQ ID NO: 5972098 - DNA, 15 bp, Homo sapiens
atccaaactgctgtc

SEQ ID NO: 5972099 - DNA, 16 bp, Homo sapiens
atccaaactgctgtct

SEQ ID NO: 5972100 - DNA, 23 bp, Homo sapiens
atccaaagaacttgatttgcatg

SEQ ID NO: 5972101 - DNA, 11 bp, Homo sapiens
atccaaagatt

SEQ ID NO: 5972102 - DNA, 17 bp, Homo sapiens
atccaaagcattgcaga

SEQ ID NO: 5972103 - DNA, 19 bp, Homo sapiens
atccaaagcgatcatgtca

SEQ ID NO: 5972104 - DNA, 13 bp, Homo sapiens
atccaaaggaatc

SEQ ID NO: 5972105 - DNA, 14 bp, Homo sapiens
atccaaaggctcct

SEQ ID NO: 5972106 - DNA, 18 bp, Homo sapiens
atccaaaggctcctgaga

SEQ ID NO: 5972107 - DNA, 19 bp, Homo sapiens
atccaaagtccccattcag

SEQ ID NO: 5972108 - DNA, 20 bp, Homo sapiens
atccaaagttgccacagatg

SEQ ID NO: 5972109 - DNA, 15 bp, Homo sapiens
atccaaatctgtcct

SEQ ID NO: 5972110 - DNA, 19 bp, Homo sapiens
atccaaatctgtcctctgt

SEQ ID NO: 5972111 - DNA, 18 bp, Homo sapiens
atccaaatcttgaatttc

SEQ ID NO: 5972112 - DNA, 17 bp, Homo sapiens
atccaaatgcattcatg

SEQ ID NO: 5972113 - DNA, 20 bp, Homo sapiens
atccaaatgcattcatgttt

SEQ ID NO: 5972114 - DNA, 19 bp, Homo sapiens
atccaaatgctgtgcaaac

SEQ ID NO: 5972115 - DNA, 20 bp, Homo sapiens
atccaaatgctgtgcaaaca

SEQ ID NO: 5972116 - DNA, 19 bp, Homo sapiens
atccaaattccctctggag

SEQ ID NO: 5972117 - DNA, 20 bp, Homo sapiens
atccaaattccctctggagt

SEQ ID NO: 5972118 - DNA, 15 bp, Homo sapiens
atccaacacaactat

SEQ ID NO: 5972119 - DNA, 21 bp, Homo sapiens
atccaacctctttcctctctg

SEQ ID NO: 5972120 - DNA, 20 bp, Homo sapiens
atccaactaatgccttactc

SEQ ID NO: 5972121 - DNA, 14 bp, Homo sapiens
atccaactatttct

SEQ ID NO: 5972122 - DNA, 15 bp, Homo sapiens
atccaactccagcaa

SEQ ID NO: 5972123 - DNA, 16 bp, Homo sapiens
atccaactccagcaac

SEQ ID NO: 5972124 - DNA, 13 bp, Homo sapiens
atccaactcctct

SEQ ID NO: 5972125 - DNA, 16 bp, Homo sapiens
atccaactggaaggct

SEQ ID NO: 5972126 - DNA, 21 bp, Homo sapiens
atccaactggaaggctttatt

SEQ ID NO: 5972127 - DNA, 18 bp, Homo sapiens
atccaactgtcagatctg

SEQ ID NO: 5972128 - DNA, 18 bp, Homo sapiens
atccaacttatatttctg

SEQ ID NO: 5972129 - DNA, 12 bp, Homo sapiens
atccaagaactt

SEQ ID NO: 5972130 - DNA, 19 bp, Homo sapiens
atccaagatattttaaaat

SEQ ID NO: 5972131 - DNA, 21 bp, Homo sapiens
atccaagatcaattccctctc

SEQ ID NO: 5972132 - DNA, 17 bp, Homo sapiens
atccaagatgtttggac

SEQ ID NO: 5972133 - DNA, 14 bp, Homo sapiens
atccaagccagagt

SEQ ID NO: 5972134 - DNA, 15 bp, Homo sapiens
atccaagcccagcct

SEQ ID NO: 5972135 - DNA, 21 bp, Homo sapiens
atccaagcctccacagcgagg

SEQ ID NO: 5972136 - DNA, 13 bp, Homo sapiens
atccaagctaatt

SEQ ID NO: 5972137 - DNA, 14 bp, Homo sapiens
atccaagctccctg

SEQ ID NO: 5972138 - DNA, 15 bp, Homo sapiens
atccaagctccctgc

SEQ ID NO: 5972139 - DNA, 23 bp, Homo sapiens
atccaaggaacttcatgcttgat

SEQ ID NO: 5972140 - DNA, 21 bp, Homo sapiens
atccaaggaagggatgtattt

SEQ ID NO: 5972141 - DNA, 17 bp, Homo sapiens
atccaaggcaaacaatc

SEQ ID NO: 5972142 - DNA, 18 bp, Homo sapiens
atccaaggcaaacaatcc

SEQ ID NO: 5972143 - DNA, 15 bp, Homo sapiens
atccaaggccgcggc

SEQ ID NO: 5972144 - DNA, 21 bp, Homo sapiens
atccaaggccgcggcccagac

SEQ ID NO: 5972145 - DNA, 22 bp, Homo sapiens
atccaagtctttcttctttttt

SEQ ID NO: 5972146 - DNA, 16 bp, Homo sapiens
atccaagtgacaaagt

SEQ ID NO: 5972147 - DNA, 15 bp, Homo sapiens
atccaataatcagaa

SEQ ID NO: 5972148 - DNA, 19 bp, Homo sapiens
atccaataattttcctgtg

SEQ ID NO: 5972149 - DNA, 19 bp, Homo sapiens
atccaatagtctgccacaa

SEQ ID NO: 5972150 - DNA, 12 bp, Homo sapiens
atccaatattgt

SEQ ID NO: 5972151 - DNA, 14 bp, Homo sapiens
atccaatattgtaa

SEQ ID NO: 5972152 - DNA, 15 bp, Homo sapiens
atccaatattgtaat

SEQ ID NO: 5972153 - DNA, 24 bp, Homo sapiens
atccaatattttctttaatgcttt

SEQ ID NO: 5972154 - DNA, 18 bp, Homo sapiens
atccaatcaatcttgcat

SEQ ID NO: 5972155 - DNA, 13 bp, Homo sapiens
atccaatcaattt

SEQ ID NO: 5972156 - DNA, 14 bp, Homo sapiens
atccaatcctcact

SEQ ID NO: 5972157 - DNA, 20 bp, Homo sapiens
atccaatctaaccacatcaa

SEQ ID NO: 5972158 - DNA, 19 bp, Homo sapiens
atccaatcttgtttccaaa

SEQ ID NO: 5972159 - DNA, 24 bp, Homo sapiens
atccaatgatataggaaaatacat

SEQ ID NO: 5972160 - DNA, 20 bp, Homo sapiens
atccaatgggtttttccctg

SEQ ID NO: 5972161 - DNA, 23 bp, Homo sapiens
atccaatgtgaagttcatcttgc

SEQ ID NO: 5972162 - DNA, 22 bp, Homo sapiens
atccaatgttagagactttttt

SEQ ID NO: 5972163 - DNA, 23 bp, Homo sapiens
atccaatgttagagacttttttc

SEQ ID NO: 5972164 - DNA, 19 bp, Homo sapiens
atccaattcattatgtcaa

SEQ ID NO: 5972165 - DNA, 20 bp, Homo sapiens
atccaattgatgtatatgtt

SEQ ID NO: 5972166 - DNA, 17 bp, Homo sapiens
atccaattttgatcttt

SEQ ID NO: 5972167 - DNA, 22 bp, Homo sapiens
atccacaaagccgtgcctttct

SEQ ID NO: 5972168 - DNA, 21 bp, Homo sapiens
atccacaattattggcaaagt

SEQ ID NO: 5972169 - DNA, 19 bp, Homo sapiens
atccacacaacaccaggac

SEQ ID NO: 5972170 - DNA, 12 bp, Homo sapiens
atccacacacag

SEQ ID NO: 5972171 - DNA, 23 bp, Homo sapiens
atccacacacagaggaagagcag

SEQ ID NO: 5972172 - DNA, 13 bp, Homo sapiens
atccacacacagc

SEQ ID NO: 5972173 - DNA, 19 bp, Homo sapiens
atccacagaaaatgtaaac

SEQ ID NO: 5972174 - DNA, 12 bp, Homo sapiens
cagtgcttttgg

SEQ ID NO: 5972175 - DNA, 20 bp, Homo sapiens
cagtgctttttccttttcat

SEQ ID NO: 5972176 - DNA, 16 bp, Homo sapiens
cagtggaaagtcctga

SEQ ID NO: 5972177 - DNA, 19 bp, Homo sapiens
cagtggaacagcgggagac

SEQ ID NO: 5972178 - DNA, 10 bp, Homo sapiens
cagtggaaga

SEQ ID NO: 5972179 - DNA, 15 bp, Homo sapiens
cagtggaagaaacac

SEQ ID NO: 5972180 - DNA, 13 bp, Homo sapiens
cagtggaagaagc

SEQ ID NO: 5972181 - DNA, 17 bp, Homo sapiens
cagtggaaggacactct

SEQ ID NO: 5972182 - DNA, 23 bp, Homo sapiens
cagtggaagttcttcaagaggaa

SEQ ID NO: 5972183 - DNA, 21 bp, Homo sapiens
cagtggaagtttttttttcct

SEQ ID NO: 5972184 - DNA, 15 bp, Homo sapiens
cagtggaatagatgt

SEQ ID NO: 5972185 - DNA, 20 bp, Homo sapiens
cagtggaattgtacaagagt

SEQ ID NO: 5972186 - DNA, 20 bp, Homo sapiens
cagtggacactcagaccagc

SEQ ID NO: 5972187 - DNA, 12 bp, Homo sapiens
cagtggacagag

SEQ ID NO: 5972188 - DNA, 20 bp, Homo sapiens
cagtggacatcgtaggcagc

SEQ ID NO: 5972189 - DNA, 23 bp, Homo sapiens
cagtggacatttgttctgggtta

SEQ ID NO: 5972190 - DNA, 18 bp, Homo sapiens
cagtggacctagcctgga

SEQ ID NO: 5972191 - DNA, 19 bp, Homo sapiens
cagtggacctagcctggat

SEQ ID NO: 5972192 - DNA, 13 bp, Homo sapiens
cagtggacggaga

SEQ ID NO: 5972193 - DNA, 14 bp, Homo sapiens
cagtggacgtgctg

SEQ ID NO: 5972194 - DNA, 19 bp, Homo sapiens
cagtggactcagcagtgac

SEQ ID NO: 5972195 - DNA, 14 bp, Homo sapiens
cagtggactctgag

SEQ ID NO: 5972196 - DNA, 15 bp, Homo sapiens
cagtggactgtgtcc

SEQ ID NO: 5972197 - DNA, 19 bp, Homo sapiens
cagtggactttccaccccc

SEQ ID NO: 5972198 - DNA, 21 bp, Homo sapiens
cagtggactttccaccccctc

SEQ ID NO: 5972199 - DNA, 17 bp, Homo sapiens
cagtggagaaatattta

SEQ ID NO: 5972200 - DNA, 14 bp, Homo sapiens
cagtggagaattat

SEQ ID NO: 5972201 - DNA, 14 bp, Homo sapiens
cagtggagagggct

SEQ ID NO: 5972202 - DNA, 13 bp, Homo sapiens
cagtggagagggg

SEQ ID NO: 5972203 - DNA, 17 bp, Homo sapiens
cagtggagaggggactt

SEQ ID NO: 5972204 - DNA, 18 bp, Homo sapiens
cagtggagaggggacttg

SEQ ID NO: 5972205 - DNA, 19 bp, Homo sapiens
cagtggagaggggacttgg

SEQ ID NO: 5972206 - DNA, 16 bp, Homo sapiens
cagtggagagtgttcc

SEQ ID NO: 5972207 - DNA, 13 bp, Homo sapiens
cagtggagcagaa

SEQ ID NO: 5972208 - DNA, 16 bp, Homo sapiens
cagtggagcctgggtg

SEQ ID NO: 5972209 - DNA, 21 bp, Homo sapiens
cagtggagctgaattttctgg

SEQ ID NO: 5972210 - DNA, 23 bp, Homo sapiens
cagtggagctgaattttctggaa

SEQ ID NO: 5972211 - DNA, 20 bp, Homo sapiens
cagtggaggaagagggacag

SEQ ID NO: 5972212 - DNA, 16 bp, Homo sapiens
cagtggaggctgctgt

SEQ ID NO: 5972213 - DNA, 17 bp, Homo sapiens
cagtggaggctgctgtg

SEQ ID NO: 5972214 - DNA, 17 bp, Homo sapiens
cagtggagggagactga

SEQ ID NO: 5972215 - DNA, 18 bp, Homo sapiens
cagtggagggggcaagct

SEQ ID NO: 5972216 - DNA, 22 bp, Homo sapiens
cagtggagggggcaagctttgc

SEQ ID NO: 5972217 - DNA, 15 bp, Homo sapiens
cagtggaggtgctgc

SEQ ID NO: 5972218 - DNA, 18 bp, Homo sapiens
cagtggagtccagatggc

SEQ ID NO: 5972219 - DNA, 14 bp, Homo sapiens
cagtggagtgagat

SEQ ID NO: 5972220 - DNA, 19 bp, Homo sapiens
cagtggagtgcaaaaggct

SEQ ID NO: 5972221 - DNA, 14 bp, Homo sapiens
cagtggatacgtgt

SEQ ID NO: 5972222 - DNA, 18 bp, Homo sapiens
cagtggatagttgatgag

SEQ ID NO: 5972223 - DNA, 16 bp, Homo sapiens
cagtggatatgaccca

SEQ ID NO: 5972224 - DNA, 23 bp, Homo sapiens
cagtggatcttcagaactgccct

SEQ ID NO: 5972225 - DNA, 19 bp, Homo sapiens
cagtggatgagggccacca

SEQ ID NO: 5972226 - DNA, 19 bp, Homo sapiens
cagtggatggattcatcat

SEQ ID NO: 5972227 - DNA, 13 bp, Homo sapiens
cagtggatttgga

SEQ ID NO: 5972228 - DNA, 15 bp, Homo sapiens
cagtggcaaaatatt

SEQ ID NO: 5972229 - DNA, 17 bp, Homo sapiens
cagtggcaaaggatcca

SEQ ID NO: 5972230 - DNA, 17 bp, Homo sapiens
cagtggcacaaaaaaat

SEQ ID NO: 5972231 - DNA, 23 bp, Homo sapiens
cagtggcacaaaaaaatatcaga

SEQ ID NO: 5972232 - DNA, 20 bp, Homo sapiens
cagtggcacaatcatggctc

SEQ ID NO: 5972233 - DNA, 16 bp, Homo sapiens
cagtggcacaatctcg

SEQ ID NO: 5972234 - DNA, 12 bp, Homo sapiens
cagtggcagaga

SEQ ID NO: 5972235 - DNA, 14 bp, Homo sapiens
cagtggcagcaaag

SEQ ID NO: 5972236 - DNA, 18 bp, Homo sapiens
cagtggcagcaaaggaag

SEQ ID NO: 5972237 - DNA, 22 bp, Homo sapiens
cagtggcagcaacaaaggattt

SEQ ID NO: 5972238 - DNA, 13 bp, Homo sapiens
cagtggcagctgc

SEQ ID NO: 5972239 - DNA, 15 bp, Homo sapiens
cagtggcaggaccct

SEQ ID NO: 5972240 - DNA, 13 bp, Homo sapiens
cagtggcaggcag

SEQ ID NO: 5972241 - DNA, 20 bp, Homo sapiens
cagtggcagggcacagggcc

SEQ ID NO: 5972242 - DNA, 18 bp, Homo sapiens
cagtggcaggggagcagg

SEQ ID NO: 5972243 - DNA, 23 bp, Homo sapiens
cagtggcatgtccacgtgtgtgt

SEQ ID NO: 5972244 - DNA, 12 bp, Homo sapiens
cagtggccaagc

SEQ ID NO: 5972245 - DNA, 14 bp, Homo sapiens
cagtggccaagcct

SEQ ID NO: 5972246 - DNA, 18 bp, Homo sapiens
cagtggccaagcctgctg

SEQ ID NO: 5972247 - DNA, 14 bp, Homo sapiens
cagtggccacggcc

SEQ ID NO: 5972248 - DNA, 14 bp, Homo sapiens
cagtggccactcag

SEQ ID NO: 5972249 - DNA, 18 bp, Homo sapiens
cagtggccccatccagca

SEQ ID NO: 5972250 - DNA, 15 bp, Homo sapiens
cagtggcccccactc

SEQ ID NO: 5972251 - DNA, 22 bp, Homo sapiens
cagtggcccccactcacaggga

SEQ ID NO: 5972252 - DNA, 18 bp, Homo sapiens
cagtggcccccgggcctg

SEQ ID NO: 5972253 - DNA, 19 bp, Homo sapiens
cagtggccgaaccccccac

SEQ ID NO: 5972254 - DNA, 23 bp, Homo sapiens
cagtggccgcaagcgcagggagg

SEQ ID NO: 5972255 - DNA, 15 bp, Homo sapiens
cagtggccggggctg

SEQ ID NO: 5972256 - DNA, 20 bp, Homo sapiens
cagtggccggggctgaagcc

SEQ ID NO: 5972257 - DNA, 20 bp, Homo sapiens
cagtggcctcaaccctccct

SEQ ID NO: 5972258 - DNA, 23 bp, Homo sapiens
cagtggcctcttgagttcctctg

SEQ ID NO: 5972259 - DNA, 17 bp, Homo sapiens
cagtggcctggatgcac

SEQ ID NO: 5972260 - DNA, 22 bp, Homo sapiens
cagtggcctggccgttcagcct

SEQ ID NO: 5972261 - DNA, 14 bp, Homo sapiens
cagtggcctggctc

SEQ ID NO: 5972262 - DNA, 14 bp, Homo sapiens
cagtggcctggctt

SEQ ID NO: 5972263 - DNA, 19 bp, Homo sapiens
cagtggccttacccctgcc

SEQ ID NO: 5972264 - DNA, 21 bp, Homo sapiens
cagtggccttacccctgcctt

SEQ ID NO: 5972265 - DNA, 20 bp, Homo sapiens
cagtggccttgcttcttaga

SEQ ID NO: 5972266 - DNA, 20 bp, Homo sapiens
cagtggcctttttctgagat

SEQ ID NO: 5972267 - DNA, 20 bp, Homo sapiens
cagtggcgaaatccctgctc

SEQ ID NO: 5972268 - DNA, 18 bp, Homo sapiens
cagtggcgcaatctcagc

SEQ ID NO: 5972269 - DNA, 19 bp, Homo sapiens
cagtggcgtgatctcggct

SEQ ID NO: 5972270 - DNA, 15 bp, Homo sapiens
cagtggcgtgatctt

SEQ ID NO: 5972271 - DNA, 21 bp, Homo sapiens
cagtggcgtgatcttggctca

SEQ ID NO: 5972272 - DNA, 21 bp, Homo sapiens
cagtggctagtggggtgaaca

SEQ ID NO: 5972273 - DNA, 13 bp, Homo sapiens
cagtggctcaatg

SEQ ID NO: 5972274 - DNA, 20 bp, Homo sapiens
cagtggctcacgcctatgat

SEQ ID NO: 5972275 - DNA, 19 bp, Homo sapiens
cagtggctcacgcctgtaa

SEQ ID NO: 5972276 - DNA, 17 bp, Homo sapiens
cagtggctcataaaaat

SEQ ID NO: 5972277 - DNA, 18 bp, Homo sapiens
cagtggctcccctgccca

SEQ ID NO: 5972278 - DNA, 13 bp, Homo sapiens
cagtggctctttt

SEQ ID NO: 5972279 - DNA, 14 bp, Homo sapiens
cagtggctgctctg

SEQ ID NO: 5972280 - DNA, 20 bp, Homo sapiens
cagtggctgctctgggaagg

SEQ ID NO: 5972281 - DNA, 22 bp, Homo sapiens
cagtggctggaattaaaacaaa

SEQ ID NO: 5972282 - DNA, 21 bp, Homo sapiens
cagtggctgggggactgcttt

SEQ ID NO: 5972283 - DNA, 14 bp, Homo sapiens
cagtggctgggtgg

SEQ ID NO: 5972284 - DNA, 22 bp, Homo sapiens
cagtggctgggtgggcccagaa

SEQ ID NO: 5972285 - DNA, 18 bp, Homo sapiens
cagtggctggtccagggc

SEQ ID NO: 5972286 - DNA, 19 bp, Homo sapiens
cagtggctggtccagggct

SEQ ID NO: 5972287 - DNA, 18 bp, Homo sapiens
cagtggctggtgcccatg

SEQ ID NO: 5972288 - DNA, 19 bp, Homo sapiens
cagtggctggtgcccatga

SEQ ID NO: 5972289 - DNA, 18 bp, Homo sapiens
cagtggctggtttctgag

SEQ ID NO: 5972290 - DNA, 20 bp, Homo sapiens
cagtggcttatgcctataat

SEQ ID NO: 5972291 - DNA, 21 bp, Homo sapiens
cagtggcttcatctgtcaagt

SEQ ID NO: 5972292 - DNA, 11 bp, Homo sapiens
cagtggcttcc

SEQ ID NO: 5972293 - DNA, 11 bp, Homo sapiens
cagtggcttct

SEQ ID NO: 5972294 - DNA, 14 bp, Homo sapiens
cagtggcttctcca

SEQ ID NO: 5972295 - DNA, 16 bp, Homo sapiens
cagtggcttctcccaa

SEQ ID NO: 5972296 - DNA, 14 bp, Homo sapiens
cagtggctttgcat

SEQ ID NO: 5972297 - DNA, 14 bp, Homo sapiens
cagtggcttttcat

SEQ ID NO: 5972298 - DNA, 23 bp, Homo sapiens
cagtggcttttgccccagaaagg

SEQ ID NO: 5972299 - DNA, 20 bp, Homo sapiens
cagtgggaacgtgactgccc

SEQ ID NO: 5972300 - DNA, 22 bp, Homo sapiens
cagtgggaacgtgactgcccca

SEQ ID NO: 5972301 - DNA, 22 bp, Homo sapiens
cagtgggaactctgacaagggc

SEQ ID NO: 5972302 - DNA, 15 bp, Homo sapiens
cagtgggaactggag

SEQ ID NO: 5972303 - DNA, 15 bp, Homo sapiens
cagtgggaactgtgc

SEQ ID NO: 5972304 - DNA, 16 bp, Homo sapiens
cagtgggaactgtgca

SEQ ID NO: 5972305 - DNA, 20 bp, Homo sapiens
cagtgggaatgcagtgggtg

SEQ ID NO: 5972306 - DNA, 16 bp, Homo sapiens
cagtgggacagggcat

SEQ ID NO: 5972307 - DNA, 18 bp, Homo sapiens
cagtgggaccacatgcca

SEQ ID NO: 5972308 - DNA, 19 bp, Homo sapiens
cagtgggaccacatgccac

SEQ ID NO: 5972309 - DNA, 16 bp, Homo sapiens
cagtgggactgtggtg

SEQ ID NO: 5972310 - DNA, 16 bp, Homo sapiens
cagtgggagactaaga

SEQ ID NO: 5972311 - DNA, 15 bp, Homo sapiens
cagtgggagatgtta

SEQ ID NO: 5972312 - DNA, 22 bp, Homo sapiens
cagtgggagcaaactgcatgcc

SEQ ID NO: 5972313 - DNA, 17 bp, Homo sapiens
cagtgggagccagggct

SEQ ID NO: 5972314 - DNA, 14 bp, Homo sapiens
cagtgggagccctg

SEQ ID NO: 5972315 - DNA, 17 bp, Homo sapiens
cagtgggagctgagctg

SEQ ID NO: 5972316 - DNA, 16 bp, Homo sapiens
cagtgggaggcaaatg

SEQ ID NO: 5972317 - DNA, 12 bp, Homo sapiens
cagtgggaggcg

SEQ ID NO: 5972318 - DNA, 15 bp, Homo sapiens
cagtgggaggggcag

SEQ ID NO: 5972319 - DNA, 12 bp, Homo sapiens
cagtgggatctt

SEQ ID NO: 5972320 - DNA, 22 bp, Homo sapiens
cagtgggatcttacccacttcc

SEQ ID NO: 5972321 - DNA, 21 bp, Homo sapiens
cagtgggatgaaccagccggg

SEQ ID NO: 5972322 - DNA, 15 bp, Homo sapiens
cagtgggatgggaca

SEQ ID NO: 5972323 - DNA, 17 bp, Homo sapiens
cagtgggatgggacagg

SEQ ID NO: 5972324 - DNA, 18 bp, Homo sapiens
cagtgggcaggaggcccc

SEQ ID NO: 5972325 - DNA, 13 bp, Homo sapiens
cagtgggcagggg

SEQ ID NO: 5972326 - DNA, 20 bp, Homo sapiens
cagtgggcatagtcagtgtc

SEQ ID NO: 5972327 - DNA, 14 bp, Homo sapiens
cagtgggccctggc

SEQ ID NO: 5972328 - DNA, 15 bp, Homo sapiens
cagtgggccctggct

SEQ ID NO: 5972329 - DNA, 16 bp, Homo sapiens
cagtgggccctggctc

SEQ ID NO: 5972330 - DNA, 17 bp, Homo sapiens
cagtgggccggccccag

SEQ ID NO: 5972331 - DNA, 23 bp, Homo sapiens
cagtgggccggccccaggctccc

SEQ ID NO: 5972332 - DNA, 12 bp, Homo sapiens
cagtgggcctgc

SEQ ID NO: 5972333 - DNA, 18 bp, Homo sapiens
cagtgggcctgctgaggc

SEQ ID NO: 5972334 - DNA, 22 bp, Homo sapiens
cagtgggcctgctgaggccttc

SEQ ID NO: 5972335 - DNA, 23 bp, Homo sapiens
cagtgggcctgctgaggccttct

SEQ ID NO: 5972336 - DNA, 18 bp, Homo sapiens
cagtgggcctgtgtgtgt

SEQ ID NO: 5972337 - DNA, 14 bp, Homo sapiens
cagtgggcgggcca

SEQ ID NO: 5972338 - DNA, 19 bp, Homo sapiens
cagtgggcgggccatgagg

SEQ ID NO: 5972339 - DNA, 21 bp, Homo sapiens
cagtgggctgatgctgggacc

SEQ ID NO: 5972340 - DNA, 20 bp, Homo sapiens
cagtgggctgcacgctcccc

SEQ ID NO: 5972341 - DNA, 19 bp, Homo sapiens
cagtgggctgtttctgctt

SEQ ID NO: 5972342 - DNA, 22 bp, Homo sapiens
cagtgggctgtttctgcttatt

SEQ ID NO: 5972343 - DNA, 18 bp, Homo sapiens
cagtggggaacaggtccc

SEQ ID NO: 5972344 - DNA, 18 bp, Homo sapiens
cagtggggacccctcgca

SEQ ID NO: 5972345 - DNA, 20 bp, Homo sapiens
cagtggggaggggctgtggg

SEQ ID NO: 5972346 - DNA, 13 bp, Homo sapiens
cagtggggcagag

SEQ ID NO: 5972347 - DNA, 21 bp, Homo sapiens
cagtggggcagaggcagtacc

SEQ ID NO: 5972348 - DNA, 20 bp, Homo sapiens
cagtggggcccatggcccca

SEQ ID NO: 5972349 - DNA, 23 bp, Homo sapiens
cagtggggcccatggccccagct

SEQ ID NO: 5972350 - DNA, 17 bp, Homo sapiens
cagtggggccccaaagc

SEQ ID NO: 5972351 - DNA, 17 bp, Homo sapiens
cagttatatgatattct

SEQ ID NO: 5972352 - DNA, 15 bp, Homo sapiens
cagttatattcttta

SEQ ID NO: 5972353 - DNA, 16 bp, Homo sapiens
cagttatattctttaa

SEQ ID NO: 5972354 - DNA, 15 bp, Homo sapiens
cagttatattttgca

SEQ ID NO: 5972355 - DNA, 22 bp, Homo sapiens
cagttatatttttgtgttttct

SEQ ID NO: 5972356 - DNA, 14 bp, Homo sapiens
cagttatcaaaaag

SEQ ID NO: 5972357 - DNA, 22 bp, Homo sapiens
cagttatctaagttaatttaaa

SEQ ID NO: 5972358 - DNA, 15 bp, Homo sapiens
cagttatcttagctg

SEQ ID NO: 5972359 - DNA, 21 bp, Homo sapiens
cagttatctttagcagatatt

SEQ ID NO: 5972360 - DNA, 13 bp, Homo sapiens
cagttatggctat

SEQ ID NO: 5972361 - DNA, 17 bp, Homo sapiens
cagttatggtgatgact

SEQ ID NO: 5972362 - DNA, 20 bp, Homo sapiens
cagttatgtgaatgatctct

SEQ ID NO: 5972363 - DNA, 21 bp, Homo sapiens
cagttatgtgacctcacgtgc

SEQ ID NO: 5972364 - DNA, 16 bp, Homo sapiens
cagttatgttcagtca

SEQ ID NO: 5972365 - DNA, 18 bp, Homo sapiens
cagttatgtttgaatgaa

SEQ ID NO: 5972366 - DNA, 14 bp, Homo sapiens
cagttattaaatga

SEQ ID NO: 5972367 - DNA, 17 bp, Homo sapiens
cagttattagaacttag

SEQ ID NO: 5972368 - DNA, 13 bp, Homo sapiens
cagttattattct

SEQ ID NO: 5972369 - DNA, 19 bp, Homo sapiens
cagttattcagattgacaa

SEQ ID NO: 5972370 - DNA, 16 bp, Homo sapiens
cagttattcttaagta

SEQ ID NO: 5972371 - DNA, 18 bp, Homo sapiens
cagttattgggcttaaaa

SEQ ID NO: 5972372 - DNA, 21 bp, Homo sapiens
cagttattggtggaatcttta

SEQ ID NO: 5972373 - DNA, 17 bp, Homo sapiens
cagttattgtccctggc

SEQ ID NO: 5972374 - DNA, 23 bp, Homo sapiens
cagttattgtccctggcttcctt

SEQ ID NO: 5972375 - DNA, 12 bp, Homo sapiens
cagttatttctg

SEQ ID NO: 5972376 - DNA, 22 bp, Homo sapiens
cagttcaaagtcatgatgtttt

SEQ ID NO: 5972377 - DNA, 16 bp, Homo sapiens
cagttcaactttcaga

SEQ ID NO: 5972378 - DNA, 12 bp, Homo sapiens
cagttcaatcaa

SEQ ID NO: 5972379 - DNA, 23 bp, Homo sapiens
cagttcaatctcccgctgctgct

SEQ ID NO: 5972380 - DNA, 20 bp, Homo sapiens
cagttcacaaacagtaaagg

SEQ ID NO: 5972381 - DNA, 13 bp, Homo sapiens
cagttcacaccct

SEQ ID NO: 5972382 - DNA, 15 bp, Homo sapiens
cagttcacaccctgc

SEQ ID NO: 5972383 - DNA, 16 bp, Homo sapiens
cagttcacaccctgca

SEQ ID NO: 5972384 - DNA, 17 bp, Homo sapiens
cagttcacaccctgcaa

SEQ ID NO: 5972385 - DNA, 19 bp, Homo sapiens
cagttcacaccctgcaagg

SEQ ID NO: 5972386 - DNA, 22 bp, Homo sapiens
cagttcacctatttcaaaaatt

SEQ ID NO: 5972387 - DNA, 23 bp, Homo sapiens
cagttcacttcctagagcatctg

SEQ ID NO: 5972388 - DNA, 22 bp, Homo sapiens
cagttcagaatggcagtcctgg

SEQ ID NO: 5972389 - DNA, 17 bp, Homo sapiens
cagttcagacactaccc

SEQ ID NO: 5972390 - DNA, 17 bp, Homo sapiens
cagttcagagctgccct

SEQ ID NO: 5972391 - DNA, 18 bp, Homo sapiens
cagttcagagctgccctc

SEQ ID NO: 5972392 - DNA, 16 bp, Homo sapiens
cagttcagcaccaccc

SEQ ID NO: 5972393 - DNA, 17 bp, Homo sapiens
cagttcagcaccaccct

SEQ ID NO: 5972394 - DNA, 23 bp, Homo sapiens
cagttcagtaataaactgtgttt

SEQ ID NO: 5972395 - DNA, 18 bp, Homo sapiens
cagttcagtacctggagg

SEQ ID NO: 5972396 - DNA, 21 bp, Homo sapiens
cagttcagtggcagggctcag

SEQ ID NO: 5972397 - DNA, 22 bp, Homo sapiens
cagttcagtggcagggctcagg

SEQ ID NO: 5972398 - DNA, 23 bp, Homo sapiens
cagttcagtggcagggctcagga

SEQ ID NO: 5972399 - DNA, 13 bp, Homo sapiens
cagttcataatat

SEQ ID NO: 5972400 - DNA, 15 bp, Homo sapiens
cagttcatatgcaga

SEQ ID NO: 5972401 - DNA, 23 bp, Homo sapiens
cagttcatcaccatttcctcctt

SEQ ID NO: 5972402 - DNA, 16 bp, Homo sapiens
cagttcatcgattttc

SEQ ID NO: 5972403 - DNA, 19 bp, Homo sapiens
cagttcatcgattttctat

SEQ ID NO: 5972404 - DNA, 18 bp, Homo sapiens
cagttcattattttgtgg

SEQ ID NO: 5972405 - DNA, 17 bp, Homo sapiens
cagttcattcccagaag

SEQ ID NO: 5972406 - DNA, 19 bp, Homo sapiens
cagttcattcgctttgtct

SEQ ID NO: 5972407 - DNA, 19 bp, Homo sapiens
cagttccaaagtcacagga

SEQ ID NO: 5972408 - DNA, 23 bp, Homo sapiens
cagttccaatcagtagcttaaga

SEQ ID NO: 5972409 - DNA, 16 bp, Homo sapiens
cagttccaatgtgccc

SEQ ID NO: 5972410 - DNA, 21 bp, Homo sapiens
cagttccaatgtgcccagtca

SEQ ID NO: 5972411 - DNA, 21 bp, Homo sapiens
cagttccacggttgctaaatt

SEQ ID NO: 5972412 - DNA, 22 bp, Homo sapiens
cagttccacggttgctaaatta

SEQ ID NO: 5972413 - DNA, 15 bp, Homo sapiens
cagttcccagagtgg

SEQ ID NO: 5972414 - DNA, 14 bp, Homo sapiens
cagttcccagctcc

SEQ ID NO: 5972415 - DNA, 15 bp, Homo sapiens
cagttcccagctccc

SEQ ID NO: 5972416 - DNA, 20 bp, Homo sapiens
cagttcccatggtgtatgtg

SEQ ID NO: 5972417 - DNA, 21 bp, Homo sapiens
cagttcccatggtgtatgtgg

SEQ ID NO: 5972418 - DNA, 18 bp, Homo sapiens
cagttcccccaacctcag

SEQ ID NO: 5972419 - DNA, 21 bp, Homo sapiens
cagttcccctggaagcagtgc

SEQ ID NO: 5972420 - DNA, 19 bp, Homo sapiens
cagttcccgctctgcattg

SEQ ID NO: 5972421 - DNA, 21 bp, Homo sapiens
cagttcccggagcacagccct

SEQ ID NO: 5972422 - DNA, 17 bp, Homo sapiens
cagttccctcagccctc

SEQ ID NO: 5972423 - DNA, 21 bp, Homo sapiens
cagttccctcagccctcatta

SEQ ID NO: 5972424 - DNA, 12 bp, Homo sapiens
cagttccctccc

SEQ ID NO: 5972425 - DNA, 12 bp, Homo sapiens
cagttccctcct

SEQ ID NO: 5972426 - DNA, 13 bp, Homo sapiens
cagttccctcctg

SEQ ID NO: 5972427 - DNA, 20 bp, Homo sapiens
cagttccggattggcttgtg

SEQ ID NO: 5972428 - DNA, 22 bp, Homo sapiens
cagttccggattggcttgtgtg

SEQ ID NO: 5972429 - DNA, 23 bp, Homo sapiens
cagttccgggagagcggctgccc

SEQ ID NO: 5972430 - DNA, 17 bp, Homo sapiens
cagttcctatgacacag

SEQ ID NO: 5972431 - DNA, 20 bp, Homo sapiens
cagttcctcaccatcatcat

SEQ ID NO: 5972432 - DNA, 22 bp, Homo sapiens
cagttcctcccaggaagcccag

SEQ ID NO: 5972433 - DNA, 18 bp, Homo sapiens
cagttcctcgccctgggt

SEQ ID NO: 5972434 - DNA, 23 bp, Homo sapiens
cagttcctctttgcatggaattt

SEQ ID NO: 5972435 - DNA, 19 bp, Homo sapiens
cagttcctgcagcagagcc

SEQ ID NO: 5972436 - DNA, 11 bp, Homo sapiens
cagttcctgct

SEQ ID NO: 5972437 - DNA, 14 bp, Homo sapiens
cagttcctgctctc

SEQ ID NO: 5972438 - DNA, 18 bp, Homo sapiens
cagttcctgctctctgct

SEQ ID NO: 5972439 - DNA, 14 bp, Homo sapiens
cagttcctggccca

SEQ ID NO: 5972440 - DNA, 21 bp, Homo sapiens
cagttcctggcccatcaactg

SEQ ID NO: 5972441 - DNA, 18 bp, Homo sapiens
cagttcctgtcccacatg

SEQ ID NO: 5972442 - DNA, 21 bp, Homo sapiens
cagttcgactctgtgctggcc

SEQ ID NO: 5972443 - DNA, 13 bp, Homo sapiens
cagttcgcagcca

SEQ ID NO: 5972444 - DNA, 16 bp, Homo sapiens
cagttcgcagccaccc

SEQ ID NO: 5972445 - DNA, 22 bp, Homo sapiens
cagttcggtgagctacaaatgc

SEQ ID NO: 5972446 - DNA, 18 bp, Homo sapiens
cagttctaacctcctaag

SEQ ID NO: 5972447 - DNA, 21 bp, Homo sapiens
cagttctacaagcatatttga

SEQ ID NO: 5972448 - DNA, 17 bp, Homo sapiens
cagttctacagaaaaac

SEQ ID NO: 5972449 - DNA, 11 bp, Homo sapiens
cagttctagga

SEQ ID NO: 5972450 - DNA, 11 bp, Homo sapiens
cagttctaggc

SEQ ID NO: 5972451 - DNA, 14 bp, Homo sapiens
cagttctaggcctt

SEQ ID NO: 5972452 - DNA, 15 bp, Homo sapiens
cagttctaggccttt

SEQ ID NO: 5972453 - DNA, 22 bp, Homo sapiens
cagttctaggcctttcctctgc

SEQ ID NO: 5972454 - DNA, 17 bp, Homo sapiens
cagttctagtctctctg

SEQ ID NO: 5972455 - DNA, 17 bp, Homo sapiens
cagttctatttaaaatg

SEQ ID NO: 5972456 - DNA, 14 bp, Homo sapiens
cagttctcaaatgt

SEQ ID NO: 5972457 - DNA, 18 bp, Homo sapiens
cagttctcacaatgttgc

SEQ ID NO: 5972458 - DNA, 16 bp, Homo sapiens
cagttctcactcctag

SEQ ID NO: 5972459 - DNA, 17 bp, Homo sapiens
cagttctcactcctagg

SEQ ID NO: 5972460 - DNA, 14 bp, Homo sapiens
cagttctcatcttg

SEQ ID NO: 5972461 - DNA, 13 bp, Homo sapiens
cagttctcccagg

SEQ ID NO: 5972462 - DNA, 23 bp, Homo sapiens
cagttctcccagggagtgagcag

SEQ ID NO: 5972463 - DNA, 16 bp, Homo sapiens
cagttctcgtgccctt

SEQ ID NO: 5972464 - DNA, 23 bp, Homo sapiens
cagttctctactccctcttgtca

SEQ ID NO: 5972465 - DNA, 15 bp, Homo sapiens
cagttctctccttct

SEQ ID NO: 5972466 - DNA, 22 bp, Homo sapiens
cagttctctccttcttcccccc

SEQ ID NO: 5972467 - DNA, 14 bp, Homo sapiens
cagttctctgccaa

SEQ ID NO: 5972468 - DNA, 11 bp, Homo sapiens
cagttctctgt

SEQ ID NO: 5972469 - DNA, 21 bp, Homo sapiens
cagttctctgtggaagcaagg

SEQ ID NO: 5972470 - DNA, 16 bp, Homo sapiens
cagttctcttgctttc

SEQ ID NO: 5972471 - DNA, 16 bp, Homo sapiens
cagttctgaactggaa

SEQ ID NO: 5972472 - DNA, 14 bp, Homo sapiens
cagttctgaagaag

SEQ ID NO: 5972473 - DNA, 16 bp, Homo sapiens
cagttctgaagaagat

SEQ ID NO: 5972474 - DNA, 14 bp, Homo sapiens
cagttctgaagaat

SEQ ID NO: 5972475 - DNA, 21 bp, Homo sapiens
cagttctgaatatgctgctca

SEQ ID NO: 5972476 - DNA, 20 bp, Homo sapiens
cagttctgacgctgacaata

SEQ ID NO: 5972477 - DNA, 17 bp, Homo sapiens
cagttctgagctgtaat

SEQ ID NO: 5972478 - DNA, 19 bp, Homo sapiens
cagttctgattcatttgaa

SEQ ID NO: 5972479 - DNA, 12 bp, Homo sapiens
cagttctgcaaa

SEQ ID NO: 5972480 - DNA, 13 bp, Homo sapiens
cagttctgcaaat

SEQ ID NO: 5972481 - DNA, 12 bp, Homo sapiens
cagttctgcacc

SEQ ID NO: 5972482 - DNA, 18 bp, Homo sapiens
cagttctgcactcttgta

SEQ ID NO: 5972483 - DNA, 13 bp, Homo sapiens
cagttctgcagct

SEQ ID NO: 5972484 - DNA, 15 bp, Homo sapiens
cagttctgctcctct

SEQ ID NO: 5972485 - DNA, 20 bp, Homo sapiens
cagttctgctcctctccagg

SEQ ID NO: 5972486 - DNA, 16 bp, Homo sapiens
cagttctgcttgctcc

SEQ ID NO: 5972487 - DNA, 19 bp, Homo sapiens
cagttctgcttgctcccaa

SEQ ID NO: 5972488 - DNA, 20 bp, Homo sapiens
cagttctgcttgctcccaag

SEQ ID NO: 5972489 - DNA, 13 bp, Homo sapiens
cagttctggagga

SEQ ID NO: 5972490 - DNA, 17 bp, Homo sapiens
cagttctggaggaggag

SEQ ID NO: 5972491 - DNA, 13 bp, Homo sapiens
cagttctgggcaa

SEQ ID NO: 5972492 - DNA, 18 bp, Homo sapiens
cagttctgggcaaagagg

SEQ ID NO: 5972493 - DNA, 23 bp, Homo sapiens
cagttctggggcccgcctgccac

SEQ ID NO: 5972494 - DNA, 22 bp, Homo sapiens
cagttctgtccttggcaacttt

SEQ ID NO: 5972495 - DNA, 23 bp, Homo sapiens
cagttctgtgatctgggtctcta

SEQ ID NO: 5972496 - DNA, 20 bp, Homo sapiens
cagttctgtgtacattttaa

SEQ ID NO: 5972497 - DNA, 13 bp, Homo sapiens
cagttctgtgtcc

SEQ ID NO: 5972498 - DNA, 15 bp, Homo sapiens
cagttctgtgtcctc

SEQ ID NO: 5972499 - DNA, 21 bp, Homo sapiens
cagttctgtgtcctcgcactg

SEQ ID NO: 5972500 - DNA, 22 bp, Homo sapiens
cagttctgtgtggtgcattcct

SEQ ID NO: 5972501 - DNA, 22 bp, Homo sapiens
cagttctgttggtctacagaaa

SEQ ID NO: 5972502 - DNA, 14 bp, Homo sapiens
cagttcttaagact

SEQ ID NO: 5972503 - DNA, 19 bp, Homo sapiens
cagttcttcatttggagga

SEQ ID NO: 5972504 - DNA, 19 bp, Homo sapiens
cagttcttcgactgttgtt

SEQ ID NO: 5972505 - DNA, 14 bp, Homo sapiens
cagttcttgagttg

SEQ ID NO: 5972506 - DNA, 20 bp, Homo sapiens
cagttcttgcaataagatat

SEQ ID NO: 5972507 - DNA, 15 bp, Homo sapiens
cagttcttggacccc

SEQ ID NO: 5972508 - DNA, 14 bp, Homo sapiens
cagttcttggcctg

SEQ ID NO: 5972509 - DNA, 17 bp, Homo sapiens
cagttcttggcctgcta

SEQ ID NO: 5972510 - DNA, 19 bp, Homo sapiens
cagttcttggtgctctgtg

SEQ ID NO: 5972511 - DNA, 16 bp, Homo sapiens
cagttcttgtggaaga

SEQ ID NO: 5972512 - DNA, 13 bp, Homo sapiens
cagttctttcctc

SEQ ID NO: 5972513 - DNA, 20 bp, Homo sapiens
cagttctttcctctttctgc

SEQ ID NO: 5972514 - DNA, 21 bp, Homo sapiens
cagttctttcctctttctgct

SEQ ID NO: 5972515 - DNA, 14 bp, Homo sapiens
cagttctttctttt

SEQ ID NO: 5972516 - DNA, 16 bp, Homo sapiens
cagttctttgggccag

SEQ ID NO: 5972517 - DNA, 17 bp, Homo sapiens
cagttctttgggccaga

SEQ ID NO: 5972518 - DNA, 20 bp, Homo sapiens
cagttcttttgttgtaaaga

SEQ ID NO: 5972519 - DNA, 15 bp, Homo sapiens
cagttctttttgtac

SEQ ID NO: 5972520 - DNA, 12 bp, Homo sapiens
cagttgaaaaac

SEQ ID NO: 5972521 - DNA, 19 bp, Homo sapiens
cagttgaaaaacagctgag

SEQ ID NO: 5972522 - DNA, 22 bp, Homo sapiens
cagttgaaaagactccaaagaa

SEQ ID NO: 5972523 - DNA, 19 bp, Homo sapiens
cagttgaacactagtctgt

SEQ ID NO: 5972524 - DNA, 17 bp, Homo sapiens
cagttgaacagagctag

SEQ ID NO: 5972525 - DNA, 10 bp, Homo sapiens
cagttgaact

SEQ ID NO: 5972526 - DNA, 14 bp, Homo sapiens
cagttgaagaaaaa

SEQ ID NO: 5972527 - DNA, 21 bp, Homo sapiens
cagttgaagaaaaaatggcaa

SEQ ID NO: 5972528 - DNA, 17 bp, Homo sapiens
ctaaatcttccttgtga

SEQ ID NO: 5972529 - DNA, 19 bp, Homo sapiens
ctaaatcttccttgtgagg

SEQ ID NO: 5972530 - DNA, 23 bp, Homo sapiens
ctaaatgaaaagagaattactta

SEQ ID NO: 5972531 - DNA, 11 bp, Homo sapiens
ctaaatgaagt

SEQ ID NO: 5972532 - DNA, 21 bp, Homo sapiens
ctaaatgaatctcgttcccaa

SEQ ID NO: 5972533 - DNA, 22 bp, Homo sapiens
ctaaatgaatgagccaaaatga

SEQ ID NO: 5972534 - DNA, 15 bp, Homo sapiens
ctaaatgaatgttta

SEQ ID NO: 5972535 - DNA, 21 bp, Homo sapiens
ctaaatgaccatccagtagag

SEQ ID NO: 5972536 - DNA, 16 bp, Homo sapiens
ctaaatgacctcagca

SEQ ID NO: 5972537 - DNA, 14 bp, Homo sapiens
ctaaatgacttatt

SEQ ID NO: 5972538 - DNA, 15 bp, Homo sapiens
ctaaatgagctcctg

SEQ ID NO: 5972539 - DNA, 16 bp, Homo sapiens
ctaaatgagctcctgc

SEQ ID NO: 5972540 - DNA, 19 bp, Homo sapiens
ctaaatgagtcactgagca

SEQ ID NO: 5972541 - DNA, 17 bp, Homo sapiens
ctaaatgcaaacactgt

SEQ ID NO: 5972542 - DNA, 20 bp, Homo sapiens
ctaaatgcaatttaaaatta

SEQ ID NO: 5972543 - DNA, 16 bp, Homo sapiens
ctaaatgcaccaagaa

SEQ ID NO: 5972544 - DNA, 16 bp, Homo sapiens
ctaaatgccatgttta

SEQ ID NO: 5972545 - DNA, 17 bp, Homo sapiens
ctaaatgcccagttcac

SEQ ID NO: 5972546 - DNA, 19 bp, Homo sapiens
ctaaatgcctaataaacaa

SEQ ID NO: 5972547 - DNA, 15 bp, Homo sapiens
ctaaatgctcataca

SEQ ID NO: 5972548 - DNA, 16 bp, Homo sapiens
ctaaatggaaccactc

SEQ ID NO: 5972549 - DNA, 18 bp, Homo sapiens
ctaaatggaaccactcta

SEQ ID NO: 5972550 - DNA, 17 bp, Homo sapiens
ctaaatggcctcatgtg

SEQ ID NO: 5972551 - DNA, 16 bp, Homo sapiens
ctaaatggctttaatt

SEQ ID NO: 5972552 - DNA, 20 bp, Homo sapiens
ctaaatggctttaattatat

SEQ ID NO: 5972553 - DNA, 23 bp, Homo sapiens
ctaaatggtatggccaaaagtca

SEQ ID NO: 5972554 - DNA, 18 bp, Homo sapiens
ctaaatggtcgcccagga

SEQ ID NO: 5972555 - DNA, 19 bp, Homo sapiens
ctaaatgtaacagtctgat

SEQ ID NO: 5972556 - DNA, 18 bp, Homo sapiens
ctaaatgtaagaatcatt

SEQ ID NO: 5972557 - DNA, 21 bp, Homo sapiens
ctaaatgtggagaaactgtag

SEQ ID NO: 5972558 - DNA, 11 bp, Homo sapiens
ctaaatgtgta

SEQ ID NO: 5972559 - DNA, 13 bp, Homo sapiens
ctaaatgtgtaat

SEQ ID NO: 5972560 - DNA, 13 bp, Homo sapiens
ctaaatgttaaag

SEQ ID NO: 5972561 - DNA, 14 bp, Homo sapiens
ctaaatgttaaaga

SEQ ID NO: 5972562 - DNA, 19 bp, Homo sapiens
ctaaatgttaaagatgtag

SEQ ID NO: 5972563 - DNA, 22 bp, Homo sapiens
ctaaatgttctatggttatgaa

SEQ ID NO: 5972564 - DNA, 16 bp, Homo sapiens
ctaaatgttgaaagat

SEQ ID NO: 5972565 - DNA, 16 bp, Homo sapiens
ctaaatgttggaatgt

SEQ ID NO: 5972566 - DNA, 21 bp, Homo sapiens
ctaaatgttggaattttcaaa

SEQ ID NO: 5972567 - DNA, 14 bp, Homo sapiens
ctaaatgtttcttt

SEQ ID NO: 5972568 - DNA, 13 bp, Homo sapiens
ctaaattaacaaa

SEQ ID NO: 5972569 - DNA, 15 bp, Homo sapiens
ctaaattaacctaaa

SEQ ID NO: 5972570 - DNA, 18 bp, Homo sapiens
ctaaattaagacagcatt

SEQ ID NO: 5972571 - DNA, 13 bp, Homo sapiens
ctaaattacaaag

SEQ ID NO: 5972572 - DNA, 19 bp, Homo sapiens
ctaaattacaattgtcatt

SEQ ID NO: 5972573 - DNA, 22 bp, Homo sapiens
ctaaattactgttttatgttga

SEQ ID NO: 5972574 - DNA, 15 bp, Homo sapiens
ctaaattagtttaaa

SEQ ID NO: 5972575 - DNA, 18 bp, Homo sapiens
ctaaattagtttaaaatg

SEQ ID NO: 5972576 - DNA, 19 bp, Homo sapiens
ctaaattagtttaaaatga

SEQ ID NO: 5972577 - DNA, 22 bp, Homo sapiens
ctaaattattagcatttgtttt

SEQ ID NO: 5972578 - DNA, 15 bp, Homo sapiens
ctaaattcagggaga

SEQ ID NO: 5972579 - DNA, 22 bp, Homo sapiens
ctaaattcccaaatcctagact

SEQ ID NO: 5972580 - DNA, 17 bp, Homo sapiens
ctaaattctactctaaa

SEQ ID NO: 5972581 - DNA, 15 bp, Homo sapiens
ctaaattctataaaa

SEQ ID NO: 5972582 - DNA, 14 bp, Homo sapiens
ctaaattctatgtt

SEQ ID NO: 5972583 - DNA, 16 bp, Homo sapiens
ctaaattctttcatga

SEQ ID NO: 5972584 - DNA, 17 bp, Homo sapiens
ctaaattgaaacctgga

SEQ ID NO: 5972585 - DNA, 14 bp, Homo sapiens
ctaaattgaataat

SEQ ID NO: 5972586 - DNA, 14 bp, Homo sapiens
ctaaattgatgttg

SEQ ID NO: 5972587 - DNA, 15 bp, Homo sapiens
ctaaattgatgttga

SEQ ID NO: 5972588 - DNA, 20 bp, Homo sapiens
ctaaattgattgaattaaat

SEQ ID NO: 5972589 - DNA, 16 bp, Homo sapiens
ctaaattgcagtttac

SEQ ID NO: 5972590 - DNA, 14 bp, Homo sapiens
ctaaattgtataca

SEQ ID NO: 5972591 - DNA, 17 bp, Homo sapiens
ctaaattgtatacattt

SEQ ID NO: 5972592 - DNA, 17 bp, Homo sapiens
ctaaatttaaatttaaa

SEQ ID NO: 5972593 - DNA, 18 bp, Homo sapiens
ctaaatttaatgctgcct

SEQ ID NO: 5972594 - DNA, 21 bp, Homo sapiens
ctaaatttacgtatatttcat

SEQ ID NO: 5972595 - DNA, 15 bp, Homo sapiens
ctaaatttcttccta

SEQ ID NO: 5972596 - DNA, 14 bp, Homo sapiens
ctaaatttcttttg

SEQ ID NO: 5972597 - DNA, 17 bp, Homo sapiens
ctaaatttcttttgcta

SEQ ID NO: 5972598 - DNA, 15 bp, Homo sapiens
ctaaatttgatactt

SEQ ID NO: 5972599 - DNA, 19 bp, Homo sapiens
ctaaatttgatacttatat

SEQ ID NO: 5972600 - DNA, 20 bp, Homo sapiens
ctaaatttgatacttatatt

SEQ ID NO: 5972601 - DNA, 15 bp, Homo sapiens
ctaaatttgcatgaa

SEQ ID NO: 5972602 - DNA, 14 bp, Homo sapiens
ctaaatttggaact

SEQ ID NO: 5972603 - DNA, 16 bp, Homo sapiens
ctaaattttaaagcca

SEQ ID NO: 5972604 - DNA, 18 bp, Homo sapiens
ctaaattttctaaataac

SEQ ID NO: 5972605 - DNA, 16 bp, Homo sapiens
ctaaattttctaatta

SEQ ID NO: 5972606 - DNA, 16 bp, Homo sapiens
ctaaattttctgaaac

SEQ ID NO: 5972607 - DNA, 16 bp, Homo sapiens
ctaaattttcttttaa

SEQ ID NO: 5972608 - DNA, 21 bp, Homo sapiens
ctaaattttcttttaagcatt

SEQ ID NO: 5972609 - DNA, 23 bp, Homo sapiens
ctaaattttcttttaagcatttg

SEQ ID NO: 5972610 - DNA, 18 bp, Homo sapiens
ctaaattttgttactgat

SEQ ID NO: 5972611 - DNA, 16 bp, Homo sapiens
ctaacaaaagatgaaa

SEQ ID NO: 5972612 - DNA, 17 bp, Homo sapiens
ctaacaaaagatgaaag

SEQ ID NO: 5972613 - DNA, 11 bp, Homo sapiens
ctaacaaaata

SEQ ID NO: 5972614 - DNA, 15 bp, Homo sapiens
ctaacaaaatcaagc

SEQ ID NO: 5972615 - DNA, 15 bp, Homo sapiens
ctaacaaaatttgaa

SEQ ID NO: 5972616 - DNA, 16 bp, Homo sapiens
ctaacaaaatttgaat

SEQ ID NO: 5972617 - DNA, 23 bp, Homo sapiens
ctaacaaacagattcttttatgt

SEQ ID NO: 5972618 - DNA, 16 bp, Homo sapiens
ctaacaaactgaaaaa

SEQ ID NO: 5972619 - DNA, 20 bp, Homo sapiens
ctaacaacattgtagcctca

SEQ ID NO: 5972620 - DNA, 16 bp, Homo sapiens
ctaacaaccaaagact

SEQ ID NO: 5972621 - DNA, 18 bp, Homo sapiens
ctaacaagaatgtaactc

SEQ ID NO: 5972622 - DNA, 16 bp, Homo sapiens
ctaacaagatttgtaa

SEQ ID NO: 5972623 - DNA, 13 bp, Homo sapiens
ctaacaataaagt

SEQ ID NO: 5972624 - DNA, 12 bp, Homo sapiens
ctaacaatatga

SEQ ID NO: 5972625 - DNA, 23 bp, Homo sapiens
ctaacaatgttttttatacttca

SEQ ID NO: 5972626 - DNA, 17 bp, Homo sapiens
ctaacacagcatgtgta

SEQ ID NO: 5972627 - DNA, 16 bp, Homo sapiens
ctaacacattaaatgt

SEQ ID NO: 5972628 - DNA, 17 bp, Homo sapiens
ctaacacattatcggga

SEQ ID NO: 5972629 - DNA, 15 bp, Homo sapiens
ctaacaccacactga

SEQ ID NO: 5972630 - DNA, 18 bp, Homo sapiens
ctaacaccacactgacca

SEQ ID NO: 5972631 - DNA, 19 bp, Homo sapiens
ctaacaccacactgaccac

SEQ ID NO: 5972632 - DNA, 23 bp, Homo sapiens
ctaacacggtgctcattttttct

SEQ ID NO: 5972633 - DNA, 18 bp, Homo sapiens
ctaacacgtgatgtgata

SEQ ID NO: 5972634 - DNA, 15 bp, Homo sapiens
ctaacactattttat

SEQ ID NO: 5972635 - DNA, 16 bp, Homo sapiens
ctaacactattttatg

SEQ ID NO: 5972636 - DNA, 20 bp, Homo sapiens
ctaacactcagaagcctggg

SEQ ID NO: 5972637 - DNA, 22 bp, Homo sapiens
ctaacactcagaagcctggggg

SEQ ID NO: 5972638 - DNA, 23 bp, Homo sapiens
ctaacactcagaagcctgggggc

SEQ ID NO: 5972639 - DNA, 11 bp, Homo sapiens
ctaacactggc

SEQ ID NO: 5972640 - DNA, 13 bp, Homo sapiens
ctaacactggccc

SEQ ID NO: 5972641 - DNA, 16 bp, Homo sapiens
ctaacactggccccta

SEQ ID NO: 5972642 - DNA, 16 bp, Homo sapiens
ctaacactgtcctgtc

SEQ ID NO: 5972643 - DNA, 14 bp, Homo sapiens
ctaacacttacccc

SEQ ID NO: 5972644 - DNA, 23 bp, Homo sapiens
ctaacactttagttatattcact

SEQ ID NO: 5972645 - DNA, 12 bp, Homo sapiens
ctaacagagact

SEQ ID NO: 5972646 - DNA, 18 bp, Homo sapiens
ctaacagattataataaa

SEQ ID NO: 5972647 - DNA, 20 bp, Homo sapiens
ctaacagattataataaatt

SEQ ID NO: 5972648 - DNA, 20 bp, Homo sapiens
ctaacagcaacacaaagctt

SEQ ID NO: 5972649 - DNA, 12 bp, Homo sapiens
ctaacagccctc

SEQ ID NO: 5972650 - DNA, 16 bp, Homo sapiens
ctaacagctgaagtaa

SEQ ID NO: 5972651 - DNA, 18 bp, Homo sapiens
ctaacaggagaaaggaca

SEQ ID NO: 5972652 - DNA, 12 bp, Homo sapiens
ctaacaggcact

SEQ ID NO: 5972653 - DNA, 15 bp, Homo sapiens
ctaacaggcactttg

SEQ ID NO: 5972654 - DNA, 18 bp, Homo sapiens
ctaacagggaaggcaggc

SEQ ID NO: 5972655 - DNA, 19 bp, Homo sapiens
ctaacagggagaagtagct

SEQ ID NO: 5972656 - DNA, 20 bp, Homo sapiens
ctaacaggggctggtgggca

SEQ ID NO: 5972657 - DNA, 14 bp, Homo sapiens
ctaacagtaactgc

SEQ ID NO: 5972658 - DNA, 15 bp, Homo sapiens
ctaacagtcaagaaa

SEQ ID NO: 5972659 - DNA, 15 bp, Homo sapiens
ctaacagtccttgct

SEQ ID NO: 5972660 - DNA, 16 bp, Homo sapiens
ctaacagtccttgctt

SEQ ID NO: 5972661 - DNA, 19 bp, Homo sapiens
ctaacagttcacttgcagt

SEQ ID NO: 5972662 - DNA, 20 bp, Homo sapiens
ctaacagttgccacatcaca

SEQ ID NO: 5972663 - DNA, 20 bp, Homo sapiens
ctaacataaagaaacacttt

SEQ ID NO: 5972664 - DNA, 16 bp, Homo sapiens
ctaacatagcacagta

SEQ ID NO: 5972665 - DNA, 13 bp, Homo sapiens
ctaacatatgtat

SEQ ID NO: 5972666 - DNA, 12 bp, Homo sapiens
ctaacatcagaa

SEQ ID NO: 5972667 - DNA, 15 bp, Homo sapiens
ctaacatcatgcatt

SEQ ID NO: 5972668 - DNA, 15 bp, Homo sapiens
ctaacatcccactta

SEQ ID NO: 5972669 - DNA, 18 bp, Homo sapiens
ctaacatcctgctttgat

SEQ ID NO: 5972670 - DNA, 22 bp, Homo sapiens
ctaacatccttggactgagaaa

SEQ ID NO: 5972671 - DNA, 14 bp, Homo sapiens
ctaacatctttacg

SEQ ID NO: 5972672 - DNA, 22 bp, Homo sapiens
ctaacatctttacgtactgtaa

SEQ ID NO: 5972673 - DNA, 20 bp, Homo sapiens
ctaacatgagtatcatcaga

SEQ ID NO: 5972674 - DNA, 15 bp, Homo sapiens
ctaacattatattgc

SEQ ID NO: 5972675 - DNA, 18 bp, Homo sapiens
ctaacattatattgcaat

SEQ ID NO: 5972676 - DNA, 20 bp, Homo sapiens
ctaacattatattgcaatga

SEQ ID NO: 5972677 - DNA, 15 bp, Homo sapiens
ctaacattatttatt

SEQ ID NO: 5972678 - DNA, 21 bp, Homo sapiens
ctaacatttttgataaagcct

SEQ ID NO: 5972679 - DNA, 21 bp, Homo sapiens
ctaaccaaaagacaccagcca

SEQ ID NO: 5972680 - DNA, 20 bp, Homo sapiens
ctaaccaaagagtctctggc

SEQ ID NO: 5972681 - DNA, 14 bp, Homo sapiens
ctaaccaaatgcat

SEQ ID NO: 5972682 - DNA, 15 bp, Homo sapiens
ctaaccaatgccttt

SEQ ID NO: 5972683 - DNA, 15 bp, Homo sapiens
ctaaccacacagcct

SEQ ID NO: 5972684 - DNA, 15 bp, Homo sapiens
ctaaccacagctcct

SEQ ID NO: 5972685 - DNA, 18 bp, Homo sapiens
ctaaccacattttaggat

SEQ ID NO: 5972686 - DNA, 14 bp, Homo sapiens
ctaaccacgctgga

SEQ ID NO: 5972687 - DNA, 13 bp, Homo sapiens
ctaaccaggccca

SEQ ID NO: 5972688 - DNA, 13 bp, Homo sapiens
ctaaccatcccca

SEQ ID NO: 5972689 - DNA, 12 bp, Homo sapiens
ctaaccatgggc

SEQ ID NO: 5972690 - DNA, 17 bp, Homo sapiens
ctaaccatgggctcagg

SEQ ID NO: 5972691 - DNA, 18 bp, Homo sapiens
ctaaccatgggctcaggg

SEQ ID NO: 5972692 - DNA, 19 bp, Homo sapiens
ctaaccatgggctcagggc

SEQ ID NO: 5972693 - DNA, 20 bp, Homo sapiens
ctaaccatgggctcagggcc

SEQ ID NO: 5972694 - DNA, 22 bp, Homo sapiens
ctaaccattcaaatgacgcctg

SEQ ID NO: 5972695 - DNA, 15 bp, Homo sapiens
ctaaccatttcttat

SEQ ID NO: 5972696 - DNA, 16 bp, Homo sapiens
ctaacccagcagtaac

SEQ ID NO: 5972697 - DNA, 19 bp, Homo sapiens
ctaaccccaacgcacagga

SEQ ID NO: 5972698 - DNA, 14 bp, Homo sapiens
ctaaccccagggca

SEQ ID NO: 5972699 - DNA, 16 bp, Homo sapiens
ctaaccccagggcact

SEQ ID NO: 5972700 - DNA, 18 bp, Homo sapiens
ctaacccccagtgccaca

SEQ ID NO: 5972701 - DNA, 23 bp, Homo sapiens
ctaacccccagtgccacagagaa

SEQ ID NO: 5972702 - DNA, 13 bp, Homo sapiens
ctaaccccgtctg

SEQ ID NO: 5972703 - DNA, 13 bp, Homo sapiens
ctaaccccttcca

SEQ ID NO: 5972704 - DNA, 19 bp, Homo sapiens
ctaaccccttccagatcac

SEQ ID NO: 5972705 - DNA, 13 bp, Homo sapiens
ctaacccctttcc

SEQ ID NO: 5972706 - DNA, 16 bp, Homo sapiens
ctaacccctttcctgc

SEQ ID NO: 5972707 - DNA, 14 bp, Homo sapiens
ctaaccctctgtca

SEQ ID NO: 5972708 - DNA, 19 bp, Homo sapiens
ctaaggtctcatgctgttg

SEQ ID NO: 5972709 - DNA, 17 bp, Homo sapiens
ctaaggtgaccagagtg

SEQ ID NO: 5972710 - DNA, 14 bp, Homo sapiens
ctaaggtgactttc

SEQ ID NO: 5972711 - DNA, 15 bp, Homo sapiens
ctaaggtgactttct

SEQ ID NO: 5972712 - DNA, 18 bp, Homo sapiens
ctaaggtgactttctgaa

SEQ ID NO: 5972713 - DNA, 15 bp, Homo sapiens
ctaaggtgctaaatc

SEQ ID NO: 5972714 - DNA, 15 bp, Homo sapiens
ctaaggtgtgctctg

SEQ ID NO: 5972715 - DNA, 11 bp, Homo sapiens
ctaaggttcta

SEQ ID NO: 5972716 - DNA, 15 bp, Homo sapiens
ctaaggttctaaggc

SEQ ID NO: 5972717 - DNA, 17 bp, Homo sapiens
ctaaggttctaaggcct

SEQ ID NO: 5972718 - DNA, 14 bp, Homo sapiens
ctaaggttctcata

SEQ ID NO: 5972719 - DNA, 16 bp, Homo sapiens
ctaaggtttccagtca

SEQ ID NO: 5972720 - DNA, 15 bp, Homo sapiens
ctaaggttttgttgt

SEQ ID NO: 5972721 - DNA, 16 bp, Homo sapiens
ctaagtaaaaatatgt

SEQ ID NO: 5972722 - DNA, 22 bp, Homo sapiens
ctaagtaaaaatatgtcatcat

SEQ ID NO: 5972723 - DNA, 21 bp, Homo sapiens
ctaagtaaaaatattaactga

SEQ ID NO: 5972724 - DNA, 20 bp, Homo sapiens
ctaagtaaaaccacagcagt

SEQ ID NO: 5972725 - DNA, 23 bp, Homo sapiens
ctaagtaaaaccacagcagttga

SEQ ID NO: 5972726 - DNA, 17 bp, Homo sapiens
ctaagtaaatctcttct

SEQ ID NO: 5972727 - DNA, 19 bp, Homo sapiens
ctaagtaaatctcttctgt

SEQ ID NO: 5972728 - DNA, 19 bp, Homo sapiens
ctaagtaaattttctttaa

SEQ ID NO: 5972729 - DNA, 20 bp, Homo sapiens
ctaagtaatctcacagcatt

SEQ ID NO: 5972730 - DNA, 17 bp, Homo sapiens
ctaagtaatttagaaga

SEQ ID NO: 5972731 - DNA, 19 bp, Homo sapiens
ctaagtaatttagaagata

SEQ ID NO: 5972732 - DNA, 16 bp, Homo sapiens
ctaagtacccttgggg

SEQ ID NO: 5972733 - DNA, 21 bp, Homo sapiens
ctaagtacctttcctacattt

SEQ ID NO: 5972734 - DNA, 22 bp, Homo sapiens
ctaagtactgtaataatacctc

SEQ ID NO: 5972735 - DNA, 16 bp, Homo sapiens
ctaagtagaataaaga

SEQ ID NO: 5972736 - DNA, 19 bp, Homo sapiens
ctaagtaggggcagtgatg

SEQ ID NO: 5972737 - DNA, 16 bp, Homo sapiens
ctaagtatttcccagc

SEQ ID NO: 5972738 - DNA, 17 bp, Homo sapiens
ctaagtcaacttagcat

SEQ ID NO: 5972739 - DNA, 16 bp, Homo sapiens
ctaagtcatggtcctg

SEQ ID NO: 5972740 - DNA, 22 bp, Homo sapiens
ctaagtcatggtcctggctgga

SEQ ID NO: 5972741 - DNA, 17 bp, Homo sapiens
ctaagtcattggcaaag

SEQ ID NO: 5972742 - DNA, 19 bp, Homo sapiens
ctaagtccaactactaaac

SEQ ID NO: 5972743 - DNA, 23 bp, Homo sapiens
ctaagtccagtccagtcctatct

SEQ ID NO: 5972744 - DNA, 14 bp, Homo sapiens
ctaagtccatcacc

SEQ ID NO: 5972745 - DNA, 23 bp, Homo sapiens
ctaagtccctataataaaggctg

SEQ ID NO: 5972746 - DNA, 15 bp, Homo sapiens
ctaagtccctgcccc

SEQ ID NO: 5972747 - DNA, 18 bp, Homo sapiens
ctaagtccctgccccctc

SEQ ID NO: 5972748 - DNA, 23 bp, Homo sapiens
ctaagtcctcagagctccatgct

SEQ ID NO: 5972749 - DNA, 18 bp, Homo sapiens
ctaagtccttccacctgc

SEQ ID NO: 5972750 - DNA, 19 bp, Homo sapiens
ctaagtccttccacctgcc

SEQ ID NO: 5972751 - DNA, 16 bp, Homo sapiens
ctaagtcgtgcacttt

SEQ ID NO: 5972752 - DNA, 22 bp, Homo sapiens
ctaagtcgttgagggaatgaca

SEQ ID NO: 5972753 - DNA, 14 bp, Homo sapiens
ctaagtctctgtga

SEQ ID NO: 5972754 - DNA, 18 bp, Homo sapiens
ctaagtctcttttttaca

SEQ ID NO: 5972755 - DNA, 14 bp, Homo sapiens
ctaagtctttccat

SEQ ID NO: 5972756 - DNA, 14 bp, Homo sapiens
ctaagtgaaaaggt

SEQ ID NO: 5972757 - DNA, 17 bp, Homo sapiens
ctaagtgacatttgtag

SEQ ID NO: 5972758 - DNA, 14 bp, Homo sapiens
ctaagtgactacca

SEQ ID NO: 5972759 - DNA, 13 bp, Homo sapiens
ctaagtgagagtt

SEQ ID NO: 5972760 - DNA, 17 bp, Homo sapiens
ctaagtgagatgtttgg

SEQ ID NO: 5972761 - DNA, 22 bp, Homo sapiens
ctaagtgatcctcccacctcag

SEQ ID NO: 5972762 - DNA, 15 bp, Homo sapiens
ctaagtgcaaacaca

SEQ ID NO: 5972763 - DNA, 19 bp, Homo sapiens
ctaagtgcaaacacagcat

SEQ ID NO: 5972764 - DNA, 11 bp, Homo sapiens
ctaagtgccca

SEQ ID NO: 5972765 - DNA, 13 bp, Homo sapiens
ctaagtgcccaaa

SEQ ID NO: 5972766 - DNA, 15 bp, Homo sapiens
ctaagtgcccaaagt

SEQ ID NO: 5972767 - DNA, 17 bp, Homo sapiens
ctaagtgcccaaagtgg

SEQ ID NO: 5972768 - DNA, 22 bp, Homo sapiens
ctaagtgcccaaagtggggagg

SEQ ID NO: 5972769 - DNA, 17 bp, Homo sapiens
ctaagtgctaagtgctt

SEQ ID NO: 5972770 - DNA, 21 bp, Homo sapiens
ctaagtgcttattacatttta

SEQ ID NO: 5972771 - DNA, 18 bp, Homo sapiens
ctaagtggaagacagaga

SEQ ID NO: 5972772 - DNA, 16 bp, Homo sapiens
ctaagtggattggctt

SEQ ID NO: 5972773 - DNA, 23 bp, Homo sapiens
ctaagtggattggctttgtgctt

SEQ ID NO: 5972774 - DNA, 22 bp, Homo sapiens
ctaagtggctgccttctttcca

SEQ ID NO: 5972775 - DNA, 19 bp, Homo sapiens
ctaagtgggaagtgaagcc

SEQ ID NO: 5972776 - DNA, 23 bp, Homo sapiens
ctaagtgggcattgccatgtgga

SEQ ID NO: 5972777 - DNA, 21 bp, Homo sapiens
ctaagtggtactaactttcct

SEQ ID NO: 5972778 - DNA, 13 bp, Homo sapiens
ctaagtgtaaaaa

SEQ ID NO: 5972779 - DNA, 12 bp, Homo sapiens
ctaagtgtggat

SEQ ID NO: 5972780 - DNA, 13 bp, Homo sapiens
ctaagtgtggatg

SEQ ID NO: 5972781 - DNA, 18 bp, Homo sapiens
ctaagtgttgattgtgcc

SEQ ID NO: 5972782 - DNA, 22 bp, Homo sapiens
ctaagtgtttactatgtgccag

SEQ ID NO: 5972783 - DNA, 15 bp, Homo sapiens
ctaagttaataataa

SEQ ID NO: 5972784 - DNA, 16 bp, Homo sapiens
ctaagttaataataat

SEQ ID NO: 5972785 - DNA, 20 bp, Homo sapiens
ctaagttatagtatatctgg

SEQ ID NO: 5972786 - DNA, 19 bp, Homo sapiens
ctaagttattacctctcca

SEQ ID NO: 5972787 - DNA, 15 bp, Homo sapiens
ctaagttattgctgc

SEQ ID NO: 5972788 - DNA, 20 bp, Homo sapiens
ctaagttattgttaattatg

SEQ ID NO: 5972789 - DNA, 22 bp, Homo sapiens
ctaagttatttactcctcctgc

SEQ ID NO: 5972790 - DNA, 16 bp, Homo sapiens
ctaagttattttatga

SEQ ID NO: 5972791 - DNA, 14 bp, Homo sapiens
ctaagttcccttct

SEQ ID NO: 5972792 - DNA, 13 bp, Homo sapiens
ctaagttctccca

SEQ ID NO: 5972793 - DNA, 15 bp, Homo sapiens
ctaagttcttagata

SEQ ID NO: 5972794 - DNA, 17 bp, Homo sapiens
ctaagttcttagatatc

SEQ ID NO: 5972795 - DNA, 18 bp, Homo sapiens
ctaagttcttagatatct

SEQ ID NO: 5972796 - DNA, 22 bp, Homo sapiens
ctaagttgcaagatcttattta

SEQ ID NO: 5972797 - DNA, 14 bp, Homo sapiens
ctaagttgctggga

SEQ ID NO: 5972798 - DNA, 20 bp, Homo sapiens
ctaagttgctgggattacag

SEQ ID NO: 5972799 - DNA, 16 bp, Homo sapiens
ctaagttgggatctag

SEQ ID NO: 5972800 - DNA, 22 bp, Homo sapiens
ctaagttgtattttaataaaga

SEQ ID NO: 5972801 - DNA, 12 bp, Homo sapiens
ctaagtttcctt

SEQ ID NO: 5972802 - DNA, 14 bp, Homo sapiens
ctaagtttctaaga

SEQ ID NO: 5972803 - DNA, 15 bp, Homo sapiens
ctaagtttctaagat

SEQ ID NO: 5972804 - DNA, 22 bp, Homo sapiens
ctaagtttctaagattctaaag

SEQ ID NO: 5972805 - DNA, 15 bp, Homo sapiens
ctaagtttctttgag

SEQ ID NO: 5972806 - DNA, 16 bp, Homo sapiens
ctaagtttctttgagg

SEQ ID NO: 5972807 - DNA, 21 bp, Homo sapiens
ctaagtttgtctacactaaaa

SEQ ID NO: 5972808 - DNA, 18 bp, Homo sapiens
ctaagttttcaaatttgt

SEQ ID NO: 5972809 - DNA, 20 bp, Homo sapiens
ctaagtttttatggcttttg

SEQ ID NO: 5972810 - DNA, 18 bp, Homo sapiens
ctaataaaaagcttttgt

SEQ ID NO: 5972811 - DNA, 16 bp, Homo sapiens
ctaataaaactgatgt

SEQ ID NO: 5972812 - DNA, 18 bp, Homo sapiens
ctaataaaactgatgtga

SEQ ID NO: 5972813 - DNA, 18 bp, Homo sapiens
ctaataaaagtcagagct

SEQ ID NO: 5972814 - DNA, 20 bp, Homo sapiens
ctaataaaagtcagagctca

SEQ ID NO: 5972815 - DNA, 11 bp, Homo sapiens
ctaataaaata

SEQ ID NO: 5972816 - DNA, 12 bp, Homo sapiens
ctaataaaataa

SEQ ID NO: 5972817 - DNA, 23 bp, Homo sapiens
ctaataaaatatcattcagcaac

SEQ ID NO: 5972818 - DNA, 14 bp, Homo sapiens
ctaataaaatgtga

SEQ ID NO: 5972819 - DNA, 15 bp, Homo sapiens
ctaataaaatgtgaa

SEQ ID NO: 5972820 - DNA, 15 bp, Homo sapiens
ctaataaaattcaga

SEQ ID NO: 5972821 - DNA, 21 bp, Homo sapiens
ctaataaaattcgctttctaa

SEQ ID NO: 5972822 - DNA, 21 bp, Homo sapiens
ctaataaaccagattccagag

SEQ ID NO: 5972823 - DNA, 14 bp, Homo sapiens
ctaataaaccagtt

SEQ ID NO: 5972824 - DNA, 17 bp, Homo sapiens
ctaataaactaataatt

SEQ ID NO: 5972825 - DNA, 11 bp, Homo sapiens
ctaataaactg

SEQ ID NO: 5972826 - DNA, 15 bp, Homo sapiens
ctaataaactgtatt

SEQ ID NO: 5972827 - DNA, 20 bp, Homo sapiens
ctaataaactgtattaaatc

SEQ ID NO: 5972828 - DNA, 23 bp, Homo sapiens
ctaataaagtctctttttctcac

SEQ ID NO: 5972829 - DNA, 15 bp, Homo sapiens
ctaataaagtgccgg

SEQ ID NO: 5972830 - DNA, 20 bp, Homo sapiens
ctaataaagttaaattgcac

SEQ ID NO: 5972831 - DNA, 24 bp, Homo sapiens
ctaataaatattgacttctcttga

SEQ ID NO: 5972832 - DNA, 16 bp, Homo sapiens
ctaataaatcaatgtg

SEQ ID NO: 5972833 - DNA, 21 bp, Homo sapiens
ctaataaatgaccagtttacc

SEQ ID NO: 5972834 - DNA, 17 bp, Homo sapiens
ctaataaattatacaaa

SEQ ID NO: 5972835 - DNA, 22 bp, Homo sapiens
ctaataagctagttgaatactt

SEQ ID NO: 5972836 - DNA, 19 bp, Homo sapiens
ctaataagtgctactttgc

SEQ ID NO: 5972837 - DNA, 18 bp, Homo sapiens
ctaataagtttgaaatat

SEQ ID NO: 5972838 - DNA, 13 bp, Homo sapiens
ctaataataaata

SEQ ID NO: 5972839 - DNA, 20 bp, Homo sapiens
ctaataatcttgtttctgaa

SEQ ID NO: 5972840 - DNA, 14 bp, Homo sapiens
ctaataattgtatc

SEQ ID NO: 5972841 - DNA, 14 bp, Homo sapiens
ctaataatttctaa

SEQ ID NO: 5972842 - DNA, 17 bp, Homo sapiens
ctaataatttctaatgt

SEQ ID NO: 5972843 - DNA, 12 bp, Homo sapiens
ctaatacaccag

SEQ ID NO: 5972844 - DNA, 18 bp, Homo sapiens
ctaatacactaatagtaa

SEQ ID NO: 5972845 - DNA, 21 bp, Homo sapiens
ctaatacagccccttttccct

SEQ ID NO: 5972846 - DNA, 17 bp, Homo sapiens
ctaatacattaaagcag

SEQ ID NO: 5972847 - DNA, 16 bp, Homo sapiens
ctaataccaactattt

SEQ ID NO: 5972848 - DNA, 11 bp, Homo sapiens
ctaatactaat

SEQ ID NO: 5972849 - DNA, 14 bp, Homo sapiens
ctaatacttactgt

SEQ ID NO: 5972850 - DNA, 17 bp, Homo sapiens
ctaatactttgtttatt

SEQ ID NO: 5972851 - DNA, 15 bp, Homo sapiens
ctaatagaaaagtct

SEQ ID NO: 5972852 - DNA, 19 bp, Homo sapiens
ctaatagacaatttattat

SEQ ID NO: 5972853 - DNA, 18 bp, Homo sapiens
ctaatagactaaatgaaa

SEQ ID NO: 5972854 - DNA, 20 bp, Homo sapiens
ctaatagactaaatgaaatc

SEQ ID NO: 5972855 - DNA, 19 bp, Homo sapiens
ctaatagagtacttaatat

SEQ ID NO: 5972856 - DNA, 22 bp, Homo sapiens
ctaatagagtacttaatatact

SEQ ID NO: 5972857 - DNA, 17 bp, Homo sapiens
ctaatagcctaaaagat

SEQ ID NO: 5972858 - DNA, 23 bp, Homo sapiens
ctaatagcctaaaagattttgtg

SEQ ID NO: 5972859 - DNA, 17 bp, Homo sapiens
ctaatagcttttcctgt

SEQ ID NO: 5972860 - DNA, 13 bp, Homo sapiens
ctaatagcttttt

SEQ ID NO: 5972861 - DNA, 15 bp, Homo sapiens
ctaatagctttttaa

SEQ ID NO: 5972862 - DNA, 22 bp, Homo sapiens
ctaatagggcaattaattcctt

SEQ ID NO: 5972863 - DNA, 13 bp, Homo sapiens
ctaataggtctgg

SEQ ID NO: 5972864 - DNA, 14 bp, Homo sapiens
ctaataggtctgga

SEQ ID NO: 5972865 - DNA, 15 bp, Homo sapiens
ctaatagtttgttga

SEQ ID NO: 5972866 - DNA, 12 bp, Homo sapiens
ctaatatacttt

SEQ ID NO: 5972867 - DNA, 23 bp, Homo sapiens
ctaatatactttttttgttatag

SEQ ID NO: 5972868 - DNA, 15 bp, Homo sapiens
ctaatatatatgaat

SEQ ID NO: 5972869 - DNA, 18 bp, Homo sapiens
ctaatatatatgtagaga

SEQ ID NO: 5972870 - DNA, 16 bp, Homo sapiens
ctaatatatccatgat

SEQ ID NO: 5972871 - DNA, 14 bp, Homo sapiens
ctaatatatctgta

SEQ ID NO: 5972872 - DNA, 13 bp, Homo sapiens
ctaatatatgaaa

SEQ ID NO: 5972873 - DNA, 13 bp, Homo sapiens
ctaatatatttaa

SEQ ID NO: 5972874 - DNA, 15 bp, Homo sapiens
ctaatatcaaatgca

SEQ ID NO: 5972875 - DNA, 23 bp, Homo sapiens
ctaatatcaaatgcagtatattt

SEQ ID NO: 5972876 - DNA, 15 bp, Homo sapiens
ctaatatcacttaaa

SEQ ID NO: 5972877 - DNA, 12 bp, Homo sapiens
ctaatatcagca

SEQ ID NO: 5972878 - DNA, 11 bp, Homo sapiens
ctaatatcatt

SEQ ID NO: 5972879 - DNA, 16 bp, Homo sapiens
ctaatatcattttatt

SEQ ID NO: 5972880 - DNA, 18 bp, Homo sapiens
ctaatatcattttattca

SEQ ID NO: 5972881 - DNA, 19 bp, Homo sapiens
ctaatatcattttattcac

SEQ ID NO: 5972882 - DNA, 19 bp, Homo sapiens
ctaatatgatgactgtttt

SEQ ID NO: 5972883 - DNA, 18 bp, Homo sapiens
ctaatatgattatacaaa

SEQ ID NO: 5972884 - DNA, 13 bp, Homo sapiens
ctaatatggcaaa

SEQ ID NO: 5972885 - DNA, 19 bp, Homo sapiens
ctaatatggttttgttttc

SEQ ID NO: 5972886 - DNA, 16 bp, Homo sapiens
ctacatagttattcta

SEQ ID NO: 5972887 - DNA, 19 bp, Homo sapiens
ctacatatcccttccagat

SEQ ID NO: 5972888 - DNA, 16 bp, Homo sapiens
ctacatatgatctgtc

SEQ ID NO: 5972889 - DNA, 11 bp, Homo sapiens
ctacatatgta

SEQ ID NO: 5972890 - DNA, 12 bp, Homo sapiens
ctacatattgaa

SEQ ID NO: 5972891 - DNA, 22 bp, Homo sapiens
ctacatcagtgtggaaaaaaat

SEQ ID NO: 5972892 - DNA, 21 bp, Homo sapiens
ctacatccagctcctctaggg

SEQ ID NO: 5972893 - DNA, 16 bp, Homo sapiens
ctacatccccaggtct

SEQ ID NO: 5972894 - DNA, 20 bp, Homo sapiens
ctacatctgaaatctacaac

SEQ ID NO: 5972895 - DNA, 17 bp, Homo sapiens
ctacatcttcagctccc

SEQ ID NO: 5972896 - DNA, 22 bp, Homo sapiens
ctacatcttcagctcccatagc

SEQ ID NO: 5972897 - DNA, 16 bp, Homo sapiens
ctacatcttctgcctt

SEQ ID NO: 5972898 - DNA, 16 bp, Homo sapiens
ctacatcttcttccca

SEQ ID NO: 5972899 - DNA, 10 bp, Homo sapiens
ctacatgaaa

SEQ ID NO: 5972900 - DNA, 16 bp, Homo sapiens
ctacatgaaacagaaa

SEQ ID NO: 5972901 - DNA, 18 bp, Homo sapiens
ctacatgacgacaaagct

SEQ ID NO: 5972902 - DNA, 21 bp, Homo sapiens
ctacatgacgacaaagctgct

SEQ ID NO: 5972903 - DNA, 22 bp, Homo sapiens
ctacatgacgggttgtgagact

SEQ ID NO: 5972904 - DNA, 12 bp, Homo sapiens
ctacatgactgg

SEQ ID NO: 5972905 - DNA, 16 bp, Homo sapiens
ctacatgactgggcct

SEQ ID NO: 5972906 - DNA, 21 bp, Homo sapiens
ctacatgaggaactgtagatg

SEQ ID NO: 5972907 - DNA, 20 bp, Homo sapiens
ctacatgaggtactgagagt

SEQ ID NO: 5972908 - DNA, 22 bp, Homo sapiens
ctacatgatctagagccagtta

SEQ ID NO: 5972909 - DNA, 20 bp, Homo sapiens
ctacatgatgactcaaggcc

SEQ ID NO: 5972910 - DNA, 14 bp, Homo sapiens
ctacatgcagccca

SEQ ID NO: 5972911 - DNA, 16 bp, Homo sapiens
ctacatgcataaacta

SEQ ID NO: 5972912 - DNA, 14 bp, Homo sapiens
ctacatgctgaaaa

SEQ ID NO: 5972913 - DNA, 17 bp, Homo sapiens
ctacatgctttgtgaac

SEQ ID NO: 5972914 - DNA, 18 bp, Homo sapiens
ctacatggagtatatgtc

SEQ ID NO: 5972915 - DNA, 18 bp, Homo sapiens
ctacatgggccagccctt

SEQ ID NO: 5972916 - DNA, 23 bp, Homo sapiens
ctacatgggccagcccttgctct

SEQ ID NO: 5972917 - DNA, 16 bp, Homo sapiens
ctacatgtgggagctt

SEQ ID NO: 5972918 - DNA, 14 bp, Homo sapiens
ctacattaaaatga

SEQ ID NO: 5972919 - DNA, 15 bp, Homo sapiens
ctacattaaaatgac

SEQ ID NO: 5972920 - DNA, 19 bp, Homo sapiens
ctacattaaaatgacaaac

SEQ ID NO: 5972921 - DNA, 18 bp, Homo sapiens
ctacattaaacatgactc

SEQ ID NO: 5972922 - DNA, 22 bp, Homo sapiens
ctacattaccctaatggctgct

SEQ ID NO: 5972923 - DNA, 18 bp, Homo sapiens
ctacattaggttgtgaat

SEQ ID NO: 5972924 - DNA, 17 bp, Homo sapiens
ctacattagtgagattt

SEQ ID NO: 5972925 - DNA, 18 bp, Homo sapiens
ctacattagtgagattta

SEQ ID NO: 5972926 - DNA, 19 bp, Homo sapiens
ctacattataataaaattt

SEQ ID NO: 5972927 - DNA, 23 bp, Homo sapiens
ctacattataccgcagagtattt

SEQ ID NO: 5972928 - DNA, 15 bp, Homo sapiens
ctacattccctctcc

SEQ ID NO: 5972929 - DNA, 22 bp, Homo sapiens
ctacattccctctcctgcccag

SEQ ID NO: 5972930 - DNA, 13 bp, Homo sapiens
ctacattcctcag

SEQ ID NO: 5972931 - DNA, 17 bp, Homo sapiens
ctacattcctcagctgc

SEQ ID NO: 5972932 - DNA, 19 bp, Homo sapiens
ctacattcctcagctgcca

SEQ ID NO: 5972933 - DNA, 16 bp, Homo sapiens
ctacattctctatttt

SEQ ID NO: 5972934 - DNA, 19 bp, Homo sapiens
ctacattctctatttttgt

SEQ ID NO: 5972935 - DNA, 11 bp, Homo sapiens
ctacattctgc

SEQ ID NO: 5972936 - DNA, 13 bp, Homo sapiens
ctacattctgtta

SEQ ID NO: 5972937 - DNA, 13 bp, Homo sapiens
ctacattcttggt

SEQ ID NO: 5972938 - DNA, 18 bp, Homo sapiens
ctacattctttattctgc

SEQ ID NO: 5972939 - DNA, 22 bp, Homo sapiens
ctacattgagtagacacattta

SEQ ID NO: 5972940 - DNA, 23 bp, Homo sapiens
ctacattggaagctttgagttga

SEQ ID NO: 5972941 - DNA, 14 bp, Homo sapiens
ctacatttccgcca

SEQ ID NO: 5972942 - DNA, 16 bp, Homo sapiens
ctacatttgtttgtat

SEQ ID NO: 5972943 - DNA, 19 bp, Homo sapiens
ctacatttgtttgtattca

SEQ ID NO: 5972944 - DNA, 23 bp, Homo sapiens
ctacatttgtttgtattcatgtt

SEQ ID NO: 5972945 - DNA, 11 bp, Homo sapiens
ctacattttaa

SEQ ID NO: 5972946 - DNA, 12 bp, Homo sapiens
ctacattttaac

SEQ ID NO: 5972947 - DNA, 13 bp, Homo sapiens
ctacattttaaca

SEQ ID NO: 5972948 - DNA, 15 bp, Homo sapiens
ctacattttaacatg

SEQ ID NO: 5972949 - DNA, 14 bp, Homo sapiens
ctacattttgaggt

SEQ ID NO: 5972950 - DNA, 22 bp, Homo sapiens
ctacattttgaggttttgtaaa

SEQ ID NO: 5972951 - DNA, 14 bp, Homo sapiens
ctacattttgcaac

SEQ ID NO: 5972952 - DNA, 13 bp, Homo sapiens
ctaccaaaagaca

SEQ ID NO: 5972953 - DNA, 14 bp, Homo sapiens
ctaccaaaagacat

SEQ ID NO: 5972954 - DNA, 15 bp, Homo sapiens
ctaccaaaagacatt

SEQ ID NO: 5972955 - DNA, 18 bp, Homo sapiens
ctaccaaaagacattaga

SEQ ID NO: 5972956 - DNA, 22 bp, Homo sapiens
ctaccaaaagacattagagaaa

SEQ ID NO: 5972957 - DNA, 14 bp, Homo sapiens
ctaccaaagaatgc

SEQ ID NO: 5972958 - DNA, 16 bp, Homo sapiens
ctaccaaatgtgtaat

SEQ ID NO: 5972959 - DNA, 19 bp, Homo sapiens
ctaccaaatgtgtaatgga

SEQ ID NO: 5972960 - DNA, 18 bp, Homo sapiens
ctaccaactggaagcaca

SEQ ID NO: 5972961 - DNA, 23 bp, Homo sapiens
ctaccaactttcaagaacttgtt

SEQ ID NO: 5972962 - DNA, 16 bp, Homo sapiens
ctaccaagctgtcaca

SEQ ID NO: 5972963 - DNA, 18 bp, Homo sapiens
ctaccaaggcatatcatg

SEQ ID NO: 5972964 - DNA, 16 bp, Homo sapiens
ctaccaatctctgctc

SEQ ID NO: 5972965 - DNA, 19 bp, Homo sapiens
ctaccacagctgcctccgg

SEQ ID NO: 5972966 - DNA, 21 bp, Homo sapiens
ctaccacagctgcctccgggc

SEQ ID NO: 5972967 - DNA, 14 bp, Homo sapiens
ctaccaccagctgt

SEQ ID NO: 5972968 - DNA, 15 bp, Homo sapiens
ctaccaccagctgtg

SEQ ID NO: 5972969 - DNA, 14 bp, Homo sapiens
ctaccaccccttcc

SEQ ID NO: 5972970 - DNA, 17 bp, Homo sapiens
ctaccaccccttcctgt

SEQ ID NO: 5972971 - DNA, 19 bp, Homo sapiens
ctaccaccctcgctgccac

SEQ ID NO: 5972972 - DNA, 23 bp, Homo sapiens
ctaccaccctcgctgccacccac

SEQ ID NO: 5972973 - DNA, 11 bp, Homo sapiens
ctaccacctcc

SEQ ID NO: 5972974 - DNA, 21 bp, Homo sapiens
ctaccacggcctcctttccgt

SEQ ID NO: 5972975 - DNA, 18 bp, Homo sapiens
ctaccactgagcccttgc

SEQ ID NO: 5972976 - DNA, 23 bp, Homo sapiens
ctaccactggtgtaaaaaacaaa

SEQ ID NO: 5972977 - DNA, 18 bp, Homo sapiens
ctaccactgtcttcttca

SEQ ID NO: 5972978 - DNA, 23 bp, Homo sapiens
ctaccactgtggccccaagaggg

SEQ ID NO: 5972979 - DNA, 18 bp, Homo sapiens
ctaccagagcagagaagg

SEQ ID NO: 5972980 - DNA, 18 bp, Homo sapiens
ctaccagataactgagga

SEQ ID NO: 5972981 - DNA, 20 bp, Homo sapiens
ctaccagcgccaaatgttca

SEQ ID NO: 5972982 - DNA, 17 bp, Homo sapiens
ctaccagcgcccgctgg

SEQ ID NO: 5972983 - DNA, 20 bp, Homo sapiens
ctaccagcgcccgctgggct

SEQ ID NO: 5972984 - DNA, 17 bp, Homo sapiens
ctaccagctaactccag

SEQ ID NO: 5972985 - DNA, 14 bp, Homo sapiens
ctaccagctcctcc

SEQ ID NO: 5972986 - DNA, 17 bp, Homo sapiens
ctaccagctcctccagc

SEQ ID NO: 5972987 - DNA, 18 bp, Homo sapiens
ctaccagctcctccagcc

SEQ ID NO: 5972988 - DNA, 23 bp, Homo sapiens
ctaccagctcctccagccctgcc

SEQ ID NO: 5972989 - DNA, 14 bp, Homo sapiens
ctaccaggaagagg

SEQ ID NO: 5972990 - DNA, 21 bp, Homo sapiens
ctaccaggaagaggggcgctg

SEQ ID NO: 5972991 - DNA, 22 bp, Homo sapiens
ctaccagggctcacccactgct

SEQ ID NO: 5972992 - DNA, 17 bp, Homo sapiens
ctaccagggtctctcag

SEQ ID NO: 5972993 - DNA, 20 bp, Homo sapiens
ctaccagggtctctcaggga

SEQ ID NO: 5972994 - DNA, 20 bp, Homo sapiens
ctaccaggtgtgcctggaag

SEQ ID NO: 5972995 - DNA, 13 bp, Homo sapiens
ctaccagtattta

SEQ ID NO: 5972996 - DNA, 19 bp, Homo sapiens
ctaccagtcgccctctgtg

SEQ ID NO: 5972997 - DNA, 18 bp, Homo sapiens
ctaccagttggcagacag

SEQ ID NO: 5972998 - DNA, 16 bp, Homo sapiens
ctaccatacagacagc

SEQ ID NO: 5972999 - DNA, 20 bp, Homo sapiens
ctaccatcagctctgccttg

SEQ ID NO: 5973000 - DNA, 21 bp, Homo sapiens
ctaccatcagctctgccttgc

SEQ ID NO: 5973001 - DNA, 18 bp, Homo sapiens
ctaccatctgatgtttca

SEQ ID NO: 5973002 - DNA, 11 bp, Homo sapiens
ctaccatctgc

SEQ ID NO: 5973003 - DNA, 18 bp, Homo sapiens
ctaccatttcagatgcaa

SEQ ID NO: 5973004 - DNA, 20 bp, Homo sapiens
ctaccatttgcagagtcctg

SEQ ID NO: 5973005 - DNA, 20 bp, Homo sapiens
ctaccatttgtgttttgaaa

SEQ ID NO: 5973006 - DNA, 19 bp, Homo sapiens
ctaccattttacatttcta

SEQ ID NO: 5973007 - DNA, 16 bp, Homo sapiens
ctacccaaaccctagg

SEQ ID NO: 5973008 - DNA, 15 bp, Homo sapiens
ctacccaaccactca

SEQ ID NO: 5973009 - DNA, 16 bp, Homo sapiens
ctacccaaccagggcc

SEQ ID NO: 5973010 - DNA, 14 bp, Homo sapiens
ctacccaatgtctc

SEQ ID NO: 5973011 - DNA, 17 bp, Homo sapiens
ctacccaatgtctccca

SEQ ID NO: 5973012 - DNA, 18 bp, Homo sapiens
ctacccaatgtctcccac

SEQ ID NO: 5973013 - DNA, 20 bp, Homo sapiens
ctacccacacctctgccaga

SEQ ID NO: 5973014 - DNA, 20 bp, Homo sapiens
ctacccacagggcctgactt

SEQ ID NO: 5973015 - DNA, 14 bp, Homo sapiens
ctacccactctttg

SEQ ID NO: 5973016 - DNA, 21 bp, Homo sapiens
ctacccagagaagccccttcc

SEQ ID NO: 5973017 - DNA, 13 bp, Homo sapiens
ctacccagagcct

SEQ ID NO: 5973018 - DNA, 20 bp, Homo sapiens
ctacccagagccttctcctg

SEQ ID NO: 5973019 - DNA, 19 bp, Homo sapiens
ctacccagcgagccctggt

SEQ ID NO: 5973020 - DNA, 19 bp, Homo sapiens
ctacccagcgtggcccagg

SEQ ID NO: 5973021 - DNA, 21 bp, Homo sapiens
ctacccagcgtggcccaggcc

SEQ ID NO: 5973022 - DNA, 12 bp, Homo sapiens
ctacccagctct

SEQ ID NO: 5973023 - DNA, 12 bp, Homo sapiens
ctacccagctga

SEQ ID NO: 5973024 - DNA, 12 bp, Homo sapiens
ctacccaggagg

SEQ ID NO: 5973025 - DNA, 23 bp, Homo sapiens
ctacccaggaggctgaggcagga

SEQ ID NO: 5973026 - DNA, 19 bp, Homo sapiens
ctacccagggcctgcagga

SEQ ID NO: 5973027 - DNA, 14 bp, Homo sapiens
ctacccagttgcct

SEQ ID NO: 5973028 - DNA, 18 bp, Homo sapiens
ctacccagttgcctccag

SEQ ID NO: 5973029 - DNA, 15 bp, Homo sapiens
ctacccatgagcctg

SEQ ID NO: 5973030 - DNA, 16 bp, Homo sapiens
ctacccatgagcctgc

SEQ ID NO: 5973031 - DNA, 18 bp, Homo sapiens
ctacccatgttgggaaaa

SEQ ID NO: 5973032 - DNA, 19 bp, Homo sapiens
ctacccattgttcccttcc

SEQ ID NO: 5973033 - DNA, 16 bp, Homo sapiens
ctaccccaattccttg

SEQ ID NO: 5973034 - DNA, 17 bp, Homo sapiens
ctaccccaattccttgt

SEQ ID NO: 5973035 - DNA, 18 bp, Homo sapiens
ctaccccacaacacgcct

SEQ ID NO: 5973036 - DNA, 16 bp, Homo sapiens
ctaccccacaccagcc

SEQ ID NO: 5973037 - DNA, 21 bp, Homo sapiens
ctaccccacaccaggccgtcc

SEQ ID NO: 5973038 - DNA, 16 bp, Homo sapiens
ctaccccacctgacct

SEQ ID NO: 5973039 - DNA, 20 bp, Homo sapiens
ctaccccaggacgcatgcag

SEQ ID NO: 5973040 - DNA, 13 bp, Homo sapiens
ctaccccagggcc

SEQ ID NO: 5973041 - DNA, 17 bp, Homo sapiens
ctaccccagggccctgg

SEQ ID NO: 5973042 - DNA, 21 bp, Homo sapiens
ctaccccagggccctggccag

SEQ ID NO: 5973043 - DNA, 21 bp, Homo sapiens
ctaccccagttcatctctgct

SEQ ID NO: 5973044 - DNA, 16 bp, Homo sapiens
ctaccccatctccaag

SEQ ID NO: 5973045 - DNA, 13 bp, Homo sapiens
ctaccccatgctg

SEQ ID NO: 5973046 - DNA, 16 bp, Homo sapiens
ctaccccccaaaaaaa

SEQ ID NO: 5973047 - DNA, 21 bp, Homo sapiens
ctaccccccctcctgctgcct

SEQ ID NO: 5973048 - DNA, 16 bp, Homo sapiens
ctacccccttgtctgc

SEQ ID NO: 5973049 - DNA, 18 bp, Homo sapiens
ctacccccttgtctgctg

SEQ ID NO: 5973050 - DNA, 21 bp, Homo sapiens
ctacccccttttcagctgagc

SEQ ID NO: 5973051 - DNA, 24 bp, Homo sapiens
ctacccccttttcagctgagccct

SEQ ID NO: 5973052 - DNA, 20 bp, Homo sapiens
ctaccccgactatccctgca

SEQ ID NO: 5973053 - DNA, 15 bp, Homo sapiens
ctaccccgcagacac

SEQ ID NO: 5973054 - DNA, 20 bp, Homo sapiens
ctaccccgcagacaccttgg

SEQ ID NO: 5973055 - DNA, 11 bp, Homo sapiens
ctacccctccc

SEQ ID NO: 5973056 - DNA, 13 bp, Homo sapiens
ctacccctcccag

SEQ ID NO: 5973057 - DNA, 15 bp, Homo sapiens
ctacccctcccagct

SEQ ID NO: 5973058 - DNA, 16 bp, Homo sapiens
ctacccctcccagctg

SEQ ID NO: 5973059 - DNA, 24 bp, Homo sapiens
ctacccctcccggccctgcctgct

SEQ ID NO: 5973060 - DNA, 16 bp, Homo sapiens
ctacccctcctgcgct

SEQ ID NO: 5973061 - DNA, 19 bp, Homo sapiens
ctacccctcgactcagcac

SEQ ID NO: 5973062 - DNA, 23 bp, Homo sapiens
ctacccctcgactcagcaccaca

SEQ ID NO: 5973063 - DNA, 20 bp, Homo sapiens
gaccagaaaatgtaaggcaa

SEQ ID NO: 5973064 - DNA, 18 bp, Homo sapiens
gaccagaaacctgggaga

SEQ ID NO: 5973065 - DNA, 20 bp, Homo sapiens
gaccagaaacctgggagaga

SEQ ID NO: 5973066 - DNA, 17 bp, Homo sapiens
gaccagaacagcatggc

SEQ ID NO: 5973067 - DNA, 12 bp, Homo sapiens
gaccagaagaaa

SEQ ID NO: 5973068 - DNA, 12 bp, Homo sapiens
gaccagaagcct

SEQ ID NO: 5973069 - DNA, 15 bp, Homo sapiens
gaccagaagtggcag

SEQ ID NO: 5973070 - DNA, 14 bp, Homo sapiens
gaccagaatgaaaa

SEQ ID NO: 5973071 - DNA, 15 bp, Homo sapiens
gaccagaatgaaaac

SEQ ID NO: 5973072 - DNA, 17 bp, Homo sapiens
gaccagacctagacctg

SEQ ID NO: 5973073 - DNA, 20 bp, Homo sapiens
gaccagacctagacctgggc

SEQ ID NO: 5973074 - DNA, 20 bp, Homo sapiens
gaccagactgtgggtccctg

SEQ ID NO: 5973075 - DNA, 17 bp, Homo sapiens
gaccagacttttgctta

SEQ ID NO: 5973076 - DNA, 15 bp, Homo sapiens
gaccagagcagtttc

SEQ ID NO: 5973077 - DNA, 13 bp, Homo sapiens
gaccagagccaga

SEQ ID NO: 5973078 - DNA, 14 bp, Homo sapiens
gaccagagccagat

SEQ ID NO: 5973079 - DNA, 16 bp, Homo sapiens
gaccagagccagatgc

SEQ ID NO: 5973080 - DNA, 11 bp, Homo sapiens
gaccagagctg

SEQ ID NO: 5973081 - DNA, 13 bp, Homo sapiens
gaccagagctgcc

SEQ ID NO: 5973082 - DNA, 15 bp, Homo sapiens
gaccagagctgccac

SEQ ID NO: 5973083 - DNA, 17 bp, Homo sapiens
gaccagagctgccacct

SEQ ID NO: 5973084 - DNA, 17 bp, Homo sapiens
gaccagaggaagcccct

SEQ ID NO: 5973085 - DNA, 18 bp, Homo sapiens
gaccagaggagccttttt

SEQ ID NO: 5973086 - DNA, 19 bp, Homo sapiens
gaccagaggagccttttta

SEQ ID NO: 5973087 - DNA, 14 bp, Homo sapiens
gaccagagggatgg

SEQ ID NO: 5973088 - DNA, 15 bp, Homo sapiens
gaccagagggatggg

SEQ ID NO: 5973089 - DNA, 16 bp, Homo sapiens
gaccagataaatagaa

SEQ ID NO: 5973090 - DNA, 15 bp, Homo sapiens
gaccagatctttctc

SEQ ID NO: 5973091 - DNA, 16 bp, Homo sapiens
gaccagatctttctct

SEQ ID NO: 5973092 - DNA, 21 bp, Homo sapiens
gaccagatctttctcttccct

SEQ ID NO: 5973093 - DNA, 15 bp, Homo sapiens
gaccagattgctctg

SEQ ID NO: 5973094 - DNA, 21 bp, Homo sapiens
gaccagcaccatctctcctcc

SEQ ID NO: 5973095 - DNA, 15 bp, Homo sapiens
gaccagcactcagcc

SEQ ID NO: 5973096 - DNA, 17 bp, Homo sapiens
gaccagcactcagcctc

SEQ ID NO: 5973097 - DNA, 17 bp, Homo sapiens
gaccagcagatcccagc

SEQ ID NO: 5973098 - DNA, 19 bp, Homo sapiens
gaccagcataccagttctt

SEQ ID NO: 5973099 - DNA, 15 bp, Homo sapiens
gaccagcccacagca

SEQ ID NO: 5973100 - DNA, 16 bp, Homo sapiens
gaccagcccacgctga

SEQ ID NO: 5973101 - DNA, 17 bp, Homo sapiens
gaccagcccagcctgca

SEQ ID NO: 5973102 - DNA, 19 bp, Homo sapiens
gaccagccccttcctgggt

SEQ ID NO: 5973103 - DNA, 20 bp, Homo sapiens
gaccagccccttcctgggta

SEQ ID NO: 5973104 - DNA, 22 bp, Homo sapiens
gaccagccgcccagatcatgcc

SEQ ID NO: 5973105 - DNA, 13 bp, Homo sapiens
gaccagcctgcca

SEQ ID NO: 5973106 - DNA, 21 bp, Homo sapiens
gaccagcctggccatcatggc

SEQ ID NO: 5973107 - DNA, 14 bp, Homo sapiens
gaccagcctggccc

SEQ ID NO: 5973108 - DNA, 15 bp, Homo sapiens
gaccagcctggccca

SEQ ID NO: 5973109 - DNA, 19 bp, Homo sapiens
gaccagcctgtcacccagc

SEQ ID NO: 5973110 - DNA, 23 bp, Homo sapiens
gaccagcctgtcacccagctcct

SEQ ID NO: 5973111 - DNA, 19 bp, Homo sapiens
gaccagcctgtccaacatg

SEQ ID NO: 5973112 - DNA, 14 bp, Homo sapiens
gaccagcggctgct

SEQ ID NO: 5973113 - DNA, 21 bp, Homo sapiens
gaccagctaattggtccaacc

SEQ ID NO: 5973114 - DNA, 17 bp, Homo sapiens
gaccagctcagaggccc

SEQ ID NO: 5973115 - DNA, 16 bp, Homo sapiens
gaccagctccccgggg

SEQ ID NO: 5973116 - DNA, 13 bp, Homo sapiens
gaccagctctctt

SEQ ID NO: 5973117 - DNA, 15 bp, Homo sapiens
gaccagctctcttcc

SEQ ID NO: 5973118 - DNA, 16 bp, Homo sapiens
gaccagctctcttcct

SEQ ID NO: 5973119 - DNA, 21 bp, Homo sapiens
gaccagctgctccgaggaccc

SEQ ID NO: 5973120 - DNA, 15 bp, Homo sapiens
gaccagctggcctgg

SEQ ID NO: 5973121 - DNA, 14 bp, Homo sapiens
gaccagctgggggg

SEQ ID NO: 5973122 - DNA, 17 bp, Homo sapiens
gaccaggaaagccacac

SEQ ID NO: 5973123 - DNA, 16 bp, Homo sapiens
gaccaggacaggacca

SEQ ID NO: 5973124 - DNA, 17 bp, Homo sapiens
gaccaggactccctcct

SEQ ID NO: 5973125 - DNA, 17 bp, Homo sapiens
gaccaggacttgtgcag

SEQ ID NO: 5973126 - DNA, 20 bp, Homo sapiens
gaccaggagaaatcaacagg

SEQ ID NO: 5973127 - DNA, 10 bp, Homo sapiens
gaccaggagc

SEQ ID NO: 5973128 - DNA, 13 bp, Homo sapiens
gaccaggagccag

SEQ ID NO: 5973129 - DNA, 15 bp, Homo sapiens
gaccaggagctagcc

SEQ ID NO: 5973130 - DNA, 18 bp, Homo sapiens
gaccaggaggattgcctt

SEQ ID NO: 5973131 - DNA, 13 bp, Homo sapiens
gaccaggagggag

SEQ ID NO: 5973132 - DNA, 18 bp, Homo sapiens
gaccaggagggagagcct

SEQ ID NO: 5973133 - DNA, 19 bp, Homo sapiens
gaccaggagggagagcctc

SEQ ID NO: 5973134 - DNA, 10 bp, Homo sapiens
gaccaggagt

SEQ ID NO: 5973135 - DNA, 12 bp, Homo sapiens
gaccaggatcag

SEQ ID NO: 5973136 - DNA, 13 bp, Homo sapiens
gaccaggatccag

SEQ ID NO: 5973137 - DNA, 12 bp, Homo sapiens
gaccaggatccc

SEQ ID NO: 5973138 - DNA, 13 bp, Homo sapiens
gaccaggatggag

SEQ ID NO: 5973139 - DNA, 14 bp, Homo sapiens
gaccaggatggagc

SEQ ID NO: 5973140 - DNA, 16 bp, Homo sapiens
gaccaggcaccaggca

SEQ ID NO: 5973141 - DNA, 19 bp, Homo sapiens
gaccaggcacccccagaat

SEQ ID NO: 5973142 - DNA, 17 bp, Homo sapiens
gaccaggccaatccctt

SEQ ID NO: 5973143 - DNA, 13 bp, Homo sapiens
gaccaggccacca

SEQ ID NO: 5973144 - DNA, 16 bp, Homo sapiens
gaccaggcccaaggag

SEQ ID NO: 5973145 - DNA, 13 bp, Homo sapiens
gaccaggcctgga

SEQ ID NO: 5973146 - DNA, 15 bp, Homo sapiens
gaccaggcctggagg

SEQ ID NO: 5973147 - DNA, 15 bp, Homo sapiens
gaccaggctgcagcc

SEQ ID NO: 5973148 - DNA, 18 bp, Homo sapiens
gaccaggctgcagcctcc

SEQ ID NO: 5973149 - DNA, 21 bp, Homo sapiens
gaccaggctggacaccctctg

SEQ ID NO: 5973150 - DNA, 22 bp, Homo sapiens
gaccaggctgggcatcatagca

SEQ ID NO: 5973151 - DNA, 15 bp, Homo sapiens
gaccaggctgtagga

SEQ ID NO: 5973152 - DNA, 13 bp, Homo sapiens
gaccaggctgtgg

SEQ ID NO: 5973153 - DNA, 14 bp, Homo sapiens
gaccaggctgtgtc

SEQ ID NO: 5973154 - DNA, 23 bp, Homo sapiens
gaccaggcttcccaaaccaagtg

SEQ ID NO: 5973155 - DNA, 16 bp, Homo sapiens
gaccagggaagtgtgt

SEQ ID NO: 5973156 - DNA, 17 bp, Homo sapiens
gaccagggatgctgggc

SEQ ID NO: 5973157 - DNA, 20 bp, Homo sapiens
gaccagggatgctgggctgg

SEQ ID NO: 5973158 - DNA, 21 bp, Homo sapiens
gaccagggatgctgggctggg

SEQ ID NO: 5973159 - DNA, 18 bp, Homo sapiens
gaccagggatttccatga

SEQ ID NO: 5973160 - DNA, 21 bp, Homo sapiens
gaccagggcaaggccccttcc

SEQ ID NO: 5973161 - DNA, 14 bp, Homo sapiens
gaccagggcagggc

SEQ ID NO: 5973162 - DNA, 11 bp, Homo sapiens
gaccagggctc

SEQ ID NO: 5973163 - DNA, 21 bp, Homo sapiens
gaccagggctccagcccctct

SEQ ID NO: 5973164 - DNA, 23 bp, Homo sapiens
gaccagggcttttcccaggaata

SEQ ID NO: 5973165 - DNA, 17 bp, Homo sapiens
gaccaggggccctacct

SEQ ID NO: 5973166 - DNA, 18 bp, Homo sapiens
gaccaggggccctacctg

SEQ ID NO: 5973167 - DNA, 22 bp, Homo sapiens
gaccaggggtgatttcagagag

SEQ ID NO: 5973168 - DNA, 23 bp, Homo sapiens
gaccaggggtgatttcagagagg

SEQ ID NO: 5973169 - DNA, 23 bp, Homo sapiens
gaccagggtggagctgagaagag

SEQ ID NO: 5973170 - DNA, 21 bp, Homo sapiens
gaccagggtggccacacaggc

SEQ ID NO: 5973171 - DNA, 16 bp, Homo sapiens
gaccaggtcctgctcc

SEQ ID NO: 5973172 - DNA, 22 bp, Homo sapiens
gaccaggtcttggagctgagcc

SEQ ID NO: 5973173 - DNA, 17 bp, Homo sapiens
gaccaggtggaattact

SEQ ID NO: 5973174 - DNA, 18 bp, Homo sapiens
gaccaggtggaattactt

SEQ ID NO: 5973175 - DNA, 20 bp, Homo sapiens
gaccaggtgtctagaggcaa

SEQ ID NO: 5973176 - DNA, 18 bp, Homo sapiens
gaccaggtttgcaggagc

SEQ ID NO: 5973177 - DNA, 19 bp, Homo sapiens
gaccaggtttgcaggagcc

SEQ ID NO: 5973178 - DNA, 14 bp, Homo sapiens
gaccagtactggga

SEQ ID NO: 5973179 - DNA, 20 bp, Homo sapiens
gaccagtactgggaaggagg

SEQ ID NO: 5973180 - DNA, 13 bp, Homo sapiens
gaccagtagtgac

SEQ ID NO: 5973181 - DNA, 22 bp, Homo sapiens
gaccagtcaggatgaggccccg

SEQ ID NO: 5973182 - DNA, 18 bp, Homo sapiens
gaccagtcccacaccgct

SEQ ID NO: 5973183 - DNA, 15 bp, Homo sapiens
gaccagtctgaccct

SEQ ID NO: 5973184 - DNA, 17 bp, Homo sapiens
gaccagtgaccccagaa

SEQ ID NO: 5973185 - DNA, 22 bp, Homo sapiens
gaccagtgataatgccccaagg

SEQ ID NO: 5973186 - DNA, 22 bp, Homo sapiens
gaccagtggtttccagtcatga

SEQ ID NO: 5973187 - DNA, 20 bp, Homo sapiens
gaccagttccctcagccctc

SEQ ID NO: 5973188 - DNA, 15 bp, Homo sapiens
gaccagttgcacttg

SEQ ID NO: 5973189 - DNA, 14 bp, Homo sapiens
gaccagttgcagtc

SEQ ID NO: 5973190 - DNA, 22 bp, Homo sapiens
gaccagttgcagtcactctagt

SEQ ID NO: 5973191 - DNA, 17 bp, Homo sapiens
gaccagttgggagcact

SEQ ID NO: 5973192 - DNA, 20 bp, Homo sapiens
gaccagttgggagcactgga

SEQ ID NO: 5973193 - DNA, 18 bp, Homo sapiens
gaccagtttaagccgcag

SEQ ID NO: 5973194 - DNA, 14 bp, Homo sapiens
gaccagtttcttaa

SEQ ID NO: 5973195 - DNA, 13 bp, Homo sapiens
gaccagtttcttt

SEQ ID NO: 5973196 - DNA, 22 bp, Homo sapiens
gaccataaagggtgtaggggcc

SEQ ID NO: 5973197 - DNA, 16 bp, Homo sapiens
gaccataacagtgcca

SEQ ID NO: 5973198 - DNA, 18 bp, Homo sapiens
gaccataagagaaacctg

SEQ ID NO: 5973199 - DNA, 13 bp, Homo sapiens
gaccatactcaga

SEQ ID NO: 5973200 - DNA, 18 bp, Homo sapiens
gaccatataactgtgatg

SEQ ID NO: 5973201 - DNA, 13 bp, Homo sapiens
gaccatcactgag

SEQ ID NO: 5973202 - DNA, 22 bp, Homo sapiens
gaccatcactgagagtcaggag

SEQ ID NO: 5973203 - DNA, 16 bp, Homo sapiens
gaccatcatgccctct

SEQ ID NO: 5973204 - DNA, 12 bp, Homo sapiens
gaccatccctga

SEQ ID NO: 5973205 - DNA, 13 bp, Homo sapiens
gaccatccctgaa

SEQ ID NO: 5973206 - DNA, 14 bp, Homo sapiens
gaccatccctgaag

SEQ ID NO: 5973207 - DNA, 17 bp, Homo sapiens
gaccatccctgaaggcc

SEQ ID NO: 5973208 - DNA, 13 bp, Homo sapiens
gaccatcctattt

SEQ ID NO: 5973209 - DNA, 15 bp, Homo sapiens
gaccatcctggcccc

SEQ ID NO: 5973210 - DNA, 13 bp, Homo sapiens
gaccatcctggct

SEQ ID NO: 5973211 - DNA, 14 bp, Homo sapiens
gaccatcctggcta

SEQ ID NO: 5973212 - DNA, 13 bp, Homo sapiens
gaccatcctgtcc

SEQ ID NO: 5973213 - DNA, 14 bp, Homo sapiens
gaccatcctgtcct

SEQ ID NO: 5973214 - DNA, 18 bp, Homo sapiens
gaccatcgtccagccctc

SEQ ID NO: 5973215 - DNA, 19 bp, Homo sapiens
gaccatcgtccagccctcc

SEQ ID NO: 5973216 - DNA, 22 bp, Homo sapiens
gaccatctctccctcctggtga

SEQ ID NO: 5973217 - DNA, 13 bp, Homo sapiens
gaccatctgctgc

SEQ ID NO: 5973218 - DNA, 16 bp, Homo sapiens
gaccatctgctgcagt

SEQ ID NO: 5973219 - DNA, 17 bp, Homo sapiens
gaccatctgcttttatt

SEQ ID NO: 5973220 - DNA, 12 bp, Homo sapiens
gaccatctgtga

SEQ ID NO: 5973221 - DNA, 14 bp, Homo sapiens
gaccatctgtgact

SEQ ID NO: 5973222 - DNA, 23 bp, Homo sapiens
gaccatctgtgactataaagctg

SEQ ID NO: 5973223 - DNA, 19 bp, Homo sapiens
gaccatctttagcagtttc

SEQ ID NO: 5973224 - DNA, 12 bp, Homo sapiens
gaccatgaaaca

SEQ ID NO: 5973225 - DNA, 16 bp, Homo sapiens
gaccatgaggtggggg

SEQ ID NO: 5973226 - DNA, 17 bp, Homo sapiens
gaccatgccagacccac

SEQ ID NO: 5973227 - DNA, 21 bp, Homo sapiens
gaccatgctgagacatccctc

SEQ ID NO: 5973228 - DNA, 22 bp, Homo sapiens
gaccatgctgtctggcacagcc

SEQ ID NO: 5973229 - DNA, 23 bp, Homo sapiens
gaccatgctgtctggcacagcct

SEQ ID NO: 5973230 - DNA, 16 bp, Homo sapiens
gaccatggacactaca

SEQ ID NO: 5973231 - DNA, 21 bp, Homo sapiens
gaccatggacactacacccag

SEQ ID NO: 5973232 - DNA, 18 bp, Homo sapiens
gaccatggagtggcagcc

SEQ ID NO: 5973233 - DNA, 21 bp, Homo sapiens
gaccatggagtggcagcccag

SEQ ID NO: 5973234 - DNA, 14 bp, Homo sapiens
gaccatgggaaatg

SEQ ID NO: 5973235 - DNA, 13 bp, Homo sapiens
gaccatggggagg

SEQ ID NO: 5973236 - DNA, 18 bp, Homo sapiens
gaccatggggtggaagga

SEQ ID NO: 5973237 - DNA, 22 bp, Homo sapiens
gaccatggttaagagtccaaga

SEQ ID NO: 5973238 - DNA, 20 bp, Homo sapiens
gaccatggttttggctctcc

SEQ ID NO: 5973239 - DNA, 12 bp, Homo sapiens
gaccatgtgaat

SEQ ID NO: 5973240 - DNA, 20 bp, Homo sapiens
gaccatgtgattatggacat

SEQ ID NO: 5973241 - DNA, 15 bp, Homo sapiens
gaccatgtgtcactt

SEQ ID NO: 5973242 - DNA, 15 bp, Homo sapiens
gaccattaataaaga

SEQ ID NO: 5973243 - DNA, 15 bp, Homo sapiens
gaccctcctgttgca

SEQ ID NO: 5973244 - DNA, 18 bp, Homo sapiens
gaccctcctgttgcaccc

SEQ ID NO: 5973245 - DNA, 19 bp, Homo sapiens
gaccctccttccccacccc

SEQ ID NO: 5973246 - DNA, 22 bp, Homo sapiens
gaccctcgagattaacggtgct

SEQ ID NO: 5973247 - DNA, 17 bp, Homo sapiens
gaccctcgcagcaggtg

SEQ ID NO: 5973248 - DNA, 19 bp, Homo sapiens
gaccctcgcagcaggtgca

SEQ ID NO: 5973249 - DNA, 18 bp, Homo sapiens
gaccctcgctctctgtct

SEQ ID NO: 5973250 - DNA, 15 bp, Homo sapiens
gaccctcgctggccc

SEQ ID NO: 5973251 - DNA, 17 bp, Homo sapiens
gaccctcgtttgatagt

SEQ ID NO: 5973252 - DNA, 19 bp, Homo sapiens
gaccctctatttacctgcg

SEQ ID NO: 5973253 - DNA, 15 bp, Homo sapiens
gaccctctccacccc

SEQ ID NO: 5973254 - DNA, 11 bp, Homo sapiens
gaccctctgct

SEQ ID NO: 5973255 - DNA, 14 bp, Homo sapiens
gaccctctgggaac

SEQ ID NO: 5973256 - DNA, 20 bp, Homo sapiens
gaccctctgggaacctccca

SEQ ID NO: 5973257 - DNA, 19 bp, Homo sapiens
gaccctctgtccccaggcc

SEQ ID NO: 5973258 - DNA, 22 bp, Homo sapiens
gaccctctgtccccaggcctgg

SEQ ID NO: 5973259 - DNA, 14 bp, Homo sapiens
gaccctcttgccca

SEQ ID NO: 5973260 - DNA, 22 bp, Homo sapiens
gaccctcttgcccatcctgact

SEQ ID NO: 5973261 - DNA, 16 bp, Homo sapiens
gaccctctttcttgtt

SEQ ID NO: 5973262 - DNA, 20 bp, Homo sapiens
gaccctctttgctgaagaat

SEQ ID NO: 5973263 - DNA, 21 bp, Homo sapiens
gaccctgaaaagaaggacggg

SEQ ID NO: 5973264 - DNA, 16 bp, Homo sapiens
gaccctgaaatgtgtg

SEQ ID NO: 5973265 - DNA, 20 bp, Homo sapiens
gaccctgaaatgtgtgtgat

SEQ ID NO: 5973266 - DNA, 23 bp, Homo sapiens
gaccctgaatccgtacttgggtc

SEQ ID NO: 5973267 - DNA, 17 bp, Homo sapiens
gaccctgaccagctccc

SEQ ID NO: 5973268 - DNA, 18 bp, Homo sapiens
gaccctgaccagctcccc

SEQ ID NO: 5973269 - DNA, 23 bp, Homo sapiens
gaccctgaccagctccccctccc

SEQ ID NO: 5973270 - DNA, 16 bp, Homo sapiens
gaccctgacctccgcc

SEQ ID NO: 5973271 - DNA, 20 bp, Homo sapiens
gaccctgacctccgcccctg

SEQ ID NO: 5973272 - DNA, 22 bp, Homo sapiens
gaccctgacctccgcccctgcc

SEQ ID NO: 5973273 - DNA, 13 bp, Homo sapiens
gaccctgagactc

SEQ ID NO: 5973274 - DNA, 17 bp, Homo sapiens
gaccctgagactccaga

SEQ ID NO: 5973275 - DNA, 12 bp, Homo sapiens
gaccctgaggcc

SEQ ID NO: 5973276 - DNA, 19 bp, Homo sapiens
gaccctgaggcccagaggg

SEQ ID NO: 5973277 - DNA, 20 bp, Homo sapiens
gaccctgaggcccagagggc

SEQ ID NO: 5973278 - DNA, 21 bp, Homo sapiens
gaccctgaggcccagagggcc

SEQ ID NO: 5973279 - DNA, 14 bp, Homo sapiens
gaccctgaggccct

SEQ ID NO: 5973280 - DNA, 17 bp, Homo sapiens
gaccctgaggccctggg

SEQ ID NO: 5973281 - DNA, 19 bp, Homo sapiens
gaccctgagtccgggaggc

SEQ ID NO: 5973282 - DNA, 15 bp, Homo sapiens
gaccctgatgcaggt

SEQ ID NO: 5973283 - DNA, 22 bp, Homo sapiens
gaccctgcaaacagaacagggt

SEQ ID NO: 5973284 - DNA, 13 bp, Homo sapiens
gaccctgcaccct

SEQ ID NO: 5973285 - DNA, 16 bp, Homo sapiens
gaccctgcaccctcct

SEQ ID NO: 5973286 - DNA, 15 bp, Homo sapiens
gaccctgcagagatg

SEQ ID NO: 5973287 - DNA, 13 bp, Homo sapiens
gaccctgccacag

SEQ ID NO: 5973288 - DNA, 17 bp, Homo sapiens
gaccctgccacagccag

SEQ ID NO: 5973289 - DNA, 19 bp, Homo sapiens
gaccctgccacagccagag

SEQ ID NO: 5973290 - DNA, 20 bp, Homo sapiens
gaccctgccacagccagagg

SEQ ID NO: 5973291 - DNA, 23 bp, Homo sapiens
gaccctgccacagccagaggagg

SEQ ID NO: 5973292 - DNA, 20 bp, Homo sapiens
gaccctgccaggcacaggca

SEQ ID NO: 5973293 - DNA, 22 bp, Homo sapiens
gaccctgccaggcacaggcagg

SEQ ID NO: 5973294 - DNA, 12 bp, Homo sapiens
gaccctgcccac

SEQ ID NO: 5973295 - DNA, 21 bp, Homo sapiens
gaccctgcccaccccatccct

SEQ ID NO: 5973296 - DNA, 22 bp, Homo sapiens
gaccctgcccatacccctgcct

SEQ ID NO: 5973297 - DNA, 15 bp, Homo sapiens
gaccctgcccccact

SEQ ID NO: 5973298 - DNA, 13 bp, Homo sapiens
gaccctgccctgg

SEQ ID NO: 5973299 - DNA, 19 bp, Homo sapiens
gaccctgccctgggcgagc

SEQ ID NO: 5973300 - DNA, 20 bp, Homo sapiens
gaccctgccctgggcgagcc

SEQ ID NO: 5973301 - DNA, 15 bp, Homo sapiens
gaccctgccctgtgg

SEQ ID NO: 5973302 - DNA, 20 bp, Homo sapiens
gaccctgccctgtgggcccc

SEQ ID NO: 5973303 - DNA, 23 bp, Homo sapiens
gaccctgcccttgtttggggcag

SEQ ID NO: 5973304 - DNA, 16 bp, Homo sapiens
gaccctgccgaggggg

SEQ ID NO: 5973305 - DNA, 17 bp, Homo sapiens
gaccctgccgagggggc

SEQ ID NO: 5973306 - DNA, 15 bp, Homo sapiens
gaccctgcctcagct

SEQ ID NO: 5973307 - DNA, 13 bp, Homo sapiens
gaccctgcctctc

SEQ ID NO: 5973308 - DNA, 16 bp, Homo sapiens
gaccctgcctctccca

SEQ ID NO: 5973309 - DNA, 21 bp, Homo sapiens
gaccctgcctctcccaggcag

SEQ ID NO: 5973310 - DNA, 21 bp, Homo sapiens
gaccctgcctgagcccaggag

SEQ ID NO: 5973311 - DNA, 21 bp, Homo sapiens
gaccctgcgaaggggccctgg

SEQ ID NO: 5973312 - DNA, 22 bp, Homo sapiens
gaccctgcgaaggggccctggt

SEQ ID NO: 5973313 - DNA, 22 bp, Homo sapiens
gaccctgcgcccctgcccagca

SEQ ID NO: 5973314 - DNA, 18 bp, Homo sapiens
gaccctgctcacaggcag

SEQ ID NO: 5973315 - DNA, 11 bp, Homo sapiens
gaccctggaat

SEQ ID NO: 5973316 - DNA, 22 bp, Homo sapiens
gaccctggaattcagcaccctg

SEQ ID NO: 5973317 - DNA, 16 bp, Homo sapiens
gaccctggaggcccca

SEQ ID NO: 5973318 - DNA, 18 bp, Homo sapiens
gaccctggagtatttgga

SEQ ID NO: 5973319 - DNA, 20 bp, Homo sapiens
gaccctggcaccgcattaga

SEQ ID NO: 5973320 - DNA, 18 bp, Homo sapiens
gaccctggcctcaagtta

SEQ ID NO: 5973321 - DNA, 23 bp, Homo sapiens
gaccctggctccttgtgccagag

SEQ ID NO: 5973322 - DNA, 12 bp, Homo sapiens
gaccctggctct

SEQ ID NO: 5973323 - DNA, 15 bp, Homo sapiens
gaccctggctctgcc

SEQ ID NO: 5973324 - DNA, 16 bp, Homo sapiens
gaccctggctctgcca

SEQ ID NO: 5973325 - DNA, 17 bp, Homo sapiens
gaccctggctctgccag

SEQ ID NO: 5973326 - DNA, 14 bp, Homo sapiens
gaccctggctcttc

SEQ ID NO: 5973327 - DNA, 16 bp, Homo sapiens
gaccctggctcttctc

SEQ ID NO: 5973328 - DNA, 23 bp, Homo sapiens
gaccctggctcttctctcggggc

SEQ ID NO: 5973329 - DNA, 15 bp, Homo sapiens
gaccctggctttcat

SEQ ID NO: 5973330 - DNA, 18 bp, Homo sapiens
gaccctgggagagtgagg

SEQ ID NO: 5973331 - DNA, 21 bp, Homo sapiens
gaccctgggagagtgaggtca

SEQ ID NO: 5973332 - DNA, 17 bp, Homo sapiens
gaccctgggcagggact

SEQ ID NO: 5973333 - DNA, 13 bp, Homo sapiens
gaccctgggcagt

SEQ ID NO: 5973334 - DNA, 16 bp, Homo sapiens
gaccctgggcctggag

SEQ ID NO: 5973335 - DNA, 11 bp, Homo sapiens
gaccctggggg

SEQ ID NO: 5973336 - DNA, 17 bp, Homo sapiens
gaccctgggggcacagg

SEQ ID NO: 5973337 - DNA, 22 bp, Homo sapiens
gaccctgggtcaccttcctggg

SEQ ID NO: 5973338 - DNA, 14 bp, Homo sapiens
gaccctgggtggga

SEQ ID NO: 5973339 - DNA, 18 bp, Homo sapiens
gaccctgggtgggctctg

SEQ ID NO: 5973340 - DNA, 22 bp, Homo sapiens
gaccctggtgacctcctgtcac

SEQ ID NO: 5973341 - DNA, 17 bp, Homo sapiens
gaccctggtgcctggct

SEQ ID NO: 5973342 - DNA, 18 bp, Homo sapiens
gaccctggtgcctggctc

SEQ ID NO: 5973343 - DNA, 18 bp, Homo sapiens
gaccctggtggtacctgt

SEQ ID NO: 5973344 - DNA, 20 bp, Homo sapiens
gaccctggttactctggtgc

SEQ ID NO: 5973345 - DNA, 12 bp, Homo sapiens
gaccctgtaaat

SEQ ID NO: 5973346 - DNA, 19 bp, Homo sapiens
gaccctgtcaggattgcag

SEQ ID NO: 5973347 - DNA, 15 bp, Homo sapiens
gaccctgtcctgcag

SEQ ID NO: 5973348 - DNA, 12 bp, Homo sapiens
gaccctgtctca

SEQ ID NO: 5973349 - DNA, 12 bp, Homo sapiens
gaccctgtctct

SEQ ID NO: 5973350 - DNA, 17 bp, Homo sapiens
gaccctgtcttctgggc

SEQ ID NO: 5973351 - DNA, 22 bp, Homo sapiens
gaccctgtgatgcctgacacag

SEQ ID NO: 5973352 - DNA, 14 bp, Homo sapiens
gaccctgtgccctc

SEQ ID NO: 5973353 - DNA, 17 bp, Homo sapiens
gaccctgtgcctgtgtt

SEQ ID NO: 5973354 - DNA, 21 bp, Homo sapiens
gaccctgtgtcctccaccatg

SEQ ID NO: 5973355 - DNA, 16 bp, Homo sapiens
gaccctgttgctaagc

SEQ ID NO: 5973356 - DNA, 21 bp, Homo sapiens
gaccctgttgctaagccccag

SEQ ID NO: 5973357 - DNA, 16 bp, Homo sapiens
gacccttattgctgtc

SEQ ID NO: 5973358 - DNA, 22 bp, Homo sapiens
gacccttcccagccctcatccc

SEQ ID NO: 5973359 - DNA, 18 bp, Homo sapiens
gacccttctactttttcc

SEQ ID NO: 5973360 - DNA, 17 bp, Homo sapiens
gacccttctccaaaggc

SEQ ID NO: 5973361 - DNA, 21 bp, Homo sapiens
gacccttcttgcctgctgggc

SEQ ID NO: 5973362 - DNA, 21 bp, Homo sapiens
gacccttgaagatgtagcttc

SEQ ID NO: 5973363 - DNA, 20 bp, Homo sapiens
gacccttgccgtctacctga

SEQ ID NO: 5973364 - DNA, 16 bp, Homo sapiens
gacccttgcctgcctc

SEQ ID NO: 5973365 - DNA, 22 bp, Homo sapiens
gacccttgcctgcctcctaggc

SEQ ID NO: 5973366 - DNA, 16 bp, Homo sapiens
gacccttggaaaacaa

SEQ ID NO: 5973367 - DNA, 21 bp, Homo sapiens
gacccttggcctccatttctg

SEQ ID NO: 5973368 - DNA, 15 bp, Homo sapiens
gacccttgggcctgg

SEQ ID NO: 5973369 - DNA, 21 bp, Homo sapiens
gacccttggtgtttcccttcc

SEQ ID NO: 5973370 - DNA, 15 bp, Homo sapiens
gacccttgtggtccc

SEQ ID NO: 5973371 - DNA, 19 bp, Homo sapiens
gacccttgtggtcccaccc

SEQ ID NO: 5973372 - DNA, 12 bp, Homo sapiens
gaccctttcctc

SEQ ID NO: 5973373 - DNA, 14 bp, Homo sapiens
gaccctttcctccc

SEQ ID NO: 5973374 - DNA, 17 bp, Homo sapiens
gacccttttccttagct

SEQ ID NO: 5973375 - DNA, 13 bp, Homo sapiens
gacccttttctga

SEQ ID NO: 5973376 - DNA, 15 bp, Homo sapiens
gacccttttgtgtct

SEQ ID NO: 5973377 - DNA, 23 bp, Homo sapiens
gaccgaaatctgtattctgtttg

SEQ ID NO: 5973378 - DNA, 19 bp, Homo sapiens
gaccgaactgttgtataaa

SEQ ID NO: 5973379 - DNA, 15 bp, Homo sapiens
gaccgaaggtgacag

SEQ ID NO: 5973380 - DNA, 15 bp, Homo sapiens
gaccgacgatccctc

SEQ ID NO: 5973381 - DNA, 14 bp, Homo sapiens
gaccgactacccca

SEQ ID NO: 5973382 - DNA, 16 bp, Homo sapiens
gaccgagccctggaga

SEQ ID NO: 5973383 - DNA, 17 bp, Homo sapiens
gaccgagccctggagag

SEQ ID NO: 5973384 - DNA, 18 bp, Homo sapiens
gaccgaggagggagagtc

SEQ ID NO: 5973385 - DNA, 17 bp, Homo sapiens
gaccgaggccctcccaa

SEQ ID NO: 5973386 - DNA, 19 bp, Homo sapiens
gaccgaggccctcccaaag

SEQ ID NO: 5973387 - DNA, 22 bp, Homo sapiens
gaccgaggctacagctccacac

SEQ ID NO: 5973388 - DNA, 15 bp, Homo sapiens
gaccgcatcctccag

SEQ ID NO: 5973389 - DNA, 16 bp, Homo sapiens
gaccgccagatggggc

SEQ ID NO: 5973390 - DNA, 15 bp, Homo sapiens
gaccgcccagctctc

SEQ ID NO: 5973391 - DNA, 15 bp, Homo sapiens
gaccgccccaaccct

SEQ ID NO: 5973392 - DNA, 15 bp, Homo sapiens
gaccgccccagggct

SEQ ID NO: 5973393 - DNA, 12 bp, Homo sapiens
gaccgccccctc

SEQ ID NO: 5973394 - DNA, 15 bp, Homo sapiens
gaccgccccctcctc

SEQ ID NO: 5973395 - DNA, 15 bp, Homo sapiens
gaccgccccctgtct

SEQ ID NO: 5973396 - DNA, 17 bp, Homo sapiens
gaccgccgatcccaggt

SEQ ID NO: 5973397 - DNA, 19 bp, Homo sapiens
gaccgccgcttccagcttc

SEQ ID NO: 5973398 - DNA, 20 bp, Homo sapiens
gaccgcctgccctgcctggg

SEQ ID NO: 5973399 - DNA, 15 bp, Homo sapiens
gaccgcctgcttcac

SEQ ID NO: 5973400 - DNA, 21 bp, Homo sapiens
gaccgcctgcttcacacccct

SEQ ID NO: 5973401 - DNA, 13 bp, Homo sapiens
gaccgcctggccc

SEQ ID NO: 5973402 - DNA, 14 bp, Homo sapiens
gaccgcctggccct

SEQ ID NO: 5973403 - DNA, 15 bp, Homo sapiens
gaccgcctggccctc

SEQ ID NO: 5973404 - DNA, 18 bp, Homo sapiens
gaccgcctggccctccct

SEQ ID NO: 5973405 - DNA, 20 bp, Homo sapiens
gaccgctacaccactctggc

SEQ ID NO: 5973406 - DNA, 22 bp, Homo sapiens
gaccgctacaccactctggcag

SEQ ID NO: 5973407 - DNA, 16 bp, Homo sapiens
gaccgctgataagcat

SEQ ID NO: 5973408 - DNA, 13 bp, Homo sapiens
gaccgctgcccag

SEQ ID NO: 5973409 - DNA, 18 bp, Homo sapiens
gaccggaattgagaggtg

SEQ ID NO: 5973410 - DNA, 19 bp, Homo sapiens
gaccggaattgagaggtgg

SEQ ID NO: 5973411 - DNA, 17 bp, Homo sapiens
gaccggagagtgggggt

SEQ ID NO: 5973412 - DNA, 14 bp, Homo sapiens
gaccggcagagctc

SEQ ID NO: 5973413 - DNA, 16 bp, Homo sapiens
gaccggcccgccacct

SEQ ID NO: 5973414 - DNA, 16 bp, Homo sapiens
gaccggccgcagcccc

SEQ ID NO: 5973415 - DNA, 22 bp, Homo sapiens
gaccggccgcagcccccactga

SEQ ID NO: 5973416 - DNA, 17 bp, Homo sapiens
gaccggcctgccaggag

SEQ ID NO: 5973417 - DNA, 12 bp, Homo sapiens
gaccggcctgga

SEQ ID NO: 5973418 - DNA, 19 bp, Homo sapiens
gaccggcggaccccagcca

SEQ ID NO: 5973419 - DNA, 20 bp, Homo sapiens
gaccggcggaccccagccat

SEQ ID NO: 5973420 - DNA, 12 bp, Homo sapiens
gaccggctgccg

SEQ ID NO: 5973421 - DNA, 19 bp, Homo sapiens
ggcggaacctggctgcgaa

SEQ ID NO: 5973422 - DNA, 21 bp, Homo sapiens
ggcggaccttgtagtgagccg

SEQ ID NO: 5973423 - DNA, 17 bp, Homo sapiens
ggcggacgttccagccg

SEQ ID NO: 5973424 - DNA, 18 bp, Homo sapiens
ggcggagccccggctctt

SEQ ID NO: 5973425 - DNA, 22 bp, Homo sapiens
ggcggagccttcccgggcgggc

SEQ ID NO: 5973426 - DNA, 16 bp, Homo sapiens
ggcggagctctggctt

SEQ ID NO: 5973427 - DNA, 20 bp, Homo sapiens
ggcggagcttgcagtgagcc

SEQ ID NO: 5973428 - DNA, 21 bp, Homo sapiens
ggcggagcttgcagtgagccg

SEQ ID NO: 5973429 - DNA, 12 bp, Homo sapiens
ggcggaggagga

SEQ ID NO: 5973430 - DNA, 14 bp, Homo sapiens
ggcggaggaggaca

SEQ ID NO: 5973431 - DNA, 11 bp, Homo sapiens
ggcggaggcgg

SEQ ID NO: 5973432 - DNA, 13 bp, Homo sapiens
ggcggaggcggct

SEQ ID NO: 5973433 - DNA, 15 bp, Homo sapiens
ggcggagggagggga

SEQ ID NO: 5973434 - DNA, 21 bp, Homo sapiens
ggcggaggggatccagccact

SEQ ID NO: 5973435 - DNA, 20 bp, Homo sapiens
ggcggagggtctccctgggc

SEQ ID NO: 5973436 - DNA, 15 bp, Homo sapiens
ggcggaggtctctgg

SEQ ID NO: 5973437 - DNA, 18 bp, Homo sapiens
ggcggatcacctgaggtc

SEQ ID NO: 5973438 - DNA, 21 bp, Homo sapiens
ggcggatccgcggggaccctg

SEQ ID NO: 5973439 - DNA, 17 bp, Homo sapiens
ggcggcacgtccttggg

SEQ ID NO: 5973440 - DNA, 21 bp, Homo sapiens
ggcggcacgtccttgggcgtc

SEQ ID NO: 5973441 - DNA, 14 bp, Homo sapiens
ggcggcagggctgg

SEQ ID NO: 5973442 - DNA, 16 bp, Homo sapiens
ggcggcaggggtcgcg

SEQ ID NO: 5973443 - DNA, 11 bp, Homo sapiens
ggcggccaggc

SEQ ID NO: 5973444 - DNA, 13 bp, Homo sapiens
ggcggccaggcac

SEQ ID NO: 5973445 - DNA, 16 bp, Homo sapiens
ggcggccaggcacagg

SEQ ID NO: 5973446 - DNA, 19 bp, Homo sapiens
ggcggccaggcacagggcc

SEQ ID NO: 5973447 - DNA, 21 bp, Homo sapiens
ggcggccaggcacagggcccg

SEQ ID NO: 5973448 - DNA, 22 bp, Homo sapiens
ggcggccaggcacagggcccgc

SEQ ID NO: 5973449 - DNA, 17 bp, Homo sapiens
ggcggccagggaccccc

SEQ ID NO: 5973450 - DNA, 19 bp, Homo sapiens
ggcggccagggcggccagg

SEQ ID NO: 5973451 - DNA, 17 bp, Homo sapiens
ggcggccatgatggtgc

SEQ ID NO: 5973452 - DNA, 14 bp, Homo sapiens
ggcggcccacgcca

SEQ ID NO: 5973453 - DNA, 19 bp, Homo sapiens
ggcggcccacgccagctgg

SEQ ID NO: 5973454 - DNA, 22 bp, Homo sapiens
ggcggcccacgccagctggccc

SEQ ID NO: 5973455 - DNA, 15 bp, Homo sapiens
ggcggcccagcctct

SEQ ID NO: 5973456 - DNA, 18 bp, Homo sapiens
ggcggcccctcagcctgc

SEQ ID NO: 5973457 - DNA, 20 bp, Homo sapiens
ggcggcccctcagcctgcct

SEQ ID NO: 5973458 - DNA, 17 bp, Homo sapiens
ggcggcccctcccgccc

SEQ ID NO: 5973459 - DNA, 21 bp, Homo sapiens
ggcggcccctggacgaaggtc

SEQ ID NO: 5973460 - DNA, 16 bp, Homo sapiens
ggcggcccggccagcg

SEQ ID NO: 5973461 - DNA, 18 bp, Homo sapiens
ggcggcccggccagcggg

SEQ ID NO: 5973462 - DNA, 19 bp, Homo sapiens
ggcggcccggccagcgggc

SEQ ID NO: 5973463 - DNA, 14 bp, Homo sapiens
ggcggcccgtggac

SEQ ID NO: 5973464 - DNA, 21 bp, Homo sapiens
ggcggccctgctgaagctgct

SEQ ID NO: 5973465 - DNA, 19 bp, Homo sapiens
ggcggcccttctgactgtt

SEQ ID NO: 5973466 - DNA, 22 bp, Homo sapiens
ggcggcccttctgactgtttat

SEQ ID NO: 5973467 - DNA, 14 bp, Homo sapiens
ggcggcctcccagg

SEQ ID NO: 5973468 - DNA, 18 bp, Homo sapiens
ggcggcctgcagaccctg

SEQ ID NO: 5973469 - DNA, 15 bp, Homo sapiens
ggcggcctgcagtgg

SEQ ID NO: 5973470 - DNA, 14 bp, Homo sapiens
ggcggcctgtgggt

SEQ ID NO: 5973471 - DNA, 14 bp, Homo sapiens
ggcggcgcagaggg

SEQ ID NO: 5973472 - DNA, 16 bp, Homo sapiens
ggcggcgcagagggaa

SEQ ID NO: 5973473 - DNA, 23 bp, Homo sapiens
ggcggcgtgggcgaggcctgaca

SEQ ID NO: 5973474 - DNA, 14 bp, Homo sapiens
ggcggctaggccgg

SEQ ID NO: 5973475 - DNA, 15 bp, Homo sapiens
ggcggctcctcctca

SEQ ID NO: 5973476 - DNA, 13 bp, Homo sapiens
ggcggctcctggt

SEQ ID NO: 5973477 - DNA, 16 bp, Homo sapiens
ggcggctcctggtgct

SEQ ID NO: 5973478 - DNA, 19 bp, Homo sapiens
ggcggctctgagcaggggc

SEQ ID NO: 5973479 - DNA, 12 bp, Homo sapiens
ggcggctctggg

SEQ ID NO: 5973480 - DNA, 14 bp, Homo sapiens
ggcggctgagagcc

SEQ ID NO: 5973481 - DNA, 21 bp, Homo sapiens
ggcggctgcacaacagccctg

SEQ ID NO: 5973482 - DNA, 22 bp, Homo sapiens
ggcggctgcacaacagccctgc

SEQ ID NO: 5973483 - DNA, 19 bp, Homo sapiens
ggcggctggaaagaggaga

SEQ ID NO: 5973484 - DNA, 17 bp, Homo sapiens
ggcggcttcctgtccac

SEQ ID NO: 5973485 - DNA, 18 bp, Homo sapiens
ggcggcttcctgtccact

SEQ ID NO: 5973486 - DNA, 15 bp, Homo sapiens
ggcgggaagggtggg

SEQ ID NO: 5973487 - DNA, 17 bp, Homo sapiens
ggcgggactcctccctg

SEQ ID NO: 5973488 - DNA, 14 bp, Homo sapiens
ggcgggagaactga

SEQ ID NO: 5973489 - DNA, 24 bp, Homo sapiens
ggcgggcactgggtacccaagtga

SEQ ID NO: 5973490 - DNA, 15 bp, Homo sapiens
ggcgggcagcacagc

SEQ ID NO: 5973491 - DNA, 18 bp, Homo sapiens
ggcgggcagcccctgctg

SEQ ID NO: 5973492 - DNA, 22 bp, Homo sapiens
ggcgggcagcccctgctggacc

SEQ ID NO: 5973493 - DNA, 23 bp, Homo sapiens
ggcgggcagcccctgctggacca

SEQ ID NO: 5973494 - DNA, 17 bp, Homo sapiens
ggcgggccagccaggcg

SEQ ID NO: 5973495 - DNA, 20 bp, Homo sapiens
ggcgggccagggtgggaaga

SEQ ID NO: 5973496 - DNA, 23 bp, Homo sapiens
ggcgggccatgagggacagggtc

SEQ ID NO: 5973497 - DNA, 14 bp, Homo sapiens
ggcgggcccctcat

SEQ ID NO: 5973498 - DNA, 21 bp, Homo sapiens
ggcgggcctgtttggtgagga

SEQ ID NO: 5973499 - DNA, 20 bp, Homo sapiens
ggcgggcctttttcctgcgt

SEQ ID NO: 5973500 - DNA, 20 bp, Homo sapiens
ggcgggcgaatcacgaggtc

SEQ ID NO: 5973501 - DNA, 12 bp, Homo sapiens
ggcgggctcctt

SEQ ID NO: 5973502 - DNA, 21 bp, Homo sapiens
ggcggggaagggtgcatagct

SEQ ID NO: 5973503 - DNA, 14 bp, Homo sapiens
ggcggggaggagga

SEQ ID NO: 5973504 - DNA, 16 bp, Homo sapiens
ggcggggaggaggaaa

SEQ ID NO: 5973505 - DNA, 12 bp, Homo sapiens
ggcggggcagga

SEQ ID NO: 5973506 - DNA, 15 bp, Homo sapiens
ggcggggcaggaggc

SEQ ID NO: 5973507 - DNA, 16 bp, Homo sapiens
ggcggggcaggaggcc

SEQ ID NO: 5973508 - DNA, 17 bp, Homo sapiens
ggcggggcaggaggcct

SEQ ID NO: 5973509 - DNA, 13 bp, Homo sapiens
ggcggggccagga

SEQ ID NO: 5973510 - DNA, 13 bp, Homo sapiens
ggcggggcccctg

SEQ ID NO: 5973511 - DNA, 18 bp, Homo sapiens
ggcggggcccctgctccg

SEQ ID NO: 5973512 - DNA, 13 bp, Homo sapiens
ggcggggctcctc

SEQ ID NO: 5973513 - DNA, 15 bp, Homo sapiens
ggcggggctggaggt

SEQ ID NO: 5973514 - DNA, 15 bp, Homo sapiens
ggcggggctggccag

SEQ ID NO: 5973515 - DNA, 22 bp, Homo sapiens
ggcgggggcaacgattcacagc

SEQ ID NO: 5973516 - DNA, 21 bp, Homo sapiens
ggcgggggcacgtgtgggccg

SEQ ID NO: 5973517 - DNA, 20 bp, Homo sapiens
ggcgggggcccgaaagctga

SEQ ID NO: 5973518 - DNA, 21 bp, Homo sapiens
ggcggggggggcgcctggaga

SEQ ID NO: 5973519 - DNA, 14 bp, Homo sapiens
ggcgggggtggcgg

SEQ ID NO: 5973520 - DNA, 14 bp, Homo sapiens
ggcggggtgtggtg

SEQ ID NO: 5973521 - DNA, 18 bp, Homo sapiens
ggcgggtgatgagacctg

SEQ ID NO: 5973522 - DNA, 19 bp, Homo sapiens
ggcgggtgatgagacctgg

SEQ ID NO: 5973523 - DNA, 20 bp, Homo sapiens
ggcgggtgatggccagcccc

SEQ ID NO: 5973524 - DNA, 22 bp, Homo sapiens
ggcgggtgtggagaccaggctc

SEQ ID NO: 5973525 - DNA, 15 bp, Homo sapiens
ggcggtcccagctcc

SEQ ID NO: 5973526 - DNA, 16 bp, Homo sapiens
ggcggtccccatcccc

SEQ ID NO: 5973527 - DNA, 20 bp, Homo sapiens
ggcggtccccatccccacca

SEQ ID NO: 5973528 - DNA, 17 bp, Homo sapiens
ggcggtgaggtgggggc

SEQ ID NO: 5973529 - DNA, 17 bp, Homo sapiens
ggcggtgccgcgctccg

SEQ ID NO: 5973530 - DNA, 16 bp, Homo sapiens
ggcggtggacaataaa

SEQ ID NO: 5973531 - DNA, 22 bp, Homo sapiens
ggcggtggccacagcgtgctgg

SEQ ID NO: 5973532 - DNA, 14 bp, Homo sapiens
ggcggtggctgccc

SEQ ID NO: 5973533 - DNA, 21 bp, Homo sapiens
ggcggtgggcacccaccctgg

SEQ ID NO: 5973534 - DNA, 16 bp, Homo sapiens
ggcggtgtcaggtccc

SEQ ID NO: 5973535 - DNA, 19 bp, Homo sapiens
ggcggtgtcaggtcccagc

SEQ ID NO: 5973536 - DNA, 14 bp, Homo sapiens
ggcgtaagtacaga

SEQ ID NO: 5973537 - DNA, 15 bp, Homo sapiens
ggcgtaatgggcctg

SEQ ID NO: 5973538 - DNA, 14 bp, Homo sapiens
ggcgtactacccag

SEQ ID NO: 5973539 - DNA, 18 bp, Homo sapiens
ggcgtagggccagggctc

SEQ ID NO: 5973540 - DNA, 23 bp, Homo sapiens
ggcgtcaccatccaccttccctt

SEQ ID NO: 5973541 - DNA, 18 bp, Homo sapiens
ggcgtcagcctccagcct

SEQ ID NO: 5973542 - DNA, 19 bp, Homo sapiens
ggcgtcaggcagaggcaac

SEQ ID NO: 5973543 - DNA, 19 bp, Homo sapiens
ggcgtcaggggtgcacagt

SEQ ID NO: 5973544 - DNA, 15 bp, Homo sapiens
ggcgtcagtcttttt

SEQ ID NO: 5973545 - DNA, 14 bp, Homo sapiens
ggcgtccagctcag

SEQ ID NO: 5973546 - DNA, 11 bp, Homo sapiens
ggcgtcctctc

SEQ ID NO: 5973547 - DNA, 21 bp, Homo sapiens
ggcgtcctctccctcctggcc

SEQ ID NO: 5973548 - DNA, 22 bp, Homo sapiens
ggcgtcgctggacaacccagaa

SEQ ID NO: 5973549 - DNA, 13 bp, Homo sapiens
ggcgtctccccca

SEQ ID NO: 5973550 - DNA, 16 bp, Homo sapiens
ggcgtctcccccagag

SEQ ID NO: 5973551 - DNA, 18 bp, Homo sapiens
ggcgtctcccccagagtg

SEQ ID NO: 5973552 - DNA, 16 bp, Homo sapiens
ggcgtctgactccctc

SEQ ID NO: 5973553 - DNA, 19 bp, Homo sapiens
ggcgtctgactccctcccc

SEQ ID NO: 5973554 - DNA, 20 bp, Homo sapiens
ggcgtctgactccctcccca

SEQ ID NO: 5973555 - DNA, 13 bp, Homo sapiens
ggcgtctgagctg

SEQ ID NO: 5973556 - DNA, 13 bp, Homo sapiens
ggcgtctgctctg

SEQ ID NO: 5973557 - DNA, 16 bp, Homo sapiens
ggcgtctggacgccga

SEQ ID NO: 5973558 - DNA, 16 bp, Homo sapiens
ggcgtctgttccccct

SEQ ID NO: 5973559 - DNA, 19 bp, Homo sapiens
ggcgtcttcatctccctgc

SEQ ID NO: 5973560 - DNA, 12 bp, Homo sapiens
ggcgtcttgccc

SEQ ID NO: 5973561 - DNA, 18 bp, Homo sapiens
ggcgtcttgcccagcagc

SEQ ID NO: 5973562 - DNA, 14 bp, Homo sapiens
ggcgtgaaacacaa

SEQ ID NO: 5973563 - DNA, 15 bp, Homo sapiens
ggcgtgactcaccca

SEQ ID NO: 5973564 - DNA, 14 bp, Homo sapiens
ggcgtgactcagca

SEQ ID NO: 5973565 - DNA, 14 bp, Homo sapiens
ggcgtgagaggcaa

SEQ ID NO: 5973566 - DNA, 18 bp, Homo sapiens
ggcgtgaggcctgggctg

SEQ ID NO: 5973567 - DNA, 23 bp, Homo sapiens
ggcgtgatctcagctcactgcaa

SEQ ID NO: 5973568 - DNA, 18 bp, Homo sapiens
ggcgtgcaaggggctcag

SEQ ID NO: 5973569 - DNA, 19 bp, Homo sapiens
ggcgtgcagtggtgcgatc

SEQ ID NO: 5973570 - DNA, 22 bp, Homo sapiens
ggcgtgcccccctcctccagta

SEQ ID NO: 5973571 - DNA, 16 bp, Homo sapiens
ggcgtgctcagaccca

SEQ ID NO: 5973572 - DNA, 12 bp, Homo sapiens
ggcgtgctcctt

SEQ ID NO: 5973573 - DNA, 18 bp, Homo sapiens
ggcgtggagactggcagg

SEQ ID NO: 5973574 - DNA, 19 bp, Homo sapiens
ggcgtggagactggcaggc

SEQ ID NO: 5973575 - DNA, 15 bp, Homo sapiens
ggcgtggagcaggcg

SEQ ID NO: 5973576 - DNA, 19 bp, Homo sapiens
ggcgtggagccagggagcg

SEQ ID NO: 5973577 - DNA, 16 bp, Homo sapiens
ggcgtggaggagagga

SEQ ID NO: 5973578 - DNA, 14 bp, Homo sapiens
ggcgtggaggagga

SEQ ID NO: 5973579 - DNA, 16 bp, Homo sapiens
ggcgtggcaaatataa

SEQ ID NO: 5973580 - DNA, 16 bp, Homo sapiens
ggcgtggcccaaggct

SEQ ID NO: 5973581 - DNA, 18 bp, Homo sapiens
ggcgtggctctgggtggg

SEQ ID NO: 5973582 - DNA, 23 bp, Homo sapiens
ggcgtggctctgggtgggcgggg

SEQ ID NO: 5973583 - DNA, 18 bp, Homo sapiens
ggcgtgggacgtggtcag

SEQ ID NO: 5973584 - DNA, 18 bp, Homo sapiens
ggcgtgggctgaccaggc

SEQ ID NO: 5973585 - DNA, 20 bp, Homo sapiens
ggcgtggggaatgggcaggt

SEQ ID NO: 5973586 - DNA, 22 bp, Homo sapiens
ggcgtggggggagctctggtgg

SEQ ID NO: 5973587 - DNA, 15 bp, Homo sapiens
ggcgtgggtctctgg

SEQ ID NO: 5973588 - DNA, 18 bp, Homo sapiens
ggcgtgggtctctgggga

SEQ ID NO: 5973589 - DNA, 17 bp, Homo sapiens
ggcgtggtcaagcactc

SEQ ID NO: 5973590 - DNA, 22 bp, Homo sapiens
ggcgtgtatctggtatatgtaa

SEQ ID NO: 5973591 - DNA, 14 bp, Homo sapiens
ggcgtgtcccctgc

SEQ ID NO: 5973592 - DNA, 14 bp, Homo sapiens
ggcgtgtgaagaac

SEQ ID NO: 5973593 - DNA, 14 bp, Homo sapiens
ggcgtgtgcagtgc

SEQ ID NO: 5973594 - DNA, 13 bp, Homo sapiens
ggcgtgtggcagc

SEQ ID NO: 5973595 - DNA, 16 bp, Homo sapiens
ggcgtgtggtttccct

SEQ ID NO: 5973596 - DNA, 17 bp, Homo sapiens
ggcgtgtgtccctgtgg

SEQ ID NO: 5973597 - DNA, 15 bp, Homo sapiens
ggcgttagtgggcag

SEQ ID NO: 5973598 - DNA, 18 bp, Homo sapiens
ggcgttagtgggcaggtg

SEQ ID NO: 5973599 - DNA, 21 bp, Homo sapiens
ggctcccgcctccaacccctc

SEQ ID NO: 5973600 - DNA, 19 bp, Homo sapiens
ggctcccgcttgctctcct

SEQ ID NO: 5973601 - DNA, 20 bp, Homo sapiens
ggctcccgcttgctctcctg

SEQ ID NO: 5973602 - DNA, 22 bp, Homo sapiens
ggctcccgcttgctctcctgga

SEQ ID NO: 5973603 - DNA, 22 bp, Homo sapiens
ggctcccggagagggagtcagt

SEQ ID NO: 5973604 - DNA, 16 bp, Homo sapiens
ggctcccggcatcctg

SEQ ID NO: 5973605 - DNA, 17 bp, Homo sapiens
ggctcccggcatcctga

SEQ ID NO: 5973606 - DNA, 18 bp, Homo sapiens
ggctcccggcatcctgaa

SEQ ID NO: 5973607 - DNA, 23 bp, Homo sapiens
ggctcccggcatcctgaaagcca

SEQ ID NO: 5973608 - DNA, 18 bp, Homo sapiens
ggctcccggggcctggac

SEQ ID NO: 5973609 - DNA, 19 bp, Homo sapiens
ggctcccggggcctggaca

SEQ ID NO: 5973610 - DNA, 19 bp, Homo sapiens
ggctcccgggggccccacc

SEQ ID NO: 5973611 - DNA, 16 bp, Homo sapiens
ggctccctcactctca

SEQ ID NO: 5973612 - DNA, 18 bp, Homo sapiens
ggctccctcactctcagg

SEQ ID NO: 5973613 - DNA, 19 bp, Homo sapiens
ggctccctcactctcagga

SEQ ID NO: 5973614 - DNA, 22 bp, Homo sapiens
ggctccctcccgtagtctcctg

SEQ ID NO: 5973615 - DNA, 15 bp, Homo sapiens
ggctccctcctccag

SEQ ID NO: 5973616 - DNA, 16 bp, Homo sapiens
ggctccctcctccagg

SEQ ID NO: 5973617 - DNA, 13 bp, Homo sapiens
ggctccctcctct

SEQ ID NO: 5973618 - DNA, 16 bp, Homo sapiens
ggctccctcctctggc

SEQ ID NO: 5973619 - DNA, 18 bp, Homo sapiens
ggctccctcctctggcag

SEQ ID NO: 5973620 - DNA, 20 bp, Homo sapiens
ggctccctcctctggcaggc

SEQ ID NO: 5973621 - DNA, 13 bp, Homo sapiens
ggctccctcctgt

SEQ ID NO: 5973622 - DNA, 12 bp, Homo sapiens
ggctccctctct

SEQ ID NO: 5973623 - DNA, 18 bp, Homo sapiens
ggctccctctctcctgga

SEQ ID NO: 5973624 - DNA, 17 bp, Homo sapiens
ggctccctctctggttt

SEQ ID NO: 5973625 - DNA, 14 bp, Homo sapiens
ggctccctgaccac

SEQ ID NO: 5973626 - DNA, 12 bp, Homo sapiens
ggctccctgagg

SEQ ID NO: 5973627 - DNA, 13 bp, Homo sapiens
ggctccctgatga

SEQ ID NO: 5973628 - DNA, 23 bp, Homo sapiens
ggctccctgatgacacccaccct

SEQ ID NO: 5973629 - DNA, 11 bp, Homo sapiens
ggctccctgga

SEQ ID NO: 5973630 - DNA, 17 bp, Homo sapiens
ggctcccttcccacctc

SEQ ID NO: 5973631 - DNA, 13 bp, Homo sapiens
ggctcccttcctc

SEQ ID NO: 5973632 - DNA, 19 bp, Homo sapiens
ggctccctttaagccaaga

SEQ ID NO: 5973633 - DNA, 18 bp, Homo sapiens
ggctccctttgctgctga

SEQ ID NO: 5973634 - DNA, 18 bp, Homo sapiens
ggctccgaaaaactttgt

SEQ ID NO: 5973635 - DNA, 20 bp, Homo sapiens
ggctccgaaattccaaggcc

SEQ ID NO: 5973636 - DNA, 15 bp, Homo sapiens
ggctccgaacaccct

SEQ ID NO: 5973637 - DNA, 17 bp, Homo sapiens
ggctccgagggcggcca

SEQ ID NO: 5973638 - DNA, 18 bp, Homo sapiens
ggctccgagggcggccag

SEQ ID NO: 5973639 - DNA, 14 bp, Homo sapiens
ggctccgcaggggt

SEQ ID NO: 5973640 - DNA, 14 bp, Homo sapiens
ggctccgctgtgcc

SEQ ID NO: 5973641 - DNA, 15 bp, Homo sapiens
ggctccgctgtgccc

SEQ ID NO: 5973642 - DNA, 22 bp, Homo sapiens
ggctccgctgtgcccgccctgg

SEQ ID NO: 5973643 - DNA, 15 bp, Homo sapiens
ggctccgctgtgtgg

SEQ ID NO: 5973644 - DNA, 23 bp, Homo sapiens
ggctccggaggggacccagctcc

SEQ ID NO: 5973645 - DNA, 15 bp, Homo sapiens
ggctccggcccacag

SEQ ID NO: 5973646 - DNA, 14 bp, Homo sapiens
ggctccggcctctg

SEQ ID NO: 5973647 - DNA, 15 bp, Homo sapiens
ggctccggcctctgc

SEQ ID NO: 5973648 - DNA, 19 bp, Homo sapiens
ggctccgggcaccaggggc

SEQ ID NO: 5973649 - DNA, 23 bp, Homo sapiens
ggctccgggcaccaggggccaac

SEQ ID NO: 5973650 - DNA, 17 bp, Homo sapiens
ggctccgtgtgggagac

SEQ ID NO: 5973651 - DNA, 23 bp, Homo sapiens
ggctcctaccagcaaacagctga

SEQ ID NO: 5973652 - DNA, 15 bp, Homo sapiens
ggctcctacctgggg

SEQ ID NO: 5973653 - DNA, 16 bp, Homo sapiens
ggctcctacctggggg

SEQ ID NO: 5973654 - DNA, 17 bp, Homo sapiens
ggctcctacctgggggc

SEQ ID NO: 5973655 - DNA, 20 bp, Homo sapiens
ggctcctatctgtgttttga

SEQ ID NO: 5973656 - DNA, 15 bp, Homo sapiens
ggctcctcagccctc

SEQ ID NO: 5973657 - DNA, 23 bp, Homo sapiens
ggctcctccagggtggcagcaac

SEQ ID NO: 5973658 - DNA, 20 bp, Homo sapiens
ggctcctccatggtgctgca

SEQ ID NO: 5973659 - DNA, 12 bp, Homo sapiens
ggctcctcccag

SEQ ID NO: 5973660 - DNA, 13 bp, Homo sapiens
ggctcctccccga

SEQ ID NO: 5973661 - DNA, 17 bp, Homo sapiens
ggctcctcccggtgccc

SEQ ID NO: 5973662 - DNA, 12 bp, Homo sapiens
ggctcctccctc

SEQ ID NO: 5973663 - DNA, 14 bp, Homo sapiens
ggctcctccctgga

SEQ ID NO: 5973664 - DNA, 17 bp, Homo sapiens
ggctcctccctggagct

SEQ ID NO: 5973665 - DNA, 22 bp, Homo sapiens
ggctcctcctcacccacctctg

SEQ ID NO: 5973666 - DNA, 23 bp, Homo sapiens
ggctcctcctcacccacctctgg

SEQ ID NO: 5973667 - DNA, 16 bp, Homo sapiens
ggctcctcctgaagga

SEQ ID NO: 5973668 - DNA, 15 bp, Homo sapiens
ggctcctcctggaaa

SEQ ID NO: 5973669 - DNA, 12 bp, Homo sapiens
ggctcctccttg

SEQ ID NO: 5973670 - DNA, 16 bp, Homo sapiens
ggctcctccttgccca

SEQ ID NO: 5973671 - DNA, 20 bp, Homo sapiens
ggctcctcgcccccaccagt

SEQ ID NO: 5973672 - DNA, 22 bp, Homo sapiens
ggctcctctaggccctgtgagc

SEQ ID NO: 5973673 - DNA, 22 bp, Homo sapiens
ggctcctctgcatcttgctctg

SEQ ID NO: 5973674 - DNA, 21 bp, Homo sapiens
ggctcctctgtggtgtctgcc

SEQ ID NO: 5973675 - DNA, 23 bp, Homo sapiens
ggctcctgaccccgccatgcatg

SEQ ID NO: 5973676 - DNA, 21 bp, Homo sapiens
ggctcctgagaaaggtgagga

SEQ ID NO: 5973677 - DNA, 17 bp, Homo sapiens
ggctcctgagacacatg

SEQ ID NO: 5973678 - DNA, 19 bp, Homo sapiens
ggctcctgagacacatggg

SEQ ID NO: 5973679 - DNA, 19 bp, Homo sapiens
ggctcctgagggagctcca

SEQ ID NO: 5973680 - DNA, 15 bp, Homo sapiens
ggctcctgagtgtca

SEQ ID NO: 5973681 - DNA, 11 bp, Homo sapiens
ggctcctgatc

SEQ ID NO: 5973682 - DNA, 23 bp, Homo sapiens
ggctcctgcaaaaggaggtgaaa

SEQ ID NO: 5973683 - DNA, 13 bp, Homo sapiens
ggctcctgccact

SEQ ID NO: 5973684 - DNA, 14 bp, Homo sapiens
ggctcctgcccagg

SEQ ID NO: 5973685 - DNA, 15 bp, Homo sapiens
ggctcctgcccaggc

SEQ ID NO: 5973686 - DNA, 17 bp, Homo sapiens
ggctcctgcccaggcca

SEQ ID NO: 5973687 - DNA, 18 bp, Homo sapiens
ggctcctgcccaggccac

SEQ ID NO: 5973688 - DNA, 15 bp, Homo sapiens
ggctcctgcccccat

SEQ ID NO: 5973689 - DNA, 15 bp, Homo sapiens
ggctcctgctgcacc

SEQ ID NO: 5973690 - DNA, 22 bp, Homo sapiens
ggctcctgcttttggggctctt

SEQ ID NO: 5973691 - DNA, 11 bp, Homo sapiens
ggctcctggac

SEQ ID NO: 5973692 - DNA, 12 bp, Homo sapiens
ggctcctggacc

SEQ ID NO: 5973693 - DNA, 12 bp, Homo sapiens
ggctcctggagc

SEQ ID NO: 5973694 - DNA, 16 bp, Homo sapiens
ggctcctggctgccag

SEQ ID NO: 5973695 - DNA, 19 bp, Homo sapiens
ggctcctggctgtgcccag

SEQ ID NO: 5973696 - DNA, 20 bp, Homo sapiens
ggctcctggctgtgcccagc

SEQ ID NO: 5973697 - DNA, 12 bp, Homo sapiens
ggctcctgggag

SEQ ID NO: 5973698 - DNA, 20 bp, Homo sapiens
ggctcctgggaggccctggc

SEQ ID NO: 5973699 - DNA, 16 bp, Homo sapiens
ggctcctggggcagag

SEQ ID NO: 5973700 - DNA, 12 bp, Homo sapiens
ggctcctgggtt

SEQ ID NO: 5973701 - DNA, 13 bp, Homo sapiens
ggctcctgggttg

SEQ ID NO: 5973702 - DNA, 18 bp, Homo sapiens
ggctcctggtggggcaga

SEQ ID NO: 5973703 - DNA, 14 bp, Homo sapiens
ggctcctgtgccct

SEQ ID NO: 5973704 - DNA, 15 bp, Homo sapiens
ggctcctgtggcagc

SEQ ID NO: 5973705 - DNA, 21 bp, Homo sapiens
ggctcctgtggtagtcctccc

SEQ ID NO: 5973706 - DNA, 22 bp, Homo sapiens
ggctcctgtggtagtcctccca

SEQ ID NO: 5973707 - DNA, 20 bp, Homo sapiens
ggctccttcccatcgctgtc

SEQ ID NO: 5973708 - DNA, 17 bp, Homo sapiens
ggctccttcccctgcac

SEQ ID NO: 5973709 - DNA, 23 bp, Homo sapiens
ggctccttcctgtgggtggggct

SEQ ID NO: 5973710 - DNA, 19 bp, Homo sapiens
ggctccttgtgccagagaa

SEQ ID NO: 5973711 - DNA, 20 bp, Homo sapiens
ggctccttgtgggcctgggc

SEQ ID NO: 5973712 - DNA, 12 bp, Homo sapiens
ggctcctttcca

SEQ ID NO: 5973713 - DNA, 16 bp, Homo sapiens
ggctcctttcccacag

SEQ ID NO: 5973714 - DNA, 13 bp, Homo sapiens
ggctcctttcccc

SEQ ID NO: 5973715 - DNA, 20 bp, Homo sapiens
ggctcctttctccagccagc

SEQ ID NO: 5973716 - DNA, 15 bp, Homo sapiens
ggctcgaatctctgt

SEQ ID NO: 5973717 - DNA, 20 bp, Homo sapiens
ggctcgaatctctgtgcctt

SEQ ID NO: 5973718 - DNA, 21 bp, Homo sapiens
ggctcgagcagtcctgcctca

SEQ ID NO: 5973719 - DNA, 21 bp, Homo sapiens
ggctcgagctcggggctgggg

SEQ ID NO: 5973720 - DNA, 21 bp, Homo sapiens
ggctcgagtgcccctgcaggg

SEQ ID NO: 5973721 - DNA, 19 bp, Homo sapiens
ggctcgattttgtatctgc

SEQ ID NO: 5973722 - DNA, 21 bp, Homo sapiens
ggctcgatttttaagagcctt

SEQ ID NO: 5973723 - DNA, 14 bp, Homo sapiens
ggctcgcaccccca

SEQ ID NO: 5973724 - DNA, 19 bp, Homo sapiens
ggctcgcactgcccacatg

SEQ ID NO: 5973725 - DNA, 19 bp, Homo sapiens
ggctcgcagggtgcaggag

SEQ ID NO: 5973726 - DNA, 15 bp, Homo sapiens
ggctcgccttccctc

SEQ ID NO: 5973727 - DNA, 18 bp, Homo sapiens
ggctcgccttccctcctg

SEQ ID NO: 5973728 - DNA, 23 bp, Homo sapiens
ggctcgctccctgtagctctgcc

SEQ ID NO: 5973729 - DNA, 18 bp, Homo sapiens
ggctcgctgtggtttctc

SEQ ID NO: 5973730 - DNA, 16 bp, Homo sapiens
ggctcggacccacccc

SEQ ID NO: 5973731 - DNA, 21 bp, Homo sapiens
ggctcggaggctacccgctgt

SEQ ID NO: 5973732 - DNA, 23 bp, Homo sapiens
ggctcggcgcccccacccctggc

SEQ ID NO: 5973733 - DNA, 18 bp, Homo sapiens
ggctcgggagccatgtca

SEQ ID NO: 5973734 - DNA, 22 bp, Homo sapiens
ggctcgggagccatgtcatgtg

SEQ ID NO: 5973735 - DNA, 16 bp, Homo sapiens
ggctcgggcgctgtgg

SEQ ID NO: 5973736 - DNA, 18 bp, Homo sapiens
ggctcgggcgctgtggct

SEQ ID NO: 5973737 - DNA, 23 bp, Homo sapiens
ggctcgggcgctgtggctcctgc

SEQ ID NO: 5973738 - DNA, 22 bp, Homo sapiens
ggctcggggctccccacgcccc

SEQ ID NO: 5973739 - DNA, 17 bp, Homo sapiens
ggctcgggtgcccagga

SEQ ID NO: 5973740 - DNA, 16 bp, Homo sapiens
ggctcggtggcccagg

SEQ ID NO: 5973741 - DNA, 14 bp, Homo sapiens
ggctcgtgggctct

SEQ ID NO: 5973742 - DNA, 19 bp, Homo sapiens
ggctctaacgcctgagccc

SEQ ID NO: 5973743 - DNA, 20 bp, Homo sapiens
ggctctaaggtactgtgggg

SEQ ID NO: 5973744 - DNA, 18 bp, Homo sapiens
ggctctacaactgagtcc

SEQ ID NO: 5973745 - DNA, 12 bp, Homo sapiens
ggctctacacat

SEQ ID NO: 5973746 - DNA, 20 bp, Homo sapiens
ggctctaccctgtctgtccc

SEQ ID NO: 5973747 - DNA, 22 bp, Homo sapiens
ggctctagatcataaggcttca

SEQ ID NO: 5973748 - DNA, 15 bp, Homo sapiens
ggctctagccccagc

SEQ ID NO: 5973749 - DNA, 13 bp, Homo sapiens
ggctctagggcct

SEQ ID NO: 5973750 - DNA, 22 bp, Homo sapiens
ggctctagggttgctggagcct

SEQ ID NO: 5973751 - DNA, 17 bp, Homo sapiens
ggctctatctgctgggc

SEQ ID NO: 5973752 - DNA, 18 bp, Homo sapiens
ggctctatctgctgggct

SEQ ID NO: 5973753 - DNA, 14 bp, Homo sapiens
ggctctatgcctgc

SEQ ID NO: 5973754 - DNA, 21 bp, Homo sapiens
ggctctatgcctgcactggga

SEQ ID NO: 5973755 - DNA, 16 bp, Homo sapiens
ggctctattgagccaa

SEQ ID NO: 5973756 - DNA, 22 bp, Homo sapiens
ggctctattggatttgtccaaa

SEQ ID NO: 5973757 - DNA, 21 bp, Homo sapiens
ggctctatttcttcttcacat

SEQ ID NO: 5973758 - DNA, 11 bp, Homo sapiens
ggctctcaggc

SEQ ID NO: 5973759 - DNA, 20 bp, Homo sapiens
ggctctcaggccagctgctt

SEQ ID NO: 5973760 - DNA, 23 bp, Homo sapiens
ggctctcatgttttcaactgcca

SEQ ID NO: 5973761 - DNA, 18 bp, Homo sapiens
ggctctccaaaggggctg

SEQ ID NO: 5973762 - DNA, 21 bp, Homo sapiens
ggctctccaaaggggctgctg

SEQ ID NO: 5973763 - DNA, 19 bp, Homo sapiens
ggctctccacctcagcctt

SEQ ID NO: 5973764 - DNA, 20 bp, Homo sapiens
ggctctccacctcagccttg

SEQ ID NO: 5973765 - DNA, 13 bp, Homo sapiens
ggctctcccaccc

SEQ ID NO: 5973766 - DNA, 17 bp, Homo sapiens
ggctctcccaccccgcc

SEQ ID NO: 5973767 - DNA, 13 bp, Homo sapiens
ggctctcccctct

SEQ ID NO: 5973768 - DNA, 23 bp, Homo sapiens
ggctctccggggccatttgcaat

SEQ ID NO: 5973769 - DNA, 12 bp, Homo sapiens
ggctctcctggc

SEQ ID NO: 5973770 - DNA, 22 bp, Homo sapiens
ggctctctatagcaccagggct

SEQ ID NO: 5973771 - DNA, 12 bp, Homo sapiens
ggctctctccag

SEQ ID NO: 5973772 - DNA, 18 bp, Homo sapiens
ggctctctctagctcccc

SEQ ID NO: 5973773 - DNA, 14 bp, Homo sapiens
ggctctctgacccg

SEQ ID NO: 5973774 - DNA, 20 bp, Homo sapiens
ggctctctgagtcctggccc

SEQ ID NO: 5973775 - DNA, 12 bp, Homo sapiens
ggctctctggac

SEQ ID NO: 5973776 - DNA, 18 bp, Homo sapiens
ggctgcccagagctgctg

SEQ ID NO: 5973777 - DNA, 19 bp, Homo sapiens
ggctgcccagagctgctgg

SEQ ID NO: 5973778 - DNA, 19 bp, Homo sapiens
ggctgcccatcatgtggcc

SEQ ID NO: 5973779 - DNA, 19 bp, Homo sapiens
ggctgccccaacctgctga

SEQ ID NO: 5973780 - DNA, 17 bp, Homo sapiens
ggctgccccacaggcca

SEQ ID NO: 5973781 - DNA, 23 bp, Homo sapiens
ggctgccccacctgccgcatgct

SEQ ID NO: 5973782 - DNA, 12 bp, Homo sapiens
ggctgccccagg

SEQ ID NO: 5973783 - DNA, 14 bp, Homo sapiens
ggctgccccaggcc

SEQ ID NO: 5973784 - DNA, 16 bp, Homo sapiens
ggctgccccaggccgg

SEQ ID NO: 5973785 - DNA, 20 bp, Homo sapiens
ggctgccccaggccggagcc

SEQ ID NO: 5973786 - DNA, 21 bp, Homo sapiens
ggctgccccaggccggagccc

SEQ ID NO: 5973787 - DNA, 17 bp, Homo sapiens
ggctgccccaggggcac

SEQ ID NO: 5973788 - DNA, 19 bp, Homo sapiens
ggctgcccccatccagcca

SEQ ID NO: 5973789 - DNA, 20 bp, Homo sapiens
ggctgcccccatccagccac

SEQ ID NO: 5973790 - DNA, 22 bp, Homo sapiens
ggctgcccccatccagccacgg

SEQ ID NO: 5973791 - DNA, 20 bp, Homo sapiens
ggctgcccccggccccctgg

SEQ ID NO: 5973792 - DNA, 21 bp, Homo sapiens
ggctgccccgggtccccagct

SEQ ID NO: 5973793 - DNA, 23 bp, Homo sapiens
ggctgccccgggtccccagctcc

SEQ ID NO: 5973794 - DNA, 20 bp, Homo sapiens
ggctgcccctaatctctgta

SEQ ID NO: 5973795 - DNA, 14 bp, Homo sapiens
ggctgcccctcacc

SEQ ID NO: 5973796 - DNA, 20 bp, Homo sapiens
ggctgcccctcgcacacagg

SEQ ID NO: 5973797 - DNA, 15 bp, Homo sapiens
ggctgcccctctcac

SEQ ID NO: 5973798 - DNA, 18 bp, Homo sapiens
ggctgcccgctcccagtg

SEQ ID NO: 5973799 - DNA, 18 bp, Homo sapiens
ggctgccctccatccctt

SEQ ID NO: 5973800 - DNA, 12 bp, Homo sapiens
ggctgccctgag

SEQ ID NO: 5973801 - DNA, 13 bp, Homo sapiens
ggctgccctgaga

SEQ ID NO: 5973802 - DNA, 18 bp, Homo sapiens
ggctgccctgagaagctg

SEQ ID NO: 5973803 - DNA, 24 bp, Homo sapiens
ggctgccctgagaagctgctccag

SEQ ID NO: 5973804 - DNA, 12 bp, Homo sapiens
ggctgccctgcc

SEQ ID NO: 5973805 - DNA, 13 bp, Homo sapiens
ggctgccctgcca

SEQ ID NO: 5973806 - DNA, 22 bp, Homo sapiens
ggctgccctggaggaaccgaaa

SEQ ID NO: 5973807 - DNA, 15 bp, Homo sapiens
ggctgccctggccct

SEQ ID NO: 5973808 - DNA, 17 bp, Homo sapiens
ggctgccctggccctga

SEQ ID NO: 5973809 - DNA, 19 bp, Homo sapiens
ggctgccctggccctgagg

SEQ ID NO: 5973810 - DNA, 12 bp, Homo sapiens
ggctgccctggg

SEQ ID NO: 5973811 - DNA, 12 bp, Homo sapiens
ggctgccctggt

SEQ ID NO: 5973812 - DNA, 22 bp, Homo sapiens
ggctgccctggtgctgccacac

SEQ ID NO: 5973813 - DNA, 12 bp, Homo sapiens
ggctgccctgtc

SEQ ID NO: 5973814 - DNA, 19 bp, Homo sapiens
ggctgcccttcgctgccag

SEQ ID NO: 5973815 - DNA, 21 bp, Homo sapiens
ggctgcccttgttgcctgcac

SEQ ID NO: 5973816 - DNA, 19 bp, Homo sapiens
ggctgccgagacagaccct

SEQ ID NO: 5973817 - DNA, 18 bp, Homo sapiens
ggctgccgagccaccatg

SEQ ID NO: 5973818 - DNA, 16 bp, Homo sapiens
ggctgccgatgggaaa

SEQ ID NO: 5973819 - DNA, 22 bp, Homo sapiens
ggctgccgcatctgcctggagc

SEQ ID NO: 5973820 - DNA, 23 bp, Homo sapiens
ggctgccgcatctgcctggagcc

SEQ ID NO: 5973821 - DNA, 19 bp, Homo sapiens
ggctgccgctgctctccca

SEQ ID NO: 5973822 - DNA, 21 bp, Homo sapiens
ggctgccgctgctctcccagg

SEQ ID NO: 5973823 - DNA, 16 bp, Homo sapiens
ggctgccggctgcacc

SEQ ID NO: 5973824 - DNA, 15 bp, Homo sapiens
ggctgccggggcagc

SEQ ID NO: 5973825 - DNA, 21 bp, Homo sapiens
ggctgccgggttctagtctcc

SEQ ID NO: 5973826 - DNA, 21 bp, Homo sapiens
ggctgcctagccctcccccca

SEQ ID NO: 5973827 - DNA, 21 bp, Homo sapiens
ggctgcctatgttggggggga

SEQ ID NO: 5973828 - DNA, 11 bp, Homo sapiens
ggctgcctcag

SEQ ID NO: 5973829 - DNA, 15 bp, Homo sapiens
ggctgcctcagccag

SEQ ID NO: 5973830 - DNA, 17 bp, Homo sapiens
ggctgcctccactccca

SEQ ID NO: 5973831 - DNA, 13 bp, Homo sapiens
ggctgcctcccaa

SEQ ID NO: 5973832 - DNA, 23 bp, Homo sapiens
ggctgcctcctcctgagagctgt

SEQ ID NO: 5973833 - DNA, 15 bp, Homo sapiens
ggctgcctctgggag

SEQ ID NO: 5973834 - DNA, 15 bp, Homo sapiens
ggctgcctctgggtg

SEQ ID NO: 5973835 - DNA, 20 bp, Homo sapiens
ggctgcctgcccctgctgct

SEQ ID NO: 5973836 - DNA, 18 bp, Homo sapiens
ggctgcctggagccccac

SEQ ID NO: 5973837 - DNA, 11 bp, Homo sapiens
ggctgcctggg

SEQ ID NO: 5973838 - DNA, 13 bp, Homo sapiens
ggctgcctgggcc

SEQ ID NO: 5973839 - DNA, 16 bp, Homo sapiens
ggctgccttagaacct

SEQ ID NO: 5973840 - DNA, 16 bp, Homo sapiens
ggctgccttctggcct

SEQ ID NO: 5973841 - DNA, 18 bp, Homo sapiens
ggctgccttctttccatc

SEQ ID NO: 5973842 - DNA, 20 bp, Homo sapiens
ggctgcctttgatcacagga

SEQ ID NO: 5973843 - DNA, 23 bp, Homo sapiens
ggctgcctttgtggtgggcgctg

SEQ ID NO: 5973844 - DNA, 16 bp, Homo sapiens
ggctgcgaactgtgca

SEQ ID NO: 5973845 - DNA, 23 bp, Homo sapiens
ggctgcgagcatttccctcccgg

SEQ ID NO: 5973846 - DNA, 14 bp, Homo sapiens
ggctgcgcactgtg

SEQ ID NO: 5973847 - DNA, 17 bp, Homo sapiens
ggctgcgcccccagctt

SEQ ID NO: 5973848 - DNA, 21 bp, Homo sapiens
ggctgcgcccccagcttctct

SEQ ID NO: 5973849 - DNA, 15 bp, Homo sapiens
ggctgcgcctgcccg

SEQ ID NO: 5973850 - DNA, 15 bp, Homo sapiens
ggctgcgctaacccc

SEQ ID NO: 5973851 - DNA, 16 bp, Homo sapiens
ggctgcgctagcagcc

SEQ ID NO: 5973852 - DNA, 17 bp, Homo sapiens
ggctgcgctagcagccc

SEQ ID NO: 5973853 - DNA, 22 bp, Homo sapiens
ggctgcggaatgaaccacatct

SEQ ID NO: 5973854 - DNA, 12 bp, Homo sapiens
ggctgcggcccc

SEQ ID NO: 5973855 - DNA, 14 bp, Homo sapiens
ggctgcggccccct

SEQ ID NO: 5973856 - DNA, 21 bp, Homo sapiens
ggctgcggcgtacaggctggc

SEQ ID NO: 5973857 - DNA, 17 bp, Homo sapiens
ggctgcgggaggccctg

SEQ ID NO: 5973858 - DNA, 18 bp, Homo sapiens
ggctgcgggaggccctgg

SEQ ID NO: 5973859 - DNA, 17 bp, Homo sapiens
ggctgcggggcgggcac

SEQ ID NO: 5973860 - DNA, 15 bp, Homo sapiens
ggctgcgtccctgct

SEQ ID NO: 5973861 - DNA, 18 bp, Homo sapiens
ggctgcgtccctgctcag

SEQ ID NO: 5973862 - DNA, 22 bp, Homo sapiens
ggctgcgtccctgctcagccca

SEQ ID NO: 5973863 - DNA, 20 bp, Homo sapiens
ggctgcgtcgaactgtcctg

SEQ ID NO: 5973864 - DNA, 21 bp, Homo sapiens
ggctgcgtcgaactgtcctgg

SEQ ID NO: 5973865 - DNA, 23 bp, Homo sapiens
ggctgctaagtggaagacagaga

SEQ ID NO: 5973866 - DNA, 22 bp, Homo sapiens
ggctgctcaagccgcaagctct

SEQ ID NO: 5973867 - DNA, 24 bp, Homo sapiens
ggctgctcatcacccagtcctggc

SEQ ID NO: 5973868 - DNA, 12 bp, Homo sapiens
ggctgctcccac

SEQ ID NO: 5973869 - DNA, 21 bp, Homo sapiens
ggctgctcccacctggctctg

SEQ ID NO: 5973870 - DNA, 11 bp, Homo sapiens
ggctgctcccc

SEQ ID NO: 5973871 - DNA, 12 bp, Homo sapiens
ggctgctcccca

SEQ ID NO: 5973872 - DNA, 20 bp, Homo sapiens
ggctgctccccacccgcctc

SEQ ID NO: 5973873 - DNA, 14 bp, Homo sapiens
ggctgctccctgag

SEQ ID NO: 5973874 - DNA, 19 bp, Homo sapiens
ggctgctccctgagggcgg

SEQ ID NO: 5973875 - DNA, 21 bp, Homo sapiens
ggctgctccctgctcccaggg

SEQ ID NO: 5973876 - DNA, 22 bp, Homo sapiens
ggctgctccctgctcccaggga

SEQ ID NO: 5973877 - DNA, 20 bp, Homo sapiens
ggctgctcctaacctacctc

SEQ ID NO: 5973878 - DNA, 23 bp, Homo sapiens
ggctgctcctccagggccacgtg

SEQ ID NO: 5973879 - DNA, 16 bp, Homo sapiens
ggctgctcctgaatga

SEQ ID NO: 5973880 - DNA, 19 bp, Homo sapiens
ggctgctcctgaatgaggc

SEQ ID NO: 5973881 - DNA, 12 bp, Homo sapiens
ggctgctccttc

SEQ ID NO: 5973882 - DNA, 15 bp, Homo sapiens
ggctgctcgcccagg

SEQ ID NO: 5973883 - DNA, 16 bp, Homo sapiens
ggctgctcgcccagga

SEQ ID NO: 5973884 - DNA, 17 bp, Homo sapiens
ggctgctcgcccaggaa

SEQ ID NO: 5973885 - DNA, 18 bp, Homo sapiens
ggctgctcgcccaggaag

SEQ ID NO: 5973886 - DNA, 19 bp, Homo sapiens
ggctgctcgcccaggaagg

SEQ ID NO: 5973887 - DNA, 15 bp, Homo sapiens
ggctgctctccatct

SEQ ID NO: 5973888 - DNA, 16 bp, Homo sapiens
ggctgctctgcctgtg

SEQ ID NO: 5973889 - DNA, 15 bp, Homo sapiens
ggctgctgaaggctc

SEQ ID NO: 5973890 - DNA, 17 bp, Homo sapiens
ggctgctgacaggatgt

SEQ ID NO: 5973891 - DNA, 20 bp, Homo sapiens
ggctgctgcacaccaaggcc

SEQ ID NO: 5973892 - DNA, 22 bp, Homo sapiens
ggctgctgcacaccaaggccct

SEQ ID NO: 5973893 - DNA, 11 bp, Homo sapiens
ggctgctgcca

SEQ ID NO: 5973894 - DNA, 13 bp, Homo sapiens
ggctgctgccagg

SEQ ID NO: 5973895 - DNA, 14 bp, Homo sapiens
ggctgctgcccagg

SEQ ID NO: 5973896 - DNA, 17 bp, Homo sapiens
ggctgctgcccccaccc

SEQ ID NO: 5973897 - DNA, 18 bp, Homo sapiens
ggctgctgcccccacccc

SEQ ID NO: 5973898 - DNA, 18 bp, Homo sapiens
ggctgctgccccctggct

SEQ ID NO: 5973899 - DNA, 13 bp, Homo sapiens
ggctgctgcctgc

SEQ ID NO: 5973900 - DNA, 15 bp, Homo sapiens
ggctgctgctacaat

SEQ ID NO: 5973901 - DNA, 20 bp, Homo sapiens
ggctgctgctcctctcttgg

SEQ ID NO: 5973902 - DNA, 23 bp, Homo sapiens
ggctgctgctgctcttggctgga

SEQ ID NO: 5973903 - DNA, 14 bp, Homo sapiens
ggctgctgctgggc

SEQ ID NO: 5973904 - DNA, 13 bp, Homo sapiens
ggctgctgcttct

SEQ ID NO: 5973905 - DNA, 14 bp, Homo sapiens
ggctgctgcttctg

SEQ ID NO: 5973906 - DNA, 19 bp, Homo sapiens
ggctgctgcttctgctcca

SEQ ID NO: 5973907 - DNA, 23 bp, Homo sapiens
ggctgctgcttctgctccagccc

SEQ ID NO: 5973908 - DNA, 13 bp, Homo sapiens
ggctgctggagga

SEQ ID NO: 5973909 - DNA, 15 bp, Homo sapiens
ggctgctggaggaaa

SEQ ID NO: 5973910 - DNA, 16 bp, Homo sapiens
ggctgctggcccacag

SEQ ID NO: 5973911 - DNA, 17 bp, Homo sapiens
ggctgctggcccacagc

SEQ ID NO: 5973912 - DNA, 14 bp, Homo sapiens
ggctgctggcgcct

SEQ ID NO: 5973913 - DNA, 18 bp, Homo sapiens
ggctgctggcgcctctgc

SEQ ID NO: 5973914 - DNA, 14 bp, Homo sapiens
ggctgctggcttca

SEQ ID NO: 5973915 - DNA, 15 bp, Homo sapiens
ggctgctggcttcag

SEQ ID NO: 5973916 - DNA, 11 bp, Homo sapiens
ggctgctggga

SEQ ID NO: 5973917 - DNA, 17 bp, Homo sapiens
ggctgctgggcgtctgt

SEQ ID NO: 5973918 - DNA, 20 bp, Homo sapiens
ggctgctgggcgtctgttct

SEQ ID NO: 5973919 - DNA, 13 bp, Homo sapiens
ggctgctggggca

SEQ ID NO: 5973920 - DNA, 16 bp, Homo sapiens
ggctgctggggcatgt

SEQ ID NO: 5973921 - DNA, 24 bp, Homo sapiens
ggctgctggggcatgtgtgcctgt

SEQ ID NO: 5973922 - DNA, 17 bp, Homo sapiens
ggctgctgggggctccc

SEQ ID NO: 5973923 - DNA, 19 bp, Homo sapiens
ggctgcttaaactggaaag

SEQ ID NO: 5973924 - DNA, 20 bp, Homo sapiens
ggctgcttagatttctagca

SEQ ID NO: 5973925 - DNA, 20 bp, Homo sapiens
ggctgcttaggaaacctcac

SEQ ID NO: 5973926 - DNA, 18 bp, Homo sapiens
ggctgcttattggaccag

SEQ ID NO: 5973927 - DNA, 11 bp, Homo sapiens
ggctgcttcaa

SEQ ID NO: 5973928 - DNA, 12 bp, Homo sapiens
ggctgcttcaag

SEQ ID NO: 5973929 - DNA, 19 bp, Homo sapiens
ggctgcttcaaggatcctg

SEQ ID NO: 5973930 - DNA, 20 bp, Homo sapiens
ggctgcttcaaggatcctga

SEQ ID NO: 5973931 - DNA, 18 bp, Homo sapiens
ggctgcttccctgaagct

SEQ ID NO: 5973932 - DNA, 19 bp, Homo sapiens
ggctgcttctacggccatg

SEQ ID NO: 5973933 - DNA, 16 bp, Homo sapiens
ggctgcttctccacct

SEQ ID NO: 5973934 - DNA, 24 bp, Homo sapiens
ggctgcttctctacagaggtgaaa

SEQ ID NO: 5973935 - DNA, 15 bp, Homo sapiens
ggctgcttgcagcca

SEQ ID NO: 5973936 - DNA, 19 bp, Homo sapiens
ggctgcttgcagccaggag

SEQ ID NO: 5973937 - DNA, 20 bp, Homo sapiens
ggctgcttgcagccaggaga

SEQ ID NO: 5973938 - DNA, 17 bp, Homo sapiens
ggctgcttgcttttgcc

SEQ ID NO: 5973939 - DNA, 18 bp, Homo sapiens
ggctgcttgcttttgcct

SEQ ID NO: 5973940 - DNA, 14 bp, Homo sapiens
ggctgcttggcctt

SEQ ID NO: 5973941 - DNA, 15 bp, Homo sapiens
ggctgctttccaaag

SEQ ID NO: 5973942 - DNA, 20 bp, Homo sapiens
ggctggaaaagtcacacaga

SEQ ID NO: 5973943 - DNA, 16 bp, Homo sapiens
ggctggaaagaggaga

SEQ ID NO: 5973944 - DNA, 19 bp, Homo sapiens
ggctggaaagcagagcctc

SEQ ID NO: 5973945 - DNA, 23 bp, Homo sapiens
ggctggaacactgtactgaggaa

SEQ ID NO: 5973946 - DNA, 19 bp, Homo sapiens
ggctggaagatcctgcggg

SEQ ID NO: 5973947 - DNA, 16 bp, Homo sapiens
ggctggaaggagccag

SEQ ID NO: 5973948 - DNA, 20 bp, Homo sapiens
ggctggaataagaggacact

SEQ ID NO: 5973949 - DNA, 15 bp, Homo sapiens
ggctggaatctcatg

SEQ ID NO: 5973950 - DNA, 20 bp, Homo sapiens
ggctggaatctggagagcta

SEQ ID NO: 5973951 - DNA, 22 bp, Homo sapiens
ggctggaatgggggccaggctg

SEQ ID NO: 5973952 - DNA, 16 bp, Homo sapiens
ggctggacaccctctg

SEQ ID NO: 5973953 - DNA, 14 bp, Homo sapiens
gtacacttcctgtg

SEQ ID NO: 5973954 - DNA, 23 bp, Homo sapiens
gtacactttttacagcagcaata

SEQ ID NO: 5973955 - DNA, 12 bp, Homo sapiens
gtacactttttt

SEQ ID NO: 5973956 - DNA, 19 bp, Homo sapiens
gtacagaaacaactgccaa

SEQ ID NO: 5973957 - DNA, 14 bp, Homo sapiens
gtacagaaagctgc

SEQ ID NO: 5973958 - DNA, 17 bp, Homo sapiens
gtacagaaccagcactc

SEQ ID NO: 5973959 - DNA, 14 bp, Homo sapiens
gtacagaatatttc

SEQ ID NO: 5973960 - DNA, 18 bp, Homo sapiens
gtacagaatcattgctta

SEQ ID NO: 5973961 - DNA, 14 bp, Homo sapiens
gtacagaattttta

SEQ ID NO: 5973962 - DNA, 15 bp, Homo sapiens
gtacagaatttttaa

SEQ ID NO: 5973963 - DNA, 23 bp, Homo sapiens
gtacagaatttttaatgactttt

SEQ ID NO: 5973964 - DNA, 16 bp, Homo sapiens
gtacagacaacaaacc

SEQ ID NO: 5973965 - DNA, 15 bp, Homo sapiens
gtacagacagaaaaa

SEQ ID NO: 5973966 - DNA, 23 bp, Homo sapiens
gtacagacagagaatatgtctgc

SEQ ID NO: 5973967 - DNA, 16 bp, Homo sapiens
gtacagacatatttaa

SEQ ID NO: 5973968 - DNA, 15 bp, Homo sapiens
gtacagacatgtgct

SEQ ID NO: 5973969 - DNA, 17 bp, Homo sapiens
gtacagacgtatgctta

SEQ ID NO: 5973970 - DNA, 14 bp, Homo sapiens
gtacagactgcaga

SEQ ID NO: 5973971 - DNA, 21 bp, Homo sapiens
gtacagactgcagacattctc

SEQ ID NO: 5973972 - DNA, 12 bp, Homo sapiens
gtacagactgtt

SEQ ID NO: 5973973 - DNA, 15 bp, Homo sapiens
gtacagactgtttta

SEQ ID NO: 5973974 - DNA, 13 bp, Homo sapiens
gtacagagaagcc

SEQ ID NO: 5973975 - DNA, 16 bp, Homo sapiens
gtacagagaagccagc

SEQ ID NO: 5973976 - DNA, 18 bp, Homo sapiens
gtacagagaagccagctt

SEQ ID NO: 5973977 - DNA, 19 bp, Homo sapiens
gtacagagaagccagcttg

SEQ ID NO: 5973978 - DNA, 23 bp, Homo sapiens
gtacagagaagccagcttgttta

SEQ ID NO: 5973979 - DNA, 13 bp, Homo sapiens
gtacagagaagga

SEQ ID NO: 5973980 - DNA, 18 bp, Homo sapiens
gtacagagcccacgcccc

SEQ ID NO: 5973981 - DNA, 22 bp, Homo sapiens
gtacagagcccacgcccccact

SEQ ID NO: 5973982 - DNA, 20 bp, Homo sapiens
gtacagagccgtaaaaactg

SEQ ID NO: 5973983 - DNA, 20 bp, Homo sapiens
gtacagaggtcagcacacat

SEQ ID NO: 5973984 - DNA, 16 bp, Homo sapiens
gtacagatatgcaaat

SEQ ID NO: 5973985 - DNA, 12 bp, Homo sapiens
gtacagatcccc

SEQ ID NO: 5973986 - DNA, 18 bp, Homo sapiens
gtacagatccccagcccc

SEQ ID NO: 5973987 - DNA, 19 bp, Homo sapiens
gtacagatgaatgataaac

SEQ ID NO: 5973988 - DNA, 20 bp, Homo sapiens
gtacagattgctgcttctgc

SEQ ID NO: 5973989 - DNA, 16 bp, Homo sapiens
gtacagcacagaatga

SEQ ID NO: 5973990 - DNA, 19 bp, Homo sapiens
gtacagcatgcatcacgga

SEQ ID NO: 5973991 - DNA, 15 bp, Homo sapiens
gtacagcatgtgcct

SEQ ID NO: 5973992 - DNA, 18 bp, Homo sapiens
gtacagcattaaaatttt

SEQ ID NO: 5973993 - DNA, 12 bp, Homo sapiens
gtacagcccaga

SEQ ID NO: 5973994 - DNA, 14 bp, Homo sapiens
gtacagcccagagg

SEQ ID NO: 5973995 - DNA, 20 bp, Homo sapiens
gtacagccttcactggagac

SEQ ID NO: 5973996 - DNA, 13 bp, Homo sapiens
gtacagcggctcc

SEQ ID NO: 5973997 - DNA, 15 bp, Homo sapiens
gtacagcgggctgtg

SEQ ID NO: 5973998 - DNA, 19 bp, Homo sapiens
gtacagcgggctgtgcccg

SEQ ID NO: 5973999 - DNA, 22 bp, Homo sapiens
gtacagctgacggtttctcccc

SEQ ID NO: 5974000 - DNA, 14 bp, Homo sapiens
gtacagctggctct

SEQ ID NO: 5974001 - DNA, 14 bp, Homo sapiens
gtacagcttctgga

SEQ ID NO: 5974002 - DNA, 16 bp, Homo sapiens
gtacagcttctggagc

SEQ ID NO: 5974003 - DNA, 15 bp, Homo sapiens
gtacaggacatatat

SEQ ID NO: 5974004 - DNA, 20 bp, Homo sapiens
gtacaggacatgtactgaga

SEQ ID NO: 5974005 - DNA, 21 bp, Homo sapiens
gtacaggcaaaacacgcaagg

SEQ ID NO: 5974006 - DNA, 15 bp, Homo sapiens
gtacaggcagcacag

SEQ ID NO: 5974007 - DNA, 19 bp, Homo sapiens
gtacaggctaggaagaact

SEQ ID NO: 5974008 - DNA, 16 bp, Homo sapiens
gtacaggggccatgcc

SEQ ID NO: 5974009 - DNA, 22 bp, Homo sapiens
gtacagggtggctgtggtccta

SEQ ID NO: 5974010 - DNA, 16 bp, Homo sapiens
gtacagggtttttacc

SEQ ID NO: 5974011 - DNA, 20 bp, Homo sapiens
gtacaggtagtgggctcaca

SEQ ID NO: 5974012 - DNA, 21 bp, Homo sapiens
gtacaggtcacccatcaggac

SEQ ID NO: 5974013 - DNA, 20 bp, Homo sapiens
gtacaggtcatctgctggga

SEQ ID NO: 5974014 - DNA, 17 bp, Homo sapiens
gtacaggttggatgtgg

SEQ ID NO: 5974015 - DNA, 20 bp, Homo sapiens
gtacaggtttttttggattt

SEQ ID NO: 5974016 - DNA, 21 bp, Homo sapiens
gtacagtagcttaaataaatt

SEQ ID NO: 5974017 - DNA, 13 bp, Homo sapiens
gtacagtatgtgt

SEQ ID NO: 5974018 - DNA, 16 bp, Homo sapiens
gtacagtatgtgtcta

SEQ ID NO: 5974019 - DNA, 17 bp, Homo sapiens
gtacagtatgtgtctag

SEQ ID NO: 5974020 - DNA, 16 bp, Homo sapiens
gtacagtattctttta

SEQ ID NO: 5974021 - DNA, 12 bp, Homo sapiens
gtacagtcccag

SEQ ID NO: 5974022 - DNA, 22 bp, Homo sapiens
gtacagtctcaattttgtattt

SEQ ID NO: 5974023 - DNA, 12 bp, Homo sapiens
gtacagtctgtc

SEQ ID NO: 5974024 - DNA, 14 bp, Homo sapiens
gtacagtctgtctt

SEQ ID NO: 5974025 - DNA, 14 bp, Homo sapiens
gtacagtcttgtat

SEQ ID NO: 5974026 - DNA, 12 bp, Homo sapiens
gtacagtgaaca

SEQ ID NO: 5974027 - DNA, 13 bp, Homo sapiens
gtacagtgaatgg

SEQ ID NO: 5974028 - DNA, 19 bp, Homo sapiens
gtacagtgaattgtctttt

SEQ ID NO: 5974029 - DNA, 14 bp, Homo sapiens
gtacagtgaggagg

SEQ ID NO: 5974030 - DNA, 15 bp, Homo sapiens
gtacagtgaggaggg

SEQ ID NO: 5974031 - DNA, 16 bp, Homo sapiens
gtacagtggagaaata

SEQ ID NO: 5974032 - DNA, 17 bp, Homo sapiens
gtacagtggagaaatat

SEQ ID NO: 5974033 - DNA, 20 bp, Homo sapiens
gtacagtgtctttttttgta

SEQ ID NO: 5974034 - DNA, 21 bp, Homo sapiens
gtacagtgtctttttttgtat

SEQ ID NO: 5974035 - DNA, 22 bp, Homo sapiens
gtacagtgtctttttttgtata

SEQ ID NO: 5974036 - DNA, 12 bp, Homo sapiens
gtacagtgttac

SEQ ID NO: 5974037 - DNA, 14 bp, Homo sapiens
gtacagtgttctgt

SEQ ID NO: 5974038 - DNA, 20 bp, Homo sapiens
gtacagttatctaagttaat

SEQ ID NO: 5974039 - DNA, 22 bp, Homo sapiens
gtacagttcagttcctctttgc

SEQ ID NO: 5974040 - DNA, 23 bp, Homo sapiens
gtacagttcagttcctctttgca

SEQ ID NO: 5974041 - DNA, 15 bp, Homo sapiens
gtacagttcataaat

SEQ ID NO: 5974042 - DNA, 19 bp, Homo sapiens
gtacagttcataattcacc

SEQ ID NO: 5974043 - DNA, 12 bp, Homo sapiens
gtacagttcttc

SEQ ID NO: 5974044 - DNA, 22 bp, Homo sapiens
gtacagttcttcgggaagagag

SEQ ID NO: 5974045 - DNA, 15 bp, Homo sapiens
gtacagttgactggc

SEQ ID NO: 5974046 - DNA, 16 bp, Homo sapiens
gtacagttgcaggagc

SEQ ID NO: 5974047 - DNA, 21 bp, Homo sapiens
gtacagttgggaaaatatgtc

SEQ ID NO: 5974048 - DNA, 15 bp, Homo sapiens
gtacagtttaacaga

SEQ ID NO: 5974049 - DNA, 15 bp, Homo sapiens
gtacagtttctgctt

SEQ ID NO: 5974050 - DNA, 16 bp, Homo sapiens
gtacagtttctgcttg

SEQ ID NO: 5974051 - DNA, 19 bp, Homo sapiens
gtacagtttgtttacacac

SEQ ID NO: 5974052 - DNA, 15 bp, Homo sapiens
gtacagttttgtgga

SEQ ID NO: 5974053 - DNA, 12 bp, Homo sapiens
gtacataaaaga

SEQ ID NO: 5974054 - DNA, 22 bp, Homo sapiens
gtacataaagtaataactgtta

SEQ ID NO: 5974055 - DNA, 18 bp, Homo sapiens
gtacataactcctgtccc

SEQ ID NO: 5974056 - DNA, 21 bp, Homo sapiens
gtacataagttaaatgattga

SEQ ID NO: 5974057 - DNA, 22 bp, Homo sapiens
gtacataatacacttgccctgc

SEQ ID NO: 5974058 - DNA, 23 bp, Homo sapiens
gtacataatacacttgccctgct

SEQ ID NO: 5974059 - DNA, 20 bp, Homo sapiens
gtacataatgcgtgcatacc

SEQ ID NO: 5974060 - DNA, 22 bp, Homo sapiens
gtacataatgcttaatttctaa

SEQ ID NO: 5974061 - DNA, 20 bp, Homo sapiens
gtacataattgattaaaatc

SEQ ID NO: 5974062 - DNA, 22 bp, Homo sapiens
gtacataattgattaaaatctc

SEQ ID NO: 5974063 - DNA, 17 bp, Homo sapiens
gtacataattgcatgaa

SEQ ID NO: 5974064 - DNA, 13 bp, Homo sapiens
gtacatacattgt

SEQ ID NO: 5974065 - DNA, 14 bp, Homo sapiens
gtacatacattgta

SEQ ID NO: 5974066 - DNA, 19 bp, Homo sapiens
gtacataccctggccgccc

SEQ ID NO: 5974067 - DNA, 22 bp, Homo sapiens
gtacataccctggccgccccct

SEQ ID NO: 5974068 - DNA, 21 bp, Homo sapiens
gtacataccggggctcctctc

SEQ ID NO: 5974069 - DNA, 13 bp, Homo sapiens
gtacatactggcc

SEQ ID NO: 5974070 - DNA, 17 bp, Homo sapiens
gtacatactggcctctg

SEQ ID NO: 5974071 - DNA, 18 bp, Homo sapiens
gtacatactggcctctgt

SEQ ID NO: 5974072 - DNA, 14 bp, Homo sapiens
gtacatactttttg

SEQ ID NO: 5974073 - DNA, 18 bp, Homo sapiens
gtacatagagcaatgttg

SEQ ID NO: 5974074 - DNA, 21 bp, Homo sapiens
gtacatagatgtatcattaat

SEQ ID NO: 5974075 - DNA, 12 bp, Homo sapiens
gtacatagccta

SEQ ID NO: 5974076 - DNA, 13 bp, Homo sapiens
gtacatagcctat

SEQ ID NO: 5974077 - DNA, 14 bp, Homo sapiens
gtacataggcagca

SEQ ID NO: 5974078 - DNA, 15 bp, Homo sapiens
gtacatagtaaagta

SEQ ID NO: 5974079 - DNA, 20 bp, Homo sapiens
gtacatagttatttttctct

SEQ ID NO: 5974080 - DNA, 14 bp, Homo sapiens
gtacatatatgtat

SEQ ID NO: 5974081 - DNA, 16 bp, Homo sapiens
gtacatatatgtataa

SEQ ID NO: 5974082 - DNA, 23 bp, Homo sapiens
gtacatatatgtataatatatat

SEQ ID NO: 5974083 - DNA, 15 bp, Homo sapiens
gtacatatcaaatag

SEQ ID NO: 5974084 - DNA, 22 bp, Homo sapiens
gtacatatcctttggtcctggt

SEQ ID NO: 5974085 - DNA, 16 bp, Homo sapiens
gtacatatggaaatcc

SEQ ID NO: 5974086 - DNA, 19 bp, Homo sapiens
gtacatatggtagacaatt

SEQ ID NO: 5974087 - DNA, 16 bp, Homo sapiens
gtacatatgtaaaata

SEQ ID NO: 5974088 - DNA, 19 bp, Homo sapiens
gtacatatttattttcttt

SEQ ID NO: 5974089 - DNA, 20 bp, Homo sapiens
gtacatatttgtggaataat

SEQ ID NO: 5974090 - DNA, 15 bp, Homo sapiens
gtacatatttttata

SEQ ID NO: 5974091 - DNA, 19 bp, Homo sapiens
gtacatcatgtaagatggc

SEQ ID NO: 5974092 - DNA, 17 bp, Homo sapiens
gtacatcccatgtaaca

SEQ ID NO: 5974093 - DNA, 21 bp, Homo sapiens
gtacatcccatgtaacagaaa

SEQ ID NO: 5974094 - DNA, 18 bp, Homo sapiens
gtacatctattttggatt

SEQ ID NO: 5974095 - DNA, 16 bp, Homo sapiens
gtacatctggcttatt

SEQ ID NO: 5974096 - DNA, 20 bp, Homo sapiens
gtacatctggcttattttaa

SEQ ID NO: 5974097 - DNA, 23 bp, Homo sapiens
gtacatctggcttattttaatgt

SEQ ID NO: 5974098 - DNA, 13 bp, Homo sapiens
gtacatcttcttt

SEQ ID NO: 5974099 - DNA, 16 bp, Homo sapiens
gtacatcttctttgga

SEQ ID NO: 5974100 - DNA, 20 bp, Homo sapiens
gtacatcttctttggaaata

SEQ ID NO: 5974101 - DNA, 18 bp, Homo sapiens
gtacatcttgtaagacac

SEQ ID NO: 5974102 - DNA, 20 bp, Homo sapiens
gtacatcttgtgcatgcaaa

SEQ ID NO: 5974103 - DNA, 21 bp, Homo sapiens
gtacatcttgtgcatgcaaaa

SEQ ID NO: 5974104 - DNA, 15 bp, Homo sapiens
gtacatgaaaacaca

SEQ ID NO: 5974105 - DNA, 16 bp, Homo sapiens
gtacatgaaaacacat

SEQ ID NO: 5974106 - DNA, 17 bp, Homo sapiens
gtacatgaaaacacatt

SEQ ID NO: 5974107 - DNA, 19 bp, Homo sapiens
gtacatgaaaacacatttt

SEQ ID NO: 5974108 - DNA, 20 bp, Homo sapiens
gtacatgaaaacacattttt

SEQ ID NO: 5974109 - DNA, 13 bp, Homo sapiens
gtacatgaagaat

SEQ ID NO: 5974110 - DNA, 16 bp, Homo sapiens
gtacatgaagaatgta

SEQ ID NO: 5974111 - DNA, 11 bp, Homo sapiens
gtacatgagaa

SEQ ID NO: 5974112 - DNA, 16 bp, Homo sapiens
gtacatggaagaagta

SEQ ID NO: 5974113 - DNA, 16 bp, Homo sapiens
gtacatggagctcagg

SEQ ID NO: 5974114 - DNA, 16 bp, Homo sapiens
gtacatggcagagttt

SEQ ID NO: 5974115 - DNA, 12 bp, Homo sapiens
gtacatgtacat

SEQ ID NO: 5974116 - DNA, 16 bp, Homo sapiens
gtacatgtatgaaatt

SEQ ID NO: 5974117 - DNA, 22 bp, Homo sapiens
gtacatgtatgaaattggtttt

SEQ ID NO: 5974118 - DNA, 21 bp, Homo sapiens
gtacatgtggaaaactcacag

SEQ ID NO: 5974119 - DNA, 13 bp, Homo sapiens
gtacatgtgtgca

SEQ ID NO: 5974120 - DNA, 15 bp, Homo sapiens
gtacatgtgtgcaga

SEQ ID NO: 5974121 - DNA, 17 bp, Homo sapiens
gtacatgtgtgcagagc

SEQ ID NO: 5974122 - DNA, 18 bp, Homo sapiens
gtacatgtgtgcagagca

SEQ ID NO: 5974123 - DNA, 21 bp, Homo sapiens
gtacatgttcgggtgtgggtt

SEQ ID NO: 5974124 - DNA, 19 bp, Homo sapiens
gtacattacactaaattat

SEQ ID NO: 5974125 - DNA, 23 bp, Homo sapiens
gtacattactaaatatataaagt

SEQ ID NO: 5974126 - DNA, 17 bp, Homo sapiens
gtacattcaatgtttat

SEQ ID NO: 5974127 - DNA, 18 bp, Homo sapiens
gtacattcaatgtttatg

SEQ ID NO: 5974128 - DNA, 18 bp, Homo sapiens
gtacattcatctggaggc

SEQ ID NO: 5974129 - DNA, 13 bp, Homo sapiens
gtacattcctgat

SEQ ID NO: 5974130 - DNA, 15 bp, Homo sapiens
gtacattctcagttt

SEQ ID NO: 5974131 - DNA, 10 bp, Homo sapiens
gtagactagt

SEQ ID NO: 5974132 - DNA, 13 bp, Homo sapiens
gtagactagtgcc

SEQ ID NO: 5974133 - DNA, 17 bp, Homo sapiens
gtagactatatacatgt

SEQ ID NO: 5974134 - DNA, 18 bp, Homo sapiens
gtagactcacggctgcac

SEQ ID NO: 5974135 - DNA, 18 bp, Homo sapiens
gtagactcatcttttgaa

SEQ ID NO: 5974136 - DNA, 19 bp, Homo sapiens
gtagactcttgctcctgct

SEQ ID NO: 5974137 - DNA, 21 bp, Homo sapiens
gtagactgatgttttagcatt

SEQ ID NO: 5974138 - DNA, 19 bp, Homo sapiens
gtagactggccatgcaagt

SEQ ID NO: 5974139 - DNA, 18 bp, Homo sapiens
gtagactggcctgaacca

SEQ ID NO: 5974140 - DNA, 23 bp, Homo sapiens
gtagacttctggttgtatttcta

SEQ ID NO: 5974141 - DNA, 12 bp, Homo sapiens
gtagacttttat

SEQ ID NO: 5974142 - DNA, 22 bp, Homo sapiens
gtagagaatgtcactgtagttt

SEQ ID NO: 5974143 - DNA, 12 bp, Homo sapiens
gtagagaatgtg

SEQ ID NO: 5974144 - DNA, 21 bp, Homo sapiens
gtagagaatgtgtgtagatac

SEQ ID NO: 5974145 - DNA, 11 bp, Homo sapiens
gtagagacagg

SEQ ID NO: 5974146 - DNA, 12 bp, Homo sapiens
gtagagacaggg

SEQ ID NO: 5974147 - DNA, 14 bp, Homo sapiens
gtagagacagtgtt

SEQ ID NO: 5974148 - DNA, 22 bp, Homo sapiens
gtagagacggggtttcaccatg

SEQ ID NO: 5974149 - DNA, 22 bp, Homo sapiens
gtagagacttccgtcacccttg

SEQ ID NO: 5974150 - DNA, 14 bp, Homo sapiens
gtagagagagacct

SEQ ID NO: 5974151 - DNA, 19 bp, Homo sapiens
gtagagagagctgtattaa

SEQ ID NO: 5974152 - DNA, 14 bp, Homo sapiens
gtagagagtgggtc

SEQ ID NO: 5974153 - DNA, 15 bp, Homo sapiens
gtagagatggaggag

SEQ ID NO: 5974154 - DNA, 20 bp, Homo sapiens
gtagagatttttatgtgttt

SEQ ID NO: 5974155 - DNA, 16 bp, Homo sapiens
gtagagcacatttagt

SEQ ID NO: 5974156 - DNA, 20 bp, Homo sapiens
gtagagccaattagacttga

SEQ ID NO: 5974157 - DNA, 21 bp, Homo sapiens
gtagagctagaacatggagag

SEQ ID NO: 5974158 - DNA, 18 bp, Homo sapiens
gtagagctagctgccact

SEQ ID NO: 5974159 - DNA, 12 bp, Homo sapiens
gtagaggaaaat

SEQ ID NO: 5974160 - DNA, 20 bp, Homo sapiens
gtagaggaagacgagacagg

SEQ ID NO: 5974161 - DNA, 15 bp, Homo sapiens
gtagaggaaggatgc

SEQ ID NO: 5974162 - DNA, 15 bp, Homo sapiens
gtagaggagaaactg

SEQ ID NO: 5974163 - DNA, 12 bp, Homo sapiens
gtagaggagcct

SEQ ID NO: 5974164 - DNA, 15 bp, Homo sapiens
gtagaggagcctgga

SEQ ID NO: 5974165 - DNA, 13 bp, Homo sapiens
gtagaggcctggg

SEQ ID NO: 5974166 - DNA, 15 bp, Homo sapiens
gtagaggcctggggc

SEQ ID NO: 5974167 - DNA, 18 bp, Homo sapiens
gtagaggctccccagggc

SEQ ID NO: 5974168 - DNA, 19 bp, Homo sapiens
gtagaggctccccagggct

SEQ ID NO: 5974169 - DNA, 14 bp, Homo sapiens
gtagaggctgggag

SEQ ID NO: 5974170 - DNA, 15 bp, Homo sapiens
gtagaggctgggagg

SEQ ID NO: 5974171 - DNA, 14 bp, Homo sapiens
gtagaggcttgttt

SEQ ID NO: 5974172 - DNA, 22 bp, Homo sapiens
gtagaggggtctcatgtctccc

SEQ ID NO: 5974173 - DNA, 15 bp, Homo sapiens
gtagaggtacacttg

SEQ ID NO: 5974174 - DNA, 17 bp, Homo sapiens
gtagaggtacacttgtg

SEQ ID NO: 5974175 - DNA, 20 bp, Homo sapiens
gtagaggtacacttgtgaat

SEQ ID NO: 5974176 - DNA, 23 bp, Homo sapiens
gtagagtcatctccatcagctgt

SEQ ID NO: 5974177 - DNA, 14 bp, Homo sapiens
gtagagtcattcat

SEQ ID NO: 5974178 - DNA, 13 bp, Homo sapiens
gtagagtccttgg

SEQ ID NO: 5974179 - DNA, 12 bp, Homo sapiens
gtagagtctgag

SEQ ID NO: 5974180 - DNA, 14 bp, Homo sapiens
gtagagtctgaggg

SEQ ID NO: 5974181 - DNA, 19 bp, Homo sapiens
gtagagtgacctcggacag

SEQ ID NO: 5974182 - DNA, 13 bp, Homo sapiens
gtagagtgcccat

SEQ ID NO: 5974183 - DNA, 13 bp, Homo sapiens
gtagagtgggagc

SEQ ID NO: 5974184 - DNA, 15 bp, Homo sapiens
gtagagttaagaagc

SEQ ID NO: 5974185 - DNA, 18 bp, Homo sapiens
gtagagttaagaagctgt

SEQ ID NO: 5974186 - DNA, 19 bp, Homo sapiens
gtagagttgatcaaaatca

SEQ ID NO: 5974187 - DNA, 14 bp, Homo sapiens
gtagagttgctgag

SEQ ID NO: 5974188 - DNA, 15 bp, Homo sapiens
gtagagttgctgaga

SEQ ID NO: 5974189 - DNA, 15 bp, Homo sapiens
gtagataaatatttg

SEQ ID NO: 5974190 - DNA, 21 bp, Homo sapiens
gtagataagtgttctgtctga

SEQ ID NO: 5974191 - DNA, 13 bp, Homo sapiens
gtagatagaaata

SEQ ID NO: 5974192 - DNA, 14 bp, Homo sapiens
gtagatagaaataa

SEQ ID NO: 5974193 - DNA, 21 bp, Homo sapiens
gtagatatcctctgcttaaaa

SEQ ID NO: 5974194 - DNA, 17 bp, Homo sapiens
gtagatatgtattcttt

SEQ ID NO: 5974195 - DNA, 15 bp, Homo sapiens
gtagatattacttta

SEQ ID NO: 5974196 - DNA, 17 bp, Homo sapiens
gtagatattcaggaaat

SEQ ID NO: 5974197 - DNA, 22 bp, Homo sapiens
gtagatattcaggaaatgttca

SEQ ID NO: 5974198 - DNA, 22 bp, Homo sapiens
gtagatattggacaaagaacct

SEQ ID NO: 5974199 - DNA, 19 bp, Homo sapiens
gtagatattgttttctgta

SEQ ID NO: 5974200 - DNA, 17 bp, Homo sapiens
gtagatcaccagaataa

SEQ ID NO: 5974201 - DNA, 17 bp, Homo sapiens
gtagatcagtggtctcc

SEQ ID NO: 5974202 - DNA, 21 bp, Homo sapiens
gtagatccagatccagactgt

SEQ ID NO: 5974203 - DNA, 22 bp, Homo sapiens
gtagatccagatccagactgta

SEQ ID NO: 5974204 - DNA, 18 bp, Homo sapiens
gtagatcgcttgagccca

SEQ ID NO: 5974205 - DNA, 19 bp, Homo sapiens
gtagatcgcttgagcccag

SEQ ID NO: 5974206 - DNA, 20 bp, Homo sapiens
gtagatcgcttgagcccagg

SEQ ID NO: 5974207 - DNA, 15 bp, Homo sapiens
gtagatctgcttctt

SEQ ID NO: 5974208 - DNA, 22 bp, Homo sapiens
gtagatctgctttctgttcatc

SEQ ID NO: 5974209 - DNA, 23 bp, Homo sapiens
gtagatgaaaaagcatgtacagt

SEQ ID NO: 5974210 - DNA, 18 bp, Homo sapiens
gtagatgacaaatattct

SEQ ID NO: 5974211 - DNA, 19 bp, Homo sapiens
gtagatgcagaaaaagaaa

SEQ ID NO: 5974212 - DNA, 15 bp, Homo sapiens
gtagatgcatttggg

SEQ ID NO: 5974213 - DNA, 20 bp, Homo sapiens
gtagatgcatttgggtccag

SEQ ID NO: 5974214 - DNA, 15 bp, Homo sapiens
gtagatgccggcagg

SEQ ID NO: 5974215 - DNA, 23 bp, Homo sapiens
gtagatggaaatcagttgtgttt

SEQ ID NO: 5974216 - DNA, 18 bp, Homo sapiens
gtagatggcgatgtgtta

SEQ ID NO: 5974217 - DNA, 16 bp, Homo sapiens
gtagatgggtgggggc

SEQ ID NO: 5974218 - DNA, 22 bp, Homo sapiens
gtagatgggtgggggctcctgg

SEQ ID NO: 5974219 - DNA, 13 bp, Homo sapiens
gtagatgtagcat

SEQ ID NO: 5974220 - DNA, 16 bp, Homo sapiens
gtagatgttctacttt

SEQ ID NO: 5974221 - DNA, 12 bp, Homo sapiens
gtagatgttctt

SEQ ID NO: 5974222 - DNA, 13 bp, Homo sapiens
gtagatgttcttt

SEQ ID NO: 5974223 - DNA, 20 bp, Homo sapiens
gtagatgttcttttctattt

SEQ ID NO: 5974224 - DNA, 19 bp, Homo sapiens
gtagattacctgccacttc

SEQ ID NO: 5974225 - DNA, 20 bp, Homo sapiens
gtagattacctgccacttcc

SEQ ID NO: 5974226 - DNA, 20 bp, Homo sapiens
gtagattatggcctttttaa

SEQ ID NO: 5974227 - DNA, 14 bp, Homo sapiens
gtagattcaggtaa

SEQ ID NO: 5974228 - DNA, 22 bp, Homo sapiens
gtagattccatttactgcattc

SEQ ID NO: 5974229 - DNA, 15 bp, Homo sapiens
gtagattcccttgca

SEQ ID NO: 5974230 - DNA, 18 bp, Homo sapiens
gtagattcgctgtcccct

SEQ ID NO: 5974231 - DNA, 15 bp, Homo sapiens
gtagattgattgtat

SEQ ID NO: 5974232 - DNA, 20 bp, Homo sapiens
gtagattgttttgttcacat

SEQ ID NO: 5974233 - DNA, 12 bp, Homo sapiens
gtagatttaaaa

SEQ ID NO: 5974234 - DNA, 16 bp, Homo sapiens
gtagatttatttcatc

SEQ ID NO: 5974235 - DNA, 21 bp, Homo sapiens
gtagatttatttcatcatatt

SEQ ID NO: 5974236 - DNA, 17 bp, Homo sapiens
gtagatttcagtagttt

SEQ ID NO: 5974237 - DNA, 17 bp, Homo sapiens
gtagatttgaaaattgt

SEQ ID NO: 5974238 - DNA, 20 bp, Homo sapiens
gtagatttgaaaattgtata

SEQ ID NO: 5974239 - DNA, 12 bp, Homo sapiens
gtagatttgatt

SEQ ID NO: 5974240 - DNA, 18 bp, Homo sapiens
gtagattttaagaatggt

SEQ ID NO: 5974241 - DNA, 16 bp, Homo sapiens
gtagattttctttaaa

SEQ ID NO: 5974242 - DNA, 16 bp, Homo sapiens
gtagatttttaacaaa

SEQ ID NO: 5974243 - DNA, 19 bp, Homo sapiens
gtagatttttaacaaaaaa

SEQ ID NO: 5974244 - DNA, 19 bp, Homo sapiens
gtagatttttgctcttctg

SEQ ID NO: 5974245 - DNA, 18 bp, Homo sapiens
gtagcaaaccctgtcaaa

SEQ ID NO: 5974246 - DNA, 23 bp, Homo sapiens
gtagcaaaccctgtcaaacatta

SEQ ID NO: 5974247 - DNA, 14 bp, Homo sapiens
gtagcaaatgttta

SEQ ID NO: 5974248 - DNA, 16 bp, Homo sapiens
gtagcaaatgtttact

SEQ ID NO: 5974249 - DNA, 18 bp, Homo sapiens
gtagcaaatgtttactgt

SEQ ID NO: 5974250 - DNA, 17 bp, Homo sapiens
gtagcaagatctttaca

SEQ ID NO: 5974251 - DNA, 20 bp, Homo sapiens
gtagcaagatgcaaatgcat

SEQ ID NO: 5974252 - DNA, 21 bp, Homo sapiens
gtagcaagttctagagaagag

SEQ ID NO: 5974253 - DNA, 18 bp, Homo sapiens
gtagcaatggccagagcc

SEQ ID NO: 5974254 - DNA, 21 bp, Homo sapiens
gtagcaatggccagagcctct

SEQ ID NO: 5974255 - DNA, 22 bp, Homo sapiens
gtagcaatggccagagcctctg

SEQ ID NO: 5974256 - DNA, 22 bp, Homo sapiens
gtagcacagattttgaatctgt

SEQ ID NO: 5974257 - DNA, 12 bp, Homo sapiens
gtagcacaggct

SEQ ID NO: 5974258 - DNA, 20 bp, Homo sapiens
gtagcacaggctgagtgcag

SEQ ID NO: 5974259 - DNA, 18 bp, Homo sapiens
gtagcacatgtctgtcct

SEQ ID NO: 5974260 - DNA, 20 bp, Homo sapiens
gtagcactactacagaaatt

SEQ ID NO: 5974261 - DNA, 14 bp, Homo sapiens
gtagcactcaggct

SEQ ID NO: 5974262 - DNA, 14 bp, Homo sapiens
gtagcactctcaga

SEQ ID NO: 5974263 - DNA, 12 bp, Homo sapiens
gtagcactgagg

SEQ ID NO: 5974264 - DNA, 18 bp, Homo sapiens
gtagcagagtcattgtta

SEQ ID NO: 5974265 - DNA, 17 bp, Homo sapiens
gtagcagagttaaatct

SEQ ID NO: 5974266 - DNA, 20 bp, Homo sapiens
gtagcagataaagacagctg

SEQ ID NO: 5974267 - DNA, 24 bp, Homo sapiens
gtagcagataaagacagctgacag

SEQ ID NO: 5974268 - DNA, 12 bp, Homo sapiens
gtagcagcaggc

SEQ ID NO: 5974269 - DNA, 15 bp, Homo sapiens
gtagcagcaggctca

SEQ ID NO: 5974270 - DNA, 16 bp, Homo sapiens
gtagcagcaggctcag

SEQ ID NO: 5974271 - DNA, 12 bp, Homo sapiens
gtagcagcctgg

SEQ ID NO: 5974272 - DNA, 22 bp, Homo sapiens
gtagcaggatgaggaacctcaa

SEQ ID NO: 5974273 - DNA, 20 bp, Homo sapiens
gtagcaggccatggctcatg

SEQ ID NO: 5974274 - DNA, 23 bp, Homo sapiens
gtagcagggggggaaatgcattt

SEQ ID NO: 5974275 - DNA, 17 bp, Homo sapiens
gtagcaggttctaggct

SEQ ID NO: 5974276 - DNA, 15 bp, Homo sapiens
gtagcagttttgaaa

SEQ ID NO: 5974277 - DNA, 15 bp, Homo sapiens
gtagcataactgtag

SEQ ID NO: 5974278 - DNA, 18 bp, Homo sapiens
gtagcataactgtagctc

SEQ ID NO: 5974279 - DNA, 20 bp, Homo sapiens
gtagcatactgatgagacaa

SEQ ID NO: 5974280 - DNA, 13 bp, Homo sapiens
gtagcatataaat

SEQ ID NO: 5974281 - DNA, 20 bp, Homo sapiens
gtagcatgaacgccaaggaa

SEQ ID NO: 5974282 - DNA, 20 bp, Homo sapiens
gtagcatgggtccaagagac

SEQ ID NO: 5974283 - DNA, 21 bp, Homo sapiens
gtagcatgggtccaagagaca

SEQ ID NO: 5974284 - DNA, 21 bp, Homo sapiens
gtagcattcatgtaataaaca

SEQ ID NO: 5974285 - DNA, 16 bp, Homo sapiens
gtagcattgttccaca

SEQ ID NO: 5974286 - DNA, 20 bp, Homo sapiens
gtagcatttactgtgtcttt

SEQ ID NO: 5974287 - DNA, 17 bp, Homo sapiens
gtagcatttcattcttc

SEQ ID NO: 5974288 - DNA, 20 bp, Homo sapiens
gtagcatttcttatttgttt

SEQ ID NO: 5974289 - DNA, 20 bp, Homo sapiens
gtagcattttcctgtttact

SEQ ID NO: 5974290 - DNA, 13 bp, Homo sapiens
gtagccacaccag

SEQ ID NO: 5974291 - DNA, 16 bp, Homo sapiens
gtagccacaccaggat

SEQ ID NO: 5974292 - DNA, 19 bp, Homo sapiens
gtagccacaggagccctgc

SEQ ID NO: 5974293 - DNA, 13 bp, Homo sapiens
gtagccaccaccg

SEQ ID NO: 5974294 - DNA, 17 bp, Homo sapiens
gtagccacctccttggc

SEQ ID NO: 5974295 - DNA, 21 bp, Homo sapiens
gtagccacctgagttcctgag

SEQ ID NO: 5974296 - DNA, 19 bp, Homo sapiens
gtagccactctctgcccac

SEQ ID NO: 5974297 - DNA, 21 bp, Homo sapiens
gtagccagagttgttctcagg

SEQ ID NO: 5974298 - DNA, 21 bp, Homo sapiens
gtagccagccggggcgagtgg

SEQ ID NO: 5974299 - DNA, 13 bp, Homo sapiens
gtagccagctgtg

SEQ ID NO: 5974300 - DNA, 23 bp, Homo sapiens
gtagccagggggactagcccctg

SEQ ID NO: 5974301 - DNA, 21 bp, Homo sapiens
gtagccaggtccccctgcagc

SEQ ID NO: 5974302 - DNA, 17 bp, Homo sapiens
gtagccatcaagcactt

SEQ ID NO: 5974303 - DNA, 20 bp, Homo sapiens
gtagccatcccatgaacaca

SEQ ID NO: 5974304 - DNA, 23 bp, Homo sapiens
gtagccatcccatgaacacactg

SEQ ID NO: 5974305 - DNA, 16 bp, Homo sapiens
gtagccatgaggaggc

SEQ ID NO: 5974306 - DNA, 19 bp, Homo sapiens
gtagccatgaggaggcaga

SEQ ID NO: 5974307 - DNA, 20 bp, Homo sapiens
gtagccatgaggaggcagag

SEQ ID NO: 5974308 - DNA, 17 bp, Homo sapiens
tccaggaacacatgcac

SEQ ID NO: 5974309 - DNA, 20 bp, Homo sapiens
tccaggaacacatgcacaca

SEQ ID NO: 5974310 - DNA, 22 bp, Homo sapiens
tccaggaacacatgcacacaca

SEQ ID NO: 5974311 - DNA, 18 bp, Homo sapiens
tccaggaactgcctgggc

SEQ ID NO: 5974312 - DNA, 18 bp, Homo sapiens
tccaggaagaagcagggg

SEQ ID NO: 5974313 - DNA, 13 bp, Homo sapiens
tccaggaagatcc

SEQ ID NO: 5974314 - DNA, 14 bp, Homo sapiens
tccaggaagatcca

SEQ ID NO: 5974315 - DNA, 17 bp, Homo sapiens
tccaggaagcacaggcc

SEQ ID NO: 5974316 - DNA, 19 bp, Homo sapiens
tccaggaagcacaggccag

SEQ ID NO: 5974317 - DNA, 12 bp, Homo sapiens
tccaggaaggca

SEQ ID NO: 5974318 - DNA, 13 bp, Homo sapiens
tccaggaaggcag

SEQ ID NO: 5974319 - DNA, 14 bp, Homo sapiens
tccaggaaggcagc

SEQ ID NO: 5974320 - DNA, 16 bp, Homo sapiens
tccaggaaggcagctg

SEQ ID NO: 5974321 - DNA, 18 bp, Homo sapiens
tccaggaaggcagctgct

SEQ ID NO: 5974322 - DNA, 19 bp, Homo sapiens
tccaggaaggtagcccagc

SEQ ID NO: 5974323 - DNA, 18 bp, Homo sapiens
tccaggaatgctgggccc

SEQ ID NO: 5974324 - DNA, 16 bp, Homo sapiens
tccaggaatggtgctt

SEQ ID NO: 5974325 - DNA, 18 bp, Homo sapiens
tccaggaatggtgcttta

SEQ ID NO: 5974326 - DNA, 19 bp, Homo sapiens
tccaggaattttgtgtgat

SEQ ID NO: 5974327 - DNA, 23 bp, Homo sapiens
tccaggacacagattatcaactg

SEQ ID NO: 5974328 - DNA, 23 bp, Homo sapiens
tccaggacaccacgattctccca

SEQ ID NO: 5974329 - DNA, 19 bp, Homo sapiens
tccaggacaggagatgctg

SEQ ID NO: 5974330 - DNA, 18 bp, Homo sapiens
tccaggacatgatactga

SEQ ID NO: 5974331 - DNA, 13 bp, Homo sapiens
tccaggacccctg

SEQ ID NO: 5974332 - DNA, 18 bp, Homo sapiens
tccaggaccctgccaggc

SEQ ID NO: 5974333 - DNA, 18 bp, Homo sapiens
tccaggaccttgcttcct

SEQ ID NO: 5974334 - DNA, 10 bp, Homo sapiens
tccaggactc

SEQ ID NO: 5974335 - DNA, 15 bp, Homo sapiens
tccaggactccactg

SEQ ID NO: 5974336 - DNA, 17 bp, Homo sapiens
tccaggactccactgga

SEQ ID NO: 5974337 - DNA, 23 bp, Homo sapiens
tccaggactccactggacagacc

SEQ ID NO: 5974338 - DNA, 22 bp, Homo sapiens
tccaggactggggcttgccagg

SEQ ID NO: 5974339 - DNA, 15 bp, Homo sapiens
tccaggactgtttca

SEQ ID NO: 5974340 - DNA, 18 bp, Homo sapiens
tccaggagaaacctcaca

SEQ ID NO: 5974341 - DNA, 23 bp, Homo sapiens
tccaggagaaagccgggggaggg

SEQ ID NO: 5974342 - DNA, 20 bp, Homo sapiens
tccaggagaaggccaattcc

SEQ ID NO: 5974343 - DNA, 23 bp, Homo sapiens
tccaggagaaggccaattcctat

SEQ ID NO: 5974344 - DNA, 21 bp, Homo sapiens
tccaggagaaggggcccaagg

SEQ ID NO: 5974345 - DNA, 23 bp, Homo sapiens
tccaggagaagggggctctgccc

SEQ ID NO: 5974346 - DNA, 16 bp, Homo sapiens
tccaggagaagtgctc

SEQ ID NO: 5974347 - DNA, 16 bp, Homo sapiens
tccaggagacatatat

SEQ ID NO: 5974348 - DNA, 15 bp, Homo sapiens
tccaggagagcctgg

SEQ ID NO: 5974349 - DNA, 16 bp, Homo sapiens
tccaggagagcctggg

SEQ ID NO: 5974350 - DNA, 21 bp, Homo sapiens
tccaggagataattgtttcat

SEQ ID NO: 5974351 - DNA, 22 bp, Homo sapiens
tccaggagattggatttgctgt

SEQ ID NO: 5974352 - DNA, 22 bp, Homo sapiens
tccaggagcaacgccagtggca

SEQ ID NO: 5974353 - DNA, 19 bp, Homo sapiens
tccaggagcacacggccct

SEQ ID NO: 5974354 - DNA, 16 bp, Homo sapiens
tccaggagcagccaca

SEQ ID NO: 5974355 - DNA, 17 bp, Homo sapiens
tccaggagcagccacat

SEQ ID NO: 5974356 - DNA, 16 bp, Homo sapiens
tccaggagcccagagg

SEQ ID NO: 5974357 - DNA, 14 bp, Homo sapiens
tccaggagccccag

SEQ ID NO: 5974358 - DNA, 15 bp, Homo sapiens
tccaggagccccagc

SEQ ID NO: 5974359 - DNA, 19 bp, Homo sapiens
tccaggagccccagccagc

SEQ ID NO: 5974360 - DNA, 20 bp, Homo sapiens
tccaggagccccagccagcc

SEQ ID NO: 5974361 - DNA, 15 bp, Homo sapiens
tccaggagcctgtgc

SEQ ID NO: 5974362 - DNA, 24 bp, Homo sapiens
tccaggagctccagtgtcctgagc

SEQ ID NO: 5974363 - DNA, 23 bp, Homo sapiens
tccaggagcttcttgtttccttg

SEQ ID NO: 5974364 - DNA, 18 bp, Homo sapiens
tccaggaggcagtggaca

SEQ ID NO: 5974365 - DNA, 20 bp, Homo sapiens
tccaggagggaccaccctcc

SEQ ID NO: 5974366 - DNA, 21 bp, Homo sapiens
tccaggagggcatcagctttc

SEQ ID NO: 5974367 - DNA, 15 bp, Homo sapiens
tccaggagggctcgg

SEQ ID NO: 5974368 - DNA, 11 bp, Homo sapiens
tccaggagggg

SEQ ID NO: 5974369 - DNA, 15 bp, Homo sapiens
tccaggaggggcctg

SEQ ID NO: 5974370 - DNA, 18 bp, Homo sapiens
tccaggaggggcctgggc

SEQ ID NO: 5974371 - DNA, 23 bp, Homo sapiens
tccaggaggggcctgggcagccc

SEQ ID NO: 5974372 - DNA, 19 bp, Homo sapiens
tccaggataaggagactga

SEQ ID NO: 5974373 - DNA, 14 bp, Homo sapiens
tccaggatcctcct

SEQ ID NO: 5974374 - DNA, 15 bp, Homo sapiens
tccaggatcctcctg

SEQ ID NO: 5974375 - DNA, 19 bp, Homo sapiens
tccaggatctttgactgaa

SEQ ID NO: 5974376 - DNA, 21 bp, Homo sapiens
tccaggatctttgactgaaaa

SEQ ID NO: 5974377 - DNA, 14 bp, Homo sapiens
tccaggatggaatt

SEQ ID NO: 5974378 - DNA, 16 bp, Homo sapiens
tccaggatggagggtc

SEQ ID NO: 5974379 - DNA, 21 bp, Homo sapiens
tccaggatggatgcatcacac

SEQ ID NO: 5974380 - DNA, 15 bp, Homo sapiens
tccaggatggggagg

SEQ ID NO: 5974381 - DNA, 20 bp, Homo sapiens
tccaggatggtgttactgca

SEQ ID NO: 5974382 - DNA, 22 bp, Homo sapiens
tccaggatggtgttactgcagt

SEQ ID NO: 5974383 - DNA, 17 bp, Homo sapiens
tccaggattccaaagtt

SEQ ID NO: 5974384 - DNA, 15 bp, Homo sapiens
tccaggattcctctt

SEQ ID NO: 5974385 - DNA, 18 bp, Homo sapiens
tccaggattggcctgtgt

SEQ ID NO: 5974386 - DNA, 21 bp, Homo sapiens
tccaggattgtccacaaatgt

SEQ ID NO: 5974387 - DNA, 23 bp, Homo sapiens
tccaggattgtccacaaatgtcc

SEQ ID NO: 5974388 - DNA, 17 bp, Homo sapiens
tccaggatttaggcctt

SEQ ID NO: 5974389 - DNA, 18 bp, Homo sapiens
tccaggatttataaagca

SEQ ID NO: 5974390 - DNA, 21 bp, Homo sapiens
tccaggcaaagctggagatga

SEQ ID NO: 5974391 - DNA, 20 bp, Homo sapiens
tccaggcaatcgttctgctg

SEQ ID NO: 5974392 - DNA, 22 bp, Homo sapiens
tccaggcaatcgttctgctggc

SEQ ID NO: 5974393 - DNA, 22 bp, Homo sapiens
tccaggcaatggcctaaacttc

SEQ ID NO: 5974394 - DNA, 17 bp, Homo sapiens
tccaggcacagctgagt

SEQ ID NO: 5974395 - DNA, 13 bp, Homo sapiens
tccaggcacagga

SEQ ID NO: 5974396 - DNA, 21 bp, Homo sapiens
tccaggcacccttctttcctc

SEQ ID NO: 5974397 - DNA, 23 bp, Homo sapiens
tccaggcacccttctttcctctt

SEQ ID NO: 5974398 - DNA, 14 bp, Homo sapiens
tccaggcaccgcct

SEQ ID NO: 5974399 - DNA, 17 bp, Homo sapiens
tccaggcaccgcctgcc

SEQ ID NO: 5974400 - DNA, 21 bp, Homo sapiens
tccaggcaccgcctgccccca

SEQ ID NO: 5974401 - DNA, 12 bp, Homo sapiens
tccaggcagaag

SEQ ID NO: 5974402 - DNA, 15 bp, Homo sapiens
tccaggcagatccag

SEQ ID NO: 5974403 - DNA, 18 bp, Homo sapiens
tccaggcagatccaggac

SEQ ID NO: 5974404 - DNA, 11 bp, Homo sapiens
tccaggcagcc

SEQ ID NO: 5974405 - DNA, 13 bp, Homo sapiens
tccaggcagccgc

SEQ ID NO: 5974406 - DNA, 15 bp, Homo sapiens
tccaggcagcctctg

SEQ ID NO: 5974407 - DNA, 15 bp, Homo sapiens
tccaggcagctccct

SEQ ID NO: 5974408 - DNA, 23 bp, Homo sapiens
tccaggcaggacgagactcctcg

SEQ ID NO: 5974409 - DNA, 17 bp, Homo sapiens
tccaggcatgaccctgg

SEQ ID NO: 5974410 - DNA, 17 bp, Homo sapiens
tccaggcatgctggcct

SEQ ID NO: 5974411 - DNA, 18 bp, Homo sapiens
tccaggccaaagccccat

SEQ ID NO: 5974412 - DNA, 16 bp, Homo sapiens
tccaggccactgtggc

SEQ ID NO: 5974413 - DNA, 21 bp, Homo sapiens
tccaggccactgtggccagag

SEQ ID NO: 5974414 - DNA, 14 bp, Homo sapiens
tccaggccagctcc

SEQ ID NO: 5974415 - DNA, 19 bp, Homo sapiens
tccaggccagctccttttc

SEQ ID NO: 5974416 - DNA, 23 bp, Homo sapiens
tccaggccagctccttttctgtg

SEQ ID NO: 5974417 - DNA, 15 bp, Homo sapiens
tccaggccagggctc

SEQ ID NO: 5974418 - DNA, 15 bp, Homo sapiens
tccaggccaggtggg

SEQ ID NO: 5974419 - DNA, 17 bp, Homo sapiens
tccaggccagtgggcct

SEQ ID NO: 5974420 - DNA, 21 bp, Homo sapiens
tccaggccatcagaggcctag

SEQ ID NO: 5974421 - DNA, 17 bp, Homo sapiens
tccaggccatggaggca

SEQ ID NO: 5974422 - DNA, 20 bp, Homo sapiens
tccaggcccaaggctcccgg

SEQ ID NO: 5974423 - DNA, 14 bp, Homo sapiens
tccaggcccagcct

SEQ ID NO: 5974424 - DNA, 15 bp, Homo sapiens
tccaggcccatctca

SEQ ID NO: 5974425 - DNA, 19 bp, Homo sapiens
tccaggccccaccggccag

SEQ ID NO: 5974426 - DNA, 15 bp, Homo sapiens
tccaggccccaggct

SEQ ID NO: 5974427 - DNA, 22 bp, Homo sapiens
tccaggccccaggctggatgct

SEQ ID NO: 5974428 - DNA, 14 bp, Homo sapiens
tccaggccccaggt

SEQ ID NO: 5974429 - DNA, 22 bp, Homo sapiens
tccaggccccatcagcatccca

SEQ ID NO: 5974430 - DNA, 13 bp, Homo sapiens
tccaggcccccaa

SEQ ID NO: 5974431 - DNA, 23 bp, Homo sapiens
tccaggcccccaacccctccttc

SEQ ID NO: 5974432 - DNA, 15 bp, Homo sapiens
tccaggcccccagcc

SEQ ID NO: 5974433 - DNA, 16 bp, Homo sapiens
tccaggcccccagccc

SEQ ID NO: 5974434 - DNA, 19 bp, Homo sapiens
tccaggcccccagcccctc

SEQ ID NO: 5974435 - DNA, 21 bp, Homo sapiens
tccaggcccccagcccctcct

SEQ ID NO: 5974436 - DNA, 22 bp, Homo sapiens
tccaggcccccagcccctcctc

SEQ ID NO: 5974437 - DNA, 23 bp, Homo sapiens
tccaggcccccagcccctcctcc

SEQ ID NO: 5974438 - DNA, 20 bp, Homo sapiens
tccaggcccctgaggactgg

SEQ ID NO: 5974439 - DNA, 18 bp, Homo sapiens
tccaggcccgtctgtcca

SEQ ID NO: 5974440 - DNA, 20 bp, Homo sapiens
tccaggcccgtctgtccatc

SEQ ID NO: 5974441 - DNA, 22 bp, Homo sapiens
tccaggcccgtctgtccatctg

SEQ ID NO: 5974442 - DNA, 13 bp, Homo sapiens
tccaggccctcca

SEQ ID NO: 5974443 - DNA, 13 bp, Homo sapiens
tccaggccctgcc

SEQ ID NO: 5974444 - DNA, 14 bp, Homo sapiens
tccaggccctgccc

SEQ ID NO: 5974445 - DNA, 11 bp, Homo sapiens
tccaggccctt

SEQ ID NO: 5974446 - DNA, 18 bp, Homo sapiens
tccaggccgcgccctttc

SEQ ID NO: 5974447 - DNA, 17 bp, Homo sapiens
tccaggcctctctctgc

SEQ ID NO: 5974448 - DNA, 16 bp, Homo sapiens
tccaggcctgaccagg

SEQ ID NO: 5974449 - DNA, 16 bp, Homo sapiens
tccaggcctgatcttg

SEQ ID NO: 5974450 - DNA, 14 bp, Homo sapiens
tccaggcctgcagg

SEQ ID NO: 5974451 - DNA, 18 bp, Homo sapiens
tccaggcctgcaggggca

SEQ ID NO: 5974452 - DNA, 15 bp, Homo sapiens
tccaggcctgcctcc

SEQ ID NO: 5974453 - DNA, 15 bp, Homo sapiens
tccaggcctgggtca

SEQ ID NO: 5974454 - DNA, 11 bp, Homo sapiens
tccaggcctgt

SEQ ID NO: 5974455 - DNA, 20 bp, Homo sapiens
tccaggcgtagggccagggc

SEQ ID NO: 5974456 - DNA, 23 bp, Homo sapiens
tccaggcgtgggacgtggtcagg

SEQ ID NO: 5974457 - DNA, 13 bp, Homo sapiens
tccaggctccagc

SEQ ID NO: 5974458 - DNA, 15 bp, Homo sapiens
tccaggctccaggct

SEQ ID NO: 5974459 - DNA, 16 bp, Homo sapiens
tccaggctccaggctg

SEQ ID NO: 5974460 - DNA, 12 bp, Homo sapiens
tccaggctcctt

SEQ ID NO: 5974461 - DNA, 16 bp, Homo sapiens
tccaggctctgggcac

SEQ ID NO: 5974462 - DNA, 17 bp, Homo sapiens
tccaggctctgggcaca

SEQ ID NO: 5974463 - DNA, 19 bp, Homo sapiens
tccaggctctgggcacagt

SEQ ID NO: 5974464 - DNA, 20 bp, Homo sapiens
tccaggctctgggcacagtg

SEQ ID NO: 5974465 - DNA, 15 bp, Homo sapiens
tccaggctcttcctg

SEQ ID NO: 5974466 - DNA, 12 bp, Homo sapiens
tccaggctgact

SEQ ID NO: 5974467 - DNA, 11 bp, Homo sapiens
tccaggctgag

SEQ ID NO: 5974468 - DNA, 13 bp, Homo sapiens
tccaggctgagag

SEQ ID NO: 5974469 - DNA, 13 bp, Homo sapiens
tccaggctgagcc

SEQ ID NO: 5974470 - DNA, 19 bp, Homo sapiens
tccaggctggagtgcaatg

SEQ ID NO: 5974471 - DNA, 20 bp, Homo sapiens
tccaggctgggagagccttc

SEQ ID NO: 5974472 - DNA, 21 bp, Homo sapiens
tccaggctgggagagccttcc

SEQ ID NO: 5974473 - DNA, 15 bp, Homo sapiens
tccaggctgggcagc

SEQ ID NO: 5974474 - DNA, 13 bp, Homo sapiens
tccaggctgggct

SEQ ID NO: 5974475 - DNA, 12 bp, Homo sapiens
tccaggctgggg

SEQ ID NO: 5974476 - DNA, 14 bp, Homo sapiens
tccaggctggggcc

SEQ ID NO: 5974477 - DNA, 15 bp, Homo sapiens
tccaggctggggcct

SEQ ID NO: 5974478 - DNA, 16 bp, Homo sapiens
tccaggctggggcctg

SEQ ID NO: 5974479 - DNA, 20 bp, Homo sapiens
tccaggctggggcctggcct

SEQ ID NO: 5974480 - DNA, 11 bp, Homo sapiens
tccaggctggt

SEQ ID NO: 5974481 - DNA, 21 bp, Homo sapiens
tccaggctgtatcccatgagc

SEQ ID NO: 5974482 - DNA, 17 bp, Homo sapiens
tccaggctgttctcagc

SEQ ID NO: 5974483 - DNA, 19 bp, Homo sapiens
tccaggctgttctcagcgt

SEQ ID NO: 5974484 - DNA, 14 bp, Homo sapiens
tccaggctgtttct

SEQ ID NO: 5974485 - DNA, 16 bp, Homo sapiens
tccaggcttccacact

SEQ ID NO: 5974486 - DNA, 23 bp, Homo sapiens
tccatgacagtagcatactgatg

SEQ ID NO: 5974487 - DNA, 19 bp, Homo sapiens
tccatgacatttttcctct

SEQ ID NO: 5974488 - DNA, 20 bp, Homo sapiens
tccatgacctagttttccat

SEQ ID NO: 5974489 - DNA, 20 bp, Homo sapiens
tccatgaccttaaggcagta

SEQ ID NO: 5974490 - DNA, 23 bp, Homo sapiens
tccatgaccttaaggcagtagtt

SEQ ID NO: 5974491 - DNA, 15 bp, Homo sapiens
tccatgactctgcct

SEQ ID NO: 5974492 - DNA, 16 bp, Homo sapiens
tccatgactctgccta

SEQ ID NO: 5974493 - DNA, 17 bp, Homo sapiens
tccatgactctgcctaa

SEQ ID NO: 5974494 - DNA, 15 bp, Homo sapiens
tccatgactgcttgc

SEQ ID NO: 5974495 - DNA, 19 bp, Homo sapiens
tccatgactgcttgcccta

SEQ ID NO: 5974496 - DNA, 17 bp, Homo sapiens
tccatgagatagctatt

SEQ ID NO: 5974497 - DNA, 13 bp, Homo sapiens
tccatgagctgct

SEQ ID NO: 5974498 - DNA, 18 bp, Homo sapiens
tccatgagggtgggggtg

SEQ ID NO: 5974499 - DNA, 19 bp, Homo sapiens
tccatgagtttgccctggt

SEQ ID NO: 5974500 - DNA, 22 bp, Homo sapiens
tccatgatactttaatttttat

SEQ ID NO: 5974501 - DNA, 17 bp, Homo sapiens
tccatgatcaaaatgca

SEQ ID NO: 5974502 - DNA, 18 bp, Homo sapiens
tccatgatcaaaatgcat

SEQ ID NO: 5974503 - DNA, 16 bp, Homo sapiens
tccatgatcacacagc

SEQ ID NO: 5974504 - DNA, 13 bp, Homo sapiens
tccatgatgcaca

SEQ ID NO: 5974505 - DNA, 15 bp, Homo sapiens
tccatgatgcacagt

SEQ ID NO: 5974506 - DNA, 18 bp, Homo sapiens
tccatgatgcacagtatc

SEQ ID NO: 5974507 - DNA, 20 bp, Homo sapiens
tccatgatgcacagtatctg

SEQ ID NO: 5974508 - DNA, 14 bp, Homo sapiens
tccatgatggaata

SEQ ID NO: 5974509 - DNA, 12 bp, Homo sapiens
tccatgatggag

SEQ ID NO: 5974510 - DNA, 20 bp, Homo sapiens
tccatgatgtaatggaagct

SEQ ID NO: 5974511 - DNA, 15 bp, Homo sapiens
tccatgattccaagg

SEQ ID NO: 5974512 - DNA, 19 bp, Homo sapiens
tccatgatttagcaagcaa

SEQ ID NO: 5974513 - DNA, 20 bp, Homo sapiens
tccatgatttagcaagcaac

SEQ ID NO: 5974514 - DNA, 14 bp, Homo sapiens
tccatgcaactgga

SEQ ID NO: 5974515 - DNA, 12 bp, Homo sapiens
tccatgcacagg

SEQ ID NO: 5974516 - DNA, 17 bp, Homo sapiens
tccatgcacctcccttc

SEQ ID NO: 5974517 - DNA, 17 bp, Homo sapiens
tccatgcactttaattg

SEQ ID NO: 5974518 - DNA, 21 bp, Homo sapiens
tccatgcactttaattgaaga

SEQ ID NO: 5974519 - DNA, 17 bp, Homo sapiens
tccatgcatgacagcct

SEQ ID NO: 5974520 - DNA, 19 bp, Homo sapiens
tccatgcatgacagcctct

SEQ ID NO: 5974521 - DNA, 13 bp, Homo sapiens
tccatgcccactg

SEQ ID NO: 5974522 - DNA, 16 bp, Homo sapiens
tccatgcccactgctg

SEQ ID NO: 5974523 - DNA, 21 bp, Homo sapiens
tccatgcccccgccacctccc

SEQ ID NO: 5974524 - DNA, 21 bp, Homo sapiens
tccatgccctcccaggaccct

SEQ ID NO: 5974525 - DNA, 14 bp, Homo sapiens
tccatgccctggga

SEQ ID NO: 5974526 - DNA, 23 bp, Homo sapiens
tccatgccctgggatgcctcacc

SEQ ID NO: 5974527 - DNA, 22 bp, Homo sapiens
tccatgcctatttactggaaac

SEQ ID NO: 5974528 - DNA, 13 bp, Homo sapiens
tccatgcctctgg

SEQ ID NO: 5974529 - DNA, 14 bp, Homo sapiens
tccatgcctctgga

SEQ ID NO: 5974530 - DNA, 19 bp, Homo sapiens
tccatgcctctggaggcct

SEQ ID NO: 5974531 - DNA, 12 bp, Homo sapiens
tccatgcctgag

SEQ ID NO: 5974532 - DNA, 13 bp, Homo sapiens
tccatgcctgagg

SEQ ID NO: 5974533 - DNA, 16 bp, Homo sapiens
tccatgcctgagggtg

SEQ ID NO: 5974534 - DNA, 14 bp, Homo sapiens
tccatgcctggccc

SEQ ID NO: 5974535 - DNA, 16 bp, Homo sapiens
tccatgcctggccctt

SEQ ID NO: 5974536 - DNA, 19 bp, Homo sapiens
tccatgcctggcccttgcc

SEQ ID NO: 5974537 - DNA, 21 bp, Homo sapiens
tccatgcctgtagctttcctg

SEQ ID NO: 5974538 - DNA, 18 bp, Homo sapiens
tccatgcggccggcctgg

SEQ ID NO: 5974539 - DNA, 21 bp, Homo sapiens
tccatgcgtgtttctgactct

SEQ ID NO: 5974540 - DNA, 16 bp, Homo sapiens
tccatgctccttgaga

SEQ ID NO: 5974541 - DNA, 20 bp, Homo sapiens
tccatgctgcaaaggagaag

SEQ ID NO: 5974542 - DNA, 14 bp, Homo sapiens
tccatgctgcctcc

SEQ ID NO: 5974543 - DNA, 20 bp, Homo sapiens
tccatgctgggtctgaggcc

SEQ ID NO: 5974544 - DNA, 12 bp, Homo sapiens
tccatgctgtcc

SEQ ID NO: 5974545 - DNA, 14 bp, Homo sapiens
tccatgctgtccct

SEQ ID NO: 5974546 - DNA, 9 bp, Homo sapiens
tccatgctt

SEQ ID NO: 5974547 - DNA, 19 bp, Homo sapiens
tccatgcttagtcactgcc

SEQ ID NO: 5974548 - DNA, 23 bp, Homo sapiens
tccatgcttagtcactgcctgca

SEQ ID NO: 5974549 - DNA, 14 bp, Homo sapiens
tccatgcttcactc

SEQ ID NO: 5974550 - DNA, 15 bp, Homo sapiens
tccatggaatgcttg

SEQ ID NO: 5974551 - DNA, 17 bp, Homo sapiens
tccatggaatgcttgaa

SEQ ID NO: 5974552 - DNA, 18 bp, Homo sapiens
tccatggaatgcttgaaa

SEQ ID NO: 5974553 - DNA, 21 bp, Homo sapiens
tccatggaatgcttgaaaaat

SEQ ID NO: 5974554 - DNA, 22 bp, Homo sapiens
tccatggaatgcttgaaaaatg

SEQ ID NO: 5974555 - DNA, 23 bp, Homo sapiens
tccatggaatgcttgaaaaatgt

SEQ ID NO: 5974556 - DNA, 16 bp, Homo sapiens
tccatggaatttctag

SEQ ID NO: 5974557 - DNA, 17 bp, Homo sapiens
tccatggacatgggcag

SEQ ID NO: 5974558 - DNA, 18 bp, Homo sapiens
tccatggacatgggcagc

SEQ ID NO: 5974559 - DNA, 22 bp, Homo sapiens
tccatggagcctacctctgtct

SEQ ID NO: 5974560 - DNA, 14 bp, Homo sapiens
tccatggaggaggt

SEQ ID NO: 5974561 - DNA, 16 bp, Homo sapiens
tccatggcaaatgggc

SEQ ID NO: 5974562 - DNA, 16 bp, Homo sapiens
tccatggcaattttgt

SEQ ID NO: 5974563 - DNA, 18 bp, Homo sapiens
tccatggcaccagccccc

SEQ ID NO: 5974564 - DNA, 14 bp, Homo sapiens
tccatggcagcagc

SEQ ID NO: 5974565 - DNA, 15 bp, Homo sapiens
tccatggcagcagcc

SEQ ID NO: 5974566 - DNA, 16 bp, Homo sapiens
tccatggcagcagcca

SEQ ID NO: 5974567 - DNA, 17 bp, Homo sapiens
tccatggccagcagcac

SEQ ID NO: 5974568 - DNA, 14 bp, Homo sapiens
tccatggccctgcc

SEQ ID NO: 5974569 - DNA, 19 bp, Homo sapiens
tccatggccctgtcccagg

SEQ ID NO: 5974570 - DNA, 22 bp, Homo sapiens
tccatggccgtgtagaagcatg

SEQ ID NO: 5974571 - DNA, 13 bp, Homo sapiens
tccatggcctttc

SEQ ID NO: 5974572 - DNA, 15 bp, Homo sapiens
tccatggcctttcta

SEQ ID NO: 5974573 - DNA, 21 bp, Homo sapiens
tccatggctaagaccacagac

SEQ ID NO: 5974574 - DNA, 15 bp, Homo sapiens
tccatggcttcctcc

SEQ ID NO: 5974575 - DNA, 16 bp, Homo sapiens
tccatggcttcctcct

SEQ ID NO: 5974576 - DNA, 20 bp, Homo sapiens
tccatggcttcctcctccct

SEQ ID NO: 5974577 - DNA, 22 bp, Homo sapiens
tccatggcttcctgagaaagcc

SEQ ID NO: 5974578 - DNA, 17 bp, Homo sapiens
tccatgggaaagatggt

SEQ ID NO: 5974579 - DNA, 17 bp, Homo sapiens
tccatgggatacaacct

SEQ ID NO: 5974580 - DNA, 19 bp, Homo sapiens
tccatgggcacctctgctg

SEQ ID NO: 5974581 - DNA, 17 bp, Homo sapiens
tccatgggcagagccca

SEQ ID NO: 5974582 - DNA, 15 bp, Homo sapiens
tccatgggcagtatg

SEQ ID NO: 5974583 - DNA, 15 bp, Homo sapiens
tccatgggccaccgc

SEQ ID NO: 5974584 - DNA, 18 bp, Homo sapiens
tccatgggccccaccatt

SEQ ID NO: 5974585 - DNA, 15 bp, Homo sapiens
tccatgggggcaggg

SEQ ID NO: 5974586 - DNA, 18 bp, Homo sapiens
tccatgggggctcagcca

SEQ ID NO: 5974587 - DNA, 19 bp, Homo sapiens
tccatgggggctcagccag

SEQ ID NO: 5974588 - DNA, 22 bp, Homo sapiens
tccatggggtctctcacagaca

SEQ ID NO: 5974589 - DNA, 17 bp, Homo sapiens
tccatggggttcgagac

SEQ ID NO: 5974590 - DNA, 16 bp, Homo sapiens
tccatgggtctggcct

SEQ ID NO: 5974591 - DNA, 17 bp, Homo sapiens
tccatgggtctggctag

SEQ ID NO: 5974592 - DNA, 22 bp, Homo sapiens
tccatggtgaactgaagcagag

SEQ ID NO: 5974593 - DNA, 23 bp, Homo sapiens
tccatggtgaactgaagcagagt

SEQ ID NO: 5974594 - DNA, 13 bp, Homo sapiens
tccatggtgctaa

SEQ ID NO: 5974595 - DNA, 16 bp, Homo sapiens
tccatggtgctgcatt

SEQ ID NO: 5974596 - DNA, 13 bp, Homo sapiens
tccatggtggttt

SEQ ID NO: 5974597 - DNA, 23 bp, Homo sapiens
tccatggtggtttcagaaagggc

SEQ ID NO: 5974598 - DNA, 22 bp, Homo sapiens
tccatggttaccatgggtgtgg

SEQ ID NO: 5974599 - DNA, 14 bp, Homo sapiens
tccatggttctcaa

SEQ ID NO: 5974600 - DNA, 15 bp, Homo sapiens
tccatggttctcaat

SEQ ID NO: 5974601 - DNA, 18 bp, Homo sapiens
tccatggttctcaattta

SEQ ID NO: 5974602 - DNA, 13 bp, Homo sapiens
tccatgtaaatac

SEQ ID NO: 5974603 - DNA, 12 bp, Homo sapiens
tccatgtaactg

SEQ ID NO: 5974604 - DNA, 14 bp, Homo sapiens
tccatgtaactgcc

SEQ ID NO: 5974605 - DNA, 16 bp, Homo sapiens
tccatgtactgtagtt

SEQ ID NO: 5974606 - DNA, 21 bp, Homo sapiens
tccatgtacttccctcttgaa

SEQ ID NO: 5974607 - DNA, 14 bp, Homo sapiens
tccatgtacttgtt

SEQ ID NO: 5974608 - DNA, 18 bp, Homo sapiens
tccatgtacttgtttgca

SEQ ID NO: 5974609 - DNA, 19 bp, Homo sapiens
tccatgtagcctttaatat

SEQ ID NO: 5974610 - DNA, 21 bp, Homo sapiens
tccatgtataagtgtaaatat

SEQ ID NO: 5974611 - DNA, 15 bp, Homo sapiens
tccatgtatgcataa

SEQ ID NO: 5974612 - DNA, 14 bp, Homo sapiens
tccatgtcagataa

SEQ ID NO: 5974613 - DNA, 18 bp, Homo sapiens
tccatgtcccctcccaga

SEQ ID NO: 5974614 - DNA, 14 bp, Homo sapiens
tccatgtccctgta

SEQ ID NO: 5974615 - DNA, 18 bp, Homo sapiens
tccatgtcctatgcctca

SEQ ID NO: 5974616 - DNA, 18 bp, Homo sapiens
tccatgtcctatgtgtga

SEQ ID NO: 5974617 - DNA, 21 bp, Homo sapiens
tccatgtctgtagttgctttg

SEQ ID NO: 5974618 - DNA, 17 bp, Homo sapiens
tccatgtgaaaataaaa

SEQ ID NO: 5974619 - DNA, 19 bp, Homo sapiens
tccatgtgaaacatgttgc

SEQ ID NO: 5974620 - DNA, 17 bp, Homo sapiens
tccatgtgaaatttaca

SEQ ID NO: 5974621 - DNA, 18 bp, Homo sapiens
tccatgtgagaatatttt

SEQ ID NO: 5974622 - DNA, 21 bp, Homo sapiens
tccatgtgagggttttcagca

SEQ ID NO: 5974623 - DNA, 18 bp, Homo sapiens
tccatgtgatctcattgt

SEQ ID NO: 5974624 - DNA, 14 bp, Homo sapiens
tccatgtgcatata

SEQ ID NO: 5974625 - DNA, 14 bp, Homo sapiens
tccatgtgcccagt

SEQ ID NO: 5974626 - DNA, 13 bp, Homo sapiens
tccatgtgccttt

SEQ ID NO: 5974627 - DNA, 14 bp, Homo sapiens
tccatgtgcctttc

SEQ ID NO: 5974628 - DNA, 19 bp, Homo sapiens
tccatgtgcctttctttgc

SEQ ID NO: 5974629 - DNA, 17 bp, Homo sapiens
tccatgtggactgtgcc

SEQ ID NO: 5974630 - DNA, 18 bp, Homo sapiens
tccatgtggacttaggaa

SEQ ID NO: 5974631 - DNA, 22 bp, Homo sapiens
tccatgtggccccaggtgccac

SEQ ID NO: 5974632 - DNA, 13 bp, Homo sapiens
tccatgtggcctt

SEQ ID NO: 5974633 - DNA, 21 bp, Homo sapiens
tccatgtgtcccccctgtggt

SEQ ID NO: 5974634 - DNA, 18 bp, Homo sapiens
tccatgtgtgtgcaagtg

SEQ ID NO: 5974635 - DNA, 13 bp, Homo sapiens
tccatgtgttcca

SEQ ID NO: 5974636 - DNA, 14 bp, Homo sapiens
tccatgtgttccaa

SEQ ID NO: 5974637 - DNA, 18 bp, Homo sapiens
tccatgtgttttgctttt

SEQ ID NO: 5974638 - DNA, 16 bp, Homo sapiens
tccatgttctattttt

SEQ ID NO: 5974639 - DNA, 18 bp, Homo sapiens
tccatgttctgggtgatg

SEQ ID NO: 5974640 - DNA, 18 bp, Homo sapiens
tccatgttggcctgtcac

SEQ ID NO: 5974641 - DNA, 22 bp, Homo sapiens
tccatgttggcctgtcaccaga

SEQ ID NO: 5974642 - DNA, 24 bp, Homo sapiens
tccatgttggtcaggctggtctca

SEQ ID NO: 5974643 - DNA, 18 bp, Homo sapiens
tccatgtttagaaataaa

SEQ ID NO: 5974644 - DNA, 20 bp, Homo sapiens
tccatgtttattgtttttta

SEQ ID NO: 5974645 - DNA, 17 bp, Homo sapiens
tccatgtttgcaatgct

SEQ ID NO: 5974646 - DNA, 16 bp, Homo sapiens
tccatgttttaaaatt

SEQ ID NO: 5974647 - DNA, 17 bp, Homo sapiens
tccatgttttaaaatta

SEQ ID NO: 5974648 - DNA, 17 bp, Homo sapiens
tccattaaaaagttgtt

SEQ ID NO: 5974649 - DNA, 18 bp, Homo sapiens
tccattaaacttctactg

SEQ ID NO: 5974650 - DNA, 19 bp, Homo sapiens
tccattaaacttctactga

SEQ ID NO: 5974651 - DNA, 23 bp, Homo sapiens
tccattaaacttctactgagcaa

SEQ ID NO: 5974652 - DNA, 13 bp, Homo sapiens
tccattaaaggtg

SEQ ID NO: 5974653 - DNA, 18 bp, Homo sapiens
tccattaaatcaatcagg

SEQ ID NO: 5974654 - DNA, 20 bp, Homo sapiens
tccattaaattgcctttgta

SEQ ID NO: 5974655 - DNA, 14 bp, Homo sapiens
tccattaacagcaa

SEQ ID NO: 5974656 - DNA, 22 bp, Homo sapiens
tccattaacttagcatgtgttg

SEQ ID NO: 5974657 - DNA, 17 bp, Homo sapiens
tccattaataactgaat

SEQ ID NO: 5974658 - DNA, 21 bp, Homo sapiens
tccattaatgtagataaagca

SEQ ID NO: 5974659 - DNA, 21 bp, Homo sapiens
tccattaatttaaatgattta

SEQ ID NO: 5974660 - DNA, 18 bp, Homo sapiens
tccattaatttcaacata

SEQ ID NO: 5974661 - DNA, 16 bp, Homo sapiens
tccattactaaagaca

SEQ ID NO: 5974662 - DNA, 14 bp, Homo sapiens
tccattactgtgat

SEQ ID NO: 5974663 - DNA, 14 bp, Homo sapiens
tccattagaatgct

SEQ ID NO: 5974664 - DNA, 13 bp, Homo sapiens
tgtccccatagct

SEQ ID NO: 5974665 - DNA, 20 bp, Homo sapiens
tgtccccatctaggtcctgg

SEQ ID NO: 5974666 - DNA, 21 bp, Homo sapiens
tgtccccatgggctcccactg

SEQ ID NO: 5974667 - DNA, 23 bp, Homo sapiens
tgtcccccaaggttttggagtca

SEQ ID NO: 5974668 - DNA, 13 bp, Homo sapiens
tgtcccccactct

SEQ ID NO: 5974669 - DNA, 22 bp, Homo sapiens
tgtcccccactctctcacccac

SEQ ID NO: 5974670 - DNA, 23 bp, Homo sapiens
tgtcccccactctctcacccacc

SEQ ID NO: 5974671 - DNA, 15 bp, Homo sapiens
tgtcccccagctctg

SEQ ID NO: 5974672 - DNA, 14 bp, Homo sapiens
tgtcccccaggctg

SEQ ID NO: 5974673 - DNA, 16 bp, Homo sapiens
tgtcccccaggctgga

SEQ ID NO: 5974674 - DNA, 14 bp, Homo sapiens
tgtcccccaggggc

SEQ ID NO: 5974675 - DNA, 20 bp, Homo sapiens
tgtcccccaggttccgaaga

SEQ ID NO: 5974676 - DNA, 15 bp, Homo sapiens
tgtccccccactccc

SEQ ID NO: 5974677 - DNA, 19 bp, Homo sapiens
tgtcccccccaggccttgt

SEQ ID NO: 5974678 - DNA, 13 bp, Homo sapiens
tgtcccccctgtg

SEQ ID NO: 5974679 - DNA, 15 bp, Homo sapiens
tgtcccccctgtggt

SEQ ID NO: 5974680 - DNA, 15 bp, Homo sapiens
tgtccccccttgaag

SEQ ID NO: 5974681 - DNA, 22 bp, Homo sapiens
tgtccccccttgaagcaataac

SEQ ID NO: 5974682 - DNA, 14 bp, Homo sapiens
tgtcccccggggca

SEQ ID NO: 5974683 - DNA, 13 bp, Homo sapiens
tgtccccctgtga

SEQ ID NO: 5974684 - DNA, 22 bp, Homo sapiens
tgtcccccttggaggagggctg

SEQ ID NO: 5974685 - DNA, 21 bp, Homo sapiens
tgtccccctttagatctctga

SEQ ID NO: 5974686 - DNA, 22 bp, Homo sapiens
tgtccccgagccgagctctcct

SEQ ID NO: 5974687 - DNA, 19 bp, Homo sapiens
tgtccccgccttccctcac

SEQ ID NO: 5974688 - DNA, 22 bp, Homo sapiens
tgtccccggggtattagcacct

SEQ ID NO: 5974689 - DNA, 17 bp, Homo sapiens
tgtccccgtgttgcatg

SEQ ID NO: 5974690 - DNA, 16 bp, Homo sapiens
tgtcccctatgccact

SEQ ID NO: 5974691 - DNA, 16 bp, Homo sapiens
tgtcccctcacagact

SEQ ID NO: 5974692 - DNA, 13 bp, Homo sapiens
tgtcccctctgtc

SEQ ID NO: 5974693 - DNA, 11 bp, Homo sapiens
tgtcccctctt

SEQ ID NO: 5974694 - DNA, 16 bp, Homo sapiens
tgtcccctgacagggc

SEQ ID NO: 5974695 - DNA, 18 bp, Homo sapiens
tgtcccctgacctgtcca

SEQ ID NO: 5974696 - DNA, 14 bp, Homo sapiens
tgtcccctgcgggc

SEQ ID NO: 5974697 - DNA, 15 bp, Homo sapiens
tgtcccctggggctg

SEQ ID NO: 5974698 - DNA, 13 bp, Homo sapiens
tgtcccctgggtc

SEQ ID NO: 5974699 - DNA, 13 bp, Homo sapiens
tgtcccctgtccc

SEQ ID NO: 5974700 - DNA, 14 bp, Homo sapiens
tgtcccctgtccca

SEQ ID NO: 5974701 - DNA, 20 bp, Homo sapiens
tgtcccctgtcccaccaact

SEQ ID NO: 5974702 - DNA, 21 bp, Homo sapiens
tgtccccttcctgttcttcct

SEQ ID NO: 5974703 - DNA, 20 bp, Homo sapiens
tgtcccggagctcaggccct

SEQ ID NO: 5974704 - DNA, 22 bp, Homo sapiens
tgtccctaagtaagtttcttcc

SEQ ID NO: 5974705 - DNA, 17 bp, Homo sapiens
tgtccctaccactgagc

SEQ ID NO: 5974706 - DNA, 18 bp, Homo sapiens
tgtccctaccactgagcc

SEQ ID NO: 5974707 - DNA, 21 bp, Homo sapiens
tgtccctaccactgagccctt

SEQ ID NO: 5974708 - DNA, 12 bp, Homo sapiens
tgtccctaccca

SEQ ID NO: 5974709 - DNA, 20 bp, Homo sapiens
tgtccctaccgagtctcttc

SEQ ID NO: 5974710 - DNA, 14 bp, Homo sapiens
tgtccctagctcac

SEQ ID NO: 5974711 - DNA, 19 bp, Homo sapiens
tgtccctagctcacactca

SEQ ID NO: 5974712 - DNA, 17 bp, Homo sapiens
tgtccctagggctctcc

SEQ ID NO: 5974713 - DNA, 13 bp, Homo sapiens
tgtccctaggtgt

SEQ ID NO: 5974714 - DNA, 18 bp, Homo sapiens
tgtccctattctgccatg

SEQ ID NO: 5974715 - DNA, 20 bp, Homo sapiens
tgtccctatttatgatttca

SEQ ID NO: 5974716 - DNA, 22 bp, Homo sapiens
tgtccctcactgccttccagga

SEQ ID NO: 5974717 - DNA, 21 bp, Homo sapiens
tgtccctcactgttgaatttt

SEQ ID NO: 5974718 - DNA, 15 bp, Homo sapiens
tgtccctcagcaaca

SEQ ID NO: 5974719 - DNA, 13 bp, Homo sapiens
tgtccctcccacc

SEQ ID NO: 5974720 - DNA, 15 bp, Homo sapiens
tgtccctcccacctc

SEQ ID NO: 5974721 - DNA, 16 bp, Homo sapiens
tgtccctcccacctct

SEQ ID NO: 5974722 - DNA, 17 bp, Homo sapiens
tgtccctcccacctctg

SEQ ID NO: 5974723 - DNA, 18 bp, Homo sapiens
tgtccctcccccgcttcc

SEQ ID NO: 5974724 - DNA, 13 bp, Homo sapiens
tgtccctcccttg

SEQ ID NO: 5974725 - DNA, 17 bp, Homo sapiens
tgtccctcccttgctga

SEQ ID NO: 5974726 - DNA, 12 bp, Homo sapiens
tgtccctccggg

SEQ ID NO: 5974727 - DNA, 16 bp, Homo sapiens
tgtccctcctcttcct

SEQ ID NO: 5974728 - DNA, 12 bp, Homo sapiens
tgtccctcctgg

SEQ ID NO: 5974729 - DNA, 13 bp, Homo sapiens
tgtccctctaaag

SEQ ID NO: 5974730 - DNA, 16 bp, Homo sapiens
tgtccctctagtgcct

SEQ ID NO: 5974731 - DNA, 22 bp, Homo sapiens
tgtccctctcactccccagccc

SEQ ID NO: 5974732 - DNA, 14 bp, Homo sapiens
tgtccctctcaggc

SEQ ID NO: 5974733 - DNA, 15 bp, Homo sapiens
tgtccctctcaggca

SEQ ID NO: 5974734 - DNA, 17 bp, Homo sapiens
tgtccctctcagtgcct

SEQ ID NO: 5974735 - DNA, 21 bp, Homo sapiens
tgtccctctccttgcccccag

SEQ ID NO: 5974736 - DNA, 20 bp, Homo sapiens
tgtccctctctcagccctcc

SEQ ID NO: 5974737 - DNA, 15 bp, Homo sapiens
tgtccctctctctgg

SEQ ID NO: 5974738 - DNA, 16 bp, Homo sapiens
tgtccctctgccccat

SEQ ID NO: 5974739 - DNA, 15 bp, Homo sapiens
tgtccctctgtggct

SEQ ID NO: 5974740 - DNA, 14 bp, Homo sapiens
tgtccctcttcact

SEQ ID NO: 5974741 - DNA, 14 bp, Homo sapiens
tgtccctgcacttg

SEQ ID NO: 5974742 - DNA, 20 bp, Homo sapiens
tgtccctgcacttgcagact

SEQ ID NO: 5974743 - DNA, 21 bp, Homo sapiens
tgtccctgcagggccatctga

SEQ ID NO: 5974744 - DNA, 20 bp, Homo sapiens
tgtccctgccaatgctccag

SEQ ID NO: 5974745 - DNA, 16 bp, Homo sapiens
tgtccctgcctggccc

SEQ ID NO: 5974746 - DNA, 12 bp, Homo sapiens
tgtccctgcctt

SEQ ID NO: 5974747 - DNA, 14 bp, Homo sapiens
tgtccctgctcctc

SEQ ID NO: 5974748 - DNA, 16 bp, Homo sapiens
tgtccctgctcctccc

SEQ ID NO: 5974749 - DNA, 15 bp, Homo sapiens
tgtccctgctttctg

SEQ ID NO: 5974750 - DNA, 17 bp, Homo sapiens
tgtccctggacacagct

SEQ ID NO: 5974751 - DNA, 19 bp, Homo sapiens
tgtccctggacacagctct

SEQ ID NO: 5974752 - DNA, 15 bp, Homo sapiens
tgtccctggccatct

SEQ ID NO: 5974753 - DNA, 17 bp, Homo sapiens
tgtccctggccatctct

SEQ ID NO: 5974754 - DNA, 17 bp, Homo sapiens
tgtccctggcttcctta

SEQ ID NO: 5974755 - DNA, 22 bp, Homo sapiens
tgtccctggggcactcccccag

SEQ ID NO: 5974756 - DNA, 14 bp, Homo sapiens
tgtccctggtgcag

SEQ ID NO: 5974757 - DNA, 19 bp, Homo sapiens
tgtccctgtagctcagtca

SEQ ID NO: 5974758 - DNA, 13 bp, Homo sapiens
tgtccctgtcctt

SEQ ID NO: 5974759 - DNA, 16 bp, Homo sapiens
tgtccctgtgggctca

SEQ ID NO: 5974760 - DNA, 22 bp, Homo sapiens
tgtccctgtgggctcacaccgg

SEQ ID NO: 5974761 - DNA, 22 bp, Homo sapiens
tgtccctgtggtaccctggcag

SEQ ID NO: 5974762 - DNA, 21 bp, Homo sapiens
tgtccctgtgttgtcccatct

SEQ ID NO: 5974763 - DNA, 22 bp, Homo sapiens
tgtccctgtgttgtcccatctg

SEQ ID NO: 5974764 - DNA, 13 bp, Homo sapiens
tgtcccttcccca

SEQ ID NO: 5974765 - DNA, 16 bp, Homo sapiens
tgtcccttccccttca

SEQ ID NO: 5974766 - DNA, 21 bp, Homo sapiens
tgtcccttccccttcaccgct

SEQ ID NO: 5974767 - DNA, 15 bp, Homo sapiens
tgtcccttcctttct

SEQ ID NO: 5974768 - DNA, 19 bp, Homo sapiens
tgtcccttcctttctcccc

SEQ ID NO: 5974769 - DNA, 19 bp, Homo sapiens
tgtcccttcgagtccagga

SEQ ID NO: 5974770 - DNA, 18 bp, Homo sapiens
tgtcccttctgtccctca

SEQ ID NO: 5974771 - DNA, 21 bp, Homo sapiens
tgtcccttgatgggtgctgcc

SEQ ID NO: 5974772 - DNA, 18 bp, Homo sapiens
tgtcccttgcccccctgg

SEQ ID NO: 5974773 - DNA, 21 bp, Homo sapiens
tgtcccttgcccccctggcct

SEQ ID NO: 5974774 - DNA, 12 bp, Homo sapiens
tgtcccttgcct

SEQ ID NO: 5974775 - DNA, 13 bp, Homo sapiens
tgtcccttgcctc

SEQ ID NO: 5974776 - DNA, 16 bp, Homo sapiens
tgtcccttgcctctgc

SEQ ID NO: 5974777 - DNA, 12 bp, Homo sapiens
tgtcccttgctg

SEQ ID NO: 5974778 - DNA, 13 bp, Homo sapiens
tgtccctttcaca

SEQ ID NO: 5974779 - DNA, 15 bp, Homo sapiens
tgtccctttcttctc

SEQ ID NO: 5974780 - DNA, 18 bp, Homo sapiens
tgtccctttcttggccag

SEQ ID NO: 5974781 - DNA, 12 bp, Homo sapiens
tgtcccttttct

SEQ ID NO: 5974782 - DNA, 18 bp, Homo sapiens
tgtccctttttgcagggg

SEQ ID NO: 5974783 - DNA, 22 bp, Homo sapiens
tgtccctttttgcaggggactg

SEQ ID NO: 5974784 - DNA, 18 bp, Homo sapiens
tgtccgcaaggggtgatg

SEQ ID NO: 5974785 - DNA, 17 bp, Homo sapiens
tgtccgccatccagggt

SEQ ID NO: 5974786 - DNA, 23 bp, Homo sapiens
tgtccgcctctgcccgcagagcc

SEQ ID NO: 5974787 - DNA, 12 bp, Homo sapiens
tgtccgcgtcct

SEQ ID NO: 5974788 - DNA, 14 bp, Homo sapiens
tgtccgctgtctcc

SEQ ID NO: 5974789 - DNA, 15 bp, Homo sapiens
tgtccgctgtctccc

SEQ ID NO: 5974790 - DNA, 20 bp, Homo sapiens
tgtccgctgtctccctcctg

SEQ ID NO: 5974791 - DNA, 17 bp, Homo sapiens
tgtccggaatgccaccc

SEQ ID NO: 5974792 - DNA, 23 bp, Homo sapiens
tgtccggaccgccgatcccaggt

SEQ ID NO: 5974793 - DNA, 20 bp, Homo sapiens
tgtccggagcgaccctggct

SEQ ID NO: 5974794 - DNA, 15 bp, Homo sapiens
tgtccggcccagtgc

SEQ ID NO: 5974795 - DNA, 19 bp, Homo sapiens
tgtccggcccagtgccact

SEQ ID NO: 5974796 - DNA, 17 bp, Homo sapiens
tgtccgtccacccttcc

SEQ ID NO: 5974797 - DNA, 18 bp, Homo sapiens
tgtccgtccagagccggc

SEQ ID NO: 5974798 - DNA, 13 bp, Homo sapiens
tgtccgtccatgc

SEQ ID NO: 5974799 - DNA, 19 bp, Homo sapiens
tgtccgtcctgctcgccct

SEQ ID NO: 5974800 - DNA, 14 bp, Homo sapiens
tgtccgtctgtcct

SEQ ID NO: 5974801 - DNA, 19 bp, Homo sapiens
tgtccgtgaaagttgtgat

SEQ ID NO: 5974802 - DNA, 21 bp, Homo sapiens
tgtccgtgaaagttgtgatct

SEQ ID NO: 5974803 - DNA, 14 bp, Homo sapiens
tgtccgtgcccctt

SEQ ID NO: 5974804 - DNA, 14 bp, Homo sapiens
tgtccgtgtgcctc

SEQ ID NO: 5974805 - DNA, 18 bp, Homo sapiens
tgtccgttgacgtgacca

SEQ ID NO: 5974806 - DNA, 22 bp, Homo sapiens
tgtcctaaaacacctggtagga

SEQ ID NO: 5974807 - DNA, 21 bp, Homo sapiens
tgtcctaaagaagacattttc

SEQ ID NO: 5974808 - DNA, 16 bp, Homo sapiens
tgtcctaaatgcaaag

SEQ ID NO: 5974809 - DNA, 15 bp, Homo sapiens
tgtcctaaggacaca

SEQ ID NO: 5974810 - DNA, 15 bp, Homo sapiens
tgtcctaaggcccat

SEQ ID NO: 5974811 - DNA, 17 bp, Homo sapiens
tgtcctaatatatacat

SEQ ID NO: 5974812 - DNA, 22 bp, Homo sapiens
tgtcctaatgcttgctgctgat

SEQ ID NO: 5974813 - DNA, 18 bp, Homo sapiens
tgtcctaattcttctgtc

SEQ ID NO: 5974814 - DNA, 20 bp, Homo sapiens
tgtcctaattcttctgtcct

SEQ ID NO: 5974815 - DNA, 12 bp, Homo sapiens
tgtcctacagaa

SEQ ID NO: 5974816 - DNA, 13 bp, Homo sapiens
tgtcctacagaaa

SEQ ID NO: 5974817 - DNA, 16 bp, Homo sapiens
tgtcctaccactctaa

SEQ ID NO: 5974818 - DNA, 19 bp, Homo sapiens
tgtcctaccatcagctctg

SEQ ID NO: 5974819 - DNA, 21 bp, Homo sapiens
tgtcctaccatcagctctgcc

SEQ ID NO: 5974820 - DNA, 14 bp, Homo sapiens
tgtcctacccgccc

SEQ ID NO: 5974821 - DNA, 19 bp, Homo sapiens
tgtcctagaagttctttga

SEQ ID NO: 5974822 - DNA, 21 bp, Homo sapiens
tgtcctagcacagatggccag

SEQ ID NO: 5974823 - DNA, 23 bp, Homo sapiens
tgtcctagcaggatctgcccaca

SEQ ID NO: 5974824 - DNA, 23 bp, Homo sapiens
tgtcctagccaggtctcctggga

SEQ ID NO: 5974825 - DNA, 13 bp, Homo sapiens
tgtcctatagttt

SEQ ID NO: 5974826 - DNA, 21 bp, Homo sapiens
tgtcctatccctggacgcatg

SEQ ID NO: 5974827 - DNA, 20 bp, Homo sapiens
tgtcctatctatcttccaaa

SEQ ID NO: 5974828 - DNA, 21 bp, Homo sapiens
tgtcctatgaatgctttgcat

SEQ ID NO: 5974829 - DNA, 12 bp, Homo sapiens
tgtcctatgcaa

SEQ ID NO: 5974830 - DNA, 16 bp, Homo sapiens
tgtcctatgcctcaca

SEQ ID NO: 5974831 - DNA, 18 bp, Homo sapiens
tgtcctatggacaactta

SEQ ID NO: 5974832 - DNA, 14 bp, Homo sapiens
tgtcctatgtcaat

SEQ ID NO: 5974833 - DNA, 16 bp, Homo sapiens
tgtcctattagtgtta

SEQ ID NO: 5974834 - DNA, 17 bp, Homo sapiens
tgtcctattagtgttat

SEQ ID NO: 5974835 - DNA, 15 bp, Homo sapiens
tgtcctattatattc

SEQ ID NO: 5974836 - DNA, 13 bp, Homo sapiens
tgtcctcaaagaa

SEQ ID NO: 5974837 - DNA, 15 bp, Homo sapiens
tgtcctcaccctgtg

SEQ ID NO: 5974838 - DNA, 14 bp, Homo sapiens
tgtcctcactgctc

SEQ ID NO: 5974839 - DNA, 22 bp, Homo sapiens
tgtcctcactgctccctgaagc

SEQ ID NO: 5974840 - DNA, 13 bp, Homo sapiens
tgtcctcagagca

SEQ ID NO: 5974841 - DNA, 21 bp, Homo sapiens
tgtcctcagagggtccctagg

SEQ ID NO: 5974842 - DNA, 21 bp, Homo sapiens
tgtcctcagccccgcgtggaa

SEQ ID NO: 5974843 - DNA, 13 bp, Homo sapiens
tgtcttctccctg

SEQ ID NO: 5974844 - DNA, 14 bp, Homo sapiens
tgtcttctcctaat

SEQ ID NO: 5974845 - DNA, 20 bp, Homo sapiens
tgtcttctccttcaaaacat

SEQ ID NO: 5974846 - DNA, 20 bp, Homo sapiens
tgtcttctctaacaccttgt

SEQ ID NO: 5974847 - DNA, 12 bp, Homo sapiens
tgtcttctctca

SEQ ID NO: 5974848 - DNA, 15 bp, Homo sapiens
tgtcttctctccact

SEQ ID NO: 5974849 - DNA, 16 bp, Homo sapiens
tgtcttctctgtctca

SEQ ID NO: 5974850 - DNA, 22 bp, Homo sapiens
tgtcttctctgtctcagacttt

SEQ ID NO: 5974851 - DNA, 14 bp, Homo sapiens
tgtcttctgcctgt

SEQ ID NO: 5974852 - DNA, 15 bp, Homo sapiens
tgtcttctgcctgtt

SEQ ID NO: 5974853 - DNA, 17 bp, Homo sapiens
tgtcttctgcctgttat

SEQ ID NO: 5974854 - DNA, 17 bp, Homo sapiens
tgtcttctgctgttctt

SEQ ID NO: 5974855 - DNA, 19 bp, Homo sapiens
tgtcttctggtctgtgtgt

SEQ ID NO: 5974856 - DNA, 17 bp, Homo sapiens
tgtcttctgtatataaa

SEQ ID NO: 5974857 - DNA, 22 bp, Homo sapiens
tgtcttctgtatataaatggga

SEQ ID NO: 5974858 - DNA, 14 bp, Homo sapiens
tgtcttctgttccc

SEQ ID NO: 5974859 - DNA, 18 bp, Homo sapiens
tgtcttcttcatgtcatc

SEQ ID NO: 5974860 - DNA, 16 bp, Homo sapiens
tgtcttcttctgtgct

SEQ ID NO: 5974861 - DNA, 21 bp, Homo sapiens
tgtcttctttctcctgtggtt

SEQ ID NO: 5974862 - DNA, 13 bp, Homo sapiens
tgtcttcttttgt

SEQ ID NO: 5974863 - DNA, 16 bp, Homo sapiens
tgtcttgaaaaaaaat

SEQ ID NO: 5974864 - DNA, 19 bp, Homo sapiens
tgtcttgaaaaaaaataga

SEQ ID NO: 5974865 - DNA, 20 bp, Homo sapiens
tgtcttgaaaaaaaatagat

SEQ ID NO: 5974866 - DNA, 17 bp, Homo sapiens
tgtcttgaatgtctttt

SEQ ID NO: 5974867 - DNA, 20 bp, Homo sapiens
tgtcttgaatgtcttttgaa

SEQ ID NO: 5974868 - DNA, 19 bp, Homo sapiens
tgtcttgagaccagcctgc

SEQ ID NO: 5974869 - DNA, 15 bp, Homo sapiens
tgtcttgagctctaa

SEQ ID NO: 5974870 - DNA, 16 bp, Homo sapiens
tgtcttgagctctatt

SEQ ID NO: 5974871 - DNA, 17 bp, Homo sapiens
tgtcttgatatatttat

SEQ ID NO: 5974872 - DNA, 22 bp, Homo sapiens
tgtcttgatgcatgcactgttc

SEQ ID NO: 5974873 - DNA, 21 bp, Homo sapiens
tgtcttgatgttttttctgta

SEQ ID NO: 5974874 - DNA, 22 bp, Homo sapiens
tgtcttgatgttttttctgtaa

SEQ ID NO: 5974875 - DNA, 15 bp, Homo sapiens
tgtcttgcaacttca

SEQ ID NO: 5974876 - DNA, 14 bp, Homo sapiens
tgtcttgcaagtta

SEQ ID NO: 5974877 - DNA, 17 bp, Homo sapiens
tgtcttgcaatggcagc

SEQ ID NO: 5974878 - DNA, 18 bp, Homo sapiens
tgtcttgccagccagaag

SEQ ID NO: 5974879 - DNA, 13 bp, Homo sapiens
tgtcttgccccag

SEQ ID NO: 5974880 - DNA, 15 bp, Homo sapiens
tgtcttgctcctggg

SEQ ID NO: 5974881 - DNA, 17 bp, Homo sapiens
tgtcttgctcctgggga

SEQ ID NO: 5974882 - DNA, 20 bp, Homo sapiens
tgtcttgctgttgacatatt

SEQ ID NO: 5974883 - DNA, 17 bp, Homo sapiens
tgtcttggaaccaccag

SEQ ID NO: 5974884 - DNA, 18 bp, Homo sapiens
tgtcttggaagtctgtct

SEQ ID NO: 5974885 - DNA, 22 bp, Homo sapiens
tgtcttggacctatcaaaaact

SEQ ID NO: 5974886 - DNA, 14 bp, Homo sapiens
tgtcttggcactgt

SEQ ID NO: 5974887 - DNA, 15 bp, Homo sapiens
tgtcttggcattaaa

SEQ ID NO: 5974888 - DNA, 19 bp, Homo sapiens
tgtcttggctgtgagcaac

SEQ ID NO: 5974889 - DNA, 19 bp, Homo sapiens
tgtcttggctttcatgtta

SEQ ID NO: 5974890 - DNA, 21 bp, Homo sapiens
tgtcttggtggatgggccctg

SEQ ID NO: 5974891 - DNA, 15 bp, Homo sapiens
tgtcttgtaagcaaa

SEQ ID NO: 5974892 - DNA, 19 bp, Homo sapiens
tgtcttgtaatattttgta

SEQ ID NO: 5974893 - DNA, 17 bp, Homo sapiens
tgtcttgtacatgtgta

SEQ ID NO: 5974894 - DNA, 15 bp, Homo sapiens
tgtcttgtacttctg

SEQ ID NO: 5974895 - DNA, 19 bp, Homo sapiens
tgtcttgtacttctgtgtt

SEQ ID NO: 5974896 - DNA, 14 bp, Homo sapiens
tgtcttgtaggtaa

SEQ ID NO: 5974897 - DNA, 23 bp, Homo sapiens
tgtcttgtaggtaagttggctca

SEQ ID NO: 5974898 - DNA, 16 bp, Homo sapiens
tgtcttgtattatcat

SEQ ID NO: 5974899 - DNA, 22 bp, Homo sapiens
tgtcttgtatttaaaaacattt

SEQ ID NO: 5974900 - DNA, 14 bp, Homo sapiens
tgtcttgtcatctt

SEQ ID NO: 5974901 - DNA, 14 bp, Homo sapiens
tgtcttgtgtattt

SEQ ID NO: 5974902 - DNA, 16 bp, Homo sapiens
tgtcttgtgttgctgt

SEQ ID NO: 5974903 - DNA, 18 bp, Homo sapiens
tgtcttgtgtttctttag

SEQ ID NO: 5974904 - DNA, 17 bp, Homo sapiens
tgtcttgttatgtacaa

SEQ ID NO: 5974905 - DNA, 19 bp, Homo sapiens
tgtcttgttcactgcagca

SEQ ID NO: 5974906 - DNA, 15 bp, Homo sapiens
tgtcttgttcatttt

SEQ ID NO: 5974907 - DNA, 14 bp, Homo sapiens
tgtcttgttctgtc

SEQ ID NO: 5974908 - DNA, 15 bp, Homo sapiens
tgtcttgttctgtca

SEQ ID NO: 5974909 - DNA, 16 bp, Homo sapiens
tgtcttgttctgtccc

SEQ ID NO: 5974910 - DNA, 15 bp, Homo sapiens
tgtctttaaaagaga

SEQ ID NO: 5974911 - DNA, 15 bp, Homo sapiens
tgtctttaaggaaaa

SEQ ID NO: 5974912 - DNA, 22 bp, Homo sapiens
tgtctttaatttctgtcagaat

SEQ ID NO: 5974913 - DNA, 16 bp, Homo sapiens
tgtctttactggacct

SEQ ID NO: 5974914 - DNA, 16 bp, Homo sapiens
tgtctttataaagctg

SEQ ID NO: 5974915 - DNA, 19 bp, Homo sapiens
tgtctttatgtaagaagaa

SEQ ID NO: 5974916 - DNA, 23 bp, Homo sapiens
tgtctttatgtaagaagaaactg

SEQ ID NO: 5974917 - DNA, 21 bp, Homo sapiens
tgtctttattaacaaacagga

SEQ ID NO: 5974918 - DNA, 22 bp, Homo sapiens
tgtctttattagattttcctcc

SEQ ID NO: 5974919 - DNA, 16 bp, Homo sapiens
tgtctttatttgctca

SEQ ID NO: 5974920 - DNA, 11 bp, Homo sapiens
tgtctttcaaa

SEQ ID NO: 5974921 - DNA, 16 bp, Homo sapiens
tgtctttcaaaagaca

SEQ ID NO: 5974922 - DNA, 16 bp, Homo sapiens
tgtctttcagatacat

SEQ ID NO: 5974923 - DNA, 23 bp, Homo sapiens
tgtctttcagcattcagtccgcc

SEQ ID NO: 5974924 - DNA, 21 bp, Homo sapiens
tgtctttcctcccttctttgc

SEQ ID NO: 5974925 - DNA, 22 bp, Homo sapiens
tgtctttcctgaaccatgtgga

SEQ ID NO: 5974926 - DNA, 15 bp, Homo sapiens
tgtctttctaagaaa

SEQ ID NO: 5974927 - DNA, 19 bp, Homo sapiens
tgtctttctccaaagttat

SEQ ID NO: 5974928 - DNA, 15 bp, Homo sapiens
tgtctttctgagcac

SEQ ID NO: 5974929 - DNA, 17 bp, Homo sapiens
tgtctttcttgctccct

SEQ ID NO: 5974930 - DNA, 15 bp, Homo sapiens
tgtctttcttgtaag

SEQ ID NO: 5974931 - DNA, 13 bp, Homo sapiens
tgtctttctttgc

SEQ ID NO: 5974932 - DNA, 14 bp, Homo sapiens
tgtctttctttgct

SEQ ID NO: 5974933 - DNA, 19 bp, Homo sapiens
tgtctttctttgctgctgt

SEQ ID NO: 5974934 - DNA, 16 bp, Homo sapiens
tgtctttctttgtcat

SEQ ID NO: 5974935 - DNA, 18 bp, Homo sapiens
tgtctttctttgtcattc

SEQ ID NO: 5974936 - DNA, 12 bp, Homo sapiens
tgtctttgaatc

SEQ ID NO: 5974937 - DNA, 10 bp, Homo sapiens
tgtctttgcg

SEQ ID NO: 5974938 - DNA, 21 bp, Homo sapiens
tgtctttgcggggcctgtctc

SEQ ID NO: 5974939 - DNA, 22 bp, Homo sapiens
tgtctttgcggggcctgtctca

SEQ ID NO: 5974940 - DNA, 21 bp, Homo sapiens
tgtctttgctgtactcttgct

SEQ ID NO: 5974941 - DNA, 16 bp, Homo sapiens
tgtctttggaggtgct

SEQ ID NO: 5974942 - DNA, 20 bp, Homo sapiens
tgtctttggcttcagaattg

SEQ ID NO: 5974943 - DNA, 15 bp, Homo sapiens
tgtctttggtcctct

SEQ ID NO: 5974944 - DNA, 11 bp, Homo sapiens
tgtctttgtaa

SEQ ID NO: 5974945 - DNA, 12 bp, Homo sapiens
tgtctttgtaag

SEQ ID NO: 5974946 - DNA, 14 bp, Homo sapiens
tgtctttgtccctg

SEQ ID NO: 5974947 - DNA, 19 bp, Homo sapiens
tgtcttttaaaaaacaaaa

SEQ ID NO: 5974948 - DNA, 15 bp, Homo sapiens
tgtcttttaaactgg

SEQ ID NO: 5974949 - DNA, 23 bp, Homo sapiens
tgtcttttaatgatactgtctaa

SEQ ID NO: 5974950 - DNA, 18 bp, Homo sapiens
tgtcttttaatgcttcat

SEQ ID NO: 5974951 - DNA, 20 bp, Homo sapiens
tgtcttttatagtggaaaaa

SEQ ID NO: 5974952 - DNA, 22 bp, Homo sapiens
tgtcttttatagtggaaaaaca

SEQ ID NO: 5974953 - DNA, 20 bp, Homo sapiens
tgtcttttatatttgaatta

SEQ ID NO: 5974954 - DNA, 16 bp, Homo sapiens
tgtcttttatatttgt

SEQ ID NO: 5974955 - DNA, 18 bp, Homo sapiens
tgtcttttatatttgtat

SEQ ID NO: 5974956 - DNA, 15 bp, Homo sapiens
tgtcttttcaagtaa

SEQ ID NO: 5974957 - DNA, 23 bp, Homo sapiens
tgtcttttcagaagcaagccaga

SEQ ID NO: 5974958 - DNA, 17 bp, Homo sapiens
tgtcttttcccctcatt

SEQ ID NO: 5974959 - DNA, 22 bp, Homo sapiens
tgtcttttcccctcattgcatt

SEQ ID NO: 5974960 - DNA, 17 bp, Homo sapiens
tgtcttttctcctccgc

SEQ ID NO: 5974961 - DNA, 23 bp, Homo sapiens
tgtcttttcttgcatgaggctag

SEQ ID NO: 5974962 - DNA, 14 bp, Homo sapiens
tgtcttttcttggc

SEQ ID NO: 5974963 - DNA, 14 bp, Homo sapiens
tgtcttttgcatga

SEQ ID NO: 5974964 - DNA, 15 bp, Homo sapiens
tgtcttttgttctct

SEQ ID NO: 5974965 - DNA, 12 bp, Homo sapiens
tgtctttttcat

SEQ ID NO: 5974966 - DNA, 14 bp, Homo sapiens
tgtctttttcctac

SEQ ID NO: 5974967 - DNA, 15 bp, Homo sapiens
tgtctttttccttcc

SEQ ID NO: 5974968 - DNA, 18 bp, Homo sapiens
tgtctttttccttcctga

SEQ ID NO: 5974969 - DNA, 20 bp, Homo sapiens
tgtctttttcgccaaactgt

SEQ ID NO: 5974970 - DNA, 17 bp, Homo sapiens
tgtctttttctagactt

SEQ ID NO: 5974971 - DNA, 15 bp, Homo sapiens
tgtctttttcttacc

SEQ ID NO: 5974972 - DNA, 16 bp, Homo sapiens
tgtctttttttgtata

SEQ ID NO: 5974973 - DNA, 16 bp, Homo sapiens
tgtcttttttttcatc

SEQ ID NO: 5974974 - DNA, 16 bp, Homo sapiens
tgtcttttttttcctt

SEQ ID NO: 5974975 - DNA, 17 bp, Homo sapiens
tgtcttttttttccttt

SEQ ID NO: 5974976 - DNA, 19 bp, Homo sapiens
tgtcttttttttcctttga

SEQ ID NO: 5974977 - DNA, 14 bp, Homo sapiens
tgtgaaaaaaataa

SEQ ID NO: 5974978 - DNA, 19 bp, Homo sapiens
tgtgaaaaaaatgagactt

SEQ ID NO: 5974979 - DNA, 16 bp, Homo sapiens
tgtgaaaaaaattatt

SEQ ID NO: 5974980 - DNA, 15 bp, Homo sapiens
tgtgaaaaaataaag

SEQ ID NO: 5974981 - DNA, 12 bp, Homo sapiens
tgtgaaaaaatt

SEQ ID NO: 5974982 - DNA, 17 bp, Homo sapiens
tgtgaaaaaatttactt

SEQ ID NO: 5974983 - DNA, 19 bp, Homo sapiens
tgtgaaaaagcctaagaaa

SEQ ID NO: 5974984 - DNA, 13 bp, Homo sapiens
tgtgaaaaaggaa

SEQ ID NO: 5974985 - DNA, 21 bp, Homo sapiens
tgtgaaaaaggaataaattgt

SEQ ID NO: 5974986 - DNA, 13 bp, Homo sapiens
tgtgaaaaattaa

SEQ ID NO: 5974987 - DNA, 14 bp, Homo sapiens
tgtgaaaaattaac

SEQ ID NO: 5974988 - DNA, 23 bp, Homo sapiens
tgtgaaaagaaaaatgagcctgg

SEQ ID NO: 5974989 - DNA, 16 bp, Homo sapiens
tgtgaaaagagtatgt

SEQ ID NO: 5974990 - DNA, 19 bp, Homo sapiens
tgtgaaaagcacagctgta

SEQ ID NO: 5974991 - DNA, 22 bp, Homo sapiens
tgtgaaaagtatcactctaaaa

SEQ ID NO: 5974992 - DNA, 11 bp, Homo sapiens
tgtgaaaatat

SEQ ID NO: 5974993 - DNA, 22 bp, Homo sapiens
tgtgaaaatgctttgaaaatgt

SEQ ID NO: 5974994 - DNA, 14 bp, Homo sapiens
tgtgaaaatgggtt

SEQ ID NO: 5974995 - DNA, 22 bp, Homo sapiens
tgtgaaaatggtccaggagaag

SEQ ID NO: 5974996 - DNA, 16 bp, Homo sapiens
tgtgaaaatgtgtgtg

SEQ ID NO: 5974997 - DNA, 20 bp, Homo sapiens
tgtgaaaattgaccaagtga

SEQ ID NO: 5974998 - DNA, 15 bp, Homo sapiens
tgtgaaacacagctg

SEQ ID NO: 5974999 - DNA, 17 bp, Homo sapiens
tgtgaaacacagctgtt

SEQ ID NO: 5975000 - DNA, 14 bp, Homo sapiens
tgtgaaacagactt

SEQ ID NO: 5975001 - DNA, 22 bp, Homo sapiens
tgtgaaacagggagctatgaga

SEQ ID NO: 5975002 - DNA, 18 bp, Homo sapiens
tgtgaaacagtgtggatg

SEQ ID NO: 5975003 - DNA, 15 bp, Homo sapiens
tgtgaaacatcttct

SEQ ID NO: 5975004 - DNA, 12 bp, Homo sapiens
tgtgaaacatgg

SEQ ID NO: 5975005 - DNA, 15 bp, Homo sapiens
tgtgaaaccacaggc

SEQ ID NO: 5975006 - DNA, 20 bp, Homo sapiens
tgtgaaaccttttttaagat

SEQ ID NO: 5975007 - DNA, 22 bp, Homo sapiens
tgtgaaaccttttttaagattt

SEQ ID NO: 5975008 - DNA, 16 bp, Homo sapiens
tgtgaaacggaagctc

SEQ ID NO: 5975009 - DNA, 21 bp, Homo sapiens
tgtgaaactaaaattttctaa

SEQ ID NO: 5975010 - DNA, 16 bp, Homo sapiens
tgtgaaactgaaggtc

SEQ ID NO: 5975011 - DNA, 20 bp, Homo sapiens
tgtgaaagaatgtgctttga

SEQ ID NO: 5975012 - DNA, 19 bp, Homo sapiens
tgtgaaagattatttaaat

SEQ ID NO: 5975013 - DNA, 21 bp, Homo sapiens
tgtgaaaggaaagagggaggt

SEQ ID NO: 5975014 - DNA, 23 bp, Homo sapiens
tgtgaaaggtgctgatggccctc

SEQ ID NO: 5975015 - DNA, 16 bp, Homo sapiens
tgtgaaagtatgtgat

SEQ ID NO: 5975016 - DNA, 22 bp, Homo sapiens
tgtgaaagtgccaaaataaagt

SEQ ID NO: 5975017 - DNA, 21 bp, Homo sapiens
tgtgaaataaaactggctttg

SEQ ID NO: 5975018 - DNA, 13 bp, Homo sapiens
tgtgaaataaaga

SEQ ID NO: 5975019 - DNA, 13 bp, Homo sapiens
tgtgaaataccac

SEQ ID NO: 5975020 - DNA, 20 bp, Homo sapiens
tgtgaaatcatcaaaaagaa

SEQ ID NO: 5975021 - DNA, 14 bp, Homo sapiens
atgttcattttctc

SEQ ID NO: 5975022 - DNA, 17 bp, Homo sapiens
atgttccaataaaactt

SEQ ID NO: 5975023 - DNA, 15 bp, Homo sapiens
atgttccaataaaca

SEQ ID NO: 5975024 - DNA, 19 bp, Homo sapiens
atgttccaccattgctgga

SEQ ID NO: 5975025 - DNA, 22 bp, Homo sapiens
atgttccaccattgctggaaaa

SEQ ID NO: 5975026 - DNA, 15 bp, Homo sapiens
atgttccaggaatga

SEQ ID NO: 5975027 - DNA, 20 bp, Homo sapiens
atgttccagtgaggaaccct

SEQ ID NO: 5975028 - DNA, 13 bp, Homo sapiens
atgttccatgcct

SEQ ID NO: 5975029 - DNA, 17 bp, Homo sapiens
atgttccatgcctggcc

SEQ ID NO: 5975030 - DNA, 20 bp, Homo sapiens
atgttccatgcctggccctt

SEQ ID NO: 5975031 - DNA, 14 bp, Homo sapiens
atgttccattaaac

SEQ ID NO: 5975032 - DNA, 17 bp, Homo sapiens
atgttcccaaaacaatg

SEQ ID NO: 5975033 - DNA, 16 bp, Homo sapiens
atgttcccaatttgaa

SEQ ID NO: 5975034 - DNA, 20 bp, Homo sapiens
atgttcccaatttgaattta

SEQ ID NO: 5975035 - DNA, 15 bp, Homo sapiens
atgttcccacttcaa

SEQ ID NO: 5975036 - DNA, 14 bp, Homo sapiens
atgttcccagctca

SEQ ID NO: 5975037 - DNA, 23 bp, Homo sapiens
atgttcccagctcagtgccaaag

SEQ ID NO: 5975038 - DNA, 13 bp, Homo sapiens
atgttccctccgg

SEQ ID NO: 5975039 - DNA, 14 bp, Homo sapiens
atgttccctgcacc

SEQ ID NO: 5975040 - DNA, 17 bp, Homo sapiens
atgttcccttcaagtat

SEQ ID NO: 5975041 - DNA, 22 bp, Homo sapiens
atgttcccttgaccattggctg

SEQ ID NO: 5975042 - DNA, 23 bp, Homo sapiens
atgttccggcgtttatttctgcg

SEQ ID NO: 5975043 - DNA, 17 bp, Homo sapiens
atgttccgttcatctga

SEQ ID NO: 5975044 - DNA, 18 bp, Homo sapiens
atgttccgttcatctgag

SEQ ID NO: 5975045 - DNA, 17 bp, Homo sapiens
atgttcctaacaaaatg

SEQ ID NO: 5975046 - DNA, 18 bp, Homo sapiens
atgttcctaataagtgaa

SEQ ID NO: 5975047 - DNA, 15 bp, Homo sapiens
atgttcctagtgaaa

SEQ ID NO: 5975048 - DNA, 16 bp, Homo sapiens
atgttcctcaaatcag

SEQ ID NO: 5975049 - DNA, 12 bp, Homo sapiens
atgttcctcctt

SEQ ID NO: 5975050 - DNA, 23 bp, Homo sapiens
atgttcctccttttcttcaccct

SEQ ID NO: 5975051 - DNA, 13 bp, Homo sapiens
atgttcctgctgt

SEQ ID NO: 5975052 - DNA, 21 bp, Homo sapiens
atgttcctgctgtatttcctg

SEQ ID NO: 5975053 - DNA, 17 bp, Homo sapiens
atgttcctgttcctcgg

SEQ ID NO: 5975054 - DNA, 12 bp, Homo sapiens
atgttccttcca

SEQ ID NO: 5975055 - DNA, 15 bp, Homo sapiens
atgttcctttaaggt

SEQ ID NO: 5975056 - DNA, 22 bp, Homo sapiens
atgttcctttggaagaaaaaat

SEQ ID NO: 5975057 - DNA, 19 bp, Homo sapiens
atgttcctttgtaattgac

SEQ ID NO: 5975058 - DNA, 16 bp, Homo sapiens
atgttccttttaaaga

SEQ ID NO: 5975059 - DNA, 13 bp, Homo sapiens
atgttccttttga

SEQ ID NO: 5975060 - DNA, 22 bp, Homo sapiens
atgttccttttttcaatatgca

SEQ ID NO: 5975061 - DNA, 15 bp, Homo sapiens
atgttcgggtgtggg

SEQ ID NO: 5975062 - DNA, 14 bp, Homo sapiens
atgttctaaattct

SEQ ID NO: 5975063 - DNA, 17 bp, Homo sapiens
atgttctaaggctctga

SEQ ID NO: 5975064 - DNA, 19 bp, Homo sapiens
atgttctaaggctctgaga

SEQ ID NO: 5975065 - DNA, 20 bp, Homo sapiens
atgttctaaggctctgagag

SEQ ID NO: 5975066 - DNA, 12 bp, Homo sapiens
atgttctaagtt

SEQ ID NO: 5975067 - DNA, 19 bp, Homo sapiens
atgttctaagtttctaaga

SEQ ID NO: 5975068 - DNA, 22 bp, Homo sapiens
atgttctaggatagttgatgca

SEQ ID NO: 5975069 - DNA, 21 bp, Homo sapiens
atgttctaggtcagtctaaca

SEQ ID NO: 5975070 - DNA, 19 bp, Homo sapiens
atgttctatggttatgaaa

SEQ ID NO: 5975071 - DNA, 21 bp, Homo sapiens
atgttctatggttatgaaaga

SEQ ID NO: 5975072 - DNA, 14 bp, Homo sapiens
atgttctattgtgg

SEQ ID NO: 5975073 - DNA, 19 bp, Homo sapiens
atgttctatttaacaactg

SEQ ID NO: 5975074 - DNA, 11 bp, Homo sapiens
atgttctcaac

SEQ ID NO: 5975075 - DNA, 16 bp, Homo sapiens
atgttctcagaatcag

SEQ ID NO: 5975076 - DNA, 20 bp, Homo sapiens
atgttctcctgatgtagctt

SEQ ID NO: 5975077 - DNA, 21 bp, Homo sapiens
atgttctccttagatgtgaga

SEQ ID NO: 5975078 - DNA, 14 bp, Homo sapiens
atgttctctatcat

SEQ ID NO: 5975079 - DNA, 15 bp, Homo sapiens
atgttctctatcatt

SEQ ID NO: 5975080 - DNA, 20 bp, Homo sapiens
atgttctctatcatttaata

SEQ ID NO: 5975081 - DNA, 18 bp, Homo sapiens
atgttctctgaggacact

SEQ ID NO: 5975082 - DNA, 19 bp, Homo sapiens
atgttctcttcccaggcct

SEQ ID NO: 5975083 - DNA, 14 bp, Homo sapiens
atgttctgaaatgg

SEQ ID NO: 5975084 - DNA, 18 bp, Homo sapiens
atgttctgaataatttct

SEQ ID NO: 5975085 - DNA, 19 bp, Homo sapiens
atgttctgacattaacagt

SEQ ID NO: 5975086 - DNA, 22 bp, Homo sapiens
atgttctgaccctgcttcaaat

SEQ ID NO: 5975087 - DNA, 14 bp, Homo sapiens
atgttctgcaagaa

SEQ ID NO: 5975088 - DNA, 15 bp, Homo sapiens
atgttctgcaagaat

SEQ ID NO: 5975089 - DNA, 16 bp, Homo sapiens
atgttctgcaagaatt

SEQ ID NO: 5975090 - DNA, 12 bp, Homo sapiens
atgttctgcccc

SEQ ID NO: 5975091 - DNA, 14 bp, Homo sapiens
atgttctgccccca

SEQ ID NO: 5975092 - DNA, 17 bp, Homo sapiens
atgttctgcccccagcc

SEQ ID NO: 5975093 - DNA, 13 bp, Homo sapiens
atgttctgctttc

SEQ ID NO: 5975094 - DNA, 23 bp, Homo sapiens
atgttctggctttacattttatt

SEQ ID NO: 5975095 - DNA, 14 bp, Homo sapiens
atgttctgtagcaa

SEQ ID NO: 5975096 - DNA, 21 bp, Homo sapiens
atgttctgtcacgtgaaatat

SEQ ID NO: 5975097 - DNA, 23 bp, Homo sapiens
atgttctgtcccttgcccccctg

SEQ ID NO: 5975098 - DNA, 15 bp, Homo sapiens
atgttctgtcttccc

SEQ ID NO: 5975099 - DNA, 16 bp, Homo sapiens
atgttctgtcttccca

SEQ ID NO: 5975100 - DNA, 21 bp, Homo sapiens
atgttctgtgcctgtaaacat

SEQ ID NO: 5975101 - DNA, 12 bp, Homo sapiens
atgttctgtgtc

SEQ ID NO: 5975102 - DNA, 22 bp, Homo sapiens
atgttctgtgtgccctgaaaat

SEQ ID NO: 5975103 - DNA, 14 bp, Homo sapiens
atgttctgttgtaa

SEQ ID NO: 5975104 - DNA, 18 bp, Homo sapiens
atgttctgttgtaaagag

SEQ ID NO: 5975105 - DNA, 21 bp, Homo sapiens
atgttcttagcaataaatgct

SEQ ID NO: 5975106 - DNA, 19 bp, Homo sapiens
atgttcttatagaataaaa

SEQ ID NO: 5975107 - DNA, 23 bp, Homo sapiens
atgttcttatttaaattttcaga

SEQ ID NO: 5975108 - DNA, 18 bp, Homo sapiens
atgttcttctgttattta

SEQ ID NO: 5975109 - DNA, 18 bp, Homo sapiens
atgttcttgaagaaaggc

SEQ ID NO: 5975110 - DNA, 12 bp, Homo sapiens
atgttcttgcag

SEQ ID NO: 5975111 - DNA, 14 bp, Homo sapiens
atgttcttggtgtt

SEQ ID NO: 5975112 - DNA, 19 bp, Homo sapiens
atgttcttgttttgttata

SEQ ID NO: 5975113 - DNA, 19 bp, Homo sapiens
atgttctttcacccatcct

SEQ ID NO: 5975114 - DNA, 20 bp, Homo sapiens
atgttctttcacccttttct

SEQ ID NO: 5975115 - DNA, 16 bp, Homo sapiens
atgttctttggaaagt

SEQ ID NO: 5975116 - DNA, 20 bp, Homo sapiens
atgttcttttaaatgattga

SEQ ID NO: 5975117 - DNA, 18 bp, Homo sapiens
atgttcttttttgttaca

SEQ ID NO: 5975118 - DNA, 18 bp, Homo sapiens
atgttgaaaaagaaaaca

SEQ ID NO: 5975119 - DNA, 22 bp, Homo sapiens
atgttgaaatatgatgttaaaa

SEQ ID NO: 5975120 - DNA, 14 bp, Homo sapiens
atgttgaaatatgc

SEQ ID NO: 5975121 - DNA, 17 bp, Homo sapiens
atgttgaaatatgcata

SEQ ID NO: 5975122 - DNA, 12 bp, Homo sapiens
atgttgaaatct

SEQ ID NO: 5975123 - DNA, 13 bp, Homo sapiens
atgttgaaatctt

SEQ ID NO: 5975124 - DNA, 13 bp, Homo sapiens
atgttgaacaaaa

SEQ ID NO: 5975125 - DNA, 14 bp, Homo sapiens
atgttgaatacttt

SEQ ID NO: 5975126 - DNA, 15 bp, Homo sapiens
atgttgaatactttt

SEQ ID NO: 5975127 - DNA, 16 bp, Homo sapiens
atgttgacatttgttt

SEQ ID NO: 5975128 - DNA, 16 bp, Homo sapiens
atgttgaccatgtcta

SEQ ID NO: 5975129 - DNA, 16 bp, Homo sapiens
atgttgacgagactgg

SEQ ID NO: 5975130 - DNA, 18 bp, Homo sapiens
atgttgactttatttctg

SEQ ID NO: 5975131 - DNA, 11 bp, Homo sapiens
atgttgagaag

SEQ ID NO: 5975132 - DNA, 16 bp, Homo sapiens
atgttgagaatcccaa

SEQ ID NO: 5975133 - DNA, 16 bp, Homo sapiens
atgttgagccatgagt

SEQ ID NO: 5975134 - DNA, 13 bp, Homo sapiens
atgttgagctgag

SEQ ID NO: 5975135 - DNA, 14 bp, Homo sapiens
atgttgaggatcta

SEQ ID NO: 5975136 - DNA, 14 bp, Homo sapiens
atgttgagggaaca

SEQ ID NO: 5975137 - DNA, 21 bp, Homo sapiens
atgttgataaaccaaaaacat

SEQ ID NO: 5975138 - DNA, 14 bp, Homo sapiens
atgttgataatttc

SEQ ID NO: 5975139 - DNA, 19 bp, Homo sapiens
atgttgataatttcaggga

SEQ ID NO: 5975140 - DNA, 22 bp, Homo sapiens
atgttgatcgatgttaaacgtc

SEQ ID NO: 5975141 - DNA, 22 bp, Homo sapiens
atgttgatctgcatatttctgt

SEQ ID NO: 5975142 - DNA, 14 bp, Homo sapiens
atgttgatgcaatc

SEQ ID NO: 5975143 - DNA, 17 bp, Homo sapiens
atgttgatttttactgt

SEQ ID NO: 5975144 - DNA, 15 bp, Homo sapiens
atgttgcaaagggat

SEQ ID NO: 5975145 - DNA, 15 bp, Homo sapiens
atgttgcaatgtgaa

SEQ ID NO: 5975146 - DNA, 19 bp, Homo sapiens
atgttgcaatgtgaaaaat

SEQ ID NO: 5975147 - DNA, 15 bp, Homo sapiens
atgttgcatagaata

SEQ ID NO: 5975148 - DNA, 13 bp, Homo sapiens
atgttgcatgcct

SEQ ID NO: 5975149 - DNA, 22 bp, Homo sapiens
atgttgcattaattgtgctgtt

SEQ ID NO: 5975150 - DNA, 22 bp, Homo sapiens
atgttgccagtttaatcattgc

SEQ ID NO: 5975151 - DNA, 19 bp, Homo sapiens
atgttgccatgaggccttt

SEQ ID NO: 5975152 - DNA, 16 bp, Homo sapiens
atgttgcccaggcagg

SEQ ID NO: 5975153 - DNA, 22 bp, Homo sapiens
atgttgcccctttctcttttcc

SEQ ID NO: 5975154 - DNA, 19 bp, Homo sapiens
atgttgccttggaaacatt

SEQ ID NO: 5975155 - DNA, 14 bp, Homo sapiens
atgttgctaacagc

SEQ ID NO: 5975156 - DNA, 19 bp, Homo sapiens
atgttgctatgtgccttat

SEQ ID NO: 5975157 - DNA, 22 bp, Homo sapiens
atgttgctgatggcccctccag

SEQ ID NO: 5975158 - DNA, 11 bp, Homo sapiens
atgttgctgcc

SEQ ID NO: 5975159 - DNA, 13 bp, Homo sapiens
atgttgctgccaa

SEQ ID NO: 5975160 - DNA, 17 bp, Homo sapiens
atgttgcttaggatgtg

SEQ ID NO: 5975161 - DNA, 18 bp, Homo sapiens
atgttgcttctgaatcac

SEQ ID NO: 5975162 - DNA, 22 bp, Homo sapiens
atgttgctttaacctgaacctt

SEQ ID NO: 5975163 - DNA, 24 bp, Homo sapiens
atgttgctttgaaaaagcctctaa

SEQ ID NO: 5975164 - DNA, 20 bp, Homo sapiens
atgttggaaaacatatgaaa

SEQ ID NO: 5975165 - DNA, 18 bp, Homo sapiens
atgttggaatctgctcca

SEQ ID NO: 5975166 - DNA, 17 bp, Homo sapiens
atgttggacacctttag

SEQ ID NO: 5975167 - DNA, 18 bp, Homo sapiens
atgttggacagacactgt

SEQ ID NO: 5975168 - DNA, 17 bp, Homo sapiens
atgttggagcagcaggc

SEQ ID NO: 5975169 - DNA, 18 bp, Homo sapiens
atgttggagcagcaggcc

SEQ ID NO: 5975170 - DNA, 18 bp, Homo sapiens
atgttggaggagagagcc

SEQ ID NO: 5975171 - DNA, 22 bp, Homo sapiens
atgttggataaggaattataga

SEQ ID NO: 5975172 - DNA, 22 bp, Homo sapiens
atgttggatgatgaaacattca

SEQ ID NO: 5975173 - DNA, 14 bp, Homo sapiens
atgttggcaaatca

SEQ ID NO: 5975174 - DNA, 19 bp, Homo sapiens
atgttggcaaatcacttca

SEQ ID NO: 5975175 - DNA, 19 bp, Homo sapiens
atgttggcagatgcagctc

SEQ ID NO: 5975176 - DNA, 20 bp, Homo sapiens
atgttggcagatgcagctct

SEQ ID NO: 5975177 - DNA, 23 bp, Homo sapiens
atgttggcattaacaataaagca

SEQ ID NO: 5975178 - DNA, 23 bp, Homo sapiens
atgttggccaccaggtgcctttc

SEQ ID NO: 5975179 - DNA, 15 bp, Homo sapiens
atgttggccaggctg

SEQ ID NO: 5975180 - DNA, 17 bp, Homo sapiens
atgttggccaggctggt

SEQ ID NO: 5975181 - DNA, 19 bp, Homo sapiens
atgttggccaggctggtct

SEQ ID NO: 5975182 - DNA, 20 bp, Homo sapiens
atgttggccaggctggtttc

SEQ ID NO: 5975183 - DNA, 12 bp, Homo sapiens
atgttggctgcg

SEQ ID NO: 5975184 - DNA, 22 bp, Homo sapiens
atgttggctgcgtactccactg

SEQ ID NO: 5975185 - DNA, 13 bp, Homo sapiens
atgttggctggga

SEQ ID NO: 5975186 - DNA, 14 bp, Homo sapiens
atgttgggaaaaac

SEQ ID NO: 5975187 - DNA, 19 bp, Homo sapiens
atgttgggaaacttggctc

SEQ ID NO: 5975188 - DNA, 20 bp, Homo sapiens
atgttgggaaacttggctcg

SEQ ID NO: 5975189 - DNA, 12 bp, Homo sapiens
atgttgggactg

SEQ ID NO: 5975190 - DNA, 12 bp, Homo sapiens
atgttggggggg

SEQ ID NO: 5975191 - DNA, 17 bp, Homo sapiens
atgttgggtctcactct

SEQ ID NO: 5975192 - DNA, 16 bp, Homo sapiens
atgttggtcaggctgg

SEQ ID NO: 5975193 - DNA, 17 bp, Homo sapiens
atgttggtcaggctggt

SEQ ID NO: 5975194 - DNA, 19 bp, Homo sapiens
atgttggtcaggctggtct

SEQ ID NO: 5975195 - DNA, 18 bp, Homo sapiens
atgttggtcattttatgt

SEQ ID NO: 5975196 - DNA, 12 bp, Homo sapiens
atgttggtgcaa

SEQ ID NO: 5975197 - DNA, 21 bp, Homo sapiens
atgttggtgcaattaactctg

SEQ ID NO: 5975198 - DNA, 14 bp, Homo sapiens
atgttggtgttcca

SEQ ID NO: 5975199 - DNA, 18 bp, Homo sapiens
attaaaaaggtttacaga

SEQ ID NO: 5975200 - DNA, 14 bp, Homo sapiens
attaaaaagtcttt

SEQ ID NO: 5975201 - DNA, 23 bp, Homo sapiens
attaaaaagtcttttaaaaagta

SEQ ID NO: 5975202 - DNA, 16 bp, Homo sapiens
attaaaaataaaatat

SEQ ID NO: 5975203 - DNA, 14 bp, Homo sapiens
attaaaaataagcc

SEQ ID NO: 5975204 - DNA, 15 bp, Homo sapiens
attaaaaatagacag

SEQ ID NO: 5975205 - DNA, 16 bp, Homo sapiens
attaaaaatataaaac

SEQ ID NO: 5975206 - DNA, 17 bp, Homo sapiens
attaaaaatataaaact

SEQ ID NO: 5975207 - DNA, 16 bp, Homo sapiens
attaaaaatataaaca

SEQ ID NO: 5975208 - DNA, 14 bp, Homo sapiens
attaaaaatatgga

SEQ ID NO: 5975209 - DNA, 21 bp, Homo sapiens
attaaaaatatggaacttcta

SEQ ID NO: 5975210 - DNA, 14 bp, Homo sapiens
attaaaaatgctgt

SEQ ID NO: 5975211 - DNA, 16 bp, Homo sapiens
attaaaaatgctgtgc

SEQ ID NO: 5975212 - DNA, 13 bp, Homo sapiens
attaaaaatgttc

SEQ ID NO: 5975213 - DNA, 14 bp, Homo sapiens
attaaaaattaatt

SEQ ID NO: 5975214 - DNA, 22 bp, Homo sapiens
attaaaaattacctttaatttt

SEQ ID NO: 5975215 - DNA, 12 bp, Homo sapiens
attaaaaattga

SEQ ID NO: 5975216 - DNA, 13 bp, Homo sapiens
attaaaacaaaag

SEQ ID NO: 5975217 - DNA, 16 bp, Homo sapiens
attaaaacaaaagggt

SEQ ID NO: 5975218 - DNA, 21 bp, Homo sapiens
attaaaacaaaagggtgtata

SEQ ID NO: 5975219 - DNA, 13 bp, Homo sapiens
attaaaacaaata

SEQ ID NO: 5975220 - DNA, 14 bp, Homo sapiens
attaaaacaaatat

SEQ ID NO: 5975221 - DNA, 11 bp, Homo sapiens
attaaaacaat

SEQ ID NO: 5975222 - DNA, 14 bp, Homo sapiens
attaaaacaatatt

SEQ ID NO: 5975223 - DNA, 18 bp, Homo sapiens
attaaaacaatattgttt

SEQ ID NO: 5975224 - DNA, 14 bp, Homo sapiens
attaaaacacacat

SEQ ID NO: 5975225 - DNA, 13 bp, Homo sapiens
attaaaacacagc

SEQ ID NO: 5975226 - DNA, 16 bp, Homo sapiens
attaaaacacagcttt

SEQ ID NO: 5975227 - DNA, 21 bp, Homo sapiens
attaaaacacattatgtatct

SEQ ID NO: 5975228 - DNA, 15 bp, Homo sapiens
attaaaacagtgtat

SEQ ID NO: 5975229 - DNA, 17 bp, Homo sapiens
attaaaacatatttcat

SEQ ID NO: 5975230 - DNA, 21 bp, Homo sapiens
attaaaacatatttcatttta

SEQ ID NO: 5975231 - DNA, 11 bp, Homo sapiens
attaaaaccac

SEQ ID NO: 5975232 - DNA, 21 bp, Homo sapiens
attaaaaccacagaacagttt

SEQ ID NO: 5975233 - DNA, 23 bp, Homo sapiens
attaaaaccagtctcagatatca

SEQ ID NO: 5975234 - DNA, 18 bp, Homo sapiens
attaaaactatttagtgt

SEQ ID NO: 5975235 - DNA, 14 bp, Homo sapiens
attaaaactcaaca

SEQ ID NO: 5975236 - DNA, 22 bp, Homo sapiens
attaaaactcaacattactgtt

SEQ ID NO: 5975237 - DNA, 15 bp, Homo sapiens
attaaaactcagcct

SEQ ID NO: 5975238 - DNA, 19 bp, Homo sapiens
attaaaactgaagtctgaa

SEQ ID NO: 5975239 - DNA, 20 bp, Homo sapiens
attaaaactgaagtctgaaa

SEQ ID NO: 5975240 - DNA, 21 bp, Homo sapiens
attaaaactgagtccatgaaa

SEQ ID NO: 5975241 - DNA, 13 bp, Homo sapiens
attaaaactgctt

SEQ ID NO: 5975242 - DNA, 13 bp, Homo sapiens
attaaaacttctt

SEQ ID NO: 5975243 - DNA, 14 bp, Homo sapiens
attaaaacttctta

SEQ ID NO: 5975244 - DNA, 22 bp, Homo sapiens
attaaaacttcttaaatatctt

SEQ ID NO: 5975245 - DNA, 19 bp, Homo sapiens
attaaaactttgtagacat

SEQ ID NO: 5975246 - DNA, 21 bp, Homo sapiens
attaaaactttgtagacattt

SEQ ID NO: 5975247 - DNA, 16 bp, Homo sapiens
attaaaagaaaaacaa

SEQ ID NO: 5975248 - DNA, 23 bp, Homo sapiens
attaaaagaaaataaaaaaaaga

SEQ ID NO: 5975249 - DNA, 20 bp, Homo sapiens
attaaaagaaatatacagtt

SEQ ID NO: 5975250 - DNA, 18 bp, Homo sapiens
attaaaagaagactggaa

SEQ ID NO: 5975251 - DNA, 18 bp, Homo sapiens
attaaaagacaaatatgt

SEQ ID NO: 5975252 - DNA, 17 bp, Homo sapiens
attaaaagactccacat

SEQ ID NO: 5975253 - DNA, 23 bp, Homo sapiens
attaaaagatgtctctgcaaacc

SEQ ID NO: 5975254 - DNA, 22 bp, Homo sapiens
attaaaagcaaatcatttgttt

SEQ ID NO: 5975255 - DNA, 14 bp, Homo sapiens
attaaaagcacaag

SEQ ID NO: 5975256 - DNA, 16 bp, Homo sapiens
attaaaagctttagat

SEQ ID NO: 5975257 - DNA, 21 bp, Homo sapiens
attaaaagctttagattgaaa

SEQ ID NO: 5975258 - DNA, 23 bp, Homo sapiens
attaaaagctttagattgaaatt

SEQ ID NO: 5975259 - DNA, 12 bp, Homo sapiens
attaaaagtcac

SEQ ID NO: 5975260 - DNA, 22 bp, Homo sapiens
attaaaagtcacaatgttcttt

SEQ ID NO: 5975261 - DNA, 23 bp, Homo sapiens
attaaaagtcacaatgttcttta

SEQ ID NO: 5975262 - DNA, 15 bp, Homo sapiens
attaaaagtttgaaa

SEQ ID NO: 5975263 - DNA, 22 bp, Homo sapiens
attaaaataaaacaagccttaa

SEQ ID NO: 5975264 - DNA, 18 bp, Homo sapiens
attaaaataaaccaaata

SEQ ID NO: 5975265 - DNA, 13 bp, Homo sapiens
attaaaataacta

SEQ ID NO: 5975266 - DNA, 20 bp, Homo sapiens
attaaaataactatcaggca

SEQ ID NO: 5975267 - DNA, 14 bp, Homo sapiens
attaaaatacattt

SEQ ID NO: 5975268 - DNA, 19 bp, Homo sapiens
attaaaatagattatccca

SEQ ID NO: 5975269 - DNA, 19 bp, Homo sapiens
attaaaatagcatactgtg

SEQ ID NO: 5975270 - DNA, 23 bp, Homo sapiens
attaaaatatagagacaggacag

SEQ ID NO: 5975271 - DNA, 12 bp, Homo sapiens
attaaaatatat

SEQ ID NO: 5975272 - DNA, 23 bp, Homo sapiens
attaaaatatatataaatatata

SEQ ID NO: 5975273 - DNA, 16 bp, Homo sapiens
attaaaatatatgttc

SEQ ID NO: 5975274 - DNA, 17 bp, Homo sapiens
attaaaatatatgttct

SEQ ID NO: 5975275 - DNA, 21 bp, Homo sapiens
attaaaatatatgttctgcaa

SEQ ID NO: 5975276 - DNA, 12 bp, Homo sapiens
attaaaatatgc

SEQ ID NO: 5975277 - DNA, 13 bp, Homo sapiens
attaaaatatgca

SEQ ID NO: 5975278 - DNA, 11 bp, Homo sapiens
attaaaatatt

SEQ ID NO: 5975279 - DNA, 13 bp, Homo sapiens
attaaaatatttc

SEQ ID NO: 5975280 - DNA, 18 bp, Homo sapiens
attaaaatattttcttaa

SEQ ID NO: 5975281 - DNA, 21 bp, Homo sapiens
attaaaatattttcttaatta

SEQ ID NO: 5975282 - DNA, 15 bp, Homo sapiens
attaaaatattttgg

SEQ ID NO: 5975283 - DNA, 16 bp, Homo sapiens
attaaaatcacaaact

SEQ ID NO: 5975284 - DNA, 15 bp, Homo sapiens
attaaaatctacaga

SEQ ID NO: 5975285 - DNA, 15 bp, Homo sapiens
attaaaatctcttga

SEQ ID NO: 5975286 - DNA, 15 bp, Homo sapiens
attaaaatctggaaa

SEQ ID NO: 5975287 - DNA, 17 bp, Homo sapiens
attaaaatctggaaatc

SEQ ID NO: 5975288 - DNA, 20 bp, Homo sapiens
attaaaatctggaaatctgt

SEQ ID NO: 5975289 - DNA, 13 bp, Homo sapiens
attaaaatgaatt

SEQ ID NO: 5975290 - DNA, 14 bp, Homo sapiens
attaaaatgacaaa

SEQ ID NO: 5975291 - DNA, 17 bp, Homo sapiens
attaaaatgacaaacat

SEQ ID NO: 5975292 - DNA, 18 bp, Homo sapiens
attaaaatgattgtaaaa

SEQ ID NO: 5975293 - DNA, 19 bp, Homo sapiens
attaaaatgattgtaaaat

SEQ ID NO: 5975294 - DNA, 20 bp, Homo sapiens
attaaaatgattgtaaaata

SEQ ID NO: 5975295 - DNA, 13 bp, Homo sapiens
attaaaatgcata

SEQ ID NO: 5975296 - DNA, 16 bp, Homo sapiens
attaaaatgcatggtg

SEQ ID NO: 5975297 - DNA, 21 bp, Homo sapiens
attaaaatgcttacatttgaa

SEQ ID NO: 5975298 - DNA, 12 bp, Homo sapiens
attaaaatggat

SEQ ID NO: 5975299 - DNA, 13 bp, Homo sapiens
attaaaatggatg

SEQ ID NO: 5975300 - DNA, 20 bp, Homo sapiens
attaaaatggatttaatcca

SEQ ID NO: 5975301 - DNA, 23 bp, Homo sapiens
attaaaatggatttaatccattt

SEQ ID NO: 5975302 - DNA, 19 bp, Homo sapiens
attaaaatgtaactgacct

SEQ ID NO: 5975303 - DNA, 23 bp, Homo sapiens
attaaaatgtcggatttatcttt

SEQ ID NO: 5975304 - DNA, 14 bp, Homo sapiens
attaaaattagtga

SEQ ID NO: 5975305 - DNA, 16 bp, Homo sapiens
attaaaattagtgctg

SEQ ID NO: 5975306 - DNA, 16 bp, Homo sapiens
attaaaattgccattt

SEQ ID NO: 5975307 - DNA, 13 bp, Homo sapiens
attaaaattgttg

SEQ ID NO: 5975308 - DNA, 16 bp, Homo sapiens
attaaaatttatctta

SEQ ID NO: 5975309 - DNA, 17 bp, Homo sapiens
attaaaatttatcttaa

SEQ ID NO: 5975310 - DNA, 14 bp, Homo sapiens
attaaaatttctta

SEQ ID NO: 5975311 - DNA, 16 bp, Homo sapiens
attaaaattttacctc

SEQ ID NO: 5975312 - DNA, 17 bp, Homo sapiens
attaaaattttatgaca

SEQ ID NO: 5975313 - DNA, 14 bp, Homo sapiens
attaaaattttcct

SEQ ID NO: 5975314 - DNA, 20 bp, Homo sapiens
attaaacaaaaacaaagaaa

SEQ ID NO: 5975315 - DNA, 13 bp, Homo sapiens
attaaacaaataa

SEQ ID NO: 5975316 - DNA, 12 bp, Homo sapiens
attaaacacagg

SEQ ID NO: 5975317 - DNA, 14 bp, Homo sapiens
attaaacacaggga

SEQ ID NO: 5975318 - DNA, 13 bp, Homo sapiens
attaaacacctga

SEQ ID NO: 5975319 - DNA, 16 bp, Homo sapiens
attaaacagatatctt

SEQ ID NO: 5975320 - DNA, 23 bp, Homo sapiens
attaaacagatatcttcagttta

SEQ ID NO: 5975321 - DNA, 13 bp, Homo sapiens
attaaacagccaa

SEQ ID NO: 5975322 - DNA, 20 bp, Homo sapiens
attaaacagtgaacttgtct

SEQ ID NO: 5975323 - DNA, 12 bp, Homo sapiens
attaaacatgaa

SEQ ID NO: 5975324 - DNA, 13 bp, Homo sapiens
attaaacatgaat

SEQ ID NO: 5975325 - DNA, 14 bp, Homo sapiens
attaaacatgactc

SEQ ID NO: 5975326 - DNA, 13 bp, Homo sapiens
attaaacatgctc

SEQ ID NO: 5975327 - DNA, 14 bp, Homo sapiens
attaaacatgctgt

SEQ ID NO: 5975328 - DNA, 22 bp, Homo sapiens
attaaaccatctccctggtgct

SEQ ID NO: 5975329 - DNA, 21 bp, Homo sapiens
attaaacccacaagctgcctc

SEQ ID NO: 5975330 - DNA, 14 bp, Homo sapiens
attaaaccgcatgt

SEQ ID NO: 5975331 - DNA, 20 bp, Homo sapiens
attaaacctgtctccactgt

SEQ ID NO: 5975332 - DNA, 17 bp, Homo sapiens
attaaacctttcagtac

SEQ ID NO: 5975333 - DNA, 15 bp, Homo sapiens
attaaacctttccat

SEQ ID NO: 5975334 - DNA, 24 bp, Homo sapiens
attaaacctttccattttacgttt

SEQ ID NO: 5975335 - DNA, 15 bp, Homo sapiens
attaaacgattttta

SEQ ID NO: 5975336 - DNA, 22 bp, Homo sapiens
attaaacgatttttaaaatgta

SEQ ID NO: 5975337 - DNA, 17 bp, Homo sapiens
attaaacggattatttt

SEQ ID NO: 5975338 - DNA, 19 bp, Homo sapiens
attaaacggattatttttt

SEQ ID NO: 5975339 - DNA, 19 bp, Homo sapiens
attaaactcatattttgaa

SEQ ID NO: 5975340 - DNA, 23 bp, Homo sapiens
attaaactcttcacaaaatctgt

SEQ ID NO: 5975341 - DNA, 14 bp, Homo sapiens
attaaactgaagaa

SEQ ID NO: 5975342 - DNA, 12 bp, Homo sapiens
attaaactgaat

SEQ ID NO: 5975343 - DNA, 13 bp, Homo sapiens
attaaactgggaa

SEQ ID NO: 5975344 - DNA, 15 bp, Homo sapiens
attaaactgggaaat

SEQ ID NO: 5975345 - DNA, 17 bp, Homo sapiens
attaaactgggaaatga

SEQ ID NO: 5975346 - DNA, 18 bp, Homo sapiens
attaaactgggaaatgag

SEQ ID NO: 5975347 - DNA, 20 bp, Homo sapiens
attaaactgtaaatcataat

SEQ ID NO: 5975348 - DNA, 18 bp, Homo sapiens
attaaactgtatgtctta

SEQ ID NO: 5975349 - DNA, 17 bp, Homo sapiens
attaaactgttaactta

SEQ ID NO: 5975350 - DNA, 19 bp, Homo sapiens
attaaacttaaaactttgt

SEQ ID NO: 5975351 - DNA, 13 bp, Homo sapiens
attaaacttatga

SEQ ID NO: 5975352 - DNA, 15 bp, Homo sapiens
attaaacttatgaat

SEQ ID NO: 5975353 - DNA, 16 bp, Homo sapiens
attaaacttatgaatg

SEQ ID NO: 5975354 - DNA, 17 bp, Homo sapiens
attaaacttatgaatgt

SEQ ID NO: 5975355 - DNA, 14 bp, Homo sapiens
attaaacttcacct

SEQ ID NO: 5975356 - DNA, 17 bp, Homo sapiens
attaaacttccaaagaa

SEQ ID NO: 5975357 - DNA, 21 bp, Homo sapiens
attaaacttccaaagaaagtt

SEQ ID NO: 5975358 - DNA, 15 bp, Homo sapiens
attaaacttccttct

SEQ ID NO: 5975359 - DNA, 20 bp, Homo sapiens
attaaacttctactgagcaa

SEQ ID NO: 5975360 - DNA, 12 bp, Homo sapiens
attaaacttgaa

SEQ ID NO: 5975361 - DNA, 17 bp, Homo sapiens
attaaacttgaagcagt

SEQ ID NO: 5975362 - DNA, 18 bp, Homo sapiens
attaaacttttaattcat

SEQ ID NO: 5975363 - DNA, 19 bp, Homo sapiens
attaaacttttaattcatt

SEQ ID NO: 5975364 - DNA, 16 bp, Homo sapiens
attaaacttttcatta

SEQ ID NO: 5975365 - DNA, 12 bp, Homo sapiens
attaaacttttt

SEQ ID NO: 5975366 - DNA, 18 bp, Homo sapiens
attaaagaaaaaaatgta

SEQ ID NO: 5975367 - DNA, 22 bp, Homo sapiens
attaaagaaaaaaatgtatttt

SEQ ID NO: 5975368 - DNA, 14 bp, Homo sapiens
attaaagaaaaact

SEQ ID NO: 5975369 - DNA, 13 bp, Homo sapiens
attaaagaaaaat

SEQ ID NO: 5975370 - DNA, 12 bp, Homo sapiens
attaaagaaaat

SEQ ID NO: 5975371 - DNA, 18 bp, Homo sapiens
attaaagaaaataaaatt

SEQ ID NO: 5975372 - DNA, 13 bp, Homo sapiens
attaaagaaaatt

SEQ ID NO: 5975373 - DNA, 16 bp, Homo sapiens
attaaagaaagtcata

SEQ ID NO: 5975374 - DNA, 13 bp, Homo sapiens
attaaagaaatga

SEQ ID NO: 5975375 - DNA, 14 bp, Homo sapiens
attaaagaagacct

SEQ ID NO: 5975376 - DNA, 20 bp, Homo sapiens
attaaagaagggttgagctg

SEQ ID NO: 5975377 - DNA, 12 bp, Homo sapiens
attaaagaagtt

SEQ ID NO: 5975378 - DNA, 13 bp, Homo sapiens
attaaagacagag

SEQ ID NO: 5975379 - DNA, 20 bp, Homo sapiens
attaataccaaatattttag

SEQ ID NO: 5975380 - DNA, 23 bp, Homo sapiens
attaatagagttggagttttatt

SEQ ID NO: 5975381 - DNA, 18 bp, Homo sapiens
attaatagcagcctttct

SEQ ID NO: 5975382 - DNA, 18 bp, Homo sapiens
attaatagtaatttgtaa

SEQ ID NO: 5975383 - DNA, 21 bp, Homo sapiens
attaatagtaatttgtaaagt

SEQ ID NO: 5975384 - DNA, 22 bp, Homo sapiens
attaatagtaggattattccta

SEQ ID NO: 5975385 - DNA, 22 bp, Homo sapiens
attaatataaccataaatcaat

SEQ ID NO: 5975386 - DNA, 16 bp, Homo sapiens
attaatatatagtcca

SEQ ID NO: 5975387 - DNA, 22 bp, Homo sapiens
attaatatatagtccagacact

SEQ ID NO: 5975388 - DNA, 21 bp, Homo sapiens
attaatatatgtattatttat

SEQ ID NO: 5975389 - DNA, 22 bp, Homo sapiens
attaatatatgtattatttata

SEQ ID NO: 5975390 - DNA, 18 bp, Homo sapiens
attaatatcaactctgaa

SEQ ID NO: 5975391 - DNA, 19 bp, Homo sapiens
attaatatctcctggaaca

SEQ ID NO: 5975392 - DNA, 14 bp, Homo sapiens
attaatatcttgct

SEQ ID NO: 5975393 - DNA, 14 bp, Homo sapiens
attaatatctttct

SEQ ID NO: 5975394 - DNA, 17 bp, Homo sapiens
attaatatctttctgca

SEQ ID NO: 5975395 - DNA, 14 bp, Homo sapiens
attaatatgaaaac

SEQ ID NO: 5975396 - DNA, 15 bp, Homo sapiens
attaatatgaaaact

SEQ ID NO: 5975397 - DNA, 14 bp, Homo sapiens
attaatatgttcat

SEQ ID NO: 5975398 - DNA, 19 bp, Homo sapiens
attaatatgttcattaaat

SEQ ID NO: 5975399 - DNA, 18 bp, Homo sapiens
attaatattaattttcta

SEQ ID NO: 5975400 - DNA, 13 bp, Homo sapiens
attaatattatta

SEQ ID NO: 5975401 - DNA, 19 bp, Homo sapiens
attaatattcattgtataa

SEQ ID NO: 5975402 - DNA, 18 bp, Homo sapiens
attaatattcttttgtta

SEQ ID NO: 5975403 - DNA, 13 bp, Homo sapiens
attaatattgtat

SEQ ID NO: 5975404 - DNA, 15 bp, Homo sapiens
attaatattgtattg

SEQ ID NO: 5975405 - DNA, 11 bp, Homo sapiens
attaatattta

SEQ ID NO: 5975406 - DNA, 23 bp, Homo sapiens
attaatatttaacattatttata

SEQ ID NO: 5975407 - DNA, 15 bp, Homo sapiens
attaatatttaccaa

SEQ ID NO: 5975408 - DNA, 14 bp, Homo sapiens
attaatatttatgt

SEQ ID NO: 5975409 - DNA, 16 bp, Homo sapiens
attaatatttatgtgt

SEQ ID NO: 5975410 - DNA, 17 bp, Homo sapiens
attaatatttgcacatg

SEQ ID NO: 5975411 - DNA, 14 bp, Homo sapiens
attaatattttaat

SEQ ID NO: 5975412 - DNA, 13 bp, Homo sapiens
attaatcaaaggc

SEQ ID NO: 5975413 - DNA, 21 bp, Homo sapiens
attaatcaagagaaacttcaa

SEQ ID NO: 5975414 - DNA, 14 bp, Homo sapiens
attaatcactgtgt

SEQ ID NO: 5975415 - DNA, 19 bp, Homo sapiens
attaatcactgtgtatatt

SEQ ID NO: 5975416 - DNA, 20 bp, Homo sapiens
attaatcactgtgtatattt

SEQ ID NO: 5975417 - DNA, 22 bp, Homo sapiens
attaatcagccccagagtgctt

SEQ ID NO: 5975418 - DNA, 22 bp, Homo sapiens
attaatcatagattattataaa

SEQ ID NO: 5975419 - DNA, 14 bp, Homo sapiens
attaatcatctata

SEQ ID NO: 5975420 - DNA, 15 bp, Homo sapiens
attaatcatgaatgt

SEQ ID NO: 5975421 - DNA, 13 bp, Homo sapiens
attaatcattcca

SEQ ID NO: 5975422 - DNA, 21 bp, Homo sapiens
attaatcatttgatttaaaca

SEQ ID NO: 5975423 - DNA, 19 bp, Homo sapiens
attaatccacaaatatgct

SEQ ID NO: 5975424 - DNA, 18 bp, Homo sapiens
attaatccacatgtttca

SEQ ID NO: 5975425 - DNA, 20 bp, Homo sapiens
attaatcctcttgagagaaa

SEQ ID NO: 5975426 - DNA, 13 bp, Homo sapiens
attaatcctttaa

SEQ ID NO: 5975427 - DNA, 17 bp, Homo sapiens
attaatcgaaatgaatt

SEQ ID NO: 5975428 - DNA, 16 bp, Homo sapiens
attaatcgtgtcttca

SEQ ID NO: 5975429 - DNA, 19 bp, Homo sapiens
attaatctaccttgcagtg

SEQ ID NO: 5975430 - DNA, 15 bp, Homo sapiens
attaatctactgtat

SEQ ID NO: 5975431 - DNA, 20 bp, Homo sapiens
attaatctagaaaatgaaaa

SEQ ID NO: 5975432 - DNA, 12 bp, Homo sapiens
attaatctctaa

SEQ ID NO: 5975433 - DNA, 16 bp, Homo sapiens
attaatctgcctccct

SEQ ID NO: 5975434 - DNA, 17 bp, Homo sapiens
attaatctgggaaggca

SEQ ID NO: 5975435 - DNA, 14 bp, Homo sapiens
attaatctgtttgt

SEQ ID NO: 5975436 - DNA, 17 bp, Homo sapiens
attaatcttagtgtatg

SEQ ID NO: 5975437 - DNA, 14 bp, Homo sapiens
attaatcttattgt

SEQ ID NO: 5975438 - DNA, 12 bp, Homo sapiens
attaatcttcag

SEQ ID NO: 5975439 - DNA, 14 bp, Homo sapiens
attaatcttgatca

SEQ ID NO: 5975440 - DNA, 13 bp, Homo sapiens
attaatcttgtgt

SEQ ID NO: 5975441 - DNA, 13 bp, Homo sapiens
attaatctttcta

SEQ ID NO: 5975442 - DNA, 23 bp, Homo sapiens
attaatctttctttacctgagac

SEQ ID NO: 5975443 - DNA, 19 bp, Homo sapiens
attaatgaaaactttttca

SEQ ID NO: 5975444 - DNA, 18 bp, Homo sapiens
attaatgaaatatctgta

SEQ ID NO: 5975445 - DNA, 19 bp, Homo sapiens
attaatgaaatatctgtat

SEQ ID NO: 5975446 - DNA, 20 bp, Homo sapiens
attaatgaaatgataaagac

SEQ ID NO: 5975447 - DNA, 21 bp, Homo sapiens
attaatgaaatgataaagact

SEQ ID NO: 5975448 - DNA, 17 bp, Homo sapiens
attaatgaactgtgaca

SEQ ID NO: 5975449 - DNA, 16 bp, Homo sapiens
attaatgaagaaagta

SEQ ID NO: 5975450 - DNA, 14 bp, Homo sapiens
attaatgacaacaa

SEQ ID NO: 5975451 - DNA, 16 bp, Homo sapiens
attaatgacagagcca

SEQ ID NO: 5975452 - DNA, 20 bp, Homo sapiens
attaatgagaagagttttct

SEQ ID NO: 5975453 - DNA, 18 bp, Homo sapiens
attaatgataaactcaga

SEQ ID NO: 5975454 - DNA, 11 bp, Homo sapiens
attaatgcact

SEQ ID NO: 5975455 - DNA, 18 bp, Homo sapiens
attaatgcagatttctct

SEQ ID NO: 5975456 - DNA, 13 bp, Homo sapiens
attaatgcattca

SEQ ID NO: 5975457 - DNA, 17 bp, Homo sapiens
attaatgcattttgctg

SEQ ID NO: 5975458 - DNA, 13 bp, Homo sapiens
attaatgcctctc

SEQ ID NO: 5975459 - DNA, 17 bp, Homo sapiens
attaatgcctttaaagt

SEQ ID NO: 5975460 - DNA, 18 bp, Homo sapiens
attaatgcgatttcttcc

SEQ ID NO: 5975461 - DNA, 15 bp, Homo sapiens
attaatgctaagggc

SEQ ID NO: 5975462 - DNA, 20 bp, Homo sapiens
attaatgcttagaattctga

SEQ ID NO: 5975463 - DNA, 12 bp, Homo sapiens
attaatgctttg

SEQ ID NO: 5975464 - DNA, 18 bp, Homo sapiens
attaatggaaaactgtta

SEQ ID NO: 5975465 - DNA, 15 bp, Homo sapiens
attaatggaaatgtt

SEQ ID NO: 5975466 - DNA, 16 bp, Homo sapiens
attaatggcatgtaat

SEQ ID NO: 5975467 - DNA, 20 bp, Homo sapiens
attaatggcatgtaatattc

SEQ ID NO: 5975468 - DNA, 13 bp, Homo sapiens
attaatgtacaca

SEQ ID NO: 5975469 - DNA, 13 bp, Homo sapiens
attaatgtagata

SEQ ID NO: 5975470 - DNA, 22 bp, Homo sapiens
attaatgtagctgctagctatt

SEQ ID NO: 5975471 - DNA, 21 bp, Homo sapiens
attaatgtaggtttagatata

SEQ ID NO: 5975472 - DNA, 18 bp, Homo sapiens
attaatgtataatttgag

SEQ ID NO: 5975473 - DNA, 21 bp, Homo sapiens
attaatgtatccaatgaaata

SEQ ID NO: 5975474 - DNA, 23 bp, Homo sapiens
attaatgtatgtaggagctgcag

SEQ ID NO: 5975475 - DNA, 20 bp, Homo sapiens
attaatgtcagtatttcaac

SEQ ID NO: 5975476 - DNA, 15 bp, Homo sapiens
attaatgtgtaaaat

SEQ ID NO: 5975477 - DNA, 12 bp, Homo sapiens
attaatgtgttg

SEQ ID NO: 5975478 - DNA, 18 bp, Homo sapiens
attaatgttaattcagca

SEQ ID NO: 5975479 - DNA, 13 bp, Homo sapiens
attaatgttgaaa

SEQ ID NO: 5975480 - DNA, 15 bp, Homo sapiens
attaatgttgatttc

SEQ ID NO: 5975481 - DNA, 22 bp, Homo sapiens
attaatgtttctatctgatttt

SEQ ID NO: 5975482 - DNA, 14 bp, Homo sapiens
attaatgtttctta

SEQ ID NO: 5975483 - DNA, 15 bp, Homo sapiens
attaatgttttcaaa

SEQ ID NO: 5975484 - DNA, 20 bp, Homo sapiens
attaatgttttcattatgtt

SEQ ID NO: 5975485 - DNA, 14 bp, Homo sapiens
attaatgttttgta

SEQ ID NO: 5975486 - DNA, 15 bp, Homo sapiens
attaattaaaatttg

SEQ ID NO: 5975487 - DNA, 21 bp, Homo sapiens
attaattaaatgaacttatgt

SEQ ID NO: 5975488 - DNA, 15 bp, Homo sapiens
attaattaattaaag

SEQ ID NO: 5975489 - DNA, 15 bp, Homo sapiens
attaattaatttgga

SEQ ID NO: 5975490 - DNA, 16 bp, Homo sapiens
attaattaatttggag

SEQ ID NO: 5975491 - DNA, 15 bp, Homo sapiens
attaattacaatgta

SEQ ID NO: 5975492 - DNA, 15 bp, Homo sapiens
attaattactaattt

SEQ ID NO: 5975493 - DNA, 20 bp, Homo sapiens
attaattagattttcttgca

SEQ ID NO: 5975494 - DNA, 14 bp, Homo sapiens
attaattaggaatt

SEQ ID NO: 5975495 - DNA, 15 bp, Homo sapiens
attaattataataaa

SEQ ID NO: 5975496 - DNA, 16 bp, Homo sapiens
attaattatatttcta

SEQ ID NO: 5975497 - DNA, 16 bp, Homo sapiens
attaattatcgtgtct

SEQ ID NO: 5975498 - DNA, 14 bp, Homo sapiens
attaattatctgat

SEQ ID NO: 5975499 - DNA, 12 bp, Homo sapiens
attaattatctt

SEQ ID NO: 5975500 - DNA, 16 bp, Homo sapiens
attaattcaattaaaa

SEQ ID NO: 5975501 - DNA, 23 bp, Homo sapiens
attaattccaagattaaaagttc

SEQ ID NO: 5975502 - DNA, 22 bp, Homo sapiens
attaattccttcagcactttag

SEQ ID NO: 5975503 - DNA, 13 bp, Homo sapiens
attaattctaaac

SEQ ID NO: 5975504 - DNA, 15 bp, Homo sapiens
attaattctaaactt

SEQ ID NO: 5975505 - DNA, 16 bp, Homo sapiens
attaattctaaactta

SEQ ID NO: 5975506 - DNA, 16 bp, Homo sapiens
attaattctactaaat

SEQ ID NO: 5975507 - DNA, 18 bp, Homo sapiens
attaattcttaataggct

SEQ ID NO: 5975508 - DNA, 19 bp, Homo sapiens
attaattgcctgttaaata

SEQ ID NO: 5975509 - DNA, 14 bp, Homo sapiens
attaattgctgcaa

SEQ ID NO: 5975510 - DNA, 12 bp, Homo sapiens
attaattgcttt

SEQ ID NO: 5975511 - DNA, 17 bp, Homo sapiens
attaattggcagcagat

SEQ ID NO: 5975512 - DNA, 19 bp, Homo sapiens
attaattgggccagctttt

SEQ ID NO: 5975513 - DNA, 14 bp, Homo sapiens
attaattgtcatta

SEQ ID NO: 5975514 - DNA, 18 bp, Homo sapiens
attaattgtcctgtgtct

SEQ ID NO: 5975515 - DNA, 21 bp, Homo sapiens
attaattgtgtgaacttggaa

SEQ ID NO: 5975516 - DNA, 18 bp, Homo sapiens
attaattgttttgcactt

SEQ ID NO: 5975517 - DNA, 19 bp, Homo sapiens
attaattgttttgcacttt

SEQ ID NO: 5975518 - DNA, 20 bp, Homo sapiens
attaattgttttgcactttt

SEQ ID NO: 5975519 - DNA, 10 bp, Homo sapiens
attaatttat

SEQ ID NO: 5975520 - DNA, 14 bp, Homo sapiens
attaatttattggg

SEQ ID NO: 5975521 - DNA, 13 bp, Homo sapiens
attaatttctgcc

SEQ ID NO: 5975522 - DNA, 12 bp, Homo sapiens
attaatttgaaa

SEQ ID NO: 5975523 - DNA, 14 bp, Homo sapiens
attaatttgaccat

SEQ ID NO: 5975524 - DNA, 14 bp, Homo sapiens
attaatttgagaat

SEQ ID NO: 5975525 - DNA, 19 bp, Homo sapiens
attaatttgagaattattc

SEQ ID NO: 5975526 - DNA, 16 bp, Homo sapiens
attaatttgattaaca

SEQ ID NO: 5975527 - DNA, 17 bp, Homo sapiens
attaatttgattaacaa

SEQ ID NO: 5975528 - DNA, 20 bp, Homo sapiens
attaatttgattaacaaata

SEQ ID NO: 5975529 - DNA, 21 bp, Homo sapiens
attaatttggagcacaaaatt

SEQ ID NO: 5975530 - DNA, 19 bp, Homo sapiens
attaatttgtgaatttgca

SEQ ID NO: 5975531 - DNA, 12 bp, Homo sapiens
attaatttgtgt

SEQ ID NO: 5975532 - DNA, 17 bp, Homo sapiens
attaatttgttaattaa

SEQ ID NO: 5975533 - DNA, 20 bp, Homo sapiens
attaatttgtttttcttatc

SEQ ID NO: 5975534 - DNA, 15 bp, Homo sapiens
attaattttctatgt

SEQ ID NO: 5975535 - DNA, 17 bp, Homo sapiens
attaatttttatttatt

SEQ ID NO: 5975536 - DNA, 19 bp, Homo sapiens
attaatttttcaatttctc

SEQ ID NO: 5975537 - DNA, 19 bp, Homo sapiens
attaatttttttattgttt

SEQ ID NO: 5975538 - DNA, 16 bp, Homo sapiens
attaattttttttcat

SEQ ID NO: 5975539 - DNA, 17 bp, Homo sapiens
attaattttttttcatt

SEQ ID NO: 5975540 - DNA, 14 bp, Homo sapiens
attacaaaagagac

SEQ ID NO: 5975541 - DNA, 22 bp, Homo sapiens
attacaaaatgacattttgcca

SEQ ID NO: 5975542 - DNA, 16 bp, Homo sapiens
attacaaacaagtgga

SEQ ID NO: 5975543 - DNA, 15 bp, Homo sapiens
attacaaagaaaata

SEQ ID NO: 5975544 - DNA, 21 bp, Homo sapiens
attacaaagaaccatgcagga

SEQ ID NO: 5975545 - DNA, 23 bp, Homo sapiens
attacaaagttaaaattgttatc

SEQ ID NO: 5975546 - DNA, 16 bp, Homo sapiens
attacaaataaacagt

SEQ ID NO: 5975547 - DNA, 14 bp, Homo sapiens
attacaaatattgt

SEQ ID NO: 5975548 - DNA, 23 bp, Homo sapiens
attacaaatcagaagtcatcttg

SEQ ID NO: 5975549 - DNA, 19 bp, Homo sapiens
attacaaatgcaaatttct

SEQ ID NO: 5975550 - DNA, 20 bp, Homo sapiens
attacaaatgtggctgtaaa

SEQ ID NO: 5975551 - DNA, 22 bp, Homo sapiens
attacaaatgtggctgtaaaac

SEQ ID NO: 5975552 - DNA, 20 bp, Homo sapiens
attacaaattttcactgctg

SEQ ID NO: 5975553 - DNA, 21 bp, Homo sapiens
attacaaattttcactgctgc

SEQ ID NO: 5975554 - DNA, 17 bp, Homo sapiens
attacaacaagcaaact

SEQ ID NO: 5975555 - DNA, 21 bp, Homo sapiens
attacaacaagcaaactgaaa

SEQ ID NO: 5975556 - DNA, 20 bp, Homo sapiens
attacaacaatctggagata

SEQ ID NO: 5975557 - DNA, 14 bp, Homo sapiens
attacaacatttat

SEQ ID NO: 5975558 - DNA, 20 bp, Homo sapiens
ccacactttgaagcaaatac

SEQ ID NO: 5975559 - DNA, 18 bp, Homo sapiens
ccacactttgagaacctg

SEQ ID NO: 5975560 - DNA, 22 bp, Homo sapiens
ccacactttgggacttgggagc

SEQ ID NO: 5975561 - DNA, 14 bp, Homo sapiens
ccacagaaagagag

SEQ ID NO: 5975562 - DNA, 18 bp, Homo sapiens
ccacagaaagccaggagc

SEQ ID NO: 5975563 - DNA, 13 bp, Homo sapiens
ccacagaaatctc

SEQ ID NO: 5975564 - DNA, 16 bp, Homo sapiens
ccacagaaatctctca

SEQ ID NO: 5975565 - DNA, 12 bp, Homo sapiens
ccacagaacctt

SEQ ID NO: 5975566 - DNA, 20 bp, Homo sapiens
ccacagaaccttcaacccag

SEQ ID NO: 5975567 - DNA, 17 bp, Homo sapiens
ccacagaacctttgtca

SEQ ID NO: 5975568 - DNA, 12 bp, Homo sapiens
ccacagaacttg

SEQ ID NO: 5975569 - DNA, 15 bp, Homo sapiens
ccacagaacttgtgg

SEQ ID NO: 5975570 - DNA, 16 bp, Homo sapiens
ccacagaacttgtggc

SEQ ID NO: 5975571 - DNA, 18 bp, Homo sapiens
ccacagaagacacgtgtt

SEQ ID NO: 5975572 - DNA, 20 bp, Homo sapiens
ccacagaagacttcccagct

SEQ ID NO: 5975573 - DNA, 17 bp, Homo sapiens
ccacagaagccaggagc

SEQ ID NO: 5975574 - DNA, 20 bp, Homo sapiens
ccacagaagccaggagcaaa

SEQ ID NO: 5975575 - DNA, 22 bp, Homo sapiens
ccacagaagccaggagcaaatg

SEQ ID NO: 5975576 - DNA, 18 bp, Homo sapiens
ccacagaagctccaggta

SEQ ID NO: 5975577 - DNA, 21 bp, Homo sapiens
ccacagaatacaagccactac

SEQ ID NO: 5975578 - DNA, 23 bp, Homo sapiens
ccacagacaaaagcgcttttcct

SEQ ID NO: 5975579 - DNA, 14 bp, Homo sapiens
ccacagacacacac

SEQ ID NO: 5975580 - DNA, 18 bp, Homo sapiens
ccacagacactcctgggg

SEQ ID NO: 5975581 - DNA, 15 bp, Homo sapiens
ccacagaccacctgc

SEQ ID NO: 5975582 - DNA, 16 bp, Homo sapiens
ccacagaccacctgct

SEQ ID NO: 5975583 - DNA, 16 bp, Homo sapiens
ccacagacccctggga

SEQ ID NO: 5975584 - DNA, 17 bp, Homo sapiens
ccacagacctgcagtga

SEQ ID NO: 5975585 - DNA, 23 bp, Homo sapiens
ccacagacctgcagtgaggggcc

SEQ ID NO: 5975586 - DNA, 18 bp, Homo sapiens
ccacagacctgctctgga

SEQ ID NO: 5975587 - DNA, 21 bp, Homo sapiens
ccacagacggaagggtaaaca

SEQ ID NO: 5975588 - DNA, 22 bp, Homo sapiens
ccacagacggaagggtaaacaa

SEQ ID NO: 5975589 - DNA, 17 bp, Homo sapiens
ccacagactcaatgtgc

SEQ ID NO: 5975590 - DNA, 20 bp, Homo sapiens
ccacagactgccccagccaa

SEQ ID NO: 5975591 - DNA, 21 bp, Homo sapiens
ccacagactgccccagccaac

SEQ ID NO: 5975592 - DNA, 20 bp, Homo sapiens
ccacagagaagtttgtagcc

SEQ ID NO: 5975593 - DNA, 21 bp, Homo sapiens
ccacagagaagtttgtagcca

SEQ ID NO: 5975594 - DNA, 22 bp, Homo sapiens
ccacagagaagtttgtagccag

SEQ ID NO: 5975595 - DNA, 17 bp, Homo sapiens
ccacagagacaaggagg

SEQ ID NO: 5975596 - DNA, 20 bp, Homo sapiens
ccacagagactgtttgaatg

SEQ ID NO: 5975597 - DNA, 21 bp, Homo sapiens
ccacagagagggagagcagag

SEQ ID NO: 5975598 - DNA, 19 bp, Homo sapiens
ccacagagagtcccactgc

SEQ ID NO: 5975599 - DNA, 20 bp, Homo sapiens
ccacagagattagcctgtag

SEQ ID NO: 5975600 - DNA, 12 bp, Homo sapiens
ccacagagcaaa

SEQ ID NO: 5975601 - DNA, 16 bp, Homo sapiens
ccacagagcaggaagc

SEQ ID NO: 5975602 - DNA, 11 bp, Homo sapiens
ccacagagcct

SEQ ID NO: 5975603 - DNA, 13 bp, Homo sapiens
ccacagagcctgg

SEQ ID NO: 5975604 - DNA, 14 bp, Homo sapiens
ccacagagcctggc

SEQ ID NO: 5975605 - DNA, 13 bp, Homo sapiens
ccacagaggacac

SEQ ID NO: 5975606 - DNA, 13 bp, Homo sapiens
ccacagaggccag

SEQ ID NO: 5975607 - DNA, 14 bp, Homo sapiens
ccacagaggcccca

SEQ ID NO: 5975608 - DNA, 19 bp, Homo sapiens
ccacagaggccccacctga

SEQ ID NO: 5975609 - DNA, 23 bp, Homo sapiens
ccacagagggaagtttaaaaccc

SEQ ID NO: 5975610 - DNA, 13 bp, Homo sapiens
ccacagagtataa

SEQ ID NO: 5975611 - DNA, 22 bp, Homo sapiens
ccacagagttactgccacggtc

SEQ ID NO: 5975612 - DNA, 22 bp, Homo sapiens
ccacagataccagacctcttct

SEQ ID NO: 5975613 - DNA, 22 bp, Homo sapiens
ccacagatgatgaagaaatgat

SEQ ID NO: 5975614 - DNA, 18 bp, Homo sapiens
ccacagatgcctccaccc

SEQ ID NO: 5975615 - DNA, 16 bp, Homo sapiens
ccacagattcactttg

SEQ ID NO: 5975616 - DNA, 22 bp, Homo sapiens
ccacagattgtttctatacaaa

SEQ ID NO: 5975617 - DNA, 21 bp, Homo sapiens
ccacagcaagccatcatcctc

SEQ ID NO: 5975618 - DNA, 19 bp, Homo sapiens
ccacagcaaggcacctgca

SEQ ID NO: 5975619 - DNA, 16 bp, Homo sapiens
ccacagcaaggctgtc

SEQ ID NO: 5975620 - DNA, 17 bp, Homo sapiens
ccacagcaaggctgtcg

SEQ ID NO: 5975621 - DNA, 19 bp, Homo sapiens
ccacagcaattggctcctc

SEQ ID NO: 5975622 - DNA, 14 bp, Homo sapiens
ccacagcacagcca

SEQ ID NO: 5975623 - DNA, 22 bp, Homo sapiens
ccacagcacagctccctgccaa

SEQ ID NO: 5975624 - DNA, 14 bp, Homo sapiens
ccacagcacccagg

SEQ ID NO: 5975625 - DNA, 17 bp, Homo sapiens
ccacagcacccaggctc

SEQ ID NO: 5975626 - DNA, 23 bp, Homo sapiens
ccacagcacccaggctccatggg

SEQ ID NO: 5975627 - DNA, 22 bp, Homo sapiens
ccacagcactagagtcaccccc

SEQ ID NO: 5975628 - DNA, 14 bp, Homo sapiens
ccacagcagagcat

SEQ ID NO: 5975629 - DNA, 14 bp, Homo sapiens
ccacagcagcattt

SEQ ID NO: 5975630 - DNA, 16 bp, Homo sapiens
ccacagcagccccagg

SEQ ID NO: 5975631 - DNA, 17 bp, Homo sapiens
ccacagcagcctctgaa

SEQ ID NO: 5975632 - DNA, 21 bp, Homo sapiens
ccacagcaggatcgaagggtt

SEQ ID NO: 5975633 - DNA, 14 bp, Homo sapiens
ccacagcaggggct

SEQ ID NO: 5975634 - DNA, 15 bp, Homo sapiens
ccacagcagtgtcac

SEQ ID NO: 5975635 - DNA, 12 bp, Homo sapiens
ccacagcagttg

SEQ ID NO: 5975636 - DNA, 17 bp, Homo sapiens
ccacagcagttgaaaag

SEQ ID NO: 5975637 - DNA, 19 bp, Homo sapiens
ccacagcattcctccatct

SEQ ID NO: 5975638 - DNA, 17 bp, Homo sapiens
ccacagccaacaaacat

SEQ ID NO: 5975639 - DNA, 15 bp, Homo sapiens
ccacagccaagccca

SEQ ID NO: 5975640 - DNA, 19 bp, Homo sapiens
ccacagccaagcccaccct

SEQ ID NO: 5975641 - DNA, 14 bp, Homo sapiens
ccacagccacctcc

SEQ ID NO: 5975642 - DNA, 23 bp, Homo sapiens
ccacagccagaaccccgagccct

SEQ ID NO: 5975643 - DNA, 21 bp, Homo sapiens
ccacagccagaggagggcaga

SEQ ID NO: 5975644 - DNA, 18 bp, Homo sapiens
ccacagccagcacctggc

SEQ ID NO: 5975645 - DNA, 19 bp, Homo sapiens
ccacagccagcacctggca

SEQ ID NO: 5975646 - DNA, 13 bp, Homo sapiens
ccacagccagggg

SEQ ID NO: 5975647 - DNA, 13 bp, Homo sapiens
ccacagccatccc

SEQ ID NO: 5975648 - DNA, 17 bp, Homo sapiens
ccacagcccacgtcctg

SEQ ID NO: 5975649 - DNA, 18 bp, Homo sapiens
ccacagcccacgtcctgt

SEQ ID NO: 5975650 - DNA, 21 bp, Homo sapiens
ccacagcccacgtcctgtcag

SEQ ID NO: 5975651 - DNA, 13 bp, Homo sapiens
ccacagcccaggc

SEQ ID NO: 5975652 - DNA, 11 bp, Homo sapiens
ccacagccccc

SEQ ID NO: 5975653 - DNA, 15 bp, Homo sapiens
ccacagcccccaccc

SEQ ID NO: 5975654 - DNA, 16 bp, Homo sapiens
ccacagcccccacccc

SEQ ID NO: 5975655 - DNA, 19 bp, Homo sapiens
ccacagcccccaccccagc

SEQ ID NO: 5975656 - DNA, 16 bp, Homo sapiens
ccacagcccccttgcc

SEQ ID NO: 5975657 - DNA, 14 bp, Homo sapiens
ccacagcccctggc

SEQ ID NO: 5975658 - DNA, 17 bp, Homo sapiens
ccacagcccctggcact

SEQ ID NO: 5975659 - DNA, 11 bp, Homo sapiens
ccacagcccta

SEQ ID NO: 5975660 - DNA, 14 bp, Homo sapiens
ccacagccctgaaa

SEQ ID NO: 5975661 - DNA, 13 bp, Homo sapiens
ccacagccctgag

SEQ ID NO: 5975662 - DNA, 14 bp, Homo sapiens
ccacagccctgaga

SEQ ID NO: 5975663 - DNA, 12 bp, Homo sapiens
ccacagccctgt

SEQ ID NO: 5975664 - DNA, 17 bp, Homo sapiens
ccacagccctgtcagca

SEQ ID NO: 5975665 - DNA, 21 bp, Homo sapiens
ccacagccctgtcagtgcagc

SEQ ID NO: 5975666 - DNA, 18 bp, Homo sapiens
ccacagccgcagcctccc

SEQ ID NO: 5975667 - DNA, 16 bp, Homo sapiens
ccacagcctccccacc

SEQ ID NO: 5975668 - DNA, 16 bp, Homo sapiens
ccacagcctcccctgc

SEQ ID NO: 5975669 - DNA, 20 bp, Homo sapiens
ccacagcctcccctgccagg

SEQ ID NO: 5975670 - DNA, 15 bp, Homo sapiens
ccacagcctcccctt

SEQ ID NO: 5975671 - DNA, 17 bp, Homo sapiens
ccacagcctctgcctgt

SEQ ID NO: 5975672 - DNA, 17 bp, Homo sapiens
ccacagcctctggctcc

SEQ ID NO: 5975673 - DNA, 17 bp, Homo sapiens
ccacagcctgctggcag

SEQ ID NO: 5975674 - DNA, 14 bp, Homo sapiens
ccacagcctgtctt

SEQ ID NO: 5975675 - DNA, 11 bp, Homo sapiens
ccacagccttc

SEQ ID NO: 5975676 - DNA, 13 bp, Homo sapiens
ccacagccttccc

SEQ ID NO: 5975677 - DNA, 17 bp, Homo sapiens
ccacagccttccctctg

SEQ ID NO: 5975678 - DNA, 23 bp, Homo sapiens
ccacagccttgcagcggctcctg

SEQ ID NO: 5975679 - DNA, 15 bp, Homo sapiens
ccacagcgagcctgt

SEQ ID NO: 5975680 - DNA, 20 bp, Homo sapiens
ccacagcgagggcagctgct

SEQ ID NO: 5975681 - DNA, 23 bp, Homo sapiens
ccacagcgccagcctcagactgg

SEQ ID NO: 5975682 - DNA, 23 bp, Homo sapiens
ccacagcgctggccgggaccccg

SEQ ID NO: 5975683 - DNA, 21 bp, Homo sapiens
ccacagcggaggagaccagct

SEQ ID NO: 5975684 - DNA, 12 bp, Homo sapiens
ccacagcgtccc

SEQ ID NO: 5975685 - DNA, 15 bp, Homo sapiens
ccacagcgtccctgg

SEQ ID NO: 5975686 - DNA, 17 bp, Homo sapiens
ccacagcgtccctggcg

SEQ ID NO: 5975687 - DNA, 17 bp, Homo sapiens
ccacagcgtgggaactc

SEQ ID NO: 5975688 - DNA, 11 bp, Homo sapiens
ccacagctacc

SEQ ID NO: 5975689 - DNA, 21 bp, Homo sapiens
ccacagctatttagaagcatc

SEQ ID NO: 5975690 - DNA, 15 bp, Homo sapiens
ccacagctcagctgc

SEQ ID NO: 5975691 - DNA, 18 bp, Homo sapiens
ccacagctcagctgccca

SEQ ID NO: 5975692 - DNA, 13 bp, Homo sapiens
ccacagctcccac

SEQ ID NO: 5975693 - DNA, 17 bp, Homo sapiens
ccacagctcccacccca

SEQ ID NO: 5975694 - DNA, 16 bp, Homo sapiens
ccacagctccttttcc

SEQ ID NO: 5975695 - DNA, 12 bp, Homo sapiens
ccacagctctgc

SEQ ID NO: 5975696 - DNA, 14 bp, Homo sapiens
ccacagctctgctg

SEQ ID NO: 5975697 - DNA, 18 bp, Homo sapiens
ccacagctctgctggaag

SEQ ID NO: 5975698 - DNA, 15 bp, Homo sapiens
ccacagctctgggcc

SEQ ID NO: 5975699 - DNA, 13 bp, Homo sapiens
ccacagctgcagc

SEQ ID NO: 5975700 - DNA, 14 bp, Homo sapiens
ccacagctgcagct

SEQ ID NO: 5975701 - DNA, 18 bp, Homo sapiens
ccacagctgcctccgggc

SEQ ID NO: 5975702 - DNA, 14 bp, Homo sapiens
ccacagctgcctct

SEQ ID NO: 5975703 - DNA, 14 bp, Homo sapiens
ccacagctgctcaa

SEQ ID NO: 5975704 - DNA, 14 bp, Homo sapiens
ccacagctgctgga

SEQ ID NO: 5975705 - DNA, 23 bp, Homo sapiens
ccacagctgctggccagggtaga

SEQ ID NO: 5975706 - DNA, 19 bp, Homo sapiens
ccacagctgctgttctcag

SEQ ID NO: 5975707 - DNA, 21 bp, Homo sapiens
ccacagctgctgttctcagga

SEQ ID NO: 5975708 - DNA, 19 bp, Homo sapiens
ccacagctggcctggtttc

SEQ ID NO: 5975709 - DNA, 13 bp, Homo sapiens
ccacagctgggca

SEQ ID NO: 5975710 - DNA, 14 bp, Homo sapiens
ccacagctgggcag

SEQ ID NO: 5975711 - DNA, 19 bp, Homo sapiens
ccacagctgggcagggtga

SEQ ID NO: 5975712 - DNA, 11 bp, Homo sapiens
ccacagcttcc

SEQ ID NO: 5975713 - DNA, 17 bp, Homo sapiens
ccacagcttcccctctc

SEQ ID NO: 5975714 - DNA, 12 bp, Homo sapiens
ccacagcttcct

SEQ ID NO: 5975715 - DNA, 14 bp, Homo sapiens
ccacagcttcctgt

SEQ ID NO: 5975716 - DNA, 22 bp, Homo sapiens
ccacagctttgcacccctttcc

SEQ ID NO: 5975717 - DNA, 20 bp, Homo sapiens
ccacaggaacaacagcatct

SEQ ID NO: 5975718 - DNA, 15 bp, Homo sapiens
ccacaggaacggccc

SEQ ID NO: 5975719 - DNA, 19 bp, Homo sapiens
ccacaggaagcctgcagtc

SEQ ID NO: 5975720 - DNA, 22 bp, Homo sapiens
ccacaggaagcctgcagtcctg

SEQ ID NO: 5975721 - DNA, 17 bp, Homo sapiens
ccacaggaagtgaagaa

SEQ ID NO: 5975722 - DNA, 18 bp, Homo sapiens
ccacaggacacgaaggct

SEQ ID NO: 5975723 - DNA, 21 bp, Homo sapiens
ccacaggacatttctctaaga

SEQ ID NO: 5975724 - DNA, 16 bp, Homo sapiens
ccacaggaccacctcc

SEQ ID NO: 5975725 - DNA, 17 bp, Homo sapiens
ccacaggaccctcgccg

SEQ ID NO: 5975726 - DNA, 15 bp, Homo sapiens
ccacaggacgaatgc

SEQ ID NO: 5975727 - DNA, 18 bp, Homo sapiens
ccacaggagcatgtccta

SEQ ID NO: 5975728 - DNA, 15 bp, Homo sapiens
ccacaggagccctgc

SEQ ID NO: 5975729 - DNA, 16 bp, Homo sapiens
ccacaggagccctgct

SEQ ID NO: 5975730 - DNA, 21 bp, Homo sapiens
ccacaggagccctgctatgaa

SEQ ID NO: 5975731 - DNA, 20 bp, Homo sapiens
ccacaggagccgcagaggcc

SEQ ID NO: 5975732 - DNA, 22 bp, Homo sapiens
ccacaggagccgcagaggcccg

SEQ ID NO: 5975733 - DNA, 20 bp, Homo sapiens
ccacaggagcgtgtcctatc

SEQ ID NO: 5975734 - DNA, 22 bp, Homo sapiens
ccacaggagcgtgtcctatccc

SEQ ID NO: 5975735 - DNA, 21 bp, Homo sapiens
ccacaggaggcaagcaagctc

SEQ ID NO: 5975736 - DNA, 22 bp, Homo sapiens
ccacaggaggcaagcaagctct

SEQ ID NO: 5975737 - DNA, 14 bp, Homo sapiens
ccacccctacacac

SEQ ID NO: 5975738 - DNA, 16 bp, Homo sapiens
ccacccctacacacac

SEQ ID NO: 5975739 - DNA, 20 bp, Homo sapiens
ccacccctaccgatggtccc

SEQ ID NO: 5975740 - DNA, 11 bp, Homo sapiens
ccacccctcac

SEQ ID NO: 5975741 - DNA, 14 bp, Homo sapiens
ccacccctcactcc

SEQ ID NO: 5975742 - DNA, 23 bp, Homo sapiens
ccacccctcactccccagggagc

SEQ ID NO: 5975743 - DNA, 16 bp, Homo sapiens
ccacccctcatcagga

SEQ ID NO: 5975744 - DNA, 12 bp, Homo sapiens
ccacccctccac

SEQ ID NO: 5975745 - DNA, 13 bp, Homo sapiens
ccacccctccacg

SEQ ID NO: 5975746 - DNA, 21 bp, Homo sapiens
ccacccctccacgtgtccgtc

SEQ ID NO: 5975747 - DNA, 14 bp, Homo sapiens
ccacccctccccac

SEQ ID NO: 5975748 - DNA, 19 bp, Homo sapiens
ccacccctccccacccacc

SEQ ID NO: 5975749 - DNA, 14 bp, Homo sapiens
ccacccctcctggg

SEQ ID NO: 5975750 - DNA, 16 bp, Homo sapiens
ccacccctccttcctt

SEQ ID NO: 5975751 - DNA, 13 bp, Homo sapiens
ccacccctcttcc

SEQ ID NO: 5975752 - DNA, 15 bp, Homo sapiens
ccacccctgccactc

SEQ ID NO: 5975753 - DNA, 15 bp, Homo sapiens
ccacccctgcccagg

SEQ ID NO: 5975754 - DNA, 22 bp, Homo sapiens
ccacccctgcccccagccccgg

SEQ ID NO: 5975755 - DNA, 14 bp, Homo sapiens
ccacccctgcctcc

SEQ ID NO: 5975756 - DNA, 18 bp, Homo sapiens
ccacccctgcctccaccc

SEQ ID NO: 5975757 - DNA, 18 bp, Homo sapiens
ccacccctgcctttgttt

SEQ ID NO: 5975758 - DNA, 13 bp, Homo sapiens
ccacccctgctgc

SEQ ID NO: 5975759 - DNA, 14 bp, Homo sapiens
ccacccctggaaga

SEQ ID NO: 5975760 - DNA, 21 bp, Homo sapiens
ccacccctggaagagcccagt

SEQ ID NO: 5975761 - DNA, 13 bp, Homo sapiens
ccacccctgtgct

SEQ ID NO: 5975762 - DNA, 23 bp, Homo sapiens
ccaccccttagattgaagtaaac

SEQ ID NO: 5975763 - DNA, 15 bp, Homo sapiens
ccaccccttccccac

SEQ ID NO: 5975764 - DNA, 16 bp, Homo sapiens
ccaccccttccccagg

SEQ ID NO: 5975765 - DNA, 22 bp, Homo sapiens
ccaccccttccccaggcccacc

SEQ ID NO: 5975766 - DNA, 15 bp, Homo sapiens
ccaccccttcctcag

SEQ ID NO: 5975767 - DNA, 16 bp, Homo sapiens
ccaccccttcctcagc

SEQ ID NO: 5975768 - DNA, 23 bp, Homo sapiens
ccaccccttcctcagcctggggt

SEQ ID NO: 5975769 - DNA, 14 bp, Homo sapiens
ccaccccttcctgt

SEQ ID NO: 5975770 - DNA, 12 bp, Homo sapiens
ccaccccttgct

SEQ ID NO: 5975771 - DNA, 19 bp, Homo sapiens
ccaccccttggaggagaga

SEQ ID NO: 5975772 - DNA, 23 bp, Homo sapiens
ccaccccttggaggagagagacc

SEQ ID NO: 5975773 - DNA, 16 bp, Homo sapiens
ccaccccttggcactg

SEQ ID NO: 5975774 - DNA, 18 bp, Homo sapiens
ccaccccttggcactgtg

SEQ ID NO: 5975775 - DNA, 17 bp, Homo sapiens
ccacccgacctggctgc

SEQ ID NO: 5975776 - DNA, 21 bp, Homo sapiens
ccacccgacctggctgcccct

SEQ ID NO: 5975777 - DNA, 13 bp, Homo sapiens
ccacccgccccag

SEQ ID NO: 5975778 - DNA, 19 bp, Homo sapiens
ccacccgccccagagactg

SEQ ID NO: 5975779 - DNA, 22 bp, Homo sapiens
ccacccgccccagagactgccc

SEQ ID NO: 5975780 - DNA, 16 bp, Homo sapiens
ccacccgcccctgccc

SEQ ID NO: 5975781 - DNA, 12 bp, Homo sapiens
ccacccgcccga

SEQ ID NO: 5975782 - DNA, 15 bp, Homo sapiens
ccacccgcccgaggg

SEQ ID NO: 5975783 - DNA, 12 bp, Homo sapiens
ccacccgcccgc

SEQ ID NO: 5975784 - DNA, 15 bp, Homo sapiens
ccacccgcctgcaga

SEQ ID NO: 5975785 - DNA, 20 bp, Homo sapiens
ccacccgccttggcctccca

SEQ ID NO: 5975786 - DNA, 14 bp, Homo sapiens
ccacccgccttgtg

SEQ ID NO: 5975787 - DNA, 17 bp, Homo sapiens
ccacccgccttgtgaga

SEQ ID NO: 5975788 - DNA, 18 bp, Homo sapiens
ccacccgccttgtgagat

SEQ ID NO: 5975789 - DNA, 14 bp, Homo sapiens
ccacccgctgcccc

SEQ ID NO: 5975790 - DNA, 17 bp, Homo sapiens
ccacccggacaggtggg

SEQ ID NO: 5975791 - DNA, 22 bp, Homo sapiens
ccacccggatctccaggcccag

SEQ ID NO: 5975792 - DNA, 14 bp, Homo sapiens
ccacccggccacag

SEQ ID NO: 5975793 - DNA, 18 bp, Homo sapiens
ccacccggccacagctgc

SEQ ID NO: 5975794 - DNA, 19 bp, Homo sapiens
ccacccggccacagctgct

SEQ ID NO: 5975795 - DNA, 21 bp, Homo sapiens
ccacccggcccatatccctgg

SEQ ID NO: 5975796 - DNA, 16 bp, Homo sapiens
ccacccgggagcagtg

SEQ ID NO: 5975797 - DNA, 14 bp, Homo sapiens
ccacccgggctgcc

SEQ ID NO: 5975798 - DNA, 20 bp, Homo sapiens
ccacccgggggagcccagtg

SEQ ID NO: 5975799 - DNA, 21 bp, Homo sapiens
ccacccggtggttcttcctgt

SEQ ID NO: 5975800 - DNA, 16 bp, Homo sapiens
ccacccgtaggcagcc

SEQ ID NO: 5975801 - DNA, 19 bp, Homo sapiens
ccacccgtaggcagcctct

SEQ ID NO: 5975802 - DNA, 14 bp, Homo sapiens
ccacccgtcctccc

SEQ ID NO: 5975803 - DNA, 18 bp, Homo sapiens
ccacccgtcctccctcag

SEQ ID NO: 5975804 - DNA, 21 bp, Homo sapiens
ccacccgtcctccctcagcct

SEQ ID NO: 5975805 - DNA, 15 bp, Homo sapiens
ccacccgtcttcaat

SEQ ID NO: 5975806 - DNA, 15 bp, Homo sapiens
ccacccgtggagatg

SEQ ID NO: 5975807 - DNA, 21 bp, Homo sapiens
ccacccgtggggtgctgccct

SEQ ID NO: 5975808 - DNA, 19 bp, Homo sapiens
ccacccgtggtggctcaag

SEQ ID NO: 5975809 - DNA, 15 bp, Homo sapiens
ccacccgtgttctcc

SEQ ID NO: 5975810 - DNA, 19 bp, Homo sapiens
ccacccgttctgctggcct

SEQ ID NO: 5975811 - DNA, 20 bp, Homo sapiens
ccacccgtttccaagcctgg

SEQ ID NO: 5975812 - DNA, 23 bp, Homo sapiens
ccacccgtttccaagcctgggcc

SEQ ID NO: 5975813 - DNA, 18 bp, Homo sapiens
ccaccctaactgagctgc

SEQ ID NO: 5975814 - DNA, 14 bp, Homo sapiens
ccaccctaccagct

SEQ ID NO: 5975815 - DNA, 12 bp, Homo sapiens
ccaccctacccc

SEQ ID NO: 5975816 - DNA, 22 bp, Homo sapiens
ccaccctacgctcatctctgga

SEQ ID NO: 5975817 - DNA, 17 bp, Homo sapiens
ccaccctactccctcca

SEQ ID NO: 5975818 - DNA, 16 bp, Homo sapiens
ccaccctagcctccac

SEQ ID NO: 5975819 - DNA, 18 bp, Homo sapiens
ccaccctagcctccacca

SEQ ID NO: 5975820 - DNA, 16 bp, Homo sapiens
ccaccctatggccact

SEQ ID NO: 5975821 - DNA, 22 bp, Homo sapiens
ccaccctcaaatgtcagagcta

SEQ ID NO: 5975822 - DNA, 23 bp, Homo sapiens
ccaccctcaccgcggctggatgg

SEQ ID NO: 5975823 - DNA, 13 bp, Homo sapiens
ccaccctcagcac

SEQ ID NO: 5975824 - DNA, 16 bp, Homo sapiens
ccaccctcaggtgcct

SEQ ID NO: 5975825 - DNA, 17 bp, Homo sapiens
ccaccctcaggtgcctc

SEQ ID NO: 5975826 - DNA, 18 bp, Homo sapiens
ccaccctcaggtgcctcc

SEQ ID NO: 5975827 - DNA, 16 bp, Homo sapiens
ccaccctccacctctc

SEQ ID NO: 5975828 - DNA, 18 bp, Homo sapiens
ccaccctccacgaggtgt

SEQ ID NO: 5975829 - DNA, 15 bp, Homo sapiens
ccaccctcccagctc

SEQ ID NO: 5975830 - DNA, 12 bp, Homo sapiens
ccaccctcccat

SEQ ID NO: 5975831 - DNA, 12 bp, Homo sapiens
ccaccctcccct

SEQ ID NO: 5975832 - DNA, 15 bp, Homo sapiens
ccaccctcccctctc

SEQ ID NO: 5975833 - DNA, 18 bp, Homo sapiens
ccaccctcccctctcctg

SEQ ID NO: 5975834 - DNA, 17 bp, Homo sapiens
ccaccctccctggagtg

SEQ ID NO: 5975835 - DNA, 14 bp, Homo sapiens
ccaccctcctcctc

SEQ ID NO: 5975836 - DNA, 12 bp, Homo sapiens
ccaccctcctct

SEQ ID NO: 5975837 - DNA, 15 bp, Homo sapiens
ccaccctcctctagc

SEQ ID NO: 5975838 - DNA, 16 bp, Homo sapiens
ccaccctcctgcccca

SEQ ID NO: 5975839 - DNA, 13 bp, Homo sapiens
ccaccctcctggc

SEQ ID NO: 5975840 - DNA, 17 bp, Homo sapiens
ccaccctcctggcctca

SEQ ID NO: 5975841 - DNA, 12 bp, Homo sapiens
ccaccctcctgt

SEQ ID NO: 5975842 - DNA, 18 bp, Homo sapiens
ccaccctccttgagactg

SEQ ID NO: 5975843 - DNA, 14 bp, Homo sapiens
ccaccctcctttca

SEQ ID NO: 5975844 - DNA, 20 bp, Homo sapiens
ccaccctcggggatgtgtcc

SEQ ID NO: 5975845 - DNA, 17 bp, Homo sapiens
ccaccctcgtggacacc

SEQ ID NO: 5975846 - DNA, 19 bp, Homo sapiens
ccaccctcgtggacacctg

SEQ ID NO: 5975847 - DNA, 20 bp, Homo sapiens
ccaccctcgtggacacctgc

SEQ ID NO: 5975848 - DNA, 21 bp, Homo sapiens
ccaccctcgtggacacctgcc

SEQ ID NO: 5975849 - DNA, 18 bp, Homo sapiens
ccaccctctccacaccca

SEQ ID NO: 5975850 - DNA, 11 bp, Homo sapiens
ccaccctctgc

SEQ ID NO: 5975851 - DNA, 18 bp, Homo sapiens
ccaccctctgcagggcag

SEQ ID NO: 5975852 - DNA, 12 bp, Homo sapiens
ccaccctctgcc

SEQ ID NO: 5975853 - DNA, 14 bp, Homo sapiens
ccaccctctgggga

SEQ ID NO: 5975854 - DNA, 19 bp, Homo sapiens
ccaccctctggggacagga

SEQ ID NO: 5975855 - DNA, 18 bp, Homo sapiens
ccaccctgaaagccctga

SEQ ID NO: 5975856 - DNA, 13 bp, Homo sapiens
ccaccctgagccg

SEQ ID NO: 5975857 - DNA, 15 bp, Homo sapiens
ccaccctgagccggc

SEQ ID NO: 5975858 - DNA, 21 bp, Homo sapiens
ccaccctgagccggccccagg

SEQ ID NO: 5975859 - DNA, 13 bp, Homo sapiens
ccaccctgagcct

SEQ ID NO: 5975860 - DNA, 17 bp, Homo sapiens
ccaccctgagcctgacc

SEQ ID NO: 5975861 - DNA, 11 bp, Homo sapiens
ccaccctgagg

SEQ ID NO: 5975862 - DNA, 16 bp, Homo sapiens
ccaccctgcagccagg

SEQ ID NO: 5975863 - DNA, 14 bp, Homo sapiens
ccaccctgcaggct

SEQ ID NO: 5975864 - DNA, 24 bp, Homo sapiens
ccaccctgcattttcctcttgtcc

SEQ ID NO: 5975865 - DNA, 12 bp, Homo sapiens
ccaccctgccaa

SEQ ID NO: 5975866 - DNA, 16 bp, Homo sapiens
ccaccctgccaaggca

SEQ ID NO: 5975867 - DNA, 14 bp, Homo sapiens
ccaccctgcccact

SEQ ID NO: 5975868 - DNA, 15 bp, Homo sapiens
ccaccctgcccactc

SEQ ID NO: 5975869 - DNA, 18 bp, Homo sapiens
ccaccctgcccactccca

SEQ ID NO: 5975870 - DNA, 15 bp, Homo sapiens
ccaccctgccctgct

SEQ ID NO: 5975871 - DNA, 22 bp, Homo sapiens
ccaccctgccctgctgagcaca

SEQ ID NO: 5975872 - DNA, 15 bp, Homo sapiens
ccaccctgcctgtgg

SEQ ID NO: 5975873 - DNA, 11 bp, Homo sapiens
ccaccctgctc

SEQ ID NO: 5975874 - DNA, 20 bp, Homo sapiens
ccaccctgctcatccactct

SEQ ID NO: 5975875 - DNA, 22 bp, Homo sapiens
ccaccctgctcctcctgccctg

SEQ ID NO: 5975876 - DNA, 16 bp, Homo sapiens
ccaccctgctgccttc

SEQ ID NO: 5975877 - DNA, 13 bp, Homo sapiens
ccaccctgctgct

SEQ ID NO: 5975878 - DNA, 14 bp, Homo sapiens
ccaccctgctgctg

SEQ ID NO: 5975879 - DNA, 16 bp, Homo sapiens
ccaccctgcttctgct

SEQ ID NO: 5975880 - DNA, 22 bp, Homo sapiens
ccaccctgcttctgctgcctgt

SEQ ID NO: 5975881 - DNA, 18 bp, Homo sapiens
ccaccctgcttggcccag

SEQ ID NO: 5975882 - DNA, 20 bp, Homo sapiens
ccaccctgcttggcccaggg

SEQ ID NO: 5975883 - DNA, 12 bp, Homo sapiens
ccaccctggaga

SEQ ID NO: 5975884 - DNA, 15 bp, Homo sapiens
ccaccctggcccgcc

SEQ ID NO: 5975885 - DNA, 21 bp, Homo sapiens
ccaccctggccgagtccaagc

SEQ ID NO: 5975886 - DNA, 13 bp, Homo sapiens
ccaccctggctgg

SEQ ID NO: 5975887 - DNA, 12 bp, Homo sapiens
ccaccctgggac

SEQ ID NO: 5975888 - DNA, 17 bp, Homo sapiens
ccaccctgggccctggg

SEQ ID NO: 5975889 - DNA, 20 bp, Homo sapiens
ccaccctgggccctgggctg

SEQ ID NO: 5975890 - DNA, 13 bp, Homo sapiens
ccaccctgggcct

SEQ ID NO: 5975891 - DNA, 12 bp, Homo sapiens
ccaccctgggct

SEQ ID NO: 5975892 - DNA, 23 bp, Homo sapiens
ccaccctgggctccacacagcag

SEQ ID NO: 5975893 - DNA, 16 bp, Homo sapiens
ccaccctgggctctgg

SEQ ID NO: 5975894 - DNA, 17 bp, Homo sapiens
ccaccctgggctctgtg

SEQ ID NO: 5975895 - DNA, 23 bp, Homo sapiens
ccaccctgggctctgtgggctgc

SEQ ID NO: 5975896 - DNA, 21 bp, Homo sapiens
ccaccctgggtttggcccctg

SEQ ID NO: 5975897 - DNA, 16 bp, Homo sapiens
ccaccctgtcccaggc

SEQ ID NO: 5975898 - DNA, 21 bp, Homo sapiens
ccaccctgtcccccagctctg

SEQ ID NO: 5975899 - DNA, 22 bp, Homo sapiens
ccaccctgtcccccagctctgg

SEQ ID NO: 5975900 - DNA, 16 bp, Homo sapiens
ccaccctgtcctatga

SEQ ID NO: 5975901 - DNA, 19 bp, Homo sapiens
ccaccctgtcctatgactt

SEQ ID NO: 5975902 - DNA, 11 bp, Homo sapiens
ccaccctgtct

SEQ ID NO: 5975903 - DNA, 13 bp, Homo sapiens
ccaccctgtgcca

SEQ ID NO: 5975904 - DNA, 15 bp, Homo sapiens
ccaccctgttagttt

SEQ ID NO: 5975905 - DNA, 19 bp, Homo sapiens
ccaccctgttcctgctgct

SEQ ID NO: 5975906 - DNA, 20 bp, Homo sapiens
ccacccttcacgctggcttc

SEQ ID NO: 5975907 - DNA, 11 bp, Homo sapiens
ccacccttcca

SEQ ID NO: 5975908 - DNA, 18 bp, Homo sapiens
ccacccttccctgcctcc

SEQ ID NO: 5975909 - DNA, 20 bp, Homo sapiens
ccacccttccctgcctccag

SEQ ID NO: 5975910 - DNA, 12 bp, Homo sapiens
ccacccttggcc

SEQ ID NO: 5975911 - DNA, 14 bp, Homo sapiens
ccacccttggcctg

SEQ ID NO: 5975912 - DNA, 16 bp, Homo sapiens
ccacccttggcctgtc

SEQ ID NO: 5975913 - DNA, 17 bp, Homo sapiens
ccacccttggcctgtct

SEQ ID NO: 5975914 - DNA, 19 bp, Homo sapiens
ccacccttggcctgtctca

SEQ ID NO: 5975915 - DNA, 21 bp, Homo sapiens
ccaccctttcatagagaggcc

SEQ ID NO: 5975916 - DNA, 12 bp, Homo sapiens
ccaccctttcta

SEQ ID NO: 5975917 - DNA, 16 bp, Homo sapiens
ccaccctttctgccag

SEQ ID NO: 5975918 - DNA, 19 bp, Homo sapiens
ctccttgagtgtatgagta

SEQ ID NO: 5975919 - DNA, 17 bp, Homo sapiens
ctccttgataacagcta

SEQ ID NO: 5975920 - DNA, 22 bp, Homo sapiens
ctccttgatatttgtatttatt

SEQ ID NO: 5975921 - DNA, 21 bp, Homo sapiens
ctccttgcaaactatgagttc

SEQ ID NO: 5975922 - DNA, 15 bp, Homo sapiens
ctccttgcagcaggg

SEQ ID NO: 5975923 - DNA, 12 bp, Homo sapiens
ctccttgcagtt

SEQ ID NO: 5975924 - DNA, 13 bp, Homo sapiens
ctccttgcagttc

SEQ ID NO: 5975925 - DNA, 12 bp, Homo sapiens
ctccttgccacc

SEQ ID NO: 5975926 - DNA, 16 bp, Homo sapiens
ctccttgccacccccc

SEQ ID NO: 5975927 - DNA, 13 bp, Homo sapiens
ctccttgccccag

SEQ ID NO: 5975928 - DNA, 20 bp, Homo sapiens
ctccttgccccccgccctca

SEQ ID NO: 5975929 - DNA, 21 bp, Homo sapiens
ctccttgccccccgccctcat

SEQ ID NO: 5975930 - DNA, 22 bp, Homo sapiens
ctccttgccccccgccctcatg

SEQ ID NO: 5975931 - DNA, 18 bp, Homo sapiens
ctccttgccgctgggaga

SEQ ID NO: 5975932 - DNA, 19 bp, Homo sapiens
ctccttgccgctgggagag

SEQ ID NO: 5975933 - DNA, 20 bp, Homo sapiens
ctccttgccgctgggagagc

SEQ ID NO: 5975934 - DNA, 20 bp, Homo sapiens
ctccttgccttgcttctccc

SEQ ID NO: 5975935 - DNA, 23 bp, Homo sapiens
ctccttgccttgcttctcccatt

SEQ ID NO: 5975936 - DNA, 14 bp, Homo sapiens
ctccttgctgaccc

SEQ ID NO: 5975937 - DNA, 13 bp, Homo sapiens
ctccttgctgatt

SEQ ID NO: 5975938 - DNA, 17 bp, Homo sapiens
ctccttgcttgttacat

SEQ ID NO: 5975939 - DNA, 13 bp, Homo sapiens
ctccttggaaggt

SEQ ID NO: 5975940 - DNA, 12 bp, Homo sapiens
ctccttggagga

SEQ ID NO: 5975941 - DNA, 18 bp, Homo sapiens
ctccttggcacccccatg

SEQ ID NO: 5975942 - DNA, 10 bp, Homo sapiens
ctccttggcc

SEQ ID NO: 5975943 - DNA, 12 bp, Homo sapiens
ctccttggccta

SEQ ID NO: 5975944 - DNA, 22 bp, Homo sapiens
ctccttggcggcaaaagcccat

SEQ ID NO: 5975945 - DNA, 19 bp, Homo sapiens
ctccttggctgcagccatc

SEQ ID NO: 5975946 - DNA, 21 bp, Homo sapiens
ctccttggctgcagccatccc

SEQ ID NO: 5975947 - DNA, 16 bp, Homo sapiens
ctccttggctgtctgt

SEQ ID NO: 5975948 - DNA, 13 bp, Homo sapiens
ctccttggcttac

SEQ ID NO: 5975949 - DNA, 19 bp, Homo sapiens
ctccttggcttacctgacc

SEQ ID NO: 5975950 - DNA, 17 bp, Homo sapiens
ctccttggctttatgca

SEQ ID NO: 5975951 - DNA, 20 bp, Homo sapiens
ctccttggctttatgcaaat

SEQ ID NO: 5975952 - DNA, 21 bp, Homo sapiens
ctccttggctttatgcaaata

SEQ ID NO: 5975953 - DNA, 18 bp, Homo sapiens
ctccttgggaggaagcag

SEQ ID NO: 5975954 - DNA, 19 bp, Homo sapiens
ctccttgggaggaagcaga

SEQ ID NO: 5975955 - DNA, 21 bp, Homo sapiens
ctccttgggaggaagcagaat

SEQ ID NO: 5975956 - DNA, 13 bp, Homo sapiens
ctccttgggaggc

SEQ ID NO: 5975957 - DNA, 21 bp, Homo sapiens
ctccttgggcactttttaatt

SEQ ID NO: 5975958 - DNA, 20 bp, Homo sapiens
ctccttgggcagggtctctg

SEQ ID NO: 5975959 - DNA, 16 bp, Homo sapiens
ctccttgggccctttg

SEQ ID NO: 5975960 - DNA, 15 bp, Homo sapiens
ctccttgggctcctg

SEQ ID NO: 5975961 - DNA, 16 bp, Homo sapiens
ctccttgggctcctgg

SEQ ID NO: 5975962 - DNA, 20 bp, Homo sapiens
ctccttgggctcctggctgc

SEQ ID NO: 5975963 - DNA, 16 bp, Homo sapiens
ctccttgggctgggac

SEQ ID NO: 5975964 - DNA, 15 bp, Homo sapiens
ctccttggtgcctgg

SEQ ID NO: 5975965 - DNA, 12 bp, Homo sapiens
ctccttggtgct

SEQ ID NO: 5975966 - DNA, 17 bp, Homo sapiens
ctccttggttatatttt

SEQ ID NO: 5975967 - DNA, 21 bp, Homo sapiens
ctccttggttcttgaggggac

SEQ ID NO: 5975968 - DNA, 17 bp, Homo sapiens
ctccttggtttctccct

SEQ ID NO: 5975969 - DNA, 16 bp, Homo sapiens
ctccttggttttgcct

SEQ ID NO: 5975970 - DNA, 20 bp, Homo sapiens
ctccttggttttgcctcttt

SEQ ID NO: 5975971 - DNA, 23 bp, Homo sapiens
ctccttggttttgcctctttaaa

SEQ ID NO: 5975972 - DNA, 16 bp, Homo sapiens
ctccttgtaaagactg

SEQ ID NO: 5975973 - DNA, 13 bp, Homo sapiens
ctccttgtacttg

SEQ ID NO: 5975974 - DNA, 14 bp, Homo sapiens
ctccttgtacttga

SEQ ID NO: 5975975 - DNA, 21 bp, Homo sapiens
ctccttgtcaacaaagtgctt

SEQ ID NO: 5975976 - DNA, 22 bp, Homo sapiens
ctccttgtcaacaaagtgcttt

SEQ ID NO: 5975977 - DNA, 15 bp, Homo sapiens
ctccttgtcactgaa

SEQ ID NO: 5975978 - DNA, 17 bp, Homo sapiens
ctccttgtccaggtctc

SEQ ID NO: 5975979 - DNA, 16 bp, Homo sapiens
ctccttgtgctgccag

SEQ ID NO: 5975980 - DNA, 14 bp, Homo sapiens
ctccttgtggccta

SEQ ID NO: 5975981 - DNA, 18 bp, Homo sapiens
ctccttgtggcctatgaa

SEQ ID NO: 5975982 - DNA, 16 bp, Homo sapiens
ctccttgtggcctggg

SEQ ID NO: 5975983 - DNA, 18 bp, Homo sapiens
ctccttgtggcctgggcc

SEQ ID NO: 5975984 - DNA, 20 bp, Homo sapiens
ctccttgtggcctgggcctc

SEQ ID NO: 5975985 - DNA, 16 bp, Homo sapiens
ctccttgtgggcctgg

SEQ ID NO: 5975986 - DNA, 18 bp, Homo sapiens
ctccttgtgggcctgggc

SEQ ID NO: 5975987 - DNA, 21 bp, Homo sapiens
ctccttgtgggcctgggctcc

SEQ ID NO: 5975988 - DNA, 15 bp, Homo sapiens
ctccttgttctgctc

SEQ ID NO: 5975989 - DNA, 16 bp, Homo sapiens
ctccttgttctgctct

SEQ ID NO: 5975990 - DNA, 23 bp, Homo sapiens
ctccttgtttgcctttaggcagg

SEQ ID NO: 5975991 - DNA, 17 bp, Homo sapiens
ctcctttaagagctctg

SEQ ID NO: 5975992 - DNA, 22 bp, Homo sapiens
ctcctttaatgacattgatttc

SEQ ID NO: 5975993 - DNA, 17 bp, Homo sapiens
ctcctttaccctcatct

SEQ ID NO: 5975994 - DNA, 21 bp, Homo sapiens
ctcctttaccctcatctgtct

SEQ ID NO: 5975995 - DNA, 14 bp, Homo sapiens
ctcctttaccctct

SEQ ID NO: 5975996 - DNA, 16 bp, Homo sapiens
ctcctttaccctcttg

SEQ ID NO: 5975997 - DNA, 17 bp, Homo sapiens
ctcctttaccgaggaca

SEQ ID NO: 5975998 - DNA, 19 bp, Homo sapiens
ctcctttaccgaggacagc

SEQ ID NO: 5975999 - DNA, 16 bp, Homo sapiens
ctcctttagcgcccag

SEQ ID NO: 5976000 - DNA, 13 bp, Homo sapiens
ctcctttcacaac

SEQ ID NO: 5976001 - DNA, 20 bp, Homo sapiens
ctcctttcacaaccttctgt

SEQ ID NO: 5976002 - DNA, 15 bp, Homo sapiens
ctcctttcaccacat

SEQ ID NO: 5976003 - DNA, 19 bp, Homo sapiens
ctcctttcaccccagggcc

SEQ ID NO: 5976004 - DNA, 15 bp, Homo sapiens
ctcctttcagccaca

SEQ ID NO: 5976005 - DNA, 14 bp, Homo sapiens
ctcctttcccacag

SEQ ID NO: 5976006 - DNA, 17 bp, Homo sapiens
ctcctttcccctctcat

SEQ ID NO: 5976007 - DNA, 23 bp, Homo sapiens
ctcctttcccctttctctttcct

SEQ ID NO: 5976008 - DNA, 20 bp, Homo sapiens
ctcctttcccttattgcctc

SEQ ID NO: 5976009 - DNA, 21 bp, Homo sapiens
ctcctttcccttattgcctcc

SEQ ID NO: 5976010 - DNA, 12 bp, Homo sapiens
ctcctttccttc

SEQ ID NO: 5976011 - DNA, 14 bp, Homo sapiens
ctcctttccttccc

SEQ ID NO: 5976012 - DNA, 17 bp, Homo sapiens
ctcctttccttcccagg

SEQ ID NO: 5976013 - DNA, 18 bp, Homo sapiens
ctcctttccttcccaggc

SEQ ID NO: 5976014 - DNA, 19 bp, Homo sapiens
ctcctttccttcccaggcc

SEQ ID NO: 5976015 - DNA, 13 bp, Homo sapiens
ctcctttctaagg

SEQ ID NO: 5976016 - DNA, 17 bp, Homo sapiens
ctcctttctccagccag

SEQ ID NO: 5976017 - DNA, 18 bp, Homo sapiens
ctcctttctccagccagc

SEQ ID NO: 5976018 - DNA, 19 bp, Homo sapiens
ctcctttctccagccagca

SEQ ID NO: 5976019 - DNA, 15 bp, Homo sapiens
ctcctttctcctgtg

SEQ ID NO: 5976020 - DNA, 16 bp, Homo sapiens
ctcctttctcctgtga

SEQ ID NO: 5976021 - DNA, 18 bp, Homo sapiens
ctcctttctcctgtgaat

SEQ ID NO: 5976022 - DNA, 13 bp, Homo sapiens
ctcctttctctat

SEQ ID NO: 5976023 - DNA, 18 bp, Homo sapiens
ctcctttctctgtatatt

SEQ ID NO: 5976024 - DNA, 13 bp, Homo sapiens
ctcctttctcttt

SEQ ID NO: 5976025 - DNA, 14 bp, Homo sapiens
ctcctttctgactg

SEQ ID NO: 5976026 - DNA, 15 bp, Homo sapiens
ctcctttctgactgt

SEQ ID NO: 5976027 - DNA, 17 bp, Homo sapiens
ctcctttctgactgtcc

SEQ ID NO: 5976028 - DNA, 19 bp, Homo sapiens
ctcctttcttattaatttc

SEQ ID NO: 5976029 - DNA, 21 bp, Homo sapiens
ctcctttctttgctgtttgca

SEQ ID NO: 5976030 - DNA, 21 bp, Homo sapiens
ctcctttctttttcttcttcc

SEQ ID NO: 5976031 - DNA, 20 bp, Homo sapiens
ctcctttgaagaaggcaagg

SEQ ID NO: 5976032 - DNA, 15 bp, Homo sapiens
ctcctttgcactgag

SEQ ID NO: 5976033 - DNA, 18 bp, Homo sapiens
ctcctttgcactgagggc

SEQ ID NO: 5976034 - DNA, 14 bp, Homo sapiens
ctcctttgcatggc

SEQ ID NO: 5976035 - DNA, 23 bp, Homo sapiens
ctcctttgcatggcagggcctca

SEQ ID NO: 5976036 - DNA, 11 bp, Homo sapiens
ctcctttgcct

SEQ ID NO: 5976037 - DNA, 23 bp, Homo sapiens
ctcctttgctgaggcctccagct

SEQ ID NO: 5976038 - DNA, 17 bp, Homo sapiens
ctcctttggcatgttta

SEQ ID NO: 5976039 - DNA, 19 bp, Homo sapiens
ctcctttggtatttcactg

SEQ ID NO: 5976040 - DNA, 18 bp, Homo sapiens
ctcctttgtattctgtct

SEQ ID NO: 5976041 - DNA, 17 bp, Homo sapiens
ctcctttgtgaggaagc

SEQ ID NO: 5976042 - DNA, 20 bp, Homo sapiens
ctcctttgtgtgtattcaga

SEQ ID NO: 5976043 - DNA, 15 bp, Homo sapiens
ctcctttgtgtgtgt

SEQ ID NO: 5976044 - DNA, 16 bp, Homo sapiens
ctcctttgttcccggc

SEQ ID NO: 5976045 - DNA, 16 bp, Homo sapiens
ctccttttatctggtg

SEQ ID NO: 5976046 - DNA, 19 bp, Homo sapiens
ctccttttatgctcacctg

SEQ ID NO: 5976047 - DNA, 12 bp, Homo sapiens
ctccttttatgt

SEQ ID NO: 5976048 - DNA, 15 bp, Homo sapiens
ctccttttcacttta

SEQ ID NO: 5976049 - DNA, 20 bp, Homo sapiens
ctccttttcactttattgct

SEQ ID NO: 5976050 - DNA, 14 bp, Homo sapiens
ctccttttcccact

SEQ ID NO: 5976051 - DNA, 13 bp, Homo sapiens
ctccttttctctt

SEQ ID NO: 5976052 - DNA, 13 bp, Homo sapiens
ctccttttctgtg

SEQ ID NO: 5976053 - DNA, 11 bp, Homo sapiens
ctccttttctt

SEQ ID NO: 5976054 - DNA, 19 bp, Homo sapiens
ctccttttcttctagcttt

SEQ ID NO: 5976055 - DNA, 19 bp, Homo sapiens
ctccttttcttttgttact

SEQ ID NO: 5976056 - DNA, 15 bp, Homo sapiens
ctccttttggcctgg

SEQ ID NO: 5976057 - DNA, 19 bp, Homo sapiens
ctccttttggcctggggga

SEQ ID NO: 5976058 - DNA, 15 bp, Homo sapiens
ctccttttgtcccca

SEQ ID NO: 5976059 - DNA, 13 bp, Homo sapiens
ctccttttgtgtt

SEQ ID NO: 5976060 - DNA, 21 bp, Homo sapiens
ctcctttttattttaggcact

SEQ ID NO: 5976061 - DNA, 13 bp, Homo sapiens
ctcctttttccat

SEQ ID NO: 5976062 - DNA, 17 bp, Homo sapiens
ctcctttttctaccttt

SEQ ID NO: 5976063 - DNA, 14 bp, Homo sapiens
ctcctttttctccc

SEQ ID NO: 5976064 - DNA, 15 bp, Homo sapiens
ctcgaaaagagcact

SEQ ID NO: 5976065 - DNA, 20 bp, Homo sapiens
ctcgaaacacagaaaccttt

SEQ ID NO: 5976066 - DNA, 23 bp, Homo sapiens
ctcgaacatggaactcattcctg

SEQ ID NO: 5976067 - DNA, 16 bp, Homo sapiens
ctcgaaccaaggcagc

SEQ ID NO: 5976068 - DNA, 20 bp, Homo sapiens
ctcgaaccaaggcagcctcc

SEQ ID NO: 5976069 - DNA, 15 bp, Homo sapiens
ctcgaacccacactg

SEQ ID NO: 5976070 - DNA, 21 bp, Homo sapiens
ctcgaactattttcaaagact

SEQ ID NO: 5976071 - DNA, 15 bp, Homo sapiens
ctcgaactcctgacc

SEQ ID NO: 5976072 - DNA, 16 bp, Homo sapiens
ctcgaactcctgacct

SEQ ID NO: 5976073 - DNA, 19 bp, Homo sapiens
ctcgaactcctggcctcaa

SEQ ID NO: 5976074 - DNA, 13 bp, Homo sapiens
ctcgaactggctg

SEQ ID NO: 5976075 - DNA, 16 bp, Homo sapiens
ctcgaactggctgcaa

SEQ ID NO: 5976076 - DNA, 13 bp, Homo sapiens
ctcgaagaaaata

SEQ ID NO: 5976077 - DNA, 15 bp, Homo sapiens
ctcgaagaacaatgt

SEQ ID NO: 5976078 - DNA, 23 bp, Homo sapiens
ctcgaagaacaatgtcagaaact

SEQ ID NO: 5976079 - DNA, 16 bp, Homo sapiens
ctcgaagcccttccag

SEQ ID NO: 5976080 - DNA, 17 bp, Homo sapiens
ctcgaagcccttccagt

SEQ ID NO: 5976081 - DNA, 13 bp, Homo sapiens
ctcgaagcgcgcc

SEQ ID NO: 5976082 - DNA, 19 bp, Homo sapiens
ctcgaagctgttctctgct

SEQ ID NO: 5976083 - DNA, 17 bp, Homo sapiens
ctcgaatactttgaatg

SEQ ID NO: 5976084 - DNA, 13 bp, Homo sapiens
ctcgaatgtaatt

SEQ ID NO: 5976085 - DNA, 18 bp, Homo sapiens
ctcgaatgtaattggaat

SEQ ID NO: 5976086 - DNA, 22 bp, Homo sapiens
ctcgaatgtgtgggcccaaggc

SEQ ID NO: 5976087 - DNA, 19 bp, Homo sapiens
ctcgacaaaggccacaggc

SEQ ID NO: 5976088 - DNA, 16 bp, Homo sapiens
ctcgacacccccccaa

SEQ ID NO: 5976089 - DNA, 17 bp, Homo sapiens
ctcgacacccccccaac

SEQ ID NO: 5976090 - DNA, 20 bp, Homo sapiens
ctcgacacgtgggctcccct

SEQ ID NO: 5976091 - DNA, 22 bp, Homo sapiens
ctcgacacgtgggctcccctct

SEQ ID NO: 5976092 - DNA, 19 bp, Homo sapiens
ctcgacagcgcccctgctg

SEQ ID NO: 5976093 - DNA, 21 bp, Homo sapiens
ctcgacagcgcccctgctgtc

SEQ ID NO: 5976094 - DNA, 17 bp, Homo sapiens
ctcgacagctctctggg

SEQ ID NO: 5976095 - DNA, 22 bp, Homo sapiens
ctcgacatcaccgtcattgatg

SEQ ID NO: 5976096 - DNA, 13 bp, Homo sapiens
ctcgaccaccccc

SEQ ID NO: 5976097 - DNA, 17 bp, Homo sapiens
ctctaacaccacactga

SEQ ID NO: 5976098 - DNA, 22 bp, Homo sapiens
ctctaacagctcaggatctctt

SEQ ID NO: 5976099 - DNA, 17 bp, Homo sapiens
ctctaacaggcactttg

SEQ ID NO: 5976100 - DNA, 15 bp, Homo sapiens
ctctaacagtggaca

SEQ ID NO: 5976101 - DNA, 15 bp, Homo sapiens
ctctaaccacacagc

SEQ ID NO: 5976102 - DNA, 17 bp, Homo sapiens
ctctaaccattcaaatg

SEQ ID NO: 5976103 - DNA, 13 bp, Homo sapiens
ctctaacccagtg

SEQ ID NO: 5976104 - DNA, 16 bp, Homo sapiens
ctctaacccagtggct

SEQ ID NO: 5976105 - DNA, 19 bp, Homo sapiens
ctctaaccccaggccccga

SEQ ID NO: 5976106 - DNA, 21 bp, Homo sapiens
ctctaaccccaggccccgagg

SEQ ID NO: 5976107 - DNA, 21 bp, Homo sapiens
ctctaacccccagtgccacag

SEQ ID NO: 5976108 - DNA, 18 bp, Homo sapiens
ctctaaccctcattgctg

SEQ ID NO: 5976109 - DNA, 13 bp, Homo sapiens
ctctaaccctgtg

SEQ ID NO: 5976110 - DNA, 15 bp, Homo sapiens
ctctaaccctgtgga

SEQ ID NO: 5976111 - DNA, 16 bp, Homo sapiens
ctctaaccctgtggaa

SEQ ID NO: 5976112 - DNA, 14 bp, Homo sapiens
ctctaacctcgccc

SEQ ID NO: 5976113 - DNA, 15 bp, Homo sapiens
ctctaacgcctgagc

SEQ ID NO: 5976114 - DNA, 16 bp, Homo sapiens
ctctaacgcctgagcc

SEQ ID NO: 5976115 - DNA, 21 bp, Homo sapiens
ctctaacgcctgagcccaggg

SEQ ID NO: 5976116 - DNA, 18 bp, Homo sapiens
ctctaactcactgcctag

SEQ ID NO: 5976117 - DNA, 14 bp, Homo sapiens
ctctaactccctcc

SEQ ID NO: 5976118 - DNA, 19 bp, Homo sapiens
ctctaactctgagagctgt

SEQ ID NO: 5976119 - DNA, 17 bp, Homo sapiens
ctctaactgtatatttg

SEQ ID NO: 5976120 - DNA, 20 bp, Homo sapiens
ctctaacttggctcacactc

SEQ ID NO: 5976121 - DNA, 12 bp, Homo sapiens
ctctaagaaaag

SEQ ID NO: 5976122 - DNA, 13 bp, Homo sapiens
ctctaagaaaaga

SEQ ID NO: 5976123 - DNA, 14 bp, Homo sapiens
ctctaagaaaagag

SEQ ID NO: 5976124 - DNA, 14 bp, Homo sapiens
ctctaagaaagaac

SEQ ID NO: 5976125 - DNA, 22 bp, Homo sapiens
ctctaagaaatggctttccaca

SEQ ID NO: 5976126 - DNA, 16 bp, Homo sapiens
ctctaagacaaatgca

SEQ ID NO: 5976127 - DNA, 13 bp, Homo sapiens
ctctaagagtata

SEQ ID NO: 5976128 - DNA, 22 bp, Homo sapiens
ctctaagatcttagattctctg

SEQ ID NO: 5976129 - DNA, 19 bp, Homo sapiens
ctctaagatgaatccaaat

SEQ ID NO: 5976130 - DNA, 18 bp, Homo sapiens
ctctaagatgttatattt

SEQ ID NO: 5976131 - DNA, 19 bp, Homo sapiens
ctctaagatgttatatttt

SEQ ID NO: 5976132 - DNA, 22 bp, Homo sapiens
ctctaagcagaagactctccac

SEQ ID NO: 5976133 - DNA, 15 bp, Homo sapiens
ctctaagcagccagg

SEQ ID NO: 5976134 - DNA, 20 bp, Homo sapiens
ctctaagcagccaggaggga

SEQ ID NO: 5976135 - DNA, 12 bp, Homo sapiens
ctctaagcctgg

SEQ ID NO: 5976136 - DNA, 23 bp, Homo sapiens
ctctaagcctggcttagaaggca

SEQ ID NO: 5976137 - DNA, 15 bp, Homo sapiens
ctctaagctgtgtgc

SEQ ID NO: 5976138 - DNA, 18 bp, Homo sapiens
ctctaagctgtgtgcagg

SEQ ID NO: 5976139 - DNA, 14 bp, Homo sapiens
ctctaaggagcagc

SEQ ID NO: 5976140 - DNA, 16 bp, Homo sapiens
ctctaaggcaggatgt

SEQ ID NO: 5976141 - DNA, 13 bp, Homo sapiens
ctctaaggccaag

SEQ ID NO: 5976142 - DNA, 16 bp, Homo sapiens
ctctaaggccaaggcc

SEQ ID NO: 5976143 - DNA, 18 bp, Homo sapiens
ctctaaggccaaggcctc

SEQ ID NO: 5976144 - DNA, 24 bp, Homo sapiens
ctctaaggtaaaaccatctaggat

SEQ ID NO: 5976145 - DNA, 19 bp, Homo sapiens
ctctaaggtaacaaattac

SEQ ID NO: 5976146 - DNA, 22 bp, Homo sapiens
ctctaagtcatgtatgtttctc

SEQ ID NO: 5976147 - DNA, 13 bp, Homo sapiens
ctctaagtgctgc

SEQ ID NO: 5976148 - DNA, 14 bp, Homo sapiens
ctctaagtgctgct

SEQ ID NO: 5976149 - DNA, 20 bp, Homo sapiens
ctctaagttatgtacgtata

SEQ ID NO: 5976150 - DNA, 18 bp, Homo sapiens
ctctaagttcaagaagac

SEQ ID NO: 5976151 - DNA, 21 bp, Homo sapiens
ctctaagttccactgagctcc

SEQ ID NO: 5976152 - DNA, 18 bp, Homo sapiens
ctctaataaacactgttt

SEQ ID NO: 5976153 - DNA, 19 bp, Homo sapiens
ctctaataaagctcctctg

SEQ ID NO: 5976154 - DNA, 22 bp, Homo sapiens
ctctaataacctttatctaaat

SEQ ID NO: 5976155 - DNA, 14 bp, Homo sapiens
ctctaataataaat

SEQ ID NO: 5976156 - DNA, 18 bp, Homo sapiens
ctctaataataaatagtt

SEQ ID NO: 5976157 - DNA, 16 bp, Homo sapiens
ctctaatagaaaagtc

SEQ ID NO: 5976158 - DNA, 23 bp, Homo sapiens
ctctaatagaaaagtctccaccc

SEQ ID NO: 5976159 - DNA, 18 bp, Homo sapiens
ctctaatagaagtccatg

SEQ ID NO: 5976160 - DNA, 15 bp, Homo sapiens
ctctaatagaggcag

SEQ ID NO: 5976161 - DNA, 20 bp, Homo sapiens
ctctaatagagtcacagctt

SEQ ID NO: 5976162 - DNA, 15 bp, Homo sapiens
ctctaatatcagcaa

SEQ ID NO: 5976163 - DNA, 20 bp, Homo sapiens
ctctaatatgcctaatctgt

SEQ ID NO: 5976164 - DNA, 16 bp, Homo sapiens
ctctaatctgagctgc

SEQ ID NO: 5976165 - DNA, 22 bp, Homo sapiens
ctctaatgaaattgtgaaagct

SEQ ID NO: 5976166 - DNA, 16 bp, Homo sapiens
ctctaatgccaagtta

SEQ ID NO: 5976167 - DNA, 22 bp, Homo sapiens
ctctaatggactgaccttaaaa

SEQ ID NO: 5976168 - DNA, 23 bp, Homo sapiens
ctctaatgttgtatcatactctt

SEQ ID NO: 5976169 - DNA, 21 bp, Homo sapiens
ctctaattaaaatgtgcagta

SEQ ID NO: 5976170 - DNA, 16 bp, Homo sapiens
ctctaattcacagtgc

SEQ ID NO: 5976171 - DNA, 20 bp, Homo sapiens
ctctaattcacagtgctctt

SEQ ID NO: 5976172 - DNA, 12 bp, Homo sapiens
ctctaattctaa

SEQ ID NO: 5976173 - DNA, 16 bp, Homo sapiens
ctctaattcttttcaa

SEQ ID NO: 5976174 - DNA, 21 bp, Homo sapiens
ctctaattcttttcaaaattg

SEQ ID NO: 5976175 - DNA, 18 bp, Homo sapiens
ctctaattgaattttcaa

SEQ ID NO: 5976176 - DNA, 13 bp, Homo sapiens
ctctaattttgga

SEQ ID NO: 5976177 - DNA, 17 bp, Homo sapiens
ctctaattttggataat

SEQ ID NO: 5976178 - DNA, 22 bp, Homo sapiens
ctctacaaaaagtaaaaattaa

SEQ ID NO: 5976179 - DNA, 16 bp, Homo sapiens
ctctacaccctctgcc

SEQ ID NO: 5976180 - DNA, 17 bp, Homo sapiens
ctctacaccctctgccc

SEQ ID NO: 5976181 - DNA, 22 bp, Homo sapiens
ctctacacggactgaggtgcct

SEQ ID NO: 5976182 - DNA, 15 bp, Homo sapiens
ctctacactcttgta

SEQ ID NO: 5976183 - DNA, 17 bp, Homo sapiens
ctctacagagcttccct

SEQ ID NO: 5976184 - DNA, 21 bp, Homo sapiens
ctctacaggaatatatttttt

SEQ ID NO: 5976185 - DNA, 19 bp, Homo sapiens
ctctacaggtccgtttcct

SEQ ID NO: 5976186 - DNA, 23 bp, Homo sapiens
ctctacaggtcggggaccaaagg

SEQ ID NO: 5976187 - DNA, 13 bp, Homo sapiens
ctctacagtgcca

SEQ ID NO: 5976188 - DNA, 20 bp, Homo sapiens
ctctacagtgccaactcctc

SEQ ID NO: 5976189 - DNA, 19 bp, Homo sapiens
ctctacatggactcagaga

SEQ ID NO: 5976190 - DNA, 13 bp, Homo sapiens
ctctacatggtat

SEQ ID NO: 5976191 - DNA, 18 bp, Homo sapiens
ctctacattctgctctgc

SEQ ID NO: 5976192 - DNA, 19 bp, Homo sapiens
ctctacattctgctctgcc

SEQ ID NO: 5976193 - DNA, 13 bp, Homo sapiens
ctctacatttaaa

SEQ ID NO: 5976194 - DNA, 15 bp, Homo sapiens
ctctacatttaaaca

SEQ ID NO: 5976195 - DNA, 14 bp, Homo sapiens
ctctacatttgcag

SEQ ID NO: 5976196 - DNA, 16 bp, Homo sapiens
ctctaccaaaaaaagg

SEQ ID NO: 5976197 - DNA, 18 bp, Homo sapiens
ctctaccaaaaaaaggaa

SEQ ID NO: 5976198 - DNA, 19 bp, Homo sapiens
ctctaccaaaaaaaggaag

SEQ ID NO: 5976199 - DNA, 20 bp, Homo sapiens
ctctaccaaaaaaaggaagg

SEQ ID NO: 5976200 - DNA, 14 bp, Homo sapiens
ctctaccaaataat

SEQ ID NO: 5976201 - DNA, 22 bp, Homo sapiens
ctctaccagtgcaggctggcca

SEQ ID NO: 5976202 - DNA, 13 bp, Homo sapiens
ctctaccagttgg

SEQ ID NO: 5976203 - DNA, 20 bp, Homo sapiens
ctctaccagttggcagacag

SEQ ID NO: 5976204 - DNA, 23 bp, Homo sapiens
ctctaccagttggcagacagccg

SEQ ID NO: 5976205 - DNA, 14 bp, Homo sapiens
ctctaccatcatcc

SEQ ID NO: 5976206 - DNA, 20 bp, Homo sapiens
ctctaccatcccctgtagag

SEQ ID NO: 5976207 - DNA, 16 bp, Homo sapiens
ctctaccatggttctg

SEQ ID NO: 5976208 - DNA, 19 bp, Homo sapiens
ctctacccactatgcacag

SEQ ID NO: 5976209 - DNA, 12 bp, Homo sapiens
ctctacccagcc

SEQ ID NO: 5976210 - DNA, 14 bp, Homo sapiens
ctctacccagggcc

SEQ ID NO: 5976211 - DNA, 19 bp, Homo sapiens
ctctacccatattacagat

SEQ ID NO: 5976212 - DNA, 21 bp, Homo sapiens
ctctacccatcttaaaaacaa

SEQ ID NO: 5976213 - DNA, 15 bp, Homo sapiens
ctctacccatgagcc

SEQ ID NO: 5976214 - DNA, 14 bp, Homo sapiens
ctctaccccaattt

SEQ ID NO: 5976215 - DNA, 17 bp, Homo sapiens
ctctacccccaacacca

SEQ ID NO: 5976216 - DNA, 18 bp, Homo sapiens
ctctacccccaacaccac

SEQ ID NO: 5976217 - DNA, 14 bp, Homo sapiens
ctctacccctttct

SEQ ID NO: 5976218 - DNA, 17 bp, Homo sapiens
ctctaccctcccacccc

SEQ ID NO: 5976219 - DNA, 14 bp, Homo sapiens
ctctaccctgcagc

SEQ ID NO: 5976220 - DNA, 16 bp, Homo sapiens
ctctaccctgctccct

SEQ ID NO: 5976221 - DNA, 13 bp, Homo sapiens
ctctaccctggca

SEQ ID NO: 5976222 - DNA, 17 bp, Homo sapiens
ctctaccctggtaggaa

SEQ ID NO: 5976223 - DNA, 17 bp, Homo sapiens
ctctacctaatgtctca

SEQ ID NO: 5976224 - DNA, 22 bp, Homo sapiens
ctctacctaatgtctcactgtt

SEQ ID NO: 5976225 - DNA, 11 bp, Homo sapiens
ctctacctcca

SEQ ID NO: 5976226 - DNA, 23 bp, Homo sapiens
ctctacctccttagctttccctg

SEQ ID NO: 5976227 - DNA, 12 bp, Homo sapiens
ctctacctctct

SEQ ID NO: 5976228 - DNA, 20 bp, Homo sapiens
ctctacctctctcctctccg

SEQ ID NO: 5976229 - DNA, 13 bp, Homo sapiens
ctctacctctctt

SEQ ID NO: 5976230 - DNA, 17 bp, Homo sapiens
ctctacctctctttctc

SEQ ID NO: 5976231 - DNA, 22 bp, Homo sapiens
ctctacctgacactcccttggg

SEQ ID NO: 5976232 - DNA, 17 bp, Homo sapiens
ctctacctggatggatg

SEQ ID NO: 5976233 - DNA, 22 bp, Homo sapiens
ctctaccttctccccagctccc

SEQ ID NO: 5976234 - DNA, 18 bp, Homo sapiens
ctctacgagagtgagact

SEQ ID NO: 5976235 - DNA, 14 bp, Homo sapiens
ctctacgccaaagt

SEQ ID NO: 5976236 - DNA, 13 bp, Homo sapiens
ctctacgtcccac

SEQ ID NO: 5976237 - DNA, 17 bp, Homo sapiens
ctctacgtcccacattt

SEQ ID NO: 5976238 - DNA, 20 bp, Homo sapiens
ctctacgtggcaaattaact

SEQ ID NO: 5976239 - DNA, 20 bp, Homo sapiens
ctctacgtttaggcacccct

SEQ ID NO: 5976240 - DNA, 23 bp, Homo sapiens
ctctacgtttccccaataaagcc

SEQ ID NO: 5976241 - DNA, 19 bp, Homo sapiens
ctctactaaaaagaaggaa

SEQ ID NO: 5976242 - DNA, 19 bp, Homo sapiens
ctctactaaaaatacaaaa

SEQ ID NO: 5976243 - DNA, 22 bp, Homo sapiens
ctctactaaaaatacaaaaaat

SEQ ID NO: 5976244 - DNA, 16 bp, Homo sapiens
ctctactaaaaatgca

SEQ ID NO: 5976245 - DNA, 21 bp, Homo sapiens
ctctactaacaatcagctcct

SEQ ID NO: 5976246 - DNA, 15 bp, Homo sapiens
ctctactaattttta

SEQ ID NO: 5976247 - DNA, 19 bp, Homo sapiens
ctctactaccacaaggaaa

SEQ ID NO: 5976248 - DNA, 23 bp, Homo sapiens
ctctactacttttactacagtga

SEQ ID NO: 5976249 - DNA, 16 bp, Homo sapiens
ctctactaggtctgct

SEQ ID NO: 5976250 - DNA, 15 bp, Homo sapiens
ctctactccctcttg

SEQ ID NO: 5976251 - DNA, 23 bp, Homo sapiens
ctctactccctcttgtcagtgta

SEQ ID NO: 5976252 - DNA, 15 bp, Homo sapiens
ctctactcttcctgt

SEQ ID NO: 5976253 - DNA, 17 bp, Homo sapiens
ctctactcttcctgtcc

SEQ ID NO: 5976254 - DNA, 17 bp, Homo sapiens
ctctactgaaaacacaa

SEQ ID NO: 5976255 - DNA, 17 bp, Homo sapiens
ctctactgaatgtcatt

SEQ ID NO: 5976256 - DNA, 14 bp, Homo sapiens
ctctactgccctcc

SEQ ID NO: 5976257 - DNA, 12 bp, Homo sapiens
ctctactgggaa

SEQ ID NO: 5976258 - DNA, 16 bp, Homo sapiens
ctctactgggaaggct

SEQ ID NO: 5976259 - DNA, 19 bp, Homo sapiens
ctctactgggaaggctact

SEQ ID NO: 5976260 - DNA, 21 bp, Homo sapiens
ctctactgggagcctacccac

SEQ ID NO: 5976261 - DNA, 22 bp, Homo sapiens
ctctactgtctcctccctgggc

SEQ ID NO: 5976262 - DNA, 23 bp, Homo sapiens
ctctactgtctcctccctgggct

SEQ ID NO: 5976263 - DNA, 20 bp, Homo sapiens
ctctactgttgcacagccag

SEQ ID NO: 5976264 - DNA, 18 bp, Homo sapiens
ctctacttaatccaatgg

SEQ ID NO: 5976265 - DNA, 16 bp, Homo sapiens
ctctacttagcatgtc

SEQ ID NO: 5976266 - DNA, 19 bp, Homo sapiens
ctctacttagcatgtccct

SEQ ID NO: 5976267 - DNA, 13 bp, Homo sapiens
ctctacttcagga

SEQ ID NO: 5976268 - DNA, 14 bp, Homo sapiens
ctctacttcccctt

SEQ ID NO: 5976269 - DNA, 18 bp, Homo sapiens
ctctacttgaagcaactt

SEQ ID NO: 5976270 - DNA, 15 bp, Homo sapiens
ctctactttataatc

SEQ ID NO: 5976271 - DNA, 20 bp, Homo sapiens
ctctactttcctgatgttga

SEQ ID NO: 5976272 - DNA, 15 bp, Homo sapiens
ctctactttgattct

SEQ ID NO: 5976273 - DNA, 15 bp, Homo sapiens
ctctagaacacccac

SEQ ID NO: 5976274 - DNA, 15 bp, Homo sapiens
ctctcatgcgtgttt

SEQ ID NO: 5976275 - DNA, 16 bp, Homo sapiens
ctctcatggcttgggc

SEQ ID NO: 5976276 - DNA, 21 bp, Homo sapiens
ctctcatggtacttcctctgt

SEQ ID NO: 5976277 - DNA, 15 bp, Homo sapiens
ctctcatgtccctcc

SEQ ID NO: 5976278 - DNA, 19 bp, Homo sapiens
ctctcatgtccctccaggg

SEQ ID NO: 5976279 - DNA, 13 bp, Homo sapiens
ctctcatgtgggg

SEQ ID NO: 5976280 - DNA, 20 bp, Homo sapiens
ctctcatgttttcaactgcc

SEQ ID NO: 5976281 - DNA, 14 bp, Homo sapiens
ctctcattcccagg

SEQ ID NO: 5976282 - DNA, 14 bp, Homo sapiens
ctctcattccccag

SEQ ID NO: 5976283 - DNA, 15 bp, Homo sapiens
ctctcattctctttc

SEQ ID NO: 5976284 - DNA, 23 bp, Homo sapiens
ctctcattgtcttgttatgtaca

SEQ ID NO: 5976285 - DNA, 16 bp, Homo sapiens
ctctcatttccagctt

SEQ ID NO: 5976286 - DNA, 19 bp, Homo sapiens
ctctcatttccagcttctc

SEQ ID NO: 5976287 - DNA, 20 bp, Homo sapiens
ctctcatttccagcttctca

SEQ ID NO: 5976288 - DNA, 15 bp, Homo sapiens
ctctccaaaaatgca

SEQ ID NO: 5976289 - DNA, 21 bp, Homo sapiens
ctctccaaaggggctgctggg

SEQ ID NO: 5976290 - DNA, 23 bp, Homo sapiens
ctctccaaatattattcaagtgc

SEQ ID NO: 5976291 - DNA, 22 bp, Homo sapiens
ctctccaaccactgtgccactg

SEQ ID NO: 5976292 - DNA, 23 bp, Homo sapiens
ctctccaaccactgtgccactga

SEQ ID NO: 5976293 - DNA, 18 bp, Homo sapiens
ctctccaagacagcagca

SEQ ID NO: 5976294 - DNA, 21 bp, Homo sapiens
ctctccaagacagcagcagcc

SEQ ID NO: 5976295 - DNA, 16 bp, Homo sapiens
ctctccaagcgcctgg

SEQ ID NO: 5976296 - DNA, 18 bp, Homo sapiens
ctctccaagcgcctggct

SEQ ID NO: 5976297 - DNA, 17 bp, Homo sapiens
ctctccaagtctctctg

SEQ ID NO: 5976298 - DNA, 18 bp, Homo sapiens
ctctccaagtctctctgt

SEQ ID NO: 5976299 - DNA, 20 bp, Homo sapiens
ctctccaagtgccagaggtg

SEQ ID NO: 5976300 - DNA, 22 bp, Homo sapiens
ctctccacacagtgctcaaggc

SEQ ID NO: 5976301 - DNA, 13 bp, Homo sapiens
ctctccacaccca

SEQ ID NO: 5976302 - DNA, 14 bp, Homo sapiens
ctctccacacccag

SEQ ID NO: 5976303 - DNA, 18 bp, Homo sapiens
ctctccacacccagcctg

SEQ ID NO: 5976304 - DNA, 20 bp, Homo sapiens
ctctccacacccagcctgtc

SEQ ID NO: 5976305 - DNA, 21 bp, Homo sapiens
ctctccacacggagctcctgg

SEQ ID NO: 5976306 - DNA, 17 bp, Homo sapiens
ctctccacagctgcctc

SEQ ID NO: 5976307 - DNA, 13 bp, Homo sapiens
ctctccacaggag

SEQ ID NO: 5976308 - DNA, 22 bp, Homo sapiens
ctctccacagtgttgtgcccct

SEQ ID NO: 5976309 - DNA, 13 bp, Homo sapiens
ctctccacccaga

SEQ ID NO: 5976310 - DNA, 14 bp, Homo sapiens
ctctccacccagag

SEQ ID NO: 5976311 - DNA, 18 bp, Homo sapiens
ctctccaccctggctggg

SEQ ID NO: 5976312 - DNA, 20 bp, Homo sapiens
ctctccaccctggctgggat

SEQ ID NO: 5976313 - DNA, 14 bp, Homo sapiens
ctctccacctagtg

SEQ ID NO: 5976314 - DNA, 17 bp, Homo sapiens
ctctccacctagtggct

SEQ ID NO: 5976315 - DNA, 13 bp, Homo sapiens
ctctccacctcag

SEQ ID NO: 5976316 - DNA, 16 bp, Homo sapiens
ctctccacctcagcct

SEQ ID NO: 5976317 - DNA, 17 bp, Homo sapiens
ctctccacctcagcctt

SEQ ID NO: 5976318 - DNA, 18 bp, Homo sapiens
ctctccacctcagccttg

SEQ ID NO: 5976319 - DNA, 21 bp, Homo sapiens
ctctccaccttagtactttag

SEQ ID NO: 5976320 - DNA, 19 bp, Homo sapiens
ctctccactcatgtgactc

SEQ ID NO: 5976321 - DNA, 14 bp, Homo sapiens
ctctccactcttct

SEQ ID NO: 5976322 - DNA, 15 bp, Homo sapiens
ctctccactcttctc

SEQ ID NO: 5976323 - DNA, 14 bp, Homo sapiens
ctctccactgcctt

SEQ ID NO: 5976324 - DNA, 15 bp, Homo sapiens
ctctccactgccttc

SEQ ID NO: 5976325 - DNA, 12 bp, Homo sapiens
ctctccactgct

SEQ ID NO: 5976326 - DNA, 18 bp, Homo sapiens
ctctccactgctggacat

SEQ ID NO: 5976327 - DNA, 22 bp, Homo sapiens
ctctccactgctggacatgaga

SEQ ID NO: 5976328 - DNA, 13 bp, Homo sapiens
ctctccactgtgc

SEQ ID NO: 5976329 - DNA, 18 bp, Homo sapiens
ctctccactttcagctgt

SEQ ID NO: 5976330 - DNA, 21 bp, Homo sapiens
ctctccactttcagctgtctt

SEQ ID NO: 5976331 - DNA, 13 bp, Homo sapiens
ctctccagacctg

SEQ ID NO: 5976332 - DNA, 15 bp, Homo sapiens
ctctccagacctgag

SEQ ID NO: 5976333 - DNA, 14 bp, Homo sapiens
ctctccagagagca

SEQ ID NO: 5976334 - DNA, 20 bp, Homo sapiens
ctctccagatgtttccagac

SEQ ID NO: 5976335 - DNA, 21 bp, Homo sapiens
ctctccagcatcccagcctca

SEQ ID NO: 5976336 - DNA, 13 bp, Homo sapiens
ctctccagcccct

SEQ ID NO: 5976337 - DNA, 16 bp, Homo sapiens
ctctccagcccctgga

SEQ ID NO: 5976338 - DNA, 19 bp, Homo sapiens
ctctccagcccctggatgc

SEQ ID NO: 5976339 - DNA, 21 bp, Homo sapiens
ctctccagccgaagctgcagg

SEQ ID NO: 5976340 - DNA, 17 bp, Homo sapiens
ctctccagcctcacaga

SEQ ID NO: 5976341 - DNA, 22 bp, Homo sapiens
ctctccagcctcacagatgctg

SEQ ID NO: 5976342 - DNA, 16 bp, Homo sapiens
ctctccagcctcagcc

SEQ ID NO: 5976343 - DNA, 14 bp, Homo sapiens
ctctccagcctgct

SEQ ID NO: 5976344 - DNA, 16 bp, Homo sapiens
ctctccagctccaaga

SEQ ID NO: 5976345 - DNA, 15 bp, Homo sapiens
ctctccagctgacta

SEQ ID NO: 5976346 - DNA, 18 bp, Homo sapiens
ctctccagctgactaaac

SEQ ID NO: 5976347 - DNA, 23 bp, Homo sapiens
ctctccagcttgggaggaagccc

SEQ ID NO: 5976348 - DNA, 21 bp, Homo sapiens
ctctccaggaaggtagcccag

SEQ ID NO: 5976349 - DNA, 22 bp, Homo sapiens
ctctccaggaaggtagcccagc

SEQ ID NO: 5976350 - DNA, 20 bp, Homo sapiens
ctctccaggagggctcgggg

SEQ ID NO: 5976351 - DNA, 18 bp, Homo sapiens
ctctccaggattgtccac

SEQ ID NO: 5976352 - DNA, 14 bp, Homo sapiens
ctctccaggcacca

SEQ ID NO: 5976353 - DNA, 17 bp, Homo sapiens
ctctccaggcaccgcct

SEQ ID NO: 5976354 - DNA, 19 bp, Homo sapiens
ctctccaggcaccgcctgc

SEQ ID NO: 5976355 - DNA, 20 bp, Homo sapiens
ctctccaggcaccgcctgcc

SEQ ID NO: 5976356 - DNA, 14 bp, Homo sapiens
ctctccaggccagg

SEQ ID NO: 5976357 - DNA, 16 bp, Homo sapiens
ctctccaggccaggtg

SEQ ID NO: 5976358 - DNA, 17 bp, Homo sapiens
ctctccaggccaggtgg

SEQ ID NO: 5976359 - DNA, 20 bp, Homo sapiens
ctctccaggcctgtcaagag

SEQ ID NO: 5976360 - DNA, 15 bp, Homo sapiens
ctctccagggtgctt

SEQ ID NO: 5976361 - DNA, 14 bp, Homo sapiens
ctctccaggtcagc

SEQ ID NO: 5976362 - DNA, 15 bp, Homo sapiens
ctctccaggtgctca

SEQ ID NO: 5976363 - DNA, 18 bp, Homo sapiens
ctctccagtcttccacct

SEQ ID NO: 5976364 - DNA, 22 bp, Homo sapiens
ctctccagtcttccacctggaa

SEQ ID NO: 5976365 - DNA, 13 bp, Homo sapiens
ctctccagtgaaa

SEQ ID NO: 5976366 - DNA, 20 bp, Homo sapiens
ctctccagttatcagtactc

SEQ ID NO: 5976367 - DNA, 20 bp, Homo sapiens
ctctccagtttgcacctgtc

SEQ ID NO: 5976368 - DNA, 16 bp, Homo sapiens
ctctccataaccccac

SEQ ID NO: 5976369 - DNA, 15 bp, Homo sapiens
ctctccatactttga

SEQ ID NO: 5976370 - DNA, 16 bp, Homo sapiens
ctctccatcataggct

SEQ ID NO: 5976371 - DNA, 20 bp, Homo sapiens
ctctccatctcccaaggctg

SEQ ID NO: 5976372 - DNA, 13 bp, Homo sapiens
ctctccatctcta

SEQ ID NO: 5976373 - DNA, 22 bp, Homo sapiens
ctctccatctcttgtaccagcc

SEQ ID NO: 5976374 - DNA, 15 bp, Homo sapiens
ctctccatgcccaac

SEQ ID NO: 5976375 - DNA, 18 bp, Homo sapiens
ctctccatgcccaaccta

SEQ ID NO: 5976376 - DNA, 23 bp, Homo sapiens
ctctccatgttggcctgtcacca

SEQ ID NO: 5976377 - DNA, 21 bp, Homo sapiens
ctctccattcccgtggaacgt

SEQ ID NO: 5976378 - DNA, 17 bp, Homo sapiens
ctctccattctgctcct

SEQ ID NO: 5976379 - DNA, 20 bp, Homo sapiens
ctctccattctgctccttcc

SEQ ID NO: 5976380 - DNA, 19 bp, Homo sapiens
ctctccattttagcccagt

SEQ ID NO: 5976381 - DNA, 22 bp, Homo sapiens
ctctccattttggtgtctttct

SEQ ID NO: 5976382 - DNA, 13 bp, Homo sapiens
ctctcccaaaaaa

SEQ ID NO: 5976383 - DNA, 18 bp, Homo sapiens
ctctcccaacgctgaagc

SEQ ID NO: 5976384 - DNA, 21 bp, Homo sapiens
ctctcccaacgctgaagcggt

SEQ ID NO: 5976385 - DNA, 14 bp, Homo sapiens
ctctcccaactctt

SEQ ID NO: 5976386 - DNA, 19 bp, Homo sapiens
ctctcccaactgctgctta

SEQ ID NO: 5976387 - DNA, 17 bp, Homo sapiens
ctctcccacatcccact

SEQ ID NO: 5976388 - DNA, 22 bp, Homo sapiens
ctctcccaccccggcctccact

SEQ ID NO: 5976389 - DNA, 12 bp, Homo sapiens
ctctcccacccg

SEQ ID NO: 5976390 - DNA, 15 bp, Homo sapiens
ctctcccacccggcc

SEQ ID NO: 5976391 - DNA, 21 bp, Homo sapiens
ctctcccacccggccacagct

SEQ ID NO: 5976392 - DNA, 20 bp, Homo sapiens
ctctcccaccctaagggcag

SEQ ID NO: 5976393 - DNA, 14 bp, Homo sapiens
ctctcccaccctct

SEQ ID NO: 5976394 - DNA, 17 bp, Homo sapiens
ctctcccaccctcttcc

SEQ ID NO: 5976395 - DNA, 21 bp, Homo sapiens
ctctcccaccctcttcctact

SEQ ID NO: 5976396 - DNA, 21 bp, Homo sapiens
ctctcccacgatgtcaaggac

SEQ ID NO: 5976397 - DNA, 14 bp, Homo sapiens
ctctcccacttcct

SEQ ID NO: 5976398 - DNA, 21 bp, Homo sapiens
ctctcccacttcctcctacct

SEQ ID NO: 5976399 - DNA, 13 bp, Homo sapiens
ctctcccagacct

SEQ ID NO: 5976400 - DNA, 14 bp, Homo sapiens
ctctcccagaggct

SEQ ID NO: 5976401 - DNA, 13 bp, Homo sapiens
ctctcccaggacc

SEQ ID NO: 5976402 - DNA, 14 bp, Homo sapiens
ctctcccaggcagg

SEQ ID NO: 5976403 - DNA, 13 bp, Homo sapiens
ctctcccaggccc

SEQ ID NO: 5976404 - DNA, 24 bp, Homo sapiens
ctctcccaggccccatgacctcca

SEQ ID NO: 5976405 - DNA, 13 bp, Homo sapiens
ctctcccagggat

SEQ ID NO: 5976406 - DNA, 15 bp, Homo sapiens
ctctcccagtccatt

SEQ ID NO: 5976407 - DNA, 19 bp, Homo sapiens
ctctcccagtgaactcctg

SEQ ID NO: 5976408 - DNA, 23 bp, Homo sapiens
ctctcccagtgaactcctgccag

SEQ ID NO: 5976409 - DNA, 20 bp, Homo sapiens
ctctcccataccatcactga

SEQ ID NO: 5976410 - DNA, 13 bp, Homo sapiens
ctctcccatcact

SEQ ID NO: 5976411 - DNA, 14 bp, Homo sapiens
ctctcccatcactt

SEQ ID NO: 5976412 - DNA, 16 bp, Homo sapiens
ctctcccatccccctg

SEQ ID NO: 5976413 - DNA, 13 bp, Homo sapiens
ctctcccatcctg

SEQ ID NO: 5976414 - DNA, 18 bp, Homo sapiens
ctctcccatcctggggca

SEQ ID NO: 5976415 - DNA, 14 bp, Homo sapiens
ctctcccatggagc

SEQ ID NO: 5976416 - DNA, 22 bp, Homo sapiens
ctctcccatggagccccagccc

SEQ ID NO: 5976417 - DNA, 23 bp, Homo sapiens
ctctcccatggagccccagcccc

SEQ ID NO: 5976418 - DNA, 16 bp, Homo sapiens
ctctcccatggctttg

SEQ ID NO: 5976419 - DNA, 21 bp, Homo sapiens
ctctcccattgtccctctgcc

SEQ ID NO: 5976420 - DNA, 20 bp, Homo sapiens
ctctccccaacccccattct

SEQ ID NO: 5976421 - DNA, 19 bp, Homo sapiens
ctctccccaatccatgctt

SEQ ID NO: 5976422 - DNA, 22 bp, Homo sapiens
ctctccccaatccatgcttcac

SEQ ID NO: 5976423 - DNA, 12 bp, Homo sapiens
ctctccccacac

SEQ ID NO: 5976424 - DNA, 13 bp, Homo sapiens
ctctccccacact

SEQ ID NO: 5976425 - DNA, 14 bp, Homo sapiens
ctctccccacccag

SEQ ID NO: 5976426 - DNA, 14 bp, Homo sapiens
ctctccccacccct

SEQ ID NO: 5976427 - DNA, 14 bp, Homo sapiens
ctctccccaccttc

SEQ ID NO: 5976428 - DNA, 14 bp, Homo sapiens
ctctccccagcaag

SEQ ID NO: 5976429 - DNA, 15 bp, Homo sapiens
ctctccccagcccag

SEQ ID NO: 5976430 - DNA, 18 bp, Homo sapiens
ctctccccagcccagaga

SEQ ID NO: 5976431 - DNA, 20 bp, Homo sapiens
ctctccccagcccagagaca

SEQ ID NO: 5976432 - DNA, 15 bp, Homo sapiens
ctctccccagccccc

SEQ ID NO: 5976433 - DNA, 16 bp, Homo sapiens
ctctccccagccccct

SEQ ID NO: 5976434 - DNA, 22 bp, Homo sapiens
ctctccccagccccctcccacc

SEQ ID NO: 5976435 - DNA, 13 bp, Homo sapiens
ctctccccaggaa

SEQ ID NO: 5976436 - DNA, 22 bp, Homo sapiens
ctctccccaggaagtggctcag

SEQ ID NO: 5976437 - DNA, 20 bp, Homo sapiens
ctctccccagggaagcagca

SEQ ID NO: 5976438 - DNA, 18 bp, Homo sapiens
ctctccccaggtccagct

SEQ ID NO: 5976439 - DNA, 20 bp, Homo sapiens
ctctccccaggtccagctct

SEQ ID NO: 5976440 - DNA, 21 bp, Homo sapiens
ctctccccagtgcctgccact

SEQ ID NO: 5976441 - DNA, 15 bp, Homo sapiens
ctctccccatatata

SEQ ID NO: 5976442 - DNA, 21 bp, Homo sapiens
ctctcccccaaccccctgcaa

SEQ ID NO: 5976443 - DNA, 17 bp, Homo sapiens
ctctcccccccccctcc

SEQ ID NO: 5976444 - DNA, 21 bp, Homo sapiens
ctctcccccccccctccaatc

SEQ ID NO: 5976445 - DNA, 17 bp, Homo sapiens
ctctccccctgcagccg

SEQ ID NO: 5976446 - DNA, 13 bp, Homo sapiens
ctctcccccttca

SEQ ID NO: 5976447 - DNA, 22 bp, Homo sapiens
ctctccccgcagtgtttgtgtg

SEQ ID NO: 5976448 - DNA, 17 bp, Homo sapiens
ctctccccgggaccgcg

SEQ ID NO: 5976449 - DNA, 18 bp, Homo sapiens
ctctcccctagagccctc

SEQ ID NO: 5976450 - DNA, 14 bp, Homo sapiens
ctctcccctcaaag

SEQ ID NO: 5976451 - DNA, 21 bp, Homo sapiens
ctctcccctcacatcctcctg

SEQ ID NO: 5976452 - DNA, 20 bp, Homo sapiens
gatgagcactcctgattttt

SEQ ID NO: 5976453 - DNA, 20 bp, Homo sapiens
gatgagcagaccagctttga

SEQ ID NO: 5976454 - DNA, 12 bp, Homo sapiens
gatgagcagcag

SEQ ID NO: 5976455 - DNA, 14 bp, Homo sapiens
gatgagcaggagct

SEQ ID NO: 5976456 - DNA, 22 bp, Homo sapiens
gatgagcatttagggcaaggag

SEQ ID NO: 5976457 - DNA, 12 bp, Homo sapiens
gatgagcccacc

SEQ ID NO: 5976458 - DNA, 14 bp, Homo sapiens
gatgagcccaccct

SEQ ID NO: 5976459 - DNA, 15 bp, Homo sapiens
gatgagcccaccctg

SEQ ID NO: 5976460 - DNA, 20 bp, Homo sapiens
gatgagccttgcagatatct

SEQ ID NO: 5976461 - DNA, 15 bp, Homo sapiens
gatgagcgccacctc

SEQ ID NO: 5976462 - DNA, 20 bp, Homo sapiens
gatgagctctacccagggcc

SEQ ID NO: 5976463 - DNA, 18 bp, Homo sapiens
gatgagctgtgcgctgct

SEQ ID NO: 5976464 - DNA, 14 bp, Homo sapiens
gatgagcttagggt

SEQ ID NO: 5976465 - DNA, 15 bp, Homo sapiens
gatgagctttctttt

SEQ ID NO: 5976466 - DNA, 16 bp, Homo sapiens
gatgagctttcttttt

SEQ ID NO: 5976467 - DNA, 16 bp, Homo sapiens
gatgaggacagagggc

SEQ ID NO: 5976468 - DNA, 18 bp, Homo sapiens
gatgaggacccagagctg

SEQ ID NO: 5976469 - DNA, 20 bp, Homo sapiens
gatgaggacccagagctgct

SEQ ID NO: 5976470 - DNA, 17 bp, Homo sapiens
gatgaggagcagctggg

SEQ ID NO: 5976471 - DNA, 18 bp, Homo sapiens
gatgaggcaaacagcaag

SEQ ID NO: 5976472 - DNA, 13 bp, Homo sapiens
gatgaggcaaccc

SEQ ID NO: 5976473 - DNA, 13 bp, Homo sapiens
gatgaggcagagg

SEQ ID NO: 5976474 - DNA, 15 bp, Homo sapiens
gatgaggccctccac

SEQ ID NO: 5976475 - DNA, 19 bp, Homo sapiens
gatgaggccctccacacct

SEQ ID NO: 5976476 - DNA, 12 bp, Homo sapiens
gatgaggccctg

SEQ ID NO: 5976477 - DNA, 23 bp, Homo sapiens
gatgaggccctgcaccttcccca

SEQ ID NO: 5976478 - DNA, 22 bp, Homo sapiens
gatgaggccgctagaggcctga

SEQ ID NO: 5976479 - DNA, 14 bp, Homo sapiens
gatgaggcctcttg

SEQ ID NO: 5976480 - DNA, 17 bp, Homo sapiens
gatgaggctcagagagg

SEQ ID NO: 5976481 - DNA, 17 bp, Homo sapiens
gatgaggcttcttcctg

SEQ ID NO: 5976482 - DNA, 18 bp, Homo sapiens
gatgaggcttcttcctgg

SEQ ID NO: 5976483 - DNA, 19 bp, Homo sapiens
gatgagggatgggcctggc

SEQ ID NO: 5976484 - DNA, 12 bp, Homo sapiens
gatgagggcagc

SEQ ID NO: 5976485 - DNA, 20 bp, Homo sapiens
gatgagggcagcagccagcc

SEQ ID NO: 5976486 - DNA, 21 bp, Homo sapiens
gatgagggcagcagccagccc

SEQ ID NO: 5976487 - DNA, 15 bp, Homo sapiens
gatgagggcatgtgc

SEQ ID NO: 5976488 - DNA, 20 bp, Homo sapiens
gatgaggggccactgaccca

SEQ ID NO: 5976489 - DNA, 20 bp, Homo sapiens
gatgagggggaattcctgga

SEQ ID NO: 5976490 - DNA, 22 bp, Homo sapiens
gatgagggggaattcctggaac

SEQ ID NO: 5976491 - DNA, 16 bp, Homo sapiens
gatgaggggtgctggg

SEQ ID NO: 5976492 - DNA, 14 bp, Homo sapiens
gatgagggtgactg

SEQ ID NO: 5976493 - DNA, 19 bp, Homo sapiens
gatgagggtgtccgctgct

SEQ ID NO: 5976494 - DNA, 16 bp, Homo sapiens
gatgaggtattttttc

SEQ ID NO: 5976495 - DNA, 14 bp, Homo sapiens
gatgagtcagacac

SEQ ID NO: 5976496 - DNA, 16 bp, Homo sapiens
gatgagtcttgatcta

SEQ ID NO: 5976497 - DNA, 16 bp, Homo sapiens
gatgagtgagcatgcc

SEQ ID NO: 5976498 - DNA, 23 bp, Homo sapiens
gatgagtggttttctttttcctt

SEQ ID NO: 5976499 - DNA, 18 bp, Homo sapiens
gatgagttaactgtgaaa

SEQ ID NO: 5976500 - DNA, 14 bp, Homo sapiens
gatgagttctgtcc

SEQ ID NO: 5976501 - DNA, 14 bp, Homo sapiens
gatgagttgcagtt

SEQ ID NO: 5976502 - DNA, 19 bp, Homo sapiens
gatgagttttgggaagtta

SEQ ID NO: 5976503 - DNA, 16 bp, Homo sapiens
gatgagtttttaaatg

SEQ ID NO: 5976504 - DNA, 15 bp, Homo sapiens
gatgagtttttcatt

SEQ ID NO: 5976505 - DNA, 16 bp, Homo sapiens
gatgataaacgacttt

SEQ ID NO: 5976506 - DNA, 13 bp, Homo sapiens
gatgataaaggaa

SEQ ID NO: 5976507 - DNA, 15 bp, Homo sapiens
gatgataaatattta

SEQ ID NO: 5976508 - DNA, 22 bp, Homo sapiens
gatgataaatatttatgcttaa

SEQ ID NO: 5976509 - DNA, 17 bp, Homo sapiens
gatgataacacttaaaa

SEQ ID NO: 5976510 - DNA, 12 bp, Homo sapiens
gatgataataat

SEQ ID NO: 5976511 - DNA, 18 bp, Homo sapiens
gatgatacaagattagaa

SEQ ID NO: 5976512 - DNA, 15 bp, Homo sapiens
gatgatacagtgttt

SEQ ID NO: 5976513 - DNA, 23 bp, Homo sapiens
gatgatagtccaatttttactca

SEQ ID NO: 5976514 - DNA, 15 bp, Homo sapiens
gatgatatacacagt

SEQ ID NO: 5976515 - DNA, 17 bp, Homo sapiens
gatgatattacaggact

SEQ ID NO: 5976516 - DNA, 20 bp, Homo sapiens
gatgatcaaaacctgtgcca

SEQ ID NO: 5976517 - DNA, 18 bp, Homo sapiens
gatgatcaatcctttatt

SEQ ID NO: 5976518 - DNA, 22 bp, Homo sapiens
gatgatcaattatagtttctga

SEQ ID NO: 5976519 - DNA, 16 bp, Homo sapiens
gatgatccccacgcca

SEQ ID NO: 5976520 - DNA, 20 bp, Homo sapiens
gatgatccccacgccacagc

SEQ ID NO: 5976521 - DNA, 14 bp, Homo sapiens
gatgatcctaggca

SEQ ID NO: 5976522 - DNA, 15 bp, Homo sapiens
gatgatctactcaga

SEQ ID NO: 5976523 - DNA, 13 bp, Homo sapiens
gatgatctctcca

SEQ ID NO: 5976524 - DNA, 22 bp, Homo sapiens
gatgatctctccacggtagcac

SEQ ID NO: 5976525 - DNA, 20 bp, Homo sapiens
gatgatctttgcagacaggc

SEQ ID NO: 5976526 - DNA, 22 bp, Homo sapiens
gatgatgacaggtcagcagtat

SEQ ID NO: 5976527 - DNA, 13 bp, Homo sapiens
gatgatgagggaa

SEQ ID NO: 5976528 - DNA, 23 bp, Homo sapiens
gatgatgataatgatgatgacga

SEQ ID NO: 5976529 - DNA, 13 bp, Homo sapiens
gatgatgcatgga

SEQ ID NO: 5976530 - DNA, 12 bp, Homo sapiens
gatgatgctgtg

SEQ ID NO: 5976531 - DNA, 13 bp, Homo sapiens
gatgatggaaaaa

SEQ ID NO: 5976532 - DNA, 19 bp, Homo sapiens
gatgatggggtcagcaggc

SEQ ID NO: 5976533 - DNA, 23 bp, Homo sapiens
gatgatggggtcagcaggcccag

SEQ ID NO: 5976534 - DNA, 22 bp, Homo sapiens
gatgatggggtgggagactttc

SEQ ID NO: 5976535 - DNA, 14 bp, Homo sapiens
gatgatgtctcttg

SEQ ID NO: 5976536 - DNA, 21 bp, Homo sapiens
gatgatgtgatggaacacaca

SEQ ID NO: 5976537 - DNA, 14 bp, Homo sapiens
gatgatgttttgat

SEQ ID NO: 5976538 - DNA, 16 bp, Homo sapiens
gatgattaaacacctg

SEQ ID NO: 5976539 - DNA, 12 bp, Homo sapiens
gatgattaaatt

SEQ ID NO: 5976540 - DNA, 14 bp, Homo sapiens
gatgattaaatttt

SEQ ID NO: 5976541 - DNA, 18 bp, Homo sapiens
gatgattcaaatatcaaa

SEQ ID NO: 5976542 - DNA, 15 bp, Homo sapiens
gatgattcagaaatt

SEQ ID NO: 5976543 - DNA, 23 bp, Homo sapiens
gatgattctggattctaaacaac

SEQ ID NO: 5976544 - DNA, 17 bp, Homo sapiens
gatgattcttccagata

SEQ ID NO: 5976545 - DNA, 14 bp, Homo sapiens
gatgattgaagaaa

SEQ ID NO: 5976546 - DNA, 19 bp, Homo sapiens
gatgattgacaacacccat

SEQ ID NO: 5976547 - DNA, 14 bp, Homo sapiens
gatgattgaggtgg

SEQ ID NO: 5976548 - DNA, 19 bp, Homo sapiens
gatgattgcgcagggaggg

SEQ ID NO: 5976549 - DNA, 20 bp, Homo sapiens
gatgattgcttgagctcagg

SEQ ID NO: 5976550 - DNA, 22 bp, Homo sapiens
gatgattggaggggggaggtgg

SEQ ID NO: 5976551 - DNA, 15 bp, Homo sapiens
gatgattgttctttt

SEQ ID NO: 5976552 - DNA, 17 bp, Homo sapiens
gatgatttaaaagggaa

SEQ ID NO: 5976553 - DNA, 15 bp, Homo sapiens
gatgatttaattctt

SEQ ID NO: 5976554 - DNA, 12 bp, Homo sapiens
gatgatttcaga

SEQ ID NO: 5976555 - DNA, 22 bp, Homo sapiens
gatgatttcagttctaggaaaa

SEQ ID NO: 5976556 - DNA, 22 bp, Homo sapiens
gatgatttcatcttctggaata

SEQ ID NO: 5976557 - DNA, 19 bp, Homo sapiens
gatgatttctagcaggcag

SEQ ID NO: 5976558 - DNA, 20 bp, Homo sapiens
gatgatttctagcaggcagg

SEQ ID NO: 5976559 - DNA, 13 bp, Homo sapiens
gatgatttgcaat

SEQ ID NO: 5976560 - DNA, 16 bp, Homo sapiens
gatgatttgggcagag

SEQ ID NO: 5976561 - DNA, 14 bp, Homo sapiens
gatgatttgtactt

SEQ ID NO: 5976562 - DNA, 23 bp, Homo sapiens
gatgattttgcaaaatgagttgt

SEQ ID NO: 5976563 - DNA, 20 bp, Homo sapiens
gatgattttgtaattcttat

SEQ ID NO: 5976564 - DNA, 18 bp, Homo sapiens
gatgatttttaacttttt

SEQ ID NO: 5976565 - DNA, 18 bp, Homo sapiens
gatgatttttaagtacaa

SEQ ID NO: 5976566 - DNA, 22 bp, Homo sapiens
gatgcaaactgtgcttctctat

SEQ ID NO: 5976567 - DNA, 19 bp, Homo sapiens
gatgcaaatagcaaaacta

SEQ ID NO: 5976568 - DNA, 23 bp, Homo sapiens
gatgcaaatgttttgaaatgata

SEQ ID NO: 5976569 - DNA, 22 bp, Homo sapiens
gatgcaaccaaaagggaaaaaa

SEQ ID NO: 5976570 - DNA, 20 bp, Homo sapiens
gatgcaagccagcttcctgt

SEQ ID NO: 5976571 - DNA, 20 bp, Homo sapiens
gatgcaaggattacagaaac

SEQ ID NO: 5976572 - DNA, 21 bp, Homo sapiens
gatgcaaggattacagaaact

SEQ ID NO: 5976573 - DNA, 22 bp, Homo sapiens
gatgcaaggattacagaaactg

SEQ ID NO: 5976574 - DNA, 15 bp, Homo sapiens
gatgcaaggtagcat

SEQ ID NO: 5976575 - DNA, 15 bp, Homo sapiens
gatgcaagtgtttct

SEQ ID NO: 5976576 - DNA, 21 bp, Homo sapiens
gatgcaagttattttatttgc

SEQ ID NO: 5976577 - DNA, 12 bp, Homo sapiens
gatgcaatataa

SEQ ID NO: 5976578 - DNA, 18 bp, Homo sapiens
gatgcaatcagacaagtg

SEQ ID NO: 5976579 - DNA, 13 bp, Homo sapiens
gatgcaattaaaa

SEQ ID NO: 5976580 - DNA, 14 bp, Homo sapiens
gatgcaattaaaac

SEQ ID NO: 5976581 - DNA, 21 bp, Homo sapiens
gatgcaattgttgaaagcttt

SEQ ID NO: 5976582 - DNA, 14 bp, Homo sapiens
gatgcacagagaag

SEQ ID NO: 5976583 - DNA, 19 bp, Homo sapiens
gatgcacagagaagctggg

SEQ ID NO: 5976584 - DNA, 18 bp, Homo sapiens
gatgcacagtatcttttc

SEQ ID NO: 5976585 - DNA, 13 bp, Homo sapiens
gatgcacagtgcc

SEQ ID NO: 5976586 - DNA, 15 bp, Homo sapiens
gatgcacatccctgg

SEQ ID NO: 5976587 - DNA, 16 bp, Homo sapiens
gatgcacatccctgga

SEQ ID NO: 5976588 - DNA, 13 bp, Homo sapiens
gatgcacatttct

SEQ ID NO: 5976589 - DNA, 15 bp, Homo sapiens
gatgcacatttctgg

SEQ ID NO: 5976590 - DNA, 19 bp, Homo sapiens
gatgcaccaagtacagcct

SEQ ID NO: 5976591 - DNA, 15 bp, Homo sapiens
gatgcaccagccctt

SEQ ID NO: 5976592 - DNA, 20 bp, Homo sapiens
gatgcactcgcactgcaaat

SEQ ID NO: 5976593 - DNA, 19 bp, Homo sapiens
gatgcacttattttttaat

SEQ ID NO: 5976594 - DNA, 21 bp, Homo sapiens
gatgcactttgctttaatata

SEQ ID NO: 5976595 - DNA, 15 bp, Homo sapiens
gatgcactttggaag

SEQ ID NO: 5976596 - DNA, 23 bp, Homo sapiens
gatgcagaaatgtggatgctctt

SEQ ID NO: 5976597 - DNA, 14 bp, Homo sapiens
gatgcagacacaga

SEQ ID NO: 5976598 - DNA, 20 bp, Homo sapiens
gatgcagacagggggccaga

SEQ ID NO: 5976599 - DNA, 23 bp, Homo sapiens
gatgcagacagggggccagaaca

SEQ ID NO: 5976600 - DNA, 21 bp, Homo sapiens
gatgcagaggcctgcagggcc

SEQ ID NO: 5976601 - DNA, 16 bp, Homo sapiens
gatgcagcattatgat

SEQ ID NO: 5976602 - DNA, 23 bp, Homo sapiens
gatgcagcatttgataatgataa

SEQ ID NO: 5976603 - DNA, 22 bp, Homo sapiens
gatgcagccgccttccttgacc

SEQ ID NO: 5976604 - DNA, 22 bp, Homo sapiens
gatgcagcgccgtgtcctctct

SEQ ID NO: 5976605 - DNA, 12 bp, Homo sapiens
gatgcagctact

SEQ ID NO: 5976606 - DNA, 18 bp, Homo sapiens
gatgcagctactggaatg

SEQ ID NO: 5976607 - DNA, 14 bp, Homo sapiens
gatgcagctcaaga

SEQ ID NO: 5976608 - DNA, 16 bp, Homo sapiens
gatgcagctcttcctg

SEQ ID NO: 5976609 - DNA, 15 bp, Homo sapiens
gatgcagcttatacg

SEQ ID NO: 5976610 - DNA, 20 bp, Homo sapiens
gatgcaggacaggaggcggc

SEQ ID NO: 5976611 - DNA, 23 bp, Homo sapiens
gatgcaggacaggaggcggcccg

SEQ ID NO: 5976612 - DNA, 21 bp, Homo sapiens
gatgcaggatttgttctctgt

SEQ ID NO: 5976613 - DNA, 22 bp, Homo sapiens
gatgcaggcaagacaccttccc

SEQ ID NO: 5976614 - DNA, 17 bp, Homo sapiens
gatgcaggctcccctga

SEQ ID NO: 5976615 - DNA, 22 bp, Homo sapiens
gatgcaggtcagcccatggagg

SEQ ID NO: 5976616 - DNA, 20 bp, Homo sapiens
gatgcaggtggatctccttg

SEQ ID NO: 5976617 - DNA, 22 bp, Homo sapiens
gatgcaggttggaaggggcctt

SEQ ID NO: 5976618 - DNA, 22 bp, Homo sapiens
gatgcaggtttgaccaggaaag

SEQ ID NO: 5976619 - DNA, 15 bp, Homo sapiens
gatgcagtgatgtga

SEQ ID NO: 5976620 - DNA, 14 bp, Homo sapiens
gatgcagtgcttcc

SEQ ID NO: 5976621 - DNA, 18 bp, Homo sapiens
gatgcagttttcaaatta

SEQ ID NO: 5976622 - DNA, 12 bp, Homo sapiens
gatgcatattaa

SEQ ID NO: 5976623 - DNA, 20 bp, Homo sapiens
gatgcatattaaagaaagtc

SEQ ID NO: 5976624 - DNA, 19 bp, Homo sapiens
gatgcatcacactcaagga

SEQ ID NO: 5976625 - DNA, 23 bp, Homo sapiens
gatgcatcacactcaaggacagg

SEQ ID NO: 5976626 - DNA, 16 bp, Homo sapiens
gatgcatcatctcttc

SEQ ID NO: 5976627 - DNA, 19 bp, Homo sapiens
gatgcatcgggaaagaaga

SEQ ID NO: 5976628 - DNA, 15 bp, Homo sapiens
gatgcatctgtggcc

SEQ ID NO: 5976629 - DNA, 22 bp, Homo sapiens
gatggcaactgtattaaagaaa

SEQ ID NO: 5976630 - DNA, 17 bp, Homo sapiens
gatggcacaatgaatgt

SEQ ID NO: 5976631 - DNA, 14 bp, Homo sapiens
gatggcaccagagg

SEQ ID NO: 5976632 - DNA, 15 bp, Homo sapiens
gatggcaccagaggc

SEQ ID NO: 5976633 - DNA, 23 bp, Homo sapiens
gatggcacccacacagaggacct

SEQ ID NO: 5976634 - DNA, 12 bp, Homo sapiens
gatggcaccctg

SEQ ID NO: 5976635 - DNA, 16 bp, Homo sapiens
gatggcaccctggaac

SEQ ID NO: 5976636 - DNA, 19 bp, Homo sapiens
gatggcacctgtggccaga

SEQ ID NO: 5976637 - DNA, 19 bp, Homo sapiens
gatggcactgtccagggcc

SEQ ID NO: 5976638 - DNA, 21 bp, Homo sapiens
gatggcacttagctatcagaa

SEQ ID NO: 5976639 - DNA, 12 bp, Homo sapiens
gatggcagagcc

SEQ ID NO: 5976640 - DNA, 15 bp, Homo sapiens
gatggcagatgcaca

SEQ ID NO: 5976641 - DNA, 16 bp, Homo sapiens
gatggcagatgcacat

SEQ ID NO: 5976642 - DNA, 21 bp, Homo sapiens
gatggcagatgttttggggga

SEQ ID NO: 5976643 - DNA, 13 bp, Homo sapiens
gatggcagcctca

SEQ ID NO: 5976644 - DNA, 17 bp, Homo sapiens
gatggcaggatccaagg

SEQ ID NO: 5976645 - DNA, 22 bp, Homo sapiens
gatggcaggatggcctggccag

SEQ ID NO: 5976646 - DNA, 18 bp, Homo sapiens
gatggcaggcctgaccca

SEQ ID NO: 5976647 - DNA, 16 bp, Homo sapiens
gatggcagtggctgtg

SEQ ID NO: 5976648 - DNA, 19 bp, Homo sapiens
gatggcagtgtggggaggg

SEQ ID NO: 5976649 - DNA, 23 bp, Homo sapiens
gatggcagtgtggggagggcagg

SEQ ID NO: 5976650 - DNA, 15 bp, Homo sapiens
gatggcatcctgtga

SEQ ID NO: 5976651 - DNA, 20 bp, Homo sapiens
gatggcatctagccagaggc

SEQ ID NO: 5976652 - DNA, 13 bp, Homo sapiens
gatggcattactc

SEQ ID NO: 5976653 - DNA, 24 bp, Homo sapiens
gatggcatttggtctcaggcagca

SEQ ID NO: 5976654 - DNA, 14 bp, Homo sapiens
gatggccaagagca

SEQ ID NO: 5976655 - DNA, 13 bp, Homo sapiens
gatggccagcccc

SEQ ID NO: 5976656 - DNA, 16 bp, Homo sapiens
gatggccagcccctgg

SEQ ID NO: 5976657 - DNA, 20 bp, Homo sapiens
gatggccagcccctggggcc

SEQ ID NO: 5976658 - DNA, 14 bp, Homo sapiens
gatggccaggcaag

SEQ ID NO: 5976659 - DNA, 14 bp, Homo sapiens
gatggccaggccag

SEQ ID NO: 5976660 - DNA, 19 bp, Homo sapiens
gatggccagtcatgtgctg

SEQ ID NO: 5976661 - DNA, 22 bp, Homo sapiens
gatggccagtttgaagcctgtg

SEQ ID NO: 5976662 - DNA, 14 bp, Homo sapiens
gatggccataggag

SEQ ID NO: 5976663 - DNA, 13 bp, Homo sapiens
gatggcccaaggg

SEQ ID NO: 5976664 - DNA, 16 bp, Homo sapiens
gatggcccaagggatg

SEQ ID NO: 5976665 - DNA, 18 bp, Homo sapiens
gatggcccagcaggcagg

SEQ ID NO: 5976666 - DNA, 14 bp, Homo sapiens
gatggcccatcctg

SEQ ID NO: 5976667 - DNA, 18 bp, Homo sapiens
gatggcccattctacttg

SEQ ID NO: 5976668 - DNA, 19 bp, Homo sapiens
gatggcccattctacttgc

SEQ ID NO: 5976669 - DNA, 22 bp, Homo sapiens
gatggcccattctacttgctct

SEQ ID NO: 5976670 - DNA, 12 bp, Homo sapiens
gatggccccagc

SEQ ID NO: 5976671 - DNA, 14 bp, Homo sapiens
gatggccccagcac

SEQ ID NO: 5976672 - DNA, 17 bp, Homo sapiens
gatggcccccagctggt

SEQ ID NO: 5976673 - DNA, 17 bp, Homo sapiens
gatggccccgcaaggcc

SEQ ID NO: 5976674 - DNA, 15 bp, Homo sapiens
gatggcccctccttg

SEQ ID NO: 5976675 - DNA, 17 bp, Homo sapiens
gatggcccctccttgca

SEQ ID NO: 5976676 - DNA, 20 bp, Homo sapiens
gatggcccggatgctgcttc

SEQ ID NO: 5976677 - DNA, 23 bp, Homo sapiens
gatggcccttcctcctccaccac

SEQ ID NO: 5976678 - DNA, 18 bp, Homo sapiens
gatggccgtggatggccg

SEQ ID NO: 5976679 - DNA, 11 bp, Homo sapiens
gatggcctctg

SEQ ID NO: 5976680 - DNA, 16 bp, Homo sapiens
gatggcctctggggca

SEQ ID NO: 5976681 - DNA, 18 bp, Homo sapiens
gatggcctctggggcagg

SEQ ID NO: 5976682 - DNA, 16 bp, Homo sapiens
gatggcctggaaccca

SEQ ID NO: 5976683 - DNA, 20 bp, Homo sapiens
gatggcctggccagggcctg

SEQ ID NO: 5976684 - DNA, 21 bp, Homo sapiens
gatggcctggccagggcctgg

SEQ ID NO: 5976685 - DNA, 18 bp, Homo sapiens
gatggcctggccttggct

SEQ ID NO: 5976686 - DNA, 14 bp, Homo sapiens
gatggcctggctgc

SEQ ID NO: 5976687 - DNA, 18 bp, Homo sapiens
gatggcctggctgcctgg

SEQ ID NO: 5976688 - DNA, 14 bp, Homo sapiens
gatggcctttcctt

SEQ ID NO: 5976689 - DNA, 17 bp, Homo sapiens
gatggcctttccttccc

SEQ ID NO: 5976690 - DNA, 18 bp, Homo sapiens
gatggcctttccttccct

SEQ ID NO: 5976691 - DNA, 17 bp, Homo sapiens
gatggcgtgtcccctgc

SEQ ID NO: 5976692 - DNA, 22 bp, Homo sapiens
gatggcgtgtcccctgcctgtg

SEQ ID NO: 5976693 - DNA, 17 bp, Homo sapiens
gatggctatgccttgca

SEQ ID NO: 5976694 - DNA, 24 bp, Homo sapiens
gatggctcagagggggactgctgc

SEQ ID NO: 5976695 - DNA, 18 bp, Homo sapiens
gatggctcccaaggttcc

SEQ ID NO: 5976696 - DNA, 13 bp, Homo sapiens
gatggctccctgg

SEQ ID NO: 5976697 - DNA, 15 bp, Homo sapiens
gatggctccctgggc

SEQ ID NO: 5976698 - DNA, 17 bp, Homo sapiens
gatggctccctgggctg

SEQ ID NO: 5976699 - DNA, 18 bp, Homo sapiens
gatggctccctgggctgg

SEQ ID NO: 5976700 - DNA, 20 bp, Homo sapiens
gatggctccctgggctggca

SEQ ID NO: 5976701 - DNA, 21 bp, Homo sapiens
gatggctccctgggctggcat

SEQ ID NO: 5976702 - DNA, 14 bp, Homo sapiens
gatggctcctctca

SEQ ID NO: 5976703 - DNA, 13 bp, Homo sapiens
gatggctgcccct

SEQ ID NO: 5976704 - DNA, 14 bp, Homo sapiens
gatggctgctgcct

SEQ ID NO: 5976705 - DNA, 17 bp, Homo sapiens
gatggctgctgctcacc

SEQ ID NO: 5976706 - DNA, 19 bp, Homo sapiens
gatggctggaaggagccag

SEQ ID NO: 5976707 - DNA, 16 bp, Homo sapiens
gatggctgtcgcctgt

SEQ ID NO: 5976708 - DNA, 21 bp, Homo sapiens
gatggctgtggcatttccaaa

SEQ ID NO: 5976709 - DNA, 14 bp, Homo sapiens
gatggcttatgtca

SEQ ID NO: 5976710 - DNA, 16 bp, Homo sapiens
gatggcttcggagggc

SEQ ID NO: 5976711 - DNA, 14 bp, Homo sapiens
gatggctttcaggg

SEQ ID NO: 5976712 - DNA, 20 bp, Homo sapiens
gatgggaaaaactgcagtca

SEQ ID NO: 5976713 - DNA, 14 bp, Homo sapiens
gatgggaaaatatt

SEQ ID NO: 5976714 - DNA, 18 bp, Homo sapiens
gatgggaaaatatttcct

SEQ ID NO: 5976715 - DNA, 17 bp, Homo sapiens
gatgggaacaaggaagg

SEQ ID NO: 5976716 - DNA, 20 bp, Homo sapiens
gatgggaacaaggaaggaaa

SEQ ID NO: 5976717 - DNA, 17 bp, Homo sapiens
gatgggaacagtaaaga

SEQ ID NO: 5976718 - DNA, 21 bp, Homo sapiens
gatgggaacgcagatgatcca

SEQ ID NO: 5976719 - DNA, 19 bp, Homo sapiens
gatgggaagatggtagcag

SEQ ID NO: 5976720 - DNA, 20 bp, Homo sapiens
gatgggaatagggagacagg

SEQ ID NO: 5976721 - DNA, 13 bp, Homo sapiens
gatgggaatgaag

SEQ ID NO: 5976722 - DNA, 16 bp, Homo sapiens
gatgggaatgaagctt

SEQ ID NO: 5976723 - DNA, 19 bp, Homo sapiens
gatgggacaagcagtccct

SEQ ID NO: 5976724 - DNA, 22 bp, Homo sapiens
gatgggacaattagataaatgt

SEQ ID NO: 5976725 - DNA, 17 bp, Homo sapiens
gatgggacagggaggcc

SEQ ID NO: 5976726 - DNA, 16 bp, Homo sapiens
gatgggactcattgta

SEQ ID NO: 5976727 - DNA, 20 bp, Homo sapiens
gatgggactccatagctcct

SEQ ID NO: 5976728 - DNA, 15 bp, Homo sapiens
gatgggactgggagg

SEQ ID NO: 5976729 - DNA, 17 bp, Homo sapiens
gatgggactgggagggc

SEQ ID NO: 5976730 - DNA, 15 bp, Homo sapiens
gatgggactgtgtcc

SEQ ID NO: 5976731 - DNA, 21 bp, Homo sapiens
gatgggagctcctctcctgga

SEQ ID NO: 5976732 - DNA, 22 bp, Homo sapiens
gatgggagctcctctcctggag

SEQ ID NO: 5976733 - DNA, 20 bp, Homo sapiens
gatgggaggaaagagagcag

SEQ ID NO: 5976734 - DNA, 21 bp, Homo sapiens
gatgggaggagagccactggg

SEQ ID NO: 5976735 - DNA, 14 bp, Homo sapiens
gatgggaggctcct

SEQ ID NO: 5976736 - DNA, 15 bp, Homo sapiens
gatgggaggctcctg

SEQ ID NO: 5976737 - DNA, 17 bp, Homo sapiens
gatgggaggtgtgccag

SEQ ID NO: 5976738 - DNA, 19 bp, Homo sapiens
gatgggagtaggctccaga

SEQ ID NO: 5976739 - DNA, 19 bp, Homo sapiens
gatgggagtgggcacctca

SEQ ID NO: 5976740 - DNA, 16 bp, Homo sapiens
gatgggatcattattt

SEQ ID NO: 5976741 - DNA, 15 bp, Homo sapiens
gatgggatcctctcc

SEQ ID NO: 5976742 - DNA, 14 bp, Homo sapiens
gatgggatttttgt

SEQ ID NO: 5976743 - DNA, 18 bp, Homo sapiens
gatgggatttttgtttga

SEQ ID NO: 5976744 - DNA, 20 bp, Homo sapiens
gatgggcaacccccagcctg

SEQ ID NO: 5976745 - DNA, 18 bp, Homo sapiens
gatgggcacaggctgccc

SEQ ID NO: 5976746 - DNA, 15 bp, Homo sapiens
gatgggcacttgaga

SEQ ID NO: 5976747 - DNA, 22 bp, Homo sapiens
gatgggcagatcttttctttaa

SEQ ID NO: 5976748 - DNA, 14 bp, Homo sapiens
gatgggcagcccaa

SEQ ID NO: 5976749 - DNA, 23 bp, Homo sapiens
gatgggcagcccaacagcacttt

SEQ ID NO: 5976750 - DNA, 20 bp, Homo sapiens
gatgggcatggtgttctcct

SEQ ID NO: 5976751 - DNA, 18 bp, Homo sapiens
gatgggcattgggctgac

SEQ ID NO: 5976752 - DNA, 15 bp, Homo sapiens
gatgggccaccgccg

SEQ ID NO: 5976753 - DNA, 21 bp, Homo sapiens
gatgggccacggctgagcctt

SEQ ID NO: 5976754 - DNA, 12 bp, Homo sapiens
gatgggccaggg

SEQ ID NO: 5976755 - DNA, 10 bp, Homo sapiens
gatgggcctg

SEQ ID NO: 5976756 - DNA, 18 bp, Homo sapiens
gatgggcctgagtgagag

SEQ ID NO: 5976757 - DNA, 20 bp, Homo sapiens
gatgggcctgcttcctgtct

SEQ ID NO: 5976758 - DNA, 16 bp, Homo sapiens
gatgggctctacctct

SEQ ID NO: 5976759 - DNA, 22 bp, Homo sapiens
gatgggctctacctctctttct

SEQ ID NO: 5976760 - DNA, 18 bp, Homo sapiens
gatgggctggggcagggg

SEQ ID NO: 5976761 - DNA, 23 bp, Homo sapiens
gatgggctggggcaggggcctgg

SEQ ID NO: 5976762 - DNA, 21 bp, Homo sapiens
gatgggctgtttcgtgtagtg

SEQ ID NO: 5976763 - DNA, 23 bp, Homo sapiens
gatgggcttctgttctctgctga

SEQ ID NO: 5976764 - DNA, 14 bp, Homo sapiens
gatggggaaggagg

SEQ ID NO: 5976765 - DNA, 19 bp, Homo sapiens
gatggggaatccgtgtgtg

SEQ ID NO: 5976766 - DNA, 21 bp, Homo sapiens
gatggggactctgccgctgtg

SEQ ID NO: 5976767 - DNA, 21 bp, Homo sapiens
gatggggagatcggggccaga

SEQ ID NO: 5976768 - DNA, 11 bp, Homo sapiens
gatggggaggg

SEQ ID NO: 5976769 - DNA, 13 bp, Homo sapiens
gatggggagggaa

SEQ ID NO: 5976770 - DNA, 18 bp, Homo sapiens
gatggggagtcccaaagc

SEQ ID NO: 5976771 - DNA, 22 bp, Homo sapiens
gatggggataaaatgactactt

SEQ ID NO: 5976772 - DNA, 23 bp, Homo sapiens
gatggggataaaatgactactta

SEQ ID NO: 5976773 - DNA, 15 bp, Homo sapiens
gatggggcagagctt

SEQ ID NO: 5976774 - DNA, 20 bp, Homo sapiens
gatggggcatataataaaga

SEQ ID NO: 5976775 - DNA, 13 bp, Homo sapiens
gatggggccacag

SEQ ID NO: 5976776 - DNA, 14 bp, Homo sapiens
gatggggccacagc

SEQ ID NO: 5976777 - DNA, 15 bp, Homo sapiens
gatggggccacagcc

SEQ ID NO: 5976778 - DNA, 20 bp, Homo sapiens
gatggggccatctccttcac

SEQ ID NO: 5976779 - DNA, 13 bp, Homo sapiens
gatggggccctgc

SEQ ID NO: 5976780 - DNA, 14 bp, Homo sapiens
gatggggccctgcc

SEQ ID NO: 5976781 - DNA, 14 bp, Homo sapiens
gatggggcctccct

SEQ ID NO: 5976782 - DNA, 20 bp, Homo sapiens
gatggggcctgggctgttgt

SEQ ID NO: 5976783 - DNA, 19 bp, Homo sapiens
gatggggcggcctgcagac

SEQ ID NO: 5976784 - DNA, 15 bp, Homo sapiens
gatggggctcccagc

SEQ ID NO: 5976785 - DNA, 19 bp, Homo sapiens
gatggggctgcaccggctg

SEQ ID NO: 5976786 - DNA, 21 bp, Homo sapiens
gatgggggaaagcacaggtgg

SEQ ID NO: 5976787 - DNA, 19 bp, Homo sapiens
gatgggggaactcagatcc

SEQ ID NO: 5976788 - DNA, 20 bp, Homo sapiens
gatgggggaactcagatcca

SEQ ID NO: 5976789 - DNA, 18 bp, Homo sapiens
gatgggggacgagggcca

SEQ ID NO: 5976790 - DNA, 20 bp, Homo sapiens
gatgggggacgagggccagg

SEQ ID NO: 5976791 - DNA, 13 bp, Homo sapiens
gatgggggagagg

SEQ ID NO: 5976792 - DNA, 15 bp, Homo sapiens
gatgggggatgcttc

SEQ ID NO: 5976793 - DNA, 17 bp, Homo sapiens
gatgggggatgggccag

SEQ ID NO: 5976794 - DNA, 20 bp, Homo sapiens
gatgggggctcctggcagtg

SEQ ID NO: 5976795 - DNA, 16 bp, Homo sapiens
gatggggggatttttt

SEQ ID NO: 5976796 - DNA, 22 bp, Homo sapiens
gatgggggtgaagtatgtcttc

SEQ ID NO: 5976797 - DNA, 15 bp, Homo sapiens
gatggggtcagcagg

SEQ ID NO: 5976798 - DNA, 20 bp, Homo sapiens
gatggggtcagcaggcccag

SEQ ID NO: 5976799 - DNA, 23 bp, Homo sapiens
gatggggtctgtgactggatctt

SEQ ID NO: 5976800 - DNA, 23 bp, Homo sapiens
gatggggtgagaagtacagggca

SEQ ID NO: 5976801 - DNA, 14 bp, Homo sapiens
gatggggtgggcag

SEQ ID NO: 5976802 - DNA, 16 bp, Homo sapiens
gatggggtgggcaggg

SEQ ID NO: 5976803 - DNA, 22 bp, Homo sapiens
gatggggtggggtggagaactc

SEQ ID NO: 5976804 - DNA, 15 bp, Homo sapiens
gatggggttctggaa

SEQ ID NO: 5976805 - DNA, 17 bp, Homo sapiens
gatggggttgggctctg

SEQ ID NO: 5976806 - DNA, 14 bp, Homo sapiens
agaatgtagccatt

SEQ ID NO: 5976807 - DNA, 17 bp, Homo sapiens
agaatgtaggctggtcc

SEQ ID NO: 5976808 - DNA, 19 bp, Homo sapiens
agaatgtaggctggtccct

SEQ ID NO: 5976809 - DNA, 18 bp, Homo sapiens
agaatgtagtttgaggaa

SEQ ID NO: 5976810 - DNA, 17 bp, Homo sapiens
agaatgtatctcctcct

SEQ ID NO: 5976811 - DNA, 16 bp, Homo sapiens
agaatgtatctgtgaa

SEQ ID NO: 5976812 - DNA, 16 bp, Homo sapiens
agaatgtattctgtat

SEQ ID NO: 5976813 - DNA, 16 bp, Homo sapiens
agaatgtattgtacct

SEQ ID NO: 5976814 - DNA, 11 bp, Homo sapiens
agaatgtattt

SEQ ID NO: 5976815 - DNA, 20 bp, Homo sapiens
agaatgtcaataaatttgct

SEQ ID NO: 5976816 - DNA, 18 bp, Homo sapiens
agaatgtcaccagtcctg

SEQ ID NO: 5976817 - DNA, 15 bp, Homo sapiens
agaatgtcagaaaaa

SEQ ID NO: 5976818 - DNA, 17 bp, Homo sapiens
agaatgtcagaaaaaca

SEQ ID NO: 5976819 - DNA, 18 bp, Homo sapiens
agaatgtcagattccttt

SEQ ID NO: 5976820 - DNA, 16 bp, Homo sapiens
agaatgtcagatttct

SEQ ID NO: 5976821 - DNA, 20 bp, Homo sapiens
agaatgtcagatttctggtt

SEQ ID NO: 5976822 - DNA, 13 bp, Homo sapiens
agaatgtcagtat

SEQ ID NO: 5976823 - DNA, 16 bp, Homo sapiens
agaatgtccttattct

SEQ ID NO: 5976824 - DNA, 17 bp, Homo sapiens
agaatgtccttattctt

SEQ ID NO: 5976825 - DNA, 15 bp, Homo sapiens
agaatgtctccattg

SEQ ID NO: 5976826 - DNA, 21 bp, Homo sapiens
agaatgtctgaagtacaaaca

SEQ ID NO: 5976827 - DNA, 13 bp, Homo sapiens
agaatgtgaaaaa

SEQ ID NO: 5976828 - DNA, 19 bp, Homo sapiens
agaatgtgaaaaaggaata

SEQ ID NO: 5976829 - DNA, 21 bp, Homo sapiens
agaatgtgcaaagcagtatgt

SEQ ID NO: 5976830 - DNA, 16 bp, Homo sapiens
agaatgtgcagtgtct

SEQ ID NO: 5976831 - DNA, 20 bp, Homo sapiens
agaatgtgcagtgtcttgta

SEQ ID NO: 5976832 - DNA, 14 bp, Homo sapiens
agaatgtgccatgt

SEQ ID NO: 5976833 - DNA, 15 bp, Homo sapiens
agaatgtgccatgta

SEQ ID NO: 5976834 - DNA, 16 bp, Homo sapiens
agaatgtgccatgtat

SEQ ID NO: 5976835 - DNA, 14 bp, Homo sapiens
agaatgtgctgcct

SEQ ID NO: 5976836 - DNA, 21 bp, Homo sapiens
agaatgtggatttgattcatt

SEQ ID NO: 5976837 - DNA, 16 bp, Homo sapiens
agaatgtggccactta

SEQ ID NO: 5976838 - DNA, 14 bp, Homo sapiens
agaatgtgtctcag

SEQ ID NO: 5976839 - DNA, 17 bp, Homo sapiens
agaatgtgtgtgcagaa

SEQ ID NO: 5976840 - DNA, 13 bp, Homo sapiens
agaatgtgttctt

SEQ ID NO: 5976841 - DNA, 20 bp, Homo sapiens
agaatgtgttcttttctcct

SEQ ID NO: 5976842 - DNA, 14 bp, Homo sapiens
agaatgttaagact

SEQ ID NO: 5976843 - DNA, 21 bp, Homo sapiens
agaatgttaagacttgacagt

SEQ ID NO: 5976844 - DNA, 20 bp, Homo sapiens
agaatgttaccagacttcaa

SEQ ID NO: 5976845 - DNA, 22 bp, Homo sapiens
agaatgttactgactcctcagt

SEQ ID NO: 5976846 - DNA, 23 bp, Homo sapiens
agaatgttactttggaatgacta

SEQ ID NO: 5976847 - DNA, 15 bp, Homo sapiens
agaatgttagagcac

SEQ ID NO: 5976848 - DNA, 16 bp, Homo sapiens
agaatgttagagcaca

SEQ ID NO: 5976849 - DNA, 17 bp, Homo sapiens
agaatgttagtaaagga

SEQ ID NO: 5976850 - DNA, 13 bp, Homo sapiens
agaatgttccaga

SEQ ID NO: 5976851 - DNA, 23 bp, Homo sapiens
agaatgttcccaatttgaattta

SEQ ID NO: 5976852 - DNA, 22 bp, Homo sapiens
agaatgttcctactcacacttc

SEQ ID NO: 5976853 - DNA, 19 bp, Homo sapiens
agaatgttgaatacttata

SEQ ID NO: 5976854 - DNA, 16 bp, Homo sapiens
agaatgttggtttact

SEQ ID NO: 5976855 - DNA, 14 bp, Homo sapiens
agaatgttgtgttg

SEQ ID NO: 5976856 - DNA, 15 bp, Homo sapiens
agaatgtttcatttg

SEQ ID NO: 5976857 - DNA, 14 bp, Homo sapiens
agaatgtttctatt

SEQ ID NO: 5976858 - DNA, 12 bp, Homo sapiens
agaatgttttca

SEQ ID NO: 5976859 - DNA, 15 bp, Homo sapiens
agaatgttttcaaat

SEQ ID NO: 5976860 - DNA, 16 bp, Homo sapiens
agaatgttttccttct

SEQ ID NO: 5976861 - DNA, 12 bp, Homo sapiens
agaattaaaact

SEQ ID NO: 5976862 - DNA, 16 bp, Homo sapiens
agaattaaaactgagt

SEQ ID NO: 5976863 - DNA, 23 bp, Homo sapiens
agaattaaaactgagtccatgaa

SEQ ID NO: 5976864 - DNA, 13 bp, Homo sapiens
agaattaaaataa

SEQ ID NO: 5976865 - DNA, 14 bp, Homo sapiens
agaattaaactttt

SEQ ID NO: 5976866 - DNA, 20 bp, Homo sapiens
agaattaaacttttaattca

SEQ ID NO: 5976867 - DNA, 21 bp, Homo sapiens
agaattaaacttttaattcat

SEQ ID NO: 5976868 - DNA, 15 bp, Homo sapiens
agaattaacacatga

SEQ ID NO: 5976869 - DNA, 23 bp, Homo sapiens
agaattaagaaatactcatgtgc

SEQ ID NO: 5976870 - DNA, 21 bp, Homo sapiens
agaattaagccctaaggtcct

SEQ ID NO: 5976871 - DNA, 20 bp, Homo sapiens
agaattaagttttaaataaa

SEQ ID NO: 5976872 - DNA, 13 bp, Homo sapiens
agaattaatgcat

SEQ ID NO: 5976873 - DNA, 15 bp, Homo sapiens
agaattaatggtcat

SEQ ID NO: 5976874 - DNA, 14 bp, Homo sapiens
agaattaatttatt

SEQ ID NO: 5976875 - DNA, 20 bp, Homo sapiens
agaattacaggaaatgcaaa

SEQ ID NO: 5976876 - DNA, 18 bp, Homo sapiens
agaattaccaagagaagg

SEQ ID NO: 5976877 - DNA, 19 bp, Homo sapiens
agaattaccaagagaaggg

SEQ ID NO: 5976878 - DNA, 19 bp, Homo sapiens
agaattaccattaattaca

SEQ ID NO: 5976879 - DNA, 18 bp, Homo sapiens
agaattaccatttgttaa

SEQ ID NO: 5976880 - DNA, 19 bp, Homo sapiens
agaattacccctatacctg

SEQ ID NO: 5976881 - DNA, 14 bp, Homo sapiens
agaattactgtaac

SEQ ID NO: 5976882 - DNA, 13 bp, Homo sapiens
agaattactgttt

SEQ ID NO: 5976883 - DNA, 16 bp, Homo sapiens
agaattactgtttgaa

SEQ ID NO: 5976884 - DNA, 23 bp, Homo sapiens
agaattacttatattcatctatt

SEQ ID NO: 5976885 - DNA, 13 bp, Homo sapiens
agaattagccaac

SEQ ID NO: 5976886 - DNA, 16 bp, Homo sapiens
agaattagctgcttct

SEQ ID NO: 5976887 - DNA, 11 bp, Homo sapiens
agaattagctt

SEQ ID NO: 5976888 - DNA, 15 bp, Homo sapiens
agaattaggaaggcc

SEQ ID NO: 5976889 - DNA, 18 bp, Homo sapiens
agaattaggaaggccatg

SEQ ID NO: 5976890 - DNA, 15 bp, Homo sapiens
agaattagtatgtct

SEQ ID NO: 5976891 - DNA, 19 bp, Homo sapiens
agaattagtatgtctgttt

SEQ ID NO: 5976892 - DNA, 23 bp, Homo sapiens
agaattataacagcaaggaaaca

SEQ ID NO: 5976893 - DNA, 20 bp, Homo sapiens
agaattataattagttcctc

SEQ ID NO: 5976894 - DNA, 16 bp, Homo sapiens
agaattatatatttct

SEQ ID NO: 5976895 - DNA, 21 bp, Homo sapiens
agaattatatctaatttatac

SEQ ID NO: 5976896 - DNA, 16 bp, Homo sapiens
agaattatccattacg

SEQ ID NO: 5976897 - DNA, 23 bp, Homo sapiens
agaattatctcaagtaaaacaaa

SEQ ID NO: 5976898 - DNA, 19 bp, Homo sapiens
agaattatgaggcattgag

SEQ ID NO: 5976899 - DNA, 21 bp, Homo sapiens
agaattatgtaatatattgta

SEQ ID NO: 5976900 - DNA, 19 bp, Homo sapiens
agaattattcagtgaattt

SEQ ID NO: 5976901 - DNA, 11 bp, Homo sapiens
agaattattta

SEQ ID NO: 5976902 - DNA, 21 bp, Homo sapiens
agaattatttcacaaataata

SEQ ID NO: 5976903 - DNA, 13 bp, Homo sapiens
agaattattttgt

SEQ ID NO: 5976904 - DNA, 15 bp, Homo sapiens
agaattattttgtga

SEQ ID NO: 5976905 - DNA, 23 bp, Homo sapiens
agaattatttttaaaaagaaatc

SEQ ID NO: 5976906 - DNA, 20 bp, Homo sapiens
agaattatttttgagcagga

SEQ ID NO: 5976907 - DNA, 23 bp, Homo sapiens
agaattatttttgagcaggagca

SEQ ID NO: 5976908 - DNA, 14 bp, Homo sapiens
agaattatttttgt

SEQ ID NO: 5976909 - DNA, 16 bp, Homo sapiens
agaattatttttgtgt

SEQ ID NO: 5976910 - DNA, 20 bp, Homo sapiens
agaattcaaactggggcctc

SEQ ID NO: 5976911 - DNA, 20 bp, Homo sapiens
agaattcaaatcctcttttg

SEQ ID NO: 5976912 - DNA, 12 bp, Homo sapiens
agaattcaaatt

SEQ ID NO: 5976913 - DNA, 17 bp, Homo sapiens
agaattcaaattttatc

SEQ ID NO: 5976914 - DNA, 12 bp, Homo sapiens
agaattcacttt

SEQ ID NO: 5976915 - DNA, 13 bp, Homo sapiens
agaattcagctgc

SEQ ID NO: 5976916 - DNA, 15 bp, Homo sapiens
agaattcatgatgct

SEQ ID NO: 5976917 - DNA, 13 bp, Homo sapiens
agaattcattcat

SEQ ID NO: 5976918 - DNA, 21 bp, Homo sapiens
agaattcattcatacttaaaa

SEQ ID NO: 5976919 - DNA, 19 bp, Homo sapiens
agaattcattccccagctc

SEQ ID NO: 5976920 - DNA, 21 bp, Homo sapiens
agaattccagtcccctttctc

SEQ ID NO: 5976921 - DNA, 20 bp, Homo sapiens
agaattccagttgtatttga

SEQ ID NO: 5976922 - DNA, 19 bp, Homo sapiens
agaattccctctctctgac

SEQ ID NO: 5976923 - DNA, 20 bp, Homo sapiens
agaattccctctctctgact

SEQ ID NO: 5976924 - DNA, 12 bp, Homo sapiens
agaattccctgt

SEQ ID NO: 5976925 - DNA, 21 bp, Homo sapiens
agaattcccttgaattgtgta

SEQ ID NO: 5976926 - DNA, 22 bp, Homo sapiens
agaattcccttgaattgtgtat

SEQ ID NO: 5976927 - DNA, 18 bp, Homo sapiens
agaattcctgaagccaga

SEQ ID NO: 5976928 - DNA, 12 bp, Homo sapiens
agaattccttca

SEQ ID NO: 5976929 - DNA, 13 bp, Homo sapiens
agaattccttcga

SEQ ID NO: 5976930 - DNA, 14 bp, Homo sapiens
agaattcgaaggct

SEQ ID NO: 5976931 - DNA, 19 bp, Homo sapiens
agaattcggtgtgctgcca

SEQ ID NO: 5976932 - DNA, 22 bp, Homo sapiens
agaattcggtgtgctgccaact

SEQ ID NO: 5976933 - DNA, 15 bp, Homo sapiens
agaattctagaaaat

SEQ ID NO: 5976934 - DNA, 12 bp, Homo sapiens
agaattctagct

SEQ ID NO: 5976935 - DNA, 18 bp, Homo sapiens
agaattctgattgatttg

SEQ ID NO: 5976936 - DNA, 13 bp, Homo sapiens
agaattctgctac

SEQ ID NO: 5976937 - DNA, 19 bp, Homo sapiens
agaattctgggaaccctgt

SEQ ID NO: 5976938 - DNA, 14 bp, Homo sapiens
agaattctggtcct

SEQ ID NO: 5976939 - DNA, 12 bp, Homo sapiens
agaattctgtat

SEQ ID NO: 5976940 - DNA, 14 bp, Homo sapiens
agaattctgtatag

SEQ ID NO: 5976941 - DNA, 23 bp, Homo sapiens
agaattctgttctaaaactccaa

SEQ ID NO: 5976942 - DNA, 16 bp, Homo sapiens
agaattcttacatgtt

SEQ ID NO: 5976943 - DNA, 23 bp, Homo sapiens
agaattcttacatgttttctttg

SEQ ID NO: 5976944 - DNA, 17 bp, Homo sapiens
agaattcttatgcttat

SEQ ID NO: 5976945 - DNA, 14 bp, Homo sapiens
agaattctttttac

SEQ ID NO: 5976946 - DNA, 15 bp, Homo sapiens
agaattgaaaatgca

SEQ ID NO: 5976947 - DNA, 21 bp, Homo sapiens
agaattgaaccgtcaatgtga

SEQ ID NO: 5976948 - DNA, 13 bp, Homo sapiens
agaattgaaggtt

SEQ ID NO: 5976949 - DNA, 14 bp, Homo sapiens
agaattgaaggttt

SEQ ID NO: 5976950 - DNA, 21 bp, Homo sapiens
agaattgaaggtttttgatag

SEQ ID NO: 5976951 - DNA, 16 bp, Homo sapiens
agaattgaattggaaa

SEQ ID NO: 5976952 - DNA, 17 bp, Homo sapiens
agaattgaattggaaag

SEQ ID NO: 5976953 - DNA, 22 bp, Homo sapiens
agaattgactgaagcacagcac

SEQ ID NO: 5976954 - DNA, 19 bp, Homo sapiens
agaattgagcagttctgtt

SEQ ID NO: 5976955 - DNA, 18 bp, Homo sapiens
agaattgagtaatggtgt

SEQ ID NO: 5976956 - DNA, 17 bp, Homo sapiens
agaattgagtgtttaaa

SEQ ID NO: 5976957 - DNA, 20 bp, Homo sapiens
agaattgatatacacggatg

SEQ ID NO: 5976958 - DNA, 15 bp, Homo sapiens
agaattgatcagaat

SEQ ID NO: 5976959 - DNA, 16 bp, Homo sapiens
agaattgattgggcac

SEQ ID NO: 5976960 - DNA, 21 bp, Homo sapiens
agaattgattttttttctctc

SEQ ID NO: 5976961 - DNA, 19 bp, Homo sapiens
agaattgcacacagatgtg

SEQ ID NO: 5976962 - DNA, 14 bp, Homo sapiens
agaattgccaatct

SEQ ID NO: 5976963 - DNA, 17 bp, Homo sapiens
agaattgccaatcttgt

SEQ ID NO: 5976964 - DNA, 21 bp, Homo sapiens
agaattgccaatcttgtttta

SEQ ID NO: 5976965 - DNA, 23 bp, Homo sapiens
agaattgccttaaggccacactg

SEQ ID NO: 5976966 - DNA, 22 bp, Homo sapiens
agaattgctgattcttgagttt

SEQ ID NO: 5976967 - DNA, 21 bp, Homo sapiens
agaattgctggatgcattttt

SEQ ID NO: 5976968 - DNA, 21 bp, Homo sapiens
agaattgcttgaacccaggag

SEQ ID NO: 5976969 - DNA, 17 bp, Homo sapiens
agaattggcataatttg

SEQ ID NO: 5976970 - DNA, 18 bp, Homo sapiens
agaattggcataatttgt

SEQ ID NO: 5976971 - DNA, 20 bp, Homo sapiens
agaattggccatcttaaaaa

SEQ ID NO: 5976972 - DNA, 12 bp, Homo sapiens
agaattggcctc

SEQ ID NO: 5976973 - DNA, 16 bp, Homo sapiens
agaattggctcaataa

SEQ ID NO: 5976974 - DNA, 21 bp, Homo sapiens
agaattggctgaactcatgag

SEQ ID NO: 5976975 - DNA, 22 bp, Homo sapiens
agaattggctgaactcatgaga

SEQ ID NO: 5976976 - DNA, 21 bp, Homo sapiens
agaattgggcccttagaatgt

SEQ ID NO: 5976977 - DNA, 13 bp, Homo sapiens
agaattgggcggc

SEQ ID NO: 5976978 - DNA, 22 bp, Homo sapiens
agaattgtatatcattttgcca

SEQ ID NO: 5976979 - DNA, 22 bp, Homo sapiens
agaattgtatctcatactgtct

SEQ ID NO: 5976980 - DNA, 23 bp, Homo sapiens
agaattgtatctcatactgtctg

SEQ ID NO: 5976981 - DNA, 23 bp, Homo sapiens
agaattgtccatgtgcttcccta

SEQ ID NO: 5976982 - DNA, 22 bp, Homo sapiens
agaattgtgcgacttcacaaaa

SEQ ID NO: 5976983 - DNA, 23 bp, Homo sapiens
agaattgtggtttatatatttaa

SEQ ID NO: 5976984 - DNA, 18 bp, Homo sapiens
agacagaatgagagagaa

SEQ ID NO: 5976985 - DNA, 19 bp, Homo sapiens
agacagaatggtggagtgt

SEQ ID NO: 5976986 - DNA, 21 bp, Homo sapiens
agacagacacacactggctcc

SEQ ID NO: 5976987 - DNA, 14 bp, Homo sapiens
agacagacacacag

SEQ ID NO: 5976988 - DNA, 19 bp, Homo sapiens
agacagacaccacagcctc

SEQ ID NO: 5976989 - DNA, 17 bp, Homo sapiens
agacagaccacttgcca

SEQ ID NO: 5976990 - DNA, 17 bp, Homo sapiens
agacagacccagtgagt

SEQ ID NO: 5976991 - DNA, 19 bp, Homo sapiens
agacagaccccttggcttt

SEQ ID NO: 5976992 - DNA, 20 bp, Homo sapiens
agacagaccccttggctttt

SEQ ID NO: 5976993 - DNA, 21 bp, Homo sapiens
agacagaccggggttcaagcc

SEQ ID NO: 5976994 - DNA, 18 bp, Homo sapiens
agacagacgcctgctttt

SEQ ID NO: 5976995 - DNA, 20 bp, Homo sapiens
agacagacggacgggacagc

SEQ ID NO: 5976996 - DNA, 22 bp, Homo sapiens
agacagagaaaacttgcctttc

SEQ ID NO: 5976997 - DNA, 14 bp, Homo sapiens
agacagagaatctt

SEQ ID NO: 5976998 - DNA, 12 bp, Homo sapiens
agacagagacag

SEQ ID NO: 5976999 - DNA, 19 bp, Homo sapiens
agacagagacctcctgcct

SEQ ID NO: 5977000 - DNA, 11 bp, Homo sapiens
agacagagatg

SEQ ID NO: 5977001 - DNA, 14 bp, Homo sapiens
agacagagcaggct

SEQ ID NO: 5977002 - DNA, 15 bp, Homo sapiens
agacagagcaggctt

SEQ ID NO: 5977003 - DNA, 21 bp, Homo sapiens
agacagagcaggctttgtgag

SEQ ID NO: 5977004 - DNA, 22 bp, Homo sapiens
agacagagccaagcactgctca

SEQ ID NO: 5977005 - DNA, 13 bp, Homo sapiens
agacagagccagg

SEQ ID NO: 5977006 - DNA, 21 bp, Homo sapiens
agacagagccaggagaagctc

SEQ ID NO: 5977007 - DNA, 20 bp, Homo sapiens
agacagagcccccaagcctc

SEQ ID NO: 5977008 - DNA, 22 bp, Homo sapiens
agacagagcccccaagcctctg

SEQ ID NO: 5977009 - DNA, 19 bp, Homo sapiens
agacagagccctgtgaggc

SEQ ID NO: 5977010 - DNA, 19 bp, Homo sapiens
agacagagcgacagagcag

SEQ ID NO: 5977011 - DNA, 21 bp, Homo sapiens
agacagagctggttgggaaga

SEQ ID NO: 5977012 - DNA, 14 bp, Homo sapiens
agacagaggcaggg

SEQ ID NO: 5977013 - DNA, 15 bp, Homo sapiens
agacagaggggagca

SEQ ID NO: 5977014 - DNA, 16 bp, Homo sapiens
agacagaggtttcatt

SEQ ID NO: 5977015 - DNA, 20 bp, Homo sapiens
agacagagtctcactgttgc

SEQ ID NO: 5977016 - DNA, 19 bp, Homo sapiens
agacagagtcttactctgt

SEQ ID NO: 5977017 - DNA, 20 bp, Homo sapiens
agacagagtcttcctctgtc

SEQ ID NO: 5977018 - DNA, 23 bp, Homo sapiens
agacagagtcttgctctgtctcc

SEQ ID NO: 5977019 - DNA, 13 bp, Homo sapiens
agacagagtggat

SEQ ID NO: 5977020 - DNA, 19 bp, Homo sapiens
agacagagtggatctggag

SEQ ID NO: 5977021 - DNA, 21 bp, Homo sapiens
agacagatacctccaaccctg

SEQ ID NO: 5977022 - DNA, 22 bp, Homo sapiens
agacagatacctccaaccctgc

SEQ ID NO: 5977023 - DNA, 15 bp, Homo sapiens
agacagatactcctc

SEQ ID NO: 5977024 - DNA, 16 bp, Homo sapiens
agacagatcccatcca

SEQ ID NO: 5977025 - DNA, 15 bp, Homo sapiens
agacagatgagcagg

SEQ ID NO: 5977026 - DNA, 14 bp, Homo sapiens
agacagatgcccca

SEQ ID NO: 5977027 - DNA, 19 bp, Homo sapiens
agacagatgccccagagct

SEQ ID NO: 5977028 - DNA, 16 bp, Homo sapiens
agacagatgctggtgg

SEQ ID NO: 5977029 - DNA, 19 bp, Homo sapiens
agacagatgctggtggagg

SEQ ID NO: 5977030 - DNA, 13 bp, Homo sapiens
agacagatggaca

SEQ ID NO: 5977031 - DNA, 22 bp, Homo sapiens
agacagatggacactgccaaga

SEQ ID NO: 5977032 - DNA, 22 bp, Homo sapiens
agacagatgtggacatgcaccc

SEQ ID NO: 5977033 - DNA, 19 bp, Homo sapiens
agacagcaaggtgtggagg

SEQ ID NO: 5977034 - DNA, 24 bp, Homo sapiens
agacagcaaggtgtggaggctcct

SEQ ID NO: 5977035 - DNA, 13 bp, Homo sapiens
agacagcacaggc

SEQ ID NO: 5977036 - DNA, 14 bp, Homo sapiens
agacagcacaggca

SEQ ID NO: 5977037 - DNA, 14 bp, Homo sapiens
agacagcacagggc

SEQ ID NO: 5977038 - DNA, 16 bp, Homo sapiens
agacagcacagggcag

SEQ ID NO: 5977039 - DNA, 18 bp, Homo sapiens
agacagcacttggctcct

SEQ ID NO: 5977040 - DNA, 16 bp, Homo sapiens
agacagcagcagcctg

SEQ ID NO: 5977041 - DNA, 14 bp, Homo sapiens
agacagcagcctgt

SEQ ID NO: 5977042 - DNA, 16 bp, Homo sapiens
agacagcagcctgtat

SEQ ID NO: 5977043 - DNA, 13 bp, Homo sapiens
agacagcagctgg

SEQ ID NO: 5977044 - DNA, 14 bp, Homo sapiens
agacagcagctgga

SEQ ID NO: 5977045 - DNA, 16 bp, Homo sapiens
agacagcagctggact

SEQ ID NO: 5977046 - DNA, 14 bp, Homo sapiens
agacagcaggcagc

SEQ ID NO: 5977047 - DNA, 14 bp, Homo sapiens
agacagcagtgtga

SEQ ID NO: 5977048 - DNA, 16 bp, Homo sapiens
agacagcagtgtgagg

SEQ ID NO: 5977049 - DNA, 20 bp, Homo sapiens
agacagcagtgtgagggtgc

SEQ ID NO: 5977050 - DNA, 17 bp, Homo sapiens
agacagcagtttccaga

SEQ ID NO: 5977051 - DNA, 21 bp, Homo sapiens
agacagcagtttccagagagt

SEQ ID NO: 5977052 - DNA, 20 bp, Homo sapiens
agacagcatttgtgtgttac

SEQ ID NO: 5977053 - DNA, 14 bp, Homo sapiens
agacagccaggtag

SEQ ID NO: 5977054 - DNA, 23 bp, Homo sapiens
agacagccaggtggcacctgcag

SEQ ID NO: 5977055 - DNA, 17 bp, Homo sapiens
agacagcccaggatact

SEQ ID NO: 5977056 - DNA, 17 bp, Homo sapiens
agacagccccctgcccc

SEQ ID NO: 5977057 - DNA, 22 bp, Homo sapiens
agacagcccgatcctcccctgg

SEQ ID NO: 5977058 - DNA, 21 bp, Homo sapiens
agacagcccgggctctgcctc

SEQ ID NO: 5977059 - DNA, 13 bp, Homo sapiens
agacagccctgcc

SEQ ID NO: 5977060 - DNA, 19 bp, Homo sapiens
agacagccggatcttggag

SEQ ID NO: 5977061 - DNA, 22 bp, Homo sapiens
agacagccggatcttggagaca

SEQ ID NO: 5977062 - DNA, 23 bp, Homo sapiens
agacagcctaatgaaggccatca

SEQ ID NO: 5977063 - DNA, 16 bp, Homo sapiens
agacagcgataagctt

SEQ ID NO: 5977064 - DNA, 21 bp, Homo sapiens
agacagcgataagctttcaat

SEQ ID NO: 5977065 - DNA, 16 bp, Homo sapiens
agacagcggtcccagg

SEQ ID NO: 5977066 - DNA, 21 bp, Homo sapiens
agacagctccaccctggccga

SEQ ID NO: 5977067 - DNA, 15 bp, Homo sapiens
agacagctccctctg

SEQ ID NO: 5977068 - DNA, 18 bp, Homo sapiens
agacagctccctctgcct

SEQ ID NO: 5977069 - DNA, 20 bp, Homo sapiens
agacagctccctctgcctga

SEQ ID NO: 5977070 - DNA, 18 bp, Homo sapiens
agacagctgacagataca

SEQ ID NO: 5977071 - DNA, 15 bp, Homo sapiens
agacagctgcctggg

SEQ ID NO: 5977072 - DNA, 13 bp, Homo sapiens
agacagctgctca

SEQ ID NO: 5977073 - DNA, 15 bp, Homo sapiens
agacagctggaccca

SEQ ID NO: 5977074 - DNA, 21 bp, Homo sapiens
agacagctggcggaggctgct

SEQ ID NO: 5977075 - DNA, 18 bp, Homo sapiens
agacagctgtttgaattg

SEQ ID NO: 5977076 - DNA, 17 bp, Homo sapiens
agacagcttacaggagc

SEQ ID NO: 5977077 - DNA, 18 bp, Homo sapiens
agacagcttacaggagcc

SEQ ID NO: 5977078 - DNA, 21 bp, Homo sapiens
agacagcttacaggagccagc

SEQ ID NO: 5977079 - DNA, 14 bp, Homo sapiens
agacagcttctctg

SEQ ID NO: 5977080 - DNA, 15 bp, Homo sapiens
agacagcttttctca

SEQ ID NO: 5977081 - DNA, 19 bp, Homo sapiens
agacaggaaaatcctctgg

SEQ ID NO: 5977082 - DNA, 15 bp, Homo sapiens
agacaggaacccttg

SEQ ID NO: 5977083 - DNA, 14 bp, Homo sapiens
agacaggaagcctc

SEQ ID NO: 5977084 - DNA, 14 bp, Homo sapiens
agacaggaaggaag

SEQ ID NO: 5977085 - DNA, 20 bp, Homo sapiens
agacaggacagaatgtgttc

SEQ ID NO: 5977086 - DNA, 22 bp, Homo sapiens
agacaggacccctgcagttccc

SEQ ID NO: 5977087 - DNA, 17 bp, Homo sapiens
agacaggactgcagagg

SEQ ID NO: 5977088 - DNA, 21 bp, Homo sapiens
agacaggagaagaaagaacta

SEQ ID NO: 5977089 - DNA, 15 bp, Homo sapiens
agacaggaggagtgg

SEQ ID NO: 5977090 - DNA, 19 bp, Homo sapiens
agacaggaggagtgggaca

SEQ ID NO: 5977091 - DNA, 20 bp, Homo sapiens
agacaggaggagtgggacag

SEQ ID NO: 5977092 - DNA, 23 bp, Homo sapiens
agacaggaggagtgggacagaca

SEQ ID NO: 5977093 - DNA, 15 bp, Homo sapiens
agacaggattctgac

SEQ ID NO: 5977094 - DNA, 22 bp, Homo sapiens
agacaggcaagcacctcctgcc

SEQ ID NO: 5977095 - DNA, 15 bp, Homo sapiens
agacaggcagaatca

SEQ ID NO: 5977096 - DNA, 22 bp, Homo sapiens
agacaggcagtttcagagatgg

SEQ ID NO: 5977097 - DNA, 16 bp, Homo sapiens
agacaggcccaagaga

SEQ ID NO: 5977098 - DNA, 12 bp, Homo sapiens
agacaggccctc

SEQ ID NO: 5977099 - DNA, 23 bp, Homo sapiens
agacaggcggggcccagcgctct

SEQ ID NO: 5977100 - DNA, 22 bp, Homo sapiens
agacaggctggaagatagctgt

SEQ ID NO: 5977101 - DNA, 17 bp, Homo sapiens
agacaggctggcattct

SEQ ID NO: 5977102 - DNA, 17 bp, Homo sapiens
agacaggctgggtcctg

SEQ ID NO: 5977103 - DNA, 11 bp, Homo sapiens
agacagggctc

SEQ ID NO: 5977104 - DNA, 20 bp, Homo sapiens
agacagggctcatttttgca

SEQ ID NO: 5977105 - DNA, 14 bp, Homo sapiens
agacagggctccag

SEQ ID NO: 5977106 - DNA, 17 bp, Homo sapiens
agacagggctccagcct

SEQ ID NO: 5977107 - DNA, 16 bp, Homo sapiens
agacagggtaggaaag

SEQ ID NO: 5977108 - DNA, 15 bp, Homo sapiens
agacagggtcctgct

SEQ ID NO: 5977109 - DNA, 16 bp, Homo sapiens
agacagggtcctgcta

SEQ ID NO: 5977110 - DNA, 11 bp, Homo sapiens
agacagggtct

SEQ ID NO: 5977111 - DNA, 18 bp, Homo sapiens
agacagggtctcactctg

SEQ ID NO: 5977112 - DNA, 19 bp, Homo sapiens
agacagggtctcactctgt

SEQ ID NO: 5977113 - DNA, 19 bp, Homo sapiens
agacagggtctgaaggact

SEQ ID NO: 5977114 - DNA, 14 bp, Homo sapiens
agacagggtcttgc

SEQ ID NO: 5977115 - DNA, 16 bp, Homo sapiens
agacagggtcttgctc

SEQ ID NO: 5977116 - DNA, 21 bp, Homo sapiens
agacagggtgctgatgggaag

SEQ ID NO: 5977117 - DNA, 17 bp, Homo sapiens
agacagggtgggaggga

SEQ ID NO: 5977118 - DNA, 20 bp, Homo sapiens
agacagggtgggagggagga

SEQ ID NO: 5977119 - DNA, 18 bp, Homo sapiens
agacagggtgggcttcct

SEQ ID NO: 5977120 - DNA, 13 bp, Homo sapiens
agacagggtgggg

SEQ ID NO: 5977121 - DNA, 23 bp, Homo sapiens
agacagggtttcaccatgttgcc

SEQ ID NO: 5977122 - DNA, 16 bp, Homo sapiens
agacagggtttggctg

SEQ ID NO: 5977123 - DNA, 22 bp, Homo sapiens
agacagggtttggctgtgtcta

SEQ ID NO: 5977124 - DNA, 17 bp, Homo sapiens
agacaggtaaatgggca

SEQ ID NO: 5977125 - DNA, 23 bp, Homo sapiens
agacaggtgcctaacctgggacc

SEQ ID NO: 5977126 - DNA, 17 bp, Homo sapiens
agacaggtgcctggggc

SEQ ID NO: 5977127 - DNA, 20 bp, Homo sapiens
agacaggtgggagatggagg

SEQ ID NO: 5977128 - DNA, 18 bp, Homo sapiens
agacaggttttcacataa

SEQ ID NO: 5977129 - DNA, 21 bp, Homo sapiens
agacaggttttcacataaatg

SEQ ID NO: 5977130 - DNA, 22 bp, Homo sapiens
agacaggttttcacataaatgc

SEQ ID NO: 5977131 - DNA, 17 bp, Homo sapiens
agacagtaacacaatta

SEQ ID NO: 5977132 - DNA, 22 bp, Homo sapiens
agacagtaagtatcttcgttct

SEQ ID NO: 5977133 - DNA, 21 bp, Homo sapiens
agacagtagccaagttatatt

SEQ ID NO: 5977134 - DNA, 17 bp, Homo sapiens
agacagtatacagtcct

SEQ ID NO: 5977135 - DNA, 13 bp, Homo sapiens
agacagtattgcc

SEQ ID NO: 5977136 - DNA, 14 bp, Homo sapiens
agacagtattgcca

SEQ ID NO: 5977137 - DNA, 20 bp, Homo sapiens
agacagtatttattggtggg

SEQ ID NO: 5977138 - DNA, 17 bp, Homo sapiens
agacagtcaaggagtgg

SEQ ID NO: 5977139 - DNA, 18 bp, Homo sapiens
agacagtcacaaatttct

SEQ ID NO: 5977140 - DNA, 17 bp, Homo sapiens
agacagtccaaccttga

SEQ ID NO: 5977141 - DNA, 12 bp, Homo sapiens
agacagtccctg

SEQ ID NO: 5977142 - DNA, 15 bp, Homo sapiens
agacagtccctgcca

SEQ ID NO: 5977143 - DNA, 17 bp, Homo sapiens
agacagtccctgccaat

SEQ ID NO: 5977144 - DNA, 20 bp, Homo sapiens
agacagtccttaatgctgaa

SEQ ID NO: 5977145 - DNA, 13 bp, Homo sapiens
agacagtctggaa

SEQ ID NO: 5977146 - DNA, 17 bp, Homo sapiens
agacagtctgttatgca

SEQ ID NO: 5977147 - DNA, 20 bp, Homo sapiens
agacagtctgttatgcactg

SEQ ID NO: 5977148 - DNA, 14 bp, Homo sapiens
agacagtgaatttg

SEQ ID NO: 5977149 - DNA, 23 bp, Homo sapiens
agacagtgactgtacagttatca

SEQ ID NO: 5977150 - DNA, 20 bp, Homo sapiens
agacagtgagacagtctgga

SEQ ID NO: 5977151 - DNA, 17 bp, Homo sapiens
agacagtgatctccata

SEQ ID NO: 5977152 - DNA, 20 bp, Homo sapiens
agacagtgatctccatatgt

SEQ ID NO: 5977153 - DNA, 17 bp, Homo sapiens
agacagtgatgcctgcc

SEQ ID NO: 5977154 - DNA, 16 bp, Homo sapiens
agacagtgcacatgaa

SEQ ID NO: 5977155 - DNA, 17 bp, Homo sapiens
agacagtgcacatgaac

SEQ ID NO: 5977156 - DNA, 15 bp, Homo sapiens
agacagtgggaaata

SEQ ID NO: 5977157 - DNA, 21 bp, Homo sapiens
agacagtggtaaatatagaac

SEQ ID NO: 5977158 - DNA, 23 bp, Homo sapiens
agacagtgtatgtagaagcatga

SEQ ID NO: 5977159 - DNA, 17 bp, Homo sapiens
agacagtgtcagagtca

SEQ ID NO: 5977160 - DNA, 20 bp, Homo sapiens
agacctgctgtaataaatgt

SEQ ID NO: 5977161 - DNA, 21 bp, Homo sapiens
agacctgctgtaataaatgta

SEQ ID NO: 5977162 - DNA, 15 bp, Homo sapiens
agacctgcttcctga

SEQ ID NO: 5977163 - DNA, 18 bp, Homo sapiens
agacctgcttcctgaaat

SEQ ID NO: 5977164 - DNA, 19 bp, Homo sapiens
agacctgctttttgaaatg

SEQ ID NO: 5977165 - DNA, 22 bp, Homo sapiens
agacctgctttttgaaatgaaa

SEQ ID NO: 5977166 - DNA, 14 bp, Homo sapiens
agacctggaaccag

SEQ ID NO: 5977167 - DNA, 20 bp, Homo sapiens
agacctggaagaacaggcct

SEQ ID NO: 5977168 - DNA, 16 bp, Homo sapiens
agacctggacacaggc

SEQ ID NO: 5977169 - DNA, 18 bp, Homo sapiens
agacctggacacaggcct

SEQ ID NO: 5977170 - DNA, 22 bp, Homo sapiens
agacctggagcccctgggtggg

SEQ ID NO: 5977171 - DNA, 11 bp, Homo sapiens
agacctggcag

SEQ ID NO: 5977172 - DNA, 17 bp, Homo sapiens
agacctggcagctctgg

SEQ ID NO: 5977173 - DNA, 18 bp, Homo sapiens
agacctggcagctctgga

SEQ ID NO: 5977174 - DNA, 12 bp, Homo sapiens
agacctggcctc

SEQ ID NO: 5977175 - DNA, 16 bp, Homo sapiens
agacctggcctctgcc

SEQ ID NO: 5977176 - DNA, 17 bp, Homo sapiens
agacctggcctctgcca

SEQ ID NO: 5977177 - DNA, 22 bp, Homo sapiens
agacctggcctctgccatcctc

SEQ ID NO: 5977178 - DNA, 17 bp, Homo sapiens
agacctggctctcagag

SEQ ID NO: 5977179 - DNA, 21 bp, Homo sapiens
agacctggctgggcctgggct

SEQ ID NO: 5977180 - DNA, 23 bp, Homo sapiens
agacctgggccaaaagggcagcc

SEQ ID NO: 5977181 - DNA, 13 bp, Homo sapiens
agacctgggccct

SEQ ID NO: 5977182 - DNA, 16 bp, Homo sapiens
agacctgggccctggt

SEQ ID NO: 5977183 - DNA, 16 bp, Homo sapiens
agacctggtgtgcgga

SEQ ID NO: 5977184 - DNA, 17 bp, Homo sapiens
agacctggtgtgcggag

SEQ ID NO: 5977185 - DNA, 19 bp, Homo sapiens
agacctggtgtgcggaggc

SEQ ID NO: 5977186 - DNA, 22 bp, Homo sapiens
agacctggtgtgcggaggcagg

SEQ ID NO: 5977187 - DNA, 15 bp, Homo sapiens
agacctgtcttccaa

SEQ ID NO: 5977188 - DNA, 18 bp, Homo sapiens
agacctgtcttccaagga

SEQ ID NO: 5977189 - DNA, 23 bp, Homo sapiens
agacctgtcttccaaggagacca

SEQ ID NO: 5977190 - DNA, 19 bp, Homo sapiens
agacctgttggtataggaa

SEQ ID NO: 5977191 - DNA, 18 bp, Homo sapiens
agaccttaagacactgtg

SEQ ID NO: 5977192 - DNA, 21 bp, Homo sapiens
agaccttaagacactgtgaga

SEQ ID NO: 5977193 - DNA, 11 bp, Homo sapiens
agaccttaccc

SEQ ID NO: 5977194 - DNA, 17 bp, Homo sapiens
agaccttactcagggga

SEQ ID NO: 5977195 - DNA, 13 bp, Homo sapiens
agaccttcacaga

SEQ ID NO: 5977196 - DNA, 20 bp, Homo sapiens
agaccttcacagatgcctac

SEQ ID NO: 5977197 - DNA, 22 bp, Homo sapiens
agaccttccataatgctactgt

SEQ ID NO: 5977198 - DNA, 18 bp, Homo sapiens
agaccttctaggacgcca

SEQ ID NO: 5977199 - DNA, 16 bp, Homo sapiens
agaccttctccaaatg

SEQ ID NO: 5977200 - DNA, 18 bp, Homo sapiens
agaccttctccaaatgag

SEQ ID NO: 5977201 - DNA, 19 bp, Homo sapiens
agaccttctccaaatgaga

SEQ ID NO: 5977202 - DNA, 16 bp, Homo sapiens
agaccttctccctagc

SEQ ID NO: 5977203 - DNA, 18 bp, Homo sapiens
agaccttctccctagccc

SEQ ID NO: 5977204 - DNA, 19 bp, Homo sapiens
agaccttctccctagccct

SEQ ID NO: 5977205 - DNA, 15 bp, Homo sapiens
agaccttcttccaca

SEQ ID NO: 5977206 - DNA, 21 bp, Homo sapiens
agaccttgagggtgggccagc

SEQ ID NO: 5977207 - DNA, 20 bp, Homo sapiens
agaccttgcaatcacaaaag

SEQ ID NO: 5977208 - DNA, 16 bp, Homo sapiens
agaccttggctgctca

SEQ ID NO: 5977209 - DNA, 19 bp, Homo sapiens
agaccttgggggaagactt

SEQ ID NO: 5977210 - DNA, 13 bp, Homo sapiens
agacctttactga

SEQ ID NO: 5977211 - DNA, 18 bp, Homo sapiens
agacctttattcacccct

SEQ ID NO: 5977212 - DNA, 21 bp, Homo sapiens
agacctttattcacccctgcc

SEQ ID NO: 5977213 - DNA, 22 bp, Homo sapiens
agacctttattcacccctgccc

SEQ ID NO: 5977214 - DNA, 23 bp, Homo sapiens
agacctttattcacccctgcccc

SEQ ID NO: 5977215 - DNA, 22 bp, Homo sapiens
agacctttgatgaattcttcct

SEQ ID NO: 5977216 - DNA, 15 bp, Homo sapiens
agacctttgtctgaa

SEQ ID NO: 5977217 - DNA, 19 bp, Homo sapiens
agacctttgtctgaaggat

SEQ ID NO: 5977218 - DNA, 20 bp, Homo sapiens
agacctttgtctgaaggatt

SEQ ID NO: 5977219 - DNA, 22 bp, Homo sapiens
agaccttttctagtctgtcttc

SEQ ID NO: 5977220 - DNA, 16 bp, Homo sapiens
agaccttttttaggaa

SEQ ID NO: 5977221 - DNA, 23 bp, Homo sapiens
agacgacacctggagactgtccc

SEQ ID NO: 5977222 - DNA, 11 bp, Homo sapiens
agacgactaca

SEQ ID NO: 5977223 - DNA, 21 bp, Homo sapiens
agacgacttatatatttgaaa

SEQ ID NO: 5977224 - DNA, 17 bp, Homo sapiens
agacgagacaccctaac

SEQ ID NO: 5977225 - DNA, 16 bp, Homo sapiens
agacgagcatccccct

SEQ ID NO: 5977226 - DNA, 13 bp, Homo sapiens
agacgagctgtct

SEQ ID NO: 5977227 - DNA, 21 bp, Homo sapiens
agacgaggcaggggctctgct

SEQ ID NO: 5977228 - DNA, 20 bp, Homo sapiens
agacgaggccctcgggccca

SEQ ID NO: 5977229 - DNA, 22 bp, Homo sapiens
agacgaggccctcgggcccagc

SEQ ID NO: 5977230 - DNA, 13 bp, Homo sapiens
agacgatatactc

SEQ ID NO: 5977231 - DNA, 22 bp, Homo sapiens
agacgatcttgctggcagggcc

SEQ ID NO: 5977232 - DNA, 23 bp, Homo sapiens
agacgatcttgctggcagggcct

SEQ ID NO: 5977233 - DNA, 16 bp, Homo sapiens
agacgatgtcttcata

SEQ ID NO: 5977234 - DNA, 17 bp, Homo sapiens
agacgatgtcttcatac

SEQ ID NO: 5977235 - DNA, 20 bp, Homo sapiens
agacgcacacagctgagcac

SEQ ID NO: 5977236 - DNA, 12 bp, Homo sapiens
agacgcagtccg

SEQ ID NO: 5977237 - DNA, 19 bp, Homo sapiens
agacgcatagactgaggta

SEQ ID NO: 5977238 - DNA, 14 bp, Homo sapiens
agacgcatttcggt

SEQ ID NO: 5977239 - DNA, 17 bp, Homo sapiens
agacgccactccctggg

SEQ ID NO: 5977240 - DNA, 13 bp, Homo sapiens
agacgcccagccc

SEQ ID NO: 5977241 - DNA, 14 bp, Homo sapiens
agacgcccagcccc

SEQ ID NO: 5977242 - DNA, 15 bp, Homo sapiens
agacgcccagcccca

SEQ ID NO: 5977243 - DNA, 22 bp, Homo sapiens
agacgcccagccccatccctgt

SEQ ID NO: 5977244 - DNA, 19 bp, Homo sapiens
agacgcccccaaatccttg

SEQ ID NO: 5977245 - DNA, 12 bp, Homo sapiens
agacgcccctcc

SEQ ID NO: 5977246 - DNA, 21 bp, Homo sapiens
agacgccggcttcctccttcc

SEQ ID NO: 5977247 - DNA, 22 bp, Homo sapiens
agacgccggggacagaggcctg

SEQ ID NO: 5977248 - DNA, 15 bp, Homo sapiens
agacgcctgaggaac

SEQ ID NO: 5977249 - DNA, 21 bp, Homo sapiens
agacgccttcatctgggacaa

SEQ ID NO: 5977250 - DNA, 20 bp, Homo sapiens
agacgccttccaggtcagga

SEQ ID NO: 5977251 - DNA, 14 bp, Homo sapiens
agacgccttcctct

SEQ ID NO: 5977252 - DNA, 17 bp, Homo sapiens
agacgctaataaaaatt

SEQ ID NO: 5977253 - DNA, 14 bp, Homo sapiens
agacgctgagtggg

SEQ ID NO: 5977254 - DNA, 13 bp, Homo sapiens
agacgctgcactt

SEQ ID NO: 5977255 - DNA, 16 bp, Homo sapiens
agacgctgccgctgcc

SEQ ID NO: 5977256 - DNA, 15 bp, Homo sapiens
agacgctgctgtcac

SEQ ID NO: 5977257 - DNA, 22 bp, Homo sapiens
agacgctgtgattggcaggagg

SEQ ID NO: 5977258 - DNA, 23 bp, Homo sapiens
agacgctgtgattggcaggaggc

SEQ ID NO: 5977259 - DNA, 17 bp, Homo sapiens
agacgctgtgctgccct

SEQ ID NO: 5977260 - DNA, 19 bp, Homo sapiens
agacgctgtgctgccctgc

SEQ ID NO: 5977261 - DNA, 18 bp, Homo sapiens
agacggaagtaaattatg

SEQ ID NO: 5977262 - DNA, 20 bp, Homo sapiens
agacggaatgaccagaaaat

SEQ ID NO: 5977263 - DNA, 13 bp, Homo sapiens
agacggaggaggg

SEQ ID NO: 5977264 - DNA, 16 bp, Homo sapiens
agacggaggggagtag

SEQ ID NO: 5977265 - DNA, 18 bp, Homo sapiens
agacggagtctctcactg

SEQ ID NO: 5977266 - DNA, 22 bp, Homo sapiens
agacggagtttcgctcttggtg

SEQ ID NO: 5977267 - DNA, 16 bp, Homo sapiens
agacggatccacagta

SEQ ID NO: 5977268 - DNA, 23 bp, Homo sapiens
agacggatgcccattcctgcctg

SEQ ID NO: 5977269 - DNA, 24 bp, Homo sapiens
agacggatgcccattcctgcctgg

SEQ ID NO: 5977270 - DNA, 14 bp, Homo sapiens
agacggatggaagg

SEQ ID NO: 5977271 - DNA, 16 bp, Homo sapiens
agacggatggaaggag

SEQ ID NO: 5977272 - DNA, 16 bp, Homo sapiens
agacggcagaaaacag

SEQ ID NO: 5977273 - DNA, 23 bp, Homo sapiens
agacggcctaggggtggcgctca

SEQ ID NO: 5977274 - DNA, 15 bp, Homo sapiens
agacggcggccaggc

SEQ ID NO: 5977275 - DNA, 22 bp, Homo sapiens
agacgggaatgcctaggtccct

SEQ ID NO: 5977276 - DNA, 17 bp, Homo sapiens
agacgggaccctgccca

SEQ ID NO: 5977277 - DNA, 13 bp, Homo sapiens
agacgggagggga

SEQ ID NO: 5977278 - DNA, 18 bp, Homo sapiens
agacgggaggggaggcat

SEQ ID NO: 5977279 - DNA, 16 bp, Homo sapiens
agacgggcaagaagct

SEQ ID NO: 5977280 - DNA, 12 bp, Homo sapiens
agacgggcacag

SEQ ID NO: 5977281 - DNA, 15 bp, Homo sapiens
agacgggcacagaca

SEQ ID NO: 5977282 - DNA, 16 bp, Homo sapiens
agacggggcctcacta

SEQ ID NO: 5977283 - DNA, 17 bp, Homo sapiens
agacggggtctccctgt

SEQ ID NO: 5977284 - DNA, 18 bp, Homo sapiens
agacggggtttccccatg

SEQ ID NO: 5977285 - DNA, 17 bp, Homo sapiens
agacgggtctgagactg

SEQ ID NO: 5977286 - DNA, 15 bp, Homo sapiens
agacgggttgaaaga

SEQ ID NO: 5977287 - DNA, 21 bp, Homo sapiens
agacgggttgaaagacatcaa

SEQ ID NO: 5977288 - DNA, 23 bp, Homo sapiens
agacggtgctcgcttctcctcca

SEQ ID NO: 5977289 - DNA, 20 bp, Homo sapiens
agacgtacgtatcagcggcc

SEQ ID NO: 5977290 - DNA, 14 bp, Homo sapiens
agacgtatgtaaca

SEQ ID NO: 5977291 - DNA, 14 bp, Homo sapiens
agacgtccaccctg

SEQ ID NO: 5977292 - DNA, 14 bp, Homo sapiens
agacgtccatagct

SEQ ID NO: 5977293 - DNA, 19 bp, Homo sapiens
agacgtccatagctcctct

SEQ ID NO: 5977294 - DNA, 22 bp, Homo sapiens
agacgtccatagctcctctccc

SEQ ID NO: 5977295 - DNA, 14 bp, Homo sapiens
agacgtccctccac

SEQ ID NO: 5977296 - DNA, 14 bp, Homo sapiens
agacgtcctggaat

SEQ ID NO: 5977297 - DNA, 23 bp, Homo sapiens
agacgtcgtacccagccatgtgt

SEQ ID NO: 5977298 - DNA, 15 bp, Homo sapiens
agacgtctggccctg

SEQ ID NO: 5977299 - DNA, 22 bp, Homo sapiens
agacgtctgtcaggggcttgga

SEQ ID NO: 5977300 - DNA, 19 bp, Homo sapiens
agacgtgatgccaggacca

SEQ ID NO: 5977301 - DNA, 19 bp, Homo sapiens
agacgtgatgggctaggcc

SEQ ID NO: 5977302 - DNA, 22 bp, Homo sapiens
agacgtgcagcgcccctctgca

SEQ ID NO: 5977303 - DNA, 18 bp, Homo sapiens
agacgtggactcctcttg

SEQ ID NO: 5977304 - DNA, 17 bp, Homo sapiens
agacgttgtaatgcaca

SEQ ID NO: 5977305 - DNA, 21 bp, Homo sapiens
agacgtttataaacagaaatg

SEQ ID NO: 5977306 - DNA, 20 bp, Homo sapiens
agactaaaggatccagagag

SEQ ID NO: 5977307 - DNA, 16 bp, Homo sapiens
agactaacaaaggcag

SEQ ID NO: 5977308 - DNA, 17 bp, Homo sapiens
agactaacaaaggcagc

SEQ ID NO: 5977309 - DNA, 19 bp, Homo sapiens
agactaacaaaggcagctg

SEQ ID NO: 5977310 - DNA, 20 bp, Homo sapiens
agactaacaaaggcagctgt

SEQ ID NO: 5977311 - DNA, 23 bp, Homo sapiens
agactaacaaaggcagctgtgtc

SEQ ID NO: 5977312 - DNA, 18 bp, Homo sapiens
agactaacttattttgat

SEQ ID NO: 5977313 - DNA, 23 bp, Homo sapiens
agactaacttattttgattgttt

SEQ ID NO: 5977314 - DNA, 19 bp, Homo sapiens
agactaagaaatattccaa

SEQ ID NO: 5977315 - DNA, 22 bp, Homo sapiens
agactaagatcggttaacaaat

SEQ ID NO: 5977316 - DNA, 15 bp, Homo sapiens
agactaagccagcac

SEQ ID NO: 5977317 - DNA, 16 bp, Homo sapiens
agactaagccagcacc

SEQ ID NO: 5977318 - DNA, 13 bp, Homo sapiens
agactaagccctg

SEQ ID NO: 5977319 - DNA, 15 bp, Homo sapiens
agactaagccctgtc

SEQ ID NO: 5977320 - DNA, 21 bp, Homo sapiens
agactaaggggcagctcctga

SEQ ID NO: 5977321 - DNA, 21 bp, Homo sapiens
agactaagttgctaacctcaa

SEQ ID NO: 5977322 - DNA, 23 bp, Homo sapiens
agactaatgaatgcaaaaagata

SEQ ID NO: 5977323 - DNA, 15 bp, Homo sapiens
agactacacaggatg

SEQ ID NO: 5977324 - DNA, 16 bp, Homo sapiens
agactacagctggggt

SEQ ID NO: 5977325 - DNA, 23 bp, Homo sapiens
agactacaggcacacaccaccac

SEQ ID NO: 5977326 - DNA, 19 bp, Homo sapiens
agactaccggacactcgtc

SEQ ID NO: 5977327 - DNA, 14 bp, Homo sapiens
agactacctgccct

SEQ ID NO: 5977328 - DNA, 15 bp, Homo sapiens
agactactaaggcct

SEQ ID NO: 5977329 - DNA, 19 bp, Homo sapiens
agactactattttcttttt

SEQ ID NO: 5977330 - DNA, 15 bp, Homo sapiens
agactactctgcctg

SEQ ID NO: 5977331 - DNA, 16 bp, Homo sapiens
agactactggccccgc

SEQ ID NO: 5977332 - DNA, 18 bp, Homo sapiens
agactactggcctctgtg

SEQ ID NO: 5977333 - DNA, 22 bp, Homo sapiens
agactactgttcagcttttatt

SEQ ID NO: 5977334 - DNA, 15 bp, Homo sapiens
agactagacaaataa

SEQ ID NO: 5977335 - DNA, 18 bp, Homo sapiens
agactagacaccttctgt

SEQ ID NO: 5977336 - DNA, 17 bp, Homo sapiens
cacaacctcaccaaact

SEQ ID NO: 5977337 - DNA, 19 bp, Homo sapiens
cacaacctccacctcctgg

SEQ ID NO: 5977338 - DNA, 14 bp, Homo sapiens
cacaacctgaaaga

SEQ ID NO: 5977339 - DNA, 14 bp, Homo sapiens
cacaacctgaacct

SEQ ID NO: 5977340 - DNA, 17 bp, Homo sapiens
cacaaccttctgtggct

SEQ ID NO: 5977341 - DNA, 18 bp, Homo sapiens
cacaaccttctgtggctc

SEQ ID NO: 5977342 - DNA, 16 bp, Homo sapiens
cacaaccttgcagtat

SEQ ID NO: 5977343 - DNA, 17 bp, Homo sapiens
cacaaccttgcagtatt

SEQ ID NO: 5977344 - DNA, 15 bp, Homo sapiens
cacaaccttttcctc

SEQ ID NO: 5977345 - DNA, 13 bp, Homo sapiens
cacaacgctgctg

SEQ ID NO: 5977346 - DNA, 18 bp, Homo sapiens
cacaacgtaaaaataaaa

SEQ ID NO: 5977347 - DNA, 19 bp, Homo sapiens
cacaacgtgcattgtgctt

SEQ ID NO: 5977348 - DNA, 23 bp, Homo sapiens
cacaacgtgggcttaaagcagaa

SEQ ID NO: 5977349 - DNA, 16 bp, Homo sapiens
cacaactaacaatgcc

SEQ ID NO: 5977350 - DNA, 19 bp, Homo sapiens
cacaactaacaatgccttg

SEQ ID NO: 5977351 - DNA, 22 bp, Homo sapiens
cacaactactagtgtgactcct

SEQ ID NO: 5977352 - DNA, 19 bp, Homo sapiens
cacaactagttaaaagcct

SEQ ID NO: 5977353 - DNA, 18 bp, Homo sapiens
cacaactagttttgttta

SEQ ID NO: 5977354 - DNA, 13 bp, Homo sapiens
cacaactatattg

SEQ ID NO: 5977355 - DNA, 15 bp, Homo sapiens
cacaactatcaaaat

SEQ ID NO: 5977356 - DNA, 19 bp, Homo sapiens
cacaactatttttccaaaa

SEQ ID NO: 5977357 - DNA, 21 bp, Homo sapiens
cacaactccttccatccttga

SEQ ID NO: 5977358 - DNA, 15 bp, Homo sapiens
cacaactgacacagg

SEQ ID NO: 5977359 - DNA, 16 bp, Homo sapiens
cacaactgacacagga

SEQ ID NO: 5977360 - DNA, 20 bp, Homo sapiens
cacaactgtggataaatttt

SEQ ID NO: 5977361 - DNA, 20 bp, Homo sapiens
cacaactgtttttgaagaag

SEQ ID NO: 5977362 - DNA, 13 bp, Homo sapiens
cacaacttaaaaa

SEQ ID NO: 5977363 - DNA, 18 bp, Homo sapiens
cacaacttgatggctgcg

SEQ ID NO: 5977364 - DNA, 23 bp, Homo sapiens
cacaacttgtcacccaaagcctg

SEQ ID NO: 5977365 - DNA, 16 bp, Homo sapiens
cacaactttgcaaatt

SEQ ID NO: 5977366 - DNA, 18 bp, Homo sapiens
cacaactttgcaaattat

SEQ ID NO: 5977367 - DNA, 15 bp, Homo sapiens
cacaacttttaacca

SEQ ID NO: 5977368 - DNA, 16 bp, Homo sapiens
cacaagaaactttgga

SEQ ID NO: 5977369 - DNA, 15 bp, Homo sapiens
cacaagaaatgaaag

SEQ ID NO: 5977370 - DNA, 21 bp, Homo sapiens
cacaagaaatgaaagcaggga

SEQ ID NO: 5977371 - DNA, 23 bp, Homo sapiens
cacaagaaatgaaagcagggact

SEQ ID NO: 5977372 - DNA, 20 bp, Homo sapiens
cacaagaacacacacatata

SEQ ID NO: 5977373 - DNA, 12 bp, Homo sapiens
cacaagaagacc

SEQ ID NO: 5977374 - DNA, 19 bp, Homo sapiens
cacaagaagaccagactgt

SEQ ID NO: 5977375 - DNA, 15 bp, Homo sapiens
cacaagaaggccagc

SEQ ID NO: 5977376 - DNA, 16 bp, Homo sapiens
cacaagaaggccagcc

SEQ ID NO: 5977377 - DNA, 22 bp, Homo sapiens
cacaagaaggccagcccactgg

SEQ ID NO: 5977378 - DNA, 14 bp, Homo sapiens
cacaagaagtggga

SEQ ID NO: 5977379 - DNA, 22 bp, Homo sapiens
cacaagacagcagagccatctg

SEQ ID NO: 5977380 - DNA, 18 bp, Homo sapiens
cacaagacataatttaaa

SEQ ID NO: 5977381 - DNA, 21 bp, Homo sapiens
cacaagacataatttaaaata

SEQ ID NO: 5977382 - DNA, 14 bp, Homo sapiens
cacaagacccctgc

SEQ ID NO: 5977383 - DNA, 21 bp, Homo sapiens
cacaagactggcccagtgcca

SEQ ID NO: 5977384 - DNA, 16 bp, Homo sapiens
cacaagagatcagcag

SEQ ID NO: 5977385 - DNA, 17 bp, Homo sapiens
cacaagagatcagcagt

SEQ ID NO: 5977386 - DNA, 22 bp, Homo sapiens
cacaagagatcagcagtggcag

SEQ ID NO: 5977387 - DNA, 18 bp, Homo sapiens
cacaagagcatcaggctc

SEQ ID NO: 5977388 - DNA, 16 bp, Homo sapiens
cacaagagcccaggcc

SEQ ID NO: 5977389 - DNA, 17 bp, Homo sapiens
cacaagagcccaggcct

SEQ ID NO: 5977390 - DNA, 18 bp, Homo sapiens
cacaagagcccaggcctc

SEQ ID NO: 5977391 - DNA, 19 bp, Homo sapiens
cacaagagcccaggcctcc

SEQ ID NO: 5977392 - DNA, 20 bp, Homo sapiens
cacaagagcccaggcctcct

SEQ ID NO: 5977393 - DNA, 15 bp, Homo sapiens
cacaagagccccaaa

SEQ ID NO: 5977394 - DNA, 15 bp, Homo sapiens
cacaagaggaagaga

SEQ ID NO: 5977395 - DNA, 20 bp, Homo sapiens
cacaagagggactgtatttc

SEQ ID NO: 5977396 - DNA, 23 bp, Homo sapiens
cacaagatggaaaaaaaaaacaa

SEQ ID NO: 5977397 - DNA, 14 bp, Homo sapiens
cacaagattcccag

SEQ ID NO: 5977398 - DNA, 18 bp, Homo sapiens
cacaagattcccagagac

SEQ ID NO: 5977399 - DNA, 23 bp, Homo sapiens
cacaagattggtgtttttttcta

SEQ ID NO: 5977400 - DNA, 17 bp, Homo sapiens
cacaagcaaaccttctc

SEQ ID NO: 5977401 - DNA, 14 bp, Homo sapiens
cacaagcaataatt

SEQ ID NO: 5977402 - DNA, 15 bp, Homo sapiens
cacaagcaataatta

SEQ ID NO: 5977403 - DNA, 23 bp, Homo sapiens
cacaagcaatgcaagaaaaaaac

SEQ ID NO: 5977404 - DNA, 17 bp, Homo sapiens
cacaagcacaaagctca

SEQ ID NO: 5977405 - DNA, 17 bp, Homo sapiens
cacaagcaccactctgg

SEQ ID NO: 5977406 - DNA, 22 bp, Homo sapiens
cacaagcaccactctgggcaca

SEQ ID NO: 5977407 - DNA, 11 bp, Homo sapiens
cacaagcaccc

SEQ ID NO: 5977408 - DNA, 21 bp, Homo sapiens
cacaagcactttaatggcctg

SEQ ID NO: 5977409 - DNA, 13 bp, Homo sapiens
cacaagcagacac

SEQ ID NO: 5977410 - DNA, 21 bp, Homo sapiens
cacaagcagagtgcacagctg

SEQ ID NO: 5977411 - DNA, 22 bp, Homo sapiens
cacaagcagagtgcacagctgt

SEQ ID NO: 5977412 - DNA, 12 bp, Homo sapiens
cacaagcatctc

SEQ ID NO: 5977413 - DNA, 22 bp, Homo sapiens
cacaagccaaggaagtctgtgt

SEQ ID NO: 5977414 - DNA, 15 bp, Homo sapiens
cacaagccacagaag

SEQ ID NO: 5977415 - DNA, 13 bp, Homo sapiens
cacaagccacgcc

SEQ ID NO: 5977416 - DNA, 18 bp, Homo sapiens
cacaagccacgcctgcga

SEQ ID NO: 5977417 - DNA, 23 bp, Homo sapiens
cacaagccattttttgaggagag

SEQ ID NO: 5977418 - DNA, 13 bp, Homo sapiens
cacaagcccaggc

SEQ ID NO: 5977419 - DNA, 12 bp, Homo sapiens
cacaagcctcct

SEQ ID NO: 5977420 - DNA, 22 bp, Homo sapiens
cacaagcctctgcccaggcact

SEQ ID NO: 5977421 - DNA, 18 bp, Homo sapiens
cacaagcctcttctgaag

SEQ ID NO: 5977422 - DNA, 23 bp, Homo sapiens
cacaagcctcttctgaagatgga

SEQ ID NO: 5977423 - DNA, 22 bp, Homo sapiens
cacaagcctgcctcgccttgtg

SEQ ID NO: 5977424 - DNA, 18 bp, Homo sapiens
cacaagccttactcacct

SEQ ID NO: 5977425 - DNA, 19 bp, Homo sapiens
cacaagccttactcacctc

SEQ ID NO: 5977426 - DNA, 20 bp, Homo sapiens
cacaagccttactcacctct

SEQ ID NO: 5977427 - DNA, 17 bp, Homo sapiens
cacaagcggccctgaca

SEQ ID NO: 5977428 - DNA, 21 bp, Homo sapiens
cacaagctccaagctcccagg

SEQ ID NO: 5977429 - DNA, 14 bp, Homo sapiens
cacaagctccctgg

SEQ ID NO: 5977430 - DNA, 13 bp, Homo sapiens
cacaagctgagca

SEQ ID NO: 5977431 - DNA, 12 bp, Homo sapiens
cacaagctgcac

SEQ ID NO: 5977432 - DNA, 23 bp, Homo sapiens
cacaagctgcaccctcaggcagg

SEQ ID NO: 5977433 - DNA, 15 bp, Homo sapiens
cacaagctgcactgt

SEQ ID NO: 5977434 - DNA, 16 bp, Homo sapiens
cacaagctgcactgtg

SEQ ID NO: 5977435 - DNA, 12 bp, Homo sapiens
cacaagctgcct

SEQ ID NO: 5977436 - DNA, 15 bp, Homo sapiens
cacaagctgcctccc

SEQ ID NO: 5977437 - DNA, 14 bp, Homo sapiens
cacaagctgcctct

SEQ ID NO: 5977438 - DNA, 15 bp, Homo sapiens
cacaagctgcctctg

SEQ ID NO: 5977439 - DNA, 12 bp, Homo sapiens
cacaagctggaa

SEQ ID NO: 5977440 - DNA, 16 bp, Homo sapiens
cacaagctggaagcac

SEQ ID NO: 5977441 - DNA, 22 bp, Homo sapiens
cacaagctgtagataacagcaa

SEQ ID NO: 5977442 - DNA, 15 bp, Homo sapiens
cacaagctgtccctg

SEQ ID NO: 5977443 - DNA, 16 bp, Homo sapiens
cacaagctgtccctgc

SEQ ID NO: 5977444 - DNA, 17 bp, Homo sapiens
cacaagctgtccctgca

SEQ ID NO: 5977445 - DNA, 13 bp, Homo sapiens
cacaagcttgtat

SEQ ID NO: 5977446 - DNA, 17 bp, Homo sapiens
cacaaggaaaaggagga

SEQ ID NO: 5977447 - DNA, 18 bp, Homo sapiens
cacaaggaaaaggaggag

SEQ ID NO: 5977448 - DNA, 20 bp, Homo sapiens
cacaaggaaaatagtttagg

SEQ ID NO: 5977449 - DNA, 14 bp, Homo sapiens
cacaaggaagaaat

SEQ ID NO: 5977450 - DNA, 15 bp, Homo sapiens
cacaaggaataaatg

SEQ ID NO: 5977451 - DNA, 18 bp, Homo sapiens
cacaaggaataaatgaga

SEQ ID NO: 5977452 - DNA, 20 bp, Homo sapiens
cacaaggaatttccctgtgt

SEQ ID NO: 5977453 - DNA, 18 bp, Homo sapiens
cacaaggacagaaccctc

SEQ ID NO: 5977454 - DNA, 20 bp, Homo sapiens
cacaaggacgctggctactg

SEQ ID NO: 5977455 - DNA, 16 bp, Homo sapiens
cacaaggagtgcccgc

SEQ ID NO: 5977456 - DNA, 20 bp, Homo sapiens
cacaaggagtgcccgccttg

SEQ ID NO: 5977457 - DNA, 22 bp, Homo sapiens
cacaaggatagatgctggccca

SEQ ID NO: 5977458 - DNA, 18 bp, Homo sapiens
cacaaggattgaaaattc

SEQ ID NO: 5977459 - DNA, 15 bp, Homo sapiens
cacaaggcacggcca

SEQ ID NO: 5977460 - DNA, 17 bp, Homo sapiens
cacaaggcagcaaggcc

SEQ ID NO: 5977461 - DNA, 22 bp, Homo sapiens
cacaaggcagcaaggcccgagc

SEQ ID NO: 5977462 - DNA, 15 bp, Homo sapiens
cacaaggccagaaaa

SEQ ID NO: 5977463 - DNA, 21 bp, Homo sapiens
cacaaggccagaaaaagaaga

SEQ ID NO: 5977464 - DNA, 13 bp, Homo sapiens
cacaaggcccagc

SEQ ID NO: 5977465 - DNA, 14 bp, Homo sapiens
cacaaggcctggtc

SEQ ID NO: 5977466 - DNA, 20 bp, Homo sapiens
cacaaggctgaaaagtgctt

SEQ ID NO: 5977467 - DNA, 21 bp, Homo sapiens
cacaaggctgaccaagagaga

SEQ ID NO: 5977468 - DNA, 24 bp, Homo sapiens
cacaaggctgggcacctctagtgc

SEQ ID NO: 5977469 - DNA, 17 bp, Homo sapiens
cacaagggaaggacaga

SEQ ID NO: 5977470 - DNA, 22 bp, Homo sapiens
cacaagggaaggacagaaagga

SEQ ID NO: 5977471 - DNA, 21 bp, Homo sapiens
cacaagggaagtggaaggaag

SEQ ID NO: 5977472 - DNA, 18 bp, Homo sapiens
cacaagggatataaaatg

SEQ ID NO: 5977473 - DNA, 20 bp, Homo sapiens
cacaagggatataaaatgaa

SEQ ID NO: 5977474 - DNA, 21 bp, Homo sapiens
cacaagggatataaaatgaaa

SEQ ID NO: 5977475 - DNA, 23 bp, Homo sapiens
cacaaggggattttgctgatggg

SEQ ID NO: 5977476 - DNA, 17 bp, Homo sapiens
cacaaggggcccttgga

SEQ ID NO: 5977477 - DNA, 14 bp, Homo sapiens
cacaaggtataata

SEQ ID NO: 5977478 - DNA, 16 bp, Homo sapiens
cacaaggtataataag

SEQ ID NO: 5977479 - DNA, 21 bp, Homo sapiens
cacaaggtcatggccacactg

SEQ ID NO: 5977480 - DNA, 13 bp, Homo sapiens
cacaaggtgctca

SEQ ID NO: 5977481 - DNA, 17 bp, Homo sapiens
cacaaggtggcagcaag

SEQ ID NO: 5977482 - DNA, 14 bp, Homo sapiens
cacaagtatctaaa

SEQ ID NO: 5977483 - DNA, 21 bp, Homo sapiens
cacaagtcctggatgttgtgt

SEQ ID NO: 5977484 - DNA, 20 bp, Homo sapiens
cacaagtcctgtgaatttct

SEQ ID NO: 5977485 - DNA, 18 bp, Homo sapiens
cacaagtctaaacaatga

SEQ ID NO: 5977486 - DNA, 13 bp, Homo sapiens
cacaagtcttcca

SEQ ID NO: 5977487 - DNA, 16 bp, Homo sapiens
cacaagtctttccaga

SEQ ID NO: 5977488 - DNA, 16 bp, Homo sapiens
cacaagtgaaaaacat

SEQ ID NO: 5977489 - DNA, 21 bp, Homo sapiens
cacaagtgggtacccccagga

SEQ ID NO: 5977490 - DNA, 14 bp, Homo sapiens
cacaagtgtattat

SEQ ID NO: 5977491 - DNA, 21 bp, Homo sapiens
cacaagtgtgtggccccgccc

SEQ ID NO: 5977492 - DNA, 16 bp, Homo sapiens
cacaagttccagctgg

SEQ ID NO: 5977493 - DNA, 14 bp, Homo sapiens
cacaagttgtgttt

SEQ ID NO: 5977494 - DNA, 19 bp, Homo sapiens
cacaagttgtttggtactt

SEQ ID NO: 5977495 - DNA, 21 bp, Homo sapiens
cacaagttgtttggtactttt

SEQ ID NO: 5977496 - DNA, 23 bp, Homo sapiens
cacaagtttacttgtctttgatt

SEQ ID NO: 5977497 - DNA, 18 bp, Homo sapiens
cacaataaaaatgtttaa

SEQ ID NO: 5977498 - DNA, 21 bp, Homo sapiens
cacaataaaaccaagcctctg

SEQ ID NO: 5977499 - DNA, 19 bp, Homo sapiens
cacaataaaagacatccac

SEQ ID NO: 5977500 - DNA, 20 bp, Homo sapiens
cacaataaatggccagtgct

SEQ ID NO: 5977501 - DNA, 16 bp, Homo sapiens
caaacagaagtgcatc

SEQ ID NO: 5977502 - DNA, 18 bp, Homo sapiens
caaacagaagtgcatcct

SEQ ID NO: 5977503 - DNA, 14 bp, Homo sapiens
caaacagacaaaac

SEQ ID NO: 5977504 - DNA, 22 bp, Homo sapiens
caaacagacaggtggaaaaact

SEQ ID NO: 5977505 - DNA, 19 bp, Homo sapiens
caaacagagctactgagac

SEQ ID NO: 5977506 - DNA, 13 bp, Homo sapiens
caaacagaggccg

SEQ ID NO: 5977507 - DNA, 15 bp, Homo sapiens
caaacagaggccgcc

SEQ ID NO: 5977508 - DNA, 16 bp, Homo sapiens
caaacagatgctctga

SEQ ID NO: 5977509 - DNA, 13 bp, Homo sapiens
caaacagatgttt

SEQ ID NO: 5977510 - DNA, 11 bp, Homo sapiens
caaacagcaaa

SEQ ID NO: 5977511 - DNA, 16 bp, Homo sapiens
caaacagcaaaccaag

SEQ ID NO: 5977512 - DNA, 19 bp, Homo sapiens
caaacagccacgaggtggt

SEQ ID NO: 5977513 - DNA, 21 bp, Homo sapiens
caaacagccccagtcttcctt

SEQ ID NO: 5977514 - DNA, 15 bp, Homo sapiens
caaacagcccttcct

SEQ ID NO: 5977515 - DNA, 17 bp, Homo sapiens
caaacagcccttccttg

SEQ ID NO: 5977516 - DNA, 21 bp, Homo sapiens
caaacagcccttccttgggga

SEQ ID NO: 5977517 - DNA, 16 bp, Homo sapiens
caaacagctcaggctg

SEQ ID NO: 5977518 - DNA, 14 bp, Homo sapiens
caaacagctgaaag

SEQ ID NO: 5977519 - DNA, 20 bp, Homo sapiens
caaacaggatcagttaacta

SEQ ID NO: 5977520 - DNA, 14 bp, Homo sapiens
caaacaggctcaga

SEQ ID NO: 5977521 - DNA, 15 bp, Homo sapiens
caaacaggctcagag

SEQ ID NO: 5977522 - DNA, 12 bp, Homo sapiens
caaacagggcct

SEQ ID NO: 5977523 - DNA, 18 bp, Homo sapiens
caaacagggtggcccagg

SEQ ID NO: 5977524 - DNA, 16 bp, Homo sapiens
caaacaggtgctaaca

SEQ ID NO: 5977525 - DNA, 17 bp, Homo sapiens
caaacaggtgctggccc

SEQ ID NO: 5977526 - DNA, 15 bp, Homo sapiens
caaacagtctcagga

SEQ ID NO: 5977527 - DNA, 20 bp, Homo sapiens
caaacagtgaatttaagcat

SEQ ID NO: 5977528 - DNA, 15 bp, Homo sapiens
caaacagtgtgttgg

SEQ ID NO: 5977529 - DNA, 20 bp, Homo sapiens
caaacagttgtaccactgct

SEQ ID NO: 5977530 - DNA, 11 bp, Homo sapiens
caaacataata

SEQ ID NO: 5977531 - DNA, 12 bp, Homo sapiens
caaacatagaca

SEQ ID NO: 5977532 - DNA, 16 bp, Homo sapiens
caaacatatgcacatt

SEQ ID NO: 5977533 - DNA, 17 bp, Homo sapiens
caaacatatgtatcttt

SEQ ID NO: 5977534 - DNA, 20 bp, Homo sapiens
caaacatcaaataaatttct

SEQ ID NO: 5977535 - DNA, 18 bp, Homo sapiens
caaacatcagctgaattc

SEQ ID NO: 5977536 - DNA, 16 bp, Homo sapiens
caaacatcattgttta

SEQ ID NO: 5977537 - DNA, 20 bp, Homo sapiens
caaacatcccccaatgacct

SEQ ID NO: 5977538 - DNA, 11 bp, Homo sapiens
caaacatgaaa

SEQ ID NO: 5977539 - DNA, 13 bp, Homo sapiens
caaacatgaaaaa

SEQ ID NO: 5977540 - DNA, 19 bp, Homo sapiens
caaacatgaaaacattgat

SEQ ID NO: 5977541 - DNA, 14 bp, Homo sapiens
caaacatgaagtgt

SEQ ID NO: 5977542 - DNA, 23 bp, Homo sapiens
caaacatgagatgtgtggactgt

SEQ ID NO: 5977543 - DNA, 20 bp, Homo sapiens
caaacatgatactgctgctt

SEQ ID NO: 5977544 - DNA, 14 bp, Homo sapiens
caaacatgtattta

SEQ ID NO: 5977545 - DNA, 14 bp, Homo sapiens
caaacatgtgcaac

SEQ ID NO: 5977546 - DNA, 11 bp, Homo sapiens
caaacatgtgg

SEQ ID NO: 5977547 - DNA, 22 bp, Homo sapiens
caaacatgtggcaacctgttct

SEQ ID NO: 5977548 - DNA, 18 bp, Homo sapiens
caaacatgtggttaatgc

SEQ ID NO: 5977549 - DNA, 20 bp, Homo sapiens
caaacatgtggttaatgcca

SEQ ID NO: 5977550 - DNA, 22 bp, Homo sapiens
caaacatgttcccaaggcccca

SEQ ID NO: 5977551 - DNA, 20 bp, Homo sapiens
caaacatgttgtttgtttta

SEQ ID NO: 5977552 - DNA, 12 bp, Homo sapiens
caaacattaaaa

SEQ ID NO: 5977553 - DNA, 14 bp, Homo sapiens
caaacattaatgtt

SEQ ID NO: 5977554 - DNA, 15 bp, Homo sapiens
caaacattaatgttg

SEQ ID NO: 5977555 - DNA, 19 bp, Homo sapiens
caaacattaatgttgattt

SEQ ID NO: 5977556 - DNA, 21 bp, Homo sapiens
caaacattaatgttgatttct

SEQ ID NO: 5977557 - DNA, 18 bp, Homo sapiens
caaacattagtactttat

SEQ ID NO: 5977558 - DNA, 19 bp, Homo sapiens
caaacattcgtgagctggg

SEQ ID NO: 5977559 - DNA, 22 bp, Homo sapiens
caaacattcgtgagctggggac

SEQ ID NO: 5977560 - DNA, 14 bp, Homo sapiens
caaacattcttatt

SEQ ID NO: 5977561 - DNA, 16 bp, Homo sapiens
caaacattcttatttt

SEQ ID NO: 5977562 - DNA, 16 bp, Homo sapiens
caaacattgctgcctt

SEQ ID NO: 5977563 - DNA, 17 bp, Homo sapiens
caaacattgtgttgaca

SEQ ID NO: 5977564 - DNA, 18 bp, Homo sapiens
caaacattgtgttgacat

SEQ ID NO: 5977565 - DNA, 21 bp, Homo sapiens
caaacatttctgtgaaactat

SEQ ID NO: 5977566 - DNA, 20 bp, Homo sapiens
caaacatttcttaaaatgtt

SEQ ID NO: 5977567 - DNA, 20 bp, Homo sapiens
caaacattttctcttagaaa

SEQ ID NO: 5977568 - DNA, 13 bp, Homo sapiens
caaaccaaagctg

SEQ ID NO: 5977569 - DNA, 14 bp, Homo sapiens
caaaccaaagctgc

SEQ ID NO: 5977570 - DNA, 18 bp, Homo sapiens
caaaccaaagctgcctgt

SEQ ID NO: 5977571 - DNA, 20 bp, Homo sapiens
caaaccaaagctgcctgtgc

SEQ ID NO: 5977572 - DNA, 14 bp, Homo sapiens
caaaccaaataaaa

SEQ ID NO: 5977573 - DNA, 15 bp, Homo sapiens
caaaccaacatcttt

SEQ ID NO: 5977574 - DNA, 21 bp, Homo sapiens
caaaccaagagattgctaatt

SEQ ID NO: 5977575 - DNA, 17 bp, Homo sapiens
caaaccaagtcggaaca

SEQ ID NO: 5977576 - DNA, 22 bp, Homo sapiens
caaaccaatggtgatcctctat

SEQ ID NO: 5977577 - DNA, 17 bp, Homo sapiens
caaaccaatttcttcct

SEQ ID NO: 5977578 - DNA, 18 bp, Homo sapiens
caaaccaatttgttctgt

SEQ ID NO: 5977579 - DNA, 21 bp, Homo sapiens
caaaccacaactgacacagga

SEQ ID NO: 5977580 - DNA, 15 bp, Homo sapiens
caaaccacagcagga

SEQ ID NO: 5977581 - DNA, 16 bp, Homo sapiens
caaaccacatatgaaa

SEQ ID NO: 5977582 - DNA, 22 bp, Homo sapiens
caaaccaccagaagcccagaat

SEQ ID NO: 5977583 - DNA, 20 bp, Homo sapiens
caaaccaccctaaaatgaca

SEQ ID NO: 5977584 - DNA, 22 bp, Homo sapiens
caaaccacgcctcttgaccagg

SEQ ID NO: 5977585 - DNA, 14 bp, Homo sapiens
caaaccactgtgaa

SEQ ID NO: 5977586 - DNA, 16 bp, Homo sapiens
caaaccacttgcctgg

SEQ ID NO: 5977587 - DNA, 17 bp, Homo sapiens
caaaccactttttgcag

SEQ ID NO: 5977588 - DNA, 20 bp, Homo sapiens
caaaccactttttgcagctt

SEQ ID NO: 5977589 - DNA, 13 bp, Homo sapiens
caaaccagaagca

SEQ ID NO: 5977590 - DNA, 18 bp, Homo sapiens
caaaccagagaaaggaaa

SEQ ID NO: 5977591 - DNA, 22 bp, Homo sapiens
caaaccagagaatgctttgaaa

SEQ ID NO: 5977592 - DNA, 23 bp, Homo sapiens
caaaccagatacggacagagacc

SEQ ID NO: 5977593 - DNA, 16 bp, Homo sapiens
caaaccagcagggagt

SEQ ID NO: 5977594 - DNA, 12 bp, Homo sapiens
caaaccagcctc

SEQ ID NO: 5977595 - DNA, 16 bp, Homo sapiens
caaaccagcctggggc

SEQ ID NO: 5977596 - DNA, 18 bp, Homo sapiens
caaaccagcctggggcct

SEQ ID NO: 5977597 - DNA, 12 bp, Homo sapiens
caaaccagcctt

SEQ ID NO: 5977598 - DNA, 18 bp, Homo sapiens
caaaccagccttcggagc

SEQ ID NO: 5977599 - DNA, 22 bp, Homo sapiens
caaaccagcttgttctgggctc

SEQ ID NO: 5977600 - DNA, 14 bp, Homo sapiens
caaaccaggaccct

SEQ ID NO: 5977601 - DNA, 18 bp, Homo sapiens
caaaccaggactctgccc

SEQ ID NO: 5977602 - DNA, 13 bp, Homo sapiens
caaaccaggagca

SEQ ID NO: 5977603 - DNA, 19 bp, Homo sapiens
caaaccaggagcattttgt

SEQ ID NO: 5977604 - DNA, 12 bp, Homo sapiens
caaaccaggatt

SEQ ID NO: 5977605 - DNA, 14 bp, Homo sapiens
caaaccaggctgca

SEQ ID NO: 5977606 - DNA, 16 bp, Homo sapiens
caaaccaggctgcagg

SEQ ID NO: 5977607 - DNA, 17 bp, Homo sapiens
caaaccaggctgcaggt

SEQ ID NO: 5977608 - DNA, 20 bp, Homo sapiens
caaaccaggggacactttgt

SEQ ID NO: 5977609 - DNA, 21 bp, Homo sapiens
caaaccaggggtaccaggcac

SEQ ID NO: 5977610 - DNA, 23 bp, Homo sapiens
caaaccagtttattctgtggttc

SEQ ID NO: 5977611 - DNA, 14 bp, Homo sapiens
caaaccagtttcac

SEQ ID NO: 5977612 - DNA, 16 bp, Homo sapiens
caaaccatcattgaaa

SEQ ID NO: 5977613 - DNA, 15 bp, Homo sapiens
caaaccatctggtgc

SEQ ID NO: 5977614 - DNA, 20 bp, Homo sapiens
caaaccatggattgtacata

SEQ ID NO: 5977615 - DNA, 20 bp, Homo sapiens
caaaccattataccttactt

SEQ ID NO: 5977616 - DNA, 18 bp, Homo sapiens
caaaccatttaattcata

SEQ ID NO: 5977617 - DNA, 19 bp, Homo sapiens
caaaccatttaattcataa

SEQ ID NO: 5977618 - DNA, 23 bp, Homo sapiens
caaaccatttaattcataattag

SEQ ID NO: 5977619 - DNA, 14 bp, Homo sapiens
caaaccatttcaaa

SEQ ID NO: 5977620 - DNA, 16 bp, Homo sapiens
caaaccatttcaaatg

SEQ ID NO: 5977621 - DNA, 17 bp, Homo sapiens
caaaccatttcaaatgg

SEQ ID NO: 5977622 - DNA, 20 bp, Homo sapiens
caaaccatttccaacagcaa

SEQ ID NO: 5977623 - DNA, 14 bp, Homo sapiens
caaacccaaagatg

SEQ ID NO: 5977624 - DNA, 15 bp, Homo sapiens
caaacccaaagatgt

SEQ ID NO: 5977625 - DNA, 20 bp, Homo sapiens
caaacccaaagatgttaaca

SEQ ID NO: 5977626 - DNA, 14 bp, Homo sapiens
caaacccaagttag

SEQ ID NO: 5977627 - DNA, 21 bp, Homo sapiens
caaacccacgattttctccag

SEQ ID NO: 5977628 - DNA, 16 bp, Homo sapiens
caaacccacgcgtgtt

SEQ ID NO: 5977629 - DNA, 12 bp, Homo sapiens
caaacccactca

SEQ ID NO: 5977630 - DNA, 15 bp, Homo sapiens
caaacccacttctgg

SEQ ID NO: 5977631 - DNA, 19 bp, Homo sapiens
caaacccacttctggcctc

SEQ ID NO: 5977632 - DNA, 14 bp, Homo sapiens
caaacccagaacat

SEQ ID NO: 5977633 - DNA, 24 bp, Homo sapiens
caaacccagacggctccactagga

SEQ ID NO: 5977634 - DNA, 20 bp, Homo sapiens
caaacccagagggttgctgg

SEQ ID NO: 5977635 - DNA, 13 bp, Homo sapiens
caaacccagccac

SEQ ID NO: 5977636 - DNA, 15 bp, Homo sapiens
caaacccagccactg

SEQ ID NO: 5977637 - DNA, 17 bp, Homo sapiens
caaacccagccactgcc

SEQ ID NO: 5977638 - DNA, 16 bp, Homo sapiens
caaacccagtctcaga

SEQ ID NO: 5977639 - DNA, 17 bp, Homo sapiens
caaacccagtctcagac

SEQ ID NO: 5977640 - DNA, 20 bp, Homo sapiens
caaacccagtctcctctcca

SEQ ID NO: 5977641 - DNA, 13 bp, Homo sapiens
caaacccatgagg

SEQ ID NO: 5977642 - DNA, 21 bp, Homo sapiens
caaacccatggctctatttct

SEQ ID NO: 5977643 - DNA, 18 bp, Homo sapiens
caaaccccacttcccctc

SEQ ID NO: 5977644 - DNA, 23 bp, Homo sapiens
caaaccccctccttacgctttgt

SEQ ID NO: 5977645 - DNA, 15 bp, Homo sapiens
caaaccccctgcagc

SEQ ID NO: 5977646 - DNA, 16 bp, Homo sapiens
caaaccccctttgtgc

SEQ ID NO: 5977647 - DNA, 18 bp, Homo sapiens
caaaccccctttgtgctg

SEQ ID NO: 5977648 - DNA, 18 bp, Homo sapiens
caaaccccgaccacctgc

SEQ ID NO: 5977649 - DNA, 21 bp, Homo sapiens
caaaccccgaccacctgccca

SEQ ID NO: 5977650 - DNA, 15 bp, Homo sapiens
caaaccctcccagaa

SEQ ID NO: 5977651 - DNA, 23 bp, Homo sapiens
caaaccctcccagaaacatctct

SEQ ID NO: 5977652 - DNA, 11 bp, Homo sapiens
caaaccctgct

SEQ ID NO: 5977653 - DNA, 13 bp, Homo sapiens
caaaccctgctgc

SEQ ID NO: 5977654 - DNA, 14 bp, Homo sapiens
caaaccctgcttct

SEQ ID NO: 5977655 - DNA, 14 bp, Homo sapiens
caaaccctggtgct

SEQ ID NO: 5977656 - DNA, 19 bp, Homo sapiens
caaaccctggtgctttcct

SEQ ID NO: 5977657 - DNA, 22 bp, Homo sapiens
caaaccctggtggtattttatt

SEQ ID NO: 5977658 - DNA, 18 bp, Homo sapiens
caaacccttaactgacat

SEQ ID NO: 5977659 - DNA, 16 bp, Homo sapiens
caaacccttagcagcc

SEQ ID NO: 5977660 - DNA, 18 bp, Homo sapiens
caaacccttcaactcctg

SEQ ID NO: 5977661 - DNA, 21 bp, Homo sapiens
caaacctaatgatcatctgaa

SEQ ID NO: 5977662 - DNA, 15 bp, Homo sapiens
caaacctaattgcac

SEQ ID NO: 5977663 - DNA, 17 bp, Homo sapiens
caaacctaccaaaatgg

SEQ ID NO: 5977664 - DNA, 22 bp, Homo sapiens
caaacctaccttatagagcaca

SEQ ID NO: 5977665 - DNA, 20 bp, Homo sapiens
caaacctactgcccacattt

SEQ ID NO: 5977666 - DNA, 13 bp, Homo sapiens
caaacctcagagg

SEQ ID NO: 5977667 - DNA, 12 bp, Homo sapiens
caaacctccaaa

SEQ ID NO: 5977668 - DNA, 13 bp, Homo sapiens
caaacctccagcc

SEQ ID NO: 5977669 - DNA, 21 bp, Homo sapiens
caaacctcctgtcagtgagga

SEQ ID NO: 5977670 - DNA, 13 bp, Homo sapiens
caaacctctcctt

SEQ ID NO: 5977671 - DNA, 15 bp, Homo sapiens
caaacctctccttcc

SEQ ID NO: 5977672 - DNA, 16 bp, Homo sapiens
caaacctctccttcct

SEQ ID NO: 5977673 - DNA, 18 bp, Homo sapiens
caaacctctccttcctca

SEQ ID NO: 5977674 - DNA, 12 bp, Homo sapiens
caaacctctgtt

SEQ ID NO: 5977675 - DNA, 19 bp, Homo sapiens
caaacctctgttcagtgta

SEQ ID NO: 5977676 - DNA, 20 bp, Homo sapiens
caaacctctgttcagtgtaa

SEQ ID NO: 5977677 - DNA, 16 bp, Homo sapiens
caaacctgcatattgt

SEQ ID NO: 5977678 - DNA, 14 bp, Homo sapiens
caaacctgctggtg

SEQ ID NO: 5977679 - DNA, 18 bp, Homo sapiens
caaacctggagctgagga

SEQ ID NO: 5977680 - DNA, 16 bp, Homo sapiens
caaacctgggaaggcc

SEQ ID NO: 5977681 - DNA, 16 bp, Homo sapiens
cacaataaatggctgt

SEQ ID NO: 5977682 - DNA, 22 bp, Homo sapiens
cacaataactagtaataccaaa

SEQ ID NO: 5977683 - DNA, 16 bp, Homo sapiens
cacaataactcctccc

SEQ ID NO: 5977684 - DNA, 20 bp, Homo sapiens
cacaataactcctcccaggg

SEQ ID NO: 5977685 - DNA, 22 bp, Homo sapiens
cacaataagagtctccttctct

SEQ ID NO: 5977686 - DNA, 13 bp, Homo sapiens
cacaataagcaaa

SEQ ID NO: 5977687 - DNA, 19 bp, Homo sapiens
cacaatacagataacatta

SEQ ID NO: 5977688 - DNA, 23 bp, Homo sapiens
cacaatacagtaagtaaagtggt

SEQ ID NO: 5977689 - DNA, 15 bp, Homo sapiens
cacaatagaattata

SEQ ID NO: 5977690 - DNA, 20 bp, Homo sapiens
cacaataggtctttctctca

SEQ ID NO: 5977691 - DNA, 23 bp, Homo sapiens
cacaatattcagtggtgaaatct

SEQ ID NO: 5977692 - DNA, 17 bp, Homo sapiens
cacaatcactaaacttt

SEQ ID NO: 5977693 - DNA, 21 bp, Homo sapiens
cacaatcagtttatcctgaca

SEQ ID NO: 5977694 - DNA, 15 bp, Homo sapiens
cacaatcccacctag

SEQ ID NO: 5977695 - DNA, 17 bp, Homo sapiens
cacaatcccacctagcc

SEQ ID NO: 5977696 - DNA, 19 bp, Homo sapiens
cacaatccctggggctgtg

SEQ ID NO: 5977697 - DNA, 15 bp, Homo sapiens
cacaatccctttcta

SEQ ID NO: 5977698 - DNA, 20 bp, Homo sapiens
cacaatcctaacacattatc

SEQ ID NO: 5977699 - DNA, 17 bp, Homo sapiens
cacaatcctcctgggga

SEQ ID NO: 5977700 - DNA, 14 bp, Homo sapiens
cacaatcctgtccc

SEQ ID NO: 5977701 - DNA, 20 bp, Homo sapiens
cacaatctcggctcactgca

SEQ ID NO: 5977702 - DNA, 22 bp, Homo sapiens
cacaatctcggctcactgcatc

SEQ ID NO: 5977703 - DNA, 14 bp, Homo sapiens
cacaatctgagcac

SEQ ID NO: 5977704 - DNA, 20 bp, Homo sapiens
cacaatcttaaggggcagct

SEQ ID NO: 5977705 - DNA, 23 bp, Homo sapiens
cacaatctttccttgtctctcat

SEQ ID NO: 5977706 - DNA, 22 bp, Homo sapiens
cacaatgaaatgctctcctttc

SEQ ID NO: 5977707 - DNA, 16 bp, Homo sapiens
cacaatgaccagcagg

SEQ ID NO: 5977708 - DNA, 14 bp, Homo sapiens
cacaatgagaaaaa

SEQ ID NO: 5977709 - DNA, 19 bp, Homo sapiens
cacaatgagatgcatgatt

SEQ ID NO: 5977710 - DNA, 23 bp, Homo sapiens
cacaatgagattgaatttcactg

SEQ ID NO: 5977711 - DNA, 22 bp, Homo sapiens
cacaatgcagtgcctttcttct

SEQ ID NO: 5977712 - DNA, 22 bp, Homo sapiens
cacaatgcatgtgctgtctcca

SEQ ID NO: 5977713 - DNA, 15 bp, Homo sapiens
cacaatgctgggtgg

SEQ ID NO: 5977714 - DNA, 22 bp, Homo sapiens
cacaatggaaaacctgggggat

SEQ ID NO: 5977715 - DNA, 22 bp, Homo sapiens
cacaatggagtgggagatcagc

SEQ ID NO: 5977716 - DNA, 17 bp, Homo sapiens
cacaatggagtgtgtaa

SEQ ID NO: 5977717 - DNA, 21 bp, Homo sapiens
cacaatggcacctctgccctt

SEQ ID NO: 5977718 - DNA, 16 bp, Homo sapiens
cacaatggtttcaaag

SEQ ID NO: 5977719 - DNA, 17 bp, Homo sapiens
cacaatggtttttaaat

SEQ ID NO: 5977720 - DNA, 22 bp, Homo sapiens
cacaatggtttttaaattttgt

SEQ ID NO: 5977721 - DNA, 24 bp, Homo sapiens
cacaatgtatacttcagtgctcac

SEQ ID NO: 5977722 - DNA, 18 bp, Homo sapiens
cacaatgtcagtatttca

SEQ ID NO: 5977723 - DNA, 12 bp, Homo sapiens
cacaatgtcttg

SEQ ID NO: 5977724 - DNA, 21 bp, Homo sapiens
cacaatgtgaaactgaaggtc

SEQ ID NO: 5977725 - DNA, 21 bp, Homo sapiens
cacaatgttccttttttgtat

SEQ ID NO: 5977726 - DNA, 21 bp, Homo sapiens
cacaatgttgcactgaaaacc

SEQ ID NO: 5977727 - DNA, 19 bp, Homo sapiens
cacaattaaaccgcatgtg

SEQ ID NO: 5977728 - DNA, 14 bp, Homo sapiens
cacaattaattgtc

SEQ ID NO: 5977729 - DNA, 14 bp, Homo sapiens
cacaattagagctt

SEQ ID NO: 5977730 - DNA, 13 bp, Homo sapiens
cacaattagggaa

SEQ ID NO: 5977731 - DNA, 15 bp, Homo sapiens
cacaattattaaatt

SEQ ID NO: 5977732 - DNA, 17 bp, Homo sapiens
cacaattattggcaaag

SEQ ID NO: 5977733 - DNA, 17 bp, Homo sapiens
cacaattcattcaccag

SEQ ID NO: 5977734 - DNA, 17 bp, Homo sapiens
cacaattcattggctcc

SEQ ID NO: 5977735 - DNA, 21 bp, Homo sapiens
cacaattccatttccagttca

SEQ ID NO: 5977736 - DNA, 22 bp, Homo sapiens
cacaattccatttccagttcat

SEQ ID NO: 5977737 - DNA, 14 bp, Homo sapiens
cacaattcctgtgc

SEQ ID NO: 5977738 - DNA, 15 bp, Homo sapiens
cacaattcctgtgct

SEQ ID NO: 5977739 - DNA, 15 bp, Homo sapiens
cacaattctgtccct

SEQ ID NO: 5977740 - DNA, 22 bp, Homo sapiens
cacaattgaattagttttttct

SEQ ID NO: 5977741 - DNA, 18 bp, Homo sapiens
cacaattgatacttcagg

SEQ ID NO: 5977742 - DNA, 18 bp, Homo sapiens
cacaattggccagggcaa

SEQ ID NO: 5977743 - DNA, 13 bp, Homo sapiens
cacaattgtaaag

SEQ ID NO: 5977744 - DNA, 21 bp, Homo sapiens
cacaatttagaaaacattcat

SEQ ID NO: 5977745 - DNA, 18 bp, Homo sapiens
cacaatttcatttccagc

SEQ ID NO: 5977746 - DNA, 17 bp, Homo sapiens
cacaatttctttaaaaa

SEQ ID NO: 5977747 - DNA, 16 bp, Homo sapiens
cacaatttgagcaatt

SEQ ID NO: 5977748 - DNA, 22 bp, Homo sapiens
cacaattttattttttttctgt

SEQ ID NO: 5977749 - DNA, 18 bp, Homo sapiens
cacaattttgataaaaat

SEQ ID NO: 5977750 - DNA, 15 bp, Homo sapiens
cacaatttttaatgg

SEQ ID NO: 5977751 - DNA, 16 bp, Homo sapiens
cacaatttttaatggc

SEQ ID NO: 5977752 - DNA, 22 bp, Homo sapiens
cacaatttttaatggcagcaga

SEQ ID NO: 5977753 - DNA, 19 bp, Homo sapiens
cacacaaaaaaagacctgt

SEQ ID NO: 5977754 - DNA, 13 bp, Homo sapiens
cacacaaaaataa

SEQ ID NO: 5977755 - DNA, 15 bp, Homo sapiens
cacacaaaacaacag

SEQ ID NO: 5977756 - DNA, 23 bp, Homo sapiens
cacacaaaagggaacccagctct

SEQ ID NO: 5977757 - DNA, 15 bp, Homo sapiens
cacacaaacaaggcc

SEQ ID NO: 5977758 - DNA, 19 bp, Homo sapiens
cacacaaacctactgccca

SEQ ID NO: 5977759 - DNA, 20 bp, Homo sapiens
cacacaaacctactgcccac

SEQ ID NO: 5977760 - DNA, 21 bp, Homo sapiens
cacacaaacctactgcccaca

SEQ ID NO: 5977761 - DNA, 15 bp, Homo sapiens
cacacaaagactcct

SEQ ID NO: 5977762 - DNA, 13 bp, Homo sapiens
cacacaaagagag

SEQ ID NO: 5977763 - DNA, 19 bp, Homo sapiens
cacacaaaggcatgctgga

SEQ ID NO: 5977764 - DNA, 21 bp, Homo sapiens
cacacaaaggcatgctggagt

SEQ ID NO: 5977765 - DNA, 17 bp, Homo sapiens
cacacaaagtgaaatta

SEQ ID NO: 5977766 - DNA, 12 bp, Homo sapiens
cacacaaatgca

SEQ ID NO: 5977767 - DNA, 18 bp, Homo sapiens
cacacaaatgcagacaca

SEQ ID NO: 5977768 - DNA, 21 bp, Homo sapiens
cacacaaattatcttaaaact

SEQ ID NO: 5977769 - DNA, 14 bp, Homo sapiens
cacacaacaaaaat

SEQ ID NO: 5977770 - DNA, 20 bp, Homo sapiens
cacacaacatcaagaaaaca

SEQ ID NO: 5977771 - DNA, 16 bp, Homo sapiens
cacacaacgtaaaaat

SEQ ID NO: 5977772 - DNA, 16 bp, Homo sapiens
cacacaagaagaaggg

SEQ ID NO: 5977773 - DNA, 12 bp, Homo sapiens
cacacaagacag

SEQ ID NO: 5977774 - DNA, 22 bp, Homo sapiens
cacacaagcagacacacacata

SEQ ID NO: 5977775 - DNA, 16 bp, Homo sapiens
cacacaagcccacagc

SEQ ID NO: 5977776 - DNA, 16 bp, Homo sapiens
cacacaagggaaggac

SEQ ID NO: 5977777 - DNA, 13 bp, Homo sapiens
cacacaaggtgct

SEQ ID NO: 5977778 - DNA, 19 bp, Homo sapiens
cacacaaggtgctcagaca

SEQ ID NO: 5977779 - DNA, 14 bp, Homo sapiens
cacacaagtgcagt

SEQ ID NO: 5977780 - DNA, 14 bp, Homo sapiens
cacacaatcagacc

SEQ ID NO: 5977781 - DNA, 10 bp, Homo sapiens
cacacacaaa

SEQ ID NO: 5977782 - DNA, 14 bp, Homo sapiens
cacacacaaaaaaa

SEQ ID NO: 5977783 - DNA, 12 bp, Homo sapiens
cacacacaaaac

SEQ ID NO: 5977784 - DNA, 13 bp, Homo sapiens
cacacacaaaaca

SEQ ID NO: 5977785 - DNA, 15 bp, Homo sapiens
cacacacaaaccatt

SEQ ID NO: 5977786 - DNA, 14 bp, Homo sapiens
cacacacaaagaga

SEQ ID NO: 5977787 - DNA, 13 bp, Homo sapiens
cacacacaacagc

SEQ ID NO: 5977788 - DNA, 20 bp, Homo sapiens
cacacacaacagccaacagc

SEQ ID NO: 5977789 - DNA, 9 bp, Homo sapiens
cacacacac

SEQ ID NO: 5977790 - DNA, 15 bp, Homo sapiens
cacacacacaacaaa

SEQ ID NO: 5977791 - DNA, 12 bp, Homo sapiens
cacacacacaca

SEQ ID NO: 5977792 - DNA, 15 bp, Homo sapiens
cacacacacacacat

SEQ ID NO: 5977793 - DNA, 14 bp, Homo sapiens
cacacacacacacg

SEQ ID NO: 5977794 - DNA, 14 bp, Homo sapiens
cacacacacacagg

SEQ ID NO: 5977795 - DNA, 15 bp, Homo sapiens
cacacacacacatac

SEQ ID NO: 5977796 - DNA, 14 bp, Homo sapiens
cacacacacacatg

SEQ ID NO: 5977797 - DNA, 15 bp, Homo sapiens
cacacacacacgcag

SEQ ID NO: 5977798 - DNA, 15 bp, Homo sapiens
cacacacacagccag

SEQ ID NO: 5977799 - DNA, 15 bp, Homo sapiens
cacacacacagccat

SEQ ID NO: 5977800 - DNA, 13 bp, Homo sapiens
cacacacacaggt

SEQ ID NO: 5977801 - DNA, 13 bp, Homo sapiens
cacacacacatac

SEQ ID NO: 5977802 - DNA, 14 bp, Homo sapiens
cacacacacatgct

SEQ ID NO: 5977803 - DNA, 13 bp, Homo sapiens
cacacacacccac

SEQ ID NO: 5977804 - DNA, 16 bp, Homo sapiens
cacacacacccttccc

SEQ ID NO: 5977805 - DNA, 13 bp, Homo sapiens
cacacacacctgt

SEQ ID NO: 5977806 - DNA, 14 bp, Homo sapiens
cacacacacgcacg

SEQ ID NO: 5977807 - DNA, 14 bp, Homo sapiens
cacacacactcctt

SEQ ID NO: 5977808 - DNA, 12 bp, Homo sapiens
cacacacactct

SEQ ID NO: 5977809 - DNA, 16 bp, Homo sapiens
cacacacactcttcaa

SEQ ID NO: 5977810 - DNA, 23 bp, Homo sapiens
cacacacagaaaatatactgtaa

SEQ ID NO: 5977811 - DNA, 13 bp, Homo sapiens
cacacacagacac

SEQ ID NO: 5977812 - DNA, 14 bp, Homo sapiens
cacacacagacaca

SEQ ID NO: 5977813 - DNA, 21 bp, Homo sapiens
cacacacagagatatgcacac

SEQ ID NO: 5977814 - DNA, 14 bp, Homo sapiens
cacacacagatatg

SEQ ID NO: 5977815 - DNA, 16 bp, Homo sapiens
cacacacagcagctcc

SEQ ID NO: 5977816 - DNA, 17 bp, Homo sapiens
cacacacagcagctcca

SEQ ID NO: 5977817 - DNA, 15 bp, Homo sapiens
cacacacagccacac

SEQ ID NO: 5977818 - DNA, 16 bp, Homo sapiens
cacacacagccacaca

SEQ ID NO: 5977819 - DNA, 13 bp, Homo sapiens
cacacacagccat

SEQ ID NO: 5977820 - DNA, 12 bp, Homo sapiens
cacacacagcct

SEQ ID NO: 5977821 - DNA, 14 bp, Homo sapiens
cacacacagcctgg

SEQ ID NO: 5977822 - DNA, 17 bp, Homo sapiens
cacacacagcctggcct

SEQ ID NO: 5977823 - DNA, 14 bp, Homo sapiens
cacacacagctcct

SEQ ID NO: 5977824 - DNA, 15 bp, Homo sapiens
cacacacagctgggc

SEQ ID NO: 5977825 - DNA, 13 bp, Homo sapiens
cacacacaggcaa

SEQ ID NO: 5977826 - DNA, 18 bp, Homo sapiens
cacacacagtcctcacac

SEQ ID NO: 5977827 - DNA, 15 bp, Homo sapiens
cacacacatacacac

SEQ ID NO: 5977828 - DNA, 13 bp, Homo sapiens
cacacacatgcac

SEQ ID NO: 5977829 - DNA, 14 bp, Homo sapiens
cacacacatgcaca

SEQ ID NO: 5977830 - DNA, 18 bp, Homo sapiens
cacacacatgcatacaca

SEQ ID NO: 5977831 - DNA, 22 bp, Homo sapiens
cacacacattgctgtgaacagg

SEQ ID NO: 5977832 - DNA, 14 bp, Homo sapiens
cacacaccagagcc

SEQ ID NO: 5977833 - DNA, 16 bp, Homo sapiens
cacacaccagagccca

SEQ ID NO: 5977834 - DNA, 15 bp, Homo sapiens
cacacaccagtttac

SEQ ID NO: 5977835 - DNA, 16 bp, Homo sapiens
cacacaccagtttaca

SEQ ID NO: 5977836 - DNA, 13 bp, Homo sapiens
cacacacccatgt

SEQ ID NO: 5977837 - DNA, 14 bp, Homo sapiens
cacacacctagcca

SEQ ID NO: 5977838 - DNA, 13 bp, Homo sapiens
cacacacctccga

SEQ ID NO: 5977839 - DNA, 14 bp, Homo sapiens
cacacacctccgag

SEQ ID NO: 5977840 - DNA, 14 bp, Homo sapiens
cacacacctctgcc

SEQ ID NO: 5977841 - DNA, 12 bp, Homo sapiens
cacacacctgca

SEQ ID NO: 5977842 - DNA, 13 bp, Homo sapiens
cacacacctgcac

SEQ ID NO: 5977843 - DNA, 13 bp, Homo sapiens
cacacacgatgca

SEQ ID NO: 5977844 - DNA, 21 bp, Homo sapiens
cacacacgatgcatttaataa

SEQ ID NO: 5977845 - DNA, 23 bp, Homo sapiens
cacacacgcacgcacacacacaa

SEQ ID NO: 5977846 - DNA, 18 bp, Homo sapiens
cacacacgcacggcttcc

SEQ ID NO: 5977847 - DNA, 16 bp, Homo sapiens
cacacacgcagacaca

SEQ ID NO: 5977848 - DNA, 19 bp, Homo sapiens
cacacacgcagacacacac

SEQ ID NO: 5977849 - DNA, 12 bp, Homo sapiens
cacacacgccag

SEQ ID NO: 5977850 - DNA, 21 bp, Homo sapiens
cacacacgcgcgcgcacacac

SEQ ID NO: 5977851 - DNA, 19 bp, Homo sapiens
cacacacgctttcttatgc

SEQ ID NO: 5977852 - DNA, 22 bp, Homo sapiens
cacacacggttttggcagctga

SEQ ID NO: 5977853 - DNA, 12 bp, Homo sapiens
cacacacgttat

SEQ ID NO: 5977854 - DNA, 14 bp, Homo sapiens
cacacactcaccag

SEQ ID NO: 5977855 - DNA, 15 bp, Homo sapiens
cacacactcaccagt

SEQ ID NO: 5977856 - DNA, 13 bp, Homo sapiens
cacacactccctg

SEQ ID NO: 5977857 - DNA, 20 bp, Homo sapiens
cacacactcgcccgcccact

SEQ ID NO: 5977858 - DNA, 23 bp, Homo sapiens
cacacactcgggttaagaaatac

SEQ ID NO: 5977859 - DNA, 16 bp, Homo sapiens
cacacactgcacatct

SEQ ID NO: 5977860 - DNA, 17 bp, Homo sapiens
cacacactgcctcccat

SEQ ID NO: 5977861 - DNA, 13 bp, Homo sapiens
cacacactggacc

SEQ ID NO: 5977862 - DNA, 17 bp, Homo sapiens
cacacactggaccccac

SEQ ID NO: 5977863 - DNA, 19 bp, Homo sapiens
caaacctgggaaggccagc

SEQ ID NO: 5977864 - DNA, 19 bp, Homo sapiens
caaacctgtagatgcagaa

SEQ ID NO: 5977865 - DNA, 21 bp, Homo sapiens
caaacctgtatttaaaaagaa

SEQ ID NO: 5977866 - DNA, 19 bp, Homo sapiens
caaacctgtcttggggcca

SEQ ID NO: 5977867 - DNA, 14 bp, Homo sapiens
caaaccttaaaaca

SEQ ID NO: 5977868 - DNA, 18 bp, Homo sapiens
caaaccttaaaacagctg

SEQ ID NO: 5977869 - DNA, 20 bp, Homo sapiens
caaaccttaaaacagctgtt

SEQ ID NO: 5977870 - DNA, 20 bp, Homo sapiens
caaaccttactctgagctca

SEQ ID NO: 5977871 - DNA, 14 bp, Homo sapiens
caaaccttcctggg

SEQ ID NO: 5977872 - DNA, 14 bp, Homo sapiens
caaaccttcttttc

SEQ ID NO: 5977873 - DNA, 15 bp, Homo sapiens
caaaccttcttttca

SEQ ID NO: 5977874 - DNA, 20 bp, Homo sapiens
caaaccttcttttcaatgca

SEQ ID NO: 5977875 - DNA, 22 bp, Homo sapiens
caaaccttcttttcaatgcaat

SEQ ID NO: 5977876 - DNA, 18 bp, Homo sapiens
caaaccttgacctccaga

SEQ ID NO: 5977877 - DNA, 20 bp, Homo sapiens
caaaccttgacctccagaca

SEQ ID NO: 5977878 - DNA, 20 bp, Homo sapiens
caaacctttctataatttta

SEQ ID NO: 5977879 - DNA, 16 bp, Homo sapiens
caaacctttctggcct

SEQ ID NO: 5977880 - DNA, 19 bp, Homo sapiens
caaacctttctggcctgtt

SEQ ID NO: 5977881 - DNA, 16 bp, Homo sapiens
caaacctttgtttcaa

SEQ ID NO: 5977882 - DNA, 19 bp, Homo sapiens
caaacgactaacctatcta

SEQ ID NO: 5977883 - DNA, 20 bp, Homo sapiens
caaacgccctttcctcctca

SEQ ID NO: 5977884 - DNA, 17 bp, Homo sapiens
caaacgcctcccctgcc

SEQ ID NO: 5977885 - DNA, 23 bp, Homo sapiens
caaacgctaaagagcccttgcct

SEQ ID NO: 5977886 - DNA, 12 bp, Homo sapiens
caaacgctgcct

SEQ ID NO: 5977887 - DNA, 17 bp, Homo sapiens
caaacgctgcctgccca

SEQ ID NO: 5977888 - DNA, 13 bp, Homo sapiens
caaacggagcccc

SEQ ID NO: 5977889 - DNA, 16 bp, Homo sapiens
caaacggagcccctga

SEQ ID NO: 5977890 - DNA, 18 bp, Homo sapiens
caaacggagcccctgaaa

SEQ ID NO: 5977891 - DNA, 14 bp, Homo sapiens
caaacggaggaagc

SEQ ID NO: 5977892 - DNA, 17 bp, Homo sapiens
caaacggaggaagccca

SEQ ID NO: 5977893 - DNA, 14 bp, Homo sapiens
caaacggcaacatt

SEQ ID NO: 5977894 - DNA, 20 bp, Homo sapiens
caaacggcaacgtagcctgg

SEQ ID NO: 5977895 - DNA, 16 bp, Homo sapiens
caaacgggtgcctggt

SEQ ID NO: 5977896 - DNA, 18 bp, Homo sapiens
caaacggtgcaacagaag

SEQ ID NO: 5977897 - DNA, 22 bp, Homo sapiens
caaacgtgttatattccatact

SEQ ID NO: 5977898 - DNA, 13 bp, Homo sapiens
caaacgtgttttt

SEQ ID NO: 5977899 - DNA, 19 bp, Homo sapiens
caaacgtgttttttaaaaa

SEQ ID NO: 5977900 - DNA, 16 bp, Homo sapiens
caaactaaaggtgcac

SEQ ID NO: 5977901 - DNA, 14 bp, Homo sapiens
caaactaacaggct

SEQ ID NO: 5977902 - DNA, 13 bp, Homo sapiens
caaactaagcccc

SEQ ID NO: 5977903 - DNA, 22 bp, Homo sapiens
caaactacaaagctgaagaaaa

SEQ ID NO: 5977904 - DNA, 18 bp, Homo sapiens
caaactacagaataatgt

SEQ ID NO: 5977905 - DNA, 16 bp, Homo sapiens
caaactacatgtaatc

SEQ ID NO: 5977906 - DNA, 21 bp, Homo sapiens
caaactacctatattccttgt

SEQ ID NO: 5977907 - DNA, 21 bp, Homo sapiens
caaactactgaatgaagcagt

SEQ ID NO: 5977908 - DNA, 18 bp, Homo sapiens
caaactactgtacatttt

SEQ ID NO: 5977909 - DNA, 20 bp, Homo sapiens
caaactactttgctgctaat

SEQ ID NO: 5977910 - DNA, 13 bp, Homo sapiens
caaactagattca

SEQ ID NO: 5977911 - DNA, 17 bp, Homo sapiens
caaactaggaggaaaag

SEQ ID NO: 5977912 - DNA, 22 bp, Homo sapiens
caaactaggggacaaagcaaaa

SEQ ID NO: 5977913 - DNA, 18 bp, Homo sapiens
caaactatgagttcacat

SEQ ID NO: 5977914 - DNA, 21 bp, Homo sapiens
caaactatgatttattttggt

SEQ ID NO: 5977915 - DNA, 14 bp, Homo sapiens
caaactatgtaatg

SEQ ID NO: 5977916 - DNA, 14 bp, Homo sapiens
caaactatttcaga

SEQ ID NO: 5977917 - DNA, 18 bp, Homo sapiens
caaactatttcagaatat

SEQ ID NO: 5977918 - DNA, 19 bp, Homo sapiens
caaactatttcagaatatt

SEQ ID NO: 5977919 - DNA, 15 bp, Homo sapiens
caaactcaaggtcaa

SEQ ID NO: 5977920 - DNA, 15 bp, Homo sapiens
caaactcaggcccag

SEQ ID NO: 5977921 - DNA, 14 bp, Homo sapiens
caaactcaggcttt

SEQ ID NO: 5977922 - DNA, 21 bp, Homo sapiens
caaactcagttccaaagtcac

SEQ ID NO: 5977923 - DNA, 23 bp, Homo sapiens
caaactcagttccaaagtcacag

SEQ ID NO: 5977924 - DNA, 11 bp, Homo sapiens
caaactcatct

SEQ ID NO: 5977925 - DNA, 14 bp, Homo sapiens
caaactcattgcag

SEQ ID NO: 5977926 - DNA, 18 bp, Homo sapiens
caaactccaaggttccct

SEQ ID NO: 5977927 - DNA, 12 bp, Homo sapiens
caaactccaggc

SEQ ID NO: 5977928 - DNA, 12 bp, Homo sapiens
caaactccaggt

SEQ ID NO: 5977929 - DNA, 14 bp, Homo sapiens
caaactcccaggac

SEQ ID NO: 5977930 - DNA, 15 bp, Homo sapiens
caaactccccttccc

SEQ ID NO: 5977931 - DNA, 22 bp, Homo sapiens
caaactccccttccctggggag

SEQ ID NO: 5977932 - DNA, 19 bp, Homo sapiens
caaactcctatttcaatga

SEQ ID NO: 5977933 - DNA, 14 bp, Homo sapiens
caaactcctgacct

SEQ ID NO: 5977934 - DNA, 15 bp, Homo sapiens
caaactcctgacctc

SEQ ID NO: 5977935 - DNA, 19 bp, Homo sapiens
caaactcctgacctcaggc

SEQ ID NO: 5977936 - DNA, 16 bp, Homo sapiens
caaactcctgcctgtg

SEQ ID NO: 5977937 - DNA, 18 bp, Homo sapiens
caaactcctgcctgtgtt

SEQ ID NO: 5977938 - DNA, 14 bp, Homo sapiens
caaactcctgggct

SEQ ID NO: 5977939 - DNA, 15 bp, Homo sapiens
caaactcgtctgatg

SEQ ID NO: 5977940 - DNA, 17 bp, Homo sapiens
caaactcttgacctcag

SEQ ID NO: 5977941 - DNA, 20 bp, Homo sapiens
caaactcttgacctcaggtg

SEQ ID NO: 5977942 - DNA, 21 bp, Homo sapiens
caaactctttgcccagttcat

SEQ ID NO: 5977943 - DNA, 17 bp, Homo sapiens
caaactcttttttaaaa

SEQ ID NO: 5977944 - DNA, 16 bp, Homo sapiens
caaactgaaaaatcta

SEQ ID NO: 5977945 - DNA, 20 bp, Homo sapiens
caaactgaaaaatctagaca

SEQ ID NO: 5977946 - DNA, 17 bp, Homo sapiens
caaactgaaattcagag

SEQ ID NO: 5977947 - DNA, 21 bp, Homo sapiens
caaactgaatgaaacccccac

SEQ ID NO: 5977948 - DNA, 15 bp, Homo sapiens
caaactgacaatttt

SEQ ID NO: 5977949 - DNA, 16 bp, Homo sapiens
caaactgactcttaag

SEQ ID NO: 5977950 - DNA, 17 bp, Homo sapiens
caaactgactcttaaga

SEQ ID NO: 5977951 - DNA, 21 bp, Homo sapiens
caaactgactcttaagaagac

SEQ ID NO: 5977952 - DNA, 17 bp, Homo sapiens
caaactgagtaaattgg

SEQ ID NO: 5977953 - DNA, 19 bp, Homo sapiens
caaactgagtaaattggaa

SEQ ID NO: 5977954 - DNA, 18 bp, Homo sapiens
caaactgatctaaaatgt

SEQ ID NO: 5977955 - DNA, 16 bp, Homo sapiens
caaactgatttctcac

SEQ ID NO: 5977956 - DNA, 15 bp, Homo sapiens
caaactgcaatagag

SEQ ID NO: 5977957 - DNA, 13 bp, Homo sapiens
caaactgcacatc

SEQ ID NO: 5977958 - DNA, 18 bp, Homo sapiens
caaactgcacatgatttc

SEQ ID NO: 5977959 - DNA, 21 bp, Homo sapiens
caaactgcacatgatttcaca

SEQ ID NO: 5977960 - DNA, 22 bp, Homo sapiens
caaactgcacatgatttcacaa

SEQ ID NO: 5977961 - DNA, 17 bp, Homo sapiens
caaactgcagctgtgag

SEQ ID NO: 5977962 - DNA, 16 bp, Homo sapiens
caaactgcatgcccag

SEQ ID NO: 5977963 - DNA, 17 bp, Homo sapiens
caaactgcctaagccct

SEQ ID NO: 5977964 - DNA, 19 bp, Homo sapiens
caaactgcggtatacattt

SEQ ID NO: 5977965 - DNA, 15 bp, Homo sapiens
caaactgctggaaat

SEQ ID NO: 5977966 - DNA, 14 bp, Homo sapiens
caaactgctggggc

SEQ ID NO: 5977967 - DNA, 19 bp, Homo sapiens
caaactgcttatgaaaagt

SEQ ID NO: 5977968 - DNA, 12 bp, Homo sapiens
caaactggagtc

SEQ ID NO: 5977969 - DNA, 19 bp, Homo sapiens
caaactggcaaacttcaga

SEQ ID NO: 5977970 - DNA, 12 bp, Homo sapiens
caaactggcagg

SEQ ID NO: 5977971 - DNA, 20 bp, Homo sapiens
caaactggccgcgggggcag

SEQ ID NO: 5977972 - DNA, 20 bp, Homo sapiens
caaactgggaacccctttcc

SEQ ID NO: 5977973 - DNA, 23 bp, Homo sapiens
caaactgggaacccctttcccac

SEQ ID NO: 5977974 - DNA, 17 bp, Homo sapiens
caaactggggcctccct

SEQ ID NO: 5977975 - DNA, 17 bp, Homo sapiens
caaactggttatttaaa

SEQ ID NO: 5977976 - DNA, 16 bp, Homo sapiens
caaactggtttgaaat

SEQ ID NO: 5977977 - DNA, 12 bp, Homo sapiens
caaactgtaaat

SEQ ID NO: 5977978 - DNA, 21 bp, Homo sapiens
caaactgtaaataaaaagaaa

SEQ ID NO: 5977979 - DNA, 21 bp, Homo sapiens
caaactgtagtaattgttaca

SEQ ID NO: 5977980 - DNA, 22 bp, Homo sapiens
caaactgtagtaattgttacaa

SEQ ID NO: 5977981 - DNA, 16 bp, Homo sapiens
caaactgtataacttg

SEQ ID NO: 5977982 - DNA, 17 bp, Homo sapiens
caaactgtatcttcctt

SEQ ID NO: 5977983 - DNA, 22 bp, Homo sapiens
caaactgtatcttcctttactg

SEQ ID NO: 5977984 - DNA, 15 bp, Homo sapiens
caaactgtccctccc

SEQ ID NO: 5977985 - DNA, 17 bp, Homo sapiens
caaactgtccctccctt

SEQ ID NO: 5977986 - DNA, 19 bp, Homo sapiens
caaactgtccctcccttgc

SEQ ID NO: 5977987 - DNA, 11 bp, Homo sapiens
caaactgtgaa

SEQ ID NO: 5977988 - DNA, 18 bp, Homo sapiens
caaactgtgaaaatagtg

SEQ ID NO: 5977989 - DNA, 22 bp, Homo sapiens
caaactgtgaagcatttacaga

SEQ ID NO: 5977990 - DNA, 14 bp, Homo sapiens
caaactgtgccctg

SEQ ID NO: 5977991 - DNA, 21 bp, Homo sapiens
caaactgtgccctgccttcag

SEQ ID NO: 5977992 - DNA, 19 bp, Homo sapiens
caaactgtgggattctgat

SEQ ID NO: 5977993 - DNA, 21 bp, Homo sapiens
caaactgtgggtattgttaat

SEQ ID NO: 5977994 - DNA, 20 bp, Homo sapiens
caaactgtgtcacgcaggct

SEQ ID NO: 5977995 - DNA, 15 bp, Homo sapiens
caaactgttggaagt

SEQ ID NO: 5977996 - DNA, 19 bp, Homo sapiens
caaactgttggaagttcac

SEQ ID NO: 5977997 - DNA, 14 bp, Homo sapiens
caaacttaacagat

SEQ ID NO: 5977998 - DNA, 22 bp, Homo sapiens
caaacttaacatggaagatatt

SEQ ID NO: 5977999 - DNA, 21 bp, Homo sapiens
caaacttaatgttcttatgca

SEQ ID NO: 5978000 - DNA, 21 bp, Homo sapiens
caaacttacaggtcctgctga

SEQ ID NO: 5978001 - DNA, 14 bp, Homo sapiens
caaacttactattt

SEQ ID NO: 5978002 - DNA, 17 bp, Homo sapiens
caaacttcactctgggc

SEQ ID NO: 5978003 - DNA, 15 bp, Homo sapiens
caaacttcagactga

SEQ ID NO: 5978004 - DNA, 13 bp, Homo sapiens
caaacttctcgca

SEQ ID NO: 5978005 - DNA, 13 bp, Homo sapiens
caaacttctttca

SEQ ID NO: 5978006 - DNA, 17 bp, Homo sapiens
caaacttggatttttga

SEQ ID NO: 5978007 - DNA, 15 bp, Homo sapiens
caaacttgggccgct

SEQ ID NO: 5978008 - DNA, 17 bp, Homo sapiens
caaacttgttcatttag

SEQ ID NO: 5978009 - DNA, 22 bp, Homo sapiens
caaacttgttcatttagataat

SEQ ID NO: 5978010 - DNA, 17 bp, Homo sapiens
caaactttaaaatgcga

SEQ ID NO: 5978011 - DNA, 18 bp, Homo sapiens
caaactttaaaatgcgaa

SEQ ID NO: 5978012 - DNA, 20 bp, Homo sapiens
caaactttaaaatgcgaaat

SEQ ID NO: 5978013 - DNA, 21 bp, Homo sapiens
caaactttaaaatgcgaaatt

SEQ ID NO: 5978014 - DNA, 23 bp, Homo sapiens
caaactttattgattcacctcct

SEQ ID NO: 5978015 - DNA, 12 bp, Homo sapiens
caaactttattt

SEQ ID NO: 5978016 - DNA, 16 bp, Homo sapiens
caaactttatttttct

SEQ ID NO: 5978017 - DNA, 18 bp, Homo sapiens
caaactttctcataagca

SEQ ID NO: 5978018 - DNA, 13 bp, Homo sapiens
caaactttgcatc

SEQ ID NO: 5978019 - DNA, 13 bp, Homo sapiens
caaactttgtgta

SEQ ID NO: 5978020 - DNA, 13 bp, Homo sapiens
caaactttgtttt

SEQ ID NO: 5978021 - DNA, 15 bp, Homo sapiens
caaacttttataaat

SEQ ID NO: 5978022 - DNA, 16 bp, Homo sapiens
caaacttttataaatg

SEQ ID NO: 5978023 - DNA, 18 bp, Homo sapiens
caaacttttatactcttt

SEQ ID NO: 5978024 - DNA, 23 bp, Homo sapiens
caaacttttattagccagtgaaa

SEQ ID NO: 5978025 - DNA, 19 bp, Homo sapiens
caaacttttcccctgtcct

SEQ ID NO: 5978026 - DNA, 14 bp, Homo sapiens
caaacttttgaaag

SEQ ID NO: 5978027 - DNA, 17 bp, Homo sapiens
caaactttttccagcaa

SEQ ID NO: 5978028 - DNA, 20 bp, Homo sapiens
caaactttttgttcatgtgg

SEQ ID NO: 5978029 - DNA, 13 bp, Homo sapiens
caaacttttttat

SEQ ID NO: 5978030 - DNA, 22 bp, Homo sapiens
caaagaaaaacaatgaaattga

SEQ ID NO: 5978031 - DNA, 24 bp, Homo sapiens
caaagaaaaagtaaatcaaagatg

SEQ ID NO: 5978032 - DNA, 13 bp, Homo sapiens
caaagaaaaccct

SEQ ID NO: 5978033 - DNA, 14 bp, Homo sapiens
caaagaaaacccta

SEQ ID NO: 5978034 - DNA, 17 bp, Homo sapiens
caaagaaaactgcacaa

SEQ ID NO: 5978035 - DNA, 21 bp, Homo sapiens
caaagaaaatgaaatgcatat

SEQ ID NO: 5978036 - DNA, 15 bp, Homo sapiens
caaagaaaatgagaa

SEQ ID NO: 5978037 - DNA, 16 bp, Homo sapiens
caaagaaaatgagaat

SEQ ID NO: 5978038 - DNA, 14 bp, Homo sapiens
caaagaaaatgcct

SEQ ID NO: 5978039 - DNA, 22 bp, Homo sapiens
caaagaaaattggtacttaccc

SEQ ID NO: 5978040 - DNA, 21 bp, Homo sapiens
caaagaaacaccacttaatct

SEQ ID NO: 5978041 - DNA, 23 bp, Homo sapiens
caaagaaacaccacttaatcttc

SEQ ID NO: 5978042 - DNA, 19 bp, Homo sapiens
cacacactgtctggggccc

SEQ ID NO: 5978043 - DNA, 23 bp, Homo sapiens
cacacactgttttttggcttgct

SEQ ID NO: 5978044 - DNA, 13 bp, Homo sapiens
cacacacttttgc

SEQ ID NO: 5978045 - DNA, 21 bp, Homo sapiens
cacacagaaaatatactgtaa

SEQ ID NO: 5978046 - DNA, 12 bp, Homo sapiens
cacacagaaata

SEQ ID NO: 5978047 - DNA, 21 bp, Homo sapiens
cacacagaaatatatatacat

SEQ ID NO: 5978048 - DNA, 14 bp, Homo sapiens
cacacagaactggc

SEQ ID NO: 5978049 - DNA, 22 bp, Homo sapiens
cacacagaaggggactgccacc

SEQ ID NO: 5978050 - DNA, 15 bp, Homo sapiens
cacacagaatgcaac

SEQ ID NO: 5978051 - DNA, 13 bp, Homo sapiens
cacacagaattgc

SEQ ID NO: 5978052 - DNA, 21 bp, Homo sapiens
cacacagactacagccagaag

SEQ ID NO: 5978053 - DNA, 15 bp, Homo sapiens
cacacagactatttt

SEQ ID NO: 5978054 - DNA, 15 bp, Homo sapiens
cacacagactgttgt

SEQ ID NO: 5978055 - DNA, 22 bp, Homo sapiens
cacacagagatatgcacacaca

SEQ ID NO: 5978056 - DNA, 18 bp, Homo sapiens
cacacagagcctgcctca

SEQ ID NO: 5978057 - DNA, 19 bp, Homo sapiens
cacacagagctcacctgtt

SEQ ID NO: 5978058 - DNA, 15 bp, Homo sapiens
cacacagagctgaat

SEQ ID NO: 5978059 - DNA, 18 bp, Homo sapiens
cacacagaggaagagcag

SEQ ID NO: 5978060 - DNA, 19 bp, Homo sapiens
cacacagaggctgcctctc

SEQ ID NO: 5978061 - DNA, 18 bp, Homo sapiens
cacacagatttgagctca

SEQ ID NO: 5978062 - DNA, 22 bp, Homo sapiens
cacacagatttgagctcagccc

SEQ ID NO: 5978063 - DNA, 12 bp, Homo sapiens
cacacagcactc

SEQ ID NO: 5978064 - DNA, 12 bp, Homo sapiens
cacacagcagca

SEQ ID NO: 5978065 - DNA, 12 bp, Homo sapiens
cacacagcagcc

SEQ ID NO: 5978066 - DNA, 14 bp, Homo sapiens
cacacagcagcccc

SEQ ID NO: 5978067 - DNA, 20 bp, Homo sapiens
cacacagcagcgcagccgag

SEQ ID NO: 5978068 - DNA, 15 bp, Homo sapiens
cacacagcagctcca

SEQ ID NO: 5978069 - DNA, 23 bp, Homo sapiens
cacacagcaggaactgagccaga

SEQ ID NO: 5978070 - DNA, 14 bp, Homo sapiens
cacacagcagtgtc

SEQ ID NO: 5978071 - DNA, 19 bp, Homo sapiens
cacacagcagtgtcccctg

SEQ ID NO: 5978072 - DNA, 20 bp, Homo sapiens
cacacagcagtgtcccctgc

SEQ ID NO: 5978073 - DNA, 19 bp, Homo sapiens
cacacagccacacacacag

SEQ ID NO: 5978074 - DNA, 19 bp, Homo sapiens
cacacagccattcatctgg

SEQ ID NO: 5978075 - DNA, 12 bp, Homo sapiens
cacacagcccag

SEQ ID NO: 5978076 - DNA, 16 bp, Homo sapiens
cacacagcccagaagg

SEQ ID NO: 5978077 - DNA, 13 bp, Homo sapiens
cacacagcccgag

SEQ ID NO: 5978078 - DNA, 13 bp, Homo sapiens
cacacagcctggc

SEQ ID NO: 5978079 - DNA, 11 bp, Homo sapiens
cacacagcctt

SEQ ID NO: 5978080 - DNA, 13 bp, Homo sapiens
cacacagcctttc

SEQ ID NO: 5978081 - DNA, 18 bp, Homo sapiens
cacacagcctttctgtat

SEQ ID NO: 5978082 - DNA, 13 bp, Homo sapiens
cacacagctccca

SEQ ID NO: 5978083 - DNA, 14 bp, Homo sapiens
cacacagctctgtc

SEQ ID NO: 5978084 - DNA, 16 bp, Homo sapiens
cacacagctgagcact

SEQ ID NO: 5978085 - DNA, 17 bp, Homo sapiens
cacacagctgagcactt

SEQ ID NO: 5978086 - DNA, 15 bp, Homo sapiens
cacacagctgcagag

SEQ ID NO: 5978087 - DNA, 15 bp, Homo sapiens
cacacagctgcccta

SEQ ID NO: 5978088 - DNA, 13 bp, Homo sapiens
cacacagctgccg

SEQ ID NO: 5978089 - DNA, 14 bp, Homo sapiens
cacacagctgccgg

SEQ ID NO: 5978090 - DNA, 15 bp, Homo sapiens
cacacagctgggcaa

SEQ ID NO: 5978091 - DNA, 18 bp, Homo sapiens
cacacagctgggctgtgg

SEQ ID NO: 5978092 - DNA, 18 bp, Homo sapiens
cacacaggaactctgtgt

SEQ ID NO: 5978093 - DNA, 20 bp, Homo sapiens
cacacaggaactctgtgtga

SEQ ID NO: 5978094 - DNA, 18 bp, Homo sapiens
cacacaggagtcctttct

SEQ ID NO: 5978095 - DNA, 20 bp, Homo sapiens
cacacaggagtcctttcttt

SEQ ID NO: 5978096 - DNA, 18 bp, Homo sapiens
cacacaggcagccagccg

SEQ ID NO: 5978097 - DNA, 15 bp, Homo sapiens
cacacaggcagggcc

SEQ ID NO: 5978098 - DNA, 17 bp, Homo sapiens
cacacaggcagggcctg

SEQ ID NO: 5978099 - DNA, 18 bp, Homo sapiens
cacacaggcagggcctgg

SEQ ID NO: 5978100 - DNA, 17 bp, Homo sapiens
cacacaggcatttcctg

SEQ ID NO: 5978101 - DNA, 18 bp, Homo sapiens
cacacaggcatttcctgg

SEQ ID NO: 5978102 - DNA, 20 bp, Homo sapiens
cacacaggcatttcctgggt

SEQ ID NO: 5978103 - DNA, 18 bp, Homo sapiens
cacacaggcccatgccct

SEQ ID NO: 5978104 - DNA, 17 bp, Homo sapiens
cacacaggcctggccca

SEQ ID NO: 5978105 - DNA, 18 bp, Homo sapiens
cacacaggcctggcccag

SEQ ID NO: 5978106 - DNA, 20 bp, Homo sapiens
cacacaggcctggcccagcc

SEQ ID NO: 5978107 - DNA, 17 bp, Homo sapiens
cacacagggcactgact

SEQ ID NO: 5978108 - DNA, 12 bp, Homo sapiens
cacacagggcag

SEQ ID NO: 5978109 - DNA, 15 bp, Homo sapiens
cacacagggcagtcc

SEQ ID NO: 5978110 - DNA, 22 bp, Homo sapiens
cacacagggcccggccacaccc

SEQ ID NO: 5978111 - DNA, 22 bp, Homo sapiens
cacacagggctcacagggcagg

SEQ ID NO: 5978112 - DNA, 19 bp, Homo sapiens
cacacaggggccacccggg

SEQ ID NO: 5978113 - DNA, 23 bp, Homo sapiens
cacacaggggtggagtttctgac

SEQ ID NO: 5978114 - DNA, 18 bp, Homo sapiens
cacacaggtggtgtcact

SEQ ID NO: 5978115 - DNA, 17 bp, Homo sapiens
cacacagtattaagtga

SEQ ID NO: 5978116 - DNA, 23 bp, Homo sapiens
cacacagtattacttctgctaca

SEQ ID NO: 5978117 - DNA, 15 bp, Homo sapiens
cacacagtccccaga

SEQ ID NO: 5978118 - DNA, 21 bp, Homo sapiens
cacacagtccccagactcagc

SEQ ID NO: 5978119 - DNA, 12 bp, Homo sapiens
cacacagtcctc

SEQ ID NO: 5978120 - DNA, 22 bp, Homo sapiens
cacacagtcctcacacacggag

SEQ ID NO: 5978121 - DNA, 18 bp, Homo sapiens
cacacagtctcagtccag

SEQ ID NO: 5978122 - DNA, 13 bp, Homo sapiens
cacacagtggccg

SEQ ID NO: 5978123 - DNA, 18 bp, Homo sapiens
cacacagtggccggggct

SEQ ID NO: 5978124 - DNA, 23 bp, Homo sapiens
cacacagtggccggggctgaagc

SEQ ID NO: 5978125 - DNA, 12 bp, Homo sapiens
cacacagtgggc

SEQ ID NO: 5978126 - DNA, 18 bp, Homo sapiens
cacacagtgttagtgctg

SEQ ID NO: 5978127 - DNA, 22 bp, Homo sapiens
cacacagttgttgaatgactga

SEQ ID NO: 5978128 - DNA, 15 bp, Homo sapiens
cacacatacacacac

SEQ ID NO: 5978129 - DNA, 12 bp, Homo sapiens
cacacatacaga

SEQ ID NO: 5978130 - DNA, 17 bp, Homo sapiens
cacacatagtttctttt

SEQ ID NO: 5978131 - DNA, 13 bp, Homo sapiens
cacacatatacat

SEQ ID NO: 5978132 - DNA, 22 bp, Homo sapiens
cacacatatacattatttctgt

SEQ ID NO: 5978133 - DNA, 21 bp, Homo sapiens
cacacatatatgtatacgcac

SEQ ID NO: 5978134 - DNA, 14 bp, Homo sapiens
cacacatccacccc

SEQ ID NO: 5978135 - DNA, 16 bp, Homo sapiens
cacacatccaccccag

SEQ ID NO: 5978136 - DNA, 15 bp, Homo sapiens
cacacatccagctgc

SEQ ID NO: 5978137 - DNA, 13 bp, Homo sapiens
cacacatcccagc

SEQ ID NO: 5978138 - DNA, 14 bp, Homo sapiens
cacacatcccagga

SEQ ID NO: 5978139 - DNA, 14 bp, Homo sapiens
cacacatctggccc

SEQ ID NO: 5978140 - DNA, 22 bp, Homo sapiens
cacacatctgggtgccctgaaa

SEQ ID NO: 5978141 - DNA, 20 bp, Homo sapiens
cacacatctgtaatcctagc

SEQ ID NO: 5978142 - DNA, 16 bp, Homo sapiens
cacacatcttacctct

SEQ ID NO: 5978143 - DNA, 18 bp, Homo sapiens
cacacatcttacctctca

SEQ ID NO: 5978144 - DNA, 20 bp, Homo sapiens
cacacatcttacctctcatg

SEQ ID NO: 5978145 - DNA, 15 bp, Homo sapiens
cacacatgaataaag

SEQ ID NO: 5978146 - DNA, 14 bp, Homo sapiens
cacacatgcacaca

SEQ ID NO: 5978147 - DNA, 14 bp, Homo sapiens
cacacatgccctcc

SEQ ID NO: 5978148 - DNA, 18 bp, Homo sapiens
cacacatgcttccctttc

SEQ ID NO: 5978149 - DNA, 19 bp, Homo sapiens
cacacatgcttttcttcct

SEQ ID NO: 5978150 - DNA, 14 bp, Homo sapiens
cacacatggatgca

SEQ ID NO: 5978151 - DNA, 15 bp, Homo sapiens
cacacatggatgcac

SEQ ID NO: 5978152 - DNA, 17 bp, Homo sapiens
cacacatggatgcacac

SEQ ID NO: 5978153 - DNA, 20 bp, Homo sapiens
cacacattccagccaggccc

SEQ ID NO: 5978154 - DNA, 21 bp, Homo sapiens
cacacattccagccaggccca

SEQ ID NO: 5978155 - DNA, 15 bp, Homo sapiens
cacacattccagggc

SEQ ID NO: 5978156 - DNA, 17 bp, Homo sapiens
cacacattctgtataat

SEQ ID NO: 5978157 - DNA, 16 bp, Homo sapiens
cacacatttaattcag

SEQ ID NO: 5978158 - DNA, 19 bp, Homo sapiens
cacacatttctgccacgtg

SEQ ID NO: 5978159 - DNA, 14 bp, Homo sapiens
cacacatttggaat

SEQ ID NO: 5978160 - DNA, 12 bp, Homo sapiens
cacacatttttt

SEQ ID NO: 5978161 - DNA, 15 bp, Homo sapiens
cacaccaaattgctg

SEQ ID NO: 5978162 - DNA, 17 bp, Homo sapiens
cacaccaaccaggcctt

SEQ ID NO: 5978163 - DNA, 17 bp, Homo sapiens
cacaccaagctgtgcca

SEQ ID NO: 5978164 - DNA, 18 bp, Homo sapiens
cacaccaagctgtgccac

SEQ ID NO: 5978165 - DNA, 23 bp, Homo sapiens
cacaccaaggccctgcatctgtc

SEQ ID NO: 5978166 - DNA, 23 bp, Homo sapiens
cacaccaatcttactttgtaaat

SEQ ID NO: 5978167 - DNA, 15 bp, Homo sapiens
cacaccaatgcgcac

SEQ ID NO: 5978168 - DNA, 18 bp, Homo sapiens
cacaccacaattctccct

SEQ ID NO: 5978169 - DNA, 21 bp, Homo sapiens
cacaccaccgccctcctcgct

SEQ ID NO: 5978170 - DNA, 15 bp, Homo sapiens
cacaccacgtcctgg

SEQ ID NO: 5978171 - DNA, 19 bp, Homo sapiens
cacaccactgcactccagc

SEQ ID NO: 5978172 - DNA, 15 bp, Homo sapiens
cacaccactgccctg

SEQ ID NO: 5978173 - DNA, 16 bp, Homo sapiens
cacaccactgccctgc

SEQ ID NO: 5978174 - DNA, 17 bp, Homo sapiens
cacaccactgccctgcc

SEQ ID NO: 5978175 - DNA, 18 bp, Homo sapiens
cacaccactgccctgcct

SEQ ID NO: 5978176 - DNA, 16 bp, Homo sapiens
cacaccactgttgcct

SEQ ID NO: 5978177 - DNA, 15 bp, Homo sapiens
cacaccagagcccac

SEQ ID NO: 5978178 - DNA, 15 bp, Homo sapiens
cacaccagcctcctg

SEQ ID NO: 5978179 - DNA, 17 bp, Homo sapiens
cacaccagcctcctggg

SEQ ID NO: 5978180 - DNA, 23 bp, Homo sapiens
cacaccaggccgtcctcccgggc

SEQ ID NO: 5978181 - DNA, 13 bp, Homo sapiens
cacaccaggctgt

SEQ ID NO: 5978182 - DNA, 14 bp, Homo sapiens
cacaccaggctgtg

SEQ ID NO: 5978183 - DNA, 17 bp, Homo sapiens
cacaccaggctgtgggc

SEQ ID NO: 5978184 - DNA, 20 bp, Homo sapiens
cacaccaggctgtgggcctc

SEQ ID NO: 5978185 - DNA, 21 bp, Homo sapiens
cacaccaggcttgcctgcagg

SEQ ID NO: 5978186 - DNA, 22 bp, Homo sapiens
cacaccaggcttgcctgcaggc

SEQ ID NO: 5978187 - DNA, 16 bp, Homo sapiens
cacaccagtcacatga

SEQ ID NO: 5978188 - DNA, 12 bp, Homo sapiens
cacaccagtggc

SEQ ID NO: 5978189 - DNA, 13 bp, Homo sapiens
cacaccagtttac

SEQ ID NO: 5978190 - DNA, 21 bp, Homo sapiens
cacaccatctggcccaggctg

SEQ ID NO: 5978191 - DNA, 14 bp, Homo sapiens
cacaccattctcct

SEQ ID NO: 5978192 - DNA, 18 bp, Homo sapiens
cacaccattctcctgcct

SEQ ID NO: 5978193 - DNA, 13 bp, Homo sapiens
cacacccaatgct

SEQ ID NO: 5978194 - DNA, 19 bp, Homo sapiens
cacacccaatgctgctcca

SEQ ID NO: 5978195 - DNA, 21 bp, Homo sapiens
cacacccaccccctctggaga

SEQ ID NO: 5978196 - DNA, 22 bp, Homo sapiens
cacacccaccccctctggagaa

SEQ ID NO: 5978197 - DNA, 20 bp, Homo sapiens
cacacccaccccctgcctgg

SEQ ID NO: 5978198 - DNA, 14 bp, Homo sapiens
cacacccacctctg

SEQ ID NO: 5978199 - DNA, 14 bp, Homo sapiens
cacacccacctgct

SEQ ID NO: 5978200 - DNA, 18 bp, Homo sapiens
cacacccacctgctgctg

SEQ ID NO: 5978201 - DNA, 15 bp, Homo sapiens
cacacccactcagct

SEQ ID NO: 5978202 - DNA, 16 bp, Homo sapiens
cacacccactcagctc

SEQ ID NO: 5978203 - DNA, 12 bp, Homo sapiens
cacacccagagg

SEQ ID NO: 5978204 - DNA, 15 bp, Homo sapiens
cacacccagcctcag

SEQ ID NO: 5978205 - DNA, 13 bp, Homo sapiens
cacacccaggaag

SEQ ID NO: 5978206 - DNA, 17 bp, Homo sapiens
cacacccaggtctcttc

SEQ ID NO: 5978207 - DNA, 19 bp, Homo sapiens
cacacccagtgggaagagt

SEQ ID NO: 5978208 - DNA, 16 bp, Homo sapiens
cacacccatcatctga

SEQ ID NO: 5978209 - DNA, 17 bp, Homo sapiens
cacacccatgactgccc

SEQ ID NO: 5978210 - DNA, 20 bp, Homo sapiens
cacacccatgtaaccactgc

SEQ ID NO: 5978211 - DNA, 12 bp, Homo sapiens
cacaccccaagg

SEQ ID NO: 5978212 - DNA, 18 bp, Homo sapiens
cacaccccaagggacaac

SEQ ID NO: 5978213 - DNA, 14 bp, Homo sapiens
cacaccccacaccc

SEQ ID NO: 5978214 - DNA, 17 bp, Homo sapiens
cacaccccacctgcgct

SEQ ID NO: 5978215 - DNA, 17 bp, Homo sapiens
cacaccccactcccaca

SEQ ID NO: 5978216 - DNA, 15 bp, Homo sapiens
cacaccccagcccac

SEQ ID NO: 5978217 - DNA, 21 bp, Homo sapiens
cacaccccagcccaccctgct

SEQ ID NO: 5978218 - DNA, 19 bp, Homo sapiens
cacaccccatctctcttcc

SEQ ID NO: 5978219 - DNA, 12 bp, Homo sapiens
cacacccccaga

SEQ ID NO: 5978220 - DNA, 14 bp, Homo sapiens
cacacccccagaga

SEQ ID NO: 5978221 - DNA, 17 bp, Homo sapiens
cacaccccgtctgcccc

SEQ ID NO: 5978222 - DNA, 15 bp, Homo sapiens
cacacccctcagcgc

SEQ ID NO: 5978223 - DNA, 13 bp, Homo sapiens
caaagaaacccaa

SEQ ID NO: 5978224 - DNA, 18 bp, Homo sapiens
caaagaaacttgaagctt

SEQ ID NO: 5978225 - DNA, 13 bp, Homo sapiens
caaagaaactttt

SEQ ID NO: 5978226 - DNA, 13 bp, Homo sapiens
caaagaaataaaa

SEQ ID NO: 5978227 - DNA, 14 bp, Homo sapiens
caaagaaatagcaa

SEQ ID NO: 5978228 - DNA, 23 bp, Homo sapiens
caaagaaatccccccttcagaac

SEQ ID NO: 5978229 - DNA, 14 bp, Homo sapiens
caaagaaatgaaca

SEQ ID NO: 5978230 - DNA, 17 bp, Homo sapiens
caaagaaatgggcctgc

SEQ ID NO: 5978231 - DNA, 19 bp, Homo sapiens
caaagaaatgggcctgcct

SEQ ID NO: 5978232 - DNA, 19 bp, Homo sapiens
caaagaaattcagaacagc

SEQ ID NO: 5978233 - DNA, 20 bp, Homo sapiens
caaagaaatttcaacagtta

SEQ ID NO: 5978234 - DNA, 14 bp, Homo sapiens
caaagaacagatgg

SEQ ID NO: 5978235 - DNA, 21 bp, Homo sapiens
caaagaacatgtagaaaacaa

SEQ ID NO: 5978236 - DNA, 22 bp, Homo sapiens
caaagaaccaggaggcctggga

SEQ ID NO: 5978237 - DNA, 15 bp, Homo sapiens
caaagaaccatgcag

SEQ ID NO: 5978238 - DNA, 19 bp, Homo sapiens
caaagaaccctagcacaaa

SEQ ID NO: 5978239 - DNA, 18 bp, Homo sapiens
caaagaaccttctctatg

SEQ ID NO: 5978240 - DNA, 21 bp, Homo sapiens
caaagaactaaggatttttcc

SEQ ID NO: 5978241 - DNA, 15 bp, Homo sapiens
caaagaacttgctgc

SEQ ID NO: 5978242 - DNA, 19 bp, Homo sapiens
caaagaacttgctgctgcc

SEQ ID NO: 5978243 - DNA, 15 bp, Homo sapiens
caaagaagaaagctg

SEQ ID NO: 5978244 - DNA, 14 bp, Homo sapiens
caaagaagacaaca

SEQ ID NO: 5978245 - DNA, 14 bp, Homo sapiens
caaagaagacatgt

SEQ ID NO: 5978246 - DNA, 19 bp, Homo sapiens
caaagaagatagctctctg

SEQ ID NO: 5978247 - DNA, 12 bp, Homo sapiens
caaagaaggaaa

SEQ ID NO: 5978248 - DNA, 14 bp, Homo sapiens
caaagaaggagctg

SEQ ID NO: 5978249 - DNA, 21 bp, Homo sapiens
caaagaaggcatttgcagggt

SEQ ID NO: 5978250 - DNA, 14 bp, Homo sapiens
caaagaagtcggaa

SEQ ID NO: 5978251 - DNA, 21 bp, Homo sapiens
caaagaatactagaatggtag

SEQ ID NO: 5978252 - DNA, 12 bp, Homo sapiens
caaagaatattt

SEQ ID NO: 5978253 - DNA, 15 bp, Homo sapiens
caaagaatattttga

SEQ ID NO: 5978254 - DNA, 19 bp, Homo sapiens
caaagaatccctagacttt

SEQ ID NO: 5978255 - DNA, 23 bp, Homo sapiens
caaagaatccctagactttaggc

SEQ ID NO: 5978256 - DNA, 14 bp, Homo sapiens
caaagaatgcatgt

SEQ ID NO: 5978257 - DNA, 18 bp, Homo sapiens
caaagaatgcatgttctg

SEQ ID NO: 5978258 - DNA, 14 bp, Homo sapiens
caaagaatgccttg

SEQ ID NO: 5978259 - DNA, 14 bp, Homo sapiens
caaagaattacagt

SEQ ID NO: 5978260 - DNA, 19 bp, Homo sapiens
caaagaattccaaagcaaa

SEQ ID NO: 5978261 - DNA, 12 bp, Homo sapiens
caaagacaaaag

SEQ ID NO: 5978262 - DNA, 15 bp, Homo sapiens
caaagacaaaagaaa

SEQ ID NO: 5978263 - DNA, 16 bp, Homo sapiens
caaagacaaaagaaac

SEQ ID NO: 5978264 - DNA, 19 bp, Homo sapiens
caaagacaaaagtctgtct

SEQ ID NO: 5978265 - DNA, 13 bp, Homo sapiens
caaagacaaatag

SEQ ID NO: 5978266 - DNA, 23 bp, Homo sapiens
caaagacaaatagtaggcaagat

SEQ ID NO: 5978267 - DNA, 20 bp, Homo sapiens
caaagacaaattctgtttct

SEQ ID NO: 5978268 - DNA, 13 bp, Homo sapiens
caaagacaagaaa

SEQ ID NO: 5978269 - DNA, 15 bp, Homo sapiens
caaagacacacagga

SEQ ID NO: 5978270 - DNA, 16 bp, Homo sapiens
caaagacacacaggag

SEQ ID NO: 5978271 - DNA, 16 bp, Homo sapiens
caaagacacaggaaga

SEQ ID NO: 5978272 - DNA, 18 bp, Homo sapiens
caaagacagtttcttgca

SEQ ID NO: 5978273 - DNA, 19 bp, Homo sapiens
caaagacagtttcttgcaa

SEQ ID NO: 5978274 - DNA, 13 bp, Homo sapiens
caaagacatcagt

SEQ ID NO: 5978275 - DNA, 20 bp, Homo sapiens
caaagacatgctttccattt

SEQ ID NO: 5978276 - DNA, 17 bp, Homo sapiens
caaagacattgacagca

SEQ ID NO: 5978277 - DNA, 23 bp, Homo sapiens
caaagacattgacagcaattcat

SEQ ID NO: 5978278 - DNA, 15 bp, Homo sapiens
caaagaccaagcgct

SEQ ID NO: 5978279 - DNA, 15 bp, Homo sapiens
caaagaccccatggt

SEQ ID NO: 5978280 - DNA, 15 bp, Homo sapiens
caaagacctacctcc

SEQ ID NO: 5978281 - DNA, 23 bp, Homo sapiens
caaagaccttgtgtgtatgtgta

SEQ ID NO: 5978282 - DNA, 15 bp, Homo sapiens
caaagacggtagaga

SEQ ID NO: 5978283 - DNA, 16 bp, Homo sapiens
caaagactccgagaag

SEQ ID NO: 5978284 - DNA, 16 bp, Homo sapiens
caaagactcctctggg

SEQ ID NO: 5978285 - DNA, 17 bp, Homo sapiens
caaagactcctctgggc

SEQ ID NO: 5978286 - DNA, 19 bp, Homo sapiens
caaagactcctctgggcct

SEQ ID NO: 5978287 - DNA, 16 bp, Homo sapiens
caaagactccttgtgg

SEQ ID NO: 5978288 - DNA, 19 bp, Homo sapiens
caaagactctgagccaagg

SEQ ID NO: 5978289 - DNA, 13 bp, Homo sapiens
caaagactgcaga

SEQ ID NO: 5978290 - DNA, 13 bp, Homo sapiens
caaagactgtact

SEQ ID NO: 5978291 - DNA, 17 bp, Homo sapiens
caaagactgtgaacagc

SEQ ID NO: 5978292 - DNA, 20 bp, Homo sapiens
caaagacttagtatattttc

SEQ ID NO: 5978293 - DNA, 21 bp, Homo sapiens
caaagagaaaaagaaatgcaa

SEQ ID NO: 5978294 - DNA, 14 bp, Homo sapiens
caaagagaaaacat

SEQ ID NO: 5978295 - DNA, 15 bp, Homo sapiens
caaagagaaaccgct

SEQ ID NO: 5978296 - DNA, 13 bp, Homo sapiens
caaagagaaacct

SEQ ID NO: 5978297 - DNA, 18 bp, Homo sapiens
caaagagaagatgcctgt

SEQ ID NO: 5978298 - DNA, 23 bp, Homo sapiens
caaagagaagatgcctgttaatt

SEQ ID NO: 5978299 - DNA, 15 bp, Homo sapiens
caaagagaataaaga

SEQ ID NO: 5978300 - DNA, 13 bp, Homo sapiens
caaagagacaggg

SEQ ID NO: 5978301 - DNA, 15 bp, Homo sapiens
caaagagacagggcc

SEQ ID NO: 5978302 - DNA, 16 bp, Homo sapiens
caaagagacagggccc

SEQ ID NO: 5978303 - DNA, 13 bp, Homo sapiens
caaagagacattt

SEQ ID NO: 5978304 - DNA, 18 bp, Homo sapiens
caaagagaggtccagagt

SEQ ID NO: 5978305 - DNA, 14 bp, Homo sapiens
caaagagatattga

SEQ ID NO: 5978306 - DNA, 22 bp, Homo sapiens
caaagagatatttaggaaaatg

SEQ ID NO: 5978307 - DNA, 20 bp, Homo sapiens
caaagagcacaaacattttt

SEQ ID NO: 5978308 - DNA, 11 bp, Homo sapiens
caaagagcact

SEQ ID NO: 5978309 - DNA, 14 bp, Homo sapiens
caaagagcacttga

SEQ ID NO: 5978310 - DNA, 17 bp, Homo sapiens
caaagagcacttgagct

SEQ ID NO: 5978311 - DNA, 21 bp, Homo sapiens
caaagagcacttgagctgtct

SEQ ID NO: 5978312 - DNA, 22 bp, Homo sapiens
caaagagcacttgagctgtctg

SEQ ID NO: 5978313 - DNA, 18 bp, Homo sapiens
caaagagccatgtgtcat

SEQ ID NO: 5978314 - DNA, 15 bp, Homo sapiens
caaagagcctggaga

SEQ ID NO: 5978315 - DNA, 17 bp, Homo sapiens
caaagagcctggagaag

SEQ ID NO: 5978316 - DNA, 23 bp, Homo sapiens
caaagagcgagtcccctgcccgg

SEQ ID NO: 5978317 - DNA, 23 bp, Homo sapiens
caaagagctcccgaggaagcaca

SEQ ID NO: 5978318 - DNA, 13 bp, Homo sapiens
caaagagctgcct

SEQ ID NO: 5978319 - DNA, 17 bp, Homo sapiens
caaagagctgtggctgg

SEQ ID NO: 5978320 - DNA, 20 bp, Homo sapiens
caaagaggactcgcttgtaa

SEQ ID NO: 5978321 - DNA, 21 bp, Homo sapiens
caaagaggactcgcttgtaaa

SEQ ID NO: 5978322 - DNA, 14 bp, Homo sapiens
caaagaggcaagag

SEQ ID NO: 5978323 - DNA, 18 bp, Homo sapiens
caaagaggcacagagcca

SEQ ID NO: 5978324 - DNA, 16 bp, Homo sapiens
caaagaggcattcagc

SEQ ID NO: 5978325 - DNA, 23 bp, Homo sapiens
caaagaggctgcccctctcacca

SEQ ID NO: 5978326 - DNA, 14 bp, Homo sapiens
caaagagggcttcc

SEQ ID NO: 5978327 - DNA, 16 bp, Homo sapiens
caaagagggcttcctc

SEQ ID NO: 5978328 - DNA, 22 bp, Homo sapiens
caaagaggggcgctgtcctgcg

SEQ ID NO: 5978329 - DNA, 20 bp, Homo sapiens
caaagagggggctctgccca

SEQ ID NO: 5978330 - DNA, 16 bp, Homo sapiens
caaagaggttggagca

SEQ ID NO: 5978331 - DNA, 20 bp, Homo sapiens
caaagaggttggagcaacaa

SEQ ID NO: 5978332 - DNA, 18 bp, Homo sapiens
caaagagtctctggctca

SEQ ID NO: 5978333 - DNA, 22 bp, Homo sapiens
caaagagtctctggctcagctg

SEQ ID NO: 5978334 - DNA, 17 bp, Homo sapiens
caaagagtgaaatattg

SEQ ID NO: 5978335 - DNA, 22 bp, Homo sapiens
caaagagtgaaatattgtaaat

SEQ ID NO: 5978336 - DNA, 20 bp, Homo sapiens
caaagagtgggctgcatctg

SEQ ID NO: 5978337 - DNA, 17 bp, Homo sapiens
caaagagtgtagatcag

SEQ ID NO: 5978338 - DNA, 16 bp, Homo sapiens
caaagagttcaagaaa

SEQ ID NO: 5978339 - DNA, 21 bp, Homo sapiens
caaagagttcaagaaataagt

SEQ ID NO: 5978340 - DNA, 20 bp, Homo sapiens
caaagataacgcaggagaga

SEQ ID NO: 5978341 - DNA, 14 bp, Homo sapiens
caaagataaggact

SEQ ID NO: 5978342 - DNA, 12 bp, Homo sapiens
caaagataattt

SEQ ID NO: 5978343 - DNA, 20 bp, Homo sapiens
caaagatacaagaaaaagta

SEQ ID NO: 5978344 - DNA, 18 bp, Homo sapiens
caaagatagacaggtcct

SEQ ID NO: 5978345 - DNA, 13 bp, Homo sapiens
caaagatagcaga

SEQ ID NO: 5978346 - DNA, 15 bp, Homo sapiens
caaagatagggaggg

SEQ ID NO: 5978347 - DNA, 17 bp, Homo sapiens
caaagatatctcatctc

SEQ ID NO: 5978348 - DNA, 20 bp, Homo sapiens
caaagatattttgctttgtg

SEQ ID NO: 5978349 - DNA, 13 bp, Homo sapiens
caaagatcaaaat

SEQ ID NO: 5978350 - DNA, 15 bp, Homo sapiens
caaagatcacttgtt

SEQ ID NO: 5978351 - DNA, 17 bp, Homo sapiens
caaagatctcagcagcc

SEQ ID NO: 5978352 - DNA, 19 bp, Homo sapiens
caaagatctcagcagccag

SEQ ID NO: 5978353 - DNA, 16 bp, Homo sapiens
caaagatctgctcctc

SEQ ID NO: 5978354 - DNA, 18 bp, Homo sapiens
caaagatgaatgaagcaa

SEQ ID NO: 5978355 - DNA, 11 bp, Homo sapiens
caaagatgact

SEQ ID NO: 5978356 - DNA, 22 bp, Homo sapiens
caaagatgacttcccctgcctc

SEQ ID NO: 5978357 - DNA, 16 bp, Homo sapiens
caaagatgagaagcca

SEQ ID NO: 5978358 - DNA, 13 bp, Homo sapiens
caaagatgataat

SEQ ID NO: 5978359 - DNA, 13 bp, Homo sapiens
caaagatgcagcc

SEQ ID NO: 5978360 - DNA, 23 bp, Homo sapiens
caaagatgcattttgagtgttta

SEQ ID NO: 5978361 - DNA, 23 bp, Homo sapiens
caaagatgcatttttataaattt

SEQ ID NO: 5978362 - DNA, 20 bp, Homo sapiens
caaagatgcgtttgcctcct

SEQ ID NO: 5978363 - DNA, 22 bp, Homo sapiens
caaagatgcgtttgcctcctgg

SEQ ID NO: 5978364 - DNA, 14 bp, Homo sapiens
caaagatggcttcc

SEQ ID NO: 5978365 - DNA, 12 bp, Homo sapiens
caaagatgtact

SEQ ID NO: 5978366 - DNA, 16 bp, Homo sapiens
caaagatgtactgaga

SEQ ID NO: 5978367 - DNA, 20 bp, Homo sapiens
caaagatgtactgagaggag

SEQ ID NO: 5978368 - DNA, 21 bp, Homo sapiens
caaagatgtactgagaggagg

SEQ ID NO: 5978369 - DNA, 17 bp, Homo sapiens
caaagatgttaacagta

SEQ ID NO: 5978370 - DNA, 18 bp, Homo sapiens
caaagatgtttgaaaatg

SEQ ID NO: 5978371 - DNA, 22 bp, Homo sapiens
caaagatgtttgtcagatatga

SEQ ID NO: 5978372 - DNA, 21 bp, Homo sapiens
caaagattaaatgtgtcattg

SEQ ID NO: 5978373 - DNA, 17 bp, Homo sapiens
caaagattcaaaattga

SEQ ID NO: 5978374 - DNA, 13 bp, Homo sapiens
caaagattcatga

SEQ ID NO: 5978375 - DNA, 19 bp, Homo sapiens
caaagattcatgatttata

SEQ ID NO: 5978376 - DNA, 17 bp, Homo sapiens
caaagattctctatgta

SEQ ID NO: 5978377 - DNA, 19 bp, Homo sapiens
caaagattctgcattttaa

SEQ ID NO: 5978378 - DNA, 16 bp, Homo sapiens
caaagattctttatat

SEQ ID NO: 5978379 - DNA, 19 bp, Homo sapiens
caaagattgaacactgcgt

SEQ ID NO: 5978380 - DNA, 15 bp, Homo sapiens
caaagattgagaagc

SEQ ID NO: 5978381 - DNA, 17 bp, Homo sapiens
caaagattgagaagcca

SEQ ID NO: 5978382 - DNA, 19 bp, Homo sapiens
caaagattgattgattttc

SEQ ID NO: 5978383 - DNA, 13 bp, Homo sapiens
caaagatttaatc

SEQ ID NO: 5978384 - DNA, 18 bp, Homo sapiens
caaagatttcatatctaa

SEQ ID NO: 5978385 - DNA, 17 bp, Homo sapiens
caaagatttgtggtaac

SEQ ID NO: 5978386 - DNA, 14 bp, Homo sapiens
caaagattttctaa

SEQ ID NO: 5978387 - DNA, 17 bp, Homo sapiens
caaagattttctaagga

SEQ ID NO: 5978388 - DNA, 15 bp, Homo sapiens
caaagcaaaaccaga

SEQ ID NO: 5978389 - DNA, 22 bp, Homo sapiens
caaagcaaaactcccaatggat

SEQ ID NO: 5978390 - DNA, 22 bp, Homo sapiens
caaagcaaaagaagtaaaagct

SEQ ID NO: 5978391 - DNA, 15 bp, Homo sapiens
caaagcaaaggcagt

SEQ ID NO: 5978392 - DNA, 22 bp, Homo sapiens
caaagcaaaggcagtcccggga

SEQ ID NO: 5978393 - DNA, 16 bp, Homo sapiens
caaagcaaatttctat

SEQ ID NO: 5978394 - DNA, 14 bp, Homo sapiens
caaagcaagaccct

SEQ ID NO: 5978395 - DNA, 17 bp, Homo sapiens
caaagcaagctcttctc

SEQ ID NO: 5978396 - DNA, 21 bp, Homo sapiens
caaagcaagctcttctcctca

SEQ ID NO: 5978397 - DNA, 19 bp, Homo sapiens
caaagcaagggctccagca

SEQ ID NO: 5978398 - DNA, 16 bp, Homo sapiens
caaagcaataatagta

SEQ ID NO: 5978399 - DNA, 13 bp, Homo sapiens
caaagcaatattt

SEQ ID NO: 5978400 - DNA, 17 bp, Homo sapiens
caaagcaatcggacata

SEQ ID NO: 5978401 - DNA, 15 bp, Homo sapiens
caaagcaatgcattt

SEQ ID NO: 5978402 - DNA, 18 bp, Homo sapiens
caaagcaattaaatgata

SEQ ID NO: 5978403 - DNA, 18 bp, Homo sapiens
cacacccctctgctgcaa

SEQ ID NO: 5978404 - DNA, 16 bp, Homo sapiens
cacacccgaagtcctg

SEQ ID NO: 5978405 - DNA, 23 bp, Homo sapiens
cacacccgccctgtgtgtgtccc

SEQ ID NO: 5978406 - DNA, 22 bp, Homo sapiens
cacacccggctccccctgcttc

SEQ ID NO: 5978407 - DNA, 15 bp, Homo sapiens
cacaccctaccttcc

SEQ ID NO: 5978408 - DNA, 18 bp, Homo sapiens
cacaccctaccttcccca

SEQ ID NO: 5978409 - DNA, 20 bp, Homo sapiens
cacaccctcactctgccagg

SEQ ID NO: 5978410 - DNA, 17 bp, Homo sapiens
cacaccctctcccagga

SEQ ID NO: 5978411 - DNA, 13 bp, Homo sapiens
cacaccctgcccc

SEQ ID NO: 5978412 - DNA, 14 bp, Homo sapiens
cacaccctgcctgc

SEQ ID NO: 5978413 - DNA, 16 bp, Homo sapiens
cacaccctgcctgctg

SEQ ID NO: 5978414 - DNA, 20 bp, Homo sapiens
cacaccctgcctgctgtgga

SEQ ID NO: 5978415 - DNA, 13 bp, Homo sapiens
cacaccctgggcc

SEQ ID NO: 5978416 - DNA, 15 bp, Homo sapiens
cacaccctgggccac

SEQ ID NO: 5978417 - DNA, 21 bp, Homo sapiens
cacaccctgtactgttctgtg

SEQ ID NO: 5978418 - DNA, 18 bp, Homo sapiens
cacacccttccccactcc

SEQ ID NO: 5978419 - DNA, 15 bp, Homo sapiens
cacaccgatgcacac

SEQ ID NO: 5978420 - DNA, 15 bp, Homo sapiens
cacaccgatgtgcgc

SEQ ID NO: 5978421 - DNA, 22 bp, Homo sapiens
cacaccgcggccaggcacccat

SEQ ID NO: 5978422 - DNA, 19 bp, Homo sapiens
cacaccgcgtcccagctcc

SEQ ID NO: 5978423 - DNA, 22 bp, Homo sapiens
cacaccgcgtcccagctcccct

SEQ ID NO: 5978424 - DNA, 20 bp, Homo sapiens
cacaccgctggtccctgccc

SEQ ID NO: 5978425 - DNA, 19 bp, Homo sapiens
cacaccgtcaggtactcct

SEQ ID NO: 5978426 - DNA, 20 bp, Homo sapiens
cacaccgtccctctccccgg

SEQ ID NO: 5978427 - DNA, 14 bp, Homo sapiens
cacacctaaattaa

SEQ ID NO: 5978428 - DNA, 16 bp, Homo sapiens
cacacctaagggacat

SEQ ID NO: 5978429 - DNA, 22 bp, Homo sapiens
cacacctactagtcaccagaga

SEQ ID NO: 5978430 - DNA, 19 bp, Homo sapiens
cacacctcacgctctggac

SEQ ID NO: 5978431 - DNA, 14 bp, Homo sapiens
cacacctcactctt

SEQ ID NO: 5978432 - DNA, 18 bp, Homo sapiens
cacacctcactgtcatct

SEQ ID NO: 5978433 - DNA, 20 bp, Homo sapiens
cacacctcactgtcatctgc

SEQ ID NO: 5978434 - DNA, 16 bp, Homo sapiens
cacacctcagccccac

SEQ ID NO: 5978435 - DNA, 17 bp, Homo sapiens
cacacctcagtgggaag

SEQ ID NO: 5978436 - DNA, 13 bp, Homo sapiens
cacacctccaccc

SEQ ID NO: 5978437 - DNA, 17 bp, Homo sapiens
cacacctccctgaacca

SEQ ID NO: 5978438 - DNA, 13 bp, Homo sapiens
cacacctcccttc

SEQ ID NO: 5978439 - DNA, 20 bp, Homo sapiens
cacacctccgagacagtcca

SEQ ID NO: 5978440 - DNA, 21 bp, Homo sapiens
cacacctccgagacagtccag

SEQ ID NO: 5978441 - DNA, 12 bp, Homo sapiens
cacacctcctcc

SEQ ID NO: 5978442 - DNA, 14 bp, Homo sapiens
cacacctcctccca

SEQ ID NO: 5978443 - DNA, 21 bp, Homo sapiens
cacacctcctcccactgccca

SEQ ID NO: 5978444 - DNA, 22 bp, Homo sapiens
cacacctcctcccactgcccac

SEQ ID NO: 5978445 - DNA, 12 bp, Homo sapiens
cacacctcgtgg

SEQ ID NO: 5978446 - DNA, 14 bp, Homo sapiens
cacacctctgccag

SEQ ID NO: 5978447 - DNA, 14 bp, Homo sapiens
cacacctctgcccc

SEQ ID NO: 5978448 - DNA, 13 bp, Homo sapiens
cacacctctggct

SEQ ID NO: 5978449 - DNA, 15 bp, Homo sapiens
cacacctctggctgt

SEQ ID NO: 5978450 - DNA, 12 bp, Homo sapiens
cacacctctggg

SEQ ID NO: 5978451 - DNA, 16 bp, Homo sapiens
cacacctctgggggga

SEQ ID NO: 5978452 - DNA, 16 bp, Homo sapiens
cacacctgaacttgcc

SEQ ID NO: 5978453 - DNA, 17 bp, Homo sapiens
cacacctgaatcagctg

SEQ ID NO: 5978454 - DNA, 23 bp, Homo sapiens
cacacctgaatcagctggacata

SEQ ID NO: 5978455 - DNA, 11 bp, Homo sapiens
cacacctgagc

SEQ ID NO: 5978456 - DNA, 14 bp, Homo sapiens
cacacctgcacacc

SEQ ID NO: 5978457 - DNA, 18 bp, Homo sapiens
cacacctgcacaccgtcc

SEQ ID NO: 5978458 - DNA, 15 bp, Homo sapiens
cacacctgccctaaa

SEQ ID NO: 5978459 - DNA, 13 bp, Homo sapiens
cacacctgcctgc

SEQ ID NO: 5978460 - DNA, 15 bp, Homo sapiens
cacacctgcctgcgt

SEQ ID NO: 5978461 - DNA, 17 bp, Homo sapiens
cacacctggccctgggg

SEQ ID NO: 5978462 - DNA, 19 bp, Homo sapiens
cacacctggccctggggcc

SEQ ID NO: 5978463 - DNA, 12 bp, Homo sapiens
cacacctggcct

SEQ ID NO: 5978464 - DNA, 20 bp, Homo sapiens
cacacctggccttaaagagg

SEQ ID NO: 5978465 - DNA, 15 bp, Homo sapiens
cacacctgggcattt

SEQ ID NO: 5978466 - DNA, 22 bp, Homo sapiens
cacacctgggcccgggcaggcc

SEQ ID NO: 5978467 - DNA, 23 bp, Homo sapiens
cacacctgggcccgggcaggcca

SEQ ID NO: 5978468 - DNA, 20 bp, Homo sapiens
cacacctgggggacagaggc

SEQ ID NO: 5978469 - DNA, 21 bp, Homo sapiens
cacacctggtctgttttctgt

SEQ ID NO: 5978470 - DNA, 23 bp, Homo sapiens
cacacctggtggatacctggttg

SEQ ID NO: 5978471 - DNA, 13 bp, Homo sapiens
cacacctgtaatc

SEQ ID NO: 5978472 - DNA, 20 bp, Homo sapiens
cacacctgtagtcccagcta

SEQ ID NO: 5978473 - DNA, 17 bp, Homo sapiens
cacacctgtccttctca

SEQ ID NO: 5978474 - DNA, 14 bp, Homo sapiens
cacacctgtctgtg

SEQ ID NO: 5978475 - DNA, 15 bp, Homo sapiens
cacacctgtgtccaa

SEQ ID NO: 5978476 - DNA, 15 bp, Homo sapiens
cacaccttaaaacat

SEQ ID NO: 5978477 - DNA, 17 bp, Homo sapiens
cacaccttacaaagcca

SEQ ID NO: 5978478 - DNA, 14 bp, Homo sapiens
cacaccttccaggg

SEQ ID NO: 5978479 - DNA, 15 bp, Homo sapiens
cacaccttccagggc

SEQ ID NO: 5978480 - DNA, 20 bp, Homo sapiens
cacaccttccagggccctag

SEQ ID NO: 5978481 - DNA, 15 bp, Homo sapiens
cacaccttccccggg

SEQ ID NO: 5978482 - DNA, 20 bp, Homo sapiens
cacaccttttatgaatcaaa

SEQ ID NO: 5978483 - DNA, 18 bp, Homo sapiens
cacacgatgcatttaata

SEQ ID NO: 5978484 - DNA, 22 bp, Homo sapiens
cacacgatgcatttaataaaga

SEQ ID NO: 5978485 - DNA, 15 bp, Homo sapiens
cacacgcacaaacac

SEQ ID NO: 5978486 - DNA, 18 bp, Homo sapiens
cacacgcacaaacacaca

SEQ ID NO: 5978487 - DNA, 14 bp, Homo sapiens
cacacgcacacaca

SEQ ID NO: 5978488 - DNA, 13 bp, Homo sapiens
cacacgcacgcac

SEQ ID NO: 5978489 - DNA, 14 bp, Homo sapiens
cacacgcacgcaca

SEQ ID NO: 5978490 - DNA, 17 bp, Homo sapiens
cacacgcagacacacac

SEQ ID NO: 5978491 - DNA, 18 bp, Homo sapiens
cacacgcagacacacaca

SEQ ID NO: 5978492 - DNA, 21 bp, Homo sapiens
cacacgcaggaactcccagca

SEQ ID NO: 5978493 - DNA, 22 bp, Homo sapiens
cacacgcaggaactcccagcaa

SEQ ID NO: 5978494 - DNA, 23 bp, Homo sapiens
cacacgcatgggcattgcagcct

SEQ ID NO: 5978495 - DNA, 23 bp, Homo sapiens
cacacgccccggtcccccagagc

SEQ ID NO: 5978496 - DNA, 22 bp, Homo sapiens
cacacgccggggctggccctgc

SEQ ID NO: 5978497 - DNA, 20 bp, Homo sapiens
cacacgcctcccactggggt

SEQ ID NO: 5978498 - DNA, 14 bp, Homo sapiens
cacacgcctgtaat

SEQ ID NO: 5978499 - DNA, 19 bp, Homo sapiens
cacacgcctgtaatcccag

SEQ ID NO: 5978500 - DNA, 14 bp, Homo sapiens
cacacgcctgtagt

SEQ ID NO: 5978501 - DNA, 14 bp, Homo sapiens
cacacgccttcatg

SEQ ID NO: 5978502 - DNA, 19 bp, Homo sapiens
cacacgcgcgcgcacacac

SEQ ID NO: 5978503 - DNA, 21 bp, Homo sapiens
cacacgcgcgcgcacacacac

SEQ ID NO: 5978504 - DNA, 16 bp, Homo sapiens
cacacgcgtccacata

SEQ ID NO: 5978505 - DNA, 14 bp, Homo sapiens
cacacgctgcacct

SEQ ID NO: 5978506 - DNA, 13 bp, Homo sapiens
cacacgctgccca

SEQ ID NO: 5978507 - DNA, 22 bp, Homo sapiens
cacacgctgcccaggctctgct

SEQ ID NO: 5978508 - DNA, 12 bp, Homo sapiens
cacacgctgcct

SEQ ID NO: 5978509 - DNA, 13 bp, Homo sapiens
cacacgctgcctt

SEQ ID NO: 5978510 - DNA, 17 bp, Homo sapiens
cacacgctgctctgccc

SEQ ID NO: 5978511 - DNA, 14 bp, Homo sapiens
cacacgcttttgaa

SEQ ID NO: 5978512 - DNA, 22 bp, Homo sapiens
cacacggacactcaaaagctgg

SEQ ID NO: 5978513 - DNA, 20 bp, Homo sapiens
cacacggactcccgggccac

SEQ ID NO: 5978514 - DNA, 20 bp, Homo sapiens
cacacggaggcatctgcacc

SEQ ID NO: 5978515 - DNA, 22 bp, Homo sapiens
cacacggaggccagacacaggc

SEQ ID NO: 5978516 - DNA, 15 bp, Homo sapiens
cacacggatgcacag

SEQ ID NO: 5978517 - DNA, 13 bp, Homo sapiens
cacacggccaccc

SEQ ID NO: 5978518 - DNA, 15 bp, Homo sapiens
cacacggccctgccc

SEQ ID NO: 5978519 - DNA, 23 bp, Homo sapiens
cacacggccctgccccatcctgg

SEQ ID NO: 5978520 - DNA, 21 bp, Homo sapiens
cacacggctcccccaggcctg

SEQ ID NO: 5978521 - DNA, 22 bp, Homo sapiens
cacacggctggtcactctgccc

SEQ ID NO: 5978522 - DNA, 20 bp, Homo sapiens
cacacgggcctctgcttgcc

SEQ ID NO: 5978523 - DNA, 20 bp, Homo sapiens
cacacggggcacccagccca

SEQ ID NO: 5978524 - DNA, 15 bp, Homo sapiens
cacacgtagactgat

SEQ ID NO: 5978525 - DNA, 22 bp, Homo sapiens
cacacgtatttatatttggaaa

SEQ ID NO: 5978526 - DNA, 19 bp, Homo sapiens
cacacgtcatgtttcttca

SEQ ID NO: 5978527 - DNA, 24 bp, Homo sapiens
cacacgtctgaccctctccacccc

SEQ ID NO: 5978528 - DNA, 13 bp, Homo sapiens
cacacgtgctcgc

SEQ ID NO: 5978529 - DNA, 16 bp, Homo sapiens
cacacgtgctcgcagc

SEQ ID NO: 5978530 - DNA, 18 bp, Homo sapiens
cacacgtgctgtgggcct

SEQ ID NO: 5978531 - DNA, 13 bp, Homo sapiens
cacacgtggctgg

SEQ ID NO: 5978532 - DNA, 14 bp, Homo sapiens
cacacgtggctggc

SEQ ID NO: 5978533 - DNA, 15 bp, Homo sapiens
cacacgtggctggcg

SEQ ID NO: 5978534 - DNA, 16 bp, Homo sapiens
cacacgtggctggcgg

SEQ ID NO: 5978535 - DNA, 19 bp, Homo sapiens
cacacgtggtgacctcaca

SEQ ID NO: 5978536 - DNA, 15 bp, Homo sapiens
cacacgtgtgtatga

SEQ ID NO: 5978537 - DNA, 19 bp, Homo sapiens
cacacgtttaatcccagca

SEQ ID NO: 5978538 - DNA, 16 bp, Homo sapiens
cacactaaaacattgt

SEQ ID NO: 5978539 - DNA, 19 bp, Homo sapiens
cacactaaaacattgtcta

SEQ ID NO: 5978540 - DNA, 13 bp, Homo sapiens
cacactaagaaat

SEQ ID NO: 5978541 - DNA, 18 bp, Homo sapiens
cacactaatctgaaagga

SEQ ID NO: 5978542 - DNA, 14 bp, Homo sapiens
cacactacaccaca

SEQ ID NO: 5978543 - DNA, 17 bp, Homo sapiens
cacactacaccacacac

SEQ ID NO: 5978544 - DNA, 20 bp, Homo sapiens
cacactacaccacacacaac

SEQ ID NO: 5978545 - DNA, 15 bp, Homo sapiens
cacactactacctct

SEQ ID NO: 5978546 - DNA, 14 bp, Homo sapiens
cacactagaattca

SEQ ID NO: 5978547 - DNA, 22 bp, Homo sapiens
cacactatcacctattacattt

SEQ ID NO: 5978548 - DNA, 19 bp, Homo sapiens
cacactatcatagttaaca

SEQ ID NO: 5978549 - DNA, 15 bp, Homo sapiens
cacactatgcacaga

SEQ ID NO: 5978550 - DNA, 20 bp, Homo sapiens
cacactatgcacagagccca

SEQ ID NO: 5978551 - DNA, 23 bp, Homo sapiens
cacactatgtgtgttgtttccat

SEQ ID NO: 5978552 - DNA, 17 bp, Homo sapiens
cacactattaccatgag

SEQ ID NO: 5978553 - DNA, 19 bp, Homo sapiens
cacactattaccatgagaa

SEQ ID NO: 5978554 - DNA, 12 bp, Homo sapiens
cacactatttta

SEQ ID NO: 5978555 - DNA, 19 bp, Homo sapiens
cacactcacaatttaaaat

SEQ ID NO: 5978556 - DNA, 19 bp, Homo sapiens
cacactcaccagtggcctt

SEQ ID NO: 5978557 - DNA, 20 bp, Homo sapiens
cacactcaccagtggccttt

SEQ ID NO: 5978558 - DNA, 17 bp, Homo sapiens
cacactcaccccagcct

SEQ ID NO: 5978559 - DNA, 15 bp, Homo sapiens
cacactcacctctaa

SEQ ID NO: 5978560 - DNA, 13 bp, Homo sapiens
cacactcagaaaa

SEQ ID NO: 5978561 - DNA, 17 bp, Homo sapiens
cacactcagcaccccct

SEQ ID NO: 5978562 - DNA, 12 bp, Homo sapiens
cacactcagcag

SEQ ID NO: 5978563 - DNA, 15 bp, Homo sapiens
cacactcagccacaa

SEQ ID NO: 5978564 - DNA, 17 bp, Homo sapiens
cacactcaggcctgtgc

SEQ ID NO: 5978565 - DNA, 14 bp, Homo sapiens
cacactcatcccct

SEQ ID NO: 5978566 - DNA, 18 bp, Homo sapiens
cacactccacctccagca

SEQ ID NO: 5978567 - DNA, 18 bp, Homo sapiens
cacactccactctgattc

SEQ ID NO: 5978568 - DNA, 12 bp, Homo sapiens
cacactccactg

SEQ ID NO: 5978569 - DNA, 14 bp, Homo sapiens
cacactccactgac

SEQ ID NO: 5978570 - DNA, 15 bp, Homo sapiens
cacactccactgaca

SEQ ID NO: 5978571 - DNA, 14 bp, Homo sapiens
cacactccagaatt

SEQ ID NO: 5978572 - DNA, 14 bp, Homo sapiens
cacactccatcagc

SEQ ID NO: 5978573 - DNA, 15 bp, Homo sapiens
cacactccatcagct

SEQ ID NO: 5978574 - DNA, 17 bp, Homo sapiens
cacactccatcagctta

SEQ ID NO: 5978575 - DNA, 14 bp, Homo sapiens
cacactccatctcc

SEQ ID NO: 5978576 - DNA, 22 bp, Homo sapiens
cacactccatctcctgctcacc

SEQ ID NO: 5978577 - DNA, 19 bp, Homo sapiens
cacactccccgcctgtcct

SEQ ID NO: 5978578 - DNA, 18 bp, Homo sapiens
cacactccccgccttaga

SEQ ID NO: 5978579 - DNA, 20 bp, Homo sapiens
cacactccccgccttagagc

SEQ ID NO: 5978580 - DNA, 18 bp, Homo sapiens
cacactcctcctgccagc

SEQ ID NO: 5978581 - DNA, 22 bp, Homo sapiens
cacactcctcctgccagctctg

SEQ ID NO: 5978582 - DNA, 14 bp, Homo sapiens
cacactccttcccc

SEQ ID NO: 5978583 - DNA, 12 bp, Homo sapiens
caaagcacagct

SEQ ID NO: 5978584 - DNA, 14 bp, Homo sapiens
caaagcacagctgg

SEQ ID NO: 5978585 - DNA, 16 bp, Homo sapiens
caaagcacagctgggc

SEQ ID NO: 5978586 - DNA, 17 bp, Homo sapiens
caaagcacagctgggca

SEQ ID NO: 5978587 - DNA, 13 bp, Homo sapiens
caaagcacagtgt

SEQ ID NO: 5978588 - DNA, 22 bp, Homo sapiens
caaagcacatgcttagcttatc

SEQ ID NO: 5978589 - DNA, 17 bp, Homo sapiens
caaagcaccaaaataag

SEQ ID NO: 5978590 - DNA, 16 bp, Homo sapiens
caaagcacctgaacca

SEQ ID NO: 5978591 - DNA, 23 bp, Homo sapiens
caaagcacctgaaccactgtggc

SEQ ID NO: 5978592 - DNA, 17 bp, Homo sapiens
caaagcaccttgaatgg

SEQ ID NO: 5978593 - DNA, 22 bp, Homo sapiens
caaagcacgaaatgttattttt

SEQ ID NO: 5978594 - DNA, 14 bp, Homo sapiens
caaagcactctctg

SEQ ID NO: 5978595 - DNA, 16 bp, Homo sapiens
caaagcactctctgca

SEQ ID NO: 5978596 - DNA, 17 bp, Homo sapiens
caaagcactctctgcag

SEQ ID NO: 5978597 - DNA, 23 bp, Homo sapiens
caaagcactctctgcagtcctcc

SEQ ID NO: 5978598 - DNA, 15 bp, Homo sapiens
caaagcactggcctt

SEQ ID NO: 5978599 - DNA, 22 bp, Homo sapiens
caaagcacttggactcttgctc

SEQ ID NO: 5978600 - DNA, 23 bp, Homo sapiens
caaagcacttggactcttgctct

SEQ ID NO: 5978601 - DNA, 15 bp, Homo sapiens
caaagcacttttaaa

SEQ ID NO: 5978602 - DNA, 13 bp, Homo sapiens
caaagcagacagc

SEQ ID NO: 5978603 - DNA, 19 bp, Homo sapiens
caaagcagacagctccacc

SEQ ID NO: 5978604 - DNA, 22 bp, Homo sapiens
caaagcagagtgaaattcaatt

SEQ ID NO: 5978605 - DNA, 18 bp, Homo sapiens
caaagcagattttcctaa

SEQ ID NO: 5978606 - DNA, 18 bp, Homo sapiens
caaagcagcaggcctctg

SEQ ID NO: 5978607 - DNA, 13 bp, Homo sapiens
caaagcagccacg

SEQ ID NO: 5978608 - DNA, 12 bp, Homo sapiens
caaagcaggagt

SEQ ID NO: 5978609 - DNA, 12 bp, Homo sapiens
caaagcaggatg

SEQ ID NO: 5978610 - DNA, 22 bp, Homo sapiens
caaagcaggggagtatgcaaaa

SEQ ID NO: 5978611 - DNA, 15 bp, Homo sapiens
caaagcagggtctgg

SEQ ID NO: 5978612 - DNA, 22 bp, Homo sapiens
caaagcagtatgtacaggctga

SEQ ID NO: 5978613 - DNA, 21 bp, Homo sapiens
caaagcagtgcatgctgtccc

SEQ ID NO: 5978614 - DNA, 12 bp, Homo sapiens
caaagcagtgtt

SEQ ID NO: 5978615 - DNA, 14 bp, Homo sapiens
caaagcagttgaat

SEQ ID NO: 5978616 - DNA, 15 bp, Homo sapiens
caaagcataaaatgg

SEQ ID NO: 5978617 - DNA, 20 bp, Homo sapiens
caaagcatcattgtaaatta

SEQ ID NO: 5978618 - DNA, 16 bp, Homo sapiens
caaagcatgaaatgga

SEQ ID NO: 5978619 - DNA, 17 bp, Homo sapiens
caaagcatgggaaaaag

SEQ ID NO: 5978620 - DNA, 21 bp, Homo sapiens
caaagcatgtgctagtggcaa

SEQ ID NO: 5978621 - DNA, 15 bp, Homo sapiens
caaagccaaacaaaa

SEQ ID NO: 5978622 - DNA, 16 bp, Homo sapiens
caaagccaaacaaaac

SEQ ID NO: 5978623 - DNA, 22 bp, Homo sapiens
caaagccacaaggctggccagc

SEQ ID NO: 5978624 - DNA, 16 bp, Homo sapiens
caaagccacctgctgc

SEQ ID NO: 5978625 - DNA, 13 bp, Homo sapiens
caaagccactgga

SEQ ID NO: 5978626 - DNA, 11 bp, Homo sapiens
caaagccagaa

SEQ ID NO: 5978627 - DNA, 13 bp, Homo sapiens
caaagccagaagc

SEQ ID NO: 5978628 - DNA, 16 bp, Homo sapiens
caaagccagaagctga

SEQ ID NO: 5978629 - DNA, 15 bp, Homo sapiens
caaagccagaggaga

SEQ ID NO: 5978630 - DNA, 14 bp, Homo sapiens
caaagccagagtgg

SEQ ID NO: 5978631 - DNA, 14 bp, Homo sapiens
caaagccagctctg

SEQ ID NO: 5978632 - DNA, 17 bp, Homo sapiens
caaagccagctctgagc

SEQ ID NO: 5978633 - DNA, 23 bp, Homo sapiens
caaagccagggtctctccctcag

SEQ ID NO: 5978634 - DNA, 14 bp, Homo sapiens
caaagccagtgaaa

SEQ ID NO: 5978635 - DNA, 21 bp, Homo sapiens
caaagccatatcaccagtctt

SEQ ID NO: 5978636 - DNA, 16 bp, Homo sapiens
caaagccatatggaca

SEQ ID NO: 5978637 - DNA, 19 bp, Homo sapiens
caaagccatatggacactg

SEQ ID NO: 5978638 - DNA, 21 bp, Homo sapiens
caaagccatatggacactgtg

SEQ ID NO: 5978639 - DNA, 17 bp, Homo sapiens
caaagccattctccccc

SEQ ID NO: 5978640 - DNA, 18 bp, Homo sapiens
caaagcccacttcacaca

SEQ ID NO: 5978641 - DNA, 11 bp, Homo sapiens
caaagcccagc

SEQ ID NO: 5978642 - DNA, 17 bp, Homo sapiens
caaagcccagcccggct

SEQ ID NO: 5978643 - DNA, 22 bp, Homo sapiens
caaagccccatgctggagcctg

SEQ ID NO: 5978644 - DNA, 16 bp, Homo sapiens
caaagccccatgtgcc

SEQ ID NO: 5978645 - DNA, 19 bp, Homo sapiens
caaagccccatgtgccttg

SEQ ID NO: 5978646 - DNA, 17 bp, Homo sapiens
caaagccccattaactg

SEQ ID NO: 5978647 - DNA, 17 bp, Homo sapiens
caaagcccccagagccc

SEQ ID NO: 5978648 - DNA, 19 bp, Homo sapiens
caaagcccccagagcccag

SEQ ID NO: 5978649 - DNA, 18 bp, Homo sapiens
caaagccccccagctccc

SEQ ID NO: 5978650 - DNA, 19 bp, Homo sapiens
caaagccccccagctccca

SEQ ID NO: 5978651 - DNA, 22 bp, Homo sapiens
caaagcccctacaactccagcc

SEQ ID NO: 5978652 - DNA, 19 bp, Homo sapiens
caaagcccctcacactgca

SEQ ID NO: 5978653 - DNA, 24 bp, Homo sapiens
caaagcccctcacactgcaaggga

SEQ ID NO: 5978654 - DNA, 23 bp, Homo sapiens
caaagccctccctgtctgtctgt

SEQ ID NO: 5978655 - DNA, 12 bp, Homo sapiens
caaagccctgcc

SEQ ID NO: 5978656 - DNA, 15 bp, Homo sapiens
caaagccctgcctct

SEQ ID NO: 5978657 - DNA, 19 bp, Homo sapiens
caaagccctgcctctgtgt

SEQ ID NO: 5978658 - DNA, 12 bp, Homo sapiens
caaagccctgtc

SEQ ID NO: 5978659 - DNA, 14 bp, Homo sapiens
caaagccctgtcct

SEQ ID NO: 5978660 - DNA, 16 bp, Homo sapiens
caaagccggcctgaga

SEQ ID NO: 5978661 - DNA, 17 bp, Homo sapiens
caaagcctcctccagcc

SEQ ID NO: 5978662 - DNA, 21 bp, Homo sapiens
caaagcctcttcaaaaagcag

SEQ ID NO: 5978663 - DNA, 14 bp, Homo sapiens
caaagcctgaggac

SEQ ID NO: 5978664 - DNA, 14 bp, Homo sapiens
caaagcctggccta

SEQ ID NO: 5978665 - DNA, 17 bp, Homo sapiens
caaagcctgtcccagga

SEQ ID NO: 5978666 - DNA, 18 bp, Homo sapiens
caaagcctgtcccaggac

SEQ ID NO: 5978667 - DNA, 22 bp, Homo sapiens
caaagcctgttcatggcagatg

SEQ ID NO: 5978668 - DNA, 18 bp, Homo sapiens
caaagccttaagcaaatt

SEQ ID NO: 5978669 - DNA, 16 bp, Homo sapiens
caaagccttctcccta

SEQ ID NO: 5978670 - DNA, 17 bp, Homo sapiens
caaagccttgtgtctac

SEQ ID NO: 5978671 - DNA, 23 bp, Homo sapiens
caaagccttgtgtctacagagaa

SEQ ID NO: 5978672 - DNA, 14 bp, Homo sapiens
caaagcgaatttta

SEQ ID NO: 5978673 - DNA, 15 bp, Homo sapiens
caaagcgacagattc

SEQ ID NO: 5978674 - DNA, 19 bp, Homo sapiens
caaagcgagatcccatctc

SEQ ID NO: 5978675 - DNA, 16 bp, Homo sapiens
caaagcgcccacccag

SEQ ID NO: 5978676 - DNA, 12 bp, Homo sapiens
caaagcggctct

SEQ ID NO: 5978677 - DNA, 22 bp, Homo sapiens
caaagcgggacgccgcaggtgt

SEQ ID NO: 5978678 - DNA, 17 bp, Homo sapiens
caaagcggtccctgtcc

SEQ ID NO: 5978679 - DNA, 20 bp, Homo sapiens
caaagctaaaaaattgttaa

SEQ ID NO: 5978680 - DNA, 21 bp, Homo sapiens
caaagctaaatacatggaaat

SEQ ID NO: 5978681 - DNA, 21 bp, Homo sapiens
caaagctaggaaaggcagaaa

SEQ ID NO: 5978682 - DNA, 13 bp, Homo sapiens
caaagctaggatg

SEQ ID NO: 5978683 - DNA, 16 bp, Homo sapiens
caaagctaggcctggc

SEQ ID NO: 5978684 - DNA, 17 bp, Homo sapiens
caaagctaggcctggcc

SEQ ID NO: 5978685 - DNA, 21 bp, Homo sapiens
caaagctatatgttgtaactt

SEQ ID NO: 5978686 - DNA, 12 bp, Homo sapiens
caaagctattta

SEQ ID NO: 5978687 - DNA, 18 bp, Homo sapiens
caaagctatttaagtgga

SEQ ID NO: 5978688 - DNA, 21 bp, Homo sapiens
caaagctcaagatgacagctc

SEQ ID NO: 5978689 - DNA, 22 bp, Homo sapiens
caaagctcaagatgacagctct

SEQ ID NO: 5978690 - DNA, 20 bp, Homo sapiens
caaagctccttaaagttctg

SEQ ID NO: 5978691 - DNA, 20 bp, Homo sapiens
caaagctcgggtctccctcc

SEQ ID NO: 5978692 - DNA, 19 bp, Homo sapiens
caaagctctgaattcaggt

SEQ ID NO: 5978693 - DNA, 21 bp, Homo sapiens
caaagctctgaattcaggtcc

SEQ ID NO: 5978694 - DNA, 22 bp, Homo sapiens
caaagctctgaattcaggtccc

SEQ ID NO: 5978695 - DNA, 22 bp, Homo sapiens
caaagctgaaaatgtgtataca

SEQ ID NO: 5978696 - DNA, 22 bp, Homo sapiens
caaagctgaagccgccaggacc

SEQ ID NO: 5978697 - DNA, 15 bp, Homo sapiens
caaagctgaatattt

SEQ ID NO: 5978698 - DNA, 21 bp, Homo sapiens
caaagctgagttacttgtctg

SEQ ID NO: 5978699 - DNA, 19 bp, Homo sapiens
caaagctgatgacaacttc

SEQ ID NO: 5978700 - DNA, 15 bp, Homo sapiens
caaagctgcccactg

SEQ ID NO: 5978701 - DNA, 20 bp, Homo sapiens
caaagctgcccactgtttct

SEQ ID NO: 5978702 - DNA, 23 bp, Homo sapiens
caaagctgcctgtgccatgccca

SEQ ID NO: 5978703 - DNA, 17 bp, Homo sapiens
caaagctgctaaatctc

SEQ ID NO: 5978704 - DNA, 23 bp, Homo sapiens
caaagctgctaaatctcctattt

SEQ ID NO: 5978705 - DNA, 14 bp, Homo sapiens
caaagctgctgggc

SEQ ID NO: 5978706 - DNA, 16 bp, Homo sapiens
caaagctgctgggcca

SEQ ID NO: 5978707 - DNA, 17 bp, Homo sapiens
caaagctgctttcttct

SEQ ID NO: 5978708 - DNA, 20 bp, Homo sapiens
caaagctgctttcttctctg

SEQ ID NO: 5978709 - DNA, 22 bp, Homo sapiens
caaagctgctttcttctctgcc

SEQ ID NO: 5978710 - DNA, 18 bp, Homo sapiens
caaagctgtcactcacaa

SEQ ID NO: 5978711 - DNA, 12 bp, Homo sapiens
caaagctgttaa

SEQ ID NO: 5978712 - DNA, 13 bp, Homo sapiens
caaagctgttaaa

SEQ ID NO: 5978713 - DNA, 18 bp, Homo sapiens
caaagctgttcttcctgg

SEQ ID NO: 5978714 - DNA, 16 bp, Homo sapiens
caaagcttagcaggag

SEQ ID NO: 5978715 - DNA, 17 bp, Homo sapiens
caaagcttagcaggaga

SEQ ID NO: 5978716 - DNA, 18 bp, Homo sapiens
caaagcttagcaggagag

SEQ ID NO: 5978717 - DNA, 22 bp, Homo sapiens
caaagcttagcaggagaggaga

SEQ ID NO: 5978718 - DNA, 20 bp, Homo sapiens
caaagcttccattccacatc

SEQ ID NO: 5978719 - DNA, 18 bp, Homo sapiens
caaagcttcgtcttgtgt

SEQ ID NO: 5978720 - DNA, 21 bp, Homo sapiens
caaagcttggaagagcctgca

SEQ ID NO: 5978721 - DNA, 19 bp, Homo sapiens
caaagcttggagggaagcc

SEQ ID NO: 5978722 - DNA, 15 bp, Homo sapiens
caaagcttgtgaaaa

SEQ ID NO: 5978723 - DNA, 16 bp, Homo sapiens
caaagctttcctgccc

SEQ ID NO: 5978724 - DNA, 23 bp, Homo sapiens
caaagctttcctgtttccagggt

SEQ ID NO: 5978725 - DNA, 13 bp, Homo sapiens
caaagctttgcta

SEQ ID NO: 5978726 - DNA, 18 bp, Homo sapiens
caaagctttgctacaaat

SEQ ID NO: 5978727 - DNA, 19 bp, Homo sapiens
caaagctttgctacaaatt

SEQ ID NO: 5978728 - DNA, 21 bp, Homo sapiens
caaagctttgctacaaattta

SEQ ID NO: 5978729 - DNA, 17 bp, Homo sapiens
caaagcttttgcatatt

SEQ ID NO: 5978730 - DNA, 19 bp, Homo sapiens
caaagcttttgcctgcaag

SEQ ID NO: 5978731 - DNA, 20 bp, Homo sapiens
caaagcttttgcctgcaaga

SEQ ID NO: 5978732 - DNA, 17 bp, Homo sapiens
caaagcttttgtaaaat

SEQ ID NO: 5978733 - DNA, 22 bp, Homo sapiens
caaaggaaaaagcacaagaagc

SEQ ID NO: 5978734 - DNA, 21 bp, Homo sapiens
caaaggaaaacacctttattt

SEQ ID NO: 5978735 - DNA, 19 bp, Homo sapiens
caaaggaaaactcttggcc

SEQ ID NO: 5978736 - DNA, 22 bp, Homo sapiens
caaaggaaaactcttggcctct

SEQ ID NO: 5978737 - DNA, 13 bp, Homo sapiens
caaaggaaaataa

SEQ ID NO: 5978738 - DNA, 17 bp, Homo sapiens
caaaggaaaatgtctgt

SEQ ID NO: 5978739 - DNA, 20 bp, Homo sapiens
caaaggaaaccaaaggaatc

SEQ ID NO: 5978740 - DNA, 18 bp, Homo sapiens
caaaggaaactttgcaga

SEQ ID NO: 5978741 - DNA, 16 bp, Homo sapiens
caaaggaacactgaca

SEQ ID NO: 5978742 - DNA, 19 bp, Homo sapiens
caaaggaacattgtgtcta

SEQ ID NO: 5978743 - DNA, 22 bp, Homo sapiens
caaaggaagacttggcccagga

SEQ ID NO: 5978744 - DNA, 18 bp, Homo sapiens
caaaggaagtagcaggcc

SEQ ID NO: 5978745 - DNA, 16 bp, Homo sapiens
caaaggaagtctagga

SEQ ID NO: 5978746 - DNA, 19 bp, Homo sapiens
caaaggaagtgccccctcc

SEQ ID NO: 5978747 - DNA, 19 bp, Homo sapiens
caaaggaatctccagtttt

SEQ ID NO: 5978748 - DNA, 21 bp, Homo sapiens
caaaggaatggaggctctaat

SEQ ID NO: 5978749 - DNA, 21 bp, Homo sapiens
caaaggaatttgcatccagca

SEQ ID NO: 5978750 - DNA, 18 bp, Homo sapiens
caaaggacattatgtgtg

SEQ ID NO: 5978751 - DNA, 16 bp, Homo sapiens
caaaggacgcactgag

SEQ ID NO: 5978752 - DNA, 18 bp, Homo sapiens
caaaggacgcactgagca

SEQ ID NO: 5978753 - DNA, 18 bp, Homo sapiens
caaaggactgacctgccc

SEQ ID NO: 5978754 - DNA, 18 bp, Homo sapiens
caaaggacttgacttgca

SEQ ID NO: 5978755 - DNA, 19 bp, Homo sapiens
caaaggagaaaaaaaacct

SEQ ID NO: 5978756 - DNA, 21 bp, Homo sapiens
caaaggagacaaagcaggagt

SEQ ID NO: 5978757 - DNA, 20 bp, Homo sapiens
caaaggagagtcacagaaca

SEQ ID NO: 5978758 - DNA, 12 bp, Homo sapiens
caaaggagcctg

SEQ ID NO: 5978759 - DNA, 14 bp, Homo sapiens
caaaggagcctgtg

SEQ ID NO: 5978760 - DNA, 23 bp, Homo sapiens
cacactccttccccttgtccctg

SEQ ID NO: 5978761 - DNA, 16 bp, Homo sapiens
cacactcgcccgccca

SEQ ID NO: 5978762 - DNA, 18 bp, Homo sapiens
cacactcgtctttccctt

SEQ ID NO: 5978763 - DNA, 21 bp, Homo sapiens
cacactctcatgtccccttcc

SEQ ID NO: 5978764 - DNA, 21 bp, Homo sapiens
cacactctctgcagcccagcc

SEQ ID NO: 5978765 - DNA, 23 bp, Homo sapiens
cacactctctgcagcccagccta

SEQ ID NO: 5978766 - DNA, 12 bp, Homo sapiens
cacactctgacg

SEQ ID NO: 5978767 - DNA, 19 bp, Homo sapiens
cacactgaaacctcttcgg

SEQ ID NO: 5978768 - DNA, 12 bp, Homo sapiens
cacactgaaatt

SEQ ID NO: 5978769 - DNA, 13 bp, Homo sapiens
cacactgaagaag

SEQ ID NO: 5978770 - DNA, 18 bp, Homo sapiens
cacactgacataatgtag

SEQ ID NO: 5978771 - DNA, 13 bp, Homo sapiens
cacactgaccaca

SEQ ID NO: 5978772 - DNA, 17 bp, Homo sapiens
cacactgaccacactgt

SEQ ID NO: 5978773 - DNA, 14 bp, Homo sapiens
cacactgagctggg

SEQ ID NO: 5978774 - DNA, 16 bp, Homo sapiens
cacactgaggcaggga

SEQ ID NO: 5978775 - DNA, 18 bp, Homo sapiens
cacactgaggcagggaag

SEQ ID NO: 5978776 - DNA, 17 bp, Homo sapiens
cacactgagttctatca

SEQ ID NO: 5978777 - DNA, 18 bp, Homo sapiens
cacactgagttgcacata

SEQ ID NO: 5978778 - DNA, 21 bp, Homo sapiens
cacactgatacataaaaatta

SEQ ID NO: 5978779 - DNA, 20 bp, Homo sapiens
cacactgatgggctggggca

SEQ ID NO: 5978780 - DNA, 14 bp, Homo sapiens
cacactgcaacagg

SEQ ID NO: 5978781 - DNA, 17 bp, Homo sapiens
cacactgcaacaggaac

SEQ ID NO: 5978782 - DNA, 17 bp, Homo sapiens
cacactgcaagagcctt

SEQ ID NO: 5978783 - DNA, 19 bp, Homo sapiens
cacactgcaagagccttgg

SEQ ID NO: 5978784 - DNA, 12 bp, Homo sapiens
cacactgcacaa

SEQ ID NO: 5978785 - DNA, 19 bp, Homo sapiens
cacactgcagggaggagtg

SEQ ID NO: 5978786 - DNA, 18 bp, Homo sapiens
cacactgcagggctgctg

SEQ ID NO: 5978787 - DNA, 11 bp, Homo sapiens
cacactgccaa

SEQ ID NO: 5978788 - DNA, 18 bp, Homo sapiens
cacactgccaaataaaca

SEQ ID NO: 5978789 - DNA, 22 bp, Homo sapiens
cacactgccaaataaacagcta

SEQ ID NO: 5978790 - DNA, 17 bp, Homo sapiens
cacactgccagaagaga

SEQ ID NO: 5978791 - DNA, 18 bp, Homo sapiens
cacactgccctctgccac

SEQ ID NO: 5978792 - DNA, 19 bp, Homo sapiens
cacactgccctctgccact

SEQ ID NO: 5978793 - DNA, 14 bp, Homo sapiens
cacactgcctccca

SEQ ID NO: 5978794 - DNA, 20 bp, Homo sapiens
cacactgcgcaggtctcttc

SEQ ID NO: 5978795 - DNA, 22 bp, Homo sapiens
cacactgcgcaggtctcttctg

SEQ ID NO: 5978796 - DNA, 23 bp, Homo sapiens
cacactgcgcaggtctcttctgg

SEQ ID NO: 5978797 - DNA, 23 bp, Homo sapiens
cacactgctaaatttacgtatat

SEQ ID NO: 5978798 - DNA, 12 bp, Homo sapiens
cacactgctggg

SEQ ID NO: 5978799 - DNA, 14 bp, Homo sapiens
cacactgctgtcct

SEQ ID NO: 5978800 - DNA, 15 bp, Homo sapiens
cacactgctgtcctc

SEQ ID NO: 5978801 - DNA, 21 bp, Homo sapiens
cacactgcttggcccttcaag

SEQ ID NO: 5978802 - DNA, 19 bp, Homo sapiens
cacactggaggagcacaca

SEQ ID NO: 5978803 - DNA, 18 bp, Homo sapiens
cacactggcgtctggact

SEQ ID NO: 5978804 - DNA, 15 bp, Homo sapiens
cacactggctcaccc

SEQ ID NO: 5978805 - DNA, 16 bp, Homo sapiens
cacactggctcaccca

SEQ ID NO: 5978806 - DNA, 19 bp, Homo sapiens
cacactgggacttgcaaaa

SEQ ID NO: 5978807 - DNA, 23 bp, Homo sapiens
cacactgggcctggagccctggg

SEQ ID NO: 5978808 - DNA, 19 bp, Homo sapiens
cacactggggtgccgcctg

SEQ ID NO: 5978809 - DNA, 16 bp, Homo sapiens
cacactggtcacaggc

SEQ ID NO: 5978810 - DNA, 23 bp, Homo sapiens
cacactggtgtggattaacctgc

SEQ ID NO: 5978811 - DNA, 18 bp, Homo sapiens
cacactggttctcaatga

SEQ ID NO: 5978812 - DNA, 17 bp, Homo sapiens
cacactgtaaacccctg

SEQ ID NO: 5978813 - DNA, 15 bp, Homo sapiens
cacactgtaaatatg

SEQ ID NO: 5978814 - DNA, 22 bp, Homo sapiens
cacactgtcatgcttcatcatt

SEQ ID NO: 5978815 - DNA, 15 bp, Homo sapiens
cacactgtctggggc

SEQ ID NO: 5978816 - DNA, 16 bp, Homo sapiens
cacactgtctggggcc

SEQ ID NO: 5978817 - DNA, 14 bp, Homo sapiens
cacactgtcttccc

SEQ ID NO: 5978818 - DNA, 12 bp, Homo sapiens
cacactgtgaca

SEQ ID NO: 5978819 - DNA, 17 bp, Homo sapiens
cacactgtgcagaccca

SEQ ID NO: 5978820 - DNA, 17 bp, Homo sapiens
cacactgtggaacacta

SEQ ID NO: 5978821 - DNA, 16 bp, Homo sapiens
cacactgtgtcctggt

SEQ ID NO: 5978822 - DNA, 23 bp, Homo sapiens
cacactgtgtgggggacggcttc

SEQ ID NO: 5978823 - DNA, 17 bp, Homo sapiens
cacactgtttttcatac

SEQ ID NO: 5978824 - DNA, 12 bp, Homo sapiens
cacacttagctg

SEQ ID NO: 5978825 - DNA, 21 bp, Homo sapiens
cacacttatattttatgaaca

SEQ ID NO: 5978826 - DNA, 17 bp, Homo sapiens
cacacttatttatgaat

SEQ ID NO: 5978827 - DNA, 13 bp, Homo sapiens
cacacttcaaact

SEQ ID NO: 5978828 - DNA, 18 bp, Homo sapiens
cacacttcaaactacttt

SEQ ID NO: 5978829 - DNA, 12 bp, Homo sapiens
cacacttcaaat

SEQ ID NO: 5978830 - DNA, 17 bp, Homo sapiens
cacacttcaggctcttc

SEQ ID NO: 5978831 - DNA, 22 bp, Homo sapiens
cacacttccacccccagctcct

SEQ ID NO: 5978832 - DNA, 20 bp, Homo sapiens
cacacttcccacccccaggc

SEQ ID NO: 5978833 - DNA, 15 bp, Homo sapiens
cacacttccccatct

SEQ ID NO: 5978834 - DNA, 12 bp, Homo sapiens
cacacttcccct

SEQ ID NO: 5978835 - DNA, 23 bp, Homo sapiens
cacacttccccttgggatgggca

SEQ ID NO: 5978836 - DNA, 13 bp, Homo sapiens
cacacttccctgg

SEQ ID NO: 5978837 - DNA, 13 bp, Homo sapiens
cacacttcctgtc

SEQ ID NO: 5978838 - DNA, 19 bp, Homo sapiens
cacacttcctgtccagaga

SEQ ID NO: 5978839 - DNA, 14 bp, Homo sapiens
cacacttctcagga

SEQ ID NO: 5978840 - DNA, 17 bp, Homo sapiens
cacacttctcaggacac

SEQ ID NO: 5978841 - DNA, 23 bp, Homo sapiens
cacacttctcaggacacaggcct

SEQ ID NO: 5978842 - DNA, 22 bp, Homo sapiens
cacacttcttgaaacagcctgg

SEQ ID NO: 5978843 - DNA, 16 bp, Homo sapiens
cacacttgaaaccttt

SEQ ID NO: 5978844 - DNA, 19 bp, Homo sapiens
cacacttgcaaatgaatgc

SEQ ID NO: 5978845 - DNA, 19 bp, Homo sapiens
cacacttgggagcagtcct

SEQ ID NO: 5978846 - DNA, 19 bp, Homo sapiens
cacacttgggcgctctgcc

SEQ ID NO: 5978847 - DNA, 21 bp, Homo sapiens
cacacttgggcgctctgccct

SEQ ID NO: 5978848 - DNA, 14 bp, Homo sapiens
cacacttgggctgg

SEQ ID NO: 5978849 - DNA, 14 bp, Homo sapiens
cacacttgtgccag

SEQ ID NO: 5978850 - DNA, 15 bp, Homo sapiens
cacacttgtgccagc

SEQ ID NO: 5978851 - DNA, 16 bp, Homo sapiens
cacacttgtgtgccac

SEQ ID NO: 5978852 - DNA, 16 bp, Homo sapiens
cacacttgttccagct

SEQ ID NO: 5978853 - DNA, 12 bp, Homo sapiens
cacacttgtttc

SEQ ID NO: 5978854 - DNA, 14 bp, Homo sapiens
cacacttgttttct

SEQ ID NO: 5978855 - DNA, 14 bp, Homo sapiens
cacactttcactgg

SEQ ID NO: 5978856 - DNA, 15 bp, Homo sapiens
cacactttccatctc

SEQ ID NO: 5978857 - DNA, 12 bp, Homo sapiens
cacactttctga

SEQ ID NO: 5978858 - DNA, 13 bp, Homo sapiens
cacactttctgac

SEQ ID NO: 5978859 - DNA, 15 bp, Homo sapiens
cacactttctggcaa

SEQ ID NO: 5978860 - DNA, 14 bp, Homo sapiens
cacactttgaagca

SEQ ID NO: 5978861 - DNA, 19 bp, Homo sapiens
cacactttgaagcaaatac

SEQ ID NO: 5978862 - DNA, 19 bp, Homo sapiens
cacactttggcccagggtg

SEQ ID NO: 5978863 - DNA, 15 bp, Homo sapiens
cacacttttccacat

SEQ ID NO: 5978864 - DNA, 20 bp, Homo sapiens
cacactttttttcctctttc

SEQ ID NO: 5978865 - DNA, 13 bp, Homo sapiens
cacagaaaaagca

SEQ ID NO: 5978866 - DNA, 14 bp, Homo sapiens
cacagaaaaagcat

SEQ ID NO: 5978867 - DNA, 14 bp, Homo sapiens
cacagaaaaccgag

SEQ ID NO: 5978868 - DNA, 15 bp, Homo sapiens
cacagaaaactagaa

SEQ ID NO: 5978869 - DNA, 23 bp, Homo sapiens
cacagaaaagaaagttcatgctt

SEQ ID NO: 5978870 - DNA, 16 bp, Homo sapiens
cacagaaaatatactg

SEQ ID NO: 5978871 - DNA, 19 bp, Homo sapiens
cacagaaaatatactgtaa

SEQ ID NO: 5978872 - DNA, 23 bp, Homo sapiens
cacagaaaatggaagacagctct

SEQ ID NO: 5978873 - DNA, 18 bp, Homo sapiens
cacagaaaatgtaaactg

SEQ ID NO: 5978874 - DNA, 12 bp, Homo sapiens
cacagaaaattt

SEQ ID NO: 5978875 - DNA, 11 bp, Homo sapiens
cacagaaacac

SEQ ID NO: 5978876 - DNA, 18 bp, Homo sapiens
cacagaaacacaatattt

SEQ ID NO: 5978877 - DNA, 19 bp, Homo sapiens
cacagaaacactgcctttt

SEQ ID NO: 5978878 - DNA, 16 bp, Homo sapiens
cacagaaaccaatttt

SEQ ID NO: 5978879 - DNA, 12 bp, Homo sapiens
cacagaaacctt

SEQ ID NO: 5978880 - DNA, 18 bp, Homo sapiens
cacagaaagactgagctc

SEQ ID NO: 5978881 - DNA, 14 bp, Homo sapiens
cacagaaagagagc

SEQ ID NO: 5978882 - DNA, 15 bp, Homo sapiens
cacagaaagagagca

SEQ ID NO: 5978883 - DNA, 21 bp, Homo sapiens
cacagaaagctccttccagac

SEQ ID NO: 5978884 - DNA, 20 bp, Homo sapiens
cacagaaaggccactcagga

SEQ ID NO: 5978885 - DNA, 15 bp, Homo sapiens
cacagaaatatatat

SEQ ID NO: 5978886 - DNA, 21 bp, Homo sapiens
cacagaaatatatatacatat

SEQ ID NO: 5978887 - DNA, 21 bp, Homo sapiens
cacagaaatcacagtcaatgg

SEQ ID NO: 5978888 - DNA, 17 bp, Homo sapiens
cacagaaatcagaggag

SEQ ID NO: 5978889 - DNA, 14 bp, Homo sapiens
cacagaaatctgaa

SEQ ID NO: 5978890 - DNA, 22 bp, Homo sapiens
cacagaaatgagatcaggctct

SEQ ID NO: 5978891 - DNA, 18 bp, Homo sapiens
cacagaaatgctgctggc

SEQ ID NO: 5978892 - DNA, 21 bp, Homo sapiens
cacagaaatgctgctggccaa

SEQ ID NO: 5978893 - DNA, 14 bp, Homo sapiens
cacagaacaagcca

SEQ ID NO: 5978894 - DNA, 13 bp, Homo sapiens
cacagaacccttg

SEQ ID NO: 5978895 - DNA, 19 bp, Homo sapiens
cacagaaccttcaacccag

SEQ ID NO: 5978896 - DNA, 21 bp, Homo sapiens
cacagaaccttcaacccagtg

SEQ ID NO: 5978897 - DNA, 16 bp, Homo sapiens
cacagaacctttgtca

SEQ ID NO: 5978898 - DNA, 19 bp, Homo sapiens
cacagaactggcaggagcc

SEQ ID NO: 5978899 - DNA, 23 bp, Homo sapiens
cacagaagcctaggaggactggg

SEQ ID NO: 5978900 - DNA, 18 bp, Homo sapiens
cacagaaggaatctgtgc

SEQ ID NO: 5978901 - DNA, 20 bp, Homo sapiens
cacagaaggaatctgtgcag

SEQ ID NO: 5978902 - DNA, 18 bp, Homo sapiens
cacagaaggggactgcca

SEQ ID NO: 5978903 - DNA, 18 bp, Homo sapiens
cacagaaggtgaactttg

SEQ ID NO: 5978904 - DNA, 22 bp, Homo sapiens
cacagaagtccctaggagggaa

SEQ ID NO: 5978905 - DNA, 16 bp, Homo sapiens
cacagaatatttttat

SEQ ID NO: 5978906 - DNA, 19 bp, Homo sapiens
cacagaatcatatgattct

SEQ ID NO: 5978907 - DNA, 15 bp, Homo sapiens
cacagaatctccatt

SEQ ID NO: 5978908 - DNA, 17 bp, Homo sapiens
cacagaatgctcagggt

SEQ ID NO: 5978909 - DNA, 15 bp, Homo sapiens
cacagacaagcagcc

SEQ ID NO: 5978910 - DNA, 20 bp, Homo sapiens
cacagacaagggggatgttg

SEQ ID NO: 5978911 - DNA, 16 bp, Homo sapiens
cacagacaattctaat

SEQ ID NO: 5978912 - DNA, 12 bp, Homo sapiens
cacagacacaca

SEQ ID NO: 5978913 - DNA, 18 bp, Homo sapiens
cacagacacacacacgca

SEQ ID NO: 5978914 - DNA, 13 bp, Homo sapiens
cacagacactcct

SEQ ID NO: 5978915 - DNA, 16 bp, Homo sapiens
cacagacactcctggg

SEQ ID NO: 5978916 - DNA, 22 bp, Homo sapiens
cacagacaggacccctgcagtt

SEQ ID NO: 5978917 - DNA, 21 bp, Homo sapiens
cacagacaggttttcacataa

SEQ ID NO: 5978918 - DNA, 22 bp, Homo sapiens
cacagacaggttttcacataaa

SEQ ID NO: 5978919 - DNA, 21 bp, Homo sapiens
cacagacatactaaccagcag

SEQ ID NO: 5978920 - DNA, 16 bp, Homo sapiens
cacagacatctttcaa

SEQ ID NO: 5978921 - DNA, 22 bp, Homo sapiens
cacagaccaagtccaagcccgt

SEQ ID NO: 5978922 - DNA, 14 bp, Homo sapiens
cacagacccacaca

SEQ ID NO: 5978923 - DNA, 17 bp, Homo sapiens
cacagaccccagctggg

SEQ ID NO: 5978924 - DNA, 14 bp, Homo sapiens
cacagacccctagg

SEQ ID NO: 5978925 - DNA, 12 bp, Homo sapiens
cacagacccctc

SEQ ID NO: 5978926 - DNA, 15 bp, Homo sapiens
cacagacccctgggg

SEQ ID NO: 5978927 - DNA, 17 bp, Homo sapiens
cacagacccctggggga

SEQ ID NO: 5978928 - DNA, 13 bp, Homo sapiens
cacagaccctgcc

SEQ ID NO: 5978929 - DNA, 19 bp, Homo sapiens
cacagaccctgcccacccc

SEQ ID NO: 5978930 - DNA, 18 bp, Homo sapiens
cacagaccctgccctgtg

SEQ ID NO: 5978931 - DNA, 20 bp, Homo sapiens
cacagaccctgccctgtggg

SEQ ID NO: 5978932 - DNA, 15 bp, Homo sapiens
cacagacctcagaga

SEQ ID NO: 5978933 - DNA, 17 bp, Homo sapiens
cacagacctcagagatg

SEQ ID NO: 5978934 - DNA, 17 bp, Homo sapiens
cacagacctctgcttgg

SEQ ID NO: 5978935 - DNA, 18 bp, Homo sapiens
cacagacctctgcttgga

SEQ ID NO: 5978936 - DNA, 13 bp, Homo sapiens
cacagacctgcag

SEQ ID NO: 5978937 - DNA, 14 bp, Homo sapiens
cacagacctgcagt

SEQ ID NO: 5978938 - DNA, 16 bp, Homo sapiens
cacagacctgcagtga

SEQ ID NO: 5978939 - DNA, 18 bp, Homo sapiens
cacagacctgcagtgagg

SEQ ID NO: 5978940 - DNA, 23 bp, Homo sapiens
cacagacctgcagtgaggggccc

SEQ ID NO: 5978941 - DNA, 14 bp, Homo sapiens
cacagacctggagc

SEQ ID NO: 5978942 - DNA, 15 bp, Homo sapiens
cacagacctggagcc

SEQ ID NO: 5978943 - DNA, 20 bp, Homo sapiens
cacagacctggagcccctgg

SEQ ID NO: 5978944 - DNA, 15 bp, Homo sapiens
cacagacgccacctg

SEQ ID NO: 5978945 - DNA, 23 bp, Homo sapiens
cacagacggaagggtaaacaata

SEQ ID NO: 5978946 - DNA, 21 bp, Homo sapiens
cacagacgggcacacagactg

SEQ ID NO: 5978947 - DNA, 16 bp, Homo sapiens
cacagacgtccctcca

SEQ ID NO: 5978948 - DNA, 21 bp, Homo sapiens
cacagacgttaggcatttcct

SEQ ID NO: 5978949 - DNA, 21 bp, Homo sapiens
cacagactacagccagaagcc

SEQ ID NO: 5978950 - DNA, 23 bp, Homo sapiens
cacagactcatcctgaacagcat

SEQ ID NO: 5978951 - DNA, 13 bp, Homo sapiens
cacagactccctc

SEQ ID NO: 5978952 - DNA, 18 bp, Homo sapiens
cacagactccctcccctg

SEQ ID NO: 5978953 - DNA, 15 bp, Homo sapiens
cacagactccggcct

SEQ ID NO: 5978954 - DNA, 22 bp, Homo sapiens
cacagactccggcctgtaatca

SEQ ID NO: 5978955 - DNA, 16 bp, Homo sapiens
cacagactctgctagt

SEQ ID NO: 5978956 - DNA, 20 bp, Homo sapiens
cacagactctgtgagattct

SEQ ID NO: 5978957 - DNA, 15 bp, Homo sapiens
cacagactcttccac

SEQ ID NO: 5978958 - DNA, 18 bp, Homo sapiens
cacagactcttccaccag

SEQ ID NO: 5978959 - DNA, 23 bp, Homo sapiens
cacagactcttccaccagagcag

SEQ ID NO: 5978960 - DNA, 23 bp, Homo sapiens
cacagactgaactcgcagggaat

SEQ ID NO: 5978961 - DNA, 12 bp, Homo sapiens
cacagactgccc

SEQ ID NO: 5978962 - DNA, 18 bp, Homo sapiens
cacagactgccccagcca

SEQ ID NO: 5978963 - DNA, 19 bp, Homo sapiens
cacagactgctgtcttact

SEQ ID NO: 5978964 - DNA, 13 bp, Homo sapiens
cacagactggaga

SEQ ID NO: 5978965 - DNA, 14 bp, Homo sapiens
cacagactggcaat

SEQ ID NO: 5978966 - DNA, 15 bp, Homo sapiens
cacagactggcaata

SEQ ID NO: 5978967 - DNA, 17 bp, Homo sapiens
cacagactggcaataaa

SEQ ID NO: 5978968 - DNA, 13 bp, Homo sapiens
cacagactgttcc

SEQ ID NO: 5978969 - DNA, 21 bp, Homo sapiens
cacagactgttccctccaagg

SEQ ID NO: 5978970 - DNA, 22 bp, Homo sapiens
cacagactgttgtccctgcact

SEQ ID NO: 5978971 - DNA, 21 bp, Homo sapiens
cacagacttcacacagcacct

SEQ ID NO: 5978972 - DNA, 15 bp, Homo sapiens
cacagacttgcactg

SEQ ID NO: 5978973 - DNA, 20 bp, Homo sapiens
cacagacttgcactgaagcc

SEQ ID NO: 5978974 - DNA, 22 bp, Homo sapiens
cacagacttgcactgaagccgg

SEQ ID NO: 5978975 - DNA, 20 bp, Homo sapiens
cacagactttagctttctga

SEQ ID NO: 5978976 - DNA, 17 bp, Homo sapiens
cacagactttctgtgac

SEQ ID NO: 5978977 - DNA, 21 bp, Homo sapiens
cacagagaaagtacttctcca

SEQ ID NO: 5978978 - DNA, 14 bp, Homo sapiens
cacagagaaataca

SEQ ID NO: 5978979 - DNA, 17 bp, Homo sapiens
cacagagaaatacaaaa

SEQ ID NO: 5978980 - DNA, 18 bp, Homo sapiens
cacagagaaatacaaaat

SEQ ID NO: 5978981 - DNA, 18 bp, Homo sapiens
cacagagaacctgagttc

SEQ ID NO: 5978982 - DNA, 14 bp, Homo sapiens
cacagagaagacaa

SEQ ID NO: 5978983 - DNA, 22 bp, Homo sapiens
cacagagaagacaaaattagca

SEQ ID NO: 5978984 - DNA, 19 bp, Homo sapiens
cacagagaagctcctgcta

SEQ ID NO: 5978985 - DNA, 11 bp, Homo sapiens
cacagagaagg

SEQ ID NO: 5978986 - DNA, 15 bp, Homo sapiens
cacagagacggtctg

SEQ ID NO: 5978987 - DNA, 14 bp, Homo sapiens
cacagagactgttt

SEQ ID NO: 5978988 - DNA, 10 bp, Homo sapiens
cacagagaga

SEQ ID NO: 5978989 - DNA, 12 bp, Homo sapiens
cacagagaggga

SEQ ID NO: 5978990 - DNA, 22 bp, Homo sapiens
cacagagagggacacatgcccc

SEQ ID NO: 5978991 - DNA, 23 bp, Homo sapiens
cacagagagggacacatgcccct

SEQ ID NO: 5978992 - DNA, 22 bp, Homo sapiens
cacagagagggggccacctccc

SEQ ID NO: 5978993 - DNA, 12 bp, Homo sapiens
cacagagatatg

SEQ ID NO: 5978994 - DNA, 13 bp, Homo sapiens
cacagagatgcat

SEQ ID NO: 5978995 - DNA, 14 bp, Homo sapiens
cacagagatgtcca

SEQ ID NO: 5978996 - DNA, 17 bp, Homo sapiens
cacagagattctgaact

SEQ ID NO: 5978997 - DNA, 18 bp, Homo sapiens
cacagagattctggatct

SEQ ID NO: 5978998 - DNA, 14 bp, Homo sapiens
cacagagcacgcct

SEQ ID NO: 5978999 - DNA, 16 bp, Homo sapiens
cacagagcacgcctgc

SEQ ID NO: 5979000 - DNA, 18 bp, Homo sapiens
cacagagcacgcctgcca

SEQ ID NO: 5979001 - DNA, 21 bp, Homo sapiens
cacagagcactaggttcaatt

SEQ ID NO: 5979002 - DNA, 14 bp, Homo sapiens
cacagagcaggact

SEQ ID NO: 5979003 - DNA, 22 bp, Homo sapiens
cacagagcatccgtctcccctc

SEQ ID NO: 5979004 - DNA, 15 bp, Homo sapiens
cacagagccactctt

SEQ ID NO: 5979005 - DNA, 17 bp, Homo sapiens
cacagagccactcttca

SEQ ID NO: 5979006 - DNA, 15 bp, Homo sapiens
cacagagccctgagg

SEQ ID NO: 5979007 - DNA, 20 bp, Homo sapiens
cacagagccctgaggggctg

SEQ ID NO: 5979008 - DNA, 23 bp, Homo sapiens
cacagagccctgaggggctgggc

SEQ ID NO: 5979009 - DNA, 19 bp, Homo sapiens
cacagagcctgaatttgta

SEQ ID NO: 5979010 - DNA, 23 bp, Homo sapiens
cacagagcctgaatttgtaagca

SEQ ID NO: 5979011 - DNA, 12 bp, Homo sapiens
cacagagcctgc

SEQ ID NO: 5979012 - DNA, 21 bp, Homo sapiens
cacagagcctgcctcagctgc

SEQ ID NO: 5979013 - DNA, 14 bp, Homo sapiens
cacagagcctggct

SEQ ID NO: 5979014 - DNA, 18 bp, Homo sapiens
cacagagcctggctttgg

SEQ ID NO: 5979015 - DNA, 22 bp, Homo sapiens
cacagagcgcctcacctgcatc

SEQ ID NO: 5979016 - DNA, 19 bp, Homo sapiens
cacagagcgtccttccccc

SEQ ID NO: 5979017 - DNA, 17 bp, Homo sapiens
cacagagctctccagct

SEQ ID NO: 5979018 - DNA, 15 bp, Homo sapiens
cacagaggaagagca

SEQ ID NO: 5979019 - DNA, 19 bp, Homo sapiens
cacagaggacacagagaag

SEQ ID NO: 5979020 - DNA, 17 bp, Homo sapiens
cacagaggagtgcagcc

SEQ ID NO: 5979021 - DNA, 11 bp, Homo sapiens
cacagaggcag

SEQ ID NO: 5979022 - DNA, 19 bp, Homo sapiens
cacagaggcagctgtgtgg

SEQ ID NO: 5979023 - DNA, 12 bp, Homo sapiens
cacagaggcagt

SEQ ID NO: 5979024 - DNA, 18 bp, Homo sapiens
cacagaggcagtggcagc

SEQ ID NO: 5979025 - DNA, 19 bp, Homo sapiens
cacagaggcagtggcagca

SEQ ID NO: 5979026 - DNA, 18 bp, Homo sapiens
cacagaggccccacctga

SEQ ID NO: 5979027 - DNA, 12 bp, Homo sapiens
cacagaggctgt

SEQ ID NO: 5979028 - DNA, 23 bp, Homo sapiens
cacagagggaagtttaaaaccca

SEQ ID NO: 5979029 - DNA, 16 bp, Homo sapiens
cacagagggcgctcct

SEQ ID NO: 5979030 - DNA, 18 bp, Homo sapiens
cacagagggcgctcctgt

SEQ ID NO: 5979031 - DNA, 17 bp, Homo sapiens
cacagagggctgtgtct

SEQ ID NO: 5979032 - DNA, 19 bp, Homo sapiens
cacagaggtcaggaagcag

SEQ ID NO: 5979033 - DNA, 15 bp, Homo sapiens
cacagagtcaaggcc

SEQ ID NO: 5979034 - DNA, 19 bp, Homo sapiens
cacagagtcaaggcctgct

SEQ ID NO: 5979035 - DNA, 21 bp, Homo sapiens
cacagagtcaaggcctgctcc

SEQ ID NO: 5979036 - DNA, 18 bp, Homo sapiens
cacagagtcgatgctcaa

SEQ ID NO: 5979037 - DNA, 17 bp, Homo sapiens
cacagagtgagactcca

SEQ ID NO: 5979038 - DNA, 13 bp, Homo sapiens
cacagagtgagcc

SEQ ID NO: 5979039 - DNA, 18 bp, Homo sapiens
cacagagtgagccagtga

SEQ ID NO: 5979040 - DNA, 21 bp, Homo sapiens
cacagagtgccatccctgaga

SEQ ID NO: 5979041 - DNA, 17 bp, Homo sapiens
cacagagtgctggactg

SEQ ID NO: 5979042 - DNA, 15 bp, Homo sapiens
cacagagtgtagcca

SEQ ID NO: 5979043 - DNA, 18 bp, Homo sapiens
cacagagtttgtagtaaa

SEQ ID NO: 5979044 - DNA, 21 bp, Homo sapiens
cacagagtttttcaggagaga

SEQ ID NO: 5979045 - DNA, 15 bp, Homo sapiens
cacagataaaaagtg

SEQ ID NO: 5979046 - DNA, 14 bp, Homo sapiens
cacagataacataa

SEQ ID NO: 5979047 - DNA, 19 bp, Homo sapiens
cacagataagcctgaaaca

SEQ ID NO: 5979048 - DNA, 18 bp, Homo sapiens
cacagatagacctttttt

SEQ ID NO: 5979049 - DNA, 23 bp, Homo sapiens
cacagatatactttgtggaccaa

SEQ ID NO: 5979050 - DNA, 20 bp, Homo sapiens
cacagatatagttccgcacc

SEQ ID NO: 5979051 - DNA, 22 bp, Homo sapiens
cacagatatgcacacacatgga

SEQ ID NO: 5979052 - DNA, 18 bp, Homo sapiens
cacagatatttccatttc

SEQ ID NO: 5979053 - DNA, 17 bp, Homo sapiens
cacagatcagttttcct

SEQ ID NO: 5979054 - DNA, 19 bp, Homo sapiens
cacagatcccactggaaga

SEQ ID NO: 5979055 - DNA, 22 bp, Homo sapiens
cacagatcccggggagctgtga

SEQ ID NO: 5979056 - DNA, 18 bp, Homo sapiens
cacagatcgcatttccta

SEQ ID NO: 5979057 - DNA, 19 bp, Homo sapiens
cacagatcgcatttcctaa

SEQ ID NO: 5979058 - DNA, 20 bp, Homo sapiens
cacagatcgcatttcctaag

SEQ ID NO: 5979059 - DNA, 12 bp, Homo sapiens
cacagatctgga

SEQ ID NO: 5979060 - DNA, 17 bp, Homo sapiens
cacagatgaaacacaaa

SEQ ID NO: 5979061 - DNA, 17 bp, Homo sapiens
cacagatgaccaaagtc

SEQ ID NO: 5979062 - DNA, 18 bp, Homo sapiens
cacagatgcacacacaga

SEQ ID NO: 5979063 - DNA, 19 bp, Homo sapiens
cacagatgcatatagacac

SEQ ID NO: 5979064 - DNA, 14 bp, Homo sapiens
cacagatgccatgg

SEQ ID NO: 5979065 - DNA, 20 bp, Homo sapiens
cacagatgccatggcctgtg

SEQ ID NO: 5979066 - DNA, 13 bp, Homo sapiens
cacagatgctcca

SEQ ID NO: 5979067 - DNA, 13 bp, Homo sapiens
cacagatgctggc

SEQ ID NO: 5979068 - DNA, 17 bp, Homo sapiens
cacagatgctggcctct

SEQ ID NO: 5979069 - DNA, 20 bp, Homo sapiens
cacagatgctggcctcttgg

SEQ ID NO: 5979070 - DNA, 22 bp, Homo sapiens
cacagatggaagaagttttaac

SEQ ID NO: 5979071 - DNA, 19 bp, Homo sapiens
cacagatggatttgcctgt

SEQ ID NO: 5979072 - DNA, 22 bp, Homo sapiens
cacagatggcacctgtggccag

SEQ ID NO: 5979073 - DNA, 13 bp, Homo sapiens
cacagatgggcaa

SEQ ID NO: 5979074 - DNA, 20 bp, Homo sapiens
cacagatgggtattaaactt

SEQ ID NO: 5979075 - DNA, 18 bp, Homo sapiens
cacagatgggtgcttgga

SEQ ID NO: 5979076 - DNA, 20 bp, Homo sapiens
cacagatgggtgcttggagg

SEQ ID NO: 5979077 - DNA, 16 bp, Homo sapiens
cacagatggtcacaca

SEQ ID NO: 5979078 - DNA, 15 bp, Homo sapiens
cacagatgtctctgg

SEQ ID NO: 5979079 - DNA, 23 bp, Homo sapiens
cacagatgtgcccagagtagccc

SEQ ID NO: 5979080 - DNA, 19 bp, Homo sapiens
cacagatgttcccccatct

SEQ ID NO: 5979081 - DNA, 22 bp, Homo sapiens
cacagattatgttcctgctgta

SEQ ID NO: 5979082 - DNA, 15 bp, Homo sapiens
cacagattcccaggc

SEQ ID NO: 5979083 - DNA, 19 bp, Homo sapiens
cacagattcccaggccagg

SEQ ID NO: 5979084 - DNA, 16 bp, Homo sapiens
cacagattgaagaatc

SEQ ID NO: 5979085 - DNA, 22 bp, Homo sapiens
cacagattgaagaatctgcccc

SEQ ID NO: 5979086 - DNA, 23 bp, Homo sapiens
cacagattgaagaatctgcccct

SEQ ID NO: 5979087 - DNA, 13 bp, Homo sapiens
cacagattggcca

SEQ ID NO: 5979088 - DNA, 14 bp, Homo sapiens
cacagattgtttct

SEQ ID NO: 5979089 - DNA, 14 bp, Homo sapiens
cacagatttccaaa

SEQ ID NO: 5979090 - DNA, 16 bp, Homo sapiens
cacagatttgagctca

SEQ ID NO: 5979091 - DNA, 17 bp, Homo sapiens
cacagatttgagctcag

SEQ ID NO: 5979092 - DNA, 14 bp, Homo sapiens
cacagatttgtgcc

SEQ ID NO: 5979093 - DNA, 22 bp, Homo sapiens
cacagatttgtgcccattccta

SEQ ID NO: 5979094 - DNA, 12 bp, Homo sapiens
cacagattttta

SEQ ID NO: 5979095 - DNA, 16 bp, Homo sapiens
cacagatttttacact

SEQ ID NO: 5979096 - DNA, 18 bp, Homo sapiens
cacagatttttacactaa

SEQ ID NO: 5979097 - DNA, 21 bp, Homo sapiens
cacagatttttacactaatat

SEQ ID NO: 5979098 - DNA, 18 bp, Homo sapiens
cacagatttttgggctcc

SEQ ID NO: 5979099 - DNA, 22 bp, Homo sapiens
cacagatttttgggctccactc

SEQ ID NO: 5979100 - DNA, 17 bp, Homo sapiens
cacagattttttcttta

SEQ ID NO: 5979101 - DNA, 16 bp, Homo sapiens
cacagatttttttgta

SEQ ID NO: 5979102 - DNA, 18 bp, Homo sapiens
cacagatttttttgtaag

SEQ ID NO: 5979103 - DNA, 17 bp, Homo sapiens
cacagcaaccccaggct

SEQ ID NO: 5979104 - DNA, 18 bp, Homo sapiens
cacagcaaccccaggctg

SEQ ID NO: 5979105 - DNA, 23 bp, Homo sapiens
cacagcaaggaaatgtcctgcat

SEQ ID NO: 5979106 - DNA, 22 bp, Homo sapiens
cacagcaaggaggctggctggg

SEQ ID NO: 5979107 - DNA, 15 bp, Homo sapiens
cacagcaaggcacct

SEQ ID NO: 5979108 - DNA, 16 bp, Homo sapiens
cacagcaaggctgtcg

SEQ ID NO: 5979109 - DNA, 20 bp, Homo sapiens
cacagcaagtacagcggctc

SEQ ID NO: 5979110 - DNA, 21 bp, Homo sapiens
cacagcaagtacagcggctcc

SEQ ID NO: 5979111 - DNA, 17 bp, Homo sapiens
cacagcacaaccggtcc

SEQ ID NO: 5979112 - DNA, 15 bp, Homo sapiens
cacagcacaccagcc

SEQ ID NO: 5979113 - DNA, 19 bp, Homo sapiens
cacagcacaccagccgctg

SEQ ID NO: 5979114 - DNA, 15 bp, Homo sapiens
cacagcacagccaac

SEQ ID NO: 5979115 - DNA, 23 bp, Homo sapiens
cacagcacatgctggccagcctg

SEQ ID NO: 5979116 - DNA, 17 bp, Homo sapiens
cacagcaccaaaggctc

SEQ ID NO: 5979117 - DNA, 16 bp, Homo sapiens
caaaggagcctgtgaa

SEQ ID NO: 5979118 - DNA, 23 bp, Homo sapiens
caaaggagcctgtgaacccagga

SEQ ID NO: 5979119 - DNA, 15 bp, Homo sapiens
caaaggagccttgat

SEQ ID NO: 5979120 - DNA, 17 bp, Homo sapiens
caaaggagctcgaagga

SEQ ID NO: 5979121 - DNA, 19 bp, Homo sapiens
caaaggagctcgaaggata

SEQ ID NO: 5979122 - DNA, 16 bp, Homo sapiens
caaaggagctttctca

SEQ ID NO: 5979123 - DNA, 17 bp, Homo sapiens
caaaggagctttctcaa

SEQ ID NO: 5979124 - DNA, 17 bp, Homo sapiens
caaaggagtgcatggcc

SEQ ID NO: 5979125 - DNA, 19 bp, Homo sapiens
caaaggagtgcatggccac

SEQ ID NO: 5979126 - DNA, 15 bp, Homo sapiens
caaaggataaatttt

SEQ ID NO: 5979127 - DNA, 16 bp, Homo sapiens
caaaggatgggggaaa

SEQ ID NO: 5979128 - DNA, 14 bp, Homo sapiens
caaaggatgtgttt

SEQ ID NO: 5979129 - DNA, 15 bp, Homo sapiens
caaaggcaagcactt

SEQ ID NO: 5979130 - DNA, 23 bp, Homo sapiens
caaaggcaagttaagagaaactt

SEQ ID NO: 5979131 - DNA, 13 bp, Homo sapiens
caaaggcagaaag

SEQ ID NO: 5979132 - DNA, 16 bp, Homo sapiens
caaaggcagaggaatt

SEQ ID NO: 5979133 - DNA, 17 bp, Homo sapiens
caaaggcagcaaggcag

SEQ ID NO: 5979134 - DNA, 21 bp, Homo sapiens
caaaggcagcaaggcagtgag

SEQ ID NO: 5979135 - DNA, 19 bp, Homo sapiens
caaaggcagctaagataga

SEQ ID NO: 5979136 - DNA, 21 bp, Homo sapiens
caaaggcagctaagatagaaa

SEQ ID NO: 5979137 - DNA, 18 bp, Homo sapiens
caaaggcagctgtgtctg

SEQ ID NO: 5979138 - DNA, 20 bp, Homo sapiens
caaaggcagctgtgtctgag

SEQ ID NO: 5979139 - DNA, 21 bp, Homo sapiens
caaaggcagctgtgtctgagc

SEQ ID NO: 5979140 - DNA, 22 bp, Homo sapiens
caaaggcagctgtgtctgagcc

SEQ ID NO: 5979141 - DNA, 14 bp, Homo sapiens
caaaggcagggcca

SEQ ID NO: 5979142 - DNA, 21 bp, Homo sapiens
caaaggcatcccagcctgggg

SEQ ID NO: 5979143 - DNA, 14 bp, Homo sapiens
caaaggcatgctgg

SEQ ID NO: 5979144 - DNA, 16 bp, Homo sapiens
caaaggcatgctggag

SEQ ID NO: 5979145 - DNA, 21 bp, Homo sapiens
caaaggcattataaaaagaat

SEQ ID NO: 5979146 - DNA, 17 bp, Homo sapiens
caaaggccacaggcagt

SEQ ID NO: 5979147 - DNA, 20 bp, Homo sapiens
caaaggccacaggcagtcca

SEQ ID NO: 5979148 - DNA, 21 bp, Homo sapiens
caaaggccagacctgcagacg

SEQ ID NO: 5979149 - DNA, 22 bp, Homo sapiens
caaaggccagacctgcagacgc

SEQ ID NO: 5979150 - DNA, 14 bp, Homo sapiens
caaaggccagcggt

SEQ ID NO: 5979151 - DNA, 16 bp, Homo sapiens
caaaggccagcggtga

SEQ ID NO: 5979152 - DNA, 20 bp, Homo sapiens
caaaggccagcggtgaccag

SEQ ID NO: 5979153 - DNA, 18 bp, Homo sapiens
caaaggccagtggaagaa

SEQ ID NO: 5979154 - DNA, 19 bp, Homo sapiens
caaaggccatggagagctg

SEQ ID NO: 5979155 - DNA, 20 bp, Homo sapiens
caaaggccatggagagctgg

SEQ ID NO: 5979156 - DNA, 11 bp, Homo sapiens
caaaggcccag

SEQ ID NO: 5979157 - DNA, 12 bp, Homo sapiens
caaaggcccaga

SEQ ID NO: 5979158 - DNA, 13 bp, Homo sapiens
caaaggcccaggg

SEQ ID NO: 5979159 - DNA, 15 bp, Homo sapiens
caaaggcccagggag

SEQ ID NO: 5979160 - DNA, 20 bp, Homo sapiens
caaaggccctaccagaggga

SEQ ID NO: 5979161 - DNA, 12 bp, Homo sapiens
caaaggccctgg

SEQ ID NO: 5979162 - DNA, 17 bp, Homo sapiens
caaaggctcctgagaca

SEQ ID NO: 5979163 - DNA, 22 bp, Homo sapiens
caaaggctgacagactcactgg

SEQ ID NO: 5979164 - DNA, 17 bp, Homo sapiens
caaaggctgacattcac

SEQ ID NO: 5979165 - DNA, 19 bp, Homo sapiens
caaaggctgacattcactg

SEQ ID NO: 5979166 - DNA, 14 bp, Homo sapiens
caaaggctgagaac

SEQ ID NO: 5979167 - DNA, 16 bp, Homo sapiens
caaagggaaaaaagag

SEQ ID NO: 5979168 - DNA, 15 bp, Homo sapiens
caaagggaaatatca

SEQ ID NO: 5979169 - DNA, 17 bp, Homo sapiens
caaagggaagtgaggcc

SEQ ID NO: 5979170 - DNA, 20 bp, Homo sapiens
caaagggaagtgaggcccaa

SEQ ID NO: 5979171 - DNA, 22 bp, Homo sapiens
caaagggaatactcacattttg

SEQ ID NO: 5979172 - DNA, 22 bp, Homo sapiens
caaagggaccaggggagaggca

SEQ ID NO: 5979173 - DNA, 13 bp, Homo sapiens
caaagggactttg

SEQ ID NO: 5979174 - DNA, 22 bp, Homo sapiens
caaagggagcactgggttgact

SEQ ID NO: 5979175 - DNA, 15 bp, Homo sapiens
caaagggagcagaac

SEQ ID NO: 5979176 - DNA, 15 bp, Homo sapiens
caaagggagggagca

SEQ ID NO: 5979177 - DNA, 16 bp, Homo sapiens
caaagggagggagcaa

SEQ ID NO: 5979178 - DNA, 21 bp, Homo sapiens
caaagggagggtggcagagac

SEQ ID NO: 5979179 - DNA, 18 bp, Homo sapiens
caaagggagtctgccagg

SEQ ID NO: 5979180 - DNA, 21 bp, Homo sapiens
caaagggcacagcatctgtag

SEQ ID NO: 5979181 - DNA, 23 bp, Homo sapiens
caaagggcacagcatctgtagtc

SEQ ID NO: 5979182 - DNA, 20 bp, Homo sapiens
caaagggcagccctccactt

SEQ ID NO: 5979183 - DNA, 14 bp, Homo sapiens
caaagggcaggcct

SEQ ID NO: 5979184 - DNA, 15 bp, Homo sapiens
caaagggcaggcctg

SEQ ID NO: 5979185 - DNA, 16 bp, Homo sapiens
caaagggcagtaaagt

SEQ ID NO: 5979186 - DNA, 12 bp, Homo sapiens
caaagggcccag

SEQ ID NO: 5979187 - DNA, 14 bp, Homo sapiens
caaagggcccagat

SEQ ID NO: 5979188 - DNA, 21 bp, Homo sapiens
caaagggcctgcccagacaag

SEQ ID NO: 5979189 - DNA, 17 bp, Homo sapiens
caaagggcgggcctgtt

SEQ ID NO: 5979190 - DNA, 19 bp, Homo sapiens
caaagggctgccttgctgt

SEQ ID NO: 5979191 - DNA, 18 bp, Homo sapiens
caaaggggacagctgtgt

SEQ ID NO: 5979192 - DNA, 18 bp, Homo sapiens
caaaggggacaggcctca

SEQ ID NO: 5979193 - DNA, 17 bp, Homo sapiens
caaaggggacctggaag

SEQ ID NO: 5979194 - DNA, 18 bp, Homo sapiens
caaaggggagaagggcca

SEQ ID NO: 5979195 - DNA, 19 bp, Homo sapiens
caaaggggagaagggccag

SEQ ID NO: 5979196 - DNA, 23 bp, Homo sapiens
caaaggggagaagggccagccct

SEQ ID NO: 5979197 - DNA, 13 bp, Homo sapiens
caaaggggagcca

SEQ ID NO: 5979198 - DNA, 22 bp, Homo sapiens
caaaggggaggcatcagtgtcc

SEQ ID NO: 5979199 - DNA, 19 bp, Homo sapiens
caaaggggatcataaagtt

SEQ ID NO: 5979200 - DNA, 11 bp, Homo sapiens
caaaggggctg

SEQ ID NO: 5979201 - DNA, 16 bp, Homo sapiens
caaaggggctgctggg

SEQ ID NO: 5979202 - DNA, 14 bp, Homo sapiens
caaaggggggaggt

SEQ ID NO: 5979203 - DNA, 15 bp, Homo sapiens
caaagggtaaattat

SEQ ID NO: 5979204 - DNA, 16 bp, Homo sapiens
caaagggtaaattata

SEQ ID NO: 5979205 - DNA, 19 bp, Homo sapiens
caaagggtaaattataaat

SEQ ID NO: 5979206 - DNA, 21 bp, Homo sapiens
caaagggtaaattataaatgt

SEQ ID NO: 5979207 - DNA, 24 bp, Homo sapiens
caaagggtacttccactgatggaa

SEQ ID NO: 5979208 - DNA, 21 bp, Homo sapiens
caaagggtctatcttgtaaat

SEQ ID NO: 5979209 - DNA, 13 bp, Homo sapiens
caaagggtgctag

SEQ ID NO: 5979210 - DNA, 14 bp, Homo sapiens
caaaggtacttgga

SEQ ID NO: 5979211 - DNA, 14 bp, Homo sapiens
caaaggtataattt

SEQ ID NO: 5979212 - DNA, 16 bp, Homo sapiens
caaaggtcaatgtcaa

SEQ ID NO: 5979213 - DNA, 21 bp, Homo sapiens
caaaggtcgggacagctgtgc

SEQ ID NO: 5979214 - DNA, 13 bp, Homo sapiens
caaaggtgaagga

SEQ ID NO: 5979215 - DNA, 20 bp, Homo sapiens
caaaggtgatatggttttat

SEQ ID NO: 5979216 - DNA, 17 bp, Homo sapiens
caaaggtgcactccaga

SEQ ID NO: 5979217 - DNA, 14 bp, Homo sapiens
caaaggtgcctcat

SEQ ID NO: 5979218 - DNA, 17 bp, Homo sapiens
caaaggtgctaattaat

SEQ ID NO: 5979219 - DNA, 13 bp, Homo sapiens
caaaggtggaata

SEQ ID NO: 5979220 - DNA, 20 bp, Homo sapiens
caaaggtggaataaacatta

SEQ ID NO: 5979221 - DNA, 14 bp, Homo sapiens
caaaggtggctctc

SEQ ID NO: 5979222 - DNA, 16 bp, Homo sapiens
caaaggtgtgcaaact

SEQ ID NO: 5979223 - DNA, 18 bp, Homo sapiens
caaaggttcagaaaatta

SEQ ID NO: 5979224 - DNA, 21 bp, Homo sapiens
caaaggttctaggtttcaaag

SEQ ID NO: 5979225 - DNA, 16 bp, Homo sapiens
caaaggttgtacatag

SEQ ID NO: 5979226 - DNA, 21 bp, Homo sapiens
caaaggtttgaagacacagcc

SEQ ID NO: 5979227 - DNA, 19 bp, Homo sapiens
caaaggttttcctcttcta

SEQ ID NO: 5979228 - DNA, 14 bp, Homo sapiens
caaagtaaaaataa

SEQ ID NO: 5979229 - DNA, 16 bp, Homo sapiens
caaagtaaaacttgct

SEQ ID NO: 5979230 - DNA, 18 bp, Homo sapiens
caaagtaaaacttgctgc

SEQ ID NO: 5979231 - DNA, 14 bp, Homo sapiens
caaagtaaaagaaa

SEQ ID NO: 5979232 - DNA, 18 bp, Homo sapiens
caaagtaaaagtagtgtt

SEQ ID NO: 5979233 - DNA, 12 bp, Homo sapiens
caaagtaaaatg

SEQ ID NO: 5979234 - DNA, 14 bp, Homo sapiens
caaagtaaaatgaa

SEQ ID NO: 5979235 - DNA, 20 bp, Homo sapiens
caaagtaaataaaagtacaa

SEQ ID NO: 5979236 - DNA, 23 bp, Homo sapiens
caaagtaaatacaagactgttgt

SEQ ID NO: 5979237 - DNA, 16 bp, Homo sapiens
caaagtaatctactgt

SEQ ID NO: 5979238 - DNA, 20 bp, Homo sapiens
caaagtaatttggaaattag

SEQ ID NO: 5979239 - DNA, 15 bp, Homo sapiens
caaagtacaaaattg

SEQ ID NO: 5979240 - DNA, 15 bp, Homo sapiens
caaagtacagaattt

SEQ ID NO: 5979241 - DNA, 16 bp, Homo sapiens
caaagtacagaatttg

SEQ ID NO: 5979242 - DNA, 21 bp, Homo sapiens
caaagtacaggtactttgtct

SEQ ID NO: 5979243 - DNA, 14 bp, Homo sapiens
caaagtacattgta

SEQ ID NO: 5979244 - DNA, 20 bp, Homo sapiens
caaagtacattgtaaaataa

SEQ ID NO: 5979245 - DNA, 20 bp, Homo sapiens
caaagtaccacactgagttc

SEQ ID NO: 5979246 - DNA, 16 bp, Homo sapiens
caaagtactagctaaa

SEQ ID NO: 5979247 - DNA, 17 bp, Homo sapiens
caaagtactgtaagaat

SEQ ID NO: 5979248 - DNA, 22 bp, Homo sapiens
caaagtactgtaagaataattt

SEQ ID NO: 5979249 - DNA, 22 bp, Homo sapiens
caaagtagaaactactaatttt

SEQ ID NO: 5979250 - DNA, 21 bp, Homo sapiens
caaagtagaatctcttttctg

SEQ ID NO: 5979251 - DNA, 17 bp, Homo sapiens
caaagtagatcatgcat

SEQ ID NO: 5979252 - DNA, 15 bp, Homo sapiens
caaagtagtcctggc

SEQ ID NO: 5979253 - DNA, 19 bp, Homo sapiens
caaagtagtcctggcagct

SEQ ID NO: 5979254 - DNA, 20 bp, Homo sapiens
caaagtagtcctggcagctg

SEQ ID NO: 5979255 - DNA, 18 bp, Homo sapiens
caaagtataaatttgtgt

SEQ ID NO: 5979256 - DNA, 21 bp, Homo sapiens
caaagtataaatttgtgtaat

SEQ ID NO: 5979257 - DNA, 19 bp, Homo sapiens
caaagtataacaattaaaa

SEQ ID NO: 5979258 - DNA, 13 bp, Homo sapiens
caaagtataacca

SEQ ID NO: 5979259 - DNA, 15 bp, Homo sapiens
caaagtataatcttt

SEQ ID NO: 5979260 - DNA, 14 bp, Homo sapiens
caaagtatcaaaga

SEQ ID NO: 5979261 - DNA, 16 bp, Homo sapiens
caaagtatcaaagaaa

SEQ ID NO: 5979262 - DNA, 19 bp, Homo sapiens
caaagtatcaggacgagaa

SEQ ID NO: 5979263 - DNA, 21 bp, Homo sapiens
caaagtatccctactgtaatt

SEQ ID NO: 5979264 - DNA, 13 bp, Homo sapiens
caaagtatgccag

SEQ ID NO: 5979265 - DNA, 15 bp, Homo sapiens
caaagtattaagcat

SEQ ID NO: 5979266 - DNA, 23 bp, Homo sapiens
caaagtattaatgtacagagtgg

SEQ ID NO: 5979267 - DNA, 15 bp, Homo sapiens
caaagtattgtaaat

SEQ ID NO: 5979268 - DNA, 20 bp, Homo sapiens
caaagtattgtaaattatat

SEQ ID NO: 5979269 - DNA, 22 bp, Homo sapiens
caaagtattgtaaattatattt

SEQ ID NO: 5979270 - DNA, 17 bp, Homo sapiens
caaagtcacaggaagaa

SEQ ID NO: 5979271 - DNA, 16 bp, Homo sapiens
caaagtcacttcccca

SEQ ID NO: 5979272 - DNA, 22 bp, Homo sapiens
caaagtcaggaatcatcaggaa

SEQ ID NO: 5979273 - DNA, 23 bp, Homo sapiens
caaagtcataattgcattgactt

SEQ ID NO: 5979274 - DNA, 16 bp, Homo sapiens
caaagtcatgtcagaa

SEQ ID NO: 5979275 - DNA, 20 bp, Homo sapiens
caaagtcatgtcagaaggag

SEQ ID NO: 5979276 - DNA, 20 bp, Homo sapiens
caaagtccaactacagccaa

SEQ ID NO: 5979277 - DNA, 13 bp, Homo sapiens
caaagtccacaca

SEQ ID NO: 5979278 - DNA, 17 bp, Homo sapiens
caaagtccacacaaaga

SEQ ID NO: 5979279 - DNA, 22 bp, Homo sapiens
caaagtccccctcctcagccag

SEQ ID NO: 5979280 - DNA, 21 bp, Homo sapiens
caaagtcccttcctgcttcct

SEQ ID NO: 5979281 - DNA, 16 bp, Homo sapiens
caaagtcctcctttca

SEQ ID NO: 5979282 - DNA, 16 bp, Homo sapiens
caaagtcctctgctcc

SEQ ID NO: 5979283 - DNA, 14 bp, Homo sapiens
caaagtcctttttt

SEQ ID NO: 5979284 - DNA, 20 bp, Homo sapiens
caaagtcgccagtcactgct

SEQ ID NO: 5979285 - DNA, 16 bp, Homo sapiens
caaagtctaaagttta

SEQ ID NO: 5979286 - DNA, 19 bp, Homo sapiens
caaagtctaaagtttacag

SEQ ID NO: 5979287 - DNA, 13 bp, Homo sapiens
caaagtctccaga

SEQ ID NO: 5979288 - DNA, 20 bp, Homo sapiens
caaagtctccagaagaaaat

SEQ ID NO: 5979289 - DNA, 13 bp, Homo sapiens
caaagtctccagc

SEQ ID NO: 5979290 - DNA, 12 bp, Homo sapiens
caaagtctctaa

SEQ ID NO: 5979291 - DNA, 15 bp, Homo sapiens
caaagtctctaattc

SEQ ID NO: 5979292 - DNA, 19 bp, Homo sapiens
caaagtctgccgcccacct

SEQ ID NO: 5979293 - DNA, 18 bp, Homo sapiens
caaagtctgggaaattct

SEQ ID NO: 5979294 - DNA, 23 bp, Homo sapiens
caaagtctgggaaattctatatg

SEQ ID NO: 5979295 - DNA, 19 bp, Homo sapiens
cacagcaccagaatgtata

SEQ ID NO: 5979296 - DNA, 13 bp, Homo sapiens
cacagcacccact

SEQ ID NO: 5979297 - DNA, 17 bp, Homo sapiens
cacagcacccaggctcc

SEQ ID NO: 5979298 - DNA, 18 bp, Homo sapiens
cacagcacccaggctcca

SEQ ID NO: 5979299 - DNA, 19 bp, Homo sapiens
cacagcacccaggctccat

SEQ ID NO: 5979300 - DNA, 20 bp, Homo sapiens
cacagcacccaggctccatg

SEQ ID NO: 5979301 - DNA, 20 bp, Homo sapiens
cacagcaccgggggagaggg

SEQ ID NO: 5979302 - DNA, 24 bp, Homo sapiens
cacagcaccgggggagagggacac

SEQ ID NO: 5979303 - DNA, 20 bp, Homo sapiens
cacagcacgggggccaagga

SEQ ID NO: 5979304 - DNA, 14 bp, Homo sapiens
cacagcactgcctg

SEQ ID NO: 5979305 - DNA, 16 bp, Homo sapiens
cacagcactgcctgcc

SEQ ID NO: 5979306 - DNA, 18 bp, Homo sapiens
cacagcactgcctgccaa

SEQ ID NO: 5979307 - DNA, 19 bp, Homo sapiens
cacagcactgcctgccaag

SEQ ID NO: 5979308 - DNA, 21 bp, Homo sapiens
cacagcacttgagtaaaatac

SEQ ID NO: 5979309 - DNA, 15 bp, Homo sapiens
cacagcagaatgaag

SEQ ID NO: 5979310 - DNA, 21 bp, Homo sapiens
cacagcagaatgaagacctaa

SEQ ID NO: 5979311 - DNA, 15 bp, Homo sapiens
cacagcagacaccat

SEQ ID NO: 5979312 - DNA, 12 bp, Homo sapiens
cacagcagagca

SEQ ID NO: 5979313 - DNA, 13 bp, Homo sapiens
cacagcagcactg

SEQ ID NO: 5979314 - DNA, 23 bp, Homo sapiens
cacagcagcagaacaagtgcctc

SEQ ID NO: 5979315 - DNA, 18 bp, Homo sapiens
cacagcagccccaggaga

SEQ ID NO: 5979316 - DNA, 18 bp, Homo sapiens
cacagcagccccccagca

SEQ ID NO: 5979317 - DNA, 20 bp, Homo sapiens
cacagcagccccccagcact

SEQ ID NO: 5979318 - DNA, 12 bp, Homo sapiens
cacagcagcctg

SEQ ID NO: 5979319 - DNA, 23 bp, Homo sapiens
cacagcagctgcaggggcctctg

SEQ ID NO: 5979320 - DNA, 18 bp, Homo sapiens
cacagcagcttcaccaga

SEQ ID NO: 5979321 - DNA, 21 bp, Homo sapiens
cacagcagcttcaccagagca

SEQ ID NO: 5979322 - DNA, 14 bp, Homo sapiens
cacagcaggacctg

SEQ ID NO: 5979323 - DNA, 16 bp, Homo sapiens
cacagcaggctgccag

SEQ ID NO: 5979324 - DNA, 17 bp, Homo sapiens
cacagcaggctgccagt

SEQ ID NO: 5979325 - DNA, 19 bp, Homo sapiens
cacagcaggctgccagtgc

SEQ ID NO: 5979326 - DNA, 21 bp, Homo sapiens
cacagcaggctgccagtgcct

SEQ ID NO: 5979327 - DNA, 19 bp, Homo sapiens
cacagcagggccttctgcc

SEQ ID NO: 5979328 - DNA, 20 bp, Homo sapiens
cacagcagggccttctgcct

SEQ ID NO: 5979329 - DNA, 13 bp, Homo sapiens
cacagcaggtcct

SEQ ID NO: 5979330 - DNA, 18 bp, Homo sapiens
cacagcagtacttgctca

SEQ ID NO: 5979331 - DNA, 18 bp, Homo sapiens
cacagcagtcacaggccc

SEQ ID NO: 5979332 - DNA, 20 bp, Homo sapiens
cacagcagtcacaggcccag

SEQ ID NO: 5979333 - DNA, 16 bp, Homo sapiens
cacagcagtgagactg

SEQ ID NO: 5979334 - DNA, 18 bp, Homo sapiens
cacagcagtgtcacagac

SEQ ID NO: 5979335 - DNA, 15 bp, Homo sapiens
cacagcagtgtcccc

SEQ ID NO: 5979336 - DNA, 22 bp, Homo sapiens
cacagcagtgtgaatagcctgg

SEQ ID NO: 5979337 - DNA, 22 bp, Homo sapiens
cacagcagttgaaaagactcca

SEQ ID NO: 5979338 - DNA, 15 bp, Homo sapiens
cacagcatcagctca

SEQ ID NO: 5979339 - DNA, 14 bp, Homo sapiens
cacagcatctcagc

SEQ ID NO: 5979340 - DNA, 15 bp, Homo sapiens
cacagcatgaacctt

SEQ ID NO: 5979341 - DNA, 21 bp, Homo sapiens
cacagcatgaggcaaaaatgt

SEQ ID NO: 5979342 - DNA, 20 bp, Homo sapiens
cacagcatgcatttagcatg

SEQ ID NO: 5979343 - DNA, 21 bp, Homo sapiens
cacagcatgcatttagcatga

SEQ ID NO: 5979344 - DNA, 20 bp, Homo sapiens
cacagcatgggtccagaaga

SEQ ID NO: 5979345 - DNA, 21 bp, Homo sapiens
cacagcatgggtccagaagac

SEQ ID NO: 5979346 - DNA, 21 bp, Homo sapiens
cacagcatgtgcaatatgcca

SEQ ID NO: 5979347 - DNA, 14 bp, Homo sapiens
cacagcatgtgcca

SEQ ID NO: 5979348 - DNA, 16 bp, Homo sapiens
cacagcattgtatatg

SEQ ID NO: 5979349 - DNA, 16 bp, Homo sapiens
cacagccaaatttaaa

SEQ ID NO: 5979350 - DNA, 22 bp, Homo sapiens
cacagccaacacgcacctgcct

SEQ ID NO: 5979351 - DNA, 14 bp, Homo sapiens
cacagccaagccca

SEQ ID NO: 5979352 - DNA, 14 bp, Homo sapiens
cacagccaatctcc

SEQ ID NO: 5979353 - DNA, 20 bp, Homo sapiens
cacagccacacacacagaaa

SEQ ID NO: 5979354 - DNA, 16 bp, Homo sapiens
cacagccaccacctgg

SEQ ID NO: 5979355 - DNA, 17 bp, Homo sapiens
cacagccaccacctgga

SEQ ID NO: 5979356 - DNA, 18 bp, Homo sapiens
cacagccacctccgccag

SEQ ID NO: 5979357 - DNA, 23 bp, Homo sapiens
cacagccacctccgccagacccc

SEQ ID NO: 5979358 - DNA, 20 bp, Homo sapiens
cacagccagacttgcttcct

SEQ ID NO: 5979359 - DNA, 11 bp, Homo sapiens
cacagccagag

SEQ ID NO: 5979360 - DNA, 13 bp, Homo sapiens
cacagccagccca

SEQ ID NO: 5979361 - DNA, 16 bp, Homo sapiens
cacagccaggtgcctt

SEQ ID NO: 5979362 - DNA, 11 bp, Homo sapiens
cacagccatag

SEQ ID NO: 5979363 - DNA, 15 bp, Homo sapiens
cacagccatagcaga

SEQ ID NO: 5979364 - DNA, 13 bp, Homo sapiens
cacagccatccca

SEQ ID NO: 5979365 - DNA, 23 bp, Homo sapiens
cacagccattcatctgggctggc

SEQ ID NO: 5979366 - DNA, 14 bp, Homo sapiens
cacagcccaaccag

SEQ ID NO: 5979367 - DNA, 19 bp, Homo sapiens
cacagcccaaccaggaggg

SEQ ID NO: 5979368 - DNA, 14 bp, Homo sapiens
cacagcccaccctc

SEQ ID NO: 5979369 - DNA, 22 bp, Homo sapiens
cacagcccacggggatcacagc

SEQ ID NO: 5979370 - DNA, 14 bp, Homo sapiens
cacagcccacgtcc

SEQ ID NO: 5979371 - DNA, 17 bp, Homo sapiens
cacagcccagaaccaca

SEQ ID NO: 5979372 - DNA, 13 bp, Homo sapiens
cacagcccagaag

SEQ ID NO: 5979373 - DNA, 15 bp, Homo sapiens
cacagcccagaaggc

SEQ ID NO: 5979374 - DNA, 16 bp, Homo sapiens
cacagcccagaaggcc

SEQ ID NO: 5979375 - DNA, 15 bp, Homo sapiens
cacagcccagagact

SEQ ID NO: 5979376 - DNA, 16 bp, Homo sapiens
cacagcccagagactg

SEQ ID NO: 5979377 - DNA, 12 bp, Homo sapiens
cacagcccagcc

SEQ ID NO: 5979378 - DNA, 14 bp, Homo sapiens
cacagcccagcccg

SEQ ID NO: 5979379 - DNA, 15 bp, Homo sapiens
cacagcccagcttgg

SEQ ID NO: 5979380 - DNA, 21 bp, Homo sapiens
cacagcccaggcctccagctc

SEQ ID NO: 5979381 - DNA, 15 bp, Homo sapiens
cacagcccagggcct

SEQ ID NO: 5979382 - DNA, 14 bp, Homo sapiens
cacagccccacagc

SEQ ID NO: 5979383 - DNA, 18 bp, Homo sapiens
cacagccccacagcaccc

SEQ ID NO: 5979384 - DNA, 20 bp, Homo sapiens
cacagccccacagcacccag

SEQ ID NO: 5979385 - DNA, 22 bp, Homo sapiens
cacagccccacccttgtccctc

SEQ ID NO: 5979386 - DNA, 15 bp, Homo sapiens
cacagccccatggac

SEQ ID NO: 5979387 - DNA, 22 bp, Homo sapiens
cacagcccccaccccagcacag

SEQ ID NO: 5979388 - DNA, 19 bp, Homo sapiens
cacagcccccttgccctcc

SEQ ID NO: 5979389 - DNA, 22 bp, Homo sapiens
cacagcccctatagcactgagc

SEQ ID NO: 5979390 - DNA, 14 bp, Homo sapiens
cacagcccctggag

SEQ ID NO: 5979391 - DNA, 16 bp, Homo sapiens
cacagcccctggagcc

SEQ ID NO: 5979392 - DNA, 21 bp, Homo sapiens
cacagcccgcatgcagcagct

SEQ ID NO: 5979393 - DNA, 23 bp, Homo sapiens
cacagccctagtatgaaagctgg

SEQ ID NO: 5979394 - DNA, 14 bp, Homo sapiens
cacagccctcccgc

SEQ ID NO: 5979395 - DNA, 15 bp, Homo sapiens
cacagccctcccgcc

SEQ ID NO: 5979396 - DNA, 17 bp, Homo sapiens
cacagccctcccgcccc

SEQ ID NO: 5979397 - DNA, 18 bp, Homo sapiens
cacagccctcccgcccct

SEQ ID NO: 5979398 - DNA, 10 bp, Homo sapiens
cacagccctg

SEQ ID NO: 5979399 - DNA, 13 bp, Homo sapiens
cacagccctgaga

SEQ ID NO: 5979400 - DNA, 18 bp, Homo sapiens
cacagccctgagtgtccc

SEQ ID NO: 5979401 - DNA, 19 bp, Homo sapiens
cacagccctgagtgtccca

SEQ ID NO: 5979402 - DNA, 22 bp, Homo sapiens
cacagccctgagtgtcccaagc

SEQ ID NO: 5979403 - DNA, 13 bp, Homo sapiens
cacagccctggaa

SEQ ID NO: 5979404 - DNA, 12 bp, Homo sapiens
cacagccctggg

SEQ ID NO: 5979405 - DNA, 17 bp, Homo sapiens
cacagccctgggagggg

SEQ ID NO: 5979406 - DNA, 11 bp, Homo sapiens
cacagccctgt

SEQ ID NO: 5979407 - DNA, 13 bp, Homo sapiens
cacagccctgtca

SEQ ID NO: 5979408 - DNA, 14 bp, Homo sapiens
cacagccctgtcag

SEQ ID NO: 5979409 - DNA, 23 bp, Homo sapiens
cacagccctgtcagtgcagcccg

SEQ ID NO: 5979410 - DNA, 20 bp, Homo sapiens
cacagccggggcctgcctag

SEQ ID NO: 5979411 - DNA, 13 bp, Homo sapiens
cacagcctagcac

SEQ ID NO: 5979412 - DNA, 17 bp, Homo sapiens
cacagcctcacccctgc

SEQ ID NO: 5979413 - DNA, 21 bp, Homo sapiens
cacagcctcacccctgcccct

SEQ ID NO: 5979414 - DNA, 16 bp, Homo sapiens
cacagcctccaagtca

SEQ ID NO: 5979415 - DNA, 18 bp, Homo sapiens
cacagcctccccacccag

SEQ ID NO: 5979416 - DNA, 14 bp, Homo sapiens
cacagcctcccctg

SEQ ID NO: 5979417 - DNA, 20 bp, Homo sapiens
cacagcctcccctgccaggg

SEQ ID NO: 5979418 - DNA, 14 bp, Homo sapiens
cacagcctcccctt

SEQ ID NO: 5979419 - DNA, 19 bp, Homo sapiens
cacagcctccctgagcctg

SEQ ID NO: 5979420 - DNA, 21 bp, Homo sapiens
cacagcctccctgagcctgca

SEQ ID NO: 5979421 - DNA, 23 bp, Homo sapiens
cacagcctcctctgtctgccctt

SEQ ID NO: 5979422 - DNA, 22 bp, Homo sapiens
cacagcctcggggatggggagg

SEQ ID NO: 5979423 - DNA, 14 bp, Homo sapiens
cacagcctctccct

SEQ ID NO: 5979424 - DNA, 15 bp, Homo sapiens
cacagcctctggctc

SEQ ID NO: 5979425 - DNA, 16 bp, Homo sapiens
cacagcctctggctcc

SEQ ID NO: 5979426 - DNA, 15 bp, Homo sapiens
cacagcctcttcctc

SEQ ID NO: 5979427 - DNA, 12 bp, Homo sapiens
cacagcctgctg

SEQ ID NO: 5979428 - DNA, 14 bp, Homo sapiens
cacagcctgctggc

SEQ ID NO: 5979429 - DNA, 15 bp, Homo sapiens
cacagcctgctggca

SEQ ID NO: 5979430 - DNA, 17 bp, Homo sapiens
cacagcctgctggcagg

SEQ ID NO: 5979431 - DNA, 18 bp, Homo sapiens
cacagcctgctggcaggg

SEQ ID NO: 5979432 - DNA, 21 bp, Homo sapiens
cacagcctgctggcagggcca

SEQ ID NO: 5979433 - DNA, 22 bp, Homo sapiens
cacagcctgctggcagggccag

SEQ ID NO: 5979434 - DNA, 13 bp, Homo sapiens
cacagcctggact

SEQ ID NO: 5979435 - DNA, 19 bp, Homo sapiens
cacagcctggcctcccctg

SEQ ID NO: 5979436 - DNA, 20 bp, Homo sapiens
cacagcctggcctcccctgc

SEQ ID NO: 5979437 - DNA, 20 bp, Homo sapiens
cacagcctgggaccagggca

SEQ ID NO: 5979438 - DNA, 12 bp, Homo sapiens
cacagcctgggc

SEQ ID NO: 5979439 - DNA, 16 bp, Homo sapiens
cacagcctgtccctgg

SEQ ID NO: 5979440 - DNA, 15 bp, Homo sapiens
cacagcctgtcttgt

SEQ ID NO: 5979441 - DNA, 18 bp, Homo sapiens
cacagcctgtgtgcagtg

SEQ ID NO: 5979442 - DNA, 13 bp, Homo sapiens
cacagccttccct

SEQ ID NO: 5979443 - DNA, 18 bp, Homo sapiens
cacagccttccctctgca

SEQ ID NO: 5979444 - DNA, 15 bp, Homo sapiens
cacagccttccttct

SEQ ID NO: 5979445 - DNA, 19 bp, Homo sapiens
cacagccttgcagcggctc

SEQ ID NO: 5979446 - DNA, 13 bp, Homo sapiens
cacagccttggct

SEQ ID NO: 5979447 - DNA, 19 bp, Homo sapiens
cacagcctttcgttctgct

SEQ ID NO: 5979448 - DNA, 14 bp, Homo sapiens
cacagcctttctgt

SEQ ID NO: 5979449 - DNA, 20 bp, Homo sapiens
cacagcctttgcgctctggg

SEQ ID NO: 5979450 - DNA, 14 bp, Homo sapiens
cacagcgagcctgt

SEQ ID NO: 5979451 - DNA, 15 bp, Homo sapiens
cacagcgagcctgtg

SEQ ID NO: 5979452 - DNA, 19 bp, Homo sapiens
cacagcgagcctgtgcctt

SEQ ID NO: 5979453 - DNA, 23 bp, Homo sapiens
cacagcgagcctgtgccttcctc

SEQ ID NO: 5979454 - DNA, 15 bp, Homo sapiens
cacagcgagggcagc

SEQ ID NO: 5979455 - DNA, 17 bp, Homo sapiens
cacagcgagggcagctg

SEQ ID NO: 5979456 - DNA, 18 bp, Homo sapiens
cacagcgagggcagctgc

SEQ ID NO: 5979457 - DNA, 19 bp, Homo sapiens
cacagcgagggcagctgct

SEQ ID NO: 5979458 - DNA, 19 bp, Homo sapiens
cacagcgctggccgggacc

SEQ ID NO: 5979459 - DNA, 17 bp, Homo sapiens
cacagcggaggagacca

SEQ ID NO: 5979460 - DNA, 21 bp, Homo sapiens
cacagcggaggtgtggagccg

SEQ ID NO: 5979461 - DNA, 16 bp, Homo sapiens
cacagcggcccctgca

SEQ ID NO: 5979462 - DNA, 20 bp, Homo sapiens
cacagcggggccccagggct

SEQ ID NO: 5979463 - DNA, 23 bp, Homo sapiens
cacagcgtcattttgaatcatca

SEQ ID NO: 5979464 - DNA, 14 bp, Homo sapiens
cacagcgtccctgg

SEQ ID NO: 5979465 - DNA, 19 bp, Homo sapiens
cacagcgtccctggcgcag

SEQ ID NO: 5979466 - DNA, 22 bp, Homo sapiens
cacagcgtccctggcgcaggtg

SEQ ID NO: 5979467 - DNA, 15 bp, Homo sapiens
cacagcgtctgctca

SEQ ID NO: 5979468 - DNA, 16 bp, Homo sapiens
cacagcgtctgctcat

SEQ ID NO: 5979469 - DNA, 13 bp, Homo sapiens
cacagcgtgctgg

SEQ ID NO: 5979470 - DNA, 20 bp, Homo sapiens
cacagctaacacacagctcc

SEQ ID NO: 5979471 - DNA, 15 bp, Homo sapiens
cacagctaacatgga

SEQ ID NO: 5979472 - DNA, 14 bp, Homo sapiens
cacagctaatattc

SEQ ID NO: 5979473 - DNA, 16 bp, Homo sapiens
cacagctacaacccta

SEQ ID NO: 5979474 - DNA, 15 bp, Homo sapiens
cacagctacctgaga

SEQ ID NO: 5979475 - DNA, 20 bp, Homo sapiens
caaagtcttaaaataactta

SEQ ID NO: 5979476 - DNA, 20 bp, Homo sapiens
caaagtgaaattagtatttt

SEQ ID NO: 5979477 - DNA, 21 bp, Homo sapiens
caaagtgaaattagtattttg

SEQ ID NO: 5979478 - DNA, 23 bp, Homo sapiens
caaagtgaaattagtattttgag

SEQ ID NO: 5979479 - DNA, 21 bp, Homo sapiens
caaagtgagaaaatgcctcaa

SEQ ID NO: 5979480 - DNA, 20 bp, Homo sapiens
caaagtgagaaattatgaaa

SEQ ID NO: 5979481 - DNA, 13 bp, Homo sapiens
caaagtgataaat

SEQ ID NO: 5979482 - DNA, 15 bp, Homo sapiens
caaagtgatagaaaa

SEQ ID NO: 5979483 - DNA, 15 bp, Homo sapiens
caaagtgcacctcaa

SEQ ID NO: 5979484 - DNA, 16 bp, Homo sapiens
caaagtgcagcccttc

SEQ ID NO: 5979485 - DNA, 19 bp, Homo sapiens
caaagtgcagcccttcctc

SEQ ID NO: 5979486 - DNA, 22 bp, Homo sapiens
caaagtgcagcccttcctcctg

SEQ ID NO: 5979487 - DNA, 23 bp, Homo sapiens
caaagtgcagcccttcctcctga

SEQ ID NO: 5979488 - DNA, 15 bp, Homo sapiens
caaagtgcatgtcac

SEQ ID NO: 5979489 - DNA, 16 bp, Homo sapiens
caaagtgccaaagaaa

SEQ ID NO: 5979490 - DNA, 16 bp, Homo sapiens
caaagtgccactcatt

SEQ ID NO: 5979491 - DNA, 22 bp, Homo sapiens
caaagtgccactcattcctgta

SEQ ID NO: 5979492 - DNA, 13 bp, Homo sapiens
caaagtgcctggg

SEQ ID NO: 5979493 - DNA, 16 bp, Homo sapiens
caaagtgcctgggctc

SEQ ID NO: 5979494 - DNA, 17 bp, Homo sapiens
caaagtgccttctgagc

SEQ ID NO: 5979495 - DNA, 18 bp, Homo sapiens
caaagtgccttgctcatt

SEQ ID NO: 5979496 - DNA, 17 bp, Homo sapiens
caaagtgcgtgtgtgta

SEQ ID NO: 5979497 - DNA, 15 bp, Homo sapiens
caaagtgctgagatt

SEQ ID NO: 5979498 - DNA, 16 bp, Homo sapiens
caaagtgctgagatta

SEQ ID NO: 5979499 - DNA, 11 bp, Homo sapiens
caaagtgctgg

SEQ ID NO: 5979500 - DNA, 15 bp, Homo sapiens
caaagtgctgggatt

SEQ ID NO: 5979501 - DNA, 14 bp, Homo sapiens
caaagtgctgtacc

SEQ ID NO: 5979502 - DNA, 14 bp, Homo sapiens
caaagtgcttcctt

SEQ ID NO: 5979503 - DNA, 16 bp, Homo sapiens
caaagtgcttcctttt

SEQ ID NO: 5979504 - DNA, 17 bp, Homo sapiens
caaagtggaaggaaaga

SEQ ID NO: 5979505 - DNA, 23 bp, Homo sapiens
caaagtggaaggaaagatgctca

SEQ ID NO: 5979506 - DNA, 15 bp, Homo sapiens
caaagtggaattaaa

SEQ ID NO: 5979507 - DNA, 18 bp, Homo sapiens
caaagtggagctgggagg

SEQ ID NO: 5979508 - DNA, 13 bp, Homo sapiens
caaagtggcaaaa

SEQ ID NO: 5979509 - DNA, 14 bp, Homo sapiens
caaagtggggaggg

SEQ ID NO: 5979510 - DNA, 20 bp, Homo sapiens
caaagtggggggtggacaca

SEQ ID NO: 5979511 - DNA, 21 bp, Homo sapiens
caaagtgggtactttctgaaa

SEQ ID NO: 5979512 - DNA, 16 bp, Homo sapiens
caaagtgggtgtgtgg

SEQ ID NO: 5979513 - DNA, 20 bp, Homo sapiens
caaagtgggtgtgtggcctc

SEQ ID NO: 5979514 - DNA, 22 bp, Homo sapiens
caaagtgggtgtgtggcctccc

SEQ ID NO: 5979515 - DNA, 20 bp, Homo sapiens
caaagtggtaaatactgtga

SEQ ID NO: 5979516 - DNA, 17 bp, Homo sapiens
caaagtggtgagaggca

SEQ ID NO: 5979517 - DNA, 19 bp, Homo sapiens
caaagtgtacaattttcat

SEQ ID NO: 5979518 - DNA, 14 bp, Homo sapiens
caaagtgtatattt

SEQ ID NO: 5979519 - DNA, 17 bp, Homo sapiens
caaagtgtatatttatt

SEQ ID NO: 5979520 - DNA, 23 bp, Homo sapiens
caaagtgtattttataaaattaa

SEQ ID NO: 5979521 - DNA, 16 bp, Homo sapiens
caaagtgtcactccat

SEQ ID NO: 5979522 - DNA, 13 bp, Homo sapiens
caaagtgtctcat

SEQ ID NO: 5979523 - DNA, 22 bp, Homo sapiens
caaagtgtctcattctcagagt

SEQ ID NO: 5979524 - DNA, 17 bp, Homo sapiens
caaagtgtgtattaaaa

SEQ ID NO: 5979525 - DNA, 19 bp, Homo sapiens
caaagtgttaggattacag

SEQ ID NO: 5979526 - DNA, 17 bp, Homo sapiens
caaagtgttgctgtggc

SEQ ID NO: 5979527 - DNA, 19 bp, Homo sapiens
caaagtgttgtgttcctgg

SEQ ID NO: 5979528 - DNA, 20 bp, Homo sapiens
caaagtgttgtgttcctggc

SEQ ID NO: 5979529 - DNA, 17 bp, Homo sapiens
caaagttaaaagtaaaa

SEQ ID NO: 5979530 - DNA, 21 bp, Homo sapiens
caaagttaattgtatttatgt

SEQ ID NO: 5979531 - DNA, 18 bp, Homo sapiens
caaagttactggctcttt

SEQ ID NO: 5979532 - DNA, 14 bp, Homo sapiens
caaagttagagaac

SEQ ID NO: 5979533 - DNA, 16 bp, Homo sapiens
caaagttagttcagta

SEQ ID NO: 5979534 - DNA, 19 bp, Homo sapiens
caaagttatattcacagtt

SEQ ID NO: 5979535 - DNA, 14 bp, Homo sapiens
caaagttatattta

SEQ ID NO: 5979536 - DNA, 16 bp, Homo sapiens
caaagttatcttaaat

SEQ ID NO: 5979537 - DNA, 13 bp, Homo sapiens
caaagttcaactt

SEQ ID NO: 5979538 - DNA, 17 bp, Homo sapiens
caaagttcactgtttat

SEQ ID NO: 5979539 - DNA, 16 bp, Homo sapiens
caaagttccaaaatgc

SEQ ID NO: 5979540 - DNA, 21 bp, Homo sapiens
caaagttccagttttgttttg

SEQ ID NO: 5979541 - DNA, 20 bp, Homo sapiens
caaagttccctacttcctgt

SEQ ID NO: 5979542 - DNA, 21 bp, Homo sapiens
caaagttccctacttcctgtg

SEQ ID NO: 5979543 - DNA, 22 bp, Homo sapiens
caaagttccctacttcctgtga

SEQ ID NO: 5979544 - DNA, 20 bp, Homo sapiens
caaagttctaataatttcta

SEQ ID NO: 5979545 - DNA, 21 bp, Homo sapiens
caaagttctaataatttctaa

SEQ ID NO: 5979546 - DNA, 15 bp, Homo sapiens
caaagttctcagagc

SEQ ID NO: 5979547 - DNA, 20 bp, Homo sapiens
caaagttctcagagctctcg

SEQ ID NO: 5979548 - DNA, 17 bp, Homo sapiens
caaagttctctgtggca

SEQ ID NO: 5979549 - DNA, 15 bp, Homo sapiens
caaagttctgtgttt

SEQ ID NO: 5979550 - DNA, 14 bp, Homo sapiens
caaagttgcctaaa

SEQ ID NO: 5979551 - DNA, 19 bp, Homo sapiens
caaagttgcctaaatccat

SEQ ID NO: 5979552 - DNA, 23 bp, Homo sapiens
caaagttgctcaccgactcacct

SEQ ID NO: 5979553 - DNA, 14 bp, Homo sapiens
caaagtttctgttg

SEQ ID NO: 5979554 - DNA, 17 bp, Homo sapiens
caaagtttgacaggaac

SEQ ID NO: 5979555 - DNA, 19 bp, Homo sapiens
caaagtttgacaggaacct

SEQ ID NO: 5979556 - DNA, 20 bp, Homo sapiens
caaagttttcatgtgctcag

SEQ ID NO: 5979557 - DNA, 13 bp, Homo sapiens
caaagttttcctt

SEQ ID NO: 5979558 - DNA, 15 bp, Homo sapiens
caaagttttcctttg

SEQ ID NO: 5979559 - DNA, 17 bp, Homo sapiens
caaagttttgaaaagct

SEQ ID NO: 5979560 - DNA, 18 bp, Homo sapiens
caaagttttgaaaagcta

SEQ ID NO: 5979561 - DNA, 14 bp, Homo sapiens
caaagttttgctgt

SEQ ID NO: 5979562 - DNA, 17 bp, Homo sapiens
caaagtttttacagtgt

SEQ ID NO: 5979563 - DNA, 21 bp, Homo sapiens
caaataaaaactaaattgtaa

SEQ ID NO: 5979564 - DNA, 22 bp, Homo sapiens
caaataaaaactaaattgtaaa

SEQ ID NO: 5979565 - DNA, 17 bp, Homo sapiens
caaataaaacagtgaaa

SEQ ID NO: 5979566 - DNA, 23 bp, Homo sapiens
caaataaaacagtgaaagccctg

SEQ ID NO: 5979567 - DNA, 23 bp, Homo sapiens
caaataaaacataatagaatttc

SEQ ID NO: 5979568 - DNA, 21 bp, Homo sapiens
caaataaaacatggccagcaa

SEQ ID NO: 5979569 - DNA, 10 bp, Homo sapiens
caaataaaat

SEQ ID NO: 5979570 - DNA, 17 bp, Homo sapiens
caaataaaatgtttaca

SEQ ID NO: 5979571 - DNA, 18 bp, Homo sapiens
caaataaaatgtttacat

SEQ ID NO: 5979572 - DNA, 20 bp, Homo sapiens
caaataaaatgtttacattt

SEQ ID NO: 5979573 - DNA, 22 bp, Homo sapiens
caaataaaatgtttacattttc

SEQ ID NO: 5979574 - DNA, 17 bp, Homo sapiens
caaataaaattccctaa

SEQ ID NO: 5979575 - DNA, 21 bp, Homo sapiens
caaataaaattccctaaagcc

SEQ ID NO: 5979576 - DNA, 18 bp, Homo sapiens
caaataaaattggcacca

SEQ ID NO: 5979577 - DNA, 21 bp, Homo sapiens
caaataaacaactatggctgt

SEQ ID NO: 5979578 - DNA, 13 bp, Homo sapiens
caaataaacactg

SEQ ID NO: 5979579 - DNA, 18 bp, Homo sapiens
caaataaacagctattta

SEQ ID NO: 5979580 - DNA, 18 bp, Homo sapiens
caaataaacctgaggcag

SEQ ID NO: 5979581 - DNA, 14 bp, Homo sapiens
caaataaaccttgt

SEQ ID NO: 5979582 - DNA, 16 bp, Homo sapiens
caaataaactagtctg

SEQ ID NO: 5979583 - DNA, 20 bp, Homo sapiens
caaataaactgactttttcc

SEQ ID NO: 5979584 - DNA, 16 bp, Homo sapiens
caaataaacttacaga

SEQ ID NO: 5979585 - DNA, 14 bp, Homo sapiens
caaataaagaaatt

SEQ ID NO: 5979586 - DNA, 15 bp, Homo sapiens
caaataaagaaattt

SEQ ID NO: 5979587 - DNA, 17 bp, Homo sapiens
caaataaagcagtcatg

SEQ ID NO: 5979588 - DNA, 20 bp, Homo sapiens
caaataaagcctgctctccc

SEQ ID NO: 5979589 - DNA, 11 bp, Homo sapiens
caaataaagtc

SEQ ID NO: 5979590 - DNA, 17 bp, Homo sapiens
caaataaagtcccaggt

SEQ ID NO: 5979591 - DNA, 12 bp, Homo sapiens
caaataaagtct

SEQ ID NO: 5979592 - DNA, 19 bp, Homo sapiens
caaataaagttaaaagtaa

SEQ ID NO: 5979593 - DNA, 17 bp, Homo sapiens
caaataaataattttca

SEQ ID NO: 5979594 - DNA, 22 bp, Homo sapiens
caaataaatgattatattcaca

SEQ ID NO: 5979595 - DNA, 12 bp, Homo sapiens
caaataaatgtg

SEQ ID NO: 5979596 - DNA, 19 bp, Homo sapiens
caaataaatgtgtaaatgt

SEQ ID NO: 5979597 - DNA, 15 bp, Homo sapiens
caaataaatgtttcc

SEQ ID NO: 5979598 - DNA, 19 bp, Homo sapiens
caaataaattcaataaaaa

SEQ ID NO: 5979599 - DNA, 14 bp, Homo sapiens
caaataaattggaa

SEQ ID NO: 5979600 - DNA, 14 bp, Homo sapiens
caaataaatttata

SEQ ID NO: 5979601 - DNA, 19 bp, Homo sapiens
caaataaatttataacaat

SEQ ID NO: 5979602 - DNA, 14 bp, Homo sapiens
caaataaatttctg

SEQ ID NO: 5979603 - DNA, 22 bp, Homo sapiens
caaataaccaacccttccctga

SEQ ID NO: 5979604 - DNA, 13 bp, Homo sapiens
caaataaccctga

SEQ ID NO: 5979605 - DNA, 17 bp, Homo sapiens
caaataactaaggaata

SEQ ID NO: 5979606 - DNA, 20 bp, Homo sapiens
caaataactaaggaatatat

SEQ ID NO: 5979607 - DNA, 23 bp, Homo sapiens
caaataacttacaagactgtaaa

SEQ ID NO: 5979608 - DNA, 15 bp, Homo sapiens
caaataacttcagtc

SEQ ID NO: 5979609 - DNA, 17 bp, Homo sapiens
caaataacttcagtcct

SEQ ID NO: 5979610 - DNA, 13 bp, Homo sapiens
caaataagacagt

SEQ ID NO: 5979611 - DNA, 12 bp, Homo sapiens
caaataagactt

SEQ ID NO: 5979612 - DNA, 21 bp, Homo sapiens
caaataagatatttttcagct

SEQ ID NO: 5979613 - DNA, 19 bp, Homo sapiens
caaataagcactcctttaa

SEQ ID NO: 5979614 - DNA, 16 bp, Homo sapiens
caaataaggatttgtt

SEQ ID NO: 5979615 - DNA, 17 bp, Homo sapiens
caaataagggaataaaa

SEQ ID NO: 5979616 - DNA, 14 bp, Homo sapiens
caaataagtaatat

SEQ ID NO: 5979617 - DNA, 22 bp, Homo sapiens
caaataagtcaaaataatctga

SEQ ID NO: 5979618 - DNA, 13 bp, Homo sapiens
caaataagtgtat

SEQ ID NO: 5979619 - DNA, 18 bp, Homo sapiens
caaataagtgtattttga

SEQ ID NO: 5979620 - DNA, 20 bp, Homo sapiens
caaataagtgtattttgaaa

SEQ ID NO: 5979621 - DNA, 21 bp, Homo sapiens
caaataagtgtattttgaaat

SEQ ID NO: 5979622 - DNA, 15 bp, Homo sapiens
caaataagtttttgc

SEQ ID NO: 5979623 - DNA, 19 bp, Homo sapiens
caaataataataataacaa

SEQ ID NO: 5979624 - DNA, 11 bp, Homo sapiens
caaataatatt

SEQ ID NO: 5979625 - DNA, 20 bp, Homo sapiens
caaataatattactctatga

SEQ ID NO: 5979626 - DNA, 21 bp, Homo sapiens
caaataatattactctatgat

SEQ ID NO: 5979627 - DNA, 14 bp, Homo sapiens
caaataatattcat

SEQ ID NO: 5979628 - DNA, 17 bp, Homo sapiens
caaataatattgccttg

SEQ ID NO: 5979629 - DNA, 22 bp, Homo sapiens
caaataatccattccaaaatac

SEQ ID NO: 5979630 - DNA, 24 bp, Homo sapiens
caaataatccattccaaaatacaa

SEQ ID NO: 5979631 - DNA, 23 bp, Homo sapiens
caaataatgatcgaaaaaataat

SEQ ID NO: 5979632 - DNA, 19 bp, Homo sapiens
caaataatgcttttctaat

SEQ ID NO: 5979633 - DNA, 21 bp, Homo sapiens
caaataatggacttttttcta

SEQ ID NO: 5979634 - DNA, 12 bp, Homo sapiens
caaataatttaa

SEQ ID NO: 5979635 - DNA, 15 bp, Homo sapiens
caaataatttaagtt

SEQ ID NO: 5979636 - DNA, 20 bp, Homo sapiens
caaataatttttcacttcaa

SEQ ID NO: 5979637 - DNA, 22 bp, Homo sapiens
caaataattttttgcagtcttt

SEQ ID NO: 5979638 - DNA, 15 bp, Homo sapiens
caaatacaaaatgat

SEQ ID NO: 5979639 - DNA, 14 bp, Homo sapiens
caaatacaaagtaa

SEQ ID NO: 5979640 - DNA, 19 bp, Homo sapiens
caaatacaaagtaaataca

SEQ ID NO: 5979641 - DNA, 20 bp, Homo sapiens
caaatacaaagtggaaactt

SEQ ID NO: 5979642 - DNA, 16 bp, Homo sapiens
caaatacacatacata

SEQ ID NO: 5979643 - DNA, 20 bp, Homo sapiens
caaatacacatacatatata

SEQ ID NO: 5979644 - DNA, 21 bp, Homo sapiens
caaatacacatacatatatac

SEQ ID NO: 5979645 - DNA, 15 bp, Homo sapiens
caaatacacatttca

SEQ ID NO: 5979646 - DNA, 14 bp, Homo sapiens
caaataccagagca

SEQ ID NO: 5979647 - DNA, 15 bp, Homo sapiens
caaataccagagcac

SEQ ID NO: 5979648 - DNA, 12 bp, Homo sapiens
caaatacctcaa

SEQ ID NO: 5979649 - DNA, 20 bp, Homo sapiens
caaatacctcaatttttgtt

SEQ ID NO: 5979650 - DNA, 22 bp, Homo sapiens
caaatacctccattaaatggtc

SEQ ID NO: 5979651 - DNA, 21 bp, Homo sapiens
caaatacgtgggcattcaaat

SEQ ID NO: 5979652 - DNA, 16 bp, Homo sapiens
caaatactaaaaagaa

SEQ ID NO: 5979653 - DNA, 22 bp, Homo sapiens
cacagctactcagtggggctgg

SEQ ID NO: 5979654 - DNA, 20 bp, Homo sapiens
cacagctacttggtttgtgt

SEQ ID NO: 5979655 - DNA, 21 bp, Homo sapiens
cacagctagtgaagaccagag

SEQ ID NO: 5979656 - DNA, 13 bp, Homo sapiens
cacagctcagctg

SEQ ID NO: 5979657 - DNA, 14 bp, Homo sapiens
cacagctcagctgc

SEQ ID NO: 5979658 - DNA, 15 bp, Homo sapiens
cacagctcagctgcc

SEQ ID NO: 5979659 - DNA, 19 bp, Homo sapiens
cacagctcagctgcccatc

SEQ ID NO: 5979660 - DNA, 16 bp, Homo sapiens
cacagctcaggaacta

SEQ ID NO: 5979661 - DNA, 15 bp, Homo sapiens
cacagctcccacccc

SEQ ID NO: 5979662 - DNA, 19 bp, Homo sapiens
cacagctcccaccccaccc

SEQ ID NO: 5979663 - DNA, 14 bp, Homo sapiens
cacagctccctgcc

SEQ ID NO: 5979664 - DNA, 20 bp, Homo sapiens
cacagctccgagctgtagga

SEQ ID NO: 5979665 - DNA, 10 bp, Homo sapiens
cacagctcct

SEQ ID NO: 5979666 - DNA, 16 bp, Homo sapiens
cacagctcctcccctg

SEQ ID NO: 5979667 - DNA, 22 bp, Homo sapiens
cacagctcctcccctgccgcct

SEQ ID NO: 5979668 - DNA, 12 bp, Homo sapiens
cacagctcctcg

SEQ ID NO: 5979669 - DNA, 21 bp, Homo sapiens
cacagctccttttccagagca

SEQ ID NO: 5979670 - DNA, 14 bp, Homo sapiens
cacagctctcactg

SEQ ID NO: 5979671 - DNA, 17 bp, Homo sapiens
cacagctctcactggcc

SEQ ID NO: 5979672 - DNA, 19 bp, Homo sapiens
cacagctctcactggccag

SEQ ID NO: 5979673 - DNA, 21 bp, Homo sapiens
cacagctctccggtctctctc

SEQ ID NO: 5979674 - DNA, 12 bp, Homo sapiens
cacagctctgct

SEQ ID NO: 5979675 - DNA, 13 bp, Homo sapiens
cacagctctgggc

SEQ ID NO: 5979676 - DNA, 14 bp, Homo sapiens
cacagctctgggcc

SEQ ID NO: 5979677 - DNA, 18 bp, Homo sapiens
cacagctctgggcctctt

SEQ ID NO: 5979678 - DNA, 14 bp, Homo sapiens
cacagctctgtcct

SEQ ID NO: 5979679 - DNA, 16 bp, Homo sapiens
cacagctctgtcctgg

SEQ ID NO: 5979680 - DNA, 19 bp, Homo sapiens
cacagctctgtcctgggag

SEQ ID NO: 5979681 - DNA, 10 bp, Homo sapiens
cacagctctt

SEQ ID NO: 5979682 - DNA, 11 bp, Homo sapiens
cacagctcttc

SEQ ID NO: 5979683 - DNA, 16 bp, Homo sapiens
cacagctcttcacacc

SEQ ID NO: 5979684 - DNA, 20 bp, Homo sapiens
cacagctcttcattccattg

SEQ ID NO: 5979685 - DNA, 19 bp, Homo sapiens
cacagctcttccagggcag

SEQ ID NO: 5979686 - DNA, 15 bp, Homo sapiens
cacagctcttctcca

SEQ ID NO: 5979687 - DNA, 13 bp, Homo sapiens
cacagctcttctt

SEQ ID NO: 5979688 - DNA, 16 bp, Homo sapiens
cacagctcttgtttgg

SEQ ID NO: 5979689 - DNA, 22 bp, Homo sapiens
cacagctgcagccaaccccatc

SEQ ID NO: 5979690 - DNA, 22 bp, Homo sapiens
cacagctgcagcccatcctccc

SEQ ID NO: 5979691 - DNA, 15 bp, Homo sapiens
cacagctgcagctgg

SEQ ID NO: 5979692 - DNA, 16 bp, Homo sapiens
cacagctgcagctggg

SEQ ID NO: 5979693 - DNA, 17 bp, Homo sapiens
cacagctgcagctgggc

SEQ ID NO: 5979694 - DNA, 18 bp, Homo sapiens
cacagctgcagctgggcc

SEQ ID NO: 5979695 - DNA, 16 bp, Homo sapiens
cacagctgcaggccac

SEQ ID NO: 5979696 - DNA, 16 bp, Homo sapiens
cacagctgccctgctg

SEQ ID NO: 5979697 - DNA, 17 bp, Homo sapiens
cacagctgccctgctgc

SEQ ID NO: 5979698 - DNA, 20 bp, Homo sapiens
cacagctgccctgctgccac

SEQ ID NO: 5979699 - DNA, 12 bp, Homo sapiens
cacagctgcctc

SEQ ID NO: 5979700 - DNA, 13 bp, Homo sapiens
cacagctgcctcc

SEQ ID NO: 5979701 - DNA, 12 bp, Homo sapiens
cacagctgctca

SEQ ID NO: 5979702 - DNA, 20 bp, Homo sapiens
cacagctgctgaagaggcaa

SEQ ID NO: 5979703 - DNA, 15 bp, Homo sapiens
cacagctgctggaga

SEQ ID NO: 5979704 - DNA, 22 bp, Homo sapiens
cacagctgctggagaataaatt

SEQ ID NO: 5979705 - DNA, 20 bp, Homo sapiens
cacagctgctggagactcct

SEQ ID NO: 5979706 - DNA, 18 bp, Homo sapiens
cacagctgctggccaggg

SEQ ID NO: 5979707 - DNA, 16 bp, Homo sapiens
cacagctgctgttctc

SEQ ID NO: 5979708 - DNA, 13 bp, Homo sapiens
cacagctgcttgt

SEQ ID NO: 5979709 - DNA, 20 bp, Homo sapiens
cacagctgctttctgttgtc

SEQ ID NO: 5979710 - DNA, 15 bp, Homo sapiens
cacagctggccacca

SEQ ID NO: 5979711 - DNA, 14 bp, Homo sapiens
cacagctggcctcc

SEQ ID NO: 5979712 - DNA, 16 bp, Homo sapiens
cacagctggcctggtt

SEQ ID NO: 5979713 - DNA, 13 bp, Homo sapiens
cacagctggctct

SEQ ID NO: 5979714 - DNA, 15 bp, Homo sapiens
cacagctgggagcct

SEQ ID NO: 5979715 - DNA, 14 bp, Homo sapiens
cacagctgggcaaa

SEQ ID NO: 5979716 - DNA, 14 bp, Homo sapiens
cacagctgggctgt

SEQ ID NO: 5979717 - DNA, 16 bp, Homo sapiens
cacagctggggccggt

SEQ ID NO: 5979718 - DNA, 11 bp, Homo sapiens
cacagctgtct

SEQ ID NO: 5979719 - DNA, 12 bp, Homo sapiens
cacagctgtctg

SEQ ID NO: 5979720 - DNA, 17 bp, Homo sapiens
cacagctgtctgccagg

SEQ ID NO: 5979721 - DNA, 22 bp, Homo sapiens
cacagctgttcttctgttctgc

SEQ ID NO: 5979722 - DNA, 19 bp, Homo sapiens
cacagctgtttcctcacgt

SEQ ID NO: 5979723 - DNA, 21 bp, Homo sapiens
cacagctgtttgaaatgttta

SEQ ID NO: 5979724 - DNA, 17 bp, Homo sapiens
cacagcttagatttcat

SEQ ID NO: 5979725 - DNA, 19 bp, Homo sapiens
cacagcttagatttcatag

SEQ ID NO: 5979726 - DNA, 21 bp, Homo sapiens
cacagcttcatttcctgtgtc

SEQ ID NO: 5979727 - DNA, 14 bp, Homo sapiens
cacagcttcccctc

SEQ ID NO: 5979728 - DNA, 11 bp, Homo sapiens
cacagcttcct

SEQ ID NO: 5979729 - DNA, 12 bp, Homo sapiens
cacagcttcctg

SEQ ID NO: 5979730 - DNA, 15 bp, Homo sapiens
cacagcttcctgagg

SEQ ID NO: 5979731 - DNA, 21 bp, Homo sapiens
cacagcttcctgtccccatct

SEQ ID NO: 5979732 - DNA, 12 bp, Homo sapiens
cacagcttcttc

SEQ ID NO: 5979733 - DNA, 18 bp, Homo sapiens
cacagcttgacctgaggc

SEQ ID NO: 5979734 - DNA, 23 bp, Homo sapiens
cacagcttgtctcttgcctgcca

SEQ ID NO: 5979735 - DNA, 14 bp, Homo sapiens
cacagcttgttttg

SEQ ID NO: 5979736 - DNA, 16 bp, Homo sapiens
cacagcttgttttgga

SEQ ID NO: 5979737 - DNA, 19 bp, Homo sapiens
cacagctttcctgggtctg

SEQ ID NO: 5979738 - DNA, 21 bp, Homo sapiens
cacagcttttagtacccacct

SEQ ID NO: 5979739 - DNA, 14 bp, Homo sapiens
cacagcttttccaa

SEQ ID NO: 5979740 - DNA, 15 bp, Homo sapiens
cacagcttttccaaa

SEQ ID NO: 5979741 - DNA, 16 bp, Homo sapiens
cacaggaaaaataaac

SEQ ID NO: 5979742 - DNA, 17 bp, Homo sapiens
cacaggaaaaataaacg

SEQ ID NO: 5979743 - DNA, 18 bp, Homo sapiens
cacaggaaaaataaacgt

SEQ ID NO: 5979744 - DNA, 22 bp, Homo sapiens
cacaggaaaatgtatccagagg

SEQ ID NO: 5979745 - DNA, 12 bp, Homo sapiens
cacaggaaacaa

SEQ ID NO: 5979746 - DNA, 16 bp, Homo sapiens
cacaggaacggccctg

SEQ ID NO: 5979747 - DNA, 15 bp, Homo sapiens
cacaggaagaaagca

SEQ ID NO: 5979748 - DNA, 23 bp, Homo sapiens
cacaggaagaatgggctgcagaa

SEQ ID NO: 5979749 - DNA, 22 bp, Homo sapiens
cacaggaagccgcctagtgcag

SEQ ID NO: 5979750 - DNA, 16 bp, Homo sapiens
cacaggaagctcagcc

SEQ ID NO: 5979751 - DNA, 18 bp, Homo sapiens
cacaggaagctcagcctt

SEQ ID NO: 5979752 - DNA, 15 bp, Homo sapiens
cacaggaaggaaaca

SEQ ID NO: 5979753 - DNA, 19 bp, Homo sapiens
cacaggaagtttggagcct

SEQ ID NO: 5979754 - DNA, 17 bp, Homo sapiens
cacaggaattctcaaga

SEQ ID NO: 5979755 - DNA, 17 bp, Homo sapiens
cacaggacacagtcaga

SEQ ID NO: 5979756 - DNA, 23 bp, Homo sapiens
cacaggacacctggccgcctcca

SEQ ID NO: 5979757 - DNA, 19 bp, Homo sapiens
cacaggacacgaaggctgc

SEQ ID NO: 5979758 - DNA, 15 bp, Homo sapiens
cacaggacagcggga

SEQ ID NO: 5979759 - DNA, 19 bp, Homo sapiens
cacaggacaggggttcctt

SEQ ID NO: 5979760 - DNA, 22 bp, Homo sapiens
cacaggaccacctcctctgcca

SEQ ID NO: 5979761 - DNA, 22 bp, Homo sapiens
cacaggacccagaaaaaaagcc

SEQ ID NO: 5979762 - DNA, 15 bp, Homo sapiens
cacaggaccctcgcc

SEQ ID NO: 5979763 - DNA, 17 bp, Homo sapiens
cacaggacgaatgcata

SEQ ID NO: 5979764 - DNA, 21 bp, Homo sapiens
cacaggacgaatgcatattca

SEQ ID NO: 5979765 - DNA, 23 bp, Homo sapiens
cacaggacgatttcactgacact

SEQ ID NO: 5979766 - DNA, 16 bp, Homo sapiens
cacaggactctgcctc

SEQ ID NO: 5979767 - DNA, 18 bp, Homo sapiens
cacaggactgagccctct

SEQ ID NO: 5979768 - DNA, 21 bp, Homo sapiens
cacaggagacactgtgctata

SEQ ID NO: 5979769 - DNA, 15 bp, Homo sapiens
cacaggagagactgg

SEQ ID NO: 5979770 - DNA, 17 bp, Homo sapiens
cacaggagagcacccac

SEQ ID NO: 5979771 - DNA, 22 bp, Homo sapiens
cacaggagcaatcacaggaaaa

SEQ ID NO: 5979772 - DNA, 14 bp, Homo sapiens
cacaggagcagaca

SEQ ID NO: 5979773 - DNA, 15 bp, Homo sapiens
cacaggagcatttgg

SEQ ID NO: 5979774 - DNA, 17 bp, Homo sapiens
cacaggagccgcagagg

SEQ ID NO: 5979775 - DNA, 19 bp, Homo sapiens
cacaggagccgcagaggcc

SEQ ID NO: 5979776 - DNA, 16 bp, Homo sapiens
cacaggagcgtgtcct

SEQ ID NO: 5979777 - DNA, 14 bp, Homo sapiens
cacaggagctacct

SEQ ID NO: 5979778 - DNA, 18 bp, Homo sapiens
cacaggagctacctgtgt

SEQ ID NO: 5979779 - DNA, 20 bp, Homo sapiens
cacaggagctacctgtgtgg

SEQ ID NO: 5979780 - DNA, 21 bp, Homo sapiens
cacaggagctccctttttgaa

SEQ ID NO: 5979781 - DNA, 17 bp, Homo sapiens
cacaggagctgccatgt

SEQ ID NO: 5979782 - DNA, 15 bp, Homo sapiens
cacaggaggcaagca

SEQ ID NO: 5979783 - DNA, 15 bp, Homo sapiens
cacaggaggccagtg

SEQ ID NO: 5979784 - DNA, 17 bp, Homo sapiens
cacaggaggccagtggg

SEQ ID NO: 5979785 - DNA, 18 bp, Homo sapiens
cacaggaggccagtgggc

SEQ ID NO: 5979786 - DNA, 20 bp, Homo sapiens
cacaggagggagagaactta

SEQ ID NO: 5979787 - DNA, 19 bp, Homo sapiens
cacaggagggagggggaag

SEQ ID NO: 5979788 - DNA, 14 bp, Homo sapiens
cacaggagggccag

SEQ ID NO: 5979789 - DNA, 17 bp, Homo sapiens
cacaggagggtaatttt

SEQ ID NO: 5979790 - DNA, 20 bp, Homo sapiens
cacaggagtcttcagaccca

SEQ ID NO: 5979791 - DNA, 20 bp, Homo sapiens
cacaggagttgtgagccctc

SEQ ID NO: 5979792 - DNA, 15 bp, Homo sapiens
cacaggataaagtta

SEQ ID NO: 5979793 - DNA, 22 bp, Homo sapiens
cacaggatattaaacgtgtaaa

SEQ ID NO: 5979794 - DNA, 12 bp, Homo sapiens
cacaggatcagt

SEQ ID NO: 5979795 - DNA, 13 bp, Homo sapiens
cacaggatcctgg

SEQ ID NO: 5979796 - DNA, 17 bp, Homo sapiens
cacaggatcctggcctg

SEQ ID NO: 5979797 - DNA, 18 bp, Homo sapiens
cacaggatcctggcctga

SEQ ID NO: 5979798 - DNA, 22 bp, Homo sapiens
cacaggatgaactagccatgac

SEQ ID NO: 5979799 - DNA, 16 bp, Homo sapiens
cacaggatgaaggcaa

SEQ ID NO: 5979800 - DNA, 13 bp, Homo sapiens
cacaggatgccag

SEQ ID NO: 5979801 - DNA, 17 bp, Homo sapiens
cacaggatgccagcccc

SEQ ID NO: 5979802 - DNA, 19 bp, Homo sapiens
cacaggatgccagcccctg

SEQ ID NO: 5979803 - DNA, 20 bp, Homo sapiens
cacaggatgccagcccctgc

SEQ ID NO: 5979804 - DNA, 21 bp, Homo sapiens
cacaggatgccagcccctgcc

SEQ ID NO: 5979805 - DNA, 22 bp, Homo sapiens
cacaggatgccagcccctgcct

SEQ ID NO: 5979806 - DNA, 20 bp, Homo sapiens
cacaggatggtctctgccat

SEQ ID NO: 5979807 - DNA, 16 bp, Homo sapiens
cacaggcaaaatcctt

SEQ ID NO: 5979808 - DNA, 12 bp, Homo sapiens
cacaggcaaaga

SEQ ID NO: 5979809 - DNA, 14 bp, Homo sapiens
cacaggcaacatta

SEQ ID NO: 5979810 - DNA, 13 bp, Homo sapiens
cacaggcaactga

SEQ ID NO: 5979811 - DNA, 14 bp, Homo sapiens
cacaggcaactgag

SEQ ID NO: 5979812 - DNA, 18 bp, Homo sapiens
cacaggcaactgaggcag

SEQ ID NO: 5979813 - DNA, 20 bp, Homo sapiens
cacaggcaactgaggcagac

SEQ ID NO: 5979814 - DNA, 22 bp, Homo sapiens
cacaggcaatgactgcgcagag

SEQ ID NO: 5979815 - DNA, 20 bp, Homo sapiens
cacaggcacacaggtctcat

SEQ ID NO: 5979816 - DNA, 17 bp, Homo sapiens
cacaggcacattaactg

SEQ ID NO: 5979817 - DNA, 20 bp, Homo sapiens
cacaggcacattaactgttg

SEQ ID NO: 5979818 - DNA, 17 bp, Homo sapiens
cacaggcacgggtccct

SEQ ID NO: 5979819 - DNA, 21 bp, Homo sapiens
cacaggcactgaacaggctgg

SEQ ID NO: 5979820 - DNA, 22 bp, Homo sapiens
cacaggcactgaacaggctggg

SEQ ID NO: 5979821 - DNA, 10 bp, Homo sapiens
cacaggcagc

SEQ ID NO: 5979822 - DNA, 23 bp, Homo sapiens
cacaggcagcaaggtcatggtct

SEQ ID NO: 5979823 - DNA, 11 bp, Homo sapiens
cacaggcagcc

SEQ ID NO: 5979824 - DNA, 17 bp, Homo sapiens
cacaggcagccagccgt

SEQ ID NO: 5979825 - DNA, 19 bp, Homo sapiens
cacaggcagccagccgtgg

SEQ ID NO: 5979826 - DNA, 15 bp, Homo sapiens
cacaggcagccagtg

SEQ ID NO: 5979827 - DNA, 14 bp, Homo sapiens
cacaggcagctctg

SEQ ID NO: 5979828 - DNA, 18 bp, Homo sapiens
cacaggcagctctgagcc

SEQ ID NO: 5979829 - DNA, 15 bp, Homo sapiens
cacaggcagctttct

SEQ ID NO: 5979830 - DNA, 20 bp, Homo sapiens
cacaggcaggaagagagaga

SEQ ID NO: 5979831 - DNA, 12 bp, Homo sapiens
cacaggcagggc

SEQ ID NO: 5979832 - DNA, 13 bp, Homo sapiens
cacaggcagggca

SEQ ID NO: 5979833 - DNA, 18 bp, Homo sapiens
cacaggcagggcaggacc

SEQ ID NO: 5979834 - DNA, 21 bp, Homo sapiens
caaatactaaaaagaagtgct

SEQ ID NO: 5979835 - DNA, 16 bp, Homo sapiens
caaatactaatgaaaa

SEQ ID NO: 5979836 - DNA, 15 bp, Homo sapiens
caaatactcatgtgt

SEQ ID NO: 5979837 - DNA, 23 bp, Homo sapiens
caaatactcattttaggaaaaaa

SEQ ID NO: 5979838 - DNA, 14 bp, Homo sapiens
caaatactccaagc

SEQ ID NO: 5979839 - DNA, 19 bp, Homo sapiens
caaatactccaagcttcaa

SEQ ID NO: 5979840 - DNA, 14 bp, Homo sapiens
caaatactcttagg

SEQ ID NO: 5979841 - DNA, 18 bp, Homo sapiens
caaatactgaaatattag

SEQ ID NO: 5979842 - DNA, 12 bp, Homo sapiens
caaatactgatt

SEQ ID NO: 5979843 - DNA, 24 bp, Homo sapiens
caaatactgcttagcattttgcat

SEQ ID NO: 5979844 - DNA, 18 bp, Homo sapiens
caaatacttcaaatcata

SEQ ID NO: 5979845 - DNA, 19 bp, Homo sapiens
caaatactttaaaggaaaa

SEQ ID NO: 5979846 - DNA, 13 bp, Homo sapiens
caaatagaaaaca

SEQ ID NO: 5979847 - DNA, 17 bp, Homo sapiens
caaatagaaaacaggaa

SEQ ID NO: 5979848 - DNA, 16 bp, Homo sapiens
caaatagaaaatggtc

SEQ ID NO: 5979849 - DNA, 13 bp, Homo sapiens
caaatagaacaag

SEQ ID NO: 5979850 - DNA, 22 bp, Homo sapiens
caaatagaagcttcttgctcct

SEQ ID NO: 5979851 - DNA, 23 bp, Homo sapiens
caaatagaagcttcttgctcctg

SEQ ID NO: 5979852 - DNA, 21 bp, Homo sapiens
caaatagagtttttatatttg

SEQ ID NO: 5979853 - DNA, 19 bp, Homo sapiens
caaatagattcagagaaat

SEQ ID NO: 5979854 - DNA, 14 bp, Homo sapiens
caaatagatttttg

SEQ ID NO: 5979855 - DNA, 16 bp, Homo sapiens
caaatagatttttgat

SEQ ID NO: 5979856 - DNA, 19 bp, Homo sapiens
caaatagatttttgattca

SEQ ID NO: 5979857 - DNA, 19 bp, Homo sapiens
caaatagatttttgttttt

SEQ ID NO: 5979858 - DNA, 13 bp, Homo sapiens
caaatagcaaatg

SEQ ID NO: 5979859 - DNA, 17 bp, Homo sapiens
caaatagccagtgctag

SEQ ID NO: 5979860 - DNA, 14 bp, Homo sapiens
caaatagccccaga

SEQ ID NO: 5979861 - DNA, 20 bp, Homo sapiens
caaatagcctctcctttgta

SEQ ID NO: 5979862 - DNA, 22 bp, Homo sapiens
caaatagcttttcacttcttaa

SEQ ID NO: 5979863 - DNA, 15 bp, Homo sapiens
caaataggaggaaaa

SEQ ID NO: 5979864 - DNA, 23 bp, Homo sapiens
caaataggatgtactgttgaaaa

SEQ ID NO: 5979865 - DNA, 19 bp, Homo sapiens
caaataggattaaacacac

SEQ ID NO: 5979866 - DNA, 17 bp, Homo sapiens
caaataggctattaaaa

SEQ ID NO: 5979867 - DNA, 23 bp, Homo sapiens
caaataggctattaaaaaagtct

SEQ ID NO: 5979868 - DNA, 16 bp, Homo sapiens
caaatagggcaaagaa

SEQ ID NO: 5979869 - DNA, 11 bp, Homo sapiens
caaataggtag

SEQ ID NO: 5979870 - DNA, 13 bp, Homo sapiens
caaataggtagag

SEQ ID NO: 5979871 - DNA, 22 bp, Homo sapiens
caaatagtagagtatcagttgc

SEQ ID NO: 5979872 - DNA, 23 bp, Homo sapiens
caaatagtaggctaaaaacattt

SEQ ID NO: 5979873 - DNA, 12 bp, Homo sapiens
caaatagtgtga

SEQ ID NO: 5979874 - DNA, 19 bp, Homo sapiens
caaatagtgttgatcagat

SEQ ID NO: 5979875 - DNA, 13 bp, Homo sapiens
caaatagttgcat

SEQ ID NO: 5979876 - DNA, 19 bp, Homo sapiens
caaatagttgcatagcagt

SEQ ID NO: 5979877 - DNA, 14 bp, Homo sapiens
caaatataaacttg

SEQ ID NO: 5979878 - DNA, 16 bp, Homo sapiens
caaatataaatcttaa

SEQ ID NO: 5979879 - DNA, 17 bp, Homo sapiens
caaatatacattttcta

SEQ ID NO: 5979880 - DNA, 19 bp, Homo sapiens
caaatatacattttctaaa

SEQ ID NO: 5979881 - DNA, 13 bp, Homo sapiens
caaatatactcat

SEQ ID NO: 5979882 - DNA, 17 bp, Homo sapiens
caaatatactcatttgg

SEQ ID NO: 5979883 - DNA, 12 bp, Homo sapiens
caaatatagaaa

SEQ ID NO: 5979884 - DNA, 14 bp, Homo sapiens
caaatatagaaagt

SEQ ID NO: 5979885 - DNA, 14 bp, Homo sapiens
caaatatagttgaa

SEQ ID NO: 5979886 - DNA, 19 bp, Homo sapiens
caaatatatgtatatatat

SEQ ID NO: 5979887 - DNA, 17 bp, Homo sapiens
caaatatattctctttg

SEQ ID NO: 5979888 - DNA, 14 bp, Homo sapiens
caaatatattgtta

SEQ ID NO: 5979889 - DNA, 15 bp, Homo sapiens
caaatatattgttaa

SEQ ID NO: 5979890 - DNA, 18 bp, Homo sapiens
caaatatatttaggccag

SEQ ID NO: 5979891 - DNA, 15 bp, Homo sapiens
caaatatcaaataaa

SEQ ID NO: 5979892 - DNA, 20 bp, Homo sapiens
caaatatcctccactttcag

SEQ ID NO: 5979893 - DNA, 17 bp, Homo sapiens
caaatatcttgtgttgt

SEQ ID NO: 5979894 - DNA, 22 bp, Homo sapiens
caaatatcttgtgttgtccttt

SEQ ID NO: 5979895 - DNA, 16 bp, Homo sapiens
caaatatgaaaaatgt

SEQ ID NO: 5979896 - DNA, 22 bp, Homo sapiens
caaatatgaaaaatgtaaatac

SEQ ID NO: 5979897 - DNA, 17 bp, Homo sapiens
caaatatgattctcctc

SEQ ID NO: 5979898 - DNA, 22 bp, Homo sapiens
caaatatgattctcctctccca

SEQ ID NO: 5979899 - DNA, 13 bp, Homo sapiens
caaatatgcaaag

SEQ ID NO: 5979900 - DNA, 16 bp, Homo sapiens
caaatatgcaaagcac

SEQ ID NO: 5979901 - DNA, 13 bp, Homo sapiens
caaatatgcactt

SEQ ID NO: 5979902 - DNA, 14 bp, Homo sapiens
caaatatgcacttt

SEQ ID NO: 5979903 - DNA, 15 bp, Homo sapiens
caaatatgcactttc

SEQ ID NO: 5979904 - DNA, 20 bp, Homo sapiens
caaatatgcactttccctag

SEQ ID NO: 5979905 - DNA, 17 bp, Homo sapiens
caaatatgctaatttgg

SEQ ID NO: 5979906 - DNA, 22 bp, Homo sapiens
caaatatgctgttatgtccaga

SEQ ID NO: 5979907 - DNA, 15 bp, Homo sapiens
caaatatgtaaactt

SEQ ID NO: 5979908 - DNA, 20 bp, Homo sapiens
caaatatgtagaatgtaata

SEQ ID NO: 5979909 - DNA, 13 bp, Homo sapiens
caaatatgtcctg

SEQ ID NO: 5979910 - DNA, 14 bp, Homo sapiens
caaatatgtcctgg

SEQ ID NO: 5979911 - DNA, 15 bp, Homo sapiens
caaatatgtcctggg

SEQ ID NO: 5979912 - DNA, 17 bp, Homo sapiens
caaatatgtcctggggt

SEQ ID NO: 5979913 - DNA, 21 bp, Homo sapiens
caaatatgttaaagtttaagt

SEQ ID NO: 5979914 - DNA, 14 bp, Homo sapiens
caaatattaaaatt

SEQ ID NO: 5979915 - DNA, 22 bp, Homo sapiens
caaatattaaagattctcttta

SEQ ID NO: 5979916 - DNA, 14 bp, Homo sapiens
caaatattacaaca

SEQ ID NO: 5979917 - DNA, 16 bp, Homo sapiens
caaatattagatgtga

SEQ ID NO: 5979918 - DNA, 17 bp, Homo sapiens
caaatattagatgtgat

SEQ ID NO: 5979919 - DNA, 19 bp, Homo sapiens
caaatattagatgtgattt

SEQ ID NO: 5979920 - DNA, 23 bp, Homo sapiens
caaatattagatgtgatttaata

SEQ ID NO: 5979921 - DNA, 19 bp, Homo sapiens
caaatattagcaaagaagc

SEQ ID NO: 5979922 - DNA, 15 bp, Homo sapiens
caaatattagccaaa

SEQ ID NO: 5979923 - DNA, 21 bp, Homo sapiens
caaatattattcaagtgcctc

SEQ ID NO: 5979924 - DNA, 12 bp, Homo sapiens
caaatattattt

SEQ ID NO: 5979925 - DNA, 15 bp, Homo sapiens
caaatattcagaata

SEQ ID NO: 5979926 - DNA, 16 bp, Homo sapiens
caaatattcattttga

SEQ ID NO: 5979927 - DNA, 20 bp, Homo sapiens
caaatattctaaaaaagata

SEQ ID NO: 5979928 - DNA, 17 bp, Homo sapiens
caaatattgatctgtat

SEQ ID NO: 5979929 - DNA, 17 bp, Homo sapiens
caaatattgcttggact

SEQ ID NO: 5979930 - DNA, 21 bp, Homo sapiens
caaatattgttaccatgaaga

SEQ ID NO: 5979931 - DNA, 19 bp, Homo sapiens
caaatattgttcttcccat

SEQ ID NO: 5979932 - DNA, 22 bp, Homo sapiens
caaatattgttgacaactgtga

SEQ ID NO: 5979933 - DNA, 21 bp, Homo sapiens
caaatatttagatgtaatttt

SEQ ID NO: 5979934 - DNA, 21 bp, Homo sapiens
caaatatttatgacctcaaca

SEQ ID NO: 5979935 - DNA, 17 bp, Homo sapiens
caaatatttgatcactt

SEQ ID NO: 5979936 - DNA, 23 bp, Homo sapiens
caaatattttagaagctaatgta

SEQ ID NO: 5979937 - DNA, 21 bp, Homo sapiens
caaatattttgtcactgctgt

SEQ ID NO: 5979938 - DNA, 13 bp, Homo sapiens
caaatcaaaataa

SEQ ID NO: 5979939 - DNA, 14 bp, Homo sapiens
caaatcaaaataaa

SEQ ID NO: 5979940 - DNA, 19 bp, Homo sapiens
caaatcaaacacaacacaa

SEQ ID NO: 5979941 - DNA, 15 bp, Homo sapiens
caaatcaaagcagat

SEQ ID NO: 5979942 - DNA, 14 bp, Homo sapiens
caaatcaacagaag

SEQ ID NO: 5979943 - DNA, 19 bp, Homo sapiens
caaatcaacagaagcattt

SEQ ID NO: 5979944 - DNA, 19 bp, Homo sapiens
caaatcaaccccagactca

SEQ ID NO: 5979945 - DNA, 22 bp, Homo sapiens
caaatcaaccccagactcaaac

SEQ ID NO: 5979946 - DNA, 19 bp, Homo sapiens
caaatcaagagcattgctt

SEQ ID NO: 5979947 - DNA, 15 bp, Homo sapiens
caaatcaagcttcag

SEQ ID NO: 5979948 - DNA, 14 bp, Homo sapiens
caaatcaaggatct

SEQ ID NO: 5979949 - DNA, 21 bp, Homo sapiens
caaatcaagtttccaagcaaa

SEQ ID NO: 5979950 - DNA, 23 bp, Homo sapiens
caaatcaagtttccaagcaaatg

SEQ ID NO: 5979951 - DNA, 14 bp, Homo sapiens
caaatcaatacact

SEQ ID NO: 5979952 - DNA, 21 bp, Homo sapiens
caaatcacaaggatttctcta

SEQ ID NO: 5979953 - DNA, 15 bp, Homo sapiens
caaatcacacctctg

SEQ ID NO: 5979954 - DNA, 16 bp, Homo sapiens
caaatcacacctctgg

SEQ ID NO: 5979955 - DNA, 18 bp, Homo sapiens
caaatcacacctctgggc

SEQ ID NO: 5979956 - DNA, 15 bp, Homo sapiens
caaatcacatatttt

SEQ ID NO: 5979957 - DNA, 19 bp, Homo sapiens
caaatcacatattttaaaa

SEQ ID NO: 5979958 - DNA, 17 bp, Homo sapiens
caaatcactctgcaatg

SEQ ID NO: 5979959 - DNA, 15 bp, Homo sapiens
caaatcactgaactt

SEQ ID NO: 5979960 - DNA, 13 bp, Homo sapiens
caaatcagaaaac

SEQ ID NO: 5979961 - DNA, 16 bp, Homo sapiens
caaatcaggggccaga

SEQ ID NO: 5979962 - DNA, 13 bp, Homo sapiens
caaatcaggtaaa

SEQ ID NO: 5979963 - DNA, 19 bp, Homo sapiens
caaatcagtatattttctg

SEQ ID NO: 5979964 - DNA, 21 bp, Homo sapiens
caaatcagtatattttctgta

SEQ ID NO: 5979965 - DNA, 23 bp, Homo sapiens
caaatcagtcagtgcaaatgtca

SEQ ID NO: 5979966 - DNA, 13 bp, Homo sapiens
caaatcagtctca

SEQ ID NO: 5979967 - DNA, 18 bp, Homo sapiens
caaatcagtcttccttgt

SEQ ID NO: 5979968 - DNA, 15 bp, Homo sapiens
caaatcagtgatcta

SEQ ID NO: 5979969 - DNA, 22 bp, Homo sapiens
caaatcagtgatctatgtttgt

SEQ ID NO: 5979970 - DNA, 16 bp, Homo sapiens
caaatcagttagtttt

SEQ ID NO: 5979971 - DNA, 15 bp, Homo sapiens
caaatcataatgtat

SEQ ID NO: 5979972 - DNA, 14 bp, Homo sapiens
caaatcatcctgaa

SEQ ID NO: 5979973 - DNA, 22 bp, Homo sapiens
caaatcatgttttttctgcaat

SEQ ID NO: 5979974 - DNA, 18 bp, Homo sapiens
caaatcatttgtttaaaa

SEQ ID NO: 5979975 - DNA, 14 bp, Homo sapiens
caaatcattttgat

SEQ ID NO: 5979976 - DNA, 20 bp, Homo sapiens
caaatcattttgatgtatta

SEQ ID NO: 5979977 - DNA, 22 bp, Homo sapiens
caaatcattttgatgtattatt

SEQ ID NO: 5979978 - DNA, 15 bp, Homo sapiens
caaatccacaagcca

SEQ ID NO: 5979979 - DNA, 17 bp, Homo sapiens
caaatccactgacagat

SEQ ID NO: 5979980 - DNA, 14 bp, Homo sapiens
caaatccaggaccc

SEQ ID NO: 5979981 - DNA, 17 bp, Homo sapiens
caaatccaggaccctgc

SEQ ID NO: 5979982 - DNA, 20 bp, Homo sapiens
caaatccaggaccctgccag

SEQ ID NO: 5979983 - DNA, 21 bp, Homo sapiens
caaatccaggaccctgccagg

SEQ ID NO: 5979984 - DNA, 17 bp, Homo sapiens
caaatccaggactttgt

SEQ ID NO: 5979985 - DNA, 10 bp, Homo sapiens
caaatccagt

SEQ ID NO: 5979986 - DNA, 15 bp, Homo sapiens
caaatccagtgtgca

SEQ ID NO: 5979987 - DNA, 22 bp, Homo sapiens
caaatccatagcacaagataaa

SEQ ID NO: 5979988 - DNA, 16 bp, Homo sapiens
caaatccatccagaat

SEQ ID NO: 5979989 - DNA, 16 bp, Homo sapiens
caaatccatgtgtccc

SEQ ID NO: 5979990 - DNA, 19 bp, Homo sapiens
caaatcccttttatctatt

SEQ ID NO: 5979991 - DNA, 18 bp, Homo sapiens
caaatccgctctcttcct

SEQ ID NO: 5979992 - DNA, 21 bp, Homo sapiens
caaatcctatgtgattttaac

SEQ ID NO: 5979993 - DNA, 13 bp, Homo sapiens
caaatcctctcca

SEQ ID NO: 5979994 - DNA, 21 bp, Homo sapiens
caaatcctctgttttctctct

SEQ ID NO: 5979995 - DNA, 12 bp, Homo sapiens
caaatcctcttt

SEQ ID NO: 5979996 - DNA, 19 bp, Homo sapiens
caaatcctggaaggacaca

SEQ ID NO: 5979997 - DNA, 23 bp, Homo sapiens
caaatcctggaaggacacagtga

SEQ ID NO: 5979998 - DNA, 22 bp, Homo sapiens
caaatcctgggcatccccagcc

SEQ ID NO: 5979999 - DNA, 21 bp, Homo sapiens
caaatccttagatctggcatg

SEQ ID NO: 5980000 - DNA, 17 bp, Homo sapiens
caaatccttattgttca

SEQ ID NO: 5980001 - DNA, 18 bp, Homo sapiens
caaatccttccaaaaatt

SEQ ID NO: 5980002 - DNA, 14 bp, Homo sapiens
caaatccttggagt

SEQ ID NO: 5980003 - DNA, 19 bp, Homo sapiens
caaatcgatggcctggcct

SEQ ID NO: 5980004 - DNA, 20 bp, Homo sapiens
caaatcgatggcctggcctt

SEQ ID NO: 5980005 - DNA, 16 bp, Homo sapiens
caaatcgatttagtaa

SEQ ID NO: 5980006 - DNA, 16 bp, Homo sapiens
caaatcgtttatttca

SEQ ID NO: 5980007 - DNA, 18 bp, Homo sapiens
caaatctaatctcttatt

SEQ ID NO: 5980008 - DNA, 18 bp, Homo sapiens
caaatctaccactgtatg

SEQ ID NO: 5980009 - DNA, 17 bp, Homo sapiens
caaatctactgagccac

SEQ ID NO: 5980010 - DNA, 18 bp, Homo sapiens
caaatctactgagccacg

SEQ ID NO: 5980011 - DNA, 20 bp, Homo sapiens
caaatctactgagccacgga

SEQ ID NO: 5980012 - DNA, 17 bp, Homo sapiens
caaatctagaatttagt

SEQ ID NO: 5980013 - DNA, 19 bp, Homo sapiens
cacaggcagggcaggacca

SEQ ID NO: 5980014 - DNA, 22 bp, Homo sapiens
cacaggcagggcaggaccagcc

SEQ ID NO: 5980015 - DNA, 20 bp, Homo sapiens
cacaggcagggcctggctcc

SEQ ID NO: 5980016 - DNA, 12 bp, Homo sapiens
cacaggcaggta

SEQ ID NO: 5980017 - DNA, 16 bp, Homo sapiens
cacaggcaggtactgt

SEQ ID NO: 5980018 - DNA, 15 bp, Homo sapiens
cacaggcaggtccag

SEQ ID NO: 5980019 - DNA, 19 bp, Homo sapiens
cacaggcaggtccagggtt

SEQ ID NO: 5980020 - DNA, 20 bp, Homo sapiens
cacaggcagtccaggcctct

SEQ ID NO: 5980021 - DNA, 22 bp, Homo sapiens
cacaggcagtccaggcctctct

SEQ ID NO: 5980022 - DNA, 13 bp, Homo sapiens
cacaggcagtgca

SEQ ID NO: 5980023 - DNA, 23 bp, Homo sapiens
cacaggcagtgcatgtgaagcat

SEQ ID NO: 5980024 - DNA, 20 bp, Homo sapiens
cacaggcagttacttctgag

SEQ ID NO: 5980025 - DNA, 17 bp, Homo sapiens
cacaggcatagagtgac

SEQ ID NO: 5980026 - DNA, 17 bp, Homo sapiens
cacaggcatttcctggg

SEQ ID NO: 5980027 - DNA, 19 bp, Homo sapiens
cacaggcatttcctgggtg

SEQ ID NO: 5980028 - DNA, 20 bp, Homo sapiens
cacaggcatttcctgggtgg

SEQ ID NO: 5980029 - DNA, 18 bp, Homo sapiens
cacaggccaaatccttgg

SEQ ID NO: 5980030 - DNA, 18 bp, Homo sapiens
cacaggccaccctgtgca

SEQ ID NO: 5980031 - DNA, 12 bp, Homo sapiens
cacaggccactg

SEQ ID NO: 5980032 - DNA, 18 bp, Homo sapiens
cacaggccacttgctcag

SEQ ID NO: 5980033 - DNA, 13 bp, Homo sapiens
cacaggccagatg

SEQ ID NO: 5980034 - DNA, 14 bp, Homo sapiens
cacaggccagcccc

SEQ ID NO: 5980035 - DNA, 14 bp, Homo sapiens
cacaggccagcctt

SEQ ID NO: 5980036 - DNA, 20 bp, Homo sapiens
cacaggccaggggatctggg

SEQ ID NO: 5980037 - DNA, 18 bp, Homo sapiens
cacaggccattatgcctg

SEQ ID NO: 5980038 - DNA, 21 bp, Homo sapiens
cacaggcccccttgagtgggg

SEQ ID NO: 5980039 - DNA, 23 bp, Homo sapiens
cacaggcccgccctctgcctcct

SEQ ID NO: 5980040 - DNA, 16 bp, Homo sapiens
cacaggcccggctcca

SEQ ID NO: 5980041 - DNA, 13 bp, Homo sapiens
cacaggccctccc

SEQ ID NO: 5980042 - DNA, 16 bp, Homo sapiens
cacaggcccttcctct

SEQ ID NO: 5980043 - DNA, 18 bp, Homo sapiens
cacaggcccttcctctcc

SEQ ID NO: 5980044 - DNA, 21 bp, Homo sapiens
cacaggcccttcctctccact

SEQ ID NO: 5980045 - DNA, 18 bp, Homo sapiens
cacaggccctttcctcag

SEQ ID NO: 5980046 - DNA, 20 bp, Homo sapiens
cacaggccctttcctcaggc

SEQ ID NO: 5980047 - DNA, 12 bp, Homo sapiens
cacaggcctccc

SEQ ID NO: 5980048 - DNA, 13 bp, Homo sapiens
cacaggcctccct

SEQ ID NO: 5980049 - DNA, 16 bp, Homo sapiens
cacaggcctctgcctg

SEQ ID NO: 5980050 - DNA, 18 bp, Homo sapiens
cacaggcctctgcctgct

SEQ ID NO: 5980051 - DNA, 23 bp, Homo sapiens
cacaggcctgagatttcatctgc

SEQ ID NO: 5980052 - DNA, 20 bp, Homo sapiens
cacaggcctggcccagccag

SEQ ID NO: 5980053 - DNA, 22 bp, Homo sapiens
cacaggcctggcccagccagca

SEQ ID NO: 5980054 - DNA, 14 bp, Homo sapiens
cacaggcctggcct

SEQ ID NO: 5980055 - DNA, 15 bp, Homo sapiens
cacaggcctggcctc

SEQ ID NO: 5980056 - DNA, 21 bp, Homo sapiens
cacaggcctgtgtagctgtga

SEQ ID NO: 5980057 - DNA, 23 bp, Homo sapiens
cacaggcctgtgtagctgtgacc

SEQ ID NO: 5980058 - DNA, 20 bp, Homo sapiens
cacaggccttctgtggggct

SEQ ID NO: 5980059 - DNA, 13 bp, Homo sapiens
cacaggctcagca

SEQ ID NO: 5980060 - DNA, 19 bp, Homo sapiens
cacaggctcaggcaggggc

SEQ ID NO: 5980061 - DNA, 21 bp, Homo sapiens
cacaggctgaaatatccaccc

SEQ ID NO: 5980062 - DNA, 17 bp, Homo sapiens
cacaggctgagaactcg

SEQ ID NO: 5980063 - DNA, 17 bp, Homo sapiens
cacaggctgagtgcagg

SEQ ID NO: 5980064 - DNA, 21 bp, Homo sapiens
cacaggctgagtgcaggccca

SEQ ID NO: 5980065 - DNA, 20 bp, Homo sapiens
cacaggctgccccacccctc

SEQ ID NO: 5980066 - DNA, 14 bp, Homo sapiens
cacaggctgccgct

SEQ ID NO: 5980067 - DNA, 13 bp, Homo sapiens
cacaggctgggct

SEQ ID NO: 5980068 - DNA, 14 bp, Homo sapiens
cacaggctggtgtg

SEQ ID NO: 5980069 - DNA, 14 bp, Homo sapiens
cacaggctgtgcct

SEQ ID NO: 5980070 - DNA, 21 bp, Homo sapiens
cacaggcttacgctgctctcc

SEQ ID NO: 5980071 - DNA, 22 bp, Homo sapiens
cacaggcttatttttaaaataa

SEQ ID NO: 5980072 - DNA, 18 bp, Homo sapiens
cacaggcttctgagcagc

SEQ ID NO: 5980073 - DNA, 23 bp, Homo sapiens
cacagggaaagcatttaggagaa

SEQ ID NO: 5980074 - DNA, 16 bp, Homo sapiens
cacagggaaatgtgta

SEQ ID NO: 5980075 - DNA, 16 bp, Homo sapiens
cacagggaagggcttg

SEQ ID NO: 5980076 - DNA, 17 bp, Homo sapiens
cacagggaatggccaca

SEQ ID NO: 5980077 - DNA, 20 bp, Homo sapiens
cacagggaatggccacaaac

SEQ ID NO: 5980078 - DNA, 23 bp, Homo sapiens
cacagggaatggccacaaacctg

SEQ ID NO: 5980079 - DNA, 11 bp, Homo sapiens
cacagggacca

SEQ ID NO: 5980080 - DNA, 23 bp, Homo sapiens
cacagggaccagggccaccgcag

SEQ ID NO: 5980081 - DNA, 17 bp, Homo sapiens
cacagggacgacccggg

SEQ ID NO: 5980082 - DNA, 15 bp, Homo sapiens
cacagggagctccgt

SEQ ID NO: 5980083 - DNA, 21 bp, Homo sapiens
cacagggaggggatgatgact

SEQ ID NO: 5980084 - DNA, 20 bp, Homo sapiens
cacagggattctcacaatag

SEQ ID NO: 5980085 - DNA, 23 bp, Homo sapiens
cacagggcaaaatcgccataggc

SEQ ID NO: 5980086 - DNA, 17 bp, Homo sapiens
cacagggcaaggacaca

SEQ ID NO: 5980087 - DNA, 15 bp, Homo sapiens
cacagggcaccagag

SEQ ID NO: 5980088 - DNA, 16 bp, Homo sapiens
cacagggcaccagagg

SEQ ID NO: 5980089 - DNA, 17 bp, Homo sapiens
cacagggcagagccggg

SEQ ID NO: 5980090 - DNA, 19 bp, Homo sapiens
cacagggcagctgggccca

SEQ ID NO: 5980091 - DNA, 13 bp, Homo sapiens
cacagggcagggg

SEQ ID NO: 5980092 - DNA, 20 bp, Homo sapiens
cacagggcatgccccggcca

SEQ ID NO: 5980093 - DNA, 18 bp, Homo sapiens
cacagggcatgcctggcc

SEQ ID NO: 5980094 - DNA, 19 bp, Homo sapiens
cacagggccccagaaggca

SEQ ID NO: 5980095 - DNA, 22 bp, Homo sapiens
cacagggcccggccacacccag

SEQ ID NO: 5980096 - DNA, 14 bp, Homo sapiens
cacagggcctgact

SEQ ID NO: 5980097 - DNA, 14 bp, Homo sapiens
cacagggcctggcc

SEQ ID NO: 5980098 - DNA, 23 bp, Homo sapiens
cacagggcggtaccttgtgccca

SEQ ID NO: 5980099 - DNA, 13 bp, Homo sapiens
cacagggctaaga

SEQ ID NO: 5980100 - DNA, 16 bp, Homo sapiens
cacagggctcacaggg

SEQ ID NO: 5980101 - DNA, 23 bp, Homo sapiens
cacagggctctttgatggaccca

SEQ ID NO: 5980102 - DNA, 20 bp, Homo sapiens
cacagggcttgttttccaaa

SEQ ID NO: 5980103 - DNA, 19 bp, Homo sapiens
cacaggggaaaagaggagt

SEQ ID NO: 5980104 - DNA, 18 bp, Homo sapiens
cacaggggaaggaaataa

SEQ ID NO: 5980105 - DNA, 22 bp, Homo sapiens
cacaggggaaggaaataacatt

SEQ ID NO: 5980106 - DNA, 16 bp, Homo sapiens
cacaggggacacagct

SEQ ID NO: 5980107 - DNA, 16 bp, Homo sapiens
cacaggggacactgaa

SEQ ID NO: 5980108 - DNA, 17 bp, Homo sapiens
cacaggggacactgaac

SEQ ID NO: 5980109 - DNA, 22 bp, Homo sapiens
cacaggggcaaagaactgcccc

SEQ ID NO: 5980110 - DNA, 18 bp, Homo sapiens
cacaggggcaggcctggg

SEQ ID NO: 5980111 - DNA, 23 bp, Homo sapiens
cacaggggccaccacctttggct

SEQ ID NO: 5980112 - DNA, 18 bp, Homo sapiens
cacaggggccctgtacag

SEQ ID NO: 5980113 - DNA, 12 bp, Homo sapiens
cacaggggcctt

SEQ ID NO: 5980114 - DNA, 15 bp, Homo sapiens
cacaggggcggggca

SEQ ID NO: 5980115 - DNA, 19 bp, Homo sapiens
cacaggggcggggcaggaa

SEQ ID NO: 5980116 - DNA, 19 bp, Homo sapiens
cacagggggattctgagca

SEQ ID NO: 5980117 - DNA, 17 bp, Homo sapiens
cacagggtcccacagcc

SEQ ID NO: 5980118 - DNA, 21 bp, Homo sapiens
cacagggtccccgagtgccta

SEQ ID NO: 5980119 - DNA, 13 bp, Homo sapiens
cacagggtctgcc

SEQ ID NO: 5980120 - DNA, 17 bp, Homo sapiens
cacagggtctgcctcca

SEQ ID NO: 5980121 - DNA, 21 bp, Homo sapiens
cacagggtctgcctccagcca

SEQ ID NO: 5980122 - DNA, 16 bp, Homo sapiens
cacagggtctgctctt

SEQ ID NO: 5980123 - DNA, 14 bp, Homo sapiens
cacagggtgagcac

SEQ ID NO: 5980124 - DNA, 19 bp, Homo sapiens
cacagggtgagcactctgg

SEQ ID NO: 5980125 - DNA, 23 bp, Homo sapiens
cacagggtgagggccacctccac

SEQ ID NO: 5980126 - DNA, 15 bp, Homo sapiens
cacagggtgttggaa

SEQ ID NO: 5980127 - DNA, 23 bp, Homo sapiens
cacagggttgggcccagatctgg

SEQ ID NO: 5980128 - DNA, 22 bp, Homo sapiens
cacagggtttggcccaagtttc

SEQ ID NO: 5980129 - DNA, 16 bp, Homo sapiens
cacagggttttgtatt

SEQ ID NO: 5980130 - DNA, 16 bp, Homo sapiens
cacaggtacagcaaca

SEQ ID NO: 5980131 - DNA, 18 bp, Homo sapiens
cacaggtacagcaacagg

SEQ ID NO: 5980132 - DNA, 22 bp, Homo sapiens
cacaggtagcacagattttgaa

SEQ ID NO: 5980133 - DNA, 13 bp, Homo sapiens
cacaggtcaggct

SEQ ID NO: 5980134 - DNA, 14 bp, Homo sapiens
cacaggtcaggcta

SEQ ID NO: 5980135 - DNA, 17 bp, Homo sapiens
cacaggtcagggctcag

SEQ ID NO: 5980136 - DNA, 21 bp, Homo sapiens
cacaggtcagggctcagagtg

SEQ ID NO: 5980137 - DNA, 21 bp, Homo sapiens
cacaggtcaggggtgacacag

SEQ ID NO: 5980138 - DNA, 22 bp, Homo sapiens
cacaggtcaggggtgacacaga

SEQ ID NO: 5980139 - DNA, 13 bp, Homo sapiens
cacaggtccaagg

SEQ ID NO: 5980140 - DNA, 14 bp, Homo sapiens
cacaggtccaagga

SEQ ID NO: 5980141 - DNA, 15 bp, Homo sapiens
cacaggtccaaggac

SEQ ID NO: 5980142 - DNA, 16 bp, Homo sapiens
cacaggtccaaggaca

SEQ ID NO: 5980143 - DNA, 14 bp, Homo sapiens
cacaggtcccacct

SEQ ID NO: 5980144 - DNA, 21 bp, Homo sapiens
cacaggtcccacctccagccc

SEQ ID NO: 5980145 - DNA, 22 bp, Homo sapiens
cacaggtcccacctccagcccg

SEQ ID NO: 5980146 - DNA, 21 bp, Homo sapiens
cacaggtctcattgcttctga

SEQ ID NO: 5980147 - DNA, 17 bp, Homo sapiens
cacaggtgaggggcagg

SEQ ID NO: 5980148 - DNA, 15 bp, Homo sapiens
cacaggtgcccgcca

SEQ ID NO: 5980149 - DNA, 23 bp, Homo sapiens
cacaggtgccgccagctgccgca

SEQ ID NO: 5980150 - DNA, 21 bp, Homo sapiens
cacaggtgcgggaccatctga

SEQ ID NO: 5980151 - DNA, 17 bp, Homo sapiens
cacaggtggggactggg

SEQ ID NO: 5980152 - DNA, 13 bp, Homo sapiens
cacaggtgtaaat

SEQ ID NO: 5980153 - DNA, 14 bp, Homo sapiens
cacaggtgtcccca

SEQ ID NO: 5980154 - DNA, 20 bp, Homo sapiens
cacaggtgtccccagcccac

SEQ ID NO: 5980155 - DNA, 13 bp, Homo sapiens
cacaggtgtggga

SEQ ID NO: 5980156 - DNA, 16 bp, Homo sapiens
cacaggtgttccgtgg

SEQ ID NO: 5980157 - DNA, 14 bp, Homo sapiens
cacaggtgttgatt

SEQ ID NO: 5980158 - DNA, 15 bp, Homo sapiens
cacaggtgtttatac

SEQ ID NO: 5980159 - DNA, 16 bp, Homo sapiens
cacaggttcacccagc

SEQ ID NO: 5980160 - DNA, 19 bp, Homo sapiens
cacaggttcatgccaccat

SEQ ID NO: 5980161 - DNA, 20 bp, Homo sapiens
cacaggttccatagaactaa

SEQ ID NO: 5980162 - DNA, 18 bp, Homo sapiens
cacaggttggaagagaat

SEQ ID NO: 5980163 - DNA, 21 bp, Homo sapiens
cacaggttggaagagaatcac

SEQ ID NO: 5980164 - DNA, 15 bp, Homo sapiens
cacaggtttaaggct

SEQ ID NO: 5980165 - DNA, 20 bp, Homo sapiens
cacaggtttagttgactaat

SEQ ID NO: 5980166 - DNA, 24 bp, Homo sapiens
cacaggtttccccaaggcctctca

SEQ ID NO: 5980167 - DNA, 15 bp, Homo sapiens
cacaggtttgtttct

SEQ ID NO: 5980168 - DNA, 19 bp, Homo sapiens
cacaggttttagcattgtc

SEQ ID NO: 5980169 - DNA, 15 bp, Homo sapiens
cacagtaaaattaac

SEQ ID NO: 5980170 - DNA, 19 bp, Homo sapiens
cacagtaagataggttctg

SEQ ID NO: 5980171 - DNA, 20 bp, Homo sapiens
cacagtaatatgaaagccac

SEQ ID NO: 5980172 - DNA, 22 bp, Homo sapiens
cacagtaatctttcggtctcct

SEQ ID NO: 5980173 - DNA, 13 bp, Homo sapiens
cacagtacatatg

SEQ ID NO: 5980174 - DNA, 19 bp, Homo sapiens
cacagtacgaacctacagt

SEQ ID NO: 5980175 - DNA, 22 bp, Homo sapiens
cacagtactcactttttccaaa

SEQ ID NO: 5980176 - DNA, 17 bp, Homo sapiens
cacagtactttattgta

SEQ ID NO: 5980177 - DNA, 21 bp, Homo sapiens
cacagtactttattgtacaga

SEQ ID NO: 5980178 - DNA, 15 bp, Homo sapiens
cacagtactttccag

SEQ ID NO: 5980179 - DNA, 15 bp, Homo sapiens
cacagtagagccagc

SEQ ID NO: 5980180 - DNA, 21 bp, Homo sapiens
cacagtaggtcccggccagct

SEQ ID NO: 5980181 - DNA, 21 bp, Homo sapiens
cacagtagtgttctgttcact

SEQ ID NO: 5980182 - DNA, 13 bp, Homo sapiens
cacagtatctgct

SEQ ID NO: 5980183 - DNA, 14 bp, Homo sapiens
cacagtatctgctg

SEQ ID NO: 5980184 - DNA, 15 bp, Homo sapiens
cacagtatctgctgt

SEQ ID NO: 5980185 - DNA, 18 bp, Homo sapiens
cacagtatctgctgttct

SEQ ID NO: 5980186 - DNA, 21 bp, Homo sapiens
cacagtatctgctgttcttca

SEQ ID NO: 5980187 - DNA, 16 bp, Homo sapiens
cacagtattacttctg

SEQ ID NO: 5980188 - DNA, 18 bp, Homo sapiens
cacagtattacttctgct

SEQ ID NO: 5980189 - DNA, 21 bp, Homo sapiens
cacagtattacttctgctaca

SEQ ID NO: 5980190 - DNA, 15 bp, Homo sapiens
caaatctataaatat

SEQ ID NO: 5980191 - DNA, 19 bp, Homo sapiens
caaatctatattaaagtgt

SEQ ID NO: 5980192 - DNA, 20 bp, Homo sapiens
caaatctatattaaagtgtt

SEQ ID NO: 5980193 - DNA, 24 bp, Homo sapiens
caaatctattacttttgcaaactg

SEQ ID NO: 5980194 - DNA, 13 bp, Homo sapiens
caaatctattcag

SEQ ID NO: 5980195 - DNA, 17 bp, Homo sapiens
caaatctatttaattag

SEQ ID NO: 5980196 - DNA, 23 bp, Homo sapiens
caaatctatttaattaggaaaaa

SEQ ID NO: 5980197 - DNA, 11 bp, Homo sapiens
caaatctcagc

SEQ ID NO: 5980198 - DNA, 13 bp, Homo sapiens
caaatctcagcaa

SEQ ID NO: 5980199 - DNA, 20 bp, Homo sapiens
caaatctcagcaaagctaca

SEQ ID NO: 5980200 - DNA, 20 bp, Homo sapiens
caaatctcatacacaactgt

SEQ ID NO: 5980201 - DNA, 15 bp, Homo sapiens
caaatctctgttact

SEQ ID NO: 5980202 - DNA, 14 bp, Homo sapiens
caaatctgacatat

SEQ ID NO: 5980203 - DNA, 13 bp, Homo sapiens
caaatctgacttt

SEQ ID NO: 5980204 - DNA, 16 bp, Homo sapiens
caaatctgatggcctt

SEQ ID NO: 5980205 - DNA, 17 bp, Homo sapiens
caaatctgatttcatta

SEQ ID NO: 5980206 - DNA, 21 bp, Homo sapiens
caaatctgcctattgcagctg

SEQ ID NO: 5980207 - DNA, 17 bp, Homo sapiens
caaatctgctttcatcc

SEQ ID NO: 5980208 - DNA, 13 bp, Homo sapiens
caaatctggaagc

SEQ ID NO: 5980209 - DNA, 14 bp, Homo sapiens
caaatctgtaatta

SEQ ID NO: 5980210 - DNA, 12 bp, Homo sapiens
caaatctgtata

SEQ ID NO: 5980211 - DNA, 19 bp, Homo sapiens
caaatctgtataaatgtct

SEQ ID NO: 5980212 - DNA, 19 bp, Homo sapiens
caaatctgtcctctgtagt

SEQ ID NO: 5980213 - DNA, 12 bp, Homo sapiens
caaatctgtcta

SEQ ID NO: 5980214 - DNA, 13 bp, Homo sapiens
caaatctgtctgc

SEQ ID NO: 5980215 - DNA, 19 bp, Homo sapiens
caaatctgtgctacactgg

SEQ ID NO: 5980216 - DNA, 15 bp, Homo sapiens
caaatctgtgctctt

SEQ ID NO: 5980217 - DNA, 18 bp, Homo sapiens
caaatctgtgctctttca

SEQ ID NO: 5980218 - DNA, 12 bp, Homo sapiens
caaatcttcctc

SEQ ID NO: 5980219 - DNA, 22 bp, Homo sapiens
caaatcttcctggtcgaaagtt

SEQ ID NO: 5980220 - DNA, 19 bp, Homo sapiens
caaatcttgaaattaagaa

SEQ ID NO: 5980221 - DNA, 18 bp, Homo sapiens
caaatcttgaatttctgc

SEQ ID NO: 5980222 - DNA, 22 bp, Homo sapiens
caaatcttggttgatgccaaaa

SEQ ID NO: 5980223 - DNA, 22 bp, Homo sapiens
caaatcttgttattgaagtgtt

SEQ ID NO: 5980224 - DNA, 23 bp, Homo sapiens
caaatcttgtttacaaaatattc

SEQ ID NO: 5980225 - DNA, 21 bp, Homo sapiens
caaatgaaagagaaaatatat

SEQ ID NO: 5980226 - DNA, 15 bp, Homo sapiens
caaatgaaagcataa

SEQ ID NO: 5980227 - DNA, 19 bp, Homo sapiens
caaatgaaatatatttaaa

SEQ ID NO: 5980228 - DNA, 18 bp, Homo sapiens
caaatgaacttttacaga

SEQ ID NO: 5980229 - DNA, 19 bp, Homo sapiens
caaatgaagacaaaacata

SEQ ID NO: 5980230 - DNA, 22 bp, Homo sapiens
caaatgaagattcagcagtgtc

SEQ ID NO: 5980231 - DNA, 13 bp, Homo sapiens
caaatgaatcatt

SEQ ID NO: 5980232 - DNA, 15 bp, Homo sapiens
caaatgaatcattgt

SEQ ID NO: 5980233 - DNA, 12 bp, Homo sapiens
caaatgaatgag

SEQ ID NO: 5980234 - DNA, 22 bp, Homo sapiens
caaatgaatgattaaattatga

SEQ ID NO: 5980235 - DNA, 22 bp, Homo sapiens
caaatgaatgttgtctgtttgt

SEQ ID NO: 5980236 - DNA, 19 bp, Homo sapiens
caaatgaattctttaagga

SEQ ID NO: 5980237 - DNA, 18 bp, Homo sapiens
caaatgaatttatcattt

SEQ ID NO: 5980238 - DNA, 20 bp, Homo sapiens
caaatgaatttatcatttta

SEQ ID NO: 5980239 - DNA, 21 bp, Homo sapiens
caaatgaattttccacgcagt

SEQ ID NO: 5980240 - DNA, 18 bp, Homo sapiens
caaatgacagatcttttt

SEQ ID NO: 5980241 - DNA, 19 bp, Homo sapiens
caaatgacagattctgaca

SEQ ID NO: 5980242 - DNA, 16 bp, Homo sapiens
caaatgacagatttct

SEQ ID NO: 5980243 - DNA, 14 bp, Homo sapiens
caaatgacatgcac

SEQ ID NO: 5980244 - DNA, 16 bp, Homo sapiens
caaatgacatgcactg

SEQ ID NO: 5980245 - DNA, 17 bp, Homo sapiens
caaatgacatgcactga

SEQ ID NO: 5980246 - DNA, 17 bp, Homo sapiens
caaatgacccaaagacc

SEQ ID NO: 5980247 - DNA, 21 bp, Homo sapiens
caaatgaccgagccctggaga

SEQ ID NO: 5980248 - DNA, 11 bp, Homo sapiens
caaatgactac

SEQ ID NO: 5980249 - DNA, 14 bp, Homo sapiens
caaatgactttatt

SEQ ID NO: 5980250 - DNA, 20 bp, Homo sapiens
caaatgactttattatttat

SEQ ID NO: 5980251 - DNA, 17 bp, Homo sapiens
caaatgagacagcagtc

SEQ ID NO: 5980252 - DNA, 22 bp, Homo sapiens
caaatgagatgtatgcccaaag

SEQ ID NO: 5980253 - DNA, 16 bp, Homo sapiens
caaatgagcattagct

SEQ ID NO: 5980254 - DNA, 20 bp, Homo sapiens
caaatgagctctgaaatctt

SEQ ID NO: 5980255 - DNA, 14 bp, Homo sapiens
caaatgagtaacat

SEQ ID NO: 5980256 - DNA, 21 bp, Homo sapiens
caaatgagtttaaaaaaataa

SEQ ID NO: 5980257 - DNA, 23 bp, Homo sapiens
caaatgagtttaaaaaaataaca

SEQ ID NO: 5980258 - DNA, 17 bp, Homo sapiens
caaatgatagaaacaga

SEQ ID NO: 5980259 - DNA, 18 bp, Homo sapiens
caaatgatcctcccacct

SEQ ID NO: 5980260 - DNA, 14 bp, Homo sapiens
caaatgatccttcc

SEQ ID NO: 5980261 - DNA, 23 bp, Homo sapiens
caaatgatctagttcagaaggaa

SEQ ID NO: 5980262 - DNA, 21 bp, Homo sapiens
caaatgatgtgcctgcttcag

SEQ ID NO: 5980263 - DNA, 21 bp, Homo sapiens
caaatgattgcttttaaaatt

SEQ ID NO: 5980264 - DNA, 14 bp, Homo sapiens
caaatgatttcata

SEQ ID NO: 5980265 - DNA, 21 bp, Homo sapiens
caaatgcaaaaactctttgag

SEQ ID NO: 5980266 - DNA, 14 bp, Homo sapiens
caaatgcaaaatta

SEQ ID NO: 5980267 - DNA, 12 bp, Homo sapiens
caaatgcaaatt

SEQ ID NO: 5980268 - DNA, 15 bp, Homo sapiens
caaatgcaatttgat

SEQ ID NO: 5980269 - DNA, 18 bp, Homo sapiens
caaatgcacaagctcaga

SEQ ID NO: 5980270 - DNA, 16 bp, Homo sapiens
caaatgcagaatactt

SEQ ID NO: 5980271 - DNA, 14 bp, Homo sapiens
caaatgcagacaca

SEQ ID NO: 5980272 - DNA, 16 bp, Homo sapiens
caaatgcagacacaca

SEQ ID NO: 5980273 - DNA, 12 bp, Homo sapiens
caaatgcagctt

SEQ ID NO: 5980274 - DNA, 13 bp, Homo sapiens
caaatgcagcttt

SEQ ID NO: 5980275 - DNA, 16 bp, Homo sapiens
caaatgcatctttgat

SEQ ID NO: 5980276 - DNA, 18 bp, Homo sapiens
caaatgcatggtgcagtt

SEQ ID NO: 5980277 - DNA, 21 bp, Homo sapiens
caaatgccaaacactagctct

SEQ ID NO: 5980278 - DNA, 21 bp, Homo sapiens
caaatgccaactgttggaatt

SEQ ID NO: 5980279 - DNA, 16 bp, Homo sapiens
caaatgccagggcccg

SEQ ID NO: 5980280 - DNA, 12 bp, Homo sapiens
caaatgcctctg

SEQ ID NO: 5980281 - DNA, 15 bp, Homo sapiens
caaatgcctctgcct

SEQ ID NO: 5980282 - DNA, 14 bp, Homo sapiens
caaatgcctgccaa

SEQ ID NO: 5980283 - DNA, 23 bp, Homo sapiens
caaatgcctgttgtatttatgga

SEQ ID NO: 5980284 - DNA, 19 bp, Homo sapiens
caaatgccttaaaatggaa

SEQ ID NO: 5980285 - DNA, 12 bp, Homo sapiens
caaatgcctttt

SEQ ID NO: 5980286 - DNA, 16 bp, Homo sapiens
caaatgcgaacactat

SEQ ID NO: 5980287 - DNA, 15 bp, Homo sapiens
caaatgctaatgtca

SEQ ID NO: 5980288 - DNA, 15 bp, Homo sapiens
caaatgctactcagt

SEQ ID NO: 5980289 - DNA, 17 bp, Homo sapiens
caaatgctattaaagtg

SEQ ID NO: 5980290 - DNA, 18 bp, Homo sapiens
caaatgctctctcttctt

SEQ ID NO: 5980291 - DNA, 22 bp, Homo sapiens
caaatgctctctcttcttatta

SEQ ID NO: 5980292 - DNA, 22 bp, Homo sapiens
caaatgctctgtcttcaatgat

SEQ ID NO: 5980293 - DNA, 21 bp, Homo sapiens
caaatgctgacccatgcaata

SEQ ID NO: 5980294 - DNA, 18 bp, Homo sapiens
caaatgctgcgcccttcc

SEQ ID NO: 5980295 - DNA, 13 bp, Homo sapiens
caaatgctggggc

SEQ ID NO: 5980296 - DNA, 17 bp, Homo sapiens
caaatgctggggcaggg

SEQ ID NO: 5980297 - DNA, 22 bp, Homo sapiens
caaatgctggggtcatataaaa

SEQ ID NO: 5980298 - DNA, 13 bp, Homo sapiens
caaatgctgtctc

SEQ ID NO: 5980299 - DNA, 20 bp, Homo sapiens
caaatgctgtggttcactgc

SEQ ID NO: 5980300 - DNA, 14 bp, Homo sapiens
caaatgctttgtga

SEQ ID NO: 5980301 - DNA, 19 bp, Homo sapiens
caaatgcttttccaaccca

SEQ ID NO: 5980302 - DNA, 18 bp, Homo sapiens
caaatgctttttgtttta

SEQ ID NO: 5980303 - DNA, 22 bp, Homo sapiens
caaatgctttttgttttatttt

SEQ ID NO: 5980304 - DNA, 15 bp, Homo sapiens
caaatggaaaatgta

SEQ ID NO: 5980305 - DNA, 14 bp, Homo sapiens
caaatggaaaggag

SEQ ID NO: 5980306 - DNA, 21 bp, Homo sapiens
caaatggaaaggagaggaaag

SEQ ID NO: 5980307 - DNA, 20 bp, Homo sapiens
caaatggaaatgggcagagc

SEQ ID NO: 5980308 - DNA, 15 bp, Homo sapiens
caaatggaagacaca

SEQ ID NO: 5980309 - DNA, 14 bp, Homo sapiens
caaatggactggcc

SEQ ID NO: 5980310 - DNA, 12 bp, Homo sapiens
caaatggactgt

SEQ ID NO: 5980311 - DNA, 18 bp, Homo sapiens
caaatggagaagctgcag

SEQ ID NO: 5980312 - DNA, 22 bp, Homo sapiens
caaatggatgacacatttaatg

SEQ ID NO: 5980313 - DNA, 22 bp, Homo sapiens
caaatggattttgggagtgact

SEQ ID NO: 5980314 - DNA, 22 bp, Homo sapiens
caaatggcagcagttccatgaa

SEQ ID NO: 5980315 - DNA, 22 bp, Homo sapiens
caaatggcattgggctgagtaa

SEQ ID NO: 5980316 - DNA, 24 bp, Homo sapiens
caaatggccagttttctggtagga

SEQ ID NO: 5980317 - DNA, 18 bp, Homo sapiens
caaatggcgtctggaagt

SEQ ID NO: 5980318 - DNA, 21 bp, Homo sapiens
caaatggcgtctggaagtcca

SEQ ID NO: 5980319 - DNA, 22 bp, Homo sapiens
caaatggcgtctggaagtccaa

SEQ ID NO: 5980320 - DNA, 14 bp, Homo sapiens
caaatggctgcttt

SEQ ID NO: 5980321 - DNA, 20 bp, Homo sapiens
caaatgggactgatgtcatc

SEQ ID NO: 5980322 - DNA, 17 bp, Homo sapiens
caaatgggagctgagca

SEQ ID NO: 5980323 - DNA, 19 bp, Homo sapiens
caaatgggatggtatgtga

SEQ ID NO: 5980324 - DNA, 16 bp, Homo sapiens
caaatggggccagatc

SEQ ID NO: 5980325 - DNA, 23 bp, Homo sapiens
caaatggggccagatccagcctg

SEQ ID NO: 5980326 - DNA, 22 bp, Homo sapiens
caaatggggtttcacaaatagt

SEQ ID NO: 5980327 - DNA, 21 bp, Homo sapiens
caaatgggttaatcctgaatt

SEQ ID NO: 5980328 - DNA, 13 bp, Homo sapiens
caaatggtacaaa

SEQ ID NO: 5980329 - DNA, 15 bp, Homo sapiens
caaatggtaggcatt

SEQ ID NO: 5980330 - DNA, 22 bp, Homo sapiens
caaatggtggaggattgctgcc

SEQ ID NO: 5980331 - DNA, 22 bp, Homo sapiens
caaatggtggttgtttcttcca

SEQ ID NO: 5980332 - DNA, 18 bp, Homo sapiens
caaatggtgtcatggctg

SEQ ID NO: 5980333 - DNA, 13 bp, Homo sapiens
caaatggttctta

SEQ ID NO: 5980334 - DNA, 15 bp, Homo sapiens
caaatggttcttact

SEQ ID NO: 5980335 - DNA, 13 bp, Homo sapiens
caaatgtaaaata

SEQ ID NO: 5980336 - DNA, 16 bp, Homo sapiens
caaatgtaaaatattt

SEQ ID NO: 5980337 - DNA, 17 bp, Homo sapiens
caaatgtaaaatattta

SEQ ID NO: 5980338 - DNA, 18 bp, Homo sapiens
caaatgtaaaatatttat

SEQ ID NO: 5980339 - DNA, 13 bp, Homo sapiens
caaatgtaaaatt

SEQ ID NO: 5980340 - DNA, 17 bp, Homo sapiens
caaatgtaaacattttc

SEQ ID NO: 5980341 - DNA, 13 bp, Homo sapiens
caaatgtaaagtc

SEQ ID NO: 5980342 - DNA, 13 bp, Homo sapiens
caaatgtaaatca

SEQ ID NO: 5980343 - DNA, 14 bp, Homo sapiens
caaatgtaaatcaa

SEQ ID NO: 5980344 - DNA, 23 bp, Homo sapiens
caaatgtacatctcccctttgct

SEQ ID NO: 5980345 - DNA, 14 bp, Homo sapiens
caaatgtattaatg

SEQ ID NO: 5980346 - DNA, 13 bp, Homo sapiens
caaatgtattgat

SEQ ID NO: 5980347 - DNA, 17 bp, Homo sapiens
caaatgtattgattaca

SEQ ID NO: 5980348 - DNA, 12 bp, Homo sapiens
caaatgtatttt

SEQ ID NO: 5980349 - DNA, 19 bp, Homo sapiens
caaatgtcagatacaatgt

SEQ ID NO: 5980350 - DNA, 17 bp, Homo sapiens
caaatgtcagcttaaaa

SEQ ID NO: 5980351 - DNA, 21 bp, Homo sapiens
caaatgtcattatgtagaaat

SEQ ID NO: 5980352 - DNA, 13 bp, Homo sapiens
caaatgtcattgt

SEQ ID NO: 5980353 - DNA, 15 bp, Homo sapiens
caaatgtcattgtct

SEQ ID NO: 5980354 - DNA, 16 bp, Homo sapiens
caaatgtcatttcata

SEQ ID NO: 5980355 - DNA, 18 bp, Homo sapiens
caaatgtcatttcataca

SEQ ID NO: 5980356 - DNA, 21 bp, Homo sapiens
caaatgtcatttcatacaaat

SEQ ID NO: 5980357 - DNA, 23 bp, Homo sapiens
caaatgtccaagcatcagcaaga

SEQ ID NO: 5980358 - DNA, 15 bp, Homo sapiens
caaatgtcctcagag

SEQ ID NO: 5980359 - DNA, 16 bp, Homo sapiens
caaatgtcctttctca

SEQ ID NO: 5980360 - DNA, 20 bp, Homo sapiens
caaatgtcctttctcagagg

SEQ ID NO: 5980361 - DNA, 20 bp, Homo sapiens
caaatgtcggggttggggtg

SEQ ID NO: 5980362 - DNA, 22 bp, Homo sapiens
caaatgtcggggttggggtggg

SEQ ID NO: 5980363 - DNA, 18 bp, Homo sapiens
caaatgtcttaaagggaa

SEQ ID NO: 5980364 - DNA, 13 bp, Homo sapiens
caaatgtcttcca

SEQ ID NO: 5980365 - DNA, 15 bp, Homo sapiens
caaatgtcttcctgg

SEQ ID NO: 5980366 - DNA, 24 bp, Homo sapiens
caaatgtcttttagaagatagatg

SEQ ID NO: 5980367 - DNA, 13 bp, Homo sapiens
caaatgtgaaaga

SEQ ID NO: 5980368 - DNA, 17 bp, Homo sapiens
caaatgtgaagatgcat

SEQ ID NO: 5980369 - DNA, 13 bp, Homo sapiens
cacagtattatct

SEQ ID NO: 5980370 - DNA, 23 bp, Homo sapiens
cacagtattatttctccatcccc

SEQ ID NO: 5980371 - DNA, 20 bp, Homo sapiens
cacagtattcgtgaataagt

SEQ ID NO: 5980372 - DNA, 19 bp, Homo sapiens
cacagtattgctcacccag

SEQ ID NO: 5980373 - DNA, 14 bp, Homo sapiens
cacagtattgtaga

SEQ ID NO: 5980374 - DNA, 18 bp, Homo sapiens
cacagtattgtagaaagc

SEQ ID NO: 5980375 - DNA, 15 bp, Homo sapiens
cacagtatttaacat

SEQ ID NO: 5980376 - DNA, 17 bp, Homo sapiens
cacagtcaaaataattc

SEQ ID NO: 5980377 - DNA, 19 bp, Homo sapiens
cacagtcaaatttacattt

SEQ ID NO: 5980378 - DNA, 16 bp, Homo sapiens
cacagtcactgatgta

SEQ ID NO: 5980379 - DNA, 14 bp, Homo sapiens
cacagtcactggat

SEQ ID NO: 5980380 - DNA, 19 bp, Homo sapiens
cacagtcacttgggagctg

SEQ ID NO: 5980381 - DNA, 20 bp, Homo sapiens
cacagtcagcatgcttccca

SEQ ID NO: 5980382 - DNA, 22 bp, Homo sapiens
cacagtcagcatgcttcccaga

SEQ ID NO: 5980383 - DNA, 14 bp, Homo sapiens
cacagtcaggttga

SEQ ID NO: 5980384 - DNA, 17 bp, Homo sapiens
cacagtcaggttgaaga

SEQ ID NO: 5980385 - DNA, 16 bp, Homo sapiens
cacagtcatgtgtcag

SEQ ID NO: 5980386 - DNA, 20 bp, Homo sapiens
cacagtcattcacatcactg

SEQ ID NO: 5980387 - DNA, 19 bp, Homo sapiens
cacagtccagacccaagtc

SEQ ID NO: 5980388 - DNA, 13 bp, Homo sapiens
cacagtccaggaa

SEQ ID NO: 5980389 - DNA, 11 bp, Homo sapiens
cacagtcccag

SEQ ID NO: 5980390 - DNA, 16 bp, Homo sapiens
cacagtccccagactc

SEQ ID NO: 5980391 - DNA, 19 bp, Homo sapiens
cacagtcccccacccacct

SEQ ID NO: 5980392 - DNA, 14 bp, Homo sapiens
cacagtcctcacag

SEQ ID NO: 5980393 - DNA, 21 bp, Homo sapiens
cacagtccttaccagcagagc

SEQ ID NO: 5980394 - DNA, 16 bp, Homo sapiens
cacagtctaattttta

SEQ ID NO: 5980395 - DNA, 15 bp, Homo sapiens
cacagtctatttttt

SEQ ID NO: 5980396 - DNA, 17 bp, Homo sapiens
cacagtctcagtccaga

SEQ ID NO: 5980397 - DNA, 19 bp, Homo sapiens
cacagtctcagtccagatg

SEQ ID NO: 5980398 - DNA, 21 bp, Homo sapiens
cacagtctcagtccagatgcc

SEQ ID NO: 5980399 - DNA, 15 bp, Homo sapiens
cacagtctcagttct

SEQ ID NO: 5980400 - DNA, 14 bp, Homo sapiens
cacagtctctctct

SEQ ID NO: 5980401 - DNA, 14 bp, Homo sapiens
cacagtctctggga

SEQ ID NO: 5980402 - DNA, 16 bp, Homo sapiens
cacagtcttcccagca

SEQ ID NO: 5980403 - DNA, 23 bp, Homo sapiens
cacagtcttgtgaactttgaatg

SEQ ID NO: 5980404 - DNA, 22 bp, Homo sapiens
cacagtgaaggctgtccttacc

SEQ ID NO: 5980405 - DNA, 20 bp, Homo sapiens
cacagtgaatgtgtgtatgt

SEQ ID NO: 5980406 - DNA, 15 bp, Homo sapiens
cacagtgacactgga

SEQ ID NO: 5980407 - DNA, 16 bp, Homo sapiens
cacagtgacagtcact

SEQ ID NO: 5980408 - DNA, 20 bp, Homo sapiens
cacagtgactcgggctcctg

SEQ ID NO: 5980409 - DNA, 21 bp, Homo sapiens
cacagtgactcgggctcctgt

SEQ ID NO: 5980410 - DNA, 22 bp, Homo sapiens
cacagtgactcgggctcctgtg

SEQ ID NO: 5980411 - DNA, 23 bp, Homo sapiens
cacagtgactcgggctcctgtgc

SEQ ID NO: 5980412 - DNA, 17 bp, Homo sapiens
cacagtgactgggccct

SEQ ID NO: 5980413 - DNA, 18 bp, Homo sapiens
cacagtgactgggccctg

SEQ ID NO: 5980414 - DNA, 20 bp, Homo sapiens
cacagtgactgggccctgtc

SEQ ID NO: 5980415 - DNA, 22 bp, Homo sapiens
cacagtgactgggccctgtcca

SEQ ID NO: 5980416 - DNA, 16 bp, Homo sapiens
cacagtgacttctgag

SEQ ID NO: 5980417 - DNA, 17 bp, Homo sapiens
cacagtgacttctgaga

SEQ ID NO: 5980418 - DNA, 19 bp, Homo sapiens
cacagtgagactgtacata

SEQ ID NO: 5980419 - DNA, 21 bp, Homo sapiens
cacagtgagactgtacataat

SEQ ID NO: 5980420 - DNA, 23 bp, Homo sapiens
cacagtgagaggggagggctcct

SEQ ID NO: 5980421 - DNA, 21 bp, Homo sapiens
cacagtgagagtactcacttt

SEQ ID NO: 5980422 - DNA, 15 bp, Homo sapiens
cacagtgagctgatg

SEQ ID NO: 5980423 - DNA, 18 bp, Homo sapiens
cacagtgagtcgaggaca

SEQ ID NO: 5980424 - DNA, 21 bp, Homo sapiens
cacagtgagtcgaggacaggg

SEQ ID NO: 5980425 - DNA, 17 bp, Homo sapiens
cacagtgataccagttc

SEQ ID NO: 5980426 - DNA, 18 bp, Homo sapiens
cacagtgatatatttcta

SEQ ID NO: 5980427 - DNA, 23 bp, Homo sapiens
cacagtgatgccgggcgccagga

SEQ ID NO: 5980428 - DNA, 11 bp, Homo sapiens
cacagtgattt

SEQ ID NO: 5980429 - DNA, 16 bp, Homo sapiens
cacagtgcagcttgca

SEQ ID NO: 5980430 - DNA, 12 bp, Homo sapiens
cacagtgcagtt

SEQ ID NO: 5980431 - DNA, 14 bp, Homo sapiens
cacagtgcatctca

SEQ ID NO: 5980432 - DNA, 18 bp, Homo sapiens
cacagtgcattatgtaca

SEQ ID NO: 5980433 - DNA, 18 bp, Homo sapiens
cacagtgccaccaagctc

SEQ ID NO: 5980434 - DNA, 16 bp, Homo sapiens
cacagtgccccagtgg

SEQ ID NO: 5980435 - DNA, 13 bp, Homo sapiens
cacagtgccccct

SEQ ID NO: 5980436 - DNA, 12 bp, Homo sapiens
cacagtgcctga

SEQ ID NO: 5980437 - DNA, 16 bp, Homo sapiens
cacagtgcctggccca

SEQ ID NO: 5980438 - DNA, 17 bp, Homo sapiens
cacagtgcctgtacagg

SEQ ID NO: 5980439 - DNA, 20 bp, Homo sapiens
cacagtgcctgtacaggaag

SEQ ID NO: 5980440 - DNA, 16 bp, Homo sapiens
cacagtgctcttttct

SEQ ID NO: 5980441 - DNA, 11 bp, Homo sapiens
cacagtgctgc

SEQ ID NO: 5980442 - DNA, 13 bp, Homo sapiens
cacagtgctgccc

SEQ ID NO: 5980443 - DNA, 19 bp, Homo sapiens
cacagtgctgccccttgca

SEQ ID NO: 5980444 - DNA, 12 bp, Homo sapiens
cacagtgctgct

SEQ ID NO: 5980445 - DNA, 13 bp, Homo sapiens
cacagtgctgctt

SEQ ID NO: 5980446 - DNA, 15 bp, Homo sapiens
cacagtgctgcttct

SEQ ID NO: 5980447 - DNA, 22 bp, Homo sapiens
cacagtgctttccgtggcactg

SEQ ID NO: 5980448 - DNA, 13 bp, Homo sapiens
cacagtggaacca

SEQ ID NO: 5980449 - DNA, 17 bp, Homo sapiens
cacagtggactcagcag

SEQ ID NO: 5980450 - DNA, 21 bp, Homo sapiens
cacagtggactcagcagtgac

SEQ ID NO: 5980451 - DNA, 16 bp, Homo sapiens
cacagtggagagggct

SEQ ID NO: 5980452 - DNA, 22 bp, Homo sapiens
cacagtggatggacggacaaga

SEQ ID NO: 5980453 - DNA, 20 bp, Homo sapiens
cacagtggcgagaggagagg

SEQ ID NO: 5980454 - DNA, 20 bp, Homo sapiens
cacagtggcgggcccactca

SEQ ID NO: 5980455 - DNA, 15 bp, Homo sapiens
cacagtggctcacgc

SEQ ID NO: 5980456 - DNA, 13 bp, Homo sapiens
cacagtgggaact

SEQ ID NO: 5980457 - DNA, 14 bp, Homo sapiens
cacagtgggaactc

SEQ ID NO: 5980458 - DNA, 19 bp, Homo sapiens
cacagtgggaactctgaca

SEQ ID NO: 5980459 - DNA, 17 bp, Homo sapiens
cacagtgggaagatttt

SEQ ID NO: 5980460 - DNA, 14 bp, Homo sapiens
cacagtgggagcca

SEQ ID NO: 5980461 - DNA, 14 bp, Homo sapiens
cacagtgggagctg

SEQ ID NO: 5980462 - DNA, 17 bp, Homo sapiens
cacagtgggagctgagc

SEQ ID NO: 5980463 - DNA, 19 bp, Homo sapiens
cacagtgggagctgagctg

SEQ ID NO: 5980464 - DNA, 15 bp, Homo sapiens
cacagtgggccggcc

SEQ ID NO: 5980465 - DNA, 20 bp, Homo sapiens
cacagtgggcctgtgtgtgt

SEQ ID NO: 5980466 - DNA, 14 bp, Homo sapiens
cacagtgggcggct

SEQ ID NO: 5980467 - DNA, 16 bp, Homo sapiens
cacagtgggcggcttc

SEQ ID NO: 5980468 - DNA, 17 bp, Homo sapiens
cacagtggggctgcagg

SEQ ID NO: 5980469 - DNA, 22 bp, Homo sapiens
cacagtggggctgcaggcaggc

SEQ ID NO: 5980470 - DNA, 17 bp, Homo sapiens
cacagtgggtggcacct

SEQ ID NO: 5980471 - DNA, 18 bp, Homo sapiens
cacagtgggtggcacctc

SEQ ID NO: 5980472 - DNA, 18 bp, Homo sapiens
cacagtggtgaccccctt

SEQ ID NO: 5980473 - DNA, 17 bp, Homo sapiens
cacagtggtggcagggc

SEQ ID NO: 5980474 - DNA, 23 bp, Homo sapiens
cacagtggtggcagggcctagct

SEQ ID NO: 5980475 - DNA, 16 bp, Homo sapiens
cacagtggttcctggc

SEQ ID NO: 5980476 - DNA, 18 bp, Homo sapiens
cacagtgtaccattaaaa

SEQ ID NO: 5980477 - DNA, 21 bp, Homo sapiens
cacagtgtaccattaaaatat

SEQ ID NO: 5980478 - DNA, 18 bp, Homo sapiens
cacagtgtcactggtcag

SEQ ID NO: 5980479 - DNA, 16 bp, Homo sapiens
cacagtgtctgggctg

SEQ ID NO: 5980480 - DNA, 20 bp, Homo sapiens
cacagtgtctgggctgactg

SEQ ID NO: 5980481 - DNA, 15 bp, Homo sapiens
cacagtgtctgtaaa

SEQ ID NO: 5980482 - DNA, 16 bp, Homo sapiens
cacagtgtctgtaaat

SEQ ID NO: 5980483 - DNA, 23 bp, Homo sapiens
cacagtgtgaagacactgtgcag

SEQ ID NO: 5980484 - DNA, 22 bp, Homo sapiens
cacagtgtgaataaagtgctgc

SEQ ID NO: 5980485 - DNA, 14 bp, Homo sapiens
cacagtgtgagccc

SEQ ID NO: 5980486 - DNA, 14 bp, Homo sapiens
cacagtgtgatttt

SEQ ID NO: 5980487 - DNA, 12 bp, Homo sapiens
cacagtgtgtga

SEQ ID NO: 5980488 - DNA, 23 bp, Homo sapiens
cacagtgtgtggtcaacatttct

SEQ ID NO: 5980489 - DNA, 17 bp, Homo sapiens
cacagtgttatgctctg

SEQ ID NO: 5980490 - DNA, 14 bp, Homo sapiens
cacagtgttgccca

SEQ ID NO: 5980491 - DNA, 16 bp, Homo sapiens
cacagtgttggaggtt

SEQ ID NO: 5980492 - DNA, 17 bp, Homo sapiens
cacagtgttggcgagag

SEQ ID NO: 5980493 - DNA, 15 bp, Homo sapiens
cacagtgtttcaatt

SEQ ID NO: 5980494 - DNA, 20 bp, Homo sapiens
cacagtgtttcaattctgta

SEQ ID NO: 5980495 - DNA, 17 bp, Homo sapiens
cacagtgtttcctgagt

SEQ ID NO: 5980496 - DNA, 23 bp, Homo sapiens
cacagtgtttcctgagtagcagt

SEQ ID NO: 5980497 - DNA, 17 bp, Homo sapiens
cacagttatcttagctg

SEQ ID NO: 5980498 - DNA, 19 bp, Homo sapiens
cacagttattaattaaaga

SEQ ID NO: 5980499 - DNA, 20 bp, Homo sapiens
cacagttcagtggcagggct

SEQ ID NO: 5980500 - DNA, 14 bp, Homo sapiens
cacagttcatttaa

SEQ ID NO: 5980501 - DNA, 22 bp, Homo sapiens
cacagttccctttatttcacat

SEQ ID NO: 5980502 - DNA, 16 bp, Homo sapiens
cacagttctatttgct

SEQ ID NO: 5980503 - DNA, 14 bp, Homo sapiens
cacagttctctcct

SEQ ID NO: 5980504 - DNA, 20 bp, Homo sapiens
cacagttcttaatacaggag

SEQ ID NO: 5980505 - DNA, 23 bp, Homo sapiens
cacagttcttaatacaggagacc

SEQ ID NO: 5980506 - DNA, 18 bp, Homo sapiens
cacagttcttggtgactg

SEQ ID NO: 5980507 - DNA, 22 bp, Homo sapiens
cacagttcttggtgactgtccc

SEQ ID NO: 5980508 - DNA, 19 bp, Homo sapiens
cacagttctttgggccaga

SEQ ID NO: 5980509 - DNA, 20 bp, Homo sapiens
cacagttctttgggccagac

SEQ ID NO: 5980510 - DNA, 19 bp, Homo sapiens
cacagttgaccctattttt

SEQ ID NO: 5980511 - DNA, 20 bp, Homo sapiens
cacagttgaccctatttttt

SEQ ID NO: 5980512 - DNA, 22 bp, Homo sapiens
cacagttggctggatgaaattt

SEQ ID NO: 5980513 - DNA, 21 bp, Homo sapiens
cacagttggtggggtcctgcc

SEQ ID NO: 5980514 - DNA, 17 bp, Homo sapiens
cacagttgtaccattca

SEQ ID NO: 5980515 - DNA, 13 bp, Homo sapiens
cacagttgtgttc

SEQ ID NO: 5980516 - DNA, 20 bp, Homo sapiens
cacagttgtgttcatgctga

SEQ ID NO: 5980517 - DNA, 23 bp, Homo sapiens
cacagttgtgttcctgacactca

SEQ ID NO: 5980518 - DNA, 23 bp, Homo sapiens
cacagttgttgaatgactgaccc

SEQ ID NO: 5980519 - DNA, 13 bp, Homo sapiens
cacagtttagaac

SEQ ID NO: 5980520 - DNA, 16 bp, Homo sapiens
cacagtttagaacaga

SEQ ID NO: 5980521 - DNA, 13 bp, Homo sapiens
cacagtttcaggc

SEQ ID NO: 5980522 - DNA, 18 bp, Homo sapiens
cacagtttcaggctttta

SEQ ID NO: 5980523 - DNA, 19 bp, Homo sapiens
cacagtttcttccattccc

SEQ ID NO: 5980524 - DNA, 14 bp, Homo sapiens
cacagtttcttctg

SEQ ID NO: 5980525 - DNA, 18 bp, Homo sapiens
cacagtttcttctgtaaa

SEQ ID NO: 5980526 - DNA, 15 bp, Homo sapiens
cacagtttgaaataa

SEQ ID NO: 5980527 - DNA, 23 bp, Homo sapiens
cacagtttgcaatcttatgttga

SEQ ID NO: 5980528 - DNA, 13 bp, Homo sapiens
cacagttttaata

SEQ ID NO: 5980529 - DNA, 21 bp, Homo sapiens
cacagttttagttggtgctga

SEQ ID NO: 5980530 - DNA, 21 bp, Homo sapiens
cacagttttctggctggagcc

SEQ ID NO: 5980531 - DNA, 21 bp, Homo sapiens
cacagttttgaaagaaaaata

SEQ ID NO: 5980532 - DNA, 22 bp, Homo sapiens
cacagttttgaaagaaaaatac

SEQ ID NO: 5980533 - DNA, 19 bp, Homo sapiens
cacagttttggttgcttta

SEQ ID NO: 5980534 - DNA, 23 bp, Homo sapiens
cacagtttttggttcctcttttc

SEQ ID NO: 5980535 - DNA, 21 bp, Homo sapiens
cacagtttttgtaaagccctt

SEQ ID NO: 5980536 - DNA, 23 bp, Homo sapiens
cacataaaaaagaagcactttga

SEQ ID NO: 5980537 - DNA, 14 bp, Homo sapiens
cacataaaagaaga

SEQ ID NO: 5980538 - DNA, 22 bp, Homo sapiens
cacataaacaattcatgccttt

SEQ ID NO: 5980539 - DNA, 21 bp, Homo sapiens
cacataaacacttctccttaa

SEQ ID NO: 5980540 - DNA, 22 bp, Homo sapiens
cacataaacacttctccttaac

SEQ ID NO: 5980541 - DNA, 12 bp, Homo sapiens
cacataaaccaa

SEQ ID NO: 5980542 - DNA, 13 bp, Homo sapiens
cacataaaggtat

SEQ ID NO: 5980543 - DNA, 19 bp, Homo sapiens
cacataaatctgtctgatt

SEQ ID NO: 5980544 - DNA, 16 bp, Homo sapiens
cacataaatgaaagaa

SEQ ID NO: 5980545 - DNA, 15 bp, Homo sapiens
cacataaatgcagcc

SEQ ID NO: 5980546 - DNA, 18 bp, Homo sapiens
cacataaatgcagcccat

SEQ ID NO: 5980547 - DNA, 18 bp, Homo sapiens
cacataacaaagggcagc

SEQ ID NO: 5980548 - DNA, 12 bp, Homo sapiens
cacataagcata

SEQ ID NO: 5980549 - DNA, 21 bp, Homo sapiens
cacataagccaaaactgagca

SEQ ID NO: 5980550 - DNA, 19 bp, Homo sapiens
cacataagctcagaatcca

SEQ ID NO: 5980551 - DNA, 22 bp, Homo sapiens
cacataaggacgtgtgtaaata

SEQ ID NO: 5980552 - DNA, 22 bp, Homo sapiens
cacataattcaggaagcagctt

SEQ ID NO: 5980553 - DNA, 22 bp, Homo sapiens
cacatacaaaaaaaatctttaa

SEQ ID NO: 5980554 - DNA, 22 bp, Homo sapiens
cacatacaacacaaagagaaaa

SEQ ID NO: 5980555 - DNA, 16 bp, Homo sapiens
cacatacaatttgcac

SEQ ID NO: 5980556 - DNA, 17 bp, Homo sapiens
cacatacacacacacgc

SEQ ID NO: 5980557 - DNA, 15 bp, Homo sapiens
cacatacacacatat

SEQ ID NO: 5980558 - DNA, 13 bp, Homo sapiens
cacatacactgca

SEQ ID NO: 5980559 - DNA, 15 bp, Homo sapiens
cacatacagaaagaa

SEQ ID NO: 5980560 - DNA, 14 bp, Homo sapiens
cacatacagatggt

SEQ ID NO: 5980561 - DNA, 16 bp, Homo sapiens
cacatacaggtgctca

SEQ ID NO: 5980562 - DNA, 13 bp, Homo sapiens
cacatacagtttt

SEQ ID NO: 5980563 - DNA, 14 bp, Homo sapiens
cacatacagtttta

SEQ ID NO: 5980564 - DNA, 16 bp, Homo sapiens
cacatacagttttatg

SEQ ID NO: 5980565 - DNA, 17 bp, Homo sapiens
cacatacagttttatgc

SEQ ID NO: 5980566 - DNA, 23 bp, Homo sapiens
cacatacagttttatgctctttt

SEQ ID NO: 5980567 - DNA, 12 bp, Homo sapiens
cacatacataca

SEQ ID NO: 5980568 - DNA, 13 bp, Homo sapiens
cacatacatacac

SEQ ID NO: 5980569 - DNA, 15 bp, Homo sapiens
cacatacatacatac

SEQ ID NO: 5980570 - DNA, 17 bp, Homo sapiens
cacatacatagatcttc

SEQ ID NO: 5980571 - DNA, 12 bp, Homo sapiens
cacatacattaa

SEQ ID NO: 5980572 - DNA, 15 bp, Homo sapiens
cacatacattaaaac

SEQ ID NO: 5980573 - DNA, 17 bp, Homo sapiens
cacatacattaaaacta

SEQ ID NO: 5980574 - DNA, 21 bp, Homo sapiens
cacataccaactcaacttttt

SEQ ID NO: 5980575 - DNA, 13 bp, Homo sapiens
cacataccctccc

SEQ ID NO: 5980576 - DNA, 16 bp, Homo sapiens
cacataccctgacctg

SEQ ID NO: 5980577 - DNA, 18 bp, Homo sapiens
cacataccctgacctggc

SEQ ID NO: 5980578 - DNA, 14 bp, Homo sapiens
cacatacctctctg

SEQ ID NO: 5980579 - DNA, 18 bp, Homo sapiens
cacatacggcagacctct

SEQ ID NO: 5980580 - DNA, 18 bp, Homo sapiens
cacatacgtgcacagggt

SEQ ID NO: 5980581 - DNA, 19 bp, Homo sapiens
cacatactacctagaagta

SEQ ID NO: 5980582 - DNA, 15 bp, Homo sapiens
cacatactagaaagc

SEQ ID NO: 5980583 - DNA, 16 bp, Homo sapiens
cacatacttgagactg

SEQ ID NO: 5980584 - DNA, 16 bp, Homo sapiens
cacatagactgtgcgc

SEQ ID NO: 5980585 - DNA, 14 bp, Homo sapiens
cacatagagatatg

SEQ ID NO: 5980586 - DNA, 15 bp, Homo sapiens
cacatagagatcatc

SEQ ID NO: 5980587 - DNA, 13 bp, Homo sapiens
cacatagagcttt

SEQ ID NO: 5980588 - DNA, 16 bp, Homo sapiens
cacatagattcacctg

SEQ ID NO: 5980589 - DNA, 22 bp, Homo sapiens
cacatagattcacctgtaaaac

SEQ ID NO: 5980590 - DNA, 13 bp, Homo sapiens
cacatagatttct

SEQ ID NO: 5980591 - DNA, 17 bp, Homo sapiens
cacatagcataggctgg

SEQ ID NO: 5980592 - DNA, 20 bp, Homo sapiens
cacatagcataggctgggga

SEQ ID NO: 5980593 - DNA, 20 bp, Homo sapiens
cacatagcccacttacattt

SEQ ID NO: 5980594 - DNA, 13 bp, Homo sapiens
cacatagccctgt

SEQ ID NO: 5980595 - DNA, 14 bp, Homo sapiens
cacatagcttgcct

SEQ ID NO: 5980596 - DNA, 18 bp, Homo sapiens
cacataggaaacttttga

SEQ ID NO: 5980597 - DNA, 20 bp, Homo sapiens
cacataggctggtggccttg

SEQ ID NO: 5980598 - DNA, 21 bp, Homo sapiens
cacatagtgatggttcccctg

SEQ ID NO: 5980599 - DNA, 15 bp, Homo sapiens
cacatagtgtcctgc

SEQ ID NO: 5980600 - DNA, 18 bp, Homo sapiens
cacatagtgtcctgccca

SEQ ID NO: 5980601 - DNA, 20 bp, Homo sapiens
cacatagttctccagttgta

SEQ ID NO: 5980602 - DNA, 14 bp, Homo sapiens
cacatagtttcttt

SEQ ID NO: 5980603 - DNA, 15 bp, Homo sapiens
cacatataaaaacaa

SEQ ID NO: 5980604 - DNA, 14 bp, Homo sapiens
cacatataaacaca

SEQ ID NO: 5980605 - DNA, 21 bp, Homo sapiens
cacatataaacatcacacaca

SEQ ID NO: 5980606 - DNA, 14 bp, Homo sapiens
cacatataacactt

SEQ ID NO: 5980607 - DNA, 22 bp, Homo sapiens
cacatataagttgagaaggtgc

SEQ ID NO: 5980608 - DNA, 16 bp, Homo sapiens
cacatatacacacaca

SEQ ID NO: 5980609 - DNA, 14 bp, Homo sapiens
cacatatacatata

SEQ ID NO: 5980610 - DNA, 16 bp, Homo sapiens
cacatatacatatata

SEQ ID NO: 5980611 - DNA, 21 bp, Homo sapiens
cacatatacatctagcacagc

SEQ ID NO: 5980612 - DNA, 23 bp, Homo sapiens
cacatatacatctagcacagctg

SEQ ID NO: 5980613 - DNA, 14 bp, Homo sapiens
cacatatacattat

SEQ ID NO: 5980614 - DNA, 14 bp, Homo sapiens
cacatatacctata

SEQ ID NO: 5980615 - DNA, 22 bp, Homo sapiens
cacatatacctataatgtgtgt

SEQ ID NO: 5980616 - DNA, 23 bp, Homo sapiens
cacatatacctataatgtgtgta

SEQ ID NO: 5980617 - DNA, 12 bp, Homo sapiens
cacatatatgta

SEQ ID NO: 5980618 - DNA, 14 bp, Homo sapiens
cacatatatgtata

SEQ ID NO: 5980619 - DNA, 17 bp, Homo sapiens
cacatatattttttaca

SEQ ID NO: 5980620 - DNA, 19 bp, Homo sapiens
cacatatccaggcaccagg

SEQ ID NO: 5980621 - DNA, 23 bp, Homo sapiens
cacatatctagtatgaaattata

SEQ ID NO: 5980622 - DNA, 20 bp, Homo sapiens
cacatatgataaaaaagtgt

SEQ ID NO: 5980623 - DNA, 18 bp, Homo sapiens
cacatatgcaccttgtgt

SEQ ID NO: 5980624 - DNA, 22 bp, Homo sapiens
cacatatgcaccttgtgtctgt

SEQ ID NO: 5980625 - DNA, 14 bp, Homo sapiens
cacatatggcacaa

SEQ ID NO: 5980626 - DNA, 13 bp, Homo sapiens
cacatatgtctta

SEQ ID NO: 5980627 - DNA, 21 bp, Homo sapiens
cacatatgtcttactacttta

SEQ ID NO: 5980628 - DNA, 13 bp, Homo sapiens
cacatattgattt

SEQ ID NO: 5980629 - DNA, 13 bp, Homo sapiens
cacatatttcaca

SEQ ID NO: 5980630 - DNA, 16 bp, Homo sapiens
cacatatttgaagggt

SEQ ID NO: 5980631 - DNA, 23 bp, Homo sapiens
cacatatttgaagggtctttctc

SEQ ID NO: 5980632 - DNA, 17 bp, Homo sapiens
cacatattttaaaattt

SEQ ID NO: 5980633 - DNA, 14 bp, Homo sapiens
cacatatttttcca

SEQ ID NO: 5980634 - DNA, 13 bp, Homo sapiens
cacatcaaagagg

SEQ ID NO: 5980635 - DNA, 18 bp, Homo sapiens
cacatcaagcatcattgt

SEQ ID NO: 5980636 - DNA, 22 bp, Homo sapiens
cacatcaagcatgcaataatgt

SEQ ID NO: 5980637 - DNA, 17 bp, Homo sapiens
cacatcaataaatactt

SEQ ID NO: 5980638 - DNA, 16 bp, Homo sapiens
cacatcacaatattca

SEQ ID NO: 5980639 - DNA, 13 bp, Homo sapiens
cacatcacattcc

SEQ ID NO: 5980640 - DNA, 16 bp, Homo sapiens
cacatcacatttaaat

SEQ ID NO: 5980641 - DNA, 18 bp, Homo sapiens
cacatcacctctttgccc

SEQ ID NO: 5980642 - DNA, 23 bp, Homo sapiens
cacatcactattgggcccccagg

SEQ ID NO: 5980643 - DNA, 18 bp, Homo sapiens
cacatcagcacgatttct

SEQ ID NO: 5980644 - DNA, 21 bp, Homo sapiens
cacatcagcacgatttctgtt

SEQ ID NO: 5980645 - DNA, 16 bp, Homo sapiens
cacatcagcatgtttt

SEQ ID NO: 5980646 - DNA, 18 bp, Homo sapiens
cacatcagcatgttttct

SEQ ID NO: 5980647 - DNA, 12 bp, Homo sapiens
cacatcagcccc

SEQ ID NO: 5980648 - DNA, 16 bp, Homo sapiens
cacatcagccccacag

SEQ ID NO: 5980649 - DNA, 20 bp, Homo sapiens
cacatcagccccacaggact

SEQ ID NO: 5980650 - DNA, 18 bp, Homo sapiens
cacatcagctagcaaaag

SEQ ID NO: 5980651 - DNA, 14 bp, Homo sapiens
cacatcaggaaaga

SEQ ID NO: 5980652 - DNA, 21 bp, Homo sapiens
cacatcagggcggcctcccag

SEQ ID NO: 5980653 - DNA, 19 bp, Homo sapiens
cacatcataaacaaagagt

SEQ ID NO: 5980654 - DNA, 22 bp, Homo sapiens
cacatcatagataaagctgatt

SEQ ID NO: 5980655 - DNA, 19 bp, Homo sapiens
cacatcatctgtaagctgt

SEQ ID NO: 5980656 - DNA, 21 bp, Homo sapiens
cacatcatctttatctcctgg

SEQ ID NO: 5980657 - DNA, 16 bp, Homo sapiens
cacatcatgagccttc

SEQ ID NO: 5980658 - DNA, 14 bp, Homo sapiens
cacatcattggaat

SEQ ID NO: 5980659 - DNA, 13 bp, Homo sapiens
cacatcatttggg

SEQ ID NO: 5980660 - DNA, 13 bp, Homo sapiens
cacatccaaacat

SEQ ID NO: 5980661 - DNA, 18 bp, Homo sapiens
cacatccaactccagcaa

SEQ ID NO: 5980662 - DNA, 21 bp, Homo sapiens
cacatccaccaaactcctgcc

SEQ ID NO: 5980663 - DNA, 16 bp, Homo sapiens
cacatccaccccagcc

SEQ ID NO: 5980664 - DNA, 19 bp, Homo sapiens
cacatccagctgcccctcc

SEQ ID NO: 5980665 - DNA, 18 bp, Homo sapiens
cacatccaggcaatggcc

SEQ ID NO: 5980666 - DNA, 21 bp, Homo sapiens
cacatccaggcaatggcctaa

SEQ ID NO: 5980667 - DNA, 19 bp, Homo sapiens
cacatccatcagcacccca

SEQ ID NO: 5980668 - DNA, 13 bp, Homo sapiens
cacatccatctac

SEQ ID NO: 5980669 - DNA, 13 bp, Homo sapiens
cacatccattcca

SEQ ID NO: 5980670 - DNA, 13 bp, Homo sapiens
cacatccattccc

SEQ ID NO: 5980671 - DNA, 13 bp, Homo sapiens
cacatcccacccc

SEQ ID NO: 5980672 - DNA, 13 bp, Homo sapiens
cacatcccactgg

SEQ ID NO: 5980673 - DNA, 14 bp, Homo sapiens
cacatcccagcagc

SEQ ID NO: 5980674 - DNA, 16 bp, Homo sapiens
cacatcccagcagccc

SEQ ID NO: 5980675 - DNA, 16 bp, Homo sapiens
cacatcccatgttgaa

SEQ ID NO: 5980676 - DNA, 15 bp, Homo sapiens
cacatccccaccctc

SEQ ID NO: 5980677 - DNA, 20 bp, Homo sapiens
cacatccccaccctcccctc

SEQ ID NO: 5980678 - DNA, 23 bp, Homo sapiens
cacatccccaccctcccctctcc

SEQ ID NO: 5980679 - DNA, 14 bp, Homo sapiens
cacatccccacctt

SEQ ID NO: 5980680 - DNA, 14 bp, Homo sapiens
cacatccccagaat

SEQ ID NO: 5980681 - DNA, 16 bp, Homo sapiens
cacatccccagagccc

SEQ ID NO: 5980682 - DNA, 22 bp, Homo sapiens
cacatccccagagcccagctct

SEQ ID NO: 5980683 - DNA, 22 bp, Homo sapiens
cacatcccccgtgtattcagga

SEQ ID NO: 5980684 - DNA, 19 bp, Homo sapiens
cacatcccggcctcttcca

SEQ ID NO: 5980685 - DNA, 21 bp, Homo sapiens
cacatccctatagaccactgg

SEQ ID NO: 5980686 - DNA, 12 bp, Homo sapiens
cacatccctcta

SEQ ID NO: 5980687 - DNA, 15 bp, Homo sapiens
cacatccctctcctc

SEQ ID NO: 5980688 - DNA, 14 bp, Homo sapiens
cacatccctgggcc

SEQ ID NO: 5980689 - DNA, 15 bp, Homo sapiens
cacatccctgggcct

SEQ ID NO: 5980690 - DNA, 16 bp, Homo sapiens
cacatccctgggcctg

SEQ ID NO: 5980691 - DNA, 17 bp, Homo sapiens
cacatccctgggcctgc

SEQ ID NO: 5980692 - DNA, 18 bp, Homo sapiens
cacatccctgggcctgct

SEQ ID NO: 5980693 - DNA, 21 bp, Homo sapiens
cacatccctgggcctgctgct

SEQ ID NO: 5980694 - DNA, 17 bp, Homo sapiens
cacatcctcagaaagtg

SEQ ID NO: 5980695 - DNA, 22 bp, Homo sapiens
cacatcctccacgttctgctca

SEQ ID NO: 5980696 - DNA, 14 bp, Homo sapiens
cacatcctccgtcc

SEQ ID NO: 5980697 - DNA, 12 bp, Homo sapiens
cacatcctcctg

SEQ ID NO: 5980698 - DNA, 14 bp, Homo sapiens
cacatcctgtgtca

SEQ ID NO: 5980699 - DNA, 16 bp, Homo sapiens
cacatccttctcactg

SEQ ID NO: 5980700 - DNA, 17 bp, Homo sapiens
cacatccttctcactgc

SEQ ID NO: 5980701 - DNA, 21 bp, Homo sapiens
cacatccttcttggcttcctg

SEQ ID NO: 5980702 - DNA, 22 bp, Homo sapiens
cacatccttcttggcttcctgg

SEQ ID NO: 5980703 - DNA, 23 bp, Homo sapiens
cacatccttcttggcttcctggc

SEQ ID NO: 5980704 - DNA, 19 bp, Homo sapiens
cacatccttgactttttag

SEQ ID NO: 5980705 - DNA, 19 bp, Homo sapiens
cacatcgcagattctccct

SEQ ID NO: 5980706 - DNA, 23 bp, Homo sapiens
cacatcgccagccctgggcctgg

SEQ ID NO: 5980707 - DNA, 19 bp, Homo sapiens
cacatcgttgccgcagcgg

SEQ ID NO: 5980708 - DNA, 13 bp, Homo sapiens
cacatcgttttgg

SEQ ID NO: 5980709 - DNA, 15 bp, Homo sapiens
cacatcgttttgggg

SEQ ID NO: 5980710 - DNA, 18 bp, Homo sapiens
cacatctaaagctttatc

SEQ ID NO: 5980711 - DNA, 23 bp, Homo sapiens
cacatctaaagctttatctttgt

SEQ ID NO: 5980712 - DNA, 22 bp, Homo sapiens
cacatctaaattgatcattcat

SEQ ID NO: 5980713 - DNA, 13 bp, Homo sapiens
cacatctaagcct

SEQ ID NO: 5980714 - DNA, 14 bp, Homo sapiens
cacatctaagcctg

SEQ ID NO: 5980715 - DNA, 22 bp, Homo sapiens
cacatctaagcctgaaggggcg

SEQ ID NO: 5980716 - DNA, 16 bp, Homo sapiens
cacatctaatgtctct

SEQ ID NO: 5980717 - DNA, 15 bp, Homo sapiens
cacatctaattaaat

SEQ ID NO: 5980718 - DNA, 21 bp, Homo sapiens
cacatctatccacactgtcaa

SEQ ID NO: 5980719 - DNA, 13 bp, Homo sapiens
cacatctcacctc

SEQ ID NO: 5980720 - DNA, 15 bp, Homo sapiens
cacatctcacctccg

SEQ ID NO: 5980721 - DNA, 12 bp, Homo sapiens
cacatctcactt

SEQ ID NO: 5980722 - DNA, 14 bp, Homo sapiens
cacatctcacttca

SEQ ID NO: 5980723 - DNA, 23 bp, Homo sapiens
cacatctcacttcagttgtggcc

SEQ ID NO: 5980724 - DNA, 21 bp, Homo sapiens
cacatctcagggaactgaccc

SEQ ID NO: 5980725 - DNA, 22 bp, Homo sapiens
cacatctcctccatactcagga

SEQ ID NO: 5980726 - DNA, 13 bp, Homo sapiens
cacatctctctgc

SEQ ID NO: 5980727 - DNA, 21 bp, Homo sapiens
cacatctctgaaagcacagga

SEQ ID NO: 5980728 - DNA, 22 bp, Homo sapiens
cacatctgaatctccttgttgt

SEQ ID NO: 5980729 - DNA, 18 bp, Homo sapiens
cacatctgcacactctct

SEQ ID NO: 5980730 - DNA, 15 bp, Homo sapiens
cacatctgccagacc

SEQ ID NO: 5980731 - DNA, 13 bp, Homo sapiens
cacatctgcctta

SEQ ID NO: 5980732 - DNA, 15 bp, Homo sapiens
cacatctgctctagg

SEQ ID NO: 5980733 - DNA, 14 bp, Homo sapiens
cacatctggccctg

SEQ ID NO: 5980734 - DNA, 16 bp, Homo sapiens
cacatctggccctgac

SEQ ID NO: 5980735 - DNA, 13 bp, Homo sapiens
cacatctggctgc

SEQ ID NO: 5980736 - DNA, 21 bp, Homo sapiens
cacatctggctgcacaggctg

SEQ ID NO: 5980737 - DNA, 24 bp, Homo sapiens
cacatctgtaatcctagctacttg

SEQ ID NO: 5980738 - DNA, 20 bp, Homo sapiens
cacatctgtatatcagctct

SEQ ID NO: 5980739 - DNA, 13 bp, Homo sapiens
cacatctgtcctc

SEQ ID NO: 5980740 - DNA, 14 bp, Homo sapiens
cacatctgtcctca

SEQ ID NO: 5980741 - DNA, 18 bp, Homo sapiens
cacatctgtcctgacaga

SEQ ID NO: 5980742 - DNA, 19 bp, Homo sapiens
cacatctgtgtctctggaa

SEQ ID NO: 5980743 - DNA, 16 bp, Homo sapiens
cacatctgtgtcttgt

SEQ ID NO: 5980744 - DNA, 14 bp, Homo sapiens
cacatcttaaaagt

SEQ ID NO: 5980745 - DNA, 16 bp, Homo sapiens
cacatcttaaaagtgt

SEQ ID NO: 5980746 - DNA, 15 bp, Homo sapiens
cacatcttaattaag

SEQ ID NO: 5980747 - DNA, 15 bp, Homo sapiens
cacatcttacctctc

SEQ ID NO: 5980748 - DNA, 13 bp, Homo sapiens
cacatcttcaggc

SEQ ID NO: 5980749 - DNA, 14 bp, Homo sapiens
cacatcttcatgtg

SEQ ID NO: 5980750 - DNA, 18 bp, Homo sapiens
cacatcttcatgtggaca

SEQ ID NO: 5980751 - DNA, 16 bp, Homo sapiens
cacatcttctcagtgt

SEQ ID NO: 5980752 - DNA, 12 bp, Homo sapiens
cacatcttgaaa

SEQ ID NO: 5980753 - DNA, 16 bp, Homo sapiens
cacatcttgaaaatgc

SEQ ID NO: 5980754 - DNA, 18 bp, Homo sapiens
cacatcttgaaaatgcca

SEQ ID NO: 5980755 - DNA, 12 bp, Homo sapiens
cacatcttgctc

SEQ ID NO: 5980756 - DNA, 14 bp, Homo sapiens
cacatcttgctctg

SEQ ID NO: 5980757 - DNA, 15 bp, Homo sapiens
cacatcttgctctgc

SEQ ID NO: 5980758 - DNA, 18 bp, Homo sapiens
cacatcttgctctgctga

SEQ ID NO: 5980759 - DNA, 13 bp, Homo sapiens
cacatcttgtctt

SEQ ID NO: 5980760 - DNA, 20 bp, Homo sapiens
cacatctttaacttagtatt

SEQ ID NO: 5980761 - DNA, 12 bp, Homo sapiens
cacatctttcac

SEQ ID NO: 5980762 - DNA, 19 bp, Homo sapiens
cacatctttcacacttcca

SEQ ID NO: 5980763 - DNA, 21 bp, Homo sapiens
cacatctttcacacttccacc

SEQ ID NO: 5980764 - DNA, 15 bp, Homo sapiens
cacatgaacagcttg

SEQ ID NO: 5980765 - DNA, 22 bp, Homo sapiens
cacatgaaccatccttcccatg

SEQ ID NO: 5980766 - DNA, 14 bp, Homo sapiens
cacatgaagaaata

SEQ ID NO: 5980767 - DNA, 22 bp, Homo sapiens
cacatgaagaaatactgcactt

SEQ ID NO: 5980768 - DNA, 21 bp, Homo sapiens
cacatgaaggagacagcagca

SEQ ID NO: 5980769 - DNA, 16 bp, Homo sapiens
cacatgaagtccaagc

SEQ ID NO: 5980770 - DNA, 17 bp, Homo sapiens
cacatgaagtccaagca

SEQ ID NO: 5980771 - DNA, 14 bp, Homo sapiens
cacatgaataattt

SEQ ID NO: 5980772 - DNA, 16 bp, Homo sapiens
cacatgaataatttca

SEQ ID NO: 5980773 - DNA, 15 bp, Homo sapiens
cacatgaatgcagtc

SEQ ID NO: 5980774 - DNA, 17 bp, Homo sapiens
cacatgacatccacatg

SEQ ID NO: 5980775 - DNA, 19 bp, Homo sapiens
cacatgacatttgtcctgc

SEQ ID NO: 5980776 - DNA, 21 bp, Homo sapiens
cacatgacgccagataaaatg

SEQ ID NO: 5980777 - DNA, 20 bp, Homo sapiens
cacatgacttattatgcata

SEQ ID NO: 5980778 - DNA, 16 bp, Homo sapiens
cacatgagaagtgata

SEQ ID NO: 5980779 - DNA, 18 bp, Homo sapiens
cacatgagcatcaggcca

SEQ ID NO: 5980780 - DNA, 18 bp, Homo sapiens
cacatgagctatttccat

SEQ ID NO: 5980781 - DNA, 20 bp, Homo sapiens
cacatgaggagggtgccctc

SEQ ID NO: 5980782 - DNA, 22 bp, Homo sapiens
cacatgaggccatctcaggaga

SEQ ID NO: 5980783 - DNA, 15 bp, Homo sapiens
cacatgagtcccagt

SEQ ID NO: 5980784 - DNA, 14 bp, Homo sapiens
cacatgattctcct

SEQ ID NO: 5980785 - DNA, 19 bp, Homo sapiens
cacatgattgtataagcat

SEQ ID NO: 5980786 - DNA, 14 bp, Homo sapiens
cacatgatttcaca

SEQ ID NO: 5980787 - DNA, 20 bp, Homo sapiens
cacatgcaaggtcatttttt

SEQ ID NO: 5980788 - DNA, 13 bp, Homo sapiens
cacatgcacacac

SEQ ID NO: 5980789 - DNA, 14 bp, Homo sapiens
cacatgcacacaca

SEQ ID NO: 5980790 - DNA, 20 bp, Homo sapiens
cacatgcaccacgcccggct

SEQ ID NO: 5980791 - DNA, 20 bp, Homo sapiens
cacatgcacttttgggcctt

SEQ ID NO: 5980792 - DNA, 14 bp, Homo sapiens
cacatgcatacaca

SEQ ID NO: 5980793 - DNA, 18 bp, Homo sapiens
cacatgcatcatcagcct

SEQ ID NO: 5980794 - DNA, 18 bp, Homo sapiens
cacatgcatgtctgccta

SEQ ID NO: 5980795 - DNA, 20 bp, Homo sapiens
cacatgcatgtctgcctatg

SEQ ID NO: 5980796 - DNA, 13 bp, Homo sapiens
cacatgccactgc

SEQ ID NO: 5980797 - DNA, 19 bp, Homo sapiens
cacatgccaggggcctttg

SEQ ID NO: 5980798 - DNA, 14 bp, Homo sapiens
cacatgccccatcc

SEQ ID NO: 5980799 - DNA, 21 bp, Homo sapiens
cacatgccccatcccatgctg

SEQ ID NO: 5980800 - DNA, 12 bp, Homo sapiens
cacatgcccctc

SEQ ID NO: 5980801 - DNA, 17 bp, Homo sapiens
cacatgcccctccccca

SEQ ID NO: 5980802 - DNA, 19 bp, Homo sapiens
cacatgcccctcttagaag

SEQ ID NO: 5980803 - DNA, 13 bp, Homo sapiens
cacatgcccgctg

SEQ ID NO: 5980804 - DNA, 16 bp, Homo sapiens
cacatgccctcctgga

SEQ ID NO: 5980805 - DNA, 20 bp, Homo sapiens
cacatgccgcccccagcagc

SEQ ID NO: 5980806 - DNA, 13 bp, Homo sapiens
cacatgcctctct

SEQ ID NO: 5980807 - DNA, 13 bp, Homo sapiens
cacatgcctctgt

SEQ ID NO: 5980808 - DNA, 14 bp, Homo sapiens
cacatgcctgcgcc

SEQ ID NO: 5980809 - DNA, 15 bp, Homo sapiens
cacatgccttctaaa

SEQ ID NO: 5980810 - DNA, 13 bp, Homo sapiens
cacatgcgcactc

SEQ ID NO: 5980811 - DNA, 18 bp, Homo sapiens
cacatgcgctcctggctt

SEQ ID NO: 5980812 - DNA, 23 bp, Homo sapiens
cacatgcgctcctggcttttaaa

SEQ ID NO: 5980813 - DNA, 18 bp, Homo sapiens
cacatgcgggctcgccca

SEQ ID NO: 5980814 - DNA, 15 bp, Homo sapiens
cacatgctatgttct

SEQ ID NO: 5980815 - DNA, 15 bp, Homo sapiens
cacatgctattgtct

SEQ ID NO: 5980816 - DNA, 23 bp, Homo sapiens
cacatgctctaagaagctcgttt

SEQ ID NO: 5980817 - DNA, 14 bp, Homo sapiens
cacatgctgcctgg

SEQ ID NO: 5980818 - DNA, 21 bp, Homo sapiens
cacatgctgcctggcacagac

SEQ ID NO: 5980819 - DNA, 19 bp, Homo sapiens
cacatgctggacaggtctg

SEQ ID NO: 5980820 - DNA, 14 bp, Homo sapiens
cacatgctggccag

SEQ ID NO: 5980821 - DNA, 14 bp, Homo sapiens
cacatgctggctcc

SEQ ID NO: 5980822 - DNA, 17 bp, Homo sapiens
cacatgctgtctggccc

SEQ ID NO: 5980823 - DNA, 20 bp, Homo sapiens
cacatgctgttggcctcaag

SEQ ID NO: 5980824 - DNA, 12 bp, Homo sapiens
cacatgcttcaa

SEQ ID NO: 5980825 - DNA, 20 bp, Homo sapiens
cacatgcttgaatggagctg

SEQ ID NO: 5980826 - DNA, 21 bp, Homo sapiens
cacatgcttgatggtttatgt

SEQ ID NO: 5980827 - DNA, 18 bp, Homo sapiens
cacatgcttttcttccta

SEQ ID NO: 5980828 - DNA, 11 bp, Homo sapiens
cacatggaaaa

SEQ ID NO: 5980829 - DNA, 20 bp, Homo sapiens
cacatggaaaaaaaaaaaac

SEQ ID NO: 5980830 - DNA, 16 bp, Homo sapiens
cacatggaacttaaaa

SEQ ID NO: 5980831 - DNA, 17 bp, Homo sapiens
cacatggaaggtgatgg

SEQ ID NO: 5980832 - DNA, 17 bp, Homo sapiens
cacatggaatgagggtt

SEQ ID NO: 5980833 - DNA, 20 bp, Homo sapiens
cacatggagccccctctgcc

SEQ ID NO: 5980834 - DNA, 12 bp, Homo sapiens
cacatggagctc

SEQ ID NO: 5980835 - DNA, 14 bp, Homo sapiens
cacatggaggagac

SEQ ID NO: 5980836 - DNA, 20 bp, Homo sapiens
cacatggattttggcagggc

SEQ ID NO: 5980837 - DNA, 20 bp, Homo sapiens
cacatggcaaggggtctcct

SEQ ID NO: 5980838 - DNA, 11 bp, Homo sapiens
cacatggcaga

SEQ ID NO: 5980839 - DNA, 15 bp, Homo sapiens
cacatggcagatgat

SEQ ID NO: 5980840 - DNA, 14 bp, Homo sapiens
cacatggcatgttt

SEQ ID NO: 5980841 - DNA, 19 bp, Homo sapiens
cacatggccatagaggccc

SEQ ID NO: 5980842 - DNA, 20 bp, Homo sapiens
cacatggccatagaggccca

SEQ ID NO: 5980843 - DNA, 23 bp, Homo sapiens
cacatggccgctgcccacgtccc

SEQ ID NO: 5980844 - DNA, 13 bp, Homo sapiens
cacatggcctgag

SEQ ID NO: 5980845 - DNA, 18 bp, Homo sapiens
cacatggctatgttttag

SEQ ID NO: 5980846 - DNA, 14 bp, Homo sapiens
cacatggctggggg

SEQ ID NO: 5980847 - DNA, 23 bp, Homo sapiens
cacatggctgggggagggactgc

SEQ ID NO: 5980848 - DNA, 18 bp, Homo sapiens
cacatggcttcctaaatg

SEQ ID NO: 5980849 - DNA, 14 bp, Homo sapiens
cacatgggacctgg

SEQ ID NO: 5980850 - DNA, 15 bp, Homo sapiens
cacatgggacctggc

SEQ ID NO: 5980851 - DNA, 22 bp, Homo sapiens
cacatgggagcagtccatgcat

SEQ ID NO: 5980852 - DNA, 15 bp, Homo sapiens
cacatgggcagccca

SEQ ID NO: 5980853 - DNA, 19 bp, Homo sapiens
cacatgggcttgtgacatt

SEQ ID NO: 5980854 - DNA, 22 bp, Homo sapiens
cacatggggcctggcccacgcc

SEQ ID NO: 5980855 - DNA, 15 bp, Homo sapiens
cacatgggggagaga

SEQ ID NO: 5980856 - DNA, 16 bp, Homo sapiens
cacatggggttcctgg

SEQ ID NO: 5980857 - DNA, 17 bp, Homo sapiens
cacatggggttcctggt

SEQ ID NO: 5980858 - DNA, 18 bp, Homo sapiens
cacatggggttcctggtt

SEQ ID NO: 5980859 - DNA, 22 bp, Homo sapiens
cacatggtccatttcatgtgat

SEQ ID NO: 5980860 - DNA, 20 bp, Homo sapiens
cacatggtgctacgcctgca

SEQ ID NO: 5980861 - DNA, 17 bp, Homo sapiens
cacatggtgtctcccaa

SEQ ID NO: 5980862 - DNA, 13 bp, Homo sapiens
cacatgtaaaata

SEQ ID NO: 5980863 - DNA, 14 bp, Homo sapiens
cacatgtaaaatat

SEQ ID NO: 5980864 - DNA, 18 bp, Homo sapiens
cacatgtaaaatatgtaa

SEQ ID NO: 5980865 - DNA, 14 bp, Homo sapiens
cacatgtacatatg

SEQ ID NO: 5980866 - DNA, 21 bp, Homo sapiens
cacatgtattctgttggccag

SEQ ID NO: 5980867 - DNA, 19 bp, Homo sapiens
cacatgtcaccgtggacct

SEQ ID NO: 5980868 - DNA, 22 bp, Homo sapiens
cacatgtcaccgtggaccttcc

SEQ ID NO: 5980869 - DNA, 21 bp, Homo sapiens
cacatgtcagcaagtcctaag

SEQ ID NO: 5980870 - DNA, 20 bp, Homo sapiens
cacatgtcagtaccttcaaa

SEQ ID NO: 5980871 - DNA, 21 bp, Homo sapiens
cacatgtccaagaagcccagg

SEQ ID NO: 5980872 - DNA, 17 bp, Homo sapiens
cacatgtccttgtgtgt

SEQ ID NO: 5980873 - DNA, 16 bp, Homo sapiens
cacatgtctgtcctca

SEQ ID NO: 5980874 - DNA, 20 bp, Homo sapiens
cacatgtctgtcctcagagc

SEQ ID NO: 5980875 - DNA, 23 bp, Homo sapiens
cacatgtcttaatgaagtttgaa

SEQ ID NO: 5980876 - DNA, 14 bp, Homo sapiens
cacatgtgaaaacc

SEQ ID NO: 5980877 - DNA, 22 bp, Homo sapiens
cacatgtgagcatgtcacttcc

SEQ ID NO: 5980878 - DNA, 14 bp, Homo sapiens
cacatgtgcacatg

SEQ ID NO: 5980879 - DNA, 17 bp, Homo sapiens
cacatgtgcacatgcac

SEQ ID NO: 5980880 - DNA, 19 bp, Homo sapiens
cacatgtgccactgttcag

SEQ ID NO: 5980881 - DNA, 15 bp, Homo sapiens
cacatgtgccctgcc

SEQ ID NO: 5980882 - DNA, 17 bp, Homo sapiens
cacatgtgccctgcctt

SEQ ID NO: 5980883 - DNA, 20 bp, Homo sapiens
cacatgtgctgatgtttaca

SEQ ID NO: 5980884 - DNA, 17 bp, Homo sapiens
cacatgtggctccccct

SEQ ID NO: 5980885 - DNA, 12 bp, Homo sapiens
cacatgtgtggt

SEQ ID NO: 5980886 - DNA, 19 bp, Homo sapiens
cacatgttactgcttcatt

SEQ ID NO: 5980887 - DNA, 12 bp, Homo sapiens
cacatgttcata

SEQ ID NO: 5980888 - DNA, 13 bp, Homo sapiens
cacatgttctaat

SEQ ID NO: 5980889 - DNA, 16 bp, Homo sapiens
cacatgttgttctcat

SEQ ID NO: 5980890 - DNA, 14 bp, Homo sapiens
cacatgtttatatt

SEQ ID NO: 5980891 - DNA, 16 bp, Homo sapiens
cacatgtttattcatg

SEQ ID NO: 5980892 - DNA, 12 bp, Homo sapiens
cacatgtttcct

SEQ ID NO: 5980893 - DNA, 14 bp, Homo sapiens
cacatgtttcctct

SEQ ID NO: 5980894 - DNA, 15 bp, Homo sapiens
cacatgttttctctg

SEQ ID NO: 5980895 - DNA, 19 bp, Homo sapiens
cacattaaaaaatgaaata

SEQ ID NO: 5980896 - DNA, 16 bp, Homo sapiens
cacattaaaaaggaaa

SEQ ID NO: 5980897 - DNA, 16 bp, Homo sapiens
cacattaaagaagacc

SEQ ID NO: 5980898 - DNA, 20 bp, Homo sapiens
cacattaaagaagacctgag

SEQ ID NO: 5980899 - DNA, 15 bp, Homo sapiens
cacattaaatgactc

SEQ ID NO: 5980900 - DNA, 13 bp, Homo sapiens
cacattaaattga

SEQ ID NO: 5980901 - DNA, 18 bp, Homo sapiens
cacattaacattttgagc

SEQ ID NO: 5980902 - DNA, 15 bp, Homo sapiens
cacattaactccctc

SEQ ID NO: 5980903 - DNA, 24 bp, Homo sapiens
cacattaactccctccaccagcct

SEQ ID NO: 5980904 - DNA, 23 bp, Homo sapiens
cacattaagccttccacactcac

SEQ ID NO: 5980905 - DNA, 17 bp, Homo sapiens
cacattaagtggctttt

SEQ ID NO: 5980906 - DNA, 14 bp, Homo sapiens
cacattaataaaca

SEQ ID NO: 5980907 - DNA, 23 bp, Homo sapiens
caaatgtgcaatttgtaaatatt

SEQ ID NO: 5980908 - DNA, 17 bp, Homo sapiens
caaatgtgccatactaa

SEQ ID NO: 5980909 - DNA, 20 bp, Homo sapiens
caaatgtggccaagcctatc

SEQ ID NO: 5980910 - DNA, 18 bp, Homo sapiens
caaatgtggctgtaaaac

SEQ ID NO: 5980911 - DNA, 17 bp, Homo sapiens
caaatgtgtacacctgc

SEQ ID NO: 5980912 - DNA, 20 bp, Homo sapiens
caaatgtgtacatggcagag

SEQ ID NO: 5980913 - DNA, 21 bp, Homo sapiens
caaatgtgtataaactgctgt

SEQ ID NO: 5980914 - DNA, 17 bp, Homo sapiens
caaatgtgtataatttt

SEQ ID NO: 5980915 - DNA, 17 bp, Homo sapiens
caaatgtgtatttttgt

SEQ ID NO: 5980916 - DNA, 14 bp, Homo sapiens
caaatgtgtcagaa

SEQ ID NO: 5980917 - DNA, 21 bp, Homo sapiens
caaatgtgtcttgtattatca

SEQ ID NO: 5980918 - DNA, 18 bp, Homo sapiens
caaatgtgtgttcctgct

SEQ ID NO: 5980919 - DNA, 15 bp, Homo sapiens
caaatgttaaaatgt

SEQ ID NO: 5980920 - DNA, 19 bp, Homo sapiens
caaatgttaaaatgtgttg

SEQ ID NO: 5980921 - DNA, 15 bp, Homo sapiens
caaatgttaacagag

SEQ ID NO: 5980922 - DNA, 16 bp, Homo sapiens
caaatgttacaaaaaa

SEQ ID NO: 5980923 - DNA, 17 bp, Homo sapiens
caaatgttacagtttat

SEQ ID NO: 5980924 - DNA, 15 bp, Homo sapiens
caaatgttacatagt

SEQ ID NO: 5980925 - DNA, 23 bp, Homo sapiens
caaatgttagacttgtgtgcatg

SEQ ID NO: 5980926 - DNA, 20 bp, Homo sapiens
caaatgttcatatttattga

SEQ ID NO: 5980927 - DNA, 19 bp, Homo sapiens
caaatgttctaagtttcta

SEQ ID NO: 5980928 - DNA, 13 bp, Homo sapiens
caaatgttgacct

SEQ ID NO: 5980929 - DNA, 17 bp, Homo sapiens
caaatgttgtcctgtta

SEQ ID NO: 5980930 - DNA, 15 bp, Homo sapiens
caaatgtttaatcat

SEQ ID NO: 5980931 - DNA, 17 bp, Homo sapiens
caaatgtttacagggag

SEQ ID NO: 5980932 - DNA, 15 bp, Homo sapiens
caaatgtttacattt

SEQ ID NO: 5980933 - DNA, 16 bp, Homo sapiens
caaatgtttatttaaa

SEQ ID NO: 5980934 - DNA, 14 bp, Homo sapiens
caaatgtttatttt

SEQ ID NO: 5980935 - DNA, 13 bp, Homo sapiens
caaatgtttcctt

SEQ ID NO: 5980936 - DNA, 14 bp, Homo sapiens
caaatgtttcctta

SEQ ID NO: 5980937 - DNA, 15 bp, Homo sapiens
caaatgtttccttaa

SEQ ID NO: 5980938 - DNA, 11 bp, Homo sapiens
caaatgtttct

SEQ ID NO: 5980939 - DNA, 15 bp, Homo sapiens
caaatgttttctgca

SEQ ID NO: 5980940 - DNA, 17 bp, Homo sapiens
caaatgttttgaaatga

SEQ ID NO: 5980941 - DNA, 15 bp, Homo sapiens
caaatgttttgacat

SEQ ID NO: 5980942 - DNA, 21 bp, Homo sapiens
caaattaaaaaaaaattgtat

SEQ ID NO: 5980943 - DNA, 14 bp, Homo sapiens
caaattaaaaagat

SEQ ID NO: 5980944 - DNA, 18 bp, Homo sapiens
caaattaaaaagattctt

SEQ ID NO: 5980945 - DNA, 23 bp, Homo sapiens
caaattaaaaagattctttttct

SEQ ID NO: 5980946 - DNA, 15 bp, Homo sapiens
caaattaaaacaaat

SEQ ID NO: 5980947 - DNA, 19 bp, Homo sapiens
caaattaaaacaaatatac

SEQ ID NO: 5980948 - DNA, 20 bp, Homo sapiens
caaattaaaacatatttcat

SEQ ID NO: 5980949 - DNA, 21 bp, Homo sapiens
caaattaaaacatatttcatt

SEQ ID NO: 5980950 - DNA, 20 bp, Homo sapiens
caaattaaagtgctgtttag

SEQ ID NO: 5980951 - DNA, 15 bp, Homo sapiens
caaattaaataaatt

SEQ ID NO: 5980952 - DNA, 18 bp, Homo sapiens
caaattaactaaggaaat

SEQ ID NO: 5980953 - DNA, 18 bp, Homo sapiens
caaattaagatggtaaga

SEQ ID NO: 5980954 - DNA, 16 bp, Homo sapiens
caaattaataatctta

SEQ ID NO: 5980955 - DNA, 14 bp, Homo sapiens
caaattaatacaat

SEQ ID NO: 5980956 - DNA, 17 bp, Homo sapiens
caaattaatatttgtgc

SEQ ID NO: 5980957 - DNA, 12 bp, Homo sapiens
caaattaatctt

SEQ ID NO: 5980958 - DNA, 13 bp, Homo sapiens
caaattaatcttt

SEQ ID NO: 5980959 - DNA, 15 bp, Homo sapiens
caaattaatctttta

SEQ ID NO: 5980960 - DNA, 20 bp, Homo sapiens
caaattaattggcagcagat

SEQ ID NO: 5980961 - DNA, 12 bp, Homo sapiens
caaattaattgt

SEQ ID NO: 5980962 - DNA, 16 bp, Homo sapiens
caaattaattgtgtga

SEQ ID NO: 5980963 - DNA, 13 bp, Homo sapiens
caaattaatttta

SEQ ID NO: 5980964 - DNA, 23 bp, Homo sapiens
caaattacaaaaggctcgtttgg

SEQ ID NO: 5980965 - DNA, 14 bp, Homo sapiens
caaattacaagtat

SEQ ID NO: 5980966 - DNA, 21 bp, Homo sapiens
caaattacaagtattcagttc

SEQ ID NO: 5980967 - DNA, 13 bp, Homo sapiens
caaattaccaaat

SEQ ID NO: 5980968 - DNA, 16 bp, Homo sapiens
caaattactctttctc

SEQ ID NO: 5980969 - DNA, 19 bp, Homo sapiens
caaattactctttctccat

SEQ ID NO: 5980970 - DNA, 15 bp, Homo sapiens
caaattactgataaa

SEQ ID NO: 5980971 - DNA, 21 bp, Homo sapiens
caaattactttgtgaatagaa

SEQ ID NO: 5980972 - DNA, 11 bp, Homo sapiens
caaattagaaa

SEQ ID NO: 5980973 - DNA, 13 bp, Homo sapiens
caaattagaaaat

SEQ ID NO: 5980974 - DNA, 22 bp, Homo sapiens
caaattagaaaatgttatttaa

SEQ ID NO: 5980975 - DNA, 12 bp, Homo sapiens
caaattagaaac

SEQ ID NO: 5980976 - DNA, 17 bp, Homo sapiens
caaattagaatagaact

SEQ ID NO: 5980977 - DNA, 23 bp, Homo sapiens
caaattagcaggtgcaccttctg

SEQ ID NO: 5980978 - DNA, 17 bp, Homo sapiens
caaattaggaagtgttt

SEQ ID NO: 5980979 - DNA, 15 bp, Homo sapiens
caaattagggcaatt

SEQ ID NO: 5980980 - DNA, 20 bp, Homo sapiens
caaattaggttttgtacaat

SEQ ID NO: 5980981 - DNA, 15 bp, Homo sapiens
caaattagttatata

SEQ ID NO: 5980982 - DNA, 13 bp, Homo sapiens
caaattataaaaa

SEQ ID NO: 5980983 - DNA, 19 bp, Homo sapiens
caaattataaaaagccact

SEQ ID NO: 5980984 - DNA, 24 bp, Homo sapiens
caaattataagagacagacacttg

SEQ ID NO: 5980985 - DNA, 19 bp, Homo sapiens
caaattataagggccctgc

SEQ ID NO: 5980986 - DNA, 14 bp, Homo sapiens
caaattatagaaac

SEQ ID NO: 5980987 - DNA, 23 bp, Homo sapiens
caaattatagaaacaatactgtt

SEQ ID NO: 5980988 - DNA, 17 bp, Homo sapiens
caaattatatgctaatt

SEQ ID NO: 5980989 - DNA, 22 bp, Homo sapiens
caaattatatgctaattaaata

SEQ ID NO: 5980990 - DNA, 18 bp, Homo sapiens
caaattatcaagctaata

SEQ ID NO: 5980991 - DNA, 20 bp, Homo sapiens
caaattatcaagctaataaa

SEQ ID NO: 5980992 - DNA, 21 bp, Homo sapiens
caaattatcaagctaataaaa

SEQ ID NO: 5980993 - DNA, 13 bp, Homo sapiens
caaattatcttga

SEQ ID NO: 5980994 - DNA, 21 bp, Homo sapiens
caaattatgctaagaattttt

SEQ ID NO: 5980995 - DNA, 15 bp, Homo sapiens
caaattattaatgaa

SEQ ID NO: 5980996 - DNA, 15 bp, Homo sapiens
caaattattaattgt

SEQ ID NO: 5980997 - DNA, 17 bp, Homo sapiens
caaattattaattgtcc

SEQ ID NO: 5980998 - DNA, 14 bp, Homo sapiens
caaattattctagt

SEQ ID NO: 5980999 - DNA, 16 bp, Homo sapiens
caaattattctagtca

SEQ ID NO: 5981000 - DNA, 17 bp, Homo sapiens
caaattattctagtcaa

SEQ ID NO: 5981001 - DNA, 15 bp, Homo sapiens
caaattatttattac

SEQ ID NO: 5981002 - DNA, 17 bp, Homo sapiens
caaattatttattactt

SEQ ID NO: 5981003 - DNA, 15 bp, Homo sapiens
caaattatttgtgta

SEQ ID NO: 5981004 - DNA, 14 bp, Homo sapiens
caaattattttaat

SEQ ID NO: 5981005 - DNA, 23 bp, Homo sapiens
caaattattttaatattttgtat

SEQ ID NO: 5981006 - DNA, 15 bp, Homo sapiens
caaattcaaaagtaa

SEQ ID NO: 5981007 - DNA, 13 bp, Homo sapiens
caaattcaaagaa

SEQ ID NO: 5981008 - DNA, 20 bp, Homo sapiens
caaattcaagagcctcccct

SEQ ID NO: 5981009 - DNA, 21 bp, Homo sapiens
caaattcaagagcctcccctg

SEQ ID NO: 5981010 - DNA, 22 bp, Homo sapiens
caaattcaagagctagaaaaat

SEQ ID NO: 5981011 - DNA, 14 bp, Homo sapiens
caaattcaaggcct

SEQ ID NO: 5981012 - DNA, 18 bp, Homo sapiens
caaattcaaggccttcca

SEQ ID NO: 5981013 - DNA, 16 bp, Homo sapiens
caaattcagctctgat

SEQ ID NO: 5981014 - DNA, 18 bp, Homo sapiens
caaattcagtggacattt

SEQ ID NO: 5981015 - DNA, 15 bp, Homo sapiens
caaattcagtttcat

SEQ ID NO: 5981016 - DNA, 18 bp, Homo sapiens
caaattcagtttcataaa

SEQ ID NO: 5981017 - DNA, 20 bp, Homo sapiens
caaattcagtttcataaaag

SEQ ID NO: 5981018 - DNA, 15 bp, Homo sapiens
caaattcatataaaa

SEQ ID NO: 5981019 - DNA, 19 bp, Homo sapiens
caaattcattcccttctct

SEQ ID NO: 5981020 - DNA, 23 bp, Homo sapiens
caaattcattcccttctctcagc

SEQ ID NO: 5981021 - DNA, 14 bp, Homo sapiens
caaattcattttta

SEQ ID NO: 5981022 - DNA, 15 bp, Homo sapiens
caaattcatttttaa

SEQ ID NO: 5981023 - DNA, 15 bp, Homo sapiens
caaattccatcacat

SEQ ID NO: 5981024 - DNA, 21 bp, Homo sapiens
caaattcccagatttgaagac

SEQ ID NO: 5981025 - DNA, 14 bp, Homo sapiens
caaattcctgcaaa

SEQ ID NO: 5981026 - DNA, 23 bp, Homo sapiens
caaattcctttcagagttttact

SEQ ID NO: 5981027 - DNA, 15 bp, Homo sapiens
caaattctactttaa

SEQ ID NO: 5981028 - DNA, 21 bp, Homo sapiens
caaattctcaacctaccaccc

SEQ ID NO: 5981029 - DNA, 15 bp, Homo sapiens
caaattctcctctct

SEQ ID NO: 5981030 - DNA, 18 bp, Homo sapiens
caaattctgattattaca

SEQ ID NO: 5981031 - DNA, 19 bp, Homo sapiens
caaattctgattattacaa

SEQ ID NO: 5981032 - DNA, 18 bp, Homo sapiens
caaattctgtctctggat

SEQ ID NO: 5981033 - DNA, 14 bp, Homo sapiens
caaattctgtctgg

SEQ ID NO: 5981034 - DNA, 16 bp, Homo sapiens
caaattcttgaataaa

SEQ ID NO: 5981035 - DNA, 16 bp, Homo sapiens
caaattctttagtact

SEQ ID NO: 5981036 - DNA, 23 bp, Homo sapiens
caaattcttttgaattgttacat

SEQ ID NO: 5981037 - DNA, 16 bp, Homo sapiens
caaattctttttttat

SEQ ID NO: 5981038 - DNA, 20 bp, Homo sapiens
caaattgaaagcttccatgt

SEQ ID NO: 5981039 - DNA, 14 bp, Homo sapiens
caaattgagataat

SEQ ID NO: 5981040 - DNA, 20 bp, Homo sapiens
caaattgatgggtgggctag

SEQ ID NO: 5981041 - DNA, 23 bp, Homo sapiens
caaattgattcaaatgttacaaa

SEQ ID NO: 5981042 - DNA, 18 bp, Homo sapiens
caaattgattgtctttcc

SEQ ID NO: 5981043 - DNA, 19 bp, Homo sapiens
caaattgattgtctttccc

SEQ ID NO: 5981044 - DNA, 14 bp, Homo sapiens
caaattgcactgaa

SEQ ID NO: 5981045 - DNA, 14 bp, Homo sapiens
caaattgccttcag

SEQ ID NO: 5981046 - DNA, 19 bp, Homo sapiens
caaattgccttcattttat

SEQ ID NO: 5981047 - DNA, 13 bp, Homo sapiens
caaattgctgaga

SEQ ID NO: 5981048 - DNA, 20 bp, Homo sapiens
caaattgcttactttggaat

SEQ ID NO: 5981049 - DNA, 19 bp, Homo sapiens
caaattgcttgaaagaaaa

SEQ ID NO: 5981050 - DNA, 21 bp, Homo sapiens
caaattggaatggaactactg

SEQ ID NO: 5981051 - DNA, 13 bp, Homo sapiens
caaattggagaaa

SEQ ID NO: 5981052 - DNA, 15 bp, Homo sapiens
caaattggagcaggg

SEQ ID NO: 5981053 - DNA, 17 bp, Homo sapiens
caaattgggatctgtct

SEQ ID NO: 5981054 - DNA, 20 bp, Homo sapiens
caaattgtaactacactaat

SEQ ID NO: 5981055 - DNA, 18 bp, Homo sapiens
caaattgtaattaataat

SEQ ID NO: 5981056 - DNA, 17 bp, Homo sapiens
caaattgtactagttgt

SEQ ID NO: 5981057 - DNA, 18 bp, Homo sapiens
caaattgtatctagtgca

SEQ ID NO: 5981058 - DNA, 22 bp, Homo sapiens
caaattgtatctagtgcagctg

SEQ ID NO: 5981059 - DNA, 21 bp, Homo sapiens
caaattgtcacctgcttctct

SEQ ID NO: 5981060 - DNA, 13 bp, Homo sapiens
caaattgtgaaat

SEQ ID NO: 5981061 - DNA, 15 bp, Homo sapiens
caaattgtgcaaaat

SEQ ID NO: 5981062 - DNA, 23 bp, Homo sapiens
caaattgtgcttctccccagaat

SEQ ID NO: 5981063 - DNA, 15 bp, Homo sapiens
caaatttaactttta

SEQ ID NO: 5981064 - DNA, 16 bp, Homo sapiens
caaatttacatttatc

SEQ ID NO: 5981065 - DNA, 20 bp, Homo sapiens
caaatttactttaaaaagaa

SEQ ID NO: 5981066 - DNA, 19 bp, Homo sapiens
caaatttagtttgttaaag

SEQ ID NO: 5981067 - DNA, 14 bp, Homo sapiens
caaatttataattt

SEQ ID NO: 5981068 - DNA, 13 bp, Homo sapiens
caaatttatcaaa

SEQ ID NO: 5981069 - DNA, 19 bp, Homo sapiens
caaatttatcaaagcatag

SEQ ID NO: 5981070 - DNA, 12 bp, Homo sapiens
caaatttatgca

SEQ ID NO: 5981071 - DNA, 15 bp, Homo sapiens
caaatttatgcattt

SEQ ID NO: 5981072 - DNA, 17 bp, Homo sapiens
caaatttatgcatttca

SEQ ID NO: 5981073 - DNA, 19 bp, Homo sapiens
caaatttatgcatttcatt

SEQ ID NO: 5981074 - DNA, 21 bp, Homo sapiens
caaatttatgcatttcattca

SEQ ID NO: 5981075 - DNA, 17 bp, Homo sapiens
caaatttcaaaagacat

SEQ ID NO: 5981076 - DNA, 11 bp, Homo sapiens
caaatttcaca

SEQ ID NO: 5981077 - DNA, 13 bp, Homo sapiens
caaatttcattgc

SEQ ID NO: 5981078 - DNA, 16 bp, Homo sapiens
caaatttcattgcact

SEQ ID NO: 5981079 - DNA, 21 bp, Homo sapiens
caaatttcattgcactttcct

SEQ ID NO: 5981080 - DNA, 16 bp, Homo sapiens
caaatttcatttcaca

SEQ ID NO: 5981081 - DNA, 20 bp, Homo sapiens
caaatttcatttcacatttt

SEQ ID NO: 5981082 - DNA, 14 bp, Homo sapiens
caaatttccctggg

SEQ ID NO: 5981083 - DNA, 23 bp, Homo sapiens
caaatttccctgggggcatcctg

SEQ ID NO: 5981084 - DNA, 19 bp, Homo sapiens
caaatttcctgtttgaaat

SEQ ID NO: 5981085 - DNA, 14 bp, Homo sapiens
caaatttctaaatc

SEQ ID NO: 5981086 - DNA, 19 bp, Homo sapiens
caaatttctataaatttaa

SEQ ID NO: 5981087 - DNA, 18 bp, Homo sapiens
cacattaatatttgctga

SEQ ID NO: 5981088 - DNA, 19 bp, Homo sapiens
cacattaatatttgctgac

SEQ ID NO: 5981089 - DNA, 15 bp, Homo sapiens
cacattaatctcaaa

SEQ ID NO: 5981090 - DNA, 19 bp, Homo sapiens
cacattaatctcaaagaga

SEQ ID NO: 5981091 - DNA, 18 bp, Homo sapiens
cacattaatggtctaaaa

SEQ ID NO: 5981092 - DNA, 22 bp, Homo sapiens
cacattaatggtctaaaaataa

SEQ ID NO: 5981093 - DNA, 14 bp, Homo sapiens
cacattaattaatt

SEQ ID NO: 5981094 - DNA, 15 bp, Homo sapiens
cacattaattaatta

SEQ ID NO: 5981095 - DNA, 18 bp, Homo sapiens
cacattaattaattaaag

SEQ ID NO: 5981096 - DNA, 23 bp, Homo sapiens
cacattaattagattttcttgca

SEQ ID NO: 5981097 - DNA, 20 bp, Homo sapiens
cacattacttgcacaagctt

SEQ ID NO: 5981098 - DNA, 15 bp, Homo sapiens
cacattagaaatatt

SEQ ID NO: 5981099 - DNA, 16 bp, Homo sapiens
cacattagataaatta

SEQ ID NO: 5981100 - DNA, 20 bp, Homo sapiens
cacattagattttattttac

SEQ ID NO: 5981101 - DNA, 15 bp, Homo sapiens
cacattaggctgttg

SEQ ID NO: 5981102 - DNA, 16 bp, Homo sapiens
cacattatagaaatta

SEQ ID NO: 5981103 - DNA, 22 bp, Homo sapiens
cacattatcactgaaaaaatgt

SEQ ID NO: 5981104 - DNA, 15 bp, Homo sapiens
cacattatcttctgg

SEQ ID NO: 5981105 - DNA, 14 bp, Homo sapiens
cacattatgtatct

SEQ ID NO: 5981106 - DNA, 14 bp, Homo sapiens
cacattatttgcat

SEQ ID NO: 5981107 - DNA, 17 bp, Homo sapiens
cacattcaaccctggag

SEQ ID NO: 5981108 - DNA, 17 bp, Homo sapiens
cacattcaggaagatga

SEQ ID NO: 5981109 - DNA, 23 bp, Homo sapiens
cacattcagggctattttttccc

SEQ ID NO: 5981110 - DNA, 15 bp, Homo sapiens
cacattcatgtacaa

SEQ ID NO: 5981111 - DNA, 15 bp, Homo sapiens
cacattccagccagg

SEQ ID NO: 5981112 - DNA, 15 bp, Homo sapiens
cacattccagggctg

SEQ ID NO: 5981113 - DNA, 17 bp, Homo sapiens
cacattccagggctggg

SEQ ID NO: 5981114 - DNA, 12 bp, Homo sapiens
cacattccatga

SEQ ID NO: 5981115 - DNA, 21 bp, Homo sapiens
cacattcccccaccagctgca

SEQ ID NO: 5981116 - DNA, 17 bp, Homo sapiens
cacattcccctggggac

SEQ ID NO: 5981117 - DNA, 16 bp, Homo sapiens
cacattccctctcatc

SEQ ID NO: 5981118 - DNA, 16 bp, Homo sapiens
cacattcctgaacagg

SEQ ID NO: 5981119 - DNA, 14 bp, Homo sapiens
cacattcctgaccc

SEQ ID NO: 5981120 - DNA, 20 bp, Homo sapiens
cacattcctgaccctcactt

SEQ ID NO: 5981121 - DNA, 21 bp, Homo sapiens
cacattcctggccccgggctc

SEQ ID NO: 5981122 - DNA, 18 bp, Homo sapiens
cacattccttgcctgcac

SEQ ID NO: 5981123 - DNA, 20 bp, Homo sapiens
cacattcgacataccccact

SEQ ID NO: 5981124 - DNA, 17 bp, Homo sapiens
cacattctacttcagct

SEQ ID NO: 5981125 - DNA, 20 bp, Homo sapiens
cacattctcacaattgtaaa

SEQ ID NO: 5981126 - DNA, 12 bp, Homo sapiens
cacattctccct

SEQ ID NO: 5981127 - DNA, 14 bp, Homo sapiens
cacattctcctgtg

SEQ ID NO: 5981128 - DNA, 19 bp, Homo sapiens
cacattctcctgtgcccct

SEQ ID NO: 5981129 - DNA, 13 bp, Homo sapiens
cacattctgcctt

SEQ ID NO: 5981130 - DNA, 14 bp, Homo sapiens
cacattctgctgcc

SEQ ID NO: 5981131 - DNA, 21 bp, Homo sapiens
cacattctgctgcccccagac

SEQ ID NO: 5981132 - DNA, 22 bp, Homo sapiens
cacattctgctgcccccagacc

SEQ ID NO: 5981133 - DNA, 21 bp, Homo sapiens
cacattctggctcagggaggt

SEQ ID NO: 5981134 - DNA, 17 bp, Homo sapiens
cacattcttaaaggaaa

SEQ ID NO: 5981135 - DNA, 16 bp, Homo sapiens
cacattcttataaata

SEQ ID NO: 5981136 - DNA, 16 bp, Homo sapiens
cacattcttcagtttt

SEQ ID NO: 5981137 - DNA, 13 bp, Homo sapiens
cacattcttggct

SEQ ID NO: 5981138 - DNA, 13 bp, Homo sapiens
cacattctttata

SEQ ID NO: 5981139 - DNA, 16 bp, Homo sapiens
cacattctttataaaa

SEQ ID NO: 5981140 - DNA, 13 bp, Homo sapiens
cacattgaaactg

SEQ ID NO: 5981141 - DNA, 17 bp, Homo sapiens
cacattgaaactgtatt

SEQ ID NO: 5981142 - DNA, 23 bp, Homo sapiens
cacattgaaactgtatttacttg

SEQ ID NO: 5981143 - DNA, 21 bp, Homo sapiens
cacattgaaatacttgaaaac

SEQ ID NO: 5981144 - DNA, 23 bp, Homo sapiens
cacattgaagaatgttagagtaa

SEQ ID NO: 5981145 - DNA, 23 bp, Homo sapiens
cacattgaatagtggaacatttt

SEQ ID NO: 5981146 - DNA, 14 bp, Homo sapiens
cacattgaatcatg

SEQ ID NO: 5981147 - DNA, 17 bp, Homo sapiens
cacattgcacacacagt

SEQ ID NO: 5981148 - DNA, 20 bp, Homo sapiens
cacattgcacacacagtctg

SEQ ID NO: 5981149 - DNA, 15 bp, Homo sapiens
cacattgcattctat

SEQ ID NO: 5981150 - DNA, 18 bp, Homo sapiens
cacattgcattctattgc

SEQ ID NO: 5981151 - DNA, 18 bp, Homo sapiens
cacattgccccatgagac

SEQ ID NO: 5981152 - DNA, 13 bp, Homo sapiens
cacattgcccctc

SEQ ID NO: 5981153 - DNA, 17 bp, Homo sapiens
cacattgcccctctgcc

SEQ ID NO: 5981154 - DNA, 18 bp, Homo sapiens
cacattgcccctctgcct

SEQ ID NO: 5981155 - DNA, 14 bp, Homo sapiens
cacattgccctgag

SEQ ID NO: 5981156 - DNA, 13 bp, Homo sapiens
cacattgccttct

SEQ ID NO: 5981157 - DNA, 16 bp, Homo sapiens
cacattgccttctgga

SEQ ID NO: 5981158 - DNA, 13 bp, Homo sapiens
cacattgctggct

SEQ ID NO: 5981159 - DNA, 15 bp, Homo sapiens
cacattgcttcatta

SEQ ID NO: 5981160 - DNA, 22 bp, Homo sapiens
cacattgcttcattaaaacaag

SEQ ID NO: 5981161 - DNA, 17 bp, Homo sapiens
cacattggaccagatga

SEQ ID NO: 5981162 - DNA, 21 bp, Homo sapiens
cacattgggtggggctcctgg

SEQ ID NO: 5981163 - DNA, 21 bp, Homo sapiens
cacattggtctatctactggc

SEQ ID NO: 5981164 - DNA, 23 bp, Homo sapiens
cacattgtagcctaatattcatg

SEQ ID NO: 5981165 - DNA, 12 bp, Homo sapiens
cacattgtgcag

SEQ ID NO: 5981166 - DNA, 13 bp, Homo sapiens
cacatttaaaaca

SEQ ID NO: 5981167 - DNA, 14 bp, Homo sapiens
cacatttaaaacat

SEQ ID NO: 5981168 - DNA, 16 bp, Homo sapiens
cacatttaagagacag

SEQ ID NO: 5981169 - DNA, 13 bp, Homo sapiens
cacatttaaggat

SEQ ID NO: 5981170 - DNA, 20 bp, Homo sapiens
cacatttacactagaggcca

SEQ ID NO: 5981171 - DNA, 12 bp, Homo sapiens
cacatttacata

SEQ ID NO: 5981172 - DNA, 18 bp, Homo sapiens
cacatttaccctttggcc

SEQ ID NO: 5981173 - DNA, 18 bp, Homo sapiens
cacatttacctcgaggct

SEQ ID NO: 5981174 - DNA, 21 bp, Homo sapiens
cacatttacctcgaggctctt

SEQ ID NO: 5981175 - DNA, 19 bp, Homo sapiens
cacatttactagctgtgca

SEQ ID NO: 5981176 - DNA, 14 bp, Homo sapiens
cacatttatatata

SEQ ID NO: 5981177 - DNA, 18 bp, Homo sapiens
cacatttatatatatatg

SEQ ID NO: 5981178 - DNA, 17 bp, Homo sapiens
cacatttattctgctca

SEQ ID NO: 5981179 - DNA, 16 bp, Homo sapiens
cacatttcacattgaa

SEQ ID NO: 5981180 - DNA, 16 bp, Homo sapiens
cacatttcactgtctg

SEQ ID NO: 5981181 - DNA, 17 bp, Homo sapiens
cacatttcactgtctgt

SEQ ID NO: 5981182 - DNA, 16 bp, Homo sapiens
cacatttcatagccta

SEQ ID NO: 5981183 - DNA, 13 bp, Homo sapiens
cacatttcatcta

SEQ ID NO: 5981184 - DNA, 11 bp, Homo sapiens
cacatttccat

SEQ ID NO: 5981185 - DNA, 13 bp, Homo sapiens
cacatttctaaaa

SEQ ID NO: 5981186 - DNA, 15 bp, Homo sapiens
cacatttctaagcct

SEQ ID NO: 5981187 - DNA, 16 bp, Homo sapiens
cacatttctaagcctt

SEQ ID NO: 5981188 - DNA, 17 bp, Homo sapiens
cacatttctaagccttt

SEQ ID NO: 5981189 - DNA, 18 bp, Homo sapiens
cacatttctcaacaaggc

SEQ ID NO: 5981190 - DNA, 12 bp, Homo sapiens
cacatttctgat

SEQ ID NO: 5981191 - DNA, 13 bp, Homo sapiens
cacatttctgcca

SEQ ID NO: 5981192 - DNA, 14 bp, Homo sapiens
cacatttctggatt

SEQ ID NO: 5981193 - DNA, 20 bp, Homo sapiens
cacatttctggccatttaac

SEQ ID NO: 5981194 - DNA, 12 bp, Homo sapiens
cacatttcttaa

SEQ ID NO: 5981195 - DNA, 17 bp, Homo sapiens
cacatttcttaaaacac

SEQ ID NO: 5981196 - DNA, 19 bp, Homo sapiens
cacatttcttaaaacacat

SEQ ID NO: 5981197 - DNA, 21 bp, Homo sapiens
cacatttcttaaaacacatga

SEQ ID NO: 5981198 - DNA, 15 bp, Homo sapiens
cacatttctttgcat

SEQ ID NO: 5981199 - DNA, 19 bp, Homo sapiens
cacatttctttgcattcca

SEQ ID NO: 5981200 - DNA, 16 bp, Homo sapiens
cacatttgaattcatt

SEQ ID NO: 5981201 - DNA, 17 bp, Homo sapiens
cacatttgatgtacatg

SEQ ID NO: 5981202 - DNA, 21 bp, Homo sapiens
cacatttgctactgttgtaag

SEQ ID NO: 5981203 - DNA, 16 bp, Homo sapiens
cacatttggaatactt

SEQ ID NO: 5981204 - DNA, 17 bp, Homo sapiens
cacatttggaatacttt

SEQ ID NO: 5981205 - DNA, 19 bp, Homo sapiens
cacatttggaatacttttt

SEQ ID NO: 5981206 - DNA, 19 bp, Homo sapiens
cacatttgggatgttcctt

SEQ ID NO: 5981207 - DNA, 17 bp, Homo sapiens
cacatttgggctcaggg

SEQ ID NO: 5981208 - DNA, 18 bp, Homo sapiens
cacatttgggctcagggt

SEQ ID NO: 5981209 - DNA, 20 bp, Homo sapiens
cacatttgtatgtgtgtaga

SEQ ID NO: 5981210 - DNA, 20 bp, Homo sapiens
cacatttgtcactgaataat

SEQ ID NO: 5981211 - DNA, 19 bp, Homo sapiens
cacatttgtcagtattttt

SEQ ID NO: 5981212 - DNA, 23 bp, Homo sapiens
cacatttgtcttctttctgtctt

SEQ ID NO: 5981213 - DNA, 18 bp, Homo sapiens
cacatttgtgaactcaaa

SEQ ID NO: 5981214 - DNA, 14 bp, Homo sapiens
cacatttgtgcata

SEQ ID NO: 5981215 - DNA, 19 bp, Homo sapiens
cacatttgtgcataaattt

SEQ ID NO: 5981216 - DNA, 20 bp, Homo sapiens
cacatttgttcatgagtgga

SEQ ID NO: 5981217 - DNA, 13 bp, Homo sapiens
cacattttaagtg

SEQ ID NO: 5981218 - DNA, 21 bp, Homo sapiens
cacattttattaaacacaggg

SEQ ID NO: 5981219 - DNA, 22 bp, Homo sapiens
cacattttattaaacacaggga

SEQ ID NO: 5981220 - DNA, 13 bp, Homo sapiens
cacattttcttta

SEQ ID NO: 5981221 - DNA, 15 bp, Homo sapiens
cacattttgctttat

SEQ ID NO: 5981222 - DNA, 14 bp, Homo sapiens
cacattttgtaaat

SEQ ID NO: 5981223 - DNA, 18 bp, Homo sapiens
cacattttgtaaatctgt

SEQ ID NO: 5981224 - DNA, 20 bp, Homo sapiens
cacattttgtaaatctgtac

SEQ ID NO: 5981225 - DNA, 20 bp, Homo sapiens
cacattttgtacaaagatat

SEQ ID NO: 5981226 - DNA, 19 bp, Homo sapiens
cacattttgtatggagtta

SEQ ID NO: 5981227 - DNA, 19 bp, Homo sapiens
cacattttgtggctgttga

SEQ ID NO: 5981228 - DNA, 21 bp, Homo sapiens
cacatttttatacctgtttaa

SEQ ID NO: 5981229 - DNA, 17 bp, Homo sapiens
cacatttttgcacagat

SEQ ID NO: 5981230 - DNA, 20 bp, Homo sapiens
cacatttttgcacagattat

SEQ ID NO: 5981231 - DNA, 19 bp, Homo sapiens
cacatttttggatttctgt

SEQ ID NO: 5981232 - DNA, 13 bp, Homo sapiens
cacatttttgtaa

SEQ ID NO: 5981233 - DNA, 21 bp, Homo sapiens
cacatttttttctatgcataa

SEQ ID NO: 5981234 - DNA, 19 bp, Homo sapiens
cacatttttttttttaatt

SEQ ID NO: 5981235 - DNA, 18 bp, Homo sapiens
caccaaaaaaatacttga

SEQ ID NO: 5981236 - DNA, 19 bp, Homo sapiens
caccaaaaaaatccagaaa

SEQ ID NO: 5981237 - DNA, 14 bp, Homo sapiens
caccaaaaaatatc

SEQ ID NO: 5981238 - DNA, 22 bp, Homo sapiens
caccaaaaaatctatagtttga

SEQ ID NO: 5981239 - DNA, 14 bp, Homo sapiens
caccaaaaacctat

SEQ ID NO: 5981240 - DNA, 23 bp, Homo sapiens
caccaaaaccaaacttgttcatt

SEQ ID NO: 5981241 - DNA, 19 bp, Homo sapiens
caccaaaactatcctgatt

SEQ ID NO: 5981242 - DNA, 20 bp, Homo sapiens
caccaaaagtgctccccaaa

SEQ ID NO: 5981243 - DNA, 17 bp, Homo sapiens
caccaaaattatagctt

SEQ ID NO: 5981244 - DNA, 18 bp, Homo sapiens
caccaaaattatagcttt

SEQ ID NO: 5981245 - DNA, 16 bp, Homo sapiens
caccaaacatactaga

SEQ ID NO: 5981246 - DNA, 16 bp, Homo sapiens
caccaaactgcacaca

SEQ ID NO: 5981247 - DNA, 21 bp, Homo sapiens
caccaaactgcacacacagct

SEQ ID NO: 5981248 - DNA, 13 bp, Homo sapiens
caccaaactgcct

SEQ ID NO: 5981249 - DNA, 21 bp, Homo sapiens
caccaaagaattgtaggcagt

SEQ ID NO: 5981250 - DNA, 17 bp, Homo sapiens
caccaaagatctgctcc

SEQ ID NO: 5981251 - DNA, 19 bp, Homo sapiens
caccaaagatctgctcctc

SEQ ID NO: 5981252 - DNA, 15 bp, Homo sapiens
caccaaagatgcagc

SEQ ID NO: 5981253 - DNA, 13 bp, Homo sapiens
caccaaagctgcc

SEQ ID NO: 5981254 - DNA, 14 bp, Homo sapiens
caccaaagctgccc

SEQ ID NO: 5981255 - DNA, 18 bp, Homo sapiens
caccaaagctgcccactg

SEQ ID NO: 5981256 - DNA, 12 bp, Homo sapiens
caccaaagttct

SEQ ID NO: 5981257 - DNA, 20 bp, Homo sapiens
caccaaatacaattcaaatg

SEQ ID NO: 5981258 - DNA, 23 bp, Homo sapiens
caccaaatagcttttcacttctt

SEQ ID NO: 5981259 - DNA, 11 bp, Homo sapiens
caccaaatagg

SEQ ID NO: 5981260 - DNA, 13 bp, Homo sapiens
caccaaatatttt

SEQ ID NO: 5981261 - DNA, 16 bp, Homo sapiens
caccaaatattttcaa

SEQ ID NO: 5981262 - DNA, 18 bp, Homo sapiens
caccaaatcatcctgaat

SEQ ID NO: 5981263 - DNA, 15 bp, Homo sapiens
caccaaatctgtcta

SEQ ID NO: 5981264 - DNA, 19 bp, Homo sapiens
caccaaatctgtctagaat

SEQ ID NO: 5981265 - DNA, 17 bp, Homo sapiens
caccaaatgcctctgcc

SEQ ID NO: 5981266 - DNA, 22 bp, Homo sapiens
caccaaattcatgtacagcatg

SEQ ID NO: 5981267 - DNA, 19 bp, Homo sapiens
caaatttctctgttccata

SEQ ID NO: 5981268 - DNA, 11 bp, Homo sapiens
caaatttgatg

SEQ ID NO: 5981269 - DNA, 19 bp, Homo sapiens
caaatttgatgatgttaaa

SEQ ID NO: 5981270 - DNA, 23 bp, Homo sapiens
caaatttgccaccactagagctg

SEQ ID NO: 5981271 - DNA, 21 bp, Homo sapiens
caaatttggccttaagaactg

SEQ ID NO: 5981272 - DNA, 22 bp, Homo sapiens
caaatttggccttaagaactgt

SEQ ID NO: 5981273 - DNA, 19 bp, Homo sapiens
caaatttgtacctctaagt

SEQ ID NO: 5981274 - DNA, 17 bp, Homo sapiens
caaatttgtcttgcctt

SEQ ID NO: 5981275 - DNA, 14 bp, Homo sapiens
caaatttgtgaact

SEQ ID NO: 5981276 - DNA, 11 bp, Homo sapiens
caaatttgtgt

SEQ ID NO: 5981277 - DNA, 17 bp, Homo sapiens
caaattttaatttttgc

SEQ ID NO: 5981278 - DNA, 17 bp, Homo sapiens
caaattttatttgtagg

SEQ ID NO: 5981279 - DNA, 21 bp, Homo sapiens
caaattttcactgctgctcct

SEQ ID NO: 5981280 - DNA, 23 bp, Homo sapiens
caaattttcccagtgaataaata

SEQ ID NO: 5981281 - DNA, 13 bp, Homo sapiens
caaattttctggt

SEQ ID NO: 5981282 - DNA, 21 bp, Homo sapiens
caaattttgatgccaagaaag

SEQ ID NO: 5981283 - DNA, 13 bp, Homo sapiens
caaattttgcatt

SEQ ID NO: 5981284 - DNA, 18 bp, Homo sapiens
caaattttgcatttagtt

SEQ ID NO: 5981285 - DNA, 21 bp, Homo sapiens
caaattttgccagagaaacta

SEQ ID NO: 5981286 - DNA, 14 bp, Homo sapiens
caaatttttactca

SEQ ID NO: 5981287 - DNA, 22 bp, Homo sapiens
caaatttttactcaggctttct

SEQ ID NO: 5981288 - DNA, 23 bp, Homo sapiens
caaatttttactcaggctttcta

SEQ ID NO: 5981289 - DNA, 23 bp, Homo sapiens
caaatttttattttttagtgcat

SEQ ID NO: 5981290 - DNA, 20 bp, Homo sapiens
caaatttttctgctttaaaa

SEQ ID NO: 5981291 - DNA, 19 bp, Homo sapiens
caaatttttctgggaagaa

SEQ ID NO: 5981292 - DNA, 19 bp, Homo sapiens
caaattttttaaaagagac

SEQ ID NO: 5981293 - DNA, 23 bp, Homo sapiens
caaattttttgactttttttgta

SEQ ID NO: 5981294 - DNA, 21 bp, Homo sapiens
caaatttttttgtatttttag

SEQ ID NO: 5981295 - DNA, 13 bp, Homo sapiens
caacaaaaacaaa

SEQ ID NO: 5981296 - DNA, 13 bp, Homo sapiens
caacaaaaagaca

SEQ ID NO: 5981297 - DNA, 16 bp, Homo sapiens
caacaaaaatgtgggt

SEQ ID NO: 5981298 - DNA, 14 bp, Homo sapiens
caacaaaagaagcc

SEQ ID NO: 5981299 - DNA, 15 bp, Homo sapiens
caacaaaagaatttt

SEQ ID NO: 5981300 - DNA, 19 bp, Homo sapiens
caacaaaagggagaacatg

SEQ ID NO: 5981301 - DNA, 14 bp, Homo sapiens
caacaaaatcaatt

SEQ ID NO: 5981302 - DNA, 19 bp, Homo sapiens
caacaaaatcatggcttag

SEQ ID NO: 5981303 - DNA, 15 bp, Homo sapiens
caacaaaatccatgt

SEQ ID NO: 5981304 - DNA, 13 bp, Homo sapiens
caacaaacactgt

SEQ ID NO: 5981305 - DNA, 15 bp, Homo sapiens
caacaaacactgtga

SEQ ID NO: 5981306 - DNA, 12 bp, Homo sapiens
caacaaacagtg

SEQ ID NO: 5981307 - DNA, 16 bp, Homo sapiens
caacaaactgcacatg

SEQ ID NO: 5981308 - DNA, 17 bp, Homo sapiens
caacaaactgcacatga

SEQ ID NO: 5981309 - DNA, 15 bp, Homo sapiens
caacaaagacatgct

SEQ ID NO: 5981310 - DNA, 16 bp, Homo sapiens
caacaaagaggacacc

SEQ ID NO: 5981311 - DNA, 17 bp, Homo sapiens
caacaaagaggattaga

SEQ ID NO: 5981312 - DNA, 22 bp, Homo sapiens
caacaaagcatgctcagtattg

SEQ ID NO: 5981313 - DNA, 12 bp, Homo sapiens
caacaaagctgt

SEQ ID NO: 5981314 - DNA, 16 bp, Homo sapiens
caacaaagctgttgat

SEQ ID NO: 5981315 - DNA, 18 bp, Homo sapiens
caacaaaggcaagttaag

SEQ ID NO: 5981316 - DNA, 18 bp, Homo sapiens
caacaaagtgctttttca

SEQ ID NO: 5981317 - DNA, 14 bp, Homo sapiens
caacaaataattta

SEQ ID NO: 5981318 - DNA, 22 bp, Homo sapiens
caacaaatattcactggcccct

SEQ ID NO: 5981319 - DNA, 19 bp, Homo sapiens
caacaaattaggttttgta

SEQ ID NO: 5981320 - DNA, 15 bp, Homo sapiens
caacaaatttcattg

SEQ ID NO: 5981321 - DNA, 17 bp, Homo sapiens
caacaaatttcattgca

SEQ ID NO: 5981322 - DNA, 20 bp, Homo sapiens
caacaaatttcattgcactt

SEQ ID NO: 5981323 - DNA, 21 bp, Homo sapiens
caacaaatttcattgcacttt

SEQ ID NO: 5981324 - DNA, 15 bp, Homo sapiens
caacaacaaaccaaa

SEQ ID NO: 5981325 - DNA, 12 bp, Homo sapiens
caacaacaacaa

SEQ ID NO: 5981326 - DNA, 15 bp, Homo sapiens
caacaacaacaataa

SEQ ID NO: 5981327 - DNA, 12 bp, Homo sapiens
caacaacaataa

SEQ ID NO: 5981328 - DNA, 16 bp, Homo sapiens
caacaacaataacaac

SEQ ID NO: 5981329 - DNA, 15 bp, Homo sapiens
caacaacaattggta

SEQ ID NO: 5981330 - DNA, 15 bp, Homo sapiens
caacaacagaacaac

SEQ ID NO: 5981331 - DNA, 17 bp, Homo sapiens
caacaacagtcagccag

SEQ ID NO: 5981332 - DNA, 13 bp, Homo sapiens
caacaacatccat

SEQ ID NO: 5981333 - DNA, 13 bp, Homo sapiens
caacaacatgaaa

SEQ ID NO: 5981334 - DNA, 21 bp, Homo sapiens
caacaacatgtataatatttt

SEQ ID NO: 5981335 - DNA, 22 bp, Homo sapiens
caacaacatgtataatattttt

SEQ ID NO: 5981336 - DNA, 17 bp, Homo sapiens
caacaaccacagtgcca

SEQ ID NO: 5981337 - DNA, 19 bp, Homo sapiens
caacaaccaccaccacaat

SEQ ID NO: 5981338 - DNA, 18 bp, Homo sapiens
caacaacctcaactgcct

SEQ ID NO: 5981339 - DNA, 19 bp, Homo sapiens
caacaacctcaactgccta

SEQ ID NO: 5981340 - DNA, 23 bp, Homo sapiens
caacaacgtgagagaaagagaga

SEQ ID NO: 5981341 - DNA, 14 bp, Homo sapiens
caacaactctgcct

SEQ ID NO: 5981342 - DNA, 19 bp, Homo sapiens
caacaactgtcagaataaa

SEQ ID NO: 5981343 - DNA, 15 bp, Homo sapiens
caacaactgtccctc

SEQ ID NO: 5981344 - DNA, 14 bp, Homo sapiens
caacaacttaatgt

SEQ ID NO: 5981345 - DNA, 15 bp, Homo sapiens
caacaacttaatgtg

SEQ ID NO: 5981346 - DNA, 18 bp, Homo sapiens
caacaacttactaaatct

SEQ ID NO: 5981347 - DNA, 21 bp, Homo sapiens
caacaacttttccctcactgt

SEQ ID NO: 5981348 - DNA, 15 bp, Homo sapiens
caacaagaaactgtc

SEQ ID NO: 5981349 - DNA, 11 bp, Homo sapiens
caacaagaaca

SEQ ID NO: 5981350 - DNA, 14 bp, Homo sapiens
caacaagaaccact

SEQ ID NO: 5981351 - DNA, 14 bp, Homo sapiens
caacaagaagaaac

SEQ ID NO: 5981352 - DNA, 14 bp, Homo sapiens
caacaagaagaaat

SEQ ID NO: 5981353 - DNA, 19 bp, Homo sapiens
caacaagaagaaatatgaa

SEQ ID NO: 5981354 - DNA, 23 bp, Homo sapiens
caacaagaagaaatatgaaattc

SEQ ID NO: 5981355 - DNA, 20 bp, Homo sapiens
caacaagaagggactgagag

SEQ ID NO: 5981356 - DNA, 12 bp, Homo sapiens
caacaagaatgc

SEQ ID NO: 5981357 - DNA, 13 bp, Homo sapiens
caacaagaatgca

SEQ ID NO: 5981358 - DNA, 18 bp, Homo sapiens
caacaagccctgcttttg

SEQ ID NO: 5981359 - DNA, 14 bp, Homo sapiens
caacaagctatttt

SEQ ID NO: 5981360 - DNA, 16 bp, Homo sapiens
caacaaggaaactttc

SEQ ID NO: 5981361 - DNA, 16 bp, Homo sapiens
caacaaggcaaaaaca

SEQ ID NO: 5981362 - DNA, 18 bp, Homo sapiens
caacaagggcagtggagg

SEQ ID NO: 5981363 - DNA, 20 bp, Homo sapiens
caacaagggtccgtggacca

SEQ ID NO: 5981364 - DNA, 15 bp, Homo sapiens
caacaaggtatacct

SEQ ID NO: 5981365 - DNA, 16 bp, Homo sapiens
caacaaggtgcacaga

SEQ ID NO: 5981366 - DNA, 19 bp, Homo sapiens
caacaaggttatatgaata

SEQ ID NO: 5981367 - DNA, 15 bp, Homo sapiens
caacaagttgaagaa

SEQ ID NO: 5981368 - DNA, 18 bp, Homo sapiens
caacaagttgaagaagct

SEQ ID NO: 5981369 - DNA, 13 bp, Homo sapiens
caacaagttgcct

SEQ ID NO: 5981370 - DNA, 22 bp, Homo sapiens
caacaagttgtttcaaacagca

SEQ ID NO: 5981371 - DNA, 14 bp, Homo sapiens
caacaataaaaaaa

SEQ ID NO: 5981372 - DNA, 17 bp, Homo sapiens
caacaataaaaaaaaac

SEQ ID NO: 5981373 - DNA, 14 bp, Homo sapiens
caacaataaaacat

SEQ ID NO: 5981374 - DNA, 13 bp, Homo sapiens
caacaataaaata

SEQ ID NO: 5981375 - DNA, 16 bp, Homo sapiens
caacaataaaatagca

SEQ ID NO: 5981376 - DNA, 20 bp, Homo sapiens
caacaataaacaggaatttt

SEQ ID NO: 5981377 - DNA, 15 bp, Homo sapiens
caacaataacaacaa

SEQ ID NO: 5981378 - DNA, 14 bp, Homo sapiens
caacaatacaacaa

SEQ ID NO: 5981379 - DNA, 18 bp, Homo sapiens
caacaatacaacaagaac

SEQ ID NO: 5981380 - DNA, 19 bp, Homo sapiens
caacaatacaacaagaaca

SEQ ID NO: 5981381 - DNA, 15 bp, Homo sapiens
caacaatcctagtgc

SEQ ID NO: 5981382 - DNA, 13 bp, Homo sapiens
caacaatctggag

SEQ ID NO: 5981383 - DNA, 21 bp, Homo sapiens
caacaatgattaatcagctgt

SEQ ID NO: 5981384 - DNA, 12 bp, Homo sapiens
caacaatgcaaa

SEQ ID NO: 5981385 - DNA, 13 bp, Homo sapiens
caacaatgctttg

SEQ ID NO: 5981386 - DNA, 18 bp, Homo sapiens
caacaatggggtgggccc

SEQ ID NO: 5981387 - DNA, 17 bp, Homo sapiens
caacaatggtttacatg

SEQ ID NO: 5981388 - DNA, 12 bp, Homo sapiens
caacaattagag

SEQ ID NO: 5981389 - DNA, 18 bp, Homo sapiens
caacaattagaggaattt

SEQ ID NO: 5981390 - DNA, 13 bp, Homo sapiens
caacaattctaaa

SEQ ID NO: 5981391 - DNA, 15 bp, Homo sapiens
caacaattggagggt

SEQ ID NO: 5981392 - DNA, 20 bp, Homo sapiens
caacaattggtgtcattttc

SEQ ID NO: 5981393 - DNA, 13 bp, Homo sapiens
caacaatttctac

SEQ ID NO: 5981394 - DNA, 18 bp, Homo sapiens
caacaatttctactttga

SEQ ID NO: 5981395 - DNA, 19 bp, Homo sapiens
caacaatttctactttgaa

SEQ ID NO: 5981396 - DNA, 21 bp, Homo sapiens
caacaatttgggcttcctgtt

SEQ ID NO: 5981397 - DNA, 12 bp, Homo sapiens
caacaattttca

SEQ ID NO: 5981398 - DNA, 18 bp, Homo sapiens
caacaattttcagatttg

SEQ ID NO: 5981399 - DNA, 19 bp, Homo sapiens
caacaattttcagatttgc

SEQ ID NO: 5981400 - DNA, 13 bp, Homo sapiens
caacacaaactgg

SEQ ID NO: 5981401 - DNA, 14 bp, Homo sapiens
caacacaaagacac

SEQ ID NO: 5981402 - DNA, 15 bp, Homo sapiens
caacacaaagacatg

SEQ ID NO: 5981403 - DNA, 21 bp, Homo sapiens
caacacaaagacatggaaggt

SEQ ID NO: 5981404 - DNA, 12 bp, Homo sapiens
caacacaaagag

SEQ ID NO: 5981405 - DNA, 22 bp, Homo sapiens
caacacaaagagaaaaagaaat

SEQ ID NO: 5981406 - DNA, 18 bp, Homo sapiens
caacacaacatttgtgtc

SEQ ID NO: 5981407 - DNA, 12 bp, Homo sapiens
caacacaagaaa

SEQ ID NO: 5981408 - DNA, 21 bp, Homo sapiens
caacacaagacaccttttgta

SEQ ID NO: 5981409 - DNA, 17 bp, Homo sapiens
caacacaagcaccccag

SEQ ID NO: 5981410 - DNA, 14 bp, Homo sapiens
caacacaaggtggg

SEQ ID NO: 5981411 - DNA, 16 bp, Homo sapiens
caacacaataacacta

SEQ ID NO: 5981412 - DNA, 18 bp, Homo sapiens
caacacaatgttattcgt

SEQ ID NO: 5981413 - DNA, 22 bp, Homo sapiens
caacacacacaacgtaaaaata

SEQ ID NO: 5981414 - DNA, 14 bp, Homo sapiens
caacacacacactc

SEQ ID NO: 5981415 - DNA, 15 bp, Homo sapiens
caacacacacatgct

SEQ ID NO: 5981416 - DNA, 23 bp, Homo sapiens
caacacacacatgcttccctttc

SEQ ID NO: 5981417 - DNA, 16 bp, Homo sapiens
caacacacctggtgaa

SEQ ID NO: 5981418 - DNA, 15 bp, Homo sapiens
caacacactgcctta

SEQ ID NO: 5981419 - DNA, 15 bp, Homo sapiens
caacacagcctgggc

SEQ ID NO: 5981420 - DNA, 19 bp, Homo sapiens
caacacagcttgtctcttg

SEQ ID NO: 5981421 - DNA, 22 bp, Homo sapiens
caacacatcaggaaagagagca

SEQ ID NO: 5981422 - DNA, 20 bp, Homo sapiens
caacacatgtgggagaggag

SEQ ID NO: 5981423 - DNA, 21 bp, Homo sapiens
caacacattacttgcacaagc

SEQ ID NO: 5981424 - DNA, 17 bp, Homo sapiens
caacacattgaaactgt

SEQ ID NO: 5981425 - DNA, 13 bp, Homo sapiens
caacacatttcac

SEQ ID NO: 5981426 - DNA, 18 bp, Homo sapiens
caacacatttcacttttc

SEQ ID NO: 5981427 - DNA, 17 bp, Homo sapiens
caacaccaaaaaatatc

SEQ ID NO: 5981428 - DNA, 13 bp, Homo sapiens
caacaccaagcac

SEQ ID NO: 5981429 - DNA, 15 bp, Homo sapiens
caacaccaagcacag

SEQ ID NO: 5981430 - DNA, 22 bp, Homo sapiens
caacaccaagcacagcagcctg

SEQ ID NO: 5981431 - DNA, 13 bp, Homo sapiens
caacaccacagac

SEQ ID NO: 5981432 - DNA, 17 bp, Homo sapiens
caacaccacagacacac

SEQ ID NO: 5981433 - DNA, 13 bp, Homo sapiens
caacaccacccct

SEQ ID NO: 5981434 - DNA, 13 bp, Homo sapiens
caacaccagaaag

SEQ ID NO: 5981435 - DNA, 17 bp, Homo sapiens
caacaccagcccctgcc

SEQ ID NO: 5981436 - DNA, 18 bp, Homo sapiens
caacaccagcccctgccc

SEQ ID NO: 5981437 - DNA, 18 bp, Homo sapiens
caacaccatcacagcttg

SEQ ID NO: 5981438 - DNA, 22 bp, Homo sapiens
caacaccatcacagcttgtttt

SEQ ID NO: 5981439 - DNA, 16 bp, Homo sapiens
caacacccatctgttt

SEQ ID NO: 5981440 - DNA, 16 bp, Homo sapiens
caacacccatttttcc

SEQ ID NO: 5981441 - DNA, 18 bp, Homo sapiens
caacaccccacaggaggg

SEQ ID NO: 5981442 - DNA, 21 bp, Homo sapiens
caacacccccgacggcctcca

SEQ ID NO: 5981443 - DNA, 17 bp, Homo sapiens
caacaccccgcctgcct

SEQ ID NO: 5981444 - DNA, 18 bp, Homo sapiens
caacaccccgcctgcctc

SEQ ID NO: 5981445 - DNA, 21 bp, Homo sapiens
caacaccctgcttctcccggg

SEQ ID NO: 5981446 - DNA, 12 bp, Homo sapiens
caacacctcctc

SEQ ID NO: 5981447 - DNA, 13 bp, Homo sapiens
caacacctcctcc

SEQ ID NO: 5981448 - DNA, 23 bp, Homo sapiens
caccaaattgctgagatgtttag

SEQ ID NO: 5981449 - DNA, 21 bp, Homo sapiens
caccaaattgttatttgcact

SEQ ID NO: 5981450 - DNA, 20 bp, Homo sapiens
caccaacaacagtcagccag

SEQ ID NO: 5981451 - DNA, 15 bp, Homo sapiens
caccaacaccacggt

SEQ ID NO: 5981452 - DNA, 22 bp, Homo sapiens
caccaacatcccattgccctgg

SEQ ID NO: 5981453 - DNA, 15 bp, Homo sapiens
caccaaccagacagc

SEQ ID NO: 5981454 - DNA, 23 bp, Homo sapiens
caccaaccagacagcacagggca

SEQ ID NO: 5981455 - DNA, 15 bp, Homo sapiens
caccaaccaggcctt

SEQ ID NO: 5981456 - DNA, 19 bp, Homo sapiens
caccaacccatcagaagga

SEQ ID NO: 5981457 - DNA, 16 bp, Homo sapiens
caccaaccccgcggcc

SEQ ID NO: 5981458 - DNA, 13 bp, Homo sapiens
caccaaccctcag

SEQ ID NO: 5981459 - DNA, 18 bp, Homo sapiens
caccaacctcactgccct

SEQ ID NO: 5981460 - DNA, 12 bp, Homo sapiens
caccaacctcca

SEQ ID NO: 5981461 - DNA, 18 bp, Homo sapiens
caccaacctccagactca

SEQ ID NO: 5981462 - DNA, 19 bp, Homo sapiens
caccaacctccagactcag

SEQ ID NO: 5981463 - DNA, 20 bp, Homo sapiens
caccaacctccagactcagc

SEQ ID NO: 5981464 - DNA, 22 bp, Homo sapiens
caccaacctccagactcagcag

SEQ ID NO: 5981465 - DNA, 19 bp, Homo sapiens
caccaactcctagttctag

SEQ ID NO: 5981466 - DNA, 15 bp, Homo sapiens
caccaactctgcact

SEQ ID NO: 5981467 - DNA, 18 bp, Homo sapiens
caccaactctgcactcca

SEQ ID NO: 5981468 - DNA, 19 bp, Homo sapiens
caccaactctgcactccat

SEQ ID NO: 5981469 - DNA, 20 bp, Homo sapiens
caccaactctgcactccatg

SEQ ID NO: 5981470 - DNA, 18 bp, Homo sapiens
caccaactgaattaaact

SEQ ID NO: 5981471 - DNA, 19 bp, Homo sapiens
caccaactggccctcttct

SEQ ID NO: 5981472 - DNA, 13 bp, Homo sapiens
caccaacttgcca

SEQ ID NO: 5981473 - DNA, 14 bp, Homo sapiens
caccaactttttcc

SEQ ID NO: 5981474 - DNA, 13 bp, Homo sapiens
caccaagaaacca

SEQ ID NO: 5981475 - DNA, 15 bp, Homo sapiens
caccaagaaaccact

SEQ ID NO: 5981476 - DNA, 15 bp, Homo sapiens
caccaagaaagcagg

SEQ ID NO: 5981477 - DNA, 13 bp, Homo sapiens
caccaagaagcaa

SEQ ID NO: 5981478 - DNA, 13 bp, Homo sapiens
caccaagaagggg

SEQ ID NO: 5981479 - DNA, 15 bp, Homo sapiens
caccaagaaggggct

SEQ ID NO: 5981480 - DNA, 15 bp, Homo sapiens
caccaagacagtgct

SEQ ID NO: 5981481 - DNA, 18 bp, Homo sapiens
caccaagagtagcacctt

SEQ ID NO: 5981482 - DNA, 16 bp, Homo sapiens
caccaagcacagcagc

SEQ ID NO: 5981483 - DNA, 23 bp, Homo sapiens
caccaagcagtggcctttttctg

SEQ ID NO: 5981484 - DNA, 13 bp, Homo sapiens
caccaagcccaca

SEQ ID NO: 5981485 - DNA, 14 bp, Homo sapiens
caccaagcccacag

SEQ ID NO: 5981486 - DNA, 23 bp, Homo sapiens
caccaagcccacaggtgtcccca

SEQ ID NO: 5981487 - DNA, 23 bp, Homo sapiens
caccaagcccgaccgggccaggc

SEQ ID NO: 5981488 - DNA, 20 bp, Homo sapiens
caccaagcccgcctccagca

SEQ ID NO: 5981489 - DNA, 17 bp, Homo sapiens
caccaagccctgcaaat

SEQ ID NO: 5981490 - DNA, 22 bp, Homo sapiens
caccaagcctggtcagcccaaa

SEQ ID NO: 5981491 - DNA, 16 bp, Homo sapiens
caccaagctcaaagcg

SEQ ID NO: 5981492 - DNA, 18 bp, Homo sapiens
caccaagctcacacctgt

SEQ ID NO: 5981493 - DNA, 16 bp, Homo sapiens
caccaagctcaccctt

SEQ ID NO: 5981494 - DNA, 16 bp, Homo sapiens
caccaagctgtgccac

SEQ ID NO: 5981495 - DNA, 14 bp, Homo sapiens
caccaagctgttcc

SEQ ID NO: 5981496 - DNA, 12 bp, Homo sapiens
caccaaggaaac

SEQ ID NO: 5981497 - DNA, 16 bp, Homo sapiens
caccaaggcagtgcat

SEQ ID NO: 5981498 - DNA, 21 bp, Homo sapiens
caccaaggcagtgcatgcatg

SEQ ID NO: 5981499 - DNA, 22 bp, Homo sapiens
caccaaggcagtgcatgcatgt

SEQ ID NO: 5981500 - DNA, 16 bp, Homo sapiens
caccaaggctgcctgc

SEQ ID NO: 5981501 - DNA, 18 bp, Homo sapiens
caccaaggctgcctgccc

SEQ ID NO: 5981502 - DNA, 16 bp, Homo sapiens
caccaagggacaggag

SEQ ID NO: 5981503 - DNA, 14 bp, Homo sapiens
caccaagggatctg

SEQ ID NO: 5981504 - DNA, 10 bp, Homo sapiens
caccaagggc

SEQ ID NO: 5981505 - DNA, 18 bp, Homo sapiens
caccaagggcgcaagagt

SEQ ID NO: 5981506 - DNA, 23 bp, Homo sapiens
caccaagggcgcaagagtagcgg

SEQ ID NO: 5981507 - DNA, 15 bp, Homo sapiens
caccaagggtatctg

SEQ ID NO: 5981508 - DNA, 22 bp, Homo sapiens
caccaaggtctcacactcctcc

SEQ ID NO: 5981509 - DNA, 14 bp, Homo sapiens
caccaaggtcttca

SEQ ID NO: 5981510 - DNA, 17 bp, Homo sapiens
caccaagtaaatctatc

SEQ ID NO: 5981511 - DNA, 13 bp, Homo sapiens
caccaagtaaatt

SEQ ID NO: 5981512 - DNA, 15 bp, Homo sapiens
caccaagtacagcct

SEQ ID NO: 5981513 - DNA, 18 bp, Homo sapiens
caccaagtacagccttca

SEQ ID NO: 5981514 - DNA, 22 bp, Homo sapiens
caccaagtattaaactgtaaat

SEQ ID NO: 5981515 - DNA, 18 bp, Homo sapiens
caccaagtccccttctgt

SEQ ID NO: 5981516 - DNA, 22 bp, Homo sapiens
caccaagtctaaaaagacctgg

SEQ ID NO: 5981517 - DNA, 22 bp, Homo sapiens
caccaagtgcgggtccggcagc

SEQ ID NO: 5981518 - DNA, 22 bp, Homo sapiens
caccaagttggaacatccttgg

SEQ ID NO: 5981519 - DNA, 11 bp, Homo sapiens
caccaataaag

SEQ ID NO: 5981520 - DNA, 15 bp, Homo sapiens
caccaataaaggagg

SEQ ID NO: 5981521 - DNA, 17 bp, Homo sapiens
caccaataaaggaggaa

SEQ ID NO: 5981522 - DNA, 20 bp, Homo sapiens
caccaataaaggaggaatca

SEQ ID NO: 5981523 - DNA, 20 bp, Homo sapiens
caccaataaatcagaccatg

SEQ ID NO: 5981524 - DNA, 14 bp, Homo sapiens
caccaataaatgtt

SEQ ID NO: 5981525 - DNA, 21 bp, Homo sapiens
caccaataatggggcagacac

SEQ ID NO: 5981526 - DNA, 23 bp, Homo sapiens
caccaataatggggcagacacaa

SEQ ID NO: 5981527 - DNA, 14 bp, Homo sapiens
caccaatacaaatt

SEQ ID NO: 5981528 - DNA, 21 bp, Homo sapiens
caccaatatcatgtgtagata

SEQ ID NO: 5981529 - DNA, 15 bp, Homo sapiens
caccaatcagagagc

SEQ ID NO: 5981530 - DNA, 15 bp, Homo sapiens
caccaatctgccctt

SEQ ID NO: 5981531 - DNA, 18 bp, Homo sapiens
caccaatcttactttgta

SEQ ID NO: 5981532 - DNA, 16 bp, Homo sapiens
caccaatgaaaacatg

SEQ ID NO: 5981533 - DNA, 21 bp, Homo sapiens
caccaatgaaaacatgtacta

SEQ ID NO: 5981534 - DNA, 16 bp, Homo sapiens
caccaatgcccagcag

SEQ ID NO: 5981535 - DNA, 17 bp, Homo sapiens
caccaatgcccagcagg

SEQ ID NO: 5981536 - DNA, 15 bp, Homo sapiens
caccaattaaaaacc

SEQ ID NO: 5981537 - DNA, 17 bp, Homo sapiens
caccaattaaaaacctt

SEQ ID NO: 5981538 - DNA, 16 bp, Homo sapiens
caccaattatcatctt

SEQ ID NO: 5981539 - DNA, 21 bp, Homo sapiens
caccaattggataaagcagct

SEQ ID NO: 5981540 - DNA, 17 bp, Homo sapiens
caccacaaaaagagaag

SEQ ID NO: 5981541 - DNA, 12 bp, Homo sapiens
caccacaaaata

SEQ ID NO: 5981542 - DNA, 16 bp, Homo sapiens
caccacaagagctcct

SEQ ID NO: 5981543 - DNA, 14 bp, Homo sapiens
caccacaattctcc

SEQ ID NO: 5981544 - DNA, 12 bp, Homo sapiens
caccacacacaa

SEQ ID NO: 5981545 - DNA, 18 bp, Homo sapiens
caccacacacaacagcca

SEQ ID NO: 5981546 - DNA, 19 bp, Homo sapiens
caccacacacacccttccc

SEQ ID NO: 5981547 - DNA, 14 bp, Homo sapiens
caccacacagtcac

SEQ ID NO: 5981548 - DNA, 19 bp, Homo sapiens
caccacacatcccagccca

SEQ ID NO: 5981549 - DNA, 13 bp, Homo sapiens
caccacaccaaat

SEQ ID NO: 5981550 - DNA, 14 bp, Homo sapiens
caccacacccagcc

SEQ ID NO: 5981551 - DNA, 17 bp, Homo sapiens
caccacacccagcctca

SEQ ID NO: 5981552 - DNA, 18 bp, Homo sapiens
caccacacccagcctcag

SEQ ID NO: 5981553 - DNA, 15 bp, Homo sapiens
caccacacccaggtc

SEQ ID NO: 5981554 - DNA, 14 bp, Homo sapiens
caccacacctggct

SEQ ID NO: 5981555 - DNA, 15 bp, Homo sapiens
caccacacctggctt

SEQ ID NO: 5981556 - DNA, 22 bp, Homo sapiens
caccacactaaaacattgtcta

SEQ ID NO: 5981557 - DNA, 13 bp, Homo sapiens
caccacactgacc

SEQ ID NO: 5981558 - DNA, 18 bp, Homo sapiens
caccacacttgttttctt

SEQ ID NO: 5981559 - DNA, 15 bp, Homo sapiens
caccacagacacaca

SEQ ID NO: 5981560 - DNA, 19 bp, Homo sapiens
caccacagacacacacacg

SEQ ID NO: 5981561 - DNA, 17 bp, Homo sapiens
caccacagacgccacct

SEQ ID NO: 5981562 - DNA, 15 bp, Homo sapiens
caccacagcctcccc

SEQ ID NO: 5981563 - DNA, 20 bp, Homo sapiens
caccacagcttatggcatct

SEQ ID NO: 5981564 - DNA, 15 bp, Homo sapiens
caccacaggctgcct

SEQ ID NO: 5981565 - DNA, 17 bp, Homo sapiens
caccacatagcatgctt

SEQ ID NO: 5981566 - DNA, 20 bp, Homo sapiens
caccacatagcatgcttcct

SEQ ID NO: 5981567 - DNA, 20 bp, Homo sapiens
caccacatcccttcatatca

SEQ ID NO: 5981568 - DNA, 21 bp, Homo sapiens
caccacatcctccgtccagcc

SEQ ID NO: 5981569 - DNA, 19 bp, Homo sapiens
caccacatctgccagacct

SEQ ID NO: 5981570 - DNA, 15 bp, Homo sapiens
caccacatgctattg

SEQ ID NO: 5981571 - DNA, 21 bp, Homo sapiens
caccacattctgtctctgctt

SEQ ID NO: 5981572 - DNA, 16 bp, Homo sapiens
caccaccacacccctg

SEQ ID NO: 5981573 - DNA, 14 bp, Homo sapiens
caccaccacactac

SEQ ID NO: 5981574 - DNA, 18 bp, Homo sapiens
caccaccacactacacag

SEQ ID NO: 5981575 - DNA, 14 bp, Homo sapiens
caccaccaccccta

SEQ ID NO: 5981576 - DNA, 21 bp, Homo sapiens
caccaccacgcagccgccgcc

SEQ ID NO: 5981577 - DNA, 15 bp, Homo sapiens
caccaccagccagcg

SEQ ID NO: 5981578 - DNA, 11 bp, Homo sapiens
caccaccagga

SEQ ID NO: 5981579 - DNA, 21 bp, Homo sapiens
caccaccaggagcagcagcca

SEQ ID NO: 5981580 - DNA, 20 bp, Homo sapiens
caccaccagggctccaggag

SEQ ID NO: 5981581 - DNA, 18 bp, Homo sapiens
caccaccagggtggacca

SEQ ID NO: 5981582 - DNA, 24 bp, Homo sapiens
caccaccagggtggaccaggcctg

SEQ ID NO: 5981583 - DNA, 13 bp, Homo sapiens
caccaccatgccc

SEQ ID NO: 5981584 - DNA, 13 bp, Homo sapiens
caccaccatttaa

SEQ ID NO: 5981585 - DNA, 14 bp, Homo sapiens
caccaccatttaat

SEQ ID NO: 5981586 - DNA, 15 bp, Homo sapiens
caccaccatttaatt

SEQ ID NO: 5981587 - DNA, 12 bp, Homo sapiens
caccacccaccc

SEQ ID NO: 5981588 - DNA, 19 bp, Homo sapiens
caccacccagcccttcctt

SEQ ID NO: 5981589 - DNA, 23 bp, Homo sapiens
caccacccagcccttccttgggc

SEQ ID NO: 5981590 - DNA, 18 bp, Homo sapiens
caccaccccaacaaacca

SEQ ID NO: 5981591 - DNA, 12 bp, Homo sapiens
caccaccccacc

SEQ ID NO: 5981592 - DNA, 17 bp, Homo sapiens
caccaccccacccacct

SEQ ID NO: 5981593 - DNA, 23 bp, Homo sapiens
caccaccccacccacctttgcag

SEQ ID NO: 5981594 - DNA, 21 bp, Homo sapiens
caccaccccagctgctcccct

SEQ ID NO: 5981595 - DNA, 14 bp, Homo sapiens
caccacccccacga

SEQ ID NO: 5981596 - DNA, 13 bp, Homo sapiens
caccacccccagt

SEQ ID NO: 5981597 - DNA, 19 bp, Homo sapiens
caccacccccagtcccccc

SEQ ID NO: 5981598 - DNA, 15 bp, Homo sapiens
caccaccccccactc

SEQ ID NO: 5981599 - DNA, 18 bp, Homo sapiens
caccaccccccactctgt

SEQ ID NO: 5981600 - DNA, 21 bp, Homo sapiens
caccacccctaaagtgccagg

SEQ ID NO: 5981601 - DNA, 18 bp, Homo sapiens
caccacccctccctctgc

SEQ ID NO: 5981602 - DNA, 23 bp, Homo sapiens
caccacccctccctctgctctca

SEQ ID NO: 5981603 - DNA, 22 bp, Homo sapiens
caccaccctagtcccttcccct

SEQ ID NO: 5981604 - DNA, 16 bp, Homo sapiens
caccaccctcaggtgc

SEQ ID NO: 5981605 - DNA, 15 bp, Homo sapiens
caccaccctgtcttc

SEQ ID NO: 5981606 - DNA, 18 bp, Homo sapiens
caccaccctgtcttcctc

SEQ ID NO: 5981607 - DNA, 18 bp, Homo sapiens
caccaccctttgctgact

SEQ ID NO: 5981608 - DNA, 23 bp, Homo sapiens
caccaccgaatatattactgatt

SEQ ID NO: 5981609 - DNA, 19 bp, Homo sapiens
caccaccgagctctgtggg

SEQ ID NO: 5981610 - DNA, 22 bp, Homo sapiens
caccaccgcctctggccgccac

SEQ ID NO: 5981611 - DNA, 23 bp, Homo sapiens
caccacctaggccactcctccaa

SEQ ID NO: 5981612 - DNA, 19 bp, Homo sapiens
caccacctatatccagaag

SEQ ID NO: 5981613 - DNA, 17 bp, Homo sapiens
caccacctcactcctgt

SEQ ID NO: 5981614 - DNA, 14 bp, Homo sapiens
caccacctctttgg

SEQ ID NO: 5981615 - DNA, 23 bp, Homo sapiens
caccacctgcccggcccaggagc

SEQ ID NO: 5981616 - DNA, 12 bp, Homo sapiens
caccacctgctc

SEQ ID NO: 5981617 - DNA, 14 bp, Homo sapiens
caccacctgctcac

SEQ ID NO: 5981618 - DNA, 20 bp, Homo sapiens
caccacctggatggatctgc

SEQ ID NO: 5981619 - DNA, 21 bp, Homo sapiens
caccacctggatggatctgct

SEQ ID NO: 5981620 - DNA, 19 bp, Homo sapiens
caccaccttatacatcact

SEQ ID NO: 5981621 - DNA, 22 bp, Homo sapiens
caccaccttatacatcacttcc

SEQ ID NO: 5981622 - DNA, 23 bp, Homo sapiens
caccaccttatacatcacttcct

SEQ ID NO: 5981623 - DNA, 14 bp, Homo sapiens
caccaccttcccag

SEQ ID NO: 5981624 - DNA, 15 bp, Homo sapiens
caccaccttcccagc

SEQ ID NO: 5981625 - DNA, 16 bp, Homo sapiens
caccaccttcccagct

SEQ ID NO: 5981626 - DNA, 19 bp, Homo sapiens
caccaccttggactcctcc

SEQ ID NO: 5981627 - DNA, 20 bp, Homo sapiens
caacacctcctcctgctgct

SEQ ID NO: 5981628 - DNA, 22 bp, Homo sapiens
caacacctctgcacaagctgca

SEQ ID NO: 5981629 - DNA, 16 bp, Homo sapiens
caacaccttcctcctg

SEQ ID NO: 5981630 - DNA, 20 bp, Homo sapiens
caacaccttgtttccctctc

SEQ ID NO: 5981631 - DNA, 15 bp, Homo sapiens
caacacgagcaggct

SEQ ID NO: 5981632 - DNA, 19 bp, Homo sapiens
caacacgcacctgcctcag

SEQ ID NO: 5981633 - DNA, 13 bp, Homo sapiens
caacacgttacta

SEQ ID NO: 5981634 - DNA, 17 bp, Homo sapiens
caacactatataaataa

SEQ ID NO: 5981635 - DNA, 14 bp, Homo sapiens
caacactcaagtct

SEQ ID NO: 5981636 - DNA, 22 bp, Homo sapiens
caacactcattgacctgaggcc

SEQ ID NO: 5981637 - DNA, 13 bp, Homo sapiens
caacactccaggc

SEQ ID NO: 5981638 - DNA, 16 bp, Homo sapiens
caacactccaggccct

SEQ ID NO: 5981639 - DNA, 18 bp, Homo sapiens
caacactccggtcagccc

SEQ ID NO: 5981640 - DNA, 22 bp, Homo sapiens
caacactccggtcagcccctgg

SEQ ID NO: 5981641 - DNA, 20 bp, Homo sapiens
caacactcttcttgagcaga

SEQ ID NO: 5981642 - DNA, 21 bp, Homo sapiens
caacactgaacctctggctag

SEQ ID NO: 5981643 - DNA, 14 bp, Homo sapiens
caacactgagcaag

SEQ ID NO: 5981644 - DNA, 21 bp, Homo sapiens
caacactgatcccccagatgc

SEQ ID NO: 5981645 - DNA, 13 bp, Homo sapiens
caacactgatgtg

SEQ ID NO: 5981646 - DNA, 15 bp, Homo sapiens
caacactgcaggaca

SEQ ID NO: 5981647 - DNA, 18 bp, Homo sapiens
caacactgccagaagtgt

SEQ ID NO: 5981648 - DNA, 21 bp, Homo sapiens
caacactgccagaagtgtgtt

SEQ ID NO: 5981649 - DNA, 15 bp, Homo sapiens
caacactgctgtcca

SEQ ID NO: 5981650 - DNA, 22 bp, Homo sapiens
caacactgtagtaaataatgct

SEQ ID NO: 5981651 - DNA, 18 bp, Homo sapiens
caacactgtgccctggtg

SEQ ID NO: 5981652 - DNA, 22 bp, Homo sapiens
caacactgtgccctggtggaga

SEQ ID NO: 5981653 - DNA, 17 bp, Homo sapiens
caacacttaagtctcag

SEQ ID NO: 5981654 - DNA, 15 bp, Homo sapiens
caacacttaatcatt

SEQ ID NO: 5981655 - DNA, 19 bp, Homo sapiens
caacacttcagactgcaag

SEQ ID NO: 5981656 - DNA, 16 bp, Homo sapiens
caacacttcattttca

SEQ ID NO: 5981657 - DNA, 21 bp, Homo sapiens
caacacttgtgttgctttctg

SEQ ID NO: 5981658 - DNA, 15 bp, Homo sapiens
caacactttaatggg

SEQ ID NO: 5981659 - DNA, 19 bp, Homo sapiens
caacactttccctctctgg

SEQ ID NO: 5981660 - DNA, 10 bp, Homo sapiens
caacagaaaa

SEQ ID NO: 5981661 - DNA, 21 bp, Homo sapiens
caacagaaaaacaatcttatt

SEQ ID NO: 5981662 - DNA, 13 bp, Homo sapiens
caacagaaacctt

SEQ ID NO: 5981663 - DNA, 12 bp, Homo sapiens
caacagaaagag

SEQ ID NO: 5981664 - DNA, 15 bp, Homo sapiens
caacagaaagaggga

SEQ ID NO: 5981665 - DNA, 12 bp, Homo sapiens
caacagaacaac

SEQ ID NO: 5981666 - DNA, 16 bp, Homo sapiens
caacagaacaacaaca

SEQ ID NO: 5981667 - DNA, 19 bp, Homo sapiens
caacagaacaacaacaaag

SEQ ID NO: 5981668 - DNA, 13 bp, Homo sapiens
caacagaacatat

SEQ ID NO: 5981669 - DNA, 15 bp, Homo sapiens
caacagaagcatttg

SEQ ID NO: 5981670 - DNA, 23 bp, Homo sapiens
caacagaagtcatgaagcccaag

SEQ ID NO: 5981671 - DNA, 14 bp, Homo sapiens
caacagaataaagc

SEQ ID NO: 5981672 - DNA, 15 bp, Homo sapiens
caacagaataaagca

SEQ ID NO: 5981673 - DNA, 16 bp, Homo sapiens
caacagaataatgcat

SEQ ID NO: 5981674 - DNA, 15 bp, Homo sapiens
caacagaatgaaaaa

SEQ ID NO: 5981675 - DNA, 17 bp, Homo sapiens
caacagaattaaaatgt

SEQ ID NO: 5981676 - DNA, 15 bp, Homo sapiens
caacagaattgttct

SEQ ID NO: 5981677 - DNA, 16 bp, Homo sapiens
caacagacctaagaaa

SEQ ID NO: 5981678 - DNA, 16 bp, Homo sapiens
caacagagagaaaaag

SEQ ID NO: 5981679 - DNA, 15 bp, Homo sapiens
caacagagagggaga

SEQ ID NO: 5981680 - DNA, 16 bp, Homo sapiens
caacagagaggggcag

SEQ ID NO: 5981681 - DNA, 17 bp, Homo sapiens
caacagagaggggcagg

SEQ ID NO: 5981682 - DNA, 21 bp, Homo sapiens
caacagagatgccatgatatc

SEQ ID NO: 5981683 - DNA, 14 bp, Homo sapiens
caacagagcaagac

SEQ ID NO: 5981684 - DNA, 19 bp, Homo sapiens
caacagagtgagaccctgt

SEQ ID NO: 5981685 - DNA, 13 bp, Homo sapiens
caacagagtggac

SEQ ID NO: 5981686 - DNA, 17 bp, Homo sapiens
caacagatcaatttgta

SEQ ID NO: 5981687 - DNA, 17 bp, Homo sapiens
caacagatctggaacct

SEQ ID NO: 5981688 - DNA, 15 bp, Homo sapiens
caacagatgcttttc

SEQ ID NO: 5981689 - DNA, 20 bp, Homo sapiens
caacagattcagaatgagaa

SEQ ID NO: 5981690 - DNA, 20 bp, Homo sapiens
caacagattggattttatgt

SEQ ID NO: 5981691 - DNA, 23 bp, Homo sapiens
caacagattggattttatgttga

SEQ ID NO: 5981692 - DNA, 14 bp, Homo sapiens
caacagatttaaag

SEQ ID NO: 5981693 - DNA, 15 bp, Homo sapiens
caacagatttaaaga

SEQ ID NO: 5981694 - DNA, 23 bp, Homo sapiens
caacagatttctaagttaaatca

SEQ ID NO: 5981695 - DNA, 20 bp, Homo sapiens
caacagatttgtgaactcag

SEQ ID NO: 5981696 - DNA, 15 bp, Homo sapiens
caacagcaaacaggt

SEQ ID NO: 5981697 - DNA, 14 bp, Homo sapiens
caacagcaaaccct

SEQ ID NO: 5981698 - DNA, 17 bp, Homo sapiens
caacagcaaaggaacta

SEQ ID NO: 5981699 - DNA, 15 bp, Homo sapiens
caacagcaacaacaa

SEQ ID NO: 5981700 - DNA, 22 bp, Homo sapiens
caacagcaagaaataaatcaga

SEQ ID NO: 5981701 - DNA, 15 bp, Homo sapiens
caacagcaagtgttt

SEQ ID NO: 5981702 - DNA, 20 bp, Homo sapiens
caacagcacacaggcagcca

SEQ ID NO: 5981703 - DNA, 12 bp, Homo sapiens
caacagcactgg

SEQ ID NO: 5981704 - DNA, 22 bp, Homo sapiens
caacagcactggctctctccag

SEQ ID NO: 5981705 - DNA, 23 bp, Homo sapiens
caacagcacttgcttgcggaact

SEQ ID NO: 5981706 - DNA, 15 bp, Homo sapiens
caacagcaggaggca

SEQ ID NO: 5981707 - DNA, 18 bp, Homo sapiens
caacagcaggaggcacag

SEQ ID NO: 5981708 - DNA, 13 bp, Homo sapiens
caacagcagtctc

SEQ ID NO: 5981709 - DNA, 14 bp, Homo sapiens
caacagccaagacc

SEQ ID NO: 5981710 - DNA, 24 bp, Homo sapiens
caacagccataataataatttgca

SEQ ID NO: 5981711 - DNA, 20 bp, Homo sapiens
caacagcccagcaagaagga

SEQ ID NO: 5981712 - DNA, 21 bp, Homo sapiens
caacagcccagcaagaaggag

SEQ ID NO: 5981713 - DNA, 21 bp, Homo sapiens
caacagcccaggcatctcctt

SEQ ID NO: 5981714 - DNA, 16 bp, Homo sapiens
caacagccctgcctga

SEQ ID NO: 5981715 - DNA, 15 bp, Homo sapiens
caacagcctcacttg

SEQ ID NO: 5981716 - DNA, 15 bp, Homo sapiens
caacagcctctgtgg

SEQ ID NO: 5981717 - DNA, 12 bp, Homo sapiens
caacagcgccca

SEQ ID NO: 5981718 - DNA, 17 bp, Homo sapiens
caacagcgtggcttaga

SEQ ID NO: 5981719 - DNA, 15 bp, Homo sapiens
caacagcgttcctag

SEQ ID NO: 5981720 - DNA, 14 bp, Homo sapiens
caacagctacaaca

SEQ ID NO: 5981721 - DNA, 22 bp, Homo sapiens
caacagctcaagtcttccctga

SEQ ID NO: 5981722 - DNA, 22 bp, Homo sapiens
caacagctctcgttctccttcc

SEQ ID NO: 5981723 - DNA, 14 bp, Homo sapiens
caacagctgaagca

SEQ ID NO: 5981724 - DNA, 23 bp, Homo sapiens
caacagctggtgccctgctttca

SEQ ID NO: 5981725 - DNA, 23 bp, Homo sapiens
caacagcttcttgcttgtaaaaa

SEQ ID NO: 5981726 - DNA, 14 bp, Homo sapiens
caacaggaactgtg

SEQ ID NO: 5981727 - DNA, 17 bp, Homo sapiens
caacaggaatctcagag

SEQ ID NO: 5981728 - DNA, 21 bp, Homo sapiens
caacaggaatctcagagacag

SEQ ID NO: 5981729 - DNA, 16 bp, Homo sapiens
caacaggacagagttc

SEQ ID NO: 5981730 - DNA, 18 bp, Homo sapiens
caacaggacagagttcac

SEQ ID NO: 5981731 - DNA, 21 bp, Homo sapiens
caacaggacagagttcacagg

SEQ ID NO: 5981732 - DNA, 16 bp, Homo sapiens
caacaggaccaggagc

SEQ ID NO: 5981733 - DNA, 19 bp, Homo sapiens
caacaggagaatggggttc

SEQ ID NO: 5981734 - DNA, 15 bp, Homo sapiens
caacaggagagacag

SEQ ID NO: 5981735 - DNA, 15 bp, Homo sapiens
caacaggagagagat

SEQ ID NO: 5981736 - DNA, 15 bp, Homo sapiens
caacaggagctggga

SEQ ID NO: 5981737 - DNA, 15 bp, Homo sapiens
caacaggaggacaat

SEQ ID NO: 5981738 - DNA, 23 bp, Homo sapiens
caacaggaggacaattcatgaac

SEQ ID NO: 5981739 - DNA, 23 bp, Homo sapiens
caacaggaggctttttcagtgat

SEQ ID NO: 5981740 - DNA, 22 bp, Homo sapiens
caacaggagtcagtctctttct

SEQ ID NO: 5981741 - DNA, 14 bp, Homo sapiens
caacaggcacctct

SEQ ID NO: 5981742 - DNA, 18 bp, Homo sapiens
caacaggcaggggcccac

SEQ ID NO: 5981743 - DNA, 13 bp, Homo sapiens
caacaggcccagg

SEQ ID NO: 5981744 - DNA, 16 bp, Homo sapiens
caacaggcccagggag

SEQ ID NO: 5981745 - DNA, 21 bp, Homo sapiens
caacaggcgtgggatcagatt

SEQ ID NO: 5981746 - DNA, 17 bp, Homo sapiens
caacaggctgggcttca

SEQ ID NO: 5981747 - DNA, 23 bp, Homo sapiens
caacaggctgttctgcactgaaa

SEQ ID NO: 5981748 - DNA, 16 bp, Homo sapiens
caacagggcttctctt

SEQ ID NO: 5981749 - DNA, 20 bp, Homo sapiens
caacaggggaggaaaaaaga

SEQ ID NO: 5981750 - DNA, 21 bp, Homo sapiens
caacagggtagatttctcttg

SEQ ID NO: 5981751 - DNA, 23 bp, Homo sapiens
caacagggtagatttctcttggg

SEQ ID NO: 5981752 - DNA, 15 bp, Homo sapiens
caacaggtaaacaca

SEQ ID NO: 5981753 - DNA, 21 bp, Homo sapiens
caacaggttttcaccatagcc

SEQ ID NO: 5981754 - DNA, 19 bp, Homo sapiens
caacaggttttcctgaaga

SEQ ID NO: 5981755 - DNA, 15 bp, Homo sapiens
caacagtaaaccact

SEQ ID NO: 5981756 - DNA, 11 bp, Homo sapiens
caacagtaaca

SEQ ID NO: 5981757 - DNA, 21 bp, Homo sapiens
caacagtaatctatgtgtttc

SEQ ID NO: 5981758 - DNA, 23 bp, Homo sapiens
caacagtaattattatttaactc

SEQ ID NO: 5981759 - DNA, 22 bp, Homo sapiens
caacagtacctgaaggattatt

SEQ ID NO: 5981760 - DNA, 20 bp, Homo sapiens
caacagtagcataggaccct

SEQ ID NO: 5981761 - DNA, 14 bp, Homo sapiens
caacagtcaaaaca

SEQ ID NO: 5981762 - DNA, 18 bp, Homo sapiens
caacagtcaaaacagaga

SEQ ID NO: 5981763 - DNA, 14 bp, Homo sapiens
caacagtcagccag

SEQ ID NO: 5981764 - DNA, 12 bp, Homo sapiens
caacagtcatgt

SEQ ID NO: 5981765 - DNA, 14 bp, Homo sapiens
caacagtcatgttt

SEQ ID NO: 5981766 - DNA, 12 bp, Homo sapiens
caacagtcttgc

SEQ ID NO: 5981767 - DNA, 13 bp, Homo sapiens
caacagtcttgct

SEQ ID NO: 5981768 - DNA, 21 bp, Homo sapiens
caacagtgaacagcttcactt

SEQ ID NO: 5981769 - DNA, 11 bp, Homo sapiens
caacagtgagt

SEQ ID NO: 5981770 - DNA, 17 bp, Homo sapiens
caacagtggggaagagt

SEQ ID NO: 5981771 - DNA, 16 bp, Homo sapiens
caacagtgtgaagtta

SEQ ID NO: 5981772 - DNA, 17 bp, Homo sapiens
caacagtgtgaagttag

SEQ ID NO: 5981773 - DNA, 19 bp, Homo sapiens
caacagtgtgaagttagaa

SEQ ID NO: 5981774 - DNA, 21 bp, Homo sapiens
caacagtgtgaagttagaatt

SEQ ID NO: 5981775 - DNA, 20 bp, Homo sapiens
caacagtttaatgaagatct

SEQ ID NO: 5981776 - DNA, 20 bp, Homo sapiens
caacagtttatttttattat

SEQ ID NO: 5981777 - DNA, 12 bp, Homo sapiens
caacagtttctc

SEQ ID NO: 5981778 - DNA, 13 bp, Homo sapiens
caacagttttcct

SEQ ID NO: 5981779 - DNA, 22 bp, Homo sapiens
caacagttttcctatgctttga

SEQ ID NO: 5981780 - DNA, 13 bp, Homo sapiens
caacataaaactc

SEQ ID NO: 5981781 - DNA, 16 bp, Homo sapiens
caacataaaattaaaa

SEQ ID NO: 5981782 - DNA, 17 bp, Homo sapiens
caacataaaattaaaat

SEQ ID NO: 5981783 - DNA, 18 bp, Homo sapiens
caacataacccacttgtc

SEQ ID NO: 5981784 - DNA, 17 bp, Homo sapiens
caacataactcaagtct

SEQ ID NO: 5981785 - DNA, 16 bp, Homo sapiens
caacataattcttcct

SEQ ID NO: 5981786 - DNA, 17 bp, Homo sapiens
caacataattcttcctt

SEQ ID NO: 5981787 - DNA, 13 bp, Homo sapiens
caacatacaattt

SEQ ID NO: 5981788 - DNA, 22 bp, Homo sapiens
caacatacattggttttgaaat

SEQ ID NO: 5981789 - DNA, 19 bp, Homo sapiens
caacatacccttctttaaa

SEQ ID NO: 5981790 - DNA, 22 bp, Homo sapiens
caacatacgggaagtttatttc

SEQ ID NO: 5981791 - DNA, 14 bp, Homo sapiens
caacatactcccat

SEQ ID NO: 5981792 - DNA, 19 bp, Homo sapiens
caacatactcccatctgtg

SEQ ID NO: 5981793 - DNA, 19 bp, Homo sapiens
caacatagtgagacactgt

SEQ ID NO: 5981794 - DNA, 13 bp, Homo sapiens
caacatataaaat

SEQ ID NO: 5981795 - DNA, 14 bp, Homo sapiens
caacatataaaata

SEQ ID NO: 5981796 - DNA, 14 bp, Homo sapiens
caacatataaagta

SEQ ID NO: 5981797 - DNA, 15 bp, Homo sapiens
caacatatcattttt

SEQ ID NO: 5981798 - DNA, 19 bp, Homo sapiens
caacatcaaaacttaagat

SEQ ID NO: 5981799 - DNA, 15 bp, Homo sapiens
caacatcaagaaaac

SEQ ID NO: 5981800 - DNA, 13 bp, Homo sapiens
caacatcaatgtt

SEQ ID NO: 5981801 - DNA, 19 bp, Homo sapiens
caacatcacacagtatact

SEQ ID NO: 5981802 - DNA, 22 bp, Homo sapiens
caacatcactaatttggctttc

SEQ ID NO: 5981803 - DNA, 14 bp, Homo sapiens
caacatcagcttga

SEQ ID NO: 5981804 - DNA, 20 bp, Homo sapiens
caacatcagctttctaatgt

SEQ ID NO: 5981805 - DNA, 13 bp, Homo sapiens
caacatccactct

SEQ ID NO: 5981806 - DNA, 19 bp, Homo sapiens
caccacgatgacgcctctg

SEQ ID NO: 5981807 - DNA, 20 bp, Homo sapiens
caccacgatgacgcctctgg

SEQ ID NO: 5981808 - DNA, 22 bp, Homo sapiens
caccacgatgtggccctggcct

SEQ ID NO: 5981809 - DNA, 16 bp, Homo sapiens
caccacgattctccca

SEQ ID NO: 5981810 - DNA, 15 bp, Homo sapiens
caccacgcccggcta

SEQ ID NO: 5981811 - DNA, 22 bp, Homo sapiens
caccacgcccggctaatgtttg

SEQ ID NO: 5981812 - DNA, 13 bp, Homo sapiens
caccacgcctggc

SEQ ID NO: 5981813 - DNA, 21 bp, Homo sapiens
caccacggcattatgatccct

SEQ ID NO: 5981814 - DNA, 16 bp, Homo sapiens
caccacggcgtttttt

SEQ ID NO: 5981815 - DNA, 22 bp, Homo sapiens
caccacgggacatcacagggtg

SEQ ID NO: 5981816 - DNA, 15 bp, Homo sapiens
caccacggtggtcac

SEQ ID NO: 5981817 - DNA, 18 bp, Homo sapiens
caccacgtctgccaggcc

SEQ ID NO: 5981818 - DNA, 20 bp, Homo sapiens
caccacgtctggctccctgc

SEQ ID NO: 5981819 - DNA, 18 bp, Homo sapiens
caccacgtggggccatgc

SEQ ID NO: 5981820 - DNA, 21 bp, Homo sapiens
caccactaaccatccccaact

SEQ ID NO: 5981821 - DNA, 20 bp, Homo sapiens
caccactacagtaagctggt

SEQ ID NO: 5981822 - DNA, 16 bp, Homo sapiens
caccactacattctgt

SEQ ID NO: 5981823 - DNA, 16 bp, Homo sapiens
caccactaccagccag

SEQ ID NO: 5981824 - DNA, 14 bp, Homo sapiens
caccactagagctg

SEQ ID NO: 5981825 - DNA, 18 bp, Homo sapiens
caccactagcctcagggg

SEQ ID NO: 5981826 - DNA, 13 bp, Homo sapiens
caccactataaaa

SEQ ID NO: 5981827 - DNA, 23 bp, Homo sapiens
caccactatctccgttccatctg

SEQ ID NO: 5981828 - DNA, 15 bp, Homo sapiens
caccactcaggccac

SEQ ID NO: 5981829 - DNA, 13 bp, Homo sapiens
caccactcagtgc

SEQ ID NO: 5981830 - DNA, 13 bp, Homo sapiens
caccactccattc

SEQ ID NO: 5981831 - DNA, 15 bp, Homo sapiens
caccactccattccc

SEQ ID NO: 5981832 - DNA, 16 bp, Homo sapiens
caccactccattccca

SEQ ID NO: 5981833 - DNA, 18 bp, Homo sapiens
caccactccccaacccct

SEQ ID NO: 5981834 - DNA, 11 bp, Homo sapiens
caccactcctc

SEQ ID NO: 5981835 - DNA, 16 bp, Homo sapiens
caccactcctctccct

SEQ ID NO: 5981836 - DNA, 19 bp, Homo sapiens
caccactcctgccagcccg

SEQ ID NO: 5981837 - DNA, 15 bp, Homo sapiens
caccactcctgcctg

SEQ ID NO: 5981838 - DNA, 13 bp, Homo sapiens
caccactctcagg

SEQ ID NO: 5981839 - DNA, 24 bp, Homo sapiens
caccactctcaggaccaccctgcc

SEQ ID NO: 5981840 - DNA, 19 bp, Homo sapiens
caccactctggcagccaca

SEQ ID NO: 5981841 - DNA, 16 bp, Homo sapiens
caccactctgggcaca

SEQ ID NO: 5981842 - DNA, 18 bp, Homo sapiens
caccactgagctctgcct

SEQ ID NO: 5981843 - DNA, 21 bp, Homo sapiens
caccactgatatcatggggag

SEQ ID NO: 5981844 - DNA, 15 bp, Homo sapiens
caccactgcactcca

SEQ ID NO: 5981845 - DNA, 20 bp, Homo sapiens
caccactgcactccagcctg

SEQ ID NO: 5981846 - DNA, 21 bp, Homo sapiens
caccactgcactccagcctgg

SEQ ID NO: 5981847 - DNA, 13 bp, Homo sapiens
caccactgcagcc

SEQ ID NO: 5981848 - DNA, 15 bp, Homo sapiens
caccactgccctgcc

SEQ ID NO: 5981849 - DNA, 17 bp, Homo sapiens
caccactgccctgcctg

SEQ ID NO: 5981850 - DNA, 21 bp, Homo sapiens
caccactgccctgcctgccca

SEQ ID NO: 5981851 - DNA, 22 bp, Homo sapiens
caccactgccctgcctgcccac

SEQ ID NO: 5981852 - DNA, 14 bp, Homo sapiens
caccactgctgagg

SEQ ID NO: 5981853 - DNA, 19 bp, Homo sapiens
caccactgcttcccactgg

SEQ ID NO: 5981854 - DNA, 15 bp, Homo sapiens
caccactggccacca

SEQ ID NO: 5981855 - DNA, 20 bp, Homo sapiens
caccactggccaccaggctg

SEQ ID NO: 5981856 - DNA, 21 bp, Homo sapiens
caccactggccaccaggctgg

SEQ ID NO: 5981857 - DNA, 15 bp, Homo sapiens
caccactgggaacca

SEQ ID NO: 5981858 - DNA, 14 bp, Homo sapiens
caccactgtcccta

SEQ ID NO: 5981859 - DNA, 15 bp, Homo sapiens
caccactgtccctac

SEQ ID NO: 5981860 - DNA, 15 bp, Homo sapiens
caccactgtgtccca

SEQ ID NO: 5981861 - DNA, 17 bp, Homo sapiens
caccactgtgtcccagt

SEQ ID NO: 5981862 - DNA, 19 bp, Homo sapiens
caccactgtgtcccagtgt

SEQ ID NO: 5981863 - DNA, 16 bp, Homo sapiens
caccacttgacagact

SEQ ID NO: 5981864 - DNA, 22 bp, Homo sapiens
caccacttggagatctttgctt

SEQ ID NO: 5981865 - DNA, 22 bp, Homo sapiens
caccactttgtctctgagaaca

SEQ ID NO: 5981866 - DNA, 21 bp, Homo sapiens
caccagaaatatcgctgatgc

SEQ ID NO: 5981867 - DNA, 23 bp, Homo sapiens
caccagaaatatcgctgatgcag

SEQ ID NO: 5981868 - DNA, 17 bp, Homo sapiens
caccagaaattccagta

SEQ ID NO: 5981869 - DNA, 19 bp, Homo sapiens
caccagaacgcaccccact

SEQ ID NO: 5981870 - DNA, 21 bp, Homo sapiens
caccagaacgcaccccactgg

SEQ ID NO: 5981871 - DNA, 15 bp, Homo sapiens
caccagaagcccaga

SEQ ID NO: 5981872 - DNA, 16 bp, Homo sapiens
caccagaagcccagaa

SEQ ID NO: 5981873 - DNA, 16 bp, Homo sapiens
caccagaagtgccatg

SEQ ID NO: 5981874 - DNA, 12 bp, Homo sapiens
caccagaataaa

SEQ ID NO: 5981875 - DNA, 13 bp, Homo sapiens
caccagaattagt

SEQ ID NO: 5981876 - DNA, 18 bp, Homo sapiens
caccagaattagtcctca

SEQ ID NO: 5981877 - DNA, 16 bp, Homo sapiens
caccagacatcaccct

SEQ ID NO: 5981878 - DNA, 17 bp, Homo sapiens
caccagacatcaccctt

SEQ ID NO: 5981879 - DNA, 20 bp, Homo sapiens
caccagacatcaccctttgc

SEQ ID NO: 5981880 - DNA, 20 bp, Homo sapiens
caccagacccacctggagcc

SEQ ID NO: 5981881 - DNA, 22 bp, Homo sapiens
caccagacccacctggagcccg

SEQ ID NO: 5981882 - DNA, 17 bp, Homo sapiens
caccagacggggctgga

SEQ ID NO: 5981883 - DNA, 16 bp, Homo sapiens
caccagagaccgtcct

SEQ ID NO: 5981884 - DNA, 21 bp, Homo sapiens
caccagagagggactgacacc

SEQ ID NO: 5981885 - DNA, 20 bp, Homo sapiens
caccagagcaggggctgctg

SEQ ID NO: 5981886 - DNA, 14 bp, Homo sapiens
caccagagcccatg

SEQ ID NO: 5981887 - DNA, 19 bp, Homo sapiens
caccagagcccatgctcaa

SEQ ID NO: 5981888 - DNA, 14 bp, Homo sapiens
caccagagctgcct

SEQ ID NO: 5981889 - DNA, 16 bp, Homo sapiens
caccagagctgcctcc

SEQ ID NO: 5981890 - DNA, 18 bp, Homo sapiens
caccagagctgcctcccc

SEQ ID NO: 5981891 - DNA, 17 bp, Homo sapiens
caccagagcttctctgg

SEQ ID NO: 5981892 - DNA, 20 bp, Homo sapiens
caccagagcttctctgggct

SEQ ID NO: 5981893 - DNA, 13 bp, Homo sapiens
caccagaggccga

SEQ ID NO: 5981894 - DNA, 20 bp, Homo sapiens
caccagaggctgcagaaggc

SEQ ID NO: 5981895 - DNA, 20 bp, Homo sapiens
caccagagtcttaagggtca

SEQ ID NO: 5981896 - DNA, 12 bp, Homo sapiens
caccagagtgaa

SEQ ID NO: 5981897 - DNA, 23 bp, Homo sapiens
caccagagtgaaagggctatggc

SEQ ID NO: 5981898 - DNA, 16 bp, Homo sapiens
caccagatagcagagg

SEQ ID NO: 5981899 - DNA, 14 bp, Homo sapiens
caccagatgagaat

SEQ ID NO: 5981900 - DNA, 13 bp, Homo sapiens
caccagatgctga

SEQ ID NO: 5981901 - DNA, 23 bp, Homo sapiens
caccagatgctgaaaatgtcctt

SEQ ID NO: 5981902 - DNA, 23 bp, Homo sapiens
caccagatgcttttgtgagaaag

SEQ ID NO: 5981903 - DNA, 14 bp, Homo sapiens
caccagcaacatct

SEQ ID NO: 5981904 - DNA, 17 bp, Homo sapiens
caccagcaacatctcga

SEQ ID NO: 5981905 - DNA, 18 bp, Homo sapiens
caccagcaatgccctgcc

SEQ ID NO: 5981906 - DNA, 21 bp, Homo sapiens
caccagcaatgccctgccttg

SEQ ID NO: 5981907 - DNA, 11 bp, Homo sapiens
caccagcacca

SEQ ID NO: 5981908 - DNA, 12 bp, Homo sapiens
caccagcagcac

SEQ ID NO: 5981909 - DNA, 15 bp, Homo sapiens
caccagcagcacaat

SEQ ID NO: 5981910 - DNA, 18 bp, Homo sapiens
caccagcagcacaattct

SEQ ID NO: 5981911 - DNA, 23 bp, Homo sapiens
caccagcagcacaattctgtccc

SEQ ID NO: 5981912 - DNA, 14 bp, Homo sapiens
caccagcagcagaa

SEQ ID NO: 5981913 - DNA, 19 bp, Homo sapiens
caccagcatcacctgcctg

SEQ ID NO: 5981914 - DNA, 20 bp, Homo sapiens
caccagcatcacctgcctgt

SEQ ID NO: 5981915 - DNA, 15 bp, Homo sapiens
caccagcatccacct

SEQ ID NO: 5981916 - DNA, 20 bp, Homo sapiens
caccagcatccaccttggct

SEQ ID NO: 5981917 - DNA, 14 bp, Homo sapiens
caccagcatgtcac

SEQ ID NO: 5981918 - DNA, 15 bp, Homo sapiens
caccagcattccttt

SEQ ID NO: 5981919 - DNA, 18 bp, Homo sapiens
caccagccacagcctccc

SEQ ID NO: 5981920 - DNA, 18 bp, Homo sapiens
caccagccacctcatccc

SEQ ID NO: 5981921 - DNA, 12 bp, Homo sapiens
caccagccagcc

SEQ ID NO: 5981922 - DNA, 15 bp, Homo sapiens
caccagccagccctg

SEQ ID NO: 5981923 - DNA, 14 bp, Homo sapiens
caccagccaggctc

SEQ ID NO: 5981924 - DNA, 18 bp, Homo sapiens
caccagccaggctctgtg

SEQ ID NO: 5981925 - DNA, 14 bp, Homo sapiens
caccagcccagaag

SEQ ID NO: 5981926 - DNA, 10 bp, Homo sapiens
caccagcccc

SEQ ID NO: 5981927 - DNA, 22 bp, Homo sapiens
caccagccccactgccagcagc

SEQ ID NO: 5981928 - DNA, 18 bp, Homo sapiens
caccagccccagtgccca

SEQ ID NO: 5981929 - DNA, 22 bp, Homo sapiens
caccagccccagtgcccacagg

SEQ ID NO: 5981930 - DNA, 19 bp, Homo sapiens
caccagccccggccttgct

SEQ ID NO: 5981931 - DNA, 22 bp, Homo sapiens
caccagcccctccccagactct

SEQ ID NO: 5981932 - DNA, 16 bp, Homo sapiens
caccagcccctgcccc

SEQ ID NO: 5981933 - DNA, 17 bp, Homo sapiens
caccagcccctgcccca

SEQ ID NO: 5981934 - DNA, 18 bp, Homo sapiens
caccagcccgcaactctc

SEQ ID NO: 5981935 - DNA, 22 bp, Homo sapiens
caccagcccgcaactctccagc

SEQ ID NO: 5981936 - DNA, 18 bp, Homo sapiens
caccagcccggcctgctc

SEQ ID NO: 5981937 - DNA, 20 bp, Homo sapiens
caccagccctagctgtccca

SEQ ID NO: 5981938 - DNA, 15 bp, Homo sapiens
caccagccctgagcc

SEQ ID NO: 5981939 - DNA, 23 bp, Homo sapiens
caccagccctgctgcttcctaac

SEQ ID NO: 5981940 - DNA, 14 bp, Homo sapiens
caccagcccttccc

SEQ ID NO: 5981941 - DNA, 15 bp, Homo sapiens
caccagccgccccag

SEQ ID NO: 5981942 - DNA, 13 bp, Homo sapiens
caccagccgctgc

SEQ ID NO: 5981943 - DNA, 18 bp, Homo sapiens
caccagcctagcctggct

SEQ ID NO: 5981944 - DNA, 15 bp, Homo sapiens
caccagcctcagtgc

SEQ ID NO: 5981945 - DNA, 15 bp, Homo sapiens
caccagcctcctggg

SEQ ID NO: 5981946 - DNA, 15 bp, Homo sapiens
caccagcctgctgac

SEQ ID NO: 5981947 - DNA, 22 bp, Homo sapiens
caccagcctgctgacagacact

SEQ ID NO: 5981948 - DNA, 23 bp, Homo sapiens
caccagcctgctgacagacacta

SEQ ID NO: 5981949 - DNA, 15 bp, Homo sapiens
caccagccttgctct

SEQ ID NO: 5981950 - DNA, 18 bp, Homo sapiens
caccagccttgctctctt

SEQ ID NO: 5981951 - DNA, 22 bp, Homo sapiens
caccagcctttctcccaggcca

SEQ ID NO: 5981952 - DNA, 14 bp, Homo sapiens
caccagcgccccca

SEQ ID NO: 5981953 - DNA, 20 bp, Homo sapiens
caccagcgcccccactcctc

SEQ ID NO: 5981954 - DNA, 16 bp, Homo sapiens
caccagcgcccccaga

SEQ ID NO: 5981955 - DNA, 23 bp, Homo sapiens
caccagcggccttgaagaggcag

SEQ ID NO: 5981956 - DNA, 16 bp, Homo sapiens
caccagcgttcccttc

SEQ ID NO: 5981957 - DNA, 22 bp, Homo sapiens
caccagcgttcccttctccccc

SEQ ID NO: 5981958 - DNA, 21 bp, Homo sapiens
caccagcgtttgaggggctgg

SEQ ID NO: 5981959 - DNA, 21 bp, Homo sapiens
caccagctagaaagtggcaga

SEQ ID NO: 5981960 - DNA, 14 bp, Homo sapiens
caccagctatctgt

SEQ ID NO: 5981961 - DNA, 20 bp, Homo sapiens
caccagctccactggcctgc

SEQ ID NO: 5981962 - DNA, 15 bp, Homo sapiens
caccagctctgtggc

SEQ ID NO: 5981963 - DNA, 17 bp, Homo sapiens
caccagctctgtggcct

SEQ ID NO: 5981964 - DNA, 22 bp, Homo sapiens
caccagctctgtggcctgtgtc

SEQ ID NO: 5981965 - DNA, 11 bp, Homo sapiens
caccagctgca

SEQ ID NO: 5981966 - DNA, 12 bp, Homo sapiens
caccagctgcaa

SEQ ID NO: 5981967 - DNA, 14 bp, Homo sapiens
caccagctgcagcc

SEQ ID NO: 5981968 - DNA, 12 bp, Homo sapiens
caccagctgcct

SEQ ID NO: 5981969 - DNA, 16 bp, Homo sapiens
caccagctgcctcttc

SEQ ID NO: 5981970 - DNA, 23 bp, Homo sapiens
caccagctgcctctttgctgctt

SEQ ID NO: 5981971 - DNA, 13 bp, Homo sapiens
caccagctgctct

SEQ ID NO: 5981972 - DNA, 14 bp, Homo sapiens
caccagctgctctg

SEQ ID NO: 5981973 - DNA, 15 bp, Homo sapiens
caccagctgctctgc

SEQ ID NO: 5981974 - DNA, 17 bp, Homo sapiens
caccagctgctctgccc

SEQ ID NO: 5981975 - DNA, 18 bp, Homo sapiens
caccagctgctctgcccc

SEQ ID NO: 5981976 - DNA, 16 bp, Homo sapiens
caccagctgctgtgcc

SEQ ID NO: 5981977 - DNA, 20 bp, Homo sapiens
caccagctgctgtgccccac

SEQ ID NO: 5981978 - DNA, 13 bp, Homo sapiens
caccagctggctc

SEQ ID NO: 5981979 - DNA, 19 bp, Homo sapiens
caccagctggctctgcagc

SEQ ID NO: 5981980 - DNA, 20 bp, Homo sapiens
caccagctggctctgcagca

SEQ ID NO: 5981981 - DNA, 14 bp, Homo sapiens
caccagctgtgtcc

SEQ ID NO: 5981982 - DNA, 20 bp, Homo sapiens
caccagcttcactctctccg

SEQ ID NO: 5981983 - DNA, 17 bp, Homo sapiens
caccagcttctccaggc

SEQ ID NO: 5981984 - DNA, 19 bp, Homo sapiens
caccagcttctccaggctc

SEQ ID NO: 5981985 - DNA, 13 bp, Homo sapiens
caacatccactgt

SEQ ID NO: 5981986 - DNA, 18 bp, Homo sapiens
caacatcctgccagcccc

SEQ ID NO: 5981987 - DNA, 13 bp, Homo sapiens
caacatctagcaa

SEQ ID NO: 5981988 - DNA, 17 bp, Homo sapiens
caacatctccagctgga

SEQ ID NO: 5981989 - DNA, 13 bp, Homo sapiens
caacatctctgaa

SEQ ID NO: 5981990 - DNA, 14 bp, Homo sapiens
caacatctctgaat

SEQ ID NO: 5981991 - DNA, 12 bp, Homo sapiens
caacatctgaga

SEQ ID NO: 5981992 - DNA, 21 bp, Homo sapiens
caacatcttacttgtcctttg

SEQ ID NO: 5981993 - DNA, 18 bp, Homo sapiens
caacatctttctttttaa

SEQ ID NO: 5981994 - DNA, 13 bp, Homo sapiens
caacatcttttct

SEQ ID NO: 5981995 - DNA, 20 bp, Homo sapiens
caacatcttttgataattgt

SEQ ID NO: 5981996 - DNA, 15 bp, Homo sapiens
caacatgaaactgcc

SEQ ID NO: 5981997 - DNA, 17 bp, Homo sapiens
caacatgaaactgccta

SEQ ID NO: 5981998 - DNA, 17 bp, Homo sapiens
caacatgaatttttatg

SEQ ID NO: 5981999 - DNA, 15 bp, Homo sapiens
caacatgaggacaga

SEQ ID NO: 5982000 - DNA, 20 bp, Homo sapiens
caacatgaggacagaaggac

SEQ ID NO: 5982001 - DNA, 19 bp, Homo sapiens
caacatgaggccactggag

SEQ ID NO: 5982002 - DNA, 15 bp, Homo sapiens
caacatgagtcaaga

SEQ ID NO: 5982003 - DNA, 17 bp, Homo sapiens
caacatgatacctggat

SEQ ID NO: 5982004 - DNA, 22 bp, Homo sapiens
caacatgatccccgtctctgcc

SEQ ID NO: 5982005 - DNA, 23 bp, Homo sapiens
caacatgatccccgtctctgccc

SEQ ID NO: 5982006 - DNA, 12 bp, Homo sapiens
caacatgcacat

SEQ ID NO: 5982007 - DNA, 18 bp, Homo sapiens
caacatgcatatgatata

SEQ ID NO: 5982008 - DNA, 20 bp, Homo sapiens
caacatgcatatgatatata

SEQ ID NO: 5982009 - DNA, 13 bp, Homo sapiens
caacatggagaaa

SEQ ID NO: 5982010 - DNA, 22 bp, Homo sapiens
caacatggagaaaccctgtctc

SEQ ID NO: 5982011 - DNA, 23 bp, Homo sapiens
caacatggagaaaccctgtctct

SEQ ID NO: 5982012 - DNA, 17 bp, Homo sapiens
caacatggatgtgttgc

SEQ ID NO: 5982013 - DNA, 15 bp, Homo sapiens
caacatggcaattgc

SEQ ID NO: 5982014 - DNA, 18 bp, Homo sapiens
caacatggcgaaaccccg

SEQ ID NO: 5982015 - DNA, 21 bp, Homo sapiens
caacatggctacttgctttga

SEQ ID NO: 5982016 - DNA, 16 bp, Homo sapiens
caacatggcttctcct

SEQ ID NO: 5982017 - DNA, 22 bp, Homo sapiens
caacatggcttctcctttggca

SEQ ID NO: 5982018 - DNA, 12 bp, Homo sapiens
caacatgggagg

SEQ ID NO: 5982019 - DNA, 14 bp, Homo sapiens
caacatgggaggga

SEQ ID NO: 5982020 - DNA, 12 bp, Homo sapiens
caacatggtcct

SEQ ID NO: 5982021 - DNA, 15 bp, Homo sapiens
caacatggtgtctgg

SEQ ID NO: 5982022 - DNA, 23 bp, Homo sapiens
caacatgtagggcaagaggatga

SEQ ID NO: 5982023 - DNA, 17 bp, Homo sapiens
caacatgtataatattt

SEQ ID NO: 5982024 - DNA, 17 bp, Homo sapiens
caacatgtatctgtcta

SEQ ID NO: 5982025 - DNA, 22 bp, Homo sapiens
caacatgtatctgtctactttc

SEQ ID NO: 5982026 - DNA, 23 bp, Homo sapiens
caacatgtatctgtctactttct

SEQ ID NO: 5982027 - DNA, 15 bp, Homo sapiens
caacatgtatgtgga

SEQ ID NO: 5982028 - DNA, 21 bp, Homo sapiens
caacatgtggctcctcccagc

SEQ ID NO: 5982029 - DNA, 12 bp, Homo sapiens
caacatgtgtga

SEQ ID NO: 5982030 - DNA, 17 bp, Homo sapiens
caacatgttactgacca

SEQ ID NO: 5982031 - DNA, 23 bp, Homo sapiens
caacatgttatttgtaatagatg

SEQ ID NO: 5982032 - DNA, 23 bp, Homo sapiens
caacatgttctaccgtggatttg

SEQ ID NO: 5982033 - DNA, 20 bp, Homo sapiens
caacattaaaacaatattgt

SEQ ID NO: 5982034 - DNA, 21 bp, Homo sapiens
caacattacagggaatgcctg

SEQ ID NO: 5982035 - DNA, 16 bp, Homo sapiens
caacattaggagtaac

SEQ ID NO: 5982036 - DNA, 24 bp, Homo sapiens
caacattatcctgtgtgattacag

SEQ ID NO: 5982037 - DNA, 16 bp, Homo sapiens
caacattatgatctaa

SEQ ID NO: 5982038 - DNA, 23 bp, Homo sapiens
caacattatgatctaataaactt

SEQ ID NO: 5982039 - DNA, 19 bp, Homo sapiens
caacattcaaaagcacaaa

SEQ ID NO: 5982040 - DNA, 16 bp, Homo sapiens
caacattccagggttg

SEQ ID NO: 5982041 - DNA, 21 bp, Homo sapiens
caacattcctttcttgtgccc

SEQ ID NO: 5982042 - DNA, 16 bp, Homo sapiens
caacattgaatatcag

SEQ ID NO: 5982043 - DNA, 15 bp, Homo sapiens
caacattgcctattt

SEQ ID NO: 5982044 - DNA, 10 bp, Homo sapiens
caacattgtg

SEQ ID NO: 5982045 - DNA, 16 bp, Homo sapiens
caacattgtgatgtat

SEQ ID NO: 5982046 - DNA, 18 bp, Homo sapiens
caacattgttcattcttg

SEQ ID NO: 5982047 - DNA, 23 bp, Homo sapiens
caacatttacagtccttcaaaat

SEQ ID NO: 5982048 - DNA, 21 bp, Homo sapiens
caacatttatatattgtctgt

SEQ ID NO: 5982049 - DNA, 23 bp, Homo sapiens
caacatttatgacctaagtcagg

SEQ ID NO: 5982050 - DNA, 17 bp, Homo sapiens
caacatttctcaataat

SEQ ID NO: 5982051 - DNA, 23 bp, Homo sapiens
caacatttctgccaggtttgtta

SEQ ID NO: 5982052 - DNA, 18 bp, Homo sapiens
caacatttctgtatactg

SEQ ID NO: 5982053 - DNA, 22 bp, Homo sapiens
caacatttctgtatactgtaaa

SEQ ID NO: 5982054 - DNA, 23 bp, Homo sapiens
caacatttgtgcagaaatttgaa

SEQ ID NO: 5982055 - DNA, 14 bp, Homo sapiens
caacattttcttga

SEQ ID NO: 5982056 - DNA, 17 bp, Homo sapiens
caacattttcttgaatt

SEQ ID NO: 5982057 - DNA, 19 bp, Homo sapiens
caacattttcttgaatttt

SEQ ID NO: 5982058 - DNA, 20 bp, Homo sapiens
caacattttgagaacaaaga

SEQ ID NO: 5982059 - DNA, 17 bp, Homo sapiens
caacatttttgtacatt

SEQ ID NO: 5982060 - DNA, 18 bp, Homo sapiens
caacatttttgtacatta

SEQ ID NO: 5982061 - DNA, 19 bp, Homo sapiens
caacatttttgtacattat

SEQ ID NO: 5982062 - DNA, 14 bp, Homo sapiens
caaccaaaagggaa

SEQ ID NO: 5982063 - DNA, 19 bp, Homo sapiens
caaccaaaagggaaaaaat

SEQ ID NO: 5982064 - DNA, 21 bp, Homo sapiens
caaccaaaagggaaaaaataa

SEQ ID NO: 5982065 - DNA, 10 bp, Homo sapiens
caaccaaagt

SEQ ID NO: 5982066 - DNA, 18 bp, Homo sapiens
caaccaaagttagttcag

SEQ ID NO: 5982067 - DNA, 16 bp, Homo sapiens
caaccaaccaaccaac

SEQ ID NO: 5982068 - DNA, 14 bp, Homo sapiens
caaccaaccacaaa

SEQ ID NO: 5982069 - DNA, 19 bp, Homo sapiens
caaccaactgccccagggg

SEQ ID NO: 5982070 - DNA, 19 bp, Homo sapiens
caaccaactgtaatgcagg

SEQ ID NO: 5982071 - DNA, 16 bp, Homo sapiens
caaccaactttccccc

SEQ ID NO: 5982072 - DNA, 22 bp, Homo sapiens
caaccaagaatgttatgtgcaa

SEQ ID NO: 5982073 - DNA, 22 bp, Homo sapiens
caaccaagaggatttcttcaaa

SEQ ID NO: 5982074 - DNA, 14 bp, Homo sapiens
caaccaaggaagga

SEQ ID NO: 5982075 - DNA, 20 bp, Homo sapiens
caaccaagtcatgtgcattt

SEQ ID NO: 5982076 - DNA, 11 bp, Homo sapiens
caaccaataaa

SEQ ID NO: 5982077 - DNA, 13 bp, Homo sapiens
caaccaataaaag

SEQ ID NO: 5982078 - DNA, 14 bp, Homo sapiens
caaccaataaaagt

SEQ ID NO: 5982079 - DNA, 22 bp, Homo sapiens
caaccaatgcacacagtagggc

SEQ ID NO: 5982080 - DNA, 20 bp, Homo sapiens
caaccaatttacactgccat

SEQ ID NO: 5982081 - DNA, 13 bp, Homo sapiens
caaccacaaaact

SEQ ID NO: 5982082 - DNA, 17 bp, Homo sapiens
caaccacacacacctgt

SEQ ID NO: 5982083 - DNA, 14 bp, Homo sapiens
caaccacacccaca

SEQ ID NO: 5982084 - DNA, 15 bp, Homo sapiens
caaccacactgcttg

SEQ ID NO: 5982085 - DNA, 16 bp, Homo sapiens
caaccacactgcttgg

SEQ ID NO: 5982086 - DNA, 13 bp, Homo sapiens
caaccacagagaa

SEQ ID NO: 5982087 - DNA, 18 bp, Homo sapiens
caaccacatgtcccagat

SEQ ID NO: 5982088 - DNA, 21 bp, Homo sapiens
caaccaccaccttatacatca

SEQ ID NO: 5982089 - DNA, 14 bp, Homo sapiens
caaccaccatggat

SEQ ID NO: 5982090 - DNA, 20 bp, Homo sapiens
caaccaccgctccccagccc

SEQ ID NO: 5982091 - DNA, 15 bp, Homo sapiens
caaccacctctggcc

SEQ ID NO: 5982092 - DNA, 16 bp, Homo sapiens
caaccacgcaggaagc

SEQ ID NO: 5982093 - DNA, 16 bp, Homo sapiens
caaccacgtggagaaa

SEQ ID NO: 5982094 - DNA, 17 bp, Homo sapiens
caaccactaaagtatag

SEQ ID NO: 5982095 - DNA, 14 bp, Homo sapiens
caaccactctgtgg

SEQ ID NO: 5982096 - DNA, 18 bp, Homo sapiens
caaccactgcgaccacaa

SEQ ID NO: 5982097 - DNA, 22 bp, Homo sapiens
caaccactggtctgtagggatt

SEQ ID NO: 5982098 - DNA, 19 bp, Homo sapiens
caaccactgtaaaatgaaa

SEQ ID NO: 5982099 - DNA, 21 bp, Homo sapiens
caaccactgtaaaatgaaatt

SEQ ID NO: 5982100 - DNA, 14 bp, Homo sapiens
caaccactgtgcca

SEQ ID NO: 5982101 - DNA, 17 bp, Homo sapiens
caaccactgtgccactg

SEQ ID NO: 5982102 - DNA, 14 bp, Homo sapiens
caaccactgtggcg

SEQ ID NO: 5982103 - DNA, 22 bp, Homo sapiens
caaccactgtggcgttctgctg

SEQ ID NO: 5982104 - DNA, 23 bp, Homo sapiens
caaccactttctcaggcttctca

SEQ ID NO: 5982105 - DNA, 21 bp, Homo sapiens
caaccagaaacaatgtgtcta

SEQ ID NO: 5982106 - DNA, 23 bp, Homo sapiens
caaccagaaacacccctctgtct

SEQ ID NO: 5982107 - DNA, 14 bp, Homo sapiens
caaccagaaaggga

SEQ ID NO: 5982108 - DNA, 20 bp, Homo sapiens
caaccagaactttctgtcct

SEQ ID NO: 5982109 - DNA, 12 bp, Homo sapiens
caaccagacaga

SEQ ID NO: 5982110 - DNA, 13 bp, Homo sapiens
caaccagacagag

SEQ ID NO: 5982111 - DNA, 13 bp, Homo sapiens
caaccagacagat

SEQ ID NO: 5982112 - DNA, 14 bp, Homo sapiens
caaccagactttga

SEQ ID NO: 5982113 - DNA, 16 bp, Homo sapiens
caaccagagcactgta

SEQ ID NO: 5982114 - DNA, 20 bp, Homo sapiens
caaccagagcactgtatacc

SEQ ID NO: 5982115 - DNA, 11 bp, Homo sapiens
caaccagagcc

SEQ ID NO: 5982116 - DNA, 21 bp, Homo sapiens
caaccagataaagaactaaat

SEQ ID NO: 5982117 - DNA, 20 bp, Homo sapiens
caaccagataacataccttt

SEQ ID NO: 5982118 - DNA, 20 bp, Homo sapiens
caaccagattgtcagctcct

SEQ ID NO: 5982119 - DNA, 18 bp, Homo sapiens
caaccagatttattttaa

SEQ ID NO: 5982120 - DNA, 18 bp, Homo sapiens
caaccagcattttactac

SEQ ID NO: 5982121 - DNA, 18 bp, Homo sapiens
caaccagccacacagagc

SEQ ID NO: 5982122 - DNA, 12 bp, Homo sapiens
caaccagccagc

SEQ ID NO: 5982123 - DNA, 16 bp, Homo sapiens
caaccagccagcgtcc

SEQ ID NO: 5982124 - DNA, 22 bp, Homo sapiens
caaccagcccgacagtgccatc

SEQ ID NO: 5982125 - DNA, 17 bp, Homo sapiens
caaccagctaagaaaag

SEQ ID NO: 5982126 - DNA, 13 bp, Homo sapiens
caaccaggaagaa

SEQ ID NO: 5982127 - DNA, 14 bp, Homo sapiens
caaccaggacccag

SEQ ID NO: 5982128 - DNA, 15 bp, Homo sapiens
caaccaggacccagg

SEQ ID NO: 5982129 - DNA, 20 bp, Homo sapiens
caaccaggagctgatggcag

SEQ ID NO: 5982130 - DNA, 19 bp, Homo sapiens
caaccaggcacctcttcct

SEQ ID NO: 5982131 - DNA, 13 bp, Homo sapiens
caaccaggcagag

SEQ ID NO: 5982132 - DNA, 14 bp, Homo sapiens
caaccaggcagctg

SEQ ID NO: 5982133 - DNA, 16 bp, Homo sapiens
caaccaggccctgcca

SEQ ID NO: 5982134 - DNA, 18 bp, Homo sapiens
caaccaggccttcatcct

SEQ ID NO: 5982135 - DNA, 22 bp, Homo sapiens
caaccaggccttcatcctcctc

SEQ ID NO: 5982136 - DNA, 19 bp, Homo sapiens
caaccaggctacagttgat

SEQ ID NO: 5982137 - DNA, 22 bp, Homo sapiens
caaccagggattgtttctgttt

SEQ ID NO: 5982138 - DNA, 12 bp, Homo sapiens
caaccagtgcca

SEQ ID NO: 5982139 - DNA, 17 bp, Homo sapiens
caaccagtgccaaggac

SEQ ID NO: 5982140 - DNA, 13 bp, Homo sapiens
caaccatacttta

SEQ ID NO: 5982141 - DNA, 15 bp, Homo sapiens
caaccatactttata

SEQ ID NO: 5982142 - DNA, 14 bp, Homo sapiens
caaccatagaactg

SEQ ID NO: 5982143 - DNA, 15 bp, Homo sapiens
caaccatcaatggaa

SEQ ID NO: 5982144 - DNA, 19 bp, Homo sapiens
caaccatcaatggaaacag

SEQ ID NO: 5982145 - DNA, 23 bp, Homo sapiens
caaccatcagaccaccagcaaat

SEQ ID NO: 5982146 - DNA, 14 bp, Homo sapiens
caaccatcatgtgt

SEQ ID NO: 5982147 - DNA, 17 bp, Homo sapiens
caaccatcatgtgtaga

SEQ ID NO: 5982148 - DNA, 14 bp, Homo sapiens
caaccatccaatta

SEQ ID NO: 5982149 - DNA, 14 bp, Homo sapiens
caaccatccctgcc

SEQ ID NO: 5982150 - DNA, 13 bp, Homo sapiens
caaccatcgcttt

SEQ ID NO: 5982151 - DNA, 14 bp, Homo sapiens
caaccatgacctca

SEQ ID NO: 5982152 - DNA, 19 bp, Homo sapiens
caaccatgcaaattgtgaa

SEQ ID NO: 5982153 - DNA, 14 bp, Homo sapiens
caaccatgtcattt

SEQ ID NO: 5982154 - DNA, 19 bp, Homo sapiens
caaccattcatctttcctt

SEQ ID NO: 5982155 - DNA, 22 bp, Homo sapiens
caaccattcatctttcctttgc

SEQ ID NO: 5982156 - DNA, 14 bp, Homo sapiens
caaccattccagac

SEQ ID NO: 5982157 - DNA, 16 bp, Homo sapiens
caaccattccagactg

SEQ ID NO: 5982158 - DNA, 21 bp, Homo sapiens
caaccatttttagaaggaaaa

SEQ ID NO: 5982159 - DNA, 20 bp, Homo sapiens
caaccattttttgttctgtg

SEQ ID NO: 5982160 - DNA, 16 bp, Homo sapiens
caacccaaacctggag

SEQ ID NO: 5982161 - DNA, 12 bp, Homo sapiens
caacccaaagta

SEQ ID NO: 5982162 - DNA, 15 bp, Homo sapiens
caacccaaggactga

SEQ ID NO: 5982163 - DNA, 15 bp, Homo sapiens
caacccaatccctct

SEQ ID NO: 5982164 - DNA, 17 bp, Homo sapiens
caccagcttctttctcg

SEQ ID NO: 5982165 - DNA, 22 bp, Homo sapiens
caccagcttctttctcggtggc

SEQ ID NO: 5982166 - DNA, 15 bp, Homo sapiens
caccagcttgcttct

SEQ ID NO: 5982167 - DNA, 17 bp, Homo sapiens
caccaggaacctcttca

SEQ ID NO: 5982168 - DNA, 16 bp, Homo sapiens
caccaggaagaaggcc

SEQ ID NO: 5982169 - DNA, 19 bp, Homo sapiens
caccaggaagaaggcccgg

SEQ ID NO: 5982170 - DNA, 19 bp, Homo sapiens
caccaggaagcacaggtcc

SEQ ID NO: 5982171 - DNA, 17 bp, Homo sapiens
caccaggaatgttaaag

SEQ ID NO: 5982172 - DNA, 17 bp, Homo sapiens
caccaggactttaatct

SEQ ID NO: 5982173 - DNA, 19 bp, Homo sapiens
caccaggagaaccactaca

SEQ ID NO: 5982174 - DNA, 17 bp, Homo sapiens
caccaggagcacctgga

SEQ ID NO: 5982175 - DNA, 20 bp, Homo sapiens
caccaggagcacctggaccc

SEQ ID NO: 5982176 - DNA, 14 bp, Homo sapiens
caccaggagcagca

SEQ ID NO: 5982177 - DNA, 20 bp, Homo sapiens
caccaggagcagcagccagc

SEQ ID NO: 5982178 - DNA, 17 bp, Homo sapiens
caccaggcaaccaggaa

SEQ ID NO: 5982179 - DNA, 16 bp, Homo sapiens
caccaggcaagaaaag

SEQ ID NO: 5982180 - DNA, 23 bp, Homo sapiens
caccaggcacctcacagaaatga

SEQ ID NO: 5982181 - DNA, 19 bp, Homo sapiens
caccaggcacgaacccacc

SEQ ID NO: 5982182 - DNA, 21 bp, Homo sapiens
caccaggcacgaacccacctg

SEQ ID NO: 5982183 - DNA, 23 bp, Homo sapiens
caccaggcacgaacccacctgct

SEQ ID NO: 5982184 - DNA, 15 bp, Homo sapiens
caccaggcagcctct

SEQ ID NO: 5982185 - DNA, 19 bp, Homo sapiens
caccaggcagctccagctg

SEQ ID NO: 5982186 - DNA, 15 bp, Homo sapiens
caccaggccacctcc

SEQ ID NO: 5982187 - DNA, 16 bp, Homo sapiens
caccaggccagctcag

SEQ ID NO: 5982188 - DNA, 18 bp, Homo sapiens
caccaggccagctcagga

SEQ ID NO: 5982189 - DNA, 15 bp, Homo sapiens
caccaggccatcagc

SEQ ID NO: 5982190 - DNA, 13 bp, Homo sapiens
caccaggcccacg

SEQ ID NO: 5982191 - DNA, 14 bp, Homo sapiens
caccaggcccacga

SEQ ID NO: 5982192 - DNA, 23 bp, Homo sapiens
caccaggcccacgaggagcagca

SEQ ID NO: 5982193 - DNA, 23 bp, Homo sapiens
caccaggccgggcttgggccctg

SEQ ID NO: 5982194 - DNA, 14 bp, Homo sapiens
caccaggcctggcc

SEQ ID NO: 5982195 - DNA, 19 bp, Homo sapiens
caccaggcctggcctctgg

SEQ ID NO: 5982196 - DNA, 24 bp, Homo sapiens
caccaggcctggcctctgggcagt

SEQ ID NO: 5982197 - DNA, 21 bp, Homo sapiens
caccaggctgctcagggctgg

SEQ ID NO: 5982198 - DNA, 15 bp, Homo sapiens
caccaggctggcgca

SEQ ID NO: 5982199 - DNA, 17 bp, Homo sapiens
caccaggctggcgcagc

SEQ ID NO: 5982200 - DNA, 20 bp, Homo sapiens
caccaggctggcgcagccaa

SEQ ID NO: 5982201 - DNA, 16 bp, Homo sapiens
caccaggctgtgggcc

SEQ ID NO: 5982202 - DNA, 20 bp, Homo sapiens
caccaggcttgcctgcaggc

SEQ ID NO: 5982203 - DNA, 13 bp, Homo sapiens
caccagggaaggg

SEQ ID NO: 5982204 - DNA, 18 bp, Homo sapiens
caccagggaaggggacaa

SEQ ID NO: 5982205 - DNA, 21 bp, Homo sapiens
caccagggaaggggacaagga

SEQ ID NO: 5982206 - DNA, 19 bp, Homo sapiens
caccagggaccagcccagc

SEQ ID NO: 5982207 - DNA, 16 bp, Homo sapiens
caccagggactgcagc

SEQ ID NO: 5982208 - DNA, 15 bp, Homo sapiens
caccagggagaggcc

SEQ ID NO: 5982209 - DNA, 23 bp, Homo sapiens
caccagggagaggcctcggctgt

SEQ ID NO: 5982210 - DNA, 19 bp, Homo sapiens
caccagggagatgtctaga

SEQ ID NO: 5982211 - DNA, 23 bp, Homo sapiens
caccagggagcttcctggctctg

SEQ ID NO: 5982212 - DNA, 22 bp, Homo sapiens
caccagggatcacagaccacag

SEQ ID NO: 5982213 - DNA, 23 bp, Homo sapiens
caccagggatcacagaccacagg

SEQ ID NO: 5982214 - DNA, 23 bp, Homo sapiens
caccagggcaactcttggaagaa

SEQ ID NO: 5982215 - DNA, 16 bp, Homo sapiens
caccagggcatctctg

SEQ ID NO: 5982216 - DNA, 20 bp, Homo sapiens
caccagggcatctctgggct

SEQ ID NO: 5982217 - DNA, 16 bp, Homo sapiens
caccagggccagagca

SEQ ID NO: 5982218 - DNA, 18 bp, Homo sapiens
caccagggcctggctggg

SEQ ID NO: 5982219 - DNA, 18 bp, Homo sapiens
caccagggcgctgggaag

SEQ ID NO: 5982220 - DNA, 19 bp, Homo sapiens
caccagggcgctgggaagg

SEQ ID NO: 5982221 - DNA, 15 bp, Homo sapiens
caccagggctcagct

SEQ ID NO: 5982222 - DNA, 16 bp, Homo sapiens
caccagggctcagctc

SEQ ID NO: 5982223 - DNA, 17 bp, Homo sapiens
caccagggctcagctcc

SEQ ID NO: 5982224 - DNA, 19 bp, Homo sapiens
caccagggctccaggagcc

SEQ ID NO: 5982225 - DNA, 17 bp, Homo sapiens
caccaggggaggagcct

SEQ ID NO: 5982226 - DNA, 12 bp, Homo sapiens
caccaggggcag

SEQ ID NO: 5982227 - DNA, 20 bp, Homo sapiens
caccaggggcaggcacagca

SEQ ID NO: 5982228 - DNA, 21 bp, Homo sapiens
caccaggggcaggcacagcac

SEQ ID NO: 5982229 - DNA, 16 bp, Homo sapiens
caccagggtcccagga

SEQ ID NO: 5982230 - DNA, 21 bp, Homo sapiens
caccagggtccgcaccagctg

SEQ ID NO: 5982231 - DNA, 15 bp, Homo sapiens
caccagggtggacca

SEQ ID NO: 5982232 - DNA, 23 bp, Homo sapiens
caccagggtttagtttgcattta

SEQ ID NO: 5982233 - DNA, 16 bp, Homo sapiens
caccaggtagaacaca

SEQ ID NO: 5982234 - DNA, 18 bp, Homo sapiens
caccaggtcctgtgagca

SEQ ID NO: 5982235 - DNA, 18 bp, Homo sapiens
caccaggtctcaaggttc

SEQ ID NO: 5982236 - DNA, 22 bp, Homo sapiens
caccaggtctcccgggaagcca

SEQ ID NO: 5982237 - DNA, 14 bp, Homo sapiens
caccaggtgcatct

SEQ ID NO: 5982238 - DNA, 21 bp, Homo sapiens
caccaggtgttaaaaaccatt

SEQ ID NO: 5982239 - DNA, 15 bp, Homo sapiens
caccaggttaaaatt

SEQ ID NO: 5982240 - DNA, 17 bp, Homo sapiens
caccaggttgggaacat

SEQ ID NO: 5982241 - DNA, 21 bp, Homo sapiens
caccagtcacctcgtctccct

SEQ ID NO: 5982242 - DNA, 15 bp, Homo sapiens
caccagtcactgtcc

SEQ ID NO: 5982243 - DNA, 21 bp, Homo sapiens
caccagtcagggacagcagcc

SEQ ID NO: 5982244 - DNA, 16 bp, Homo sapiens
caccagtctcacccac

SEQ ID NO: 5982245 - DNA, 17 bp, Homo sapiens
caccagtctcacccact

SEQ ID NO: 5982246 - DNA, 23 bp, Homo sapiens
caccagtctgtaaaatacatgta
